United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 80

SEQ ID NO: 2884807 - RNA, 14 nt, Mycobacterium avium subsp. paratuberculosis
ggcgccgcggucgc

SEQ ID NO: 2884808 - RNA, 19 nt, Mycobacterium avium subsp. paratuberculosis
ggcgccgcguaccagcgcc

SEQ ID NO: 2884809 - RNA, 20 nt, Mycobacterium avium subsp. paratuberculosis
ggcgccgcucgaccccucgg

SEQ ID NO: 2884810 - RNA, 23 nt, Mycobacterium avium subsp. paratuberculosis
ggcgccgcucgaccccucggcau

SEQ ID NO: 2884811 - RNA, 16 nt, Mycobacterium avium subsp. paratuberculosis
ggcgccgcugcgggcc

SEQ ID NO: 2884812 - RNA, 23 nt, Mycobacterium avium subsp. paratuberculosis
ggcgccgcugcgggccaucgacu

SEQ ID NO: 2884813 - RNA, 16 nt, Mycobacterium avium subsp. paratuberculosis
ggcgccggaggccagc

SEQ ID NO: 2884814 - RNA, 17 nt, Mycobacterium avium subsp. paratuberculosis
ggcgccggaggccagcu

SEQ ID NO: 2884815 - RNA, 18 nt, Mycobacterium avium subsp. paratuberculosis
ggcgccggaggccagcuc

SEQ ID NO: 2884816 - RNA, 19 nt, Mycobacterium avium subsp. paratuberculosis
ggcgccggaggccagcucg

SEQ ID NO: 2884817 - RNA, 23 nt, Mycobacterium avium subsp. paratuberculosis
ggcgccggaggccagcucgaccg

SEQ ID NO: 2884818 - RNA, 14 nt, Mycobacterium avium subsp. paratuberculosis
ggcgccggaucaug

SEQ ID NO: 2884819 - RNA, 17 nt, Mycobacterium avium subsp. paratuberculosis
ggcgccggaucaugucg

SEQ ID NO: 2884820 - RNA, 17 nt, Mycobacterium avium subsp. paratuberculosis
ggcgccggaucggcccc

SEQ ID NO: 2884821 - RNA, 20 nt, Mycobacterium avium subsp. paratuberculosis
ggcgccggaucggcccccgg

SEQ ID NO: 2884822 - RNA, 23 nt, Mycobacterium avium subsp. paratuberculosis
ggcgccggaucggcccccgggcc

SEQ ID NO: 2884823 - RNA, 20 nt, Mycobacterium avium subsp. paratuberculosis
ggcgccggaugggcgcacga

SEQ ID NO: 2884824 - RNA, 23 nt, Mycobacterium avium subsp. paratuberculosis
ggcgccggcacugcugcccgcga

SEQ ID NO: 2884825 - RNA, 16 nt, Mycobacterium avium subsp. paratuberculosis
ggcgccggcauccagc

SEQ ID NO: 2884826 - RNA, 17 nt, Mycobacterium avium subsp. paratuberculosis
ggcgccggcauccagca

SEQ ID NO: 2884827 - RNA, 14 nt, Mycobacterium avium subsp. paratuberculosis
ggcgccggcaucga

SEQ ID NO: 2884828 - RNA, 12 nt, Mycobacterium avium subsp. paratuberculosis
ggcgccggccag

SEQ ID NO: 2884829 - RNA, 14 nt, Mycobacterium avium subsp. paratuberculosis
ggcgccggccagca

SEQ ID NO: 2884830 - RNA, 15 nt, Mycobacterium avium subsp. paratuberculosis
ggcgccggccagcac

SEQ ID NO: 2884831 - RNA, 18 nt, Mycobacterium avium subsp. paratuberculosis
ggcgccggccagcaccac

SEQ ID NO: 2884832 - RNA, 19 nt, Mycobacterium avium subsp. paratuberculosis
ggcgccggccagcaccacg

SEQ ID NO: 2884833 - RNA, 16 nt, Mycobacterium avium subsp. paratuberculosis
ggcgccggccagcacg

SEQ ID NO: 2884834 - RNA, 20 nt, Mycobacterium avium subsp. paratuberculosis
ggcgccggccagcacggcca

SEQ ID NO: 2884835 - RNA, 23 nt, Mycobacterium avium subsp. paratuberculosis
ggcgccggccagcacggccagcc

SEQ ID NO: 2884836 - RNA, 17 nt, Mycobacterium avium subsp. paratuberculosis
ggcgccggccagcggcu

SEQ ID NO: 2884837 - RNA, 18 nt, Mycobacterium avium subsp. paratuberculosis
ggcgccggccagcggcuu

SEQ ID NO: 2884838 - RNA, 15 nt, Mycobacterium avium subsp. paratuberculosis
ggcgccggcccgcgg

SEQ ID NO: 2884839 - RNA, 20 nt, Mycobacterium avium subsp. paratuberculosis
ggcgccggcccgcggcggau

SEQ ID NO: 2884840 - RNA, 14 nt, Mycobacterium avium subsp. paratuberculosis
ggcgccggccgaca

SEQ ID NO: 2884841 - RNA, 22 nt, Mycobacterium avium subsp. paratuberculosis
ggcgccggccgacauggacgcg

SEQ ID NO: 2884842 - RNA, 12 nt, Mycobacterium avium subsp. paratuberculosis
ggcgccggccgc

SEQ ID NO: 2884843 - RNA, 16 nt, Mycobacterium avium subsp. paratuberculosis
ggcgccggccgccgga

SEQ ID NO: 2884844 - RNA, 14 nt, Mycobacterium avium subsp. paratuberculosis
ggcgccggccggcg

SEQ ID NO: 2884845 - RNA, 16 nt, Mycobacterium avium subsp. paratuberculosis
ggcgccggccggcgcg

SEQ ID NO: 2884846 - RNA, 17 nt, Mycobacterium avium subsp. paratuberculosis
ggcgccggccggcgcgu

SEQ ID NO: 2884847 - RNA, 20 nt, Mycobacterium avium subsp. paratuberculosis
ggcgccggccggcgcgugcg

SEQ ID NO: 2884848 - RNA, 12 nt, Mycobacterium avium subsp. paratuberculosis
ggcgccggccgu

SEQ ID NO: 2884849 - RNA, 14 nt, Mycobacterium avium subsp. paratuberculosis
ggcgccggccguca

SEQ ID NO: 2884850 - RNA, 18 nt, Mycobacterium avium subsp. paratuberculosis
ggcgccggccgucacgcu

SEQ ID NO: 2884851 - RNA, 19 nt, Mycobacterium avium subsp. paratuberculosis
ggcgccggccgucacgcug

SEQ ID NO: 2884852 - RNA, 13 nt, Mycobacterium avium subsp. paratuberculosis
ggcgccggcgcgg

SEQ ID NO: 2884853 - RNA, 14 nt, Mycobacterium avium subsp. paratuberculosis
ggcgccggcgcggg

SEQ ID NO: 2884854 - RNA, 18 nt, Mycobacterium avium subsp. paratuberculosis
ggcgccggcgcgggggcg

SEQ ID NO: 2884855 - RNA, 14 nt, Mycobacterium avium subsp. paratuberculosis
ggcgccggcggcca

SEQ ID NO: 2884856 - RNA, 16 nt, Mycobacterium avium subsp. paratuberculosis
ggcgccggcggccacg

SEQ ID NO: 2884857 - RNA, 20 nt, Mycobacterium avium subsp. paratuberculosis
ggcgccggcgggugagccgg

SEQ ID NO: 2884858 - RNA, 20 nt, Mycobacterium avium subsp. paratuberculosis
ggcgccggcggucagcucag

SEQ ID NO: 2884859 - RNA, 21 nt, Mycobacterium avium subsp. paratuberculosis
ggcgccggcguccagcgccgc

SEQ ID NO: 2884860 - RNA, 24 nt, Mycobacterium avium subsp. paratuberculosis
ggcgccggcugcccgcgacugucg

SEQ ID NO: 2884861 - RNA, 17 nt, Mycobacterium avium subsp. paratuberculosis
ggcgccgggcagcccgg

SEQ ID NO: 2884862 - RNA, 18 nt, Mycobacterium avium subsp. paratuberculosis
ggcgccgggcagcccggg

SEQ ID NO: 2884863 - RNA, 16 nt, Mycobacterium avium subsp. paratuberculosis
ggcgccgggcgggcgc

SEQ ID NO: 2884864 - RNA, 14 nt, Mycobacterium avium subsp. paratuberculosis
ggcgccggggcggg

SEQ ID NO: 2884865 - RNA, 22 nt, Mycobacterium avium subsp. paratuberculosis
ggcgccgggucauccccgugcg

SEQ ID NO: 2884866 - RNA, 23 nt, Mycobacterium avium subsp. paratuberculosis
ggcgccgggucauccccgugcgg

SEQ ID NO: 2884867 - RNA, 21 nt, Mycobacterium avium subsp. paratuberculosis
ggcgccgguaggcgcggguga

SEQ ID NO: 2884868 - RNA, 22 nt, Mycobacterium avium subsp. paratuberculosis
ggcgccgguauauucgcgaugg

SEQ ID NO: 2884869 - RNA, 14 nt, Mycobacterium avium subsp. paratuberculosis
ggcgccgguaucga

SEQ ID NO: 2884870 - RNA, 19 nt, Mycobacterium avium subsp. paratuberculosis
ggcgccgguaucgagcacc

SEQ ID NO: 2884871 - RNA, 13 nt, Mycobacterium avium subsp. paratuberculosis
ggcgccggucagc

SEQ ID NO: 2884872 - RNA, 14 nt, Mycobacterium avium subsp. paratuberculosis
ggcgccggucagcg

SEQ ID NO: 2884873 - RNA, 15 nt, Mycobacterium avium subsp. paratuberculosis
ggcgccggucagcgg

SEQ ID NO: 2884874 - RNA, 13 nt, Mycobacterium avium subsp. paratuberculosis
ggcgccggucgac

SEQ ID NO: 2884875 - RNA, 16 nt, Mycobacterium avium subsp. paratuberculosis
ggcgccggucgacgcg

SEQ ID NO: 2884876 - RNA, 16 nt, Mycobacterium avium subsp. paratuberculosis
ggcgccggucggcgga

SEQ ID NO: 2884877 - RNA, 16 nt, Mycobacterium avium subsp. paratuberculosis
ggcgccggucguagcg

SEQ ID NO: 2884878 - RNA, 19 nt, Mycobacterium avium subsp. paratuberculosis
ggcgccggugaagaucgcc

SEQ ID NO: 2884879 - RNA, 22 nt, Mycobacterium avium subsp. paratuberculosis
ggcgccggugaagaucgcccgc

SEQ ID NO: 2884880 - RNA, 20 nt, Mycobacterium avium subsp. paratuberculosis
ggcgccggugaagcgggaca

SEQ ID NO: 2884881 - RNA, 18 nt, Mycobacterium avium subsp. paratuberculosis
ggcgccggugccgcagcc

SEQ ID NO: 2884882 - RNA, 19 nt, Mycobacterium avium subsp. paratuberculosis
ggcgccguaggccgcgcug

SEQ ID NO: 2884883 - RNA, 15 nt, Mycobacterium avium subsp. paratuberculosis
ggcgccguagguggc

SEQ ID NO: 2884884 - RNA, 16 nt, Mycobacterium avium subsp. paratuberculosis
ggcgccguagguggcc

SEQ ID NO: 2884885 - RNA, 20 nt, Mycobacterium avium subsp. paratuberculosis
ggcgccguauuggcaggcga

SEQ ID NO: 2884886 - RNA, 16 nt, Mycobacterium avium subsp. paratuberculosis
ggcgccguccagcucg

SEQ ID NO: 2884887 - RNA, 18 nt, Mycobacterium avium subsp. paratuberculosis
ggcgccguccagcucgcg

SEQ ID NO: 2884888 - RNA, 19 nt, Mycobacterium avium subsp. paratuberculosis
ggcgccguccagcucgcgu

SEQ ID NO: 2884889 - RNA, 16 nt, Mycobacterium avium subsp. paratuberculosis
ggcgccguccgcggcg

SEQ ID NO: 2884890 - RNA, 18 nt, Mycobacterium avium subsp. paratuberculosis
ggcgccguccgcggcggc

SEQ ID NO: 2884891 - RNA, 14 nt, Mycobacterium avium subsp. paratuberculosis
ggcgccgucgacca

SEQ ID NO: 2884892 - RNA, 16 nt, Mycobacterium avium subsp. paratuberculosis
ggcgccgucgaccagc

SEQ ID NO: 2884893 - RNA, 18 nt, Mycobacterium avium subsp. paratuberculosis
ggcgccgucgaccagcuu

SEQ ID NO: 2884894 - RNA, 13 nt, Mycobacterium avium subsp. paratuberculosis
ggcgccgucgagg

SEQ ID NO: 2884895 - RNA, 22 nt, Mycobacterium avium subsp. paratuberculosis
ggcgccgucgaggaauccgguc

SEQ ID NO: 2884896 - RNA, 13 nt, Mycobacterium avium subsp. paratuberculosis
ggcgccgucgaug

SEQ ID NO: 2884897 - RNA, 16 nt, Mycobacterium avium subsp. paratuberculosis
ggcgccgucgauggcg

SEQ ID NO: 2884898 - RNA, 19 nt, Mycobacterium avium subsp. paratuberculosis
ggcgccgucgccgacguug

SEQ ID NO: 2884899 - RNA, 15 nt, Mycobacterium avium subsp. paratuberculosis
ggcgccgucgccgcc

SEQ ID NO: 2884900 - RNA, 14 nt, Mycobacterium avium subsp. paratuberculosis
ggcgccgucgccgg

SEQ ID NO: 2884901 - RNA, 11 nt, Mycobacterium avium subsp. paratuberculosis
ggcgccgucgg

SEQ ID NO: 2884902 - RNA, 14 nt, Mycobacterium avium subsp. paratuberculosis
ggcgccgucggugg

SEQ ID NO: 2884903 - RNA, 19 nt, Mycobacterium avium subsp. paratuberculosis
ggcgccgucggugggggcc

SEQ ID NO: 2884904 - RNA, 17 nt, Mycobacterium avium subsp. paratuberculosis
ggcgccgugcaggauga

SEQ ID NO: 2884905 - RNA, 22 nt, Mycobacterium avium subsp. paratuberculosis
ggcgccgugcaggaugaccgcg

SEQ ID NO: 2884906 - RNA, 14 nt, Mycobacterium avium subsp. paratuberculosis
ggcgccgugccgcg

SEQ ID NO: 2884907 - RNA, 16 nt, Mycobacterium avium subsp. paratuberculosis
ggcgccgugccgcgcg

SEQ ID NO: 2884908 - RNA, 21 nt, Mycobacterium avium subsp. paratuberculosis
ggcgccgugccgcgcggcgau

SEQ ID NO: 2884909 - RNA, 18 nt, Mycobacterium avium subsp. paratuberculosis
ggcgccguugaccggccg

SEQ ID NO: 2884910 - RNA, 18 nt, Mycobacterium avium subsp. paratuberculosis
ggcgccguuguaggccgc

SEQ ID NO: 2884911 - RNA, 19 nt, Mycobacterium avium subsp. paratuberculosis
ggcgccguuguaggccgcg

SEQ ID NO: 2884912 - RNA, 21 nt, Mycobacterium avium subsp. paratuberculosis
ggcgccuaccggguggccagc

SEQ ID NO: 2884913 - RNA, 22 nt, Mycobacterium avium subsp. paratuberculosis
ggcgccuaccggguggccagca

SEQ ID NO: 2884914 - RNA, 23 nt, Mycobacterium avium subsp. paratuberculosis
ggcgccuaccggguggccagcac

SEQ ID NO: 2884915 - RNA, 20 nt, Mycobacterium avium subsp. paratuberculosis
ggcgccucgaugcggguguu

SEQ ID NO: 2884916 - RNA, 13 nt, Mycobacterium avium subsp. paratuberculosis
ggcgccucgccga

SEQ ID NO: 2884917 - RNA, 14 nt, Mycobacterium avium subsp. paratuberculosis
ggcgccucgccgac

SEQ ID NO: 2884918 - RNA, 16 nt, Mycobacterium avium subsp. paratuberculosis
ggcgccucgccgaccu

SEQ ID NO: 2884919 - RNA, 12 nt, Mycobacterium avium subsp. paratuberculosis
ggcgccucggcg

SEQ ID NO: 2884920 - RNA, 20 nt, Mycobacterium avium subsp. paratuberculosis
ggcgccucggcgccucggcg

SEQ ID NO: 2884921 - RNA, 22 nt, Mycobacterium avium subsp. paratuberculosis
ggcgccugcacgcaggccucua

SEQ ID NO: 2884922 - RNA, 24 nt, Mycobacterium avium subsp. paratuberculosis
ggcgccugcgagcacacccucacc

SEQ ID NO: 2884923 - RNA, 21 nt, Mycobacterium avium subsp. paratuberculosis
ggcgccugguagggguccucc

SEQ ID NO: 2884924 - RNA, 22 nt, Mycobacterium avium subsp. paratuberculosis
ggcgccugguagggguccucca

SEQ ID NO: 2884925 - RNA, 13 nt, Mycobacterium avium subsp. paratuberculosis
ggcgccuggucaa

SEQ ID NO: 2884926 - RNA, 18 nt, Mycobacterium avium subsp. paratuberculosis
ggcgccuucuuggcggcg

SEQ ID NO: 2884927 - RNA, 13 nt, Mycobacterium avium subsp. paratuberculosis
ggcgcgaaagcgc

SEQ ID NO: 2884928 - RNA, 13 nt, Mycobacterium avium subsp. paratuberculosis
ggcgcgaacagcg

SEQ ID NO: 2884929 - RNA, 16 nt, Mycobacterium avium subsp. paratuberculosis
ggcgcgaacagcgccg

SEQ ID NO: 2884930 - RNA, 19 nt, Mycobacterium avium subsp. paratuberculosis
ggcgcgaacagcgccgacu

SEQ ID NO: 2884931 - RNA, 18 nt, Mycobacterium avium subsp. paratuberculosis
ggcgcgaaccgggccagg

SEQ ID NO: 2884932 - RNA, 19 nt, Mycobacterium avium subsp. paratuberculosis
ggcgcgaaccgggccagga

SEQ ID NO: 2884933 - RNA, 14 nt, Mycobacterium avium subsp. paratuberculosis
ggcgcgaacgcagu

SEQ ID NO: 2884934 - RNA, 16 nt, Mycobacterium avium subsp. paratuberculosis
ggcgcgaagguggcgc

SEQ ID NO: 2884935 - RNA, 20 nt, Mycobacterium avium subsp. paratuberculosis
ggcgcgaagguggcgccggu

SEQ ID NO: 2884936 - RNA, 16 nt, Mycobacterium avium subsp. paratuberculosis
ggcgcgaaucccggcc

SEQ ID NO: 2884937 - RNA, 16 nt, Mycobacterium avium subsp. paratuberculosis
ggcgcgaaucgcuucc

SEQ ID NO: 2884938 - RNA, 18 nt, Mycobacterium avium subsp. paratuberculosis
ggcgcgacaccgcggcga

SEQ ID NO: 2884939 - RNA, 21 nt, Mycobacterium avium subsp. paratuberculosis
ggcgcgaccacauaccgggac

SEQ ID NO: 2884940 - RNA, 16 nt, Mycobacterium avium subsp. paratuberculosis
ggcgcgaccagcggca

SEQ ID NO: 2884941 - RNA, 17 nt, Mycobacterium avium subsp. paratuberculosis
ggcgcgaccagcggcag

SEQ ID NO: 2884942 - RNA, 13 nt, Mycobacterium avium subsp. paratuberculosis
ggcgcgaccaggu

SEQ ID NO: 2884943 - RNA, 22 nt, Mycobacterium avium subsp. paratuberculosis
ggcgcgaccagguucucggugg

SEQ ID NO: 2884944 - RNA, 23 nt, Mycobacterium avium subsp. paratuberculosis
ggcgcgacgcgggauugccgagc

SEQ ID NO: 2884945 - RNA, 12 nt, Mycobacterium avium subsp. paratuberculosis
ggcgcgacggcg

SEQ ID NO: 2884946 - RNA, 13 nt, Mycobacterium avium subsp. paratuberculosis
ggcgcgaggcgcg

SEQ ID NO: 2884947 - RNA, 15 nt, Mycobacterium avium subsp. paratuberculosis
ggcgcgaggcgcggg

SEQ ID NO: 2884948 - RNA, 18 nt, Mycobacterium avium subsp. paratuberculosis
ggcgcgaggcgcggggcg

SEQ ID NO: 2884949 - RNA, 17 nt, Mycobacterium avium subsp. paratuberculosis
ggcgcgauagccgguga

SEQ ID NO: 2884950 - RNA, 21 nt, Mycobacterium avium subsp. paratuberculosis
ggcgcgauagccggugaucgc

SEQ ID NO: 2884951 - RNA, 15 nt, Mycobacterium avium subsp. paratuberculosis
ggcgcgaucaggcug

SEQ ID NO: 2884952 - RNA, 18 nt, Mycobacterium avium subsp. paratuberculosis
ggcgcgaucaggcugccg

SEQ ID NO: 2884953 - RNA, 13 nt, Mycobacterium avium subsp. paratuberculosis
ggcgcgaucggca

SEQ ID NO: 2884954 - RNA, 23 nt, Mycobacterium avium subsp. paratuberculosis
ggcgcgaucggcaggucgucgac

SEQ ID NO: 2884955 - RNA, 13 nt, Mycobacterium avium subsp. paratuberculosis
ggcgcgaucggcc

SEQ ID NO: 2884956 - RNA, 15 nt, Mycobacterium avium subsp. paratuberculosis
ggcgcgaucgucgac

SEQ ID NO: 2884957 - RNA, 17 nt, Mycobacterium avium subsp. paratuberculosis
ggcgcgaucgucgacca

SEQ ID NO: 2884958 - RNA, 19 nt, Mycobacterium avium subsp. paratuberculosis
ggcgcgaucgucgaccacc

SEQ ID NO: 2884959 - RNA, 14 nt, Mycobacterium avium subsp. paratuberculosis
ggcgcgaugaucgc

SEQ ID NO: 2884960 - RNA, 22 nt, Mycobacterium avium subsp. paratuberculosis
ggcgcgcaacgauucacccagc

SEQ ID NO: 2884961 - RNA, 23 nt, Mycobacterium avium subsp. paratuberculosis
ggcgcgcaacucguccaccagcu

SEQ ID NO: 2884962 - RNA, 12 nt, Mycobacterium avium subsp. paratuberculosis
ggcgcgcaccag

SEQ ID NO: 2884963 - RNA, 19 nt, Mycobacterium avium subsp. paratuberculosis
ggcgcgcaccagcucggcg

SEQ ID NO: 2884964 - RNA, 21 nt, Mycobacterium avium subsp. paratuberculosis
ggcgcgcaccagcucggcgcu

SEQ ID NO: 2884965 - RNA, 14 nt, Mycobacterium avium subsp. paratuberculosis
ggcgcgcaccaucg

SEQ ID NO: 2884966 - RNA, 17 nt, Mycobacterium avium subsp. paratuberculosis
ggcgcgcaccaucgcga

SEQ ID NO: 2884967 - RNA, 13 nt, Mycobacterium avium subsp. paratuberculosis
ggcgcgcaccgcg

SEQ ID NO: 2884968 - RNA, 14 nt, Mycobacterium avium subsp. paratuberculosis
ggcgcgcaccgcga

SEQ ID NO: 2884969 - RNA, 13 nt, Mycobacterium avium subsp. paratuberculosis
ggcgcgcacggca

SEQ ID NO: 2884970 - RNA, 14 nt, Mycobacterium avium subsp. paratuberculosis
ggcgcgcacggcag

SEQ ID NO: 2884971 - RNA, 12 nt, Mycobacterium avium subsp. paratuberculosis
ggcgcgcacguc

SEQ ID NO: 2884972 - RNA, 19 nt, Mycobacterium avium subsp. paratuberculosis
ggcgcgcacgucaccgcgc

SEQ ID NO: 2884973 - RNA, 22 nt, Mycobacterium avium subsp. paratuberculosis
ggcgcgcacguuggcggccagc

SEQ ID NO: 2884974 - RNA, 23 nt, Mycobacterium avium subsp. paratuberculosis
ggcgcgcacguuggcggccagcg

SEQ ID NO: 2884975 - RNA, 18 nt, Mycobacterium avium subsp. paratuberculosis
ggcgcgcagaucgucgac

SEQ ID NO: 2884976 - RNA, 12 nt, Mycobacterium avium subsp. paratuberculosis
ggcgcgcagcac

SEQ ID NO: 2884977 - RNA, 13 nt, Mycobacterium avium subsp. paratuberculosis
ggcgcgcagcacc

SEQ ID NO: 2884978 - RNA, 15 nt, Mycobacterium avium subsp. paratuberculosis
ggcgcgcagccacga

SEQ ID NO: 2884979 - RNA, 18 nt, Mycobacterium avium subsp. paratuberculosis
ggcgcgcagccagucgcc

SEQ ID NO: 2884980 - RNA, 23 nt, Mycobacterium avium subsp. paratuberculosis
ggcgcgcagccagucgccggcca

SEQ ID NO: 2884981 - RNA, 17 nt, Mycobacterium avium subsp. paratuberculosis
ggcgcgcagccggccgu

SEQ ID NO: 2884982 - RNA, 13 nt, Mycobacterium avium subsp. paratuberculosis
ggcgcgcagcgaa

SEQ ID NO: 2884983 - RNA, 12 nt, Mycobacterium avium subsp. paratuberculosis
ggcgcgcagcuc

SEQ ID NO: 2884984 - RNA, 14 nt, Mycobacterium avium subsp. paratuberculosis
ggcgcgcagcucgc

SEQ ID NO: 2884985 - RNA, 16 nt, Mycobacterium avium subsp. paratuberculosis
ggcgcgcagcucgcgc

SEQ ID NO: 2884986 - RNA, 14 nt, Mycobacterium avium subsp. paratuberculosis
ggcgcgcaggcgca

SEQ ID NO: 2884987 - RNA, 17 nt, Mycobacterium avium subsp. paratuberculosis
ggcgcgcaggcgcacca

SEQ ID NO: 2884988 - RNA, 20 nt, Mycobacterium avium subsp. paratuberculosis
ggcgcgcaggcgcgcggcca

SEQ ID NO: 2884989 - RNA, 14 nt, Mycobacterium avium subsp. paratuberculosis
ggcgcgcaggcugg

SEQ ID NO: 2884990 - RNA, 17 nt, Mycobacterium avium subsp. paratuberculosis
ggcgcgcagucgcaggc

SEQ ID NO: 2884991 - RNA, 15 nt, Mycobacterium avium subsp. paratuberculosis
ggcgcgcaucccgau

SEQ ID NO: 2884992 - RNA, 13 nt, Mycobacterium avium subsp. paratuberculosis
ggcgcgcaucguc

SEQ ID NO: 2884993 - RNA, 16 nt, Mycobacterium avium subsp. paratuberculosis
ggcgcgcaucgucgcg

SEQ ID NO: 2884994 - RNA, 21 nt, Mycobacterium avium subsp. paratuberculosis
ggcgcgcaucgucgcggcgcu

SEQ ID NO: 2884995 - RNA, 22 nt, Mycobacterium avium subsp. paratuberculosis
ggcgcgcaucugcucggcgucc

SEQ ID NO: 2884996 - RNA, 23 nt, Mycobacterium avium subsp. paratuberculosis
ggcgcgcaucugcucggcgucca

SEQ ID NO: 2884997 - RNA, 22 nt, Mycobacterium avium subsp. paratuberculosis
ggcgcgccacgacguacccccg

SEQ ID NO: 2884998 - RNA, 14 nt, Mycobacterium avium subsp. paratuberculosis
ggcgcgcccacccg

SEQ ID NO: 2884999 - RNA, 16 nt, Mycobacterium avium subsp. paratuberculosis
ggcgcgcccacccgcg

SEQ ID NO: 2885000 - RNA, 19 nt, Mycobacterium avium subsp. paratuberculosis
ggcgcgcccacccgcgccg

SEQ ID NO: 2885001 - RNA, 22 nt, Mycobacterium avium subsp. paratuberculosis
ggcgcgcccacccgcgccggca

SEQ ID NO: 2885002 - RNA, 13 nt, Mycobacterium avium subsp. paratuberculosis
ggcgcgccccggc

SEQ ID NO: 2885003 - RNA, 16 nt, Mycobacterium avium subsp. paratuberculosis
ggcgcgccccggcccg

SEQ ID NO: 2885004 - RNA, 20 nt, Mycobacterium avium subsp. paratuberculosis
ggcgcgccccggcccgucca

SEQ ID NO: 2885005 - RNA, 13 nt, Mycobacterium avium subsp. paratuberculosis
ggcgcgccgaaga

SEQ ID NO: 2885006 - RNA, 22 nt, Mycobacterium avium subsp. paratuberculosis
ggcgcgccgaagauggccagcg

SEQ ID NO: 2885007 - RNA, 14 nt, Mycobacterium avium subsp. paratuberculosis
ggcgcgccgagcgc

SEQ ID NO: 2885008 - RNA, 16 nt, Mycobacterium avium subsp. paratuberculosis
ggcgcgccgagcgcug

SEQ ID NO: 2885009 - RNA, 13 nt, Mycobacterium avium subsp. paratuberculosis
ggcgcgccgcacc

SEQ ID NO: 2885010 - RNA, 12 nt, Mycobacterium avium subsp. paratuberculosis
ggcgcgccgcag

SEQ ID NO: 2885011 - RNA, 19 nt, Mycobacterium avium subsp. paratuberculosis
ggcgcgccgcguucggcgg

SEQ ID NO: 2885012 - RNA, 14 nt, Mycobacterium avium subsp. paratuberculosis
ggcgcgccggccgg

SEQ ID NO: 2885013 - RNA, 23 nt, Mycobacterium avium subsp. paratuberculosis
ggcgcgccggccggagcggaugg

SEQ ID NO: 2885014 - RNA, 14 nt, Mycobacterium avium subsp. paratuberculosis
ggcgcgccggcgcg

SEQ ID NO: 2885015 - RNA, 16 nt, Mycobacterium avium subsp. paratuberculosis
ggcgcgccggcgcgca

SEQ ID NO: 2885016 - RNA, 18 nt, Mycobacterium avium subsp. paratuberculosis
ggcgcgccggcgcgcagc

SEQ ID NO: 2885017 - RNA, 19 nt, Mycobacterium avium subsp. paratuberculosis
ggcgcgccggcgcgcagcc

SEQ ID NO: 2885018 - RNA, 24 nt, Mycobacterium avium subsp. paratuberculosis
ggcgcgccgguaaugggcgaucga

SEQ ID NO: 2885019 - RNA, 16 nt, Mycobacterium avium subsp. paratuberculosis
ggcgcgccgucccagc

SEQ ID NO: 2885020 - RNA, 17 nt, Mycobacterium avium subsp. paratuberculosis
ggcgcgccgucccagcc

SEQ ID NO: 2885021 - RNA, 18 nt, Mycobacterium avium subsp. paratuberculosis
ggcgcgccgucccagccg

SEQ ID NO: 2885022 - RNA, 21 nt, Mycobacterium avium subsp. paratuberculosis
ggcgcgcgaaaaaacggcggc

SEQ ID NO: 2885023 - RNA, 18 nt, Mycobacterium avium subsp. paratuberculosis
ggcgcgcgccgaucaggu

SEQ ID NO: 2885024 - RNA, 13 nt, Mycobacterium avium subsp. paratuberculosis
ggcgcgcgccgca

SEQ ID NO: 2885025 - RNA, 15 nt, Mycobacterium avium subsp. paratuberculosis
ggcgcgcgccgcagc

SEQ ID NO: 2885026 - RNA, 19 nt, Mycobacterium avium subsp. paratuberculosis
ggcgcgcgccgcccccgcg

SEQ ID NO: 2885027 - RNA, 13 nt, Mycobacterium avium subsp. paratuberculosis
ggcgcgcgcgcca

SEQ ID NO: 2885028 - RNA, 21 nt, Mycobacterium avium subsp. paratuberculosis
ggcgcgcgcuggugcgggcca

SEQ ID NO: 2885029 - RNA, 15 nt, Mycobacterium avium subsp. paratuberculosis
ggcgcgcggccagcc

SEQ ID NO: 2885030 - RNA, 17 nt, Mycobacterium avium subsp. paratuberculosis
ggcgcgcggccgcgacu

SEQ ID NO: 2885031 - RNA, 17 nt, Mycobacterium avium subsp. paratuberculosis
ggcgcgcggggccggcg

SEQ ID NO: 2885032 - RNA, 19 nt, Mycobacterium avium subsp. paratuberculosis
ggcgcgcggggccggcgcg

SEQ ID NO: 2885033 - RNA, 13 nt, Mycobacterium avium subsp. paratuberculosis
ggcgcgcggggug

SEQ ID NO: 2885034 - RNA, 16 nt, Mycobacterium avium subsp. paratuberculosis
ggcgcgcguagcgcag

SEQ ID NO: 2885035 - RNA, 17 nt, Mycobacterium avium subsp. paratuberculosis
ggcgcgcguagcgcagc

SEQ ID NO: 2885036 - RNA, 21 nt, Mycobacterium avium subsp. paratuberculosis
ggcgcgcuaacggcgcggcag

SEQ ID NO: 2885037 - RNA, 16 nt, Mycobacterium avium subsp. paratuberculosis
ggcgcgcucggugcug

SEQ ID NO: 2885038 - RNA, 14 nt, Mycobacterium avium subsp. paratuberculosis
ggcgcgcucggugg

SEQ ID NO: 2885039 - RNA, 14 nt, Mycobacterium avium subsp. paratuberculosis
ggcgcgcucgucgu

SEQ ID NO: 2885040 - RNA, 14 nt, Mycobacterium avium subsp. paratuberculosis
ggcgcgcugcggcg

SEQ ID NO: 2885041 - RNA, 17 nt, Mycobacterium avium subsp. paratuberculosis
ggcgcggaacgcgccgg

SEQ ID NO: 2885042 - RNA, 16 nt, Mycobacterium avium subsp. paratuberculosis
ggcgcggacagcgcgg

SEQ ID NO: 2885043 - RNA, 17 nt, Mycobacterium avium subsp. paratuberculosis
ggcgcggacagcgcggu

SEQ ID NO: 2885044 - RNA, 16 nt, Mycobacterium avium subsp. paratuberculosis
ggcgcggaccgcaccc

SEQ ID NO: 2885045 - RNA, 16 nt, Mycobacterium avium subsp. paratuberculosis
ggcgcggagccggccg

SEQ ID NO: 2885046 - RNA, 18 nt, Mycobacterium avium subsp. paratuberculosis
ggcgcggagccggccgcc

SEQ ID NO: 2885047 - RNA, 21 nt, Mycobacterium avium subsp. paratuberculosis
ggcgcggagccggccgccgaa

SEQ ID NO: 2885048 - RNA, 23 nt, Mycobacterium avium subsp. paratuberculosis
ggcgcggagccggccgccgaagc

SEQ ID NO: 2885049 - RNA, 20 nt, Mycobacterium avium subsp. paratuberculosis
ggcgcggaucgucaccgacc

SEQ ID NO: 2885050 - RNA, 23 nt, Mycobacterium avium subsp. paratuberculosis
ggcgcggaucgucaccgaccccu

SEQ ID NO: 2885051 - RNA, 20 nt, Mycobacterium avium subsp. paratuberculosis
ggcgcggaucucgcgcaggu

SEQ ID NO: 2885052 - RNA, 18 nt, Mycobacterium avium subsp. paratuberculosis
ggcgcggauggguggcga

SEQ ID NO: 2885053 - RNA, 20 nt, Mycobacterium avium subsp. paratuberculosis
ggcgcggcagggccaggccg

SEQ ID NO: 2885054 - RNA, 15 nt, Mycobacterium avium subsp. paratuberculosis
ggcgcggccagcgcg

SEQ ID NO: 2885055 - RNA, 13 nt, Mycobacterium avium subsp. paratuberculosis
ggcgcggccagcu

SEQ ID NO: 2885056 - RNA, 14 nt, Mycobacterium avium subsp. paratuberculosis
ggcgcggcccaggg

SEQ ID NO: 2885057 - RNA, 20 nt, Mycobacterium avium subsp. paratuberculosis
ggcgcggcccaguucgcacc

SEQ ID NO: 2885058 - RNA, 22 nt, Mycobacterium avium subsp. paratuberculosis
ggcgcggcccggcccgcuggcc

SEQ ID NO: 2885059 - RNA, 21 nt, Mycobacterium avium subsp. paratuberculosis
ggcgcggccgauucggcgccg

SEQ ID NO: 2885060 - RNA, 13 nt, Mycobacterium avium subsp. paratuberculosis
ggcgcggccgccc

SEQ ID NO: 2885061 - RNA, 16 nt, Mycobacterium avium subsp. paratuberculosis
ggcgcggccgcccagc

SEQ ID NO: 2885062 - RNA, 22 nt, Mycobacterium avium subsp. paratuberculosis
ggcgcggccgcccagcccgcgc

SEQ ID NO: 2885063 - RNA, 17 nt, Mycobacterium avium subsp. paratuberculosis
ggcgcggccggccgaca

SEQ ID NO: 2885064 - RNA, 18 nt, Mycobacterium avium subsp. paratuberculosis
ggcgcggccggugcgcgu

SEQ ID NO: 2885065 - RNA, 20 nt, Mycobacterium avium subsp. paratuberculosis
ggcgcggccggugcgcguca

SEQ ID NO: 2885066 - RNA, 13 nt, Mycobacterium avium subsp. paratuberculosis
ggcgcggcgacgu

SEQ ID NO: 2885067 - RNA, 13 nt, Mycobacterium avium subsp. paratuberculosis
ggccgucgggucg

SEQ ID NO: 2885068 - RNA, 17 nt, Mycobacterium avium subsp. paratuberculosis
ggccgucgggucggcga

SEQ ID NO: 2885069 - RNA, 18 nt, Mycobacterium avium subsp. paratuberculosis
ggccgucgggucggcgag

SEQ ID NO: 2885070 - RNA, 19 nt, Mycobacterium avium subsp. paratuberculosis
ggccgucgggucggcgagc

SEQ ID NO: 2885071 - RNA, 23 nt, Mycobacterium avium subsp. paratuberculosis
ggccgucgggucggcgagcagcc

SEQ ID NO: 2885072 - RNA, 14 nt, Mycobacterium avium subsp. paratuberculosis
ggccgucgguggcc

SEQ ID NO: 2885073 - RNA, 16 nt, Mycobacterium avium subsp. paratuberculosis
ggccgucgucgaggcc

SEQ ID NO: 2885074 - RNA, 12 nt, Mycobacterium avium subsp. paratuberculosis
ggccgucgucgu

SEQ ID NO: 2885075 - RNA, 23 nt, Mycobacterium avium subsp. paratuberculosis
ggccgucgucgugcaccacgacg

SEQ ID NO: 2885076 - RNA, 16 nt, Mycobacterium avium subsp. paratuberculosis
ggccgucucgagccgg

SEQ ID NO: 2885077 - RNA, 18 nt, Mycobacterium avium subsp. paratuberculosis
ggccgucucgagccggcg

SEQ ID NO: 2885078 - RNA, 20 nt, Mycobacterium avium subsp. paratuberculosis
ggccgucucgagccggcgca

SEQ ID NO: 2885079 - RNA, 13 nt, Mycobacterium avium subsp. paratuberculosis
ggccgucucgucg

SEQ ID NO: 2885080 - RNA, 14 nt, Mycobacterium avium subsp. paratuberculosis
ggccgucucgucgg

SEQ ID NO: 2885081 - RNA, 16 nt, Mycobacterium avium subsp. paratuberculosis
ggccgucucgucggcc

SEQ ID NO: 2885082 - RNA, 17 nt, Mycobacterium avium subsp. paratuberculosis
ggccucgaucaucacca

SEQ ID NO: 2885083 - RNA, 17 nt, Mycobacterium avium subsp. paratuberculosis
ggccucgaugucgucga

SEQ ID NO: 2885084 - RNA, 18 nt, Mycobacterium avium subsp. paratuberculosis
ggccucgcccagcgccgc

SEQ ID NO: 2885085 - RNA, 15 nt, Mycobacterium avium subsp. paratuberculosis
ggccucgccggcgcc

SEQ ID NO: 2885086 - RNA, 16 nt, Mycobacterium avium subsp. paratuberculosis
ggccucgccggcgccg

SEQ ID NO: 2885087 - RNA, 19 nt, Mycobacterium avium subsp. paratuberculosis
ggccucgccggcgccgggc

SEQ ID NO: 2885088 - RNA, 23 nt, Mycobacterium avium subsp. paratuberculosis
ggccucgccgucgaaggccgggc

SEQ ID NO: 2885089 - RNA, 16 nt, Mycobacterium avium subsp. paratuberculosis
ggccucgccgucgcga

SEQ ID NO: 2885090 - RNA, 12 nt, Mycobacterium avium subsp. paratuberculosis
ggccucgccguu

SEQ ID NO: 2885091 - RNA, 20 nt, Mycobacterium avium subsp. paratuberculosis
ggccucgccguugccggccc

SEQ ID NO: 2885092 - RNA, 18 nt, Mycobacterium avium subsp. paratuberculosis
ggccucgcgcaaugccgc

SEQ ID NO: 2885093 - RNA, 20 nt, Mycobacterium avium subsp. paratuberculosis
ggccucggcaccgugccgcg

SEQ ID NO: 2885094 - RNA, 23 nt, Mycobacterium avium subsp. paratuberculosis
ggccucggcgaccgcccggggcg

SEQ ID NO: 2885095 - RNA, 14 nt, Mycobacterium avium subsp. paratuberculosis
ggccucggcggccg

SEQ ID NO: 2885096 - RNA, 16 nt, Mycobacterium avium subsp. paratuberculosis
ggccucggcgguggcc

SEQ ID NO: 2885097 - RNA, 18 nt, Mycobacterium avium subsp. paratuberculosis
ggccucgggcgacgacgc

SEQ ID NO: 2885098 - RNA, 15 nt, Mycobacterium avium subsp. paratuberculosis
ggccucgguggcggu

SEQ ID NO: 2885099 - RNA, 22 nt, Mycobacterium avium subsp. paratuberculosis
ggccucgguggcgguggccacg

SEQ ID NO: 2885100 - RNA, 12 nt, Mycobacterium avium subsp. paratuberculosis
ggccucguccag

SEQ ID NO: 2885101 - RNA, 14 nt, Mycobacterium avium subsp. paratuberculosis
ggccucguccaggg

SEQ ID NO: 2885102 - RNA, 13 nt, Mycobacterium avium subsp. paratuberculosis
ggccucgucgacg

SEQ ID NO: 2885103 - RNA, 14 nt, Mycobacterium avium subsp. paratuberculosis
ggccucgucgacgu

SEQ ID NO: 2885104 - RNA, 16 nt, Mycobacterium avium subsp. paratuberculosis
ggccucgucgacgucg

SEQ ID NO: 2885105 - RNA, 20 nt, Mycobacterium avium subsp. paratuberculosis
ggccucgucgacgucgggga

SEQ ID NO: 2885106 - RNA, 23 nt, Mycobacterium avium subsp. paratuberculosis
ggccucgucgagguacugcagca

SEQ ID NO: 2885107 - RNA, 16 nt, Mycobacterium avium subsp. paratuberculosis
ggccucgucgaugucg

SEQ ID NO: 2885108 - RNA, 19 nt, Mycobacterium avium subsp. paratuberculosis
ggccucgucgaugucggcg

SEQ ID NO: 2885109 - RNA, 21 nt, Mycobacterium avium subsp. paratuberculosis
ggccucgucgaugucggcggc

SEQ ID NO: 2885110 - RNA, 14 nt, Mycobacterium avium subsp. paratuberculosis
ggccucgucgccgc

SEQ ID NO: 2885111 - RNA, 15 nt, Mycobacterium avium subsp. paratuberculosis
ggccucgucgccgcg

SEQ ID NO: 2885112 - RNA, 14 nt, Mycobacterium avium subsp. paratuberculosis
ggccucgucgcgga

SEQ ID NO: 2885113 - RNA, 15 nt, Mycobacterium avium subsp. paratuberculosis
ggccucgucggcgag

SEQ ID NO: 2885114 - RNA, 17 nt, Mycobacterium avium subsp. paratuberculosis
ggccucgucggcgagca

SEQ ID NO: 2885115 - RNA, 23 nt, Mycobacterium avium subsp. paratuberculosis
ggccucgucggcgagcagcagcg

SEQ ID NO: 2885116 - RNA, 16 nt, Mycobacterium avium subsp. paratuberculosis
ggccucgucggcgccg

SEQ ID NO: 2885117 - RNA, 19 nt, Mycobacterium avium subsp. paratuberculosis
ggccucgucggcgccgucg

SEQ ID NO: 2885118 - RNA, 23 nt, Mycobacterium avium subsp. paratuberculosis
ggccucgucggcgccgucgcggg

SEQ ID NO: 2885119 - RNA, 22 nt, Mycobacterium avium subsp. paratuberculosis
ggccucguggaaaucgagcgcg

SEQ ID NO: 2885120 - RNA, 14 nt, Mycobacterium avium subsp. paratuberculosis
ggccucguggaaca

SEQ ID NO: 2885121 - RNA, 23 nt, Mycobacterium avium subsp. paratuberculosis
ggccucucgucgacgauggcccg

SEQ ID NO: 2885122 - RNA, 19 nt, Mycobacterium avium subsp. paratuberculosis
ggccugagacgacgccacc

SEQ ID NO: 2885123 - RNA, 20 nt, Mycobacterium avium subsp. paratuberculosis
ggccugagacgacgccacca

SEQ ID NO: 2885124 - RNA, 17 nt, Mycobacterium avium subsp. paratuberculosis
ggccugagccgccgggg

SEQ ID NO: 2885125 - RNA, 20 nt, Mycobacterium avium subsp. paratuberculosis
ggccugauugacggcccacg

SEQ ID NO: 2885126 - RNA, 14 nt, Mycobacterium avium subsp. paratuberculosis
ggccugcaccacca

SEQ ID NO: 2885127 - RNA, 16 nt, Mycobacterium avium subsp. paratuberculosis
ggccugcaccaccaca

SEQ ID NO: 2885128 - RNA, 21 nt, Mycobacterium avium subsp. paratuberculosis
ggccugcaccaccacacccag

SEQ ID NO: 2885129 - RNA, 22 nt, Mycobacterium avium subsp. paratuberculosis
ggccugcaccaccacacccagc

SEQ ID NO: 2885130 - RNA, 14 nt, Mycobacterium avium subsp. paratuberculosis
ggccugcacccagg

SEQ ID NO: 2885131 - RNA, 15 nt, Mycobacterium avium subsp. paratuberculosis
ggccugcacccaggu

SEQ ID NO: 2885132 - RNA, 18 nt, Mycobacterium avium subsp. paratuberculosis
ggccugcacccaggucau

SEQ ID NO: 2885133 - RNA, 22 nt, Mycobacterium avium subsp. paratuberculosis
ggccugcacgaagucgaccgcg

SEQ ID NO: 2885134 - RNA, 19 nt, Mycobacterium avium subsp. paratuberculosis
ggccugcacgucggcgcgc

SEQ ID NO: 2885135 - RNA, 20 nt, Mycobacterium avium subsp. paratuberculosis
ggccugcacgucggcgcgca

SEQ ID NO: 2885136 - RNA, 14 nt, Mycobacterium avium subsp. paratuberculosis
ggccugcagaaugc

SEQ ID NO: 2885137 - RNA, 15 nt, Mycobacterium avium subsp. paratuberculosis
ggccugcagcaccag

SEQ ID NO: 2885138 - RNA, 14 nt, Mycobacterium avium subsp. paratuberculosis
ggccugcagcgcgg

SEQ ID NO: 2885139 - RNA, 17 nt, Mycobacterium avium subsp. paratuberculosis
ggccugcagcgcgguca

SEQ ID NO: 2885140 - RNA, 20 nt, Mycobacterium avium subsp. paratuberculosis
ggccugcagcucggugcgca

SEQ ID NO: 2885141 - RNA, 15 nt, Mycobacterium avium subsp. paratuberculosis
ggccugccaccgcga

SEQ ID NO: 2885142 - RNA, 14 nt, Mycobacterium avium subsp. paratuberculosis
ggccugcccgccgc

SEQ ID NO: 2885143 - RNA, 18 nt, Mycobacterium avium subsp. paratuberculosis
ggccugcccgccgcggcc

SEQ ID NO: 2885144 - RNA, 20 nt, Mycobacterium avium subsp. paratuberculosis
ggccugcccgccgcggccgc

SEQ ID NO: 2885145 - RNA, 24 nt, Mycobacterium avium subsp. paratuberculosis
ggccugcccgccgcggccgcuggc

SEQ ID NO: 2885146 - RNA, 14 nt, Mycobacterium avium subsp. paratuberculosis
ggccugcccggcgg

SEQ ID NO: 2885147 - RNA, 16 nt, Mycobacterium avium subsp. paratuberculosis
ggccugcccggcggug

SEQ ID NO: 2885148 - RNA, 18 nt, Mycobacterium avium subsp. paratuberculosis
ggccugcccggcggugcc

SEQ ID NO: 2885149 - RNA, 19 nt, Mycobacterium avium subsp. paratuberculosis
ggccugccggaugccgcgc

SEQ ID NO: 2885150 - RNA, 22 nt, Mycobacterium avium subsp. paratuberculosis
ggccugccggaugccgcgcggc

SEQ ID NO: 2885151 - RNA, 13 nt, Mycobacterium avium subsp. paratuberculosis
ggccugccggccg

SEQ ID NO: 2885152 - RNA, 14 nt, Mycobacterium avium subsp. paratuberculosis
ggccugccggccgc

SEQ ID NO: 2885153 - RNA, 18 nt, Mycobacterium avium subsp. paratuberculosis
ggccugccggccgccgcg

SEQ ID NO: 2885154 - RNA, 23 nt, Mycobacterium avium subsp. paratuberculosis
ggccugcgccaggauccgcccgc

SEQ ID NO: 2885155 - RNA, 15 nt, Mycobacterium avium subsp. paratuberculosis
ggccugcgccuuggc

SEQ ID NO: 2885156 - RNA, 13 nt, Mycobacterium avium subsp. paratuberculosis
ggccugcgcgccg

SEQ ID NO: 2885157 - RNA, 13 nt, Mycobacterium avium subsp. paratuberculosis
ggccugcgcggcc

SEQ ID NO: 2885158 - RNA, 14 nt, Mycobacterium avium subsp. paratuberculosis
ggccugcgcggccg

SEQ ID NO: 2885159 - RNA, 16 nt, Mycobacterium avium subsp. paratuberculosis
ggccugcgcggccgcg

SEQ ID NO: 2885160 - RNA, 13 nt, Mycobacterium avium subsp. paratuberculosis
ggccugcgcgucg

SEQ ID NO: 2885161 - RNA, 20 nt, Mycobacterium avium subsp. paratuberculosis
ggccugcggcaacagcacca

SEQ ID NO: 2885162 - RNA, 13 nt, Mycobacterium avium subsp. paratuberculosis
ggccugcggcgcg

SEQ ID NO: 2885163 - RNA, 18 nt, Mycobacterium avium subsp. paratuberculosis
ggccugcggcggccgcag

SEQ ID NO: 2885164 - RNA, 16 nt, Mycobacterium avium subsp. paratuberculosis
ggccugcgggacgccg

SEQ ID NO: 2885165 - RNA, 20 nt, Mycobacterium avium subsp. paratuberculosis
ggccugcgggcgccggcugc

SEQ ID NO: 2885166 - RNA, 21 nt, Mycobacterium avium subsp. paratuberculosis
ggccugcucgcuugccagccg

SEQ ID NO: 2885167 - RNA, 23 nt, Mycobacterium avium subsp. paratuberculosis
ggccugcucgcuugccagccggg

SEQ ID NO: 2885168 - RNA, 15 nt, Mycobacterium avium subsp. paratuberculosis
ggccugcucgucggg

SEQ ID NO: 2885169 - RNA, 22 nt, Mycobacterium avium subsp. paratuberculosis
ggccugcucgucggggcagccg

SEQ ID NO: 2885170 - RNA, 23 nt, Mycobacterium avium subsp. paratuberculosis
ggccugcucgucggggcagccgu

SEQ ID NO: 2885171 - RNA, 15 nt, Mycobacterium avium subsp. paratuberculosis
ggccugcuugaccgc

SEQ ID NO: 2885172 - RNA, 16 nt, Mycobacterium avium subsp. paratuberculosis
ggccugcuugaccgcc

SEQ ID NO: 2885173 - RNA, 18 nt, Mycobacterium avium subsp. paratuberculosis
ggccugcuugaccgccag

SEQ ID NO: 2885174 - RNA, 19 nt, Mycobacterium avium subsp. paratuberculosis
ggccugcuugggcagcagc

SEQ ID NO: 2885175 - RNA, 20 nt, Mycobacterium avium subsp. paratuberculosis
ggccugcuugggcagcagcu

SEQ ID NO: 2885176 - RNA, 17 nt, Mycobacterium avium subsp. paratuberculosis
ggccugcuuuucggccg

SEQ ID NO: 2885177 - RNA, 22 nt, Mycobacterium avium subsp. paratuberculosis
ggccuggaaccgggucucgcgc

SEQ ID NO: 2885178 - RNA, 23 nt, Mycobacterium avium subsp. paratuberculosis
ggccuggacuugcgucgcgaugc

SEQ ID NO: 2885179 - RNA, 15 nt, Mycobacterium avium subsp. paratuberculosis
ggccuggaugccgcc

SEQ ID NO: 2885180 - RNA, 16 nt, Mycobacterium avium subsp. paratuberculosis
ggccuggaugccgccc

SEQ ID NO: 2885181 - RNA, 17 nt, Mycobacterium avium subsp. paratuberculosis
ggccuggaugccgcccu

SEQ ID NO: 2885182 - RNA, 16 nt, Mycobacterium avium subsp. paratuberculosis
ggccuggcccagccgc

SEQ ID NO: 2885183 - RNA, 16 nt, Mycobacterium avium subsp. paratuberculosis
ggccuggccgucgcgg

SEQ ID NO: 2885184 - RNA, 17 nt, Mycobacterium avium subsp. paratuberculosis
ggccuggcgcuccagcc

SEQ ID NO: 2885185 - RNA, 19 nt, Mycobacterium avium subsp. paratuberculosis
ggccugggcaauggccgcg

SEQ ID NO: 2885186 - RNA, 16 nt, Mycobacterium avium subsp. paratuberculosis
ggccugggcgaccacg

SEQ ID NO: 2885187 - RNA, 22 nt, Mycobacterium avium subsp. paratuberculosis
ggccugguacagcaccgccgcg

SEQ ID NO: 2885188 - RNA, 23 nt, Mycobacterium avium subsp. paratuberculosis
ggccugguacagcaccgccgcgg

SEQ ID NO: 2885189 - RNA, 15 nt, Mycobacterium avium subsp. paratuberculosis
ggccugguagcugag

SEQ ID NO: 2885190 - RNA, 20 nt, Mycobacterium avium subsp. paratuberculosis
ggccugguagcugagcagca

SEQ ID NO: 2885191 - RNA, 21 nt, Mycobacterium avium subsp. paratuberculosis
ggccugguagcugagcagcag

SEQ ID NO: 2885192 - RNA, 17 nt, Mycobacterium avium subsp. paratuberculosis
ggccugguaggccgccu

SEQ ID NO: 2885193 - RNA, 18 nt, Mycobacterium avium subsp. paratuberculosis
ggccugguaggccgccuu

SEQ ID NO: 2885194 - RNA, 22 nt, Mycobacterium avium subsp. paratuberculosis
ggccuggucgaacagcacgccg

SEQ ID NO: 2885195 - RNA, 14 nt, Mycobacterium avium subsp. paratuberculosis
ggccuggucggccg

SEQ ID NO: 2885196 - RNA, 18 nt, Mycobacterium avium subsp. paratuberculosis
ggccuggucggccggcag

SEQ ID NO: 2885197 - RNA, 14 nt, Mycobacterium avium subsp. paratuberculosis
ggccuggucggcga

SEQ ID NO: 2885198 - RNA, 15 nt, Mycobacterium avium subsp. paratuberculosis
ggccuggucggcgac

SEQ ID NO: 2885199 - RNA, 17 nt, Mycobacterium avium subsp. paratuberculosis
ggccugguggcccaggc

SEQ ID NO: 2885200 - RNA, 16 nt, Mycobacterium avium subsp. paratuberculosis
ggccuguccggucuuc

SEQ ID NO: 2885201 - RNA, 17 nt, Mycobacterium avium subsp. paratuberculosis
ggccuucacgcuggccu

SEQ ID NO: 2885202 - RNA, 18 nt, Mycobacterium avium subsp. paratuberculosis
ggccuucagcguccacga

SEQ ID NO: 2885203 - RNA, 17 nt, Mycobacterium avium subsp. paratuberculosis
ggccuucaucaccgccc

SEQ ID NO: 2885204 - RNA, 18 nt, Mycobacterium avium subsp. paratuberculosis
ggccuuccgcaacaucgu

SEQ ID NO: 2885205 - RNA, 12 nt, Mycobacterium avium subsp. paratuberculosis
ggccuucggggu

SEQ ID NO: 2885206 - RNA, 17 nt, Mycobacterium avium subsp. paratuberculosis
ggccuucggggugguca

SEQ ID NO: 2885207 - RNA, 20 nt, Mycobacterium avium subsp. paratuberculosis
ggccuucgggguggucaccg

SEQ ID NO: 2885208 - RNA, 21 nt, Mycobacterium avium subsp. paratuberculosis
ggccuucgggguggucaccgg

SEQ ID NO: 2885209 - RNA, 23 nt, Mycobacterium avium subsp. paratuberculosis
ggccuucgggguggucaccggca

SEQ ID NO: 2885210 - RNA, 19 nt, Mycobacterium avium subsp. paratuberculosis
ggccuucucgcgcaccgcg

SEQ ID NO: 2885211 - RNA, 18 nt, Mycobacterium avium subsp. paratuberculosis
ggccuucuggaagccugg

SEQ ID NO: 2885212 - RNA, 22 nt, Mycobacterium avium subsp. paratuberculosis
ggccuucuggaagccuggcacg

SEQ ID NO: 2885213 - RNA, 23 nt, Mycobacterium avium subsp. paratuberculosis
ggccuucuuggccggagccuugg

SEQ ID NO: 2885214 - RNA, 21 nt, Mycobacterium avium subsp. paratuberculosis
ggccuucuuggcggcggccuu

SEQ ID NO: 2885215 - RNA, 21 nt, Mycobacterium avium subsp. paratuberculosis
ggccuucuuucguucgauguc

SEQ ID NO: 2885216 - RNA, 19 nt, Mycobacterium avium subsp. paratuberculosis
ggccuugaacucggccagg

SEQ ID NO: 2885217 - RNA, 14 nt, Mycobacterium avium subsp. paratuberculosis
ggccuugaccagga

SEQ ID NO: 2885218 - RNA, 17 nt, Mycobacterium avium subsp. paratuberculosis
ggccuugacgacggcca

SEQ ID NO: 2885219 - RNA, 22 nt, Mycobacterium avium subsp. paratuberculosis
ggccuugacgacggccaccgcg

SEQ ID NO: 2885220 - RNA, 19 nt, Mycobacterium avium subsp. paratuberculosis
ggccuugacggccugggcg

SEQ ID NO: 2885221 - RNA, 15 nt, Mycobacterium avium subsp. paratuberculosis
ggccuugccgaucag

SEQ ID NO: 2885222 - RNA, 20 nt, Mycobacterium avium subsp. paratuberculosis
ggccuugccgaucagcuggc

SEQ ID NO: 2885223 - RNA, 15 nt, Mycobacterium avium subsp. paratuberculosis
ggccuugcgagccgg

SEQ ID NO: 2885224 - RNA, 22 nt, Mycobacterium avium subsp. paratuberculosis
ggccuugcgcaccggagccuug

SEQ ID NO: 2885225 - RNA, 15 nt, Mycobacterium avium subsp. paratuberculosis
ggccuugcucgccgc

SEQ ID NO: 2885226 - RNA, 20 nt, Mycobacterium avium subsp. paratuberculosis
ggccuugcugagccggcccu

SEQ ID NO: 2885227 - RNA, 22 nt, Mycobacterium avium subsp. paratuberculosis
ggccuugcugauccccagcggc

SEQ ID NO: 2885228 - RNA, 14 nt, Mycobacterium avium subsp. paratuberculosis
ggccuuggccaacg

SEQ ID NO: 2885229 - RNA, 14 nt, Mycobacterium avium subsp. paratuberculosis
ggccuuggccacca

SEQ ID NO: 2885230 - RNA, 17 nt, Mycobacterium avium subsp. paratuberculosis
ggccuuggccaccgccu

SEQ ID NO: 2885231 - RNA, 23 nt, Mycobacterium avium subsp. paratuberculosis
ggccuuggugaugggcagcgccc

SEQ ID NO: 2885232 - RNA, 17 nt, Mycobacterium avium subsp. paratuberculosis
ggccuuuuccggcgaca

SEQ ID NO: 2885233 - RNA, 16 nt, Mycobacterium avium subsp. paratuberculosis
ggccuuuugcaccaag

SEQ ID NO: 2885234 - RNA, 17 nt, Mycobacterium avium subsp. paratuberculosis
ggcgaaauaacccaccc

SEQ ID NO: 2885235 - RNA, 19 nt, Mycobacterium avium subsp. paratuberculosis
ggcgaaauaacccaccccg

SEQ ID NO: 2885236 - RNA, 14 nt, Mycobacterium avium subsp. paratuberculosis
ggcgaacaccacgg

SEQ ID NO: 2885237 - RNA, 13 nt, Mycobacterium avium subsp. paratuberculosis
ggcgaacaccagc

SEQ ID NO: 2885238 - RNA, 14 nt, Mycobacterium avium subsp. paratuberculosis
ggcgaacaccagca

SEQ ID NO: 2885239 - RNA, 14 nt, Mycobacterium avium subsp. paratuberculosis
ggcgaacaccagcc

SEQ ID NO: 2885240 - RNA, 19 nt, Mycobacterium avium subsp. paratuberculosis
ggcgaacaccagcccggcc

SEQ ID NO: 2885241 - RNA, 17 nt, Mycobacterium avium subsp. paratuberculosis
ggcgaacaccucggcga

SEQ ID NO: 2885242 - RNA, 22 nt, Mycobacterium avium subsp. paratuberculosis
ggcgaacaccucggcgaugccu

SEQ ID NO: 2885243 - RNA, 14 nt, Mycobacterium avium subsp. paratuberculosis
ggcgaacaccugcu

SEQ ID NO: 2885244 - RNA, 19 nt, Mycobacterium avium subsp. paratuberculosis
ggcgaacacgucggccagc

SEQ ID NO: 2885245 - RNA, 22 nt, Mycobacterium avium subsp. paratuberculosis
ggcgaacacgucggccagcgcg

SEQ ID NO: 2885246 - RNA, 17 nt, Mycobacterium avium subsp. paratuberculosis
ggcgaacagcagcaccc

SEQ ID NO: 2885247 - RNA, 21 nt, Mycobacterium avium subsp. paratuberculosis
ggcgaacagcagcacccgggu

SEQ ID NO: 2885248 - RNA, 22 nt, Mycobacterium avium subsp. paratuberculosis
ggcgaacagcggggugcccacc

SEQ ID NO: 2885249 - RNA, 23 nt, Mycobacterium avium subsp. paratuberculosis
ggcgaacagcggggugcccacca

SEQ ID NO: 2885250 - RNA, 20 nt, Mycobacterium avium subsp. paratuberculosis
ggcgaacagugcacugccga

SEQ ID NO: 2885251 - RNA, 16 nt, Mycobacterium avium subsp. paratuberculosis
ggcgaaucugucgaug

SEQ ID NO: 2885252 - RNA, 22 nt, Mycobacterium avium subsp. paratuberculosis
ggcgaauuccccguagucaccc

SEQ ID NO: 2885253 - RNA, 21 nt, Mycobacterium avium subsp. paratuberculosis
ggcgacaacagcgccgagacg

SEQ ID NO: 2885254 - RNA, 18 nt, Mycobacterium avium subsp. paratuberculosis
ggcgacaacaggcgaccu

SEQ ID NO: 2885255 - RNA, 21 nt, Mycobacterium avium subsp. paratuberculosis
ggcgacaacaggcgaccucgg

SEQ ID NO: 2885256 - RNA, 13 nt, Mycobacterium avium subsp. paratuberculosis
ggcgacacccagc

SEQ ID NO: 2885257 - RNA, 18 nt, Mycobacterium avium subsp. paratuberculosis
ggcgacaccccgcgaguc

SEQ ID NO: 2885258 - RNA, 14 nt, Mycobacterium avium subsp. paratuberculosis
ggcgacacgccgac

SEQ ID NO: 2885259 - RNA, 16 nt, Mycobacterium avium subsp. paratuberculosis
ggcgacaucgccgcgg

SEQ ID NO: 2885260 - RNA, 21 nt, Mycobacterium avium subsp. paratuberculosis
ggcgacaucgccgcggccgga

SEQ ID NO: 2885261 - RNA, 15 nt, Mycobacterium avium subsp. paratuberculosis
ggcgacaucggcaca

SEQ ID NO: 2885262 - RNA, 20 nt, Mycobacterium avium subsp. paratuberculosis
ggcgacaugcgcagcgccca

SEQ ID NO: 2885263 - RNA, 22 nt, Mycobacterium avium subsp. paratuberculosis
ggcgacaugcgcagcgcccagg

SEQ ID NO: 2885264 - RNA, 24 nt, Mycobacterium avium subsp. paratuberculosis
ggcgacaugcgcagcgcccaggcg

SEQ ID NO: 2885265 - RNA, 12 nt, Mycobacterium avium subsp. paratuberculosis
ggcgaccacacc

SEQ ID NO: 2885266 - RNA, 13 nt, Mycobacterium avium subsp. paratuberculosis
ggcgaccacaccg

SEQ ID NO: 2885267 - RNA, 18 nt, Mycobacterium avium subsp. paratuberculosis
ggcgaccacaccgccggc

SEQ ID NO: 2885268 - RNA, 22 nt, Mycobacterium avium subsp. paratuberculosis
ggcgaccacaccgccggccacg

SEQ ID NO: 2885269 - RNA, 16 nt, Mycobacterium avium subsp. paratuberculosis
ggcgaccacaccgucg

SEQ ID NO: 2885270 - RNA, 20 nt, Mycobacterium avium subsp. paratuberculosis
ggcgaccacaccgucgacga

SEQ ID NO: 2885271 - RNA, 18 nt, Mycobacterium avium subsp. paratuberculosis
ggcgaccaccaccgccca

SEQ ID NO: 2885272 - RNA, 22 nt, Mycobacterium avium subsp. paratuberculosis
ggcgaccaccacggccgcagcg

SEQ ID NO: 2885273 - RNA, 13 nt, Mycobacterium avium subsp. paratuberculosis
ggcgaccaccagc

SEQ ID NO: 2885274 - RNA, 16 nt, Mycobacterium avium subsp. paratuberculosis
ggcgaccaccagccgc

SEQ ID NO: 2885275 - RNA, 16 nt, Mycobacterium avium subsp. paratuberculosis
ggcgaccaccucggcg

SEQ ID NO: 2885276 - RNA, 18 nt, Mycobacterium avium subsp. paratuberculosis
ggcgaccaccucggcgac

SEQ ID NO: 2885277 - RNA, 20 nt, Mycobacterium avium subsp. paratuberculosis
ggcgaccaccucggcgacga

SEQ ID NO: 2885278 - RNA, 22 nt, Mycobacterium avium subsp. paratuberculosis
ggcgaccaccucggcgacgaug

SEQ ID NO: 2885279 - RNA, 23 nt, Mycobacterium avium subsp. paratuberculosis
ggcgaccaccucggcgacgaugg

SEQ ID NO: 2885280 - RNA, 19 nt, Mycobacterium avium subsp. paratuberculosis
ggcgaccacgaacaccggc

SEQ ID NO: 2885281 - RNA, 20 nt, Mycobacterium avium subsp. paratuberculosis
ggcgaccagauaggccagcg

SEQ ID NO: 2885282 - RNA, 22 nt, Mycobacterium avium subsp. paratuberculosis
ggcgaccagauaggccagcgcg

SEQ ID NO: 2885283 - RNA, 23 nt, Mycobacterium avium subsp. paratuberculosis
ggcgaccagauaggccagcgcgu

SEQ ID NO: 2885284 - RNA, 15 nt, Mycobacterium avium subsp. paratuberculosis
ggcgaccagccccuc

SEQ ID NO: 2885285 - RNA, 16 nt, Mycobacterium avium subsp. paratuberculosis
ggcgaccagccccucg

SEQ ID NO: 2885286 - RNA, 12 nt, Mycobacterium avium subsp. paratuberculosis
ggcgaccagcga

SEQ ID NO: 2885287 - RNA, 18 nt, Mycobacterium avium subsp. paratuberculosis
ggcgaccagcgacggcag

SEQ ID NO: 2885288 - RNA, 21 nt, Mycobacterium avium subsp. paratuberculosis
ggcgaccagcgacggcagguc

SEQ ID NO: 2885289 - RNA, 15 nt, Mycobacterium avium subsp. paratuberculosis
ggcgaccagcgagcc

SEQ ID NO: 2885290 - RNA, 19 nt, Mycobacterium avium subsp. paratuberculosis
ggcgaccagcgagcccagc

SEQ ID NO: 2885291 - RNA, 22 nt, Mycobacterium avium subsp. paratuberculosis
ggcgaccagcgagcccagcugc

SEQ ID NO: 2885292 - RNA, 19 nt, Mycobacterium avium subsp. paratuberculosis
ggcgaccaguaggccagca

SEQ ID NO: 2885293 - RNA, 19 nt, Mycobacterium avium subsp. paratuberculosis
ggcgaccaucagccugcgg

SEQ ID NO: 2885294 - RNA, 19 nt, Mycobacterium avium subsp. paratuberculosis
ggcgaccaugcccagcagu

SEQ ID NO: 2885295 - RNA, 20 nt, Mycobacterium avium subsp. paratuberculosis
ggcgaccaugccgcgggcca

SEQ ID NO: 2885296 - RNA, 10 nt, Mycobacterium avium subsp. paratuberculosis
ggcgaccccg

SEQ ID NO: 2885297 - RNA, 12 nt, Mycobacterium avium subsp. paratuberculosis
ggcgaccccggc

SEQ ID NO: 2885298 - RNA, 16 nt, Mycobacterium avium subsp. paratuberculosis
ggcgaccccguucgcc

SEQ ID NO: 2885299 - RNA, 19 nt, Mycobacterium avium subsp. paratuberculosis
ggcgaccccguucgccgac

SEQ ID NO: 2885300 - RNA, 14 nt, Mycobacterium avium subsp. paratuberculosis
ggcgacccgcacga

SEQ ID NO: 2885301 - RNA, 12 nt, Mycobacterium avium subsp. paratuberculosis
ggcgacccgcuu

SEQ ID NO: 2885302 - RNA, 16 nt, Mycobacterium avium subsp. paratuberculosis
ggcgacccggaugaug

SEQ ID NO: 2885303 - RNA, 17 nt, Mycobacterium avium subsp. paratuberculosis
ggcgaccgcccggggcg

SEQ ID NO: 2885304 - RNA, 19 nt, Mycobacterium avium subsp. paratuberculosis
ggcgaccgcccggggcgcg

SEQ ID NO: 2885305 - RNA, 21 nt, Mycobacterium avium subsp. paratuberculosis
ggcgaccgccgcguacagcca

SEQ ID NO: 2885306 - RNA, 13 nt, Mycobacterium avium subsp. paratuberculosis
ggcgaccgcgacg

SEQ ID NO: 2885307 - RNA, 14 nt, Mycobacterium avium subsp. paratuberculosis
ggcgaccgcgacgg

SEQ ID NO: 2885308 - RNA, 22 nt, Mycobacterium avium subsp. paratuberculosis
ggcgaccgcgacgguggacccg

SEQ ID NO: 2885309 - RNA, 14 nt, Mycobacterium avium subsp. paratuberculosis
ggcgaccgcgcagg

SEQ ID NO: 2885310 - RNA, 15 nt, Mycobacterium avium subsp. paratuberculosis
ggcgaccgcgcaggc

SEQ ID NO: 2885311 - RNA, 18 nt, Mycobacterium avium subsp. paratuberculosis
ggcgaccgcgcaggcggc

SEQ ID NO: 2885312 - RNA, 19 nt, Mycobacterium avium subsp. paratuberculosis
ggcgaccgcgcaggcggcg

SEQ ID NO: 2885313 - RNA, 22 nt, Mycobacterium avium subsp. paratuberculosis
ggcgaccgcgcaggcggcgacg

SEQ ID NO: 2885314 - RNA, 23 nt, Mycobacterium avium subsp. paratuberculosis
ggcgaccgcgcaggcggcgacgg

SEQ ID NO: 2885315 - RNA, 13 nt, Mycobacterium avium subsp. paratuberculosis
ggcgaccgcgcgc

SEQ ID NO: 2885316 - RNA, 17 nt, Mycobacterium avium subsp. paratuberculosis
ggcgaccgcgcgcggcg

SEQ ID NO: 2885317 - RNA, 20 nt, Mycobacterium avium subsp. paratuberculosis
ggcgaccgcgcgcggcgccg

SEQ ID NO: 2885318 - RNA, 13 nt, Mycobacterium avium subsp. paratuberculosis
ggcgaccgcggcc

SEQ ID NO: 2885319 - RNA, 14 nt, Mycobacterium avium subsp. paratuberculosis
ggcgaccgcggccg

SEQ ID NO: 2885320 - RNA, 18 nt, Mycobacterium avium subsp. paratuberculosis
ggcgaccgcguagucguu

SEQ ID NO: 2885321 - RNA, 13 nt, Mycobacterium avium subsp. paratuberculosis
ggcgaccggcccc

SEQ ID NO: 2885322 - RNA, 22 nt, Mycobacterium avium subsp. paratuberculosis
ggccggaucgaacuugaucacc

SEQ ID NO: 2885323 - RNA, 22 nt, Mycobacterium avium subsp. paratuberculosis
ggccggaucgaauccggcggcg

SEQ ID NO: 2885324 - RNA, 17 nt, Mycobacterium avium subsp. paratuberculosis
ggccggauggccagcag

SEQ ID NO: 2885325 - RNA, 18 nt, Mycobacterium avium subsp. paratuberculosis
ggccggauggccagcagg

SEQ ID NO: 2885326 - RNA, 17 nt, Mycobacterium avium subsp. paratuberculosis
ggccggcaacgacccgu

SEQ ID NO: 2885327 - RNA, 15 nt, Mycobacterium avium subsp. paratuberculosis
ggccggcacccgggc

SEQ ID NO: 2885328 - RNA, 13 nt, Mycobacterium avium subsp. paratuberculosis
ggccggcacgaug

SEQ ID NO: 2885329 - RNA, 22 nt, Mycobacterium avium subsp. paratuberculosis
ggccggcacgauggcgcggcgc

SEQ ID NO: 2885330 - RNA, 15 nt, Mycobacterium avium subsp. paratuberculosis
ggccggcacuaccgc

SEQ ID NO: 2885331 - RNA, 17 nt, Mycobacterium avium subsp. paratuberculosis
ggccggcacuaccgccu

SEQ ID NO: 2885332 - RNA, 24 nt, Mycobacterium avium subsp. paratuberculosis
ggccggcacuaccgccucgccagc

SEQ ID NO: 2885333 - RNA, 11 nt, Mycobacterium avium subsp. paratuberculosis
ggccggcacuc

SEQ ID NO: 2885334 - RNA, 15 nt, Mycobacterium avium subsp. paratuberculosis
ggccggcacucgccu

SEQ ID NO: 2885335 - RNA, 16 nt, Mycobacterium avium subsp. paratuberculosis
ggccggcagcaucggg

SEQ ID NO: 2885336 - RNA, 18 nt, Mycobacterium avium subsp. paratuberculosis
ggccggcagcaucgggac

SEQ ID NO: 2885337 - RNA, 12 nt, Mycobacterium avium subsp. paratuberculosis
ggccggcagccg

SEQ ID NO: 2885338 - RNA, 13 nt, Mycobacterium avium subsp. paratuberculosis
ggccggcagccgg

SEQ ID NO: 2885339 - RNA, 15 nt, Mycobacterium avium subsp. paratuberculosis
ggccggcagccggcc

SEQ ID NO: 2885340 - RNA, 17 nt, Mycobacterium avium subsp. paratuberculosis
ggccggcagccggccac

SEQ ID NO: 2885341 - RNA, 18 nt, Mycobacterium avium subsp. paratuberculosis
ggccggcagccggccacc

SEQ ID NO: 2885342 - RNA, 16 nt, Mycobacterium avium subsp. paratuberculosis
ggccggcagccggcgc

SEQ ID NO: 2885343 - RNA, 23 nt, Mycobacterium avium subsp. paratuberculosis
ggccggcagccggcgcggugauu

SEQ ID NO: 2885344 - RNA, 12 nt, Mycobacterium avium subsp. paratuberculosis
ggccggcagcgg

SEQ ID NO: 2885345 - RNA, 13 nt, Mycobacterium avium subsp. paratuberculosis
ggccggcagcggu

SEQ ID NO: 2885346 - RNA, 21 nt, Mycobacterium avium subsp. paratuberculosis
ggccggcagcggugccgcccg

SEQ ID NO: 2885347 - RNA, 14 nt, Mycobacterium avium subsp. paratuberculosis
ggccggcaggccgc

SEQ ID NO: 2885348 - RNA, 13 nt, Mycobacterium avium subsp. paratuberculosis
ggccggcaguucc

SEQ ID NO: 2885349 - RNA, 19 nt, Mycobacterium avium subsp. paratuberculosis
ggccggcaguuccucgccg

SEQ ID NO: 2885350 - RNA, 16 nt, Mycobacterium avium subsp. paratuberculosis
ggccggccaccagcgg

SEQ ID NO: 2885351 - RNA, 18 nt, Mycobacterium avium subsp. paratuberculosis
ggccggccaccagcggcc

SEQ ID NO: 2885352 - RNA, 22 nt, Mycobacterium avium subsp. paratuberculosis
ggccggccaccagcggccggaa

SEQ ID NO: 2885353 - RNA, 21 nt, Mycobacterium avium subsp. paratuberculosis
ggccggccacgcucggcggcg

SEQ ID NO: 2885354 - RNA, 13 nt, Mycobacterium avium subsp. paratuberculosis
ggccggccagcac

SEQ ID NO: 2885355 - RNA, 15 nt, Mycobacterium avium subsp. paratuberculosis
ggccggccagcagcc

SEQ ID NO: 2885356 - RNA, 17 nt, Mycobacterium avium subsp. paratuberculosis
ggccggccagcagccgg

SEQ ID NO: 2885357 - RNA, 14 nt, Mycobacterium avium subsp. paratuberculosis
ggccggccagcgcg

SEQ ID NO: 2885358 - RNA, 13 nt, Mycobacterium avium subsp. paratuberculosis
ggccggccagcgg

SEQ ID NO: 2885359 - RNA, 15 nt, Mycobacterium avium subsp. paratuberculosis
ggccggccagcgggu

SEQ ID NO: 2885360 - RNA, 21 nt, Mycobacterium avium subsp. paratuberculosis
ggccggccagcgggucgugca

SEQ ID NO: 2885361 - RNA, 17 nt, Mycobacterium avium subsp. paratuberculosis
ggccggccaugaugaug

SEQ ID NO: 2885362 - RNA, 10 nt, Mycobacterium avium subsp. paratuberculosis
ggccggccca

SEQ ID NO: 2885363 - RNA, 15 nt, Mycobacterium avium subsp. paratuberculosis
ggccggcccagccuu

SEQ ID NO: 2885364 - RNA, 21 nt, Mycobacterium avium subsp. paratuberculosis
ggccggcccagccuucgccgc

SEQ ID NO: 2885365 - RNA, 14 nt, Mycobacterium avium subsp. paratuberculosis
ggccggcccagcgc

SEQ ID NO: 2885366 - RNA, 20 nt, Mycobacterium avium subsp. paratuberculosis
ggccggccccgcccggcgcg

SEQ ID NO: 2885367 - RNA, 15 nt, Mycobacterium avium subsp. paratuberculosis
ggccggccccggccg

SEQ ID NO: 2885368 - RNA, 22 nt, Mycobacterium avium subsp. paratuberculosis
ggccggccccgggggaccagcg

SEQ ID NO: 2885369 - RNA, 22 nt, Mycobacterium avium subsp. paratuberculosis
ggccggccccuaccgccgagcg

SEQ ID NO: 2885370 - RNA, 16 nt, Mycobacterium avium subsp. paratuberculosis
ggccggcccgcccggc

SEQ ID NO: 2885371 - RNA, 12 nt, Mycobacterium avium subsp. paratuberculosis
ggccggcccggc

SEQ ID NO: 2885372 - RNA, 15 nt, Mycobacterium avium subsp. paratuberculosis
ggccggcccugcacg

SEQ ID NO: 2885373 - RNA, 14 nt, Mycobacterium avium subsp. paratuberculosis
ggccggccgaacac

SEQ ID NO: 2885374 - RNA, 15 nt, Mycobacterium avium subsp. paratuberculosis
ggccggccgagccga

SEQ ID NO: 2885375 - RNA, 17 nt, Mycobacterium avium subsp. paratuberculosis
ggccggccgagccgagc

SEQ ID NO: 2885376 - RNA, 12 nt, Mycobacterium avium subsp. paratuberculosis
ggccggccgcag

SEQ ID NO: 2885377 - RNA, 23 nt, Mycobacterium avium subsp. paratuberculosis
ggccggccgcagcugcugcggcc

SEQ ID NO: 2885378 - RNA, 13 nt, Mycobacterium avium subsp. paratuberculosis
ggccggccgccgg

SEQ ID NO: 2885379 - RNA, 14 nt, Mycobacterium avium subsp. paratuberculosis
ggccggccgccggc

SEQ ID NO: 2885380 - RNA, 15 nt, Mycobacterium avium subsp. paratuberculosis
ggccggccgccggcg

SEQ ID NO: 2885381 - RNA, 13 nt, Mycobacterium avium subsp. paratuberculosis
ggccggccgccug

SEQ ID NO: 2885382 - RNA, 16 nt, Mycobacterium avium subsp. paratuberculosis
ggccggccgcgcccau

SEQ ID NO: 2885383 - RNA, 14 nt, Mycobacterium avium subsp. paratuberculosis
ggccggccgcgcgc

SEQ ID NO: 2885384 - RNA, 17 nt, Mycobacterium avium subsp. paratuberculosis
ggccggccggccgagcc

SEQ ID NO: 2885385 - RNA, 13 nt, Mycobacterium avium subsp. paratuberculosis
ggccggccggccu

SEQ ID NO: 2885386 - RNA, 14 nt, Mycobacterium avium subsp. paratuberculosis
ggccggccggguca

SEQ ID NO: 2885387 - RNA, 15 nt, Mycobacterium avium subsp. paratuberculosis
ggccggccucgaugu

SEQ ID NO: 2885388 - RNA, 16 nt, Mycobacterium avium subsp. paratuberculosis
ggccggccucgauguc

SEQ ID NO: 2885389 - RNA, 17 nt, Mycobacterium avium subsp. paratuberculosis
ggccggccucgaugucg

SEQ ID NO: 2885390 - RNA, 16 nt, Mycobacterium avium subsp. paratuberculosis
ggccggccugccaccg

SEQ ID NO: 2885391 - RNA, 17 nt, Mycobacterium avium subsp. paratuberculosis
ggccggccugccaccgc

SEQ ID NO: 2885392 - RNA, 19 nt, Mycobacterium avium subsp. paratuberculosis
ggccggccugccaccgcga

SEQ ID NO: 2885393 - RNA, 13 nt, Mycobacterium avium subsp. paratuberculosis
ggccggccugccg

SEQ ID NO: 2885394 - RNA, 17 nt, Mycobacterium avium subsp. paratuberculosis
ggccggccuugcucgcc

SEQ ID NO: 2885395 - RNA, 18 nt, Mycobacterium avium subsp. paratuberculosis
ggccggccuugcucgccg

SEQ ID NO: 2885396 - RNA, 19 nt, Mycobacterium avium subsp. paratuberculosis
ggccggccuugcucgccgc

SEQ ID NO: 2885397 - RNA, 20 nt, Mycobacterium avium subsp. paratuberculosis
ggccggcgaaacacagcagc

SEQ ID NO: 2885398 - RNA, 21 nt, Mycobacterium avium subsp. paratuberculosis
ggccggcgaaacacagcagca

SEQ ID NO: 2885399 - RNA, 18 nt, Mycobacterium avium subsp. paratuberculosis
ggccggcgaaccgccgca

SEQ ID NO: 2885400 - RNA, 12 nt, Mycobacterium avium subsp. paratuberculosis
ggccggcgaagg

SEQ ID NO: 2885401 - RNA, 23 nt, Mycobacterium avium subsp. paratuberculosis
ggccggcgaaggacagccggacg

SEQ ID NO: 2885402 - RNA, 17 nt, Mycobacterium avium subsp. paratuberculosis
ggccggcgacgccgcgc

SEQ ID NO: 2885403 - RNA, 18 nt, Mycobacterium avium subsp. paratuberculosis
ggccggcgacgccgcgcu

SEQ ID NO: 2885404 - RNA, 21 nt, Mycobacterium avium subsp. paratuberculosis
ggccggcgacgccgcgcuggc

SEQ ID NO: 2885405 - RNA, 23 nt, Mycobacterium avium subsp. paratuberculosis
ggccggcgacgccgcgcuggccg

SEQ ID NO: 2885406 - RNA, 17 nt, Mycobacterium avium subsp. paratuberculosis
ggccggcgacgccggcg

SEQ ID NO: 2885407 - RNA, 13 nt, Mycobacterium avium subsp. paratuberculosis
ggccgggcggacg

SEQ ID NO: 2885408 - RNA, 15 nt, Mycobacterium avium subsp. paratuberculosis
ggccgggcggacggc

SEQ ID NO: 2885409 - RNA, 12 nt, Mycobacterium avium subsp. paratuberculosis
ggccgggcgggc

SEQ ID NO: 2885410 - RNA, 15 nt, Mycobacterium avium subsp. paratuberculosis
ggccgggcgggcacc

SEQ ID NO: 2885411 - RNA, 12 nt, Mycobacterium avium subsp. paratuberculosis
ggccgggcgugc

SEQ ID NO: 2885412 - RNA, 17 nt, Mycobacterium avium subsp. paratuberculosis
ggccgggcgugcccggc

SEQ ID NO: 2885413 - RNA, 13 nt, Mycobacterium avium subsp. paratuberculosis
ggccgggcuacca

SEQ ID NO: 2885414 - RNA, 14 nt, Mycobacterium avium subsp. paratuberculosis
ggccgggcucccgc

SEQ ID NO: 2885415 - RNA, 23 nt, Mycobacterium avium subsp. paratuberculosis
ggccgggcugcccaccaccaggg

SEQ ID NO: 2885416 - RNA, 17 nt, Mycobacterium avium subsp. paratuberculosis
ggccgggcugcgcagca

SEQ ID NO: 2885417 - RNA, 14 nt, Mycobacterium avium subsp. paratuberculosis
ggccgggcuggcgc

SEQ ID NO: 2885418 - RNA, 17 nt, Mycobacterium avium subsp. paratuberculosis
ggccgggcugguccgga

SEQ ID NO: 2885419 - RNA, 23 nt, Mycobacterium avium subsp. paratuberculosis
ggccgggcugguccggaaccgcg

SEQ ID NO: 2885420 - RNA, 17 nt, Mycobacterium avium subsp. paratuberculosis
ggccggggcagacccgc

SEQ ID NO: 2885421 - RNA, 13 nt, Mycobacterium avium subsp. paratuberculosis
ggccggggccagc

SEQ ID NO: 2885422 - RNA, 17 nt, Mycobacterium avium subsp. paratuberculosis
ggccggggccagcaccc

SEQ ID NO: 2885423 - RNA, 14 nt, Mycobacterium avium subsp. paratuberculosis
ggccggggcgccac

SEQ ID NO: 2885424 - RNA, 15 nt, Mycobacterium avium subsp. paratuberculosis
ggccggggcggcggu

SEQ ID NO: 2885425 - RNA, 14 nt, Mycobacterium avium subsp. paratuberculosis
ggccggggcgggca

SEQ ID NO: 2885426 - RNA, 21 nt, Mycobacterium avium subsp. paratuberculosis
ggccggggcgggcacgucgcg

SEQ ID NO: 2885427 - RNA, 22 nt, Mycobacterium avium subsp. paratuberculosis
ggccggggcgggcacgucgcgc

SEQ ID NO: 2885428 - RNA, 18 nt, Mycobacterium avium subsp. paratuberculosis
ggccggggcuucgaacgc

SEQ ID NO: 2885429 - RNA, 16 nt, Mycobacterium avium subsp. paratuberculosis
ggccgggggcggcggc

SEQ ID NO: 2885430 - RNA, 17 nt, Mycobacterium avium subsp. paratuberculosis
ggccgggggcggcggcg

SEQ ID NO: 2885431 - RNA, 18 nt, Mycobacterium avium subsp. paratuberculosis
ggccgggggcggcggcgc

SEQ ID NO: 2885432 - RNA, 18 nt, Mycobacterium avium subsp. paratuberculosis
ggccggggggaggucgcg

SEQ ID NO: 2885433 - RNA, 20 nt, Mycobacterium avium subsp. paratuberculosis
ggccgggguguagcggaugg

SEQ ID NO: 2885434 - RNA, 22 nt, Mycobacterium avium subsp. paratuberculosis
ggccgggucacgugcacccacg

SEQ ID NO: 2885435 - RNA, 17 nt, Mycobacterium avium subsp. paratuberculosis
ggccggguccacgccga

SEQ ID NO: 2885436 - RNA, 18 nt, Mycobacterium avium subsp. paratuberculosis
ggccggguccacgccgag

SEQ ID NO: 2885437 - RNA, 14 nt, Mycobacterium avium subsp. paratuberculosis
ggccgggucgaacg

SEQ ID NO: 2885438 - RNA, 16 nt, Mycobacterium avium subsp. paratuberculosis
ggccgggucgaccgcg

SEQ ID NO: 2885439 - RNA, 15 nt, Mycobacterium avium subsp. paratuberculosis
ggccgggucgagcgc

SEQ ID NO: 2885440 - RNA, 16 nt, Mycobacterium avium subsp. paratuberculosis
ggccgggucgagcgcg

SEQ ID NO: 2885441 - RNA, 22 nt, Mycobacterium avium subsp. paratuberculosis
ggccgggucgagcgcgccgaga

SEQ ID NO: 2885442 - RNA, 15 nt, Mycobacterium avium subsp. paratuberculosis
ggccgggucgcaggc

SEQ ID NO: 2885443 - RNA, 17 nt, Mycobacterium avium subsp. paratuberculosis
ggccgggucgcaggcag

SEQ ID NO: 2885444 - RNA, 22 nt, Mycobacterium avium subsp. paratuberculosis
ggccgggucgcaggcagcagca

SEQ ID NO: 2885445 - RNA, 13 nt, Mycobacterium avium subsp. paratuberculosis
ggccgggucgccg

SEQ ID NO: 2885446 - RNA, 14 nt, Mycobacterium avium subsp. paratuberculosis
ggccgggucgccgu

SEQ ID NO: 2885447 - RNA, 18 nt, Mycobacterium avium subsp. paratuberculosis
ggccgggucgccgucgag

SEQ ID NO: 2885448 - RNA, 16 nt, Mycobacterium avium subsp. paratuberculosis
ggccggguguagcugg

SEQ ID NO: 2885449 - RNA, 14 nt, Mycobacterium avium subsp. paratuberculosis
ggccggguuccggu

SEQ ID NO: 2885450 - RNA, 18 nt, Mycobacterium avium subsp. paratuberculosis
ggccggguuuucgggccg

SEQ ID NO: 2885451 - RNA, 21 nt, Mycobacterium avium subsp. paratuberculosis
ggccggguuuucgggccgguc

SEQ ID NO: 2885452 - RNA, 22 nt, Mycobacterium avium subsp. paratuberculosis
ggccggguuuucgggccgguca

SEQ ID NO: 2885453 - RNA, 23 nt, Mycobacterium avium subsp. paratuberculosis
ggccgguaaaacuggccagcaua

SEQ ID NO: 2885454 - RNA, 16 nt, Mycobacterium avium subsp. paratuberculosis
ggccgguaucggguca

SEQ ID NO: 2885455 - RNA, 20 nt, Mycobacterium avium subsp. paratuberculosis
ggccgguaucgggucaccgu

SEQ ID NO: 2885456 - RNA, 22 nt, Mycobacterium avium subsp. paratuberculosis
ggccgguaucgggucaccgugc

SEQ ID NO: 2885457 - RNA, 21 nt, Mycobacterium avium subsp. paratuberculosis
ggccgguauuggccacgcugg

SEQ ID NO: 2885458 - RNA, 11 nt, Mycobacterium avium subsp. paratuberculosis
ggccggucagc

SEQ ID NO: 2885459 - RNA, 12 nt, Mycobacterium avium subsp. paratuberculosis
ggccggucagcg

SEQ ID NO: 2885460 - RNA, 13 nt, Mycobacterium avium subsp. paratuberculosis
ggccggucagcga

SEQ ID NO: 2885461 - RNA, 13 nt, Mycobacterium avium subsp. paratuberculosis
ggccggucagcgc

SEQ ID NO: 2885462 - RNA, 14 nt, Mycobacterium avium subsp. paratuberculosis
ggccggucagcgcg

SEQ ID NO: 2885463 - RNA, 17 nt, Mycobacterium avium subsp. paratuberculosis
ggccggucagcgcgaca

SEQ ID NO: 2885464 - RNA, 16 nt, Mycobacterium avium subsp. paratuberculosis
ggccgguccccggcga

SEQ ID NO: 2885465 - RNA, 18 nt, Mycobacterium avium subsp. paratuberculosis
ggccgguccccggcgacc

SEQ ID NO: 2885466 - RNA, 15 nt, Mycobacterium avium subsp. paratuberculosis
ggccgguccgcccag

SEQ ID NO: 2885467 - RNA, 14 nt, Mycobacterium avium subsp. paratuberculosis
ggccgguccgugca

SEQ ID NO: 2885468 - RNA, 15 nt, Mycobacterium avium subsp. paratuberculosis
ggccgguccgugcac

SEQ ID NO: 2885469 - RNA, 18 nt, Mycobacterium avium subsp. paratuberculosis
ggccgguccgugcacggc

SEQ ID NO: 2885470 - RNA, 14 nt, Mycobacterium avium subsp. paratuberculosis
ggccggucgaaggc

SEQ ID NO: 2885471 - RNA, 14 nt, Mycobacterium avium subsp. paratuberculosis
ggccggucgccgau

SEQ ID NO: 2885472 - RNA, 16 nt, Mycobacterium avium subsp. paratuberculosis
ggccggucgccgaugg

SEQ ID NO: 2885473 - RNA, 21 nt, Mycobacterium avium subsp. paratuberculosis
ggccggucggucagucgcgcc

SEQ ID NO: 2885474 - RNA, 19 nt, Mycobacterium avium subsp. paratuberculosis
ggccggucggucggccgca

SEQ ID NO: 2885475 - RNA, 14 nt, Mycobacterium avium subsp. paratuberculosis
ggccggugauggug

SEQ ID NO: 2885476 - RNA, 23 nt, Mycobacterium avium subsp. paratuberculosis
ggccggugauggugaucucgccg

SEQ ID NO: 2885477 - RNA, 13 nt, Mycobacterium avium subsp. paratuberculosis
ggccggugcagca

SEQ ID NO: 2885478 - RNA, 16 nt, Mycobacterium avium subsp. paratuberculosis
ggccggugcagcacgu

SEQ ID NO: 2885479 - RNA, 17 nt, Mycobacterium avium subsp. paratuberculosis
ggccggugccacgguca

SEQ ID NO: 2885480 - RNA, 14 nt, Mycobacterium avium subsp. paratuberculosis
ggccggugcgccga

SEQ ID NO: 2885481 - RNA, 16 nt, Mycobacterium avium subsp. paratuberculosis
ggccggugcgccgacc

SEQ ID NO: 2885482 - RNA, 19 nt, Mycobacterium avium subsp. paratuberculosis
ggccggugcgccgaccgcg

SEQ ID NO: 2885483 - RNA, 12 nt, Mycobacterium avium subsp. paratuberculosis
ggccggugcgga

SEQ ID NO: 2885484 - RNA, 19 nt, Mycobacterium avium subsp. paratuberculosis
ggccggugcguccgccggc

SEQ ID NO: 2885485 - RNA, 19 nt, Mycobacterium avium subsp. paratuberculosis
ggccggugcgugaugacca

SEQ ID NO: 2885486 - RNA, 15 nt, Mycobacterium avium subsp. paratuberculosis
ggccggugcugucca

SEQ ID NO: 2885487 - RNA, 12 nt, Mycobacterium avium subsp. paratuberculosis
ggccgguggccg

SEQ ID NO: 2885488 - RNA, 16 nt, Mycobacterium avium subsp. paratuberculosis
ggccgguggcgacaac

SEQ ID NO: 2885489 - RNA, 20 nt, Mycobacterium avium subsp. paratuberculosis
ggccgguggcgacaacaggc

SEQ ID NO: 2885490 - RNA, 16 nt, Mycobacterium avium subsp. paratuberculosis
ggccggugggcggcgc

SEQ ID NO: 2885491 - RNA, 17 nt, Mycobacterium avium subsp. paratuberculosis
ggccggugggcggcgcc

SEQ ID NO: 2885492 - RNA, 18 nt, Mycobacterium avium subsp. paratuberculosis
gcucgaugcgcaccugcg

SEQ ID NO: 2885493 - RNA, 21 nt, Mycobacterium avium subsp. paratuberculosis
gcucgaugcgcaccugcggcc

SEQ ID NO: 2885494 - RNA, 16 nt, Mycobacterium avium subsp. paratuberculosis
gcucgaugcgcgccag

SEQ ID NO: 2885495 - RNA, 17 nt, Mycobacterium avium subsp. paratuberculosis
gcucgaugcgcgccagc

SEQ ID NO: 2885496 - RNA, 20 nt, Mycobacterium avium subsp. paratuberculosis
gcucgaugcgcgccagcagc

SEQ ID NO: 2885497 - RNA, 17 nt, Mycobacterium avium subsp. paratuberculosis
gcucgaugcggcccugg

SEQ ID NO: 2885498 - RNA, 18 nt, Mycobacterium avium subsp. paratuberculosis
gcucgaugcggcccuggu

SEQ ID NO: 2885499 - RNA, 21 nt, Mycobacterium avium subsp. paratuberculosis
gcucgauggaccggguggugg

SEQ ID NO: 2885500 - RNA, 18 nt, Mycobacterium avium subsp. paratuberculosis
gcucgauggacgccagca

SEQ ID NO: 2885501 - RNA, 20 nt, Mycobacterium avium subsp. paratuberculosis
gcucgauggacgccagcaug

SEQ ID NO: 2885502 - RNA, 15 nt, Mycobacterium avium subsp. paratuberculosis
gcucgauggccagcg

SEQ ID NO: 2885503 - RNA, 16 nt, Mycobacterium avium subsp. paratuberculosis
gcucgauggccagcgc

SEQ ID NO: 2885504 - RNA, 14 nt, Mycobacterium avium subsp. paratuberculosis
gcucgauggcgccg

SEQ ID NO: 2885505 - RNA, 21 nt, Mycobacterium avium subsp. paratuberculosis
gcucgauggcgccgaucgcgc

SEQ ID NO: 2885506 - RNA, 19 nt, Mycobacterium avium subsp. paratuberculosis
gcucgauggugccgucggc

SEQ ID NO: 2885507 - RNA, 17 nt, Mycobacterium avium subsp. paratuberculosis
gcucgauguaccaggcc

SEQ ID NO: 2885508 - RNA, 19 nt, Mycobacterium avium subsp. paratuberculosis
gcucgauguugaucgccau

SEQ ID NO: 2885509 - RNA, 19 nt, Mycobacterium avium subsp. paratuberculosis
gcucgauuugucggauccc

SEQ ID NO: 2885510 - RNA, 14 nt, Mycobacterium avium subsp. paratuberculosis
gcucgcaccagcgc

SEQ ID NO: 2885511 - RNA, 16 nt, Mycobacterium avium subsp. paratuberculosis
gcucgcaggcgagccg

SEQ ID NO: 2885512 - RNA, 20 nt, Mycobacterium avium subsp. paratuberculosis
gcucgcaggcgagccgacag

SEQ ID NO: 2885513 - RNA, 18 nt, Mycobacterium avium subsp. paratuberculosis
gcucgcagucgaucagcg

SEQ ID NO: 2885514 - RNA, 21 nt, Mycobacterium avium subsp. paratuberculosis
gcucgccaccccgcgccacgc

SEQ ID NO: 2885515 - RNA, 13 nt, Mycobacterium avium subsp. paratuberculosis
gcucgccagacuc

SEQ ID NO: 2885516 - RNA, 14 nt, Mycobacterium avium subsp. paratuberculosis
gcucgcccagcacc

SEQ ID NO: 2885517 - RNA, 15 nt, Mycobacterium avium subsp. paratuberculosis
gcucgcccagcaccg

SEQ ID NO: 2885518 - RNA, 14 nt, Mycobacterium avium subsp. paratuberculosis
gcucgcccagcgcg

SEQ ID NO: 2885519 - RNA, 16 nt, Mycobacterium avium subsp. paratuberculosis
gcucgcccagcgcggc

SEQ ID NO: 2885520 - RNA, 17 nt, Mycobacterium avium subsp. paratuberculosis
gcucgcccagcgcggcg

SEQ ID NO: 2885521 - RNA, 19 nt, Mycobacterium avium subsp. paratuberculosis
gcucgcccagcgcggcggc

SEQ ID NO: 2885522 - RNA, 20 nt, Mycobacterium avium subsp. paratuberculosis
gcucgcccagcgcggcggcc

SEQ ID NO: 2885523 - RNA, 21 nt, Mycobacterium avium subsp. paratuberculosis
gcucgcccagcgcggcggcca

SEQ ID NO: 2885524 - RNA, 13 nt, Mycobacterium avium subsp. paratuberculosis
gcucgcccgcgac

SEQ ID NO: 2885525 - RNA, 21 nt, Mycobacterium avium subsp. paratuberculosis
gcucgcccgggcuaucgcccg

SEQ ID NO: 2885526 - RNA, 23 nt, Mycobacterium avium subsp. paratuberculosis
gcucgcccgggcuaucgcccggc

SEQ ID NO: 2885527 - RNA, 24 nt, Mycobacterium avium subsp. paratuberculosis
gcucgccgaaaugccgugccagcc

SEQ ID NO: 2885528 - RNA, 15 nt, Mycobacterium avium subsp. paratuberculosis
gcucgccgagcgugu

SEQ ID NO: 2885529 - RNA, 15 nt, Mycobacterium avium subsp. paratuberculosis
gcucgccgauccgcg

SEQ ID NO: 2885530 - RNA, 19 nt, Mycobacterium avium subsp. paratuberculosis
gcucgccgaucuggcgcag

SEQ ID NO: 2885531 - RNA, 22 nt, Mycobacterium avium subsp. paratuberculosis
gcucgccgaugacguugcgcgc

SEQ ID NO: 2885532 - RNA, 15 nt, Mycobacterium avium subsp. paratuberculosis
gcucgccgaugucgg

SEQ ID NO: 2885533 - RNA, 12 nt, Mycobacterium avium subsp. paratuberculosis
gcucgccgccga

SEQ ID NO: 2885534 - RNA, 13 nt, Mycobacterium avium subsp. paratuberculosis
gcucgccgcgcau

SEQ ID NO: 2885535 - RNA, 18 nt, Mycobacterium avium subsp. paratuberculosis
gcucgccgcgcggcccgc

SEQ ID NO: 2885536 - RNA, 12 nt, Mycobacterium avium subsp. paratuberculosis
gcucgccgcggc

SEQ ID NO: 2885537 - RNA, 14 nt, Mycobacterium avium subsp. paratuberculosis
gcucgccgcggcca

SEQ ID NO: 2885538 - RNA, 16 nt, Mycobacterium avium subsp. paratuberculosis
gcucgccgcggccacg

SEQ ID NO: 2885539 - RNA, 12 nt, Mycobacterium avium subsp. paratuberculosis
gcucgccgcgua

SEQ ID NO: 2885540 - RNA, 17 nt, Mycobacterium avium subsp. paratuberculosis
gcucgccgcguacgccg

SEQ ID NO: 2885541 - RNA, 18 nt, Mycobacterium avium subsp. paratuberculosis
gcucgccgcugucgucga

SEQ ID NO: 2885542 - RNA, 13 nt, Mycobacterium avium subsp. paratuberculosis
gcucgccggcccg

SEQ ID NO: 2885543 - RNA, 13 nt, Mycobacterium avium subsp. paratuberculosis
gcgaaucccggcc

SEQ ID NO: 2885544 - RNA, 15 nt, Mycobacterium avium subsp. paratuberculosis
gcgaauccgaccggc

SEQ ID NO: 2885545 - RNA, 19 nt, Mycobacterium avium subsp. paratuberculosis
gcgaauccgaccggcucag

SEQ ID NO: 2885546 - RNA, 19 nt, Mycobacterium avium subsp. paratuberculosis
gcgaauccgauugcggcgc

SEQ ID NO: 2885547 - RNA, 16 nt, Mycobacterium avium subsp. paratuberculosis
gcgaauccgggccucc

SEQ ID NO: 2885548 - RNA, 22 nt, Mycobacterium avium subsp. paratuberculosis
gcgaauccgggugucgacgccg

SEQ ID NO: 2885549 - RNA, 20 nt, Mycobacterium avium subsp. paratuberculosis
gcgaauccggucaacgccgc

SEQ ID NO: 2885550 - RNA, 20 nt, Mycobacterium avium subsp. paratuberculosis
gcgaaucgaccggguuggcg

SEQ ID NO: 2885551 - RNA, 20 nt, Mycobacterium avium subsp. paratuberculosis
gcgaaucgccuuggcucggg

SEQ ID NO: 2885552 - RNA, 17 nt, Mycobacterium avium subsp. paratuberculosis
gcgaaucggcgcacagc

SEQ ID NO: 2885553 - RNA, 15 nt, Mycobacterium avium subsp. paratuberculosis
gcgaaucgguccggc

SEQ ID NO: 2885554 - RNA, 14 nt, Mycobacterium avium subsp. paratuberculosis
gcgaaucgucggcg

SEQ ID NO: 2885555 - RNA, 18 nt, Mycobacterium avium subsp. paratuberculosis
gcgaaucugucgauggcg

SEQ ID NO: 2885556 - RNA, 16 nt, Mycobacterium avium subsp. paratuberculosis
gcgaaugcggccaugu

SEQ ID NO: 2885557 - RNA, 20 nt, Mycobacterium avium subsp. paratuberculosis
gcgaaugucgaccaccgggu

SEQ ID NO: 2885558 - RNA, 22 nt, Mycobacterium avium subsp. paratuberculosis
gcgaauucgcagguucgacacg

SEQ ID NO: 2885559 - RNA, 22 nt, Mycobacterium avium subsp. paratuberculosis
gcgaauucggugaucgcggugg

SEQ ID NO: 2885560 - RNA, 14 nt, Mycobacterium avium subsp. paratuberculosis
gcgacaaaggaggg

SEQ ID NO: 2885561 - RNA, 17 nt, Mycobacterium avium subsp. paratuberculosis
gcgacaaaggaggggcg

SEQ ID NO: 2885562 - RNA, 21 nt, Mycobacterium avium subsp. paratuberculosis
gcgacaaaggaggggcgcggc

SEQ ID NO: 2885563 - RNA, 22 nt, Mycobacterium avium subsp. paratuberculosis
gcgacaaaggaggggcgcggca

SEQ ID NO: 2885564 - RNA, 13 nt, Mycobacterium avium subsp. paratuberculosis
gcgacaacagcgc

SEQ ID NO: 2885565 - RNA, 17 nt, Mycobacterium avium subsp. paratuberculosis
gcgacaacagcgccgag

SEQ ID NO: 2885566 - RNA, 14 nt, Mycobacterium avium subsp. paratuberculosis
gcgacaacaggcga

SEQ ID NO: 2885567 - RNA, 17 nt, Mycobacterium avium subsp. paratuberculosis
gcgacaacaggcgaccu

SEQ ID NO: 2885568 - RNA, 17 nt, Mycobacterium avium subsp. paratuberculosis
gcgacaacgggccgccu

SEQ ID NO: 2885569 - RNA, 21 nt, Mycobacterium avium subsp. paratuberculosis
gcgacaacguggugugcacca

SEQ ID NO: 2885570 - RNA, 23 nt, Mycobacterium avium subsp. paratuberculosis
gcgacaacguggugugcaccagc

SEQ ID NO: 2885571 - RNA, 18 nt, Mycobacterium avium subsp. paratuberculosis
gcgacaaggucgaccgcg

SEQ ID NO: 2885572 - RNA, 20 nt, Mycobacterium avium subsp. paratuberculosis
gcgacaaggucgaccgcgca

SEQ ID NO: 2885573 - RNA, 17 nt, Mycobacterium avium subsp. paratuberculosis
gcgacaaucggcucgcc

SEQ ID NO: 2885574 - RNA, 12 nt, Mycobacterium avium subsp. paratuberculosis
gcgacaccacgg

SEQ ID NO: 2885575 - RNA, 15 nt, Mycobacterium avium subsp. paratuberculosis
gcgacacccagcggc

SEQ ID NO: 2885576 - RNA, 16 nt, Mycobacterium avium subsp. paratuberculosis
gcgacacccagcggcg

SEQ ID NO: 2885577 - RNA, 21 nt, Mycobacterium avium subsp. paratuberculosis
gcgacacccagcggcgcggcc

SEQ ID NO: 2885578 - RNA, 21 nt, Mycobacterium avium subsp. paratuberculosis
gcgacaccccgcgagucaccg

SEQ ID NO: 2885579 - RNA, 11 nt, Mycobacterium avium subsp. paratuberculosis
gcgacaccgca

SEQ ID NO: 2885580 - RNA, 17 nt, Mycobacterium avium subsp. paratuberculosis
gcgacaccgcauggccg

SEQ ID NO: 2885581 - RNA, 22 nt, Mycobacterium avium subsp. paratuberculosis
gcgacaccgcauggccggcgaa

SEQ ID NO: 2885582 - RNA, 15 nt, Mycobacterium avium subsp. paratuberculosis
gcgacaccgcggcga

SEQ ID NO: 2885583 - RNA, 16 nt, Mycobacterium avium subsp. paratuberculosis
gcgacaccgcggcgac

SEQ ID NO: 2885584 - RNA, 19 nt, Mycobacterium avium subsp. paratuberculosis
gcgacaccgcggcgacguc

SEQ ID NO: 2885585 - RNA, 13 nt, Mycobacterium avium subsp. paratuberculosis
gcgacaccgcguc

SEQ ID NO: 2885586 - RNA, 22 nt, Mycobacterium avium subsp. paratuberculosis
gcgacaccggacugcuugggcg

SEQ ID NO: 2885587 - RNA, 13 nt, Mycobacterium avium subsp. paratuberculosis
gcgacaccggcgu

SEQ ID NO: 2885588 - RNA, 14 nt, Mycobacterium avium subsp. paratuberculosis
gcgacaccggcgug

SEQ ID NO: 2885589 - RNA, 15 nt, Mycobacterium avium subsp. paratuberculosis
gcgacaccugcucac

SEQ ID NO: 2885590 - RNA, 23 nt, Mycobacterium avium subsp. paratuberculosis
gcgacaccugcucaccgagcugg

SEQ ID NO: 2885591 - RNA, 14 nt, Mycobacterium avium subsp. paratuberculosis
gcgacacgccgacg

SEQ ID NO: 2885592 - RNA, 17 nt, Mycobacterium avium subsp. paratuberculosis
gcgacacgccgacgauc

SEQ ID NO: 2885593 - RNA, 23 nt, Mycobacterium avium subsp. paratuberculosis
gcgacacgccgacgauccgcgcc

SEQ ID NO: 2885594 - RNA, 14 nt, Mycobacterium avium subsp. paratuberculosis
gcgacacgccgcgc

SEQ ID NO: 2885595 - RNA, 20 nt, Mycobacterium avium subsp. paratuberculosis
gcgacacggaaaccgcugcg

SEQ ID NO: 2885596 - RNA, 23 nt, Mycobacterium avium subsp. paratuberculosis
gcgacacggaaaccgcugcggca

SEQ ID NO: 2885597 - RNA, 14 nt, Mycobacterium avium subsp. paratuberculosis
gcgacacguccagc

SEQ ID NO: 2885598 - RNA, 13 nt, Mycobacterium avium subsp. paratuberculosis
gcgacacgucgac

SEQ ID NO: 2885599 - RNA, 14 nt, Mycobacterium avium subsp. paratuberculosis
gcgacacgucgaca

SEQ ID NO: 2885600 - RNA, 23 nt, Mycobacterium avium subsp. paratuberculosis
gcgacacgucgacacgccggccg

SEQ ID NO: 2885601 - RNA, 24 nt, Mycobacterium avium subsp. paratuberculosis
gcgacacugcaacuacgcacccga

SEQ ID NO: 2885602 - RNA, 15 nt, Mycobacterium avium subsp. paratuberculosis
gcgacagaaaucgcg

SEQ ID NO: 2885603 - RNA, 13 nt, Mycobacterium avium subsp. paratuberculosis
gcgacagcacccg

SEQ ID NO: 2885604 - RNA, 16 nt, Mycobacterium avium subsp. paratuberculosis
gcgacagcacccgcug

SEQ ID NO: 2885605 - RNA, 14 nt, Mycobacterium avium subsp. paratuberculosis
ggccagcucgccgc

SEQ ID NO: 2885606 - RNA, 19 nt, Mycobacterium avium subsp. paratuberculosis
ggccagcucgccgccgacg

SEQ ID NO: 2885607 - RNA, 15 nt, Mycobacterium avium subsp. paratuberculosis
ggccagcucggccau

SEQ ID NO: 2885608 - RNA, 16 nt, Mycobacterium avium subsp. paratuberculosis
ggccagcucggcccgc

SEQ ID NO: 2885609 - RNA, 13 nt, Mycobacterium avium subsp. paratuberculosis
ggccagcucggcg

SEQ ID NO: 2885610 - RNA, 14 nt, Mycobacterium avium subsp. paratuberculosis
ggccagcucggcgg

SEQ ID NO: 2885611 - RNA, 15 nt, Mycobacterium avium subsp. paratuberculosis
ggccagcucggcggc

SEQ ID NO: 2885612 - RNA, 22 nt, Mycobacterium avium subsp. paratuberculosis
ggccagcucggcguggucgagg

SEQ ID NO: 2885613 - RNA, 12 nt, Mycobacterium avium subsp. paratuberculosis
ggccagcucggu

SEQ ID NO: 2885614 - RNA, 16 nt, Mycobacterium avium subsp. paratuberculosis
ggccagcucggucagc

SEQ ID NO: 2885615 - RNA, 17 nt, Mycobacterium avium subsp. paratuberculosis
ggccagcucggucagcc

SEQ ID NO: 2885616 - RNA, 22 nt, Mycobacterium avium subsp. paratuberculosis
ggccagcucggucagccgggcg

SEQ ID NO: 2885617 - RNA, 17 nt, Mycobacterium avium subsp. paratuberculosis
ggccagcucggucgcgg

SEQ ID NO: 2885618 - RNA, 22 nt, Mycobacterium avium subsp. paratuberculosis
ggccagcucggucgcggucggc

SEQ ID NO: 2885619 - RNA, 13 nt, Mycobacterium avium subsp. paratuberculosis
ggccagcucgucg

SEQ ID NO: 2885620 - RNA, 20 nt, Mycobacterium avium subsp. paratuberculosis
ggccagcucgucgagccggc

SEQ ID NO: 2885621 - RNA, 22 nt, Mycobacterium avium subsp. paratuberculosis
ggccagcucgucgagccggccg

SEQ ID NO: 2885622 - RNA, 24 nt, Mycobacterium avium subsp. paratuberculosis
ggccagcucgucgagccggccgga

SEQ ID NO: 2885623 - RNA, 17 nt, Mycobacterium avium subsp. paratuberculosis
ggccagcucgucgcgga

SEQ ID NO: 2885624 - RNA, 20 nt, Mycobacterium avium subsp. paratuberculosis
ggccagcugauagccgcccu

SEQ ID NO: 2885625 - RNA, 22 nt, Mycobacterium avium subsp. paratuberculosis
ggccagcugauagccgcccugc

SEQ ID NO: 2885626 - RNA, 18 nt, Mycobacterium avium subsp. paratuberculosis
ggccagcugcaccggggc

SEQ ID NO: 2885627 - RNA, 21 nt, Mycobacterium avium subsp. paratuberculosis
ggccagcugcaccggggccgg

SEQ ID NO: 2885628 - RNA, 19 nt, Mycobacterium avium subsp. paratuberculosis
ggccagcugcccgccgacg

SEQ ID NO: 2885629 - RNA, 22 nt, Mycobacterium avium subsp. paratuberculosis
ggccagcugcccgccgacgccc

SEQ ID NO: 2885630 - RNA, 12 nt, Mycobacterium avium subsp. paratuberculosis
ggccagcugcgu

SEQ ID NO: 2885631 - RNA, 16 nt, Mycobacterium avium subsp. paratuberculosis
ggccagcuugcagcug

SEQ ID NO: 2885632 - RNA, 19 nt, Mycobacterium avium subsp. paratuberculosis
ggccagcuuuccggccgcc

SEQ ID NO: 2885633 - RNA, 20 nt, Mycobacterium avium subsp. paratuberculosis
ggccagcuuuccggccgccu

SEQ ID NO: 2885634 - RNA, 16 nt, Mycobacterium avium subsp. paratuberculosis
ggccaggaacggcgcc

SEQ ID NO: 2885635 - RNA, 16 nt, Mycobacterium avium subsp. paratuberculosis
ggccaggaagccggcg

SEQ ID NO: 2885636 - RNA, 17 nt, Mycobacterium avium subsp. paratuberculosis
ggccaggaagccggcga

SEQ ID NO: 2885637 - RNA, 19 nt, Mycobacterium avium subsp. paratuberculosis
ggccaggaagccggcgacg

SEQ ID NO: 2885638 - RNA, 20 nt, Mycobacterium avium subsp. paratuberculosis
ggccaggaagccggcgacga

SEQ ID NO: 2885639 - RNA, 22 nt, Mycobacterium avium subsp. paratuberculosis
ggccaggaaguccuuguucgcc

SEQ ID NO: 2885640 - RNA, 12 nt, Mycobacterium avium subsp. paratuberculosis
ggccaggaccgg

SEQ ID NO: 2885641 - RNA, 20 nt, Mycobacterium avium subsp. paratuberculosis
ggccaggaccggauccacca

SEQ ID NO: 2885642 - RNA, 14 nt, Mycobacterium avium subsp. paratuberculosis
ggccaggaccggga

SEQ ID NO: 2885643 - RNA, 22 nt, Mycobacterium avium subsp. paratuberculosis
ggccaggaccgggacgacggcg

SEQ ID NO: 2885644 - RNA, 20 nt, Mycobacterium avium subsp. paratuberculosis
ggccaggaugaccgcccagg

SEQ ID NO: 2885645 - RNA, 22 nt, Mycobacterium avium subsp. paratuberculosis
ggccaggaugaccgcccaggac

SEQ ID NO: 2885646 - RNA, 19 nt, Mycobacterium avium subsp. paratuberculosis
ggccaggaugccgaacgcg

SEQ ID NO: 2885647 - RNA, 24 nt, Mycobacterium avium subsp. paratuberculosis
ggccaggaugccgaacgcgaucca

SEQ ID NO: 2885648 - RNA, 17 nt, Mycobacterium avium subsp. paratuberculosis
ggccaggcacggcccgu

SEQ ID NO: 2885649 - RNA, 16 nt, Mycobacterium avium subsp. paratuberculosis
ggccaggcccagcccg

SEQ ID NO: 2885650 - RNA, 22 nt, Mycobacterium avium subsp. paratuberculosis
ggccaggcccagcccggcccca

SEQ ID NO: 2885651 - RNA, 18 nt, Mycobacterium avium subsp. paratuberculosis
ggccaggcccugccagcg

SEQ ID NO: 2885652 - RNA, 13 nt, Mycobacterium avium subsp. paratuberculosis
ggccaggccggcg

SEQ ID NO: 2885653 - RNA, 13 nt, Mycobacterium avium subsp. paratuberculosis
ggccaggccuccc

SEQ ID NO: 2885654 - RNA, 13 nt, Mycobacterium avium subsp. paratuberculosis
ggccaggcgccca

SEQ ID NO: 2885655 - RNA, 14 nt, Mycobacterium avium subsp. paratuberculosis
ggccaggcgcgcgc

SEQ ID NO: 2885656 - RNA, 16 nt, Mycobacterium avium subsp. paratuberculosis
ggccaggcgcgcgcug

SEQ ID NO: 2885657 - RNA, 14 nt, Mycobacterium avium subsp. paratuberculosis
ggccaggcgcgcgu

SEQ ID NO: 2885658 - RNA, 14 nt, Mycobacterium avium subsp. paratuberculosis
ggccaggcgggacg

SEQ ID NO: 2885659 - RNA, 12 nt, Mycobacterium avium subsp. paratuberculosis
ggccaggcgggc

SEQ ID NO: 2885660 - RNA, 14 nt, Mycobacterium avium subsp. paratuberculosis
ggccaggcggguga

SEQ ID NO: 2885661 - RNA, 21 nt, Mycobacterium avium subsp. paratuberculosis
ggccaggcgggugaucccgau

SEQ ID NO: 2885662 - RNA, 14 nt, Mycobacterium avium subsp. paratuberculosis
ggccaggcguuugg

SEQ ID NO: 2885663 - RNA, 16 nt, Mycobacterium avium subsp. paratuberculosis
ggccaggcuggcgucg

SEQ ID NO: 2885664 - RNA, 14 nt, Mycobacterium avium subsp. paratuberculosis
ggccagggcccgca

SEQ ID NO: 2885665 - RNA, 17 nt, Mycobacterium avium subsp. paratuberculosis
ggccagggcccgcagcc

SEQ ID NO: 2885666 - RNA, 16 nt, Mycobacterium avium subsp. paratuberculosis
ggccagggccgccgca

SEQ ID NO: 2885667 - RNA, 13 nt, Mycobacterium avium subsp. paratuberculosis
ggccagggcgagg

SEQ ID NO: 2885668 - RNA, 12 nt, Mycobacterium avium subsp. paratuberculosis
ggccagggcggc

SEQ ID NO: 2885669 - RNA, 13 nt, Mycobacterium avium subsp. paratuberculosis
ggccagggcggcg

SEQ ID NO: 2885670 - RNA, 15 nt, Mycobacterium avium subsp. paratuberculosis
ggccagggcggcgcc

SEQ ID NO: 2885671 - RNA, 16 nt, Mycobacterium avium subsp. paratuberculosis
ggccagggcggcgccg

SEQ ID NO: 2885672 - RNA, 18 nt, Mycobacterium avium subsp. paratuberculosis
ggccagggcggcgccggc

SEQ ID NO: 2885673 - RNA, 19 nt, Mycobacterium avium subsp. paratuberculosis
ggccaggguagaggcggcg

SEQ ID NO: 2885674 - RNA, 22 nt, Mycobacterium avium subsp. paratuberculosis
ggccaggguagaggcggcgacc

SEQ ID NO: 2885675 - RNA, 12 nt, Mycobacterium avium subsp. paratuberculosis
ggccagggugac

SEQ ID NO: 2885676 - RNA, 14 nt, Mycobacterium avium subsp. paratuberculosis
ggccagggugccga

SEQ ID NO: 2885677 - RNA, 15 nt, Mycobacterium avium subsp. paratuberculosis
ggccaggguguccca

SEQ ID NO: 2885678 - RNA, 17 nt, Mycobacterium avium subsp. paratuberculosis
ggccagggugucccagc

SEQ ID NO: 2885679 - RNA, 21 nt, Mycobacterium avium subsp. paratuberculosis
ggccagggugucccagcgcca

SEQ ID NO: 2885680 - RNA, 17 nt, Mycobacterium avium subsp. paratuberculosis
ggccagguacuccucga

SEQ ID NO: 2885681 - RNA, 17 nt, Mycobacterium avium subsp. paratuberculosis
ggccagguagugguggg

SEQ ID NO: 2885682 - RNA, 22 nt, Mycobacterium avium subsp. paratuberculosis
ggccagguaguggugggcgugc

SEQ ID NO: 2885683 - RNA, 17 nt, Mycobacterium avium subsp. paratuberculosis
ggccaggucccaggcgu

SEQ ID NO: 2885684 - RNA, 20 nt, Mycobacterium avium subsp. paratuberculosis
ggccaggucccaggcguggu

SEQ ID NO: 2885685 - RNA, 14 nt, Mycobacterium avium subsp. paratuberculosis
ggccaggucgagcg

SEQ ID NO: 2885686 - RNA, 17 nt, Mycobacterium avium subsp. paratuberculosis
ggccaggucgccgcgca

SEQ ID NO: 2885687 - RNA, 20 nt, Mycobacterium avium subsp. paratuberculosis
ggccaggucgccgcgcagca

SEQ ID NO: 2885688 - RNA, 14 nt, Mycobacterium avium subsp. paratuberculosis
ggccaggucgcuga

SEQ ID NO: 2885689 - RNA, 12 nt, Mycobacterium avium subsp. paratuberculosis
ggccaggucggu

SEQ ID NO: 2885690 - RNA, 15 nt, Mycobacterium avium subsp. paratuberculosis
ggccaggucggugac

SEQ ID NO: 2885691 - RNA, 14 nt, Mycobacterium avium subsp. paratuberculosis
ggccaggugcacgc

SEQ ID NO: 2885692 - RNA, 21 nt, Mycobacterium avium subsp. paratuberculosis
ggccaggugcacgccgagcag

SEQ ID NO: 2885693 - RNA, 22 nt, Mycobacterium avium subsp. paratuberculosis
ggccaggugcacgccgagcagc

SEQ ID NO: 2885694 - RNA, 23 nt, Mycobacterium avium subsp. paratuberculosis
ggccaggugcacgccgagcagca

SEQ ID NO: 2885695 - RNA, 13 nt, Mycobacterium avium subsp. paratuberculosis
ggccagguggccg

SEQ ID NO: 2885696 - RNA, 15 nt, Mycobacterium avium subsp. paratuberculosis
ggccagguggccgcu

SEQ ID NO: 2885697 - RNA, 20 nt, Mycobacterium avium subsp. paratuberculosis
ggccagguggccgcuuucca

SEQ ID NO: 2885698 - RNA, 22 nt, Mycobacterium avium subsp. paratuberculosis
ggccagguucaggcccgcgccg

SEQ ID NO: 2885699 - RNA, 23 nt, Mycobacterium avium subsp. paratuberculosis
ggccagguucaggcccgcgccga

SEQ ID NO: 2885700 - RNA, 17 nt, Mycobacterium avium subsp. paratuberculosis
ggccagguucaggcuga

SEQ ID NO: 2885701 - RNA, 14 nt, Mycobacterium avium subsp. paratuberculosis
ggccagguucgcgc

SEQ ID NO: 2885702 - RNA, 15 nt, Mycobacterium avium subsp. paratuberculosis
ggccagguucgcgcc

SEQ ID NO: 2885703 - RNA, 16 nt, Mycobacterium avium subsp. paratuberculosis
ggccagguucgcgccg

SEQ ID NO: 2885704 - RNA, 17 nt, Mycobacterium avium subsp. paratuberculosis
ggccagguucgcgccga

SEQ ID NO: 2885705 - RNA, 16 nt, Mycobacterium avium subsp. paratuberculosis
ggccagguugaccacc

SEQ ID NO: 2885706 - RNA, 16 nt, Mycobacterium avium subsp. paratuberculosis
ggccagguugccacgc

SEQ ID NO: 2885707 - RNA, 19 nt, Mycobacterium avium subsp. paratuberculosis
ggccagguuggucagcagc

SEQ ID NO: 2885708 - RNA, 15 nt, Mycobacterium avium subsp. paratuberculosis
ggccagguugucguc

SEQ ID NO: 2885709 - RNA, 23 nt, Mycobacterium avium subsp. paratuberculosis
ggccaguccagcgaaucgaccgg

SEQ ID NO: 2885710 - RNA, 16 nt, Mycobacterium avium subsp. paratuberculosis
ggccaguccaggccgc

SEQ ID NO: 2885711 - RNA, 18 nt, Mycobacterium avium subsp. paratuberculosis
ggccaguccaggccgccg

SEQ ID NO: 2885712 - RNA, 15 nt, Mycobacterium avium subsp. paratuberculosis
ggccaguccggcagc

SEQ ID NO: 2885713 - RNA, 16 nt, Mycobacterium avium subsp. paratuberculosis
ggccaguccggcagca

SEQ ID NO: 2885714 - RNA, 22 nt, Mycobacterium avium subsp. paratuberculosis
ggccaguccggcagcagcgagu

SEQ ID NO: 2885715 - RNA, 18 nt, Mycobacterium avium subsp. paratuberculosis
ggccagucgaaguucggc

SEQ ID NO: 2885716 - RNA, 20 nt, Mycobacterium avium subsp. paratuberculosis
ggccagucgaaguucggcau

SEQ ID NO: 2885717 - RNA, 22 nt, Mycobacterium avium subsp. paratuberculosis
ggccagucgaaguucggcaucu

SEQ ID NO: 2885718 - RNA, 15 nt, Mycobacterium avium subsp. paratuberculosis
ggccagucgccgcgc

SEQ ID NO: 2885719 - RNA, 17 nt, Mycobacterium avium subsp. paratuberculosis
ggccaguucaccgcgcu

SEQ ID NO: 2885720 - RNA, 15 nt, Mycobacterium avium subsp. paratuberculosis
ggccaguucccgggc

SEQ ID NO: 2885721 - RNA, 15 nt, Mycobacterium avium subsp. paratuberculosis
ggccaguucgccggu

SEQ ID NO: 2885722 - RNA, 15 nt, Mycobacterium avium subsp. paratuberculosis
ggccaguucgggucc

SEQ ID NO: 2885723 - RNA, 13 nt, Mycobacterium avium subsp. paratuberculosis
ggccaguucgucg

SEQ ID NO: 2885724 - RNA, 15 nt, Mycobacterium avium subsp. paratuberculosis
ggccaguucgucgcg

SEQ ID NO: 2885725 - RNA, 16 nt, Mycobacterium avium subsp. paratuberculosis
ggccaguucgucgcgc

SEQ ID NO: 2885726 - RNA, 17 nt, Mycobacterium avium subsp. paratuberculosis
ggccaguucgucgcgcg

SEQ ID NO: 2885727 - RNA, 21 nt, Mycobacterium avium subsp. paratuberculosis
ggccaguugaaguccggcggu

SEQ ID NO: 2885728 - RNA, 22 nt, Mycobacterium avium subsp. paratuberculosis
ggccaguugaaguccggcgguc

SEQ ID NO: 2885729 - RNA, 23 nt, Mycobacterium avium subsp. paratuberculosis
ggccaguugaaguccggcggucg

SEQ ID NO: 2885730 - RNA, 16 nt, Mycobacterium avium subsp. paratuberculosis
ggccaucaccuccuug

SEQ ID NO: 2885731 - RNA, 15 nt, Mycobacterium avium subsp. paratuberculosis
ggccaucacggugcc

SEQ ID NO: 2885732 - RNA, 17 nt, Mycobacterium avium subsp. paratuberculosis
ggccaucacggugccga

SEQ ID NO: 2885733 - RNA, 19 nt, Mycobacterium avium subsp. paratuberculosis
ggccaucacggugccgagu

SEQ ID NO: 2885734 - RNA, 16 nt, Mycobacterium avium subsp. paratuberculosis
ggccaucagcaccgaa

SEQ ID NO: 2885735 - RNA, 22 nt, Mycobacterium avium subsp. paratuberculosis
ggccaucagccgccgucgcgcc

SEQ ID NO: 2885736 - RNA, 23 nt, Mycobacterium avium subsp. paratuberculosis
ggccaucagccgccgucgcgcca

SEQ ID NO: 2885737 - RNA, 17 nt, Mycobacterium avium subsp. paratuberculosis
ggccaucaugcccacca

SEQ ID NO: 2885738 - RNA, 22 nt, Mycobacterium avium subsp. paratuberculosis
ggccauccccgcguuggccagc

SEQ ID NO: 2885739 - RNA, 14 nt, Mycobacterium avium subsp. paratuberculosis
ggccaucccgggga

SEQ ID NO: 2885740 - RNA, 21 nt, Mycobacterium avium subsp. paratuberculosis
ggccaucccggggacaccggg

SEQ ID NO: 2885741 - RNA, 17 nt, Mycobacterium avium subsp. paratuberculosis
ggccaucccggugccgc

SEQ ID NO: 2885742 - RNA, 17 nt, Mycobacterium avium subsp. paratuberculosis
ggccauccgcugcgcgu

SEQ ID NO: 2885743 - RNA, 15 nt, Mycobacterium avium subsp. paratuberculosis
ggccauccggccggc

SEQ ID NO: 2885744 - RNA, 16 nt, Mycobacterium avium subsp. paratuberculosis
ggccauccggccggcg

SEQ ID NO: 2885745 - RNA, 18 nt, Mycobacterium avium subsp. paratuberculosis
ggccauccggccggcgag

SEQ ID NO: 2885746 - RNA, 22 nt, Mycobacterium avium subsp. paratuberculosis
ggccauccugaagaagcggccg

SEQ ID NO: 2885747 - RNA, 21 nt, Mycobacterium avium subsp. paratuberculosis
ggccaucgacuccaccaccug

SEQ ID NO: 2885748 - RNA, 15 nt, Mycobacterium avium subsp. paratuberculosis
ggccaucgacuccag

SEQ ID NO: 2885749 - RNA, 17 nt, Mycobacterium avium subsp. paratuberculosis
ggccaucgacuccagca

SEQ ID NO: 2885750 - RNA, 18 nt, Mycobacterium avium subsp. paratuberculosis
ggccaucgacuccagcac

SEQ ID NO: 2885751 - RNA, 12 nt, Mycobacterium avium subsp. paratuberculosis
ggccaucgccag

SEQ ID NO: 2885752 - RNA, 14 nt, Mycobacterium avium subsp. paratuberculosis
ggccaucgccagga

SEQ ID NO: 2885753 - RNA, 16 nt, Mycobacterium avium subsp. paratuberculosis
ggccaucgccgagccg

SEQ ID NO: 2885754 - RNA, 17 nt, Mycobacterium avium subsp. paratuberculosis
ggccaucgccgccaucg

SEQ ID NO: 2885755 - RNA, 13 nt, Mycobacterium avium subsp. paratuberculosis
ggccaucgccgcg

SEQ ID NO: 2885756 - RNA, 14 nt, Mycobacterium avium subsp. paratuberculosis
ggccaucgccgcgg

SEQ ID NO: 2885757 - RNA, 15 nt, Mycobacterium avium subsp. paratuberculosis
ggccaucgccgcggu

SEQ ID NO: 2885758 - RNA, 20 nt, Mycobacterium avium subsp. paratuberculosis
ggccaucgccgcgguggcgc

SEQ ID NO: 2885759 - RNA, 15 nt, Mycobacterium avium subsp. paratuberculosis
ggccaucgccugagc

SEQ ID NO: 2885760 - RNA, 14 nt, Mycobacterium avium subsp. paratuberculosis
ggccaucgcggccc

SEQ ID NO: 2885761 - RNA, 15 nt, Mycobacterium avium subsp. paratuberculosis
ggccaucgcggcccc

SEQ ID NO: 2885762 - RNA, 20 nt, Mycobacterium avium subsp. paratuberculosis
ggccaucgcggcccccacgc

SEQ ID NO: 2885763 - RNA, 22 nt, Mycobacterium avium subsp. paratuberculosis
ggccaucgcggcccccacgcag

SEQ ID NO: 2885764 - RNA, 23 nt, Mycobacterium avium subsp. paratuberculosis
ggccaucgcggcccccacgcagc

SEQ ID NO: 2885765 - RNA, 19 nt, Mycobacterium avium subsp. paratuberculosis
ggccaucggcagacccagc

SEQ ID NO: 2885766 - RNA, 23 nt, Mycobacterium avium subsp. paratuberculosis
ggccaucgucaucuugucggccu

SEQ ID NO: 2885767 - RNA, 22 nt, Mycobacterium avium subsp. paratuberculosis
ggccaucuccugcacgcgcggg

SEQ ID NO: 2885768 - RNA, 15 nt, Mycobacterium avium subsp. paratuberculosis
ggccaucucggcggc

SEQ ID NO: 2885769 - RNA, 22 nt, Mycobacterium avium subsp. paratuberculosis
ggccaugaacugguuccacacc

SEQ ID NO: 2885770 - RNA, 21 nt, Mycobacterium avium subsp. paratuberculosis
ggccaugaccaugucgacgcu

SEQ ID NO: 2885771 - RNA, 22 nt, Mycobacterium avium subsp. paratuberculosis
ggccaugaccaugucgacgcug

SEQ ID NO: 2885772 - RNA, 20 nt, Mycobacterium avium subsp. paratuberculosis
ggccaugagcuaggucaccg

SEQ ID NO: 2885773 - RNA, 16 nt, Mycobacterium avium subsp. paratuberculosis
ggccaugcagaccagc

SEQ ID NO: 2885774 - RNA, 19 nt, Mycobacterium avium subsp. paratuberculosis
ggccaugcagaccagcccg

SEQ ID NO: 2885775 - RNA, 14 nt, Mycobacterium avium subsp. paratuberculosis
ggccaugccgcgcu

SEQ ID NO: 2885776 - RNA, 14 nt, Mycobacterium avium subsp. paratuberculosis
ggccaugccggccu

SEQ ID NO: 2885777 - RNA, 18 nt, Mycobacterium avium subsp. paratuberculosis
ggccaugccucuucggcg

SEQ ID NO: 2885778 - RNA, 22 nt, Mycobacterium avium subsp. paratuberculosis
ggccaugccucuucggcgcgcc

SEQ ID NO: 2885779 - RNA, 23 nt, Mycobacterium avium subsp. paratuberculosis
ggccaugccucuucggcgcgccg

SEQ ID NO: 2885780 - RNA, 20 nt, Mycobacterium avium subsp. paratuberculosis
ggccaugcuuucgaucaucg

SEQ ID NO: 2885781 - RNA, 15 nt, Mycobacterium avium subsp. paratuberculosis
ggccauggcgcaccg

SEQ ID NO: 2885782 - RNA, 17 nt, Mycobacterium avium subsp. paratuberculosis
ggccauggcgcaccgcg

SEQ ID NO: 2885783 - RNA, 23 nt, Mycobacterium avium subsp. paratuberculosis
ggccauggcgcaccgcggccucg

SEQ ID NO: 2885784 - RNA, 20 nt, Mycobacterium avium subsp. paratuberculosis
ggccaugggguugaccuuga

SEQ ID NO: 2885785 - RNA, 20 nt, Mycobacterium avium subsp. paratuberculosis
ggccauggucgcggccgugu

SEQ ID NO: 2885786 - RNA, 16 nt, Mycobacterium avium subsp. paratuberculosis
ggccauggugccgccg

SEQ ID NO: 2885787 - RNA, 18 nt, Mycobacterium avium subsp. paratuberculosis
ggccauggugccgccguu

SEQ ID NO: 2885788 - RNA, 22 nt, Mycobacterium avium subsp. paratuberculosis
ggccauguacggauugcggacg

SEQ ID NO: 2885789 - RNA, 24 nt, Mycobacterium avium subsp. paratuberculosis
ggccauguacggauugcggacgcc

SEQ ID NO: 2885790 - RNA, 18 nt, Mycobacterium avium subsp. paratuberculosis
ggccauguccccgccggu

SEQ ID NO: 2885791 - RNA, 22 nt, Mycobacterium avium subsp. paratuberculosis
ggccaugucggagcugcgcgcc

SEQ ID NO: 2885792 - RNA, 17 nt, Mycobacterium avium subsp. paratuberculosis
ggccauucaucgcgcac

SEQ ID NO: 2885793 - RNA, 22 nt, Mycobacterium avium subsp. paratuberculosis
ggccauucaucgcgcaccaggg

SEQ ID NO: 2885794 - RNA, 20 nt, Mycobacterium avium subsp. paratuberculosis
ggcccaaaaacgagaugccc

SEQ ID NO: 2885795 - RNA, 19 nt, Mycobacterium avium subsp. paratuberculosis
ggcccaacacgcccugcag

SEQ ID NO: 2885796 - RNA, 15 nt, Mycobacterium avium subsp. paratuberculosis
ggcccaauaccguuc

SEQ ID NO: 2885797 - RNA, 22 nt, Mycobacterium avium subsp. paratuberculosis
ggcccaauaccguuccgccccu

SEQ ID NO: 2885798 - RNA, 23 nt, Mycobacterium avium subsp. paratuberculosis
ggcccaauaccguuccgccccug

SEQ ID NO: 2885799 - RNA, 23 nt, Mycobacterium avium subsp. paratuberculosis
ggcccacacgcgauagaccucac

SEQ ID NO: 2885800 - RNA, 15 nt, Mycobacterium avium subsp. paratuberculosis
ggcccacagcagccg

SEQ ID NO: 2885801 - RNA, 17 nt, Mycobacterium avium subsp. paratuberculosis
ggcccacagcagccgca

SEQ ID NO: 2885802 - RNA, 16 nt, Mycobacterium avium subsp. paratuberculosis
ggcccacagcuugccg

SEQ ID NO: 2885803 - RNA, 15 nt, Mycobacterium avium subsp. paratuberculosis
ggcccaccaccgccu

SEQ ID NO: 2885804 - RNA, 23 nt, Mycobacterium avium subsp. paratuberculosis
ggcccaccaccgccucgacggug

SEQ ID NO: 2885805 - RNA, 22 nt, Mycobacterium avium subsp. paratuberculosis
ggcccaccagcugggaggcgca

SEQ ID NO: 2885806 - RNA, 15 nt, Mycobacterium avium subsp. paratuberculosis
ggcccaccaggucga

SEQ ID NO: 2885807 - RNA, 21 nt, Mycobacterium avium subsp. paratuberculosis
ggcccacccacucggacaggu

SEQ ID NO: 2885808 - RNA, 13 nt, Mycobacterium avium subsp. paratuberculosis
ggcccaccccgga

SEQ ID NO: 2885809 - RNA, 22 nt, Mycobacterium avium subsp. paratuberculosis
ggcccacccgcagggcgccggu

SEQ ID NO: 2885810 - RNA, 16 nt, Mycobacterium avium subsp. paratuberculosis
ggcccaccgaaucacc

SEQ ID NO: 2885811 - RNA, 18 nt, Mycobacterium avium subsp. paratuberculosis
ggcccaccgaaucaccca

SEQ ID NO: 2885812 - RNA, 22 nt, Mycobacterium avium subsp. paratuberculosis
ggcccaccgaaucacccacggc

SEQ ID NO: 2885813 - RNA, 14 nt, Mycobacterium avium subsp. paratuberculosis
ggcccaccgccacc

SEQ ID NO: 2885814 - RNA, 19 nt, Mycobacterium avium subsp. paratuberculosis
ggcccaccgccaccaggcc

SEQ ID NO: 2885815 - RNA, 20 nt, Mycobacterium avium subsp. paratuberculosis
ggcccaccgcgacccggccg

SEQ ID NO: 2885816 - RNA, 21 nt, Mycobacterium avium subsp. paratuberculosis
ggcccaccgcgacccggccga

SEQ ID NO: 2885817 - RNA, 23 nt, Mycobacterium avium subsp. paratuberculosis
ggcccaccgcgacccggccgagc

SEQ ID NO: 2885818 - RNA, 12 nt, Mycobacterium avium subsp. paratuberculosis
ggcccaccggcc

SEQ ID NO: 2885819 - RNA, 19 nt, Mycobacterium avium subsp. paratuberculosis
ggcccaccggcccggcggg

SEQ ID NO: 2885820 - RNA, 20 nt, Mycobacterium avium subsp. paratuberculosis
ggcccaccggcccggcgggc

SEQ ID NO: 2885821 - RNA, 23 nt, Mycobacterium avium subsp. paratuberculosis
ggcccacgaaccgguugcgggcc

SEQ ID NO: 2885822 - RNA, 16 nt, Mycobacterium avium subsp. paratuberculosis
ggcccacgacgucugg

SEQ ID NO: 2885823 - RNA, 13 nt, Mycobacterium avium subsp. paratuberculosis
ggcccacgcagcc

SEQ ID NO: 2885824 - RNA, 15 nt, Mycobacterium avium subsp. paratuberculosis
ggcccacgcagccgu

SEQ ID NO: 2885825 - RNA, 12 nt, Mycobacterium avium subsp. paratuberculosis
ggcccacgccgu

SEQ ID NO: 2885826 - RNA, 21 nt, Mycobacterium avium subsp. paratuberculosis
ggcccacgccgucgucguugu

SEQ ID NO: 2885827 - RNA, 15 nt, Mycobacterium avium subsp. paratuberculosis
ggcccacgcucgacg

SEQ ID NO: 2885828 - RNA, 14 nt, Mycobacterium avium subsp. paratuberculosis
ggcccacggugagg

SEQ ID NO: 2885829 - RNA, 14 nt, Mycobacterium avium subsp. paratuberculosis
ggcccacggugauu

SEQ ID NO: 2885830 - RNA, 21 nt, Mycobacterium avium subsp. paratuberculosis
ggcccagacaggccggccgcu

SEQ ID NO: 2885831 - RNA, 13 nt, Mycobacterium avium subsp. paratuberculosis
ggcccagacgaug

SEQ ID NO: 2885832 - RNA, 14 nt, Mycobacterium avium subsp. paratuberculosis
ggcccagacgaugu

SEQ ID NO: 2885833 - RNA, 19 nt, Mycobacterium avium subsp. paratuberculosis
ggcccagacgaugucgucg

SEQ ID NO: 2885834 - RNA, 22 nt, Mycobacterium avium subsp. paratuberculosis
ggcccagaucgcgguccaccag

SEQ ID NO: 2885835 - RNA, 13 nt, Mycobacterium avium subsp. paratuberculosis
ggcccagcaccac

SEQ ID NO: 2885836 - RNA, 15 nt, Mycobacterium avium subsp. paratuberculosis
ggcccagcaccacca

SEQ ID NO: 2885837 - RNA, 15 nt, Mycobacterium avium subsp. paratuberculosis
ggcccagcaccaccu

SEQ ID NO: 2885838 - RNA, 23 nt, Mycobacterium avium subsp. paratuberculosis
ggcccagcagauagcccagccag

SEQ ID NO: 2885839 - RNA, 17 nt, Mycobacterium avium subsp. paratuberculosis
ggcccagcagcaccgcg

SEQ ID NO: 2885840 - RNA, 21 nt, Mycobacterium avium subsp. paratuberculosis
ggcccagcagcaccgcgaccg

SEQ ID NO: 2885841 - RNA, 16 nt, Mycobacterium avium subsp. paratuberculosis
ggcccagcagccugcc

SEQ ID NO: 2885842 - RNA, 17 nt, Mycobacterium avium subsp. paratuberculosis
ggcccagcagccugccc

SEQ ID NO: 2885843 - RNA, 12 nt, Mycobacterium avium subsp. paratuberculosis
ggcccagcagcg

SEQ ID NO: 2885844 - RNA, 17 nt, Mycobacterium avium subsp. paratuberculosis
ggcccagcagcgcaccg

SEQ ID NO: 2885845 - RNA, 19 nt, Mycobacterium avium subsp. paratuberculosis
ggcccagcagcgcaccggc

SEQ ID NO: 2885846 - RNA, 21 nt, Mycobacterium avium subsp. paratuberculosis
ggcccagcagcgcaccggcga

SEQ ID NO: 2885847 - RNA, 23 nt, Mycobacterium avium subsp. paratuberculosis
ggcccagcagcgucacgucgacg

SEQ ID NO: 2885848 - RNA, 14 nt, Mycobacterium avium subsp. paratuberculosis
ggcccagcccaccg

SEQ ID NO: 2885849 - RNA, 15 nt, Mycobacterium avium subsp. paratuberculosis
ggcccagcccgccgc

SEQ ID NO: 2885850 - RNA, 13 nt, Mycobacterium avium subsp. paratuberculosis
ggcccagcccggc

SEQ ID NO: 2885851 - RNA, 16 nt, Mycobacterium avium subsp. paratuberculosis
ggcccagcccggccag

SEQ ID NO: 2885852 - RNA, 19 nt, Mycobacterium avium subsp. paratuberculosis
ggcccagcccggccagcac

SEQ ID NO: 2885853 - RNA, 20 nt, Mycobacterium avium subsp. paratuberculosis
ggcccagcccggccagcacc

SEQ ID NO: 2885854 - RNA, 16 nt, Mycobacterium avium subsp. paratuberculosis
ggcccagcccggcccc

SEQ ID NO: 2885855 - RNA, 12 nt, Mycobacterium avium subsp. paratuberculosis
ggcccagccggc

SEQ ID NO: 2885856 - RNA, 15 nt, Mycobacterium avium subsp. paratuberculosis
ggcccagccggccga

SEQ ID NO: 2885857 - RNA, 22 nt, Mycobacterium avium subsp. paratuberculosis
ggcccagccggccgacgcggcc

SEQ ID NO: 2885858 - RNA, 13 nt, Mycobacterium avium subsp. paratuberculosis
ggcccagccggcg

SEQ ID NO: 2885859 - RNA, 15 nt, Mycobacterium avium subsp. paratuberculosis
ggcccagccggcggu

SEQ ID NO: 2885860 - RNA, 22 nt, Mycobacterium avium subsp. paratuberculosis
ggcccagccggcggugcagggu

SEQ ID NO: 2885861 - RNA, 16 nt, Mycobacterium avium subsp. paratuberculosis
ggcccagccggucgcc

SEQ ID NO: 2885862 - RNA, 17 nt, Mycobacterium avium subsp. paratuberculosis
ggcccagccggucgccg

SEQ ID NO: 2885863 - RNA, 13 nt, Mycobacterium avium subsp. paratuberculosis
ggcccagccggug

SEQ ID NO: 2885864 - RNA, 14 nt, Mycobacterium avium subsp. paratuberculosis
ggcccagcgaggcg

SEQ ID NO: 2885865 - RNA, 18 nt, Mycobacterium avium subsp. paratuberculosis
ggcccagcgaggcggcca

SEQ ID NO: 2885866 - RNA, 20 nt, Mycobacterium avium subsp. paratuberculosis
ggcccagcgaggcggccagc

SEQ ID NO: 2885867 - RNA, 21 nt, Mycobacterium avium subsp. paratuberculosis
ggcccagcgaggcggccagcg

SEQ ID NO: 2885868 - RNA, 23 nt, Mycobacterium avium subsp. paratuberculosis
ggcccagcgaggcggccagcggc

SEQ ID NO: 2885869 - RNA, 12 nt, Mycobacterium avium subsp. paratuberculosis
ggcccagcgcga

SEQ ID NO: 2885870 - RNA, 23 nt, Mycobacterium avium subsp. paratuberculosis
ggcccagcgcgacgucgaccgcg

SEQ ID NO: 2885871 - RNA, 23 nt, Mycobacterium avium subsp. paratuberculosis
ggcccagcgcgguguacagcgcg

SEQ ID NO: 2885872 - RNA, 22 nt, Mycobacterium avium subsp. paratuberculosis
ggcccagcggaucgagguagcg

SEQ ID NO: 2885873 - RNA, 24 nt, Mycobacterium avium subsp. paratuberculosis
ggcccagcggcuguagcacccggc

SEQ ID NO: 2885874 - RNA, 18 nt, Mycobacterium avium subsp. paratuberculosis
ggcccagcucggugcgca

SEQ ID NO: 2885875 - RNA, 22 nt, Mycobacterium avium subsp. paratuberculosis
ggcccagcucguugccggcggc

SEQ ID NO: 2885876 - RNA, 14 nt, Mycobacterium avium subsp. paratuberculosis
ggcccagcugcugg

SEQ ID NO: 2885877 - RNA, 23 nt, Mycobacterium avium subsp. paratuberculosis
ggcccaggcacagcgaaagcgcu

SEQ ID NO: 2885878 - RNA, 17 nt, Mycobacterium avium subsp. paratuberculosis
ggcccaggcagaccccc

SEQ ID NO: 2885879 - RNA, 12 nt, Mycobacterium avium subsp. paratuberculosis
ggcccaggcagu

SEQ ID NO: 2885880 - RNA, 18 nt, Mycobacterium avium subsp. paratuberculosis
ggcccaggcaguagccga

SEQ ID NO: 2885881 - RNA, 14 nt, Mycobacterium avium subsp. paratuberculosis
ggcccaggccaaca

SEQ ID NO: 2885882 - RNA, 12 nt, Mycobacterium avium subsp. paratuberculosis
ggcccaggccgg

SEQ ID NO: 2885883 - RNA, 17 nt, Mycobacterium avium subsp. paratuberculosis
ggcccaggccggcggug

SEQ ID NO: 2885884 - RNA, 18 nt, Mycobacterium avium subsp. paratuberculosis
ggcccagggcgcucugga

SEQ ID NO: 2885885 - RNA, 19 nt, Mycobacterium avium subsp. paratuberculosis
ggcccagguaguagcgcca

SEQ ID NO: 2885886 - RNA, 21 nt, Mycobacterium avium subsp. paratuberculosis
ggcccagguaguagcgccaca

SEQ ID NO: 2885887 - RNA, 14 nt, Mycobacterium avium subsp. paratuberculosis
ggcccaggucguga

SEQ ID NO: 2885888 - RNA, 24 nt, Mycobacterium avium subsp. paratuberculosis
ggcccagguucuccggcccgcucg

SEQ ID NO: 2885889 - RNA, 17 nt, Mycobacterium avium subsp. paratuberculosis
ggcccaguccagucgcg

SEQ ID NO: 2885890 - RNA, 24 nt, Mycobacterium avium subsp. paratuberculosis
ggcccaguccagucgcgccgaggu

SEQ ID NO: 2885891 - RNA, 17 nt, Mycobacterium avium subsp. paratuberculosis
ggcccaguccugcagcu

SEQ ID NO: 2885892 - RNA, 22 nt, Mycobacterium avium subsp. paratuberculosis
ggcccaguccugcagcucgccg

SEQ ID NO: 2885893 - RNA, 15 nt, Mycobacterium avium subsp. paratuberculosis
ggcccaucaccagcg

SEQ ID NO: 2885894 - RNA, 18 nt, Mycobacterium avium subsp. paratuberculosis
ggcccaucaccagcggcu

SEQ ID NO: 2885895 - RNA, 20 nt, Mycobacterium avium subsp. paratuberculosis
ggcccaugaguugggucaca

SEQ ID NO: 2885896 - RNA, 12 nt, Mycobacterium avium subsp. paratuberculosis
ggccccacccgc

SEQ ID NO: 2885897 - RNA, 17 nt, Mycobacterium avium subsp. paratuberculosis
ggccccacgcgcucagc

SEQ ID NO: 2885898 - RNA, 24 nt, Mycobacterium avium subsp. paratuberculosis
ggccccacgcgcucagcgcggcca

SEQ ID NO: 2885899 - RNA, 13 nt, Mycobacterium avium subsp. paratuberculosis
ggccccacgggcc

SEQ ID NO: 2885900 - RNA, 20 nt, Mycobacterium avium subsp. paratuberculosis
ggccccacgggccauguccc

SEQ ID NO: 2885901 - RNA, 23 nt, Mycobacterium avium subsp. paratuberculosis
ggccccacgggccauguccccga

SEQ ID NO: 2885902 - RNA, 15 nt, Mycobacterium avium subsp. paratuberculosis
ggccccagaaccgcu

SEQ ID NO: 2885903 - RNA, 20 nt, Mycobacterium avium subsp. paratuberculosis
ggccccagaaccgcucggcg

SEQ ID NO: 2885904 - RNA, 21 nt, Mycobacterium avium subsp. paratuberculosis
ggccccagaaccgcucggcgg

SEQ ID NO: 2885905 - RNA, 23 nt, Mycobacterium avium subsp. paratuberculosis
ggccccagaaccgcucggcggcg

SEQ ID NO: 2885906 - RNA, 22 nt, Mycobacterium avium subsp. paratuberculosis
ggccccagccaccguggcccca

SEQ ID NO: 2885907 - RNA, 12 nt, Mycobacterium avium subsp. paratuberculosis
ggccccagcccg

SEQ ID NO: 2885908 - RNA, 14 nt, Mycobacterium avium subsp. paratuberculosis
ggccccagccgccg

SEQ ID NO: 2885909 - RNA, 17 nt, Mycobacterium avium subsp. paratuberculosis
ggccccagccgccgcga

SEQ ID NO: 2885910 - RNA, 18 nt, Mycobacterium avium subsp. paratuberculosis
ggccccccgcacaccggc

SEQ ID NO: 2885911 - RNA, 19 nt, Mycobacterium avium subsp. paratuberculosis
ggccccccgggcaccagcg

SEQ ID NO: 2885912 - RNA, 18 nt, Mycobacterium avium subsp. paratuberculosis
ggcccccgccccagcccg

SEQ ID NO: 2885913 - RNA, 18 nt, Mycobacterium avium subsp. paratuberculosis
ggcccccgccucgccggu

SEQ ID NO: 2885914 - RNA, 19 nt, Mycobacterium avium subsp. paratuberculosis
ggcccccggcucgaucgcg

SEQ ID NO: 2885915 - RNA, 20 nt, Mycobacterium avium subsp. paratuberculosis
ggcccccggcucgaucgcgg

SEQ ID NO: 2885916 - RNA, 23 nt, Mycobacterium avium subsp. paratuberculosis
ggcccccugaggagacgaucucg

SEQ ID NO: 2885917 - RNA, 19 nt, Mycobacterium avium subsp. paratuberculosis
ggcccccugaucggccgca

SEQ ID NO: 2885918 - RNA, 19 nt, Mycobacterium avium subsp. paratuberculosis
ggccccgagcgucacgcca

SEQ ID NO: 2885919 - RNA, 21 nt, Mycobacterium avium subsp. paratuberculosis
ggccccgagcgucacgccagc

SEQ ID NO: 2885920 - RNA, 22 nt, Mycobacterium avium subsp. paratuberculosis
ggccccgccagauagggcagcg

SEQ ID NO: 2885921 - RNA, 23 nt, Mycobacterium avium subsp. paratuberculosis
ggccccgcccggcgcgcagccca

SEQ ID NO: 2885922 - RNA, 21 nt, Mycobacterium avium subsp. paratuberculosis
ggccccgcgcaucggucagca

SEQ ID NO: 2885923 - RNA, 14 nt, Mycobacterium avium subsp. paratuberculosis
ggccccgcgugacg

SEQ ID NO: 2885924 - RNA, 18 nt, Mycobacterium avium subsp. paratuberculosis
ggccccgcgugacggccg

SEQ ID NO: 2885925 - RNA, 20 nt, Mycobacterium avium subsp. paratuberculosis
ggccccgcgugacggccgcg

SEQ ID NO: 2885926 - RNA, 22 nt, Mycobacterium avium subsp. paratuberculosis
ggccccgcgugacggccgcggc

SEQ ID NO: 2885927 - RNA, 15 nt, Mycobacterium avium subsp. paratuberculosis
ggccccgcugccguc

SEQ ID NO: 2885928 - RNA, 21 nt, Mycobacterium avium subsp. paratuberculosis
ggccccgcugccguccggcgg

SEQ ID NO: 2885929 - RNA, 22 nt, Mycobacterium avium subsp. paratuberculosis
ggccccgcugccguccggcggc

SEQ ID NO: 2885930 - RNA, 17 nt, Mycobacterium avium subsp. paratuberculosis
ggccccggauccgucgc

SEQ ID NO: 2885931 - RNA, 18 nt, Mycobacterium avium subsp. paratuberculosis
ggccccggauccgucgcc

SEQ ID NO: 2885932 - RNA, 20 nt, Mycobacterium avium subsp. paratuberculosis
ggccccggauccgucgcccc

SEQ ID NO: 2885933 - RNA, 16 nt, Mycobacterium avium subsp. paratuberculosis
ggccccggcaucgaca

SEQ ID NO: 2885934 - RNA, 14 nt, Mycobacterium avium subsp. paratuberculosis
ggccccggccgagc

SEQ ID NO: 2885935 - RNA, 15 nt, Mycobacterium avium subsp. paratuberculosis
ggccccggccgagcg

SEQ ID NO: 2885936 - RNA, 14 nt, Mycobacterium avium subsp. paratuberculosis
ggccccggcgacgg

SEQ ID NO: 2885937 - RNA, 14 nt, Mycobacterium avium subsp. paratuberculosis
ggccccggcucggg

SEQ ID NO: 2885938 - RNA, 21 nt, Mycobacterium avium subsp. paratuberculosis
ggccccgggcgcuggcgaugg

SEQ ID NO: 2885939 - RNA, 17 nt, Mycobacterium avium subsp. paratuberculosis
ggccccgggggaccagc

SEQ ID NO: 2885940 - RNA, 19 nt, Mycobacterium avium subsp. paratuberculosis
ggccccgguggaugggcuc

SEQ ID NO: 2885941 - RNA, 17 nt, Mycobacterium avium subsp. paratuberculosis
ggccccuaccgccgagc

SEQ ID NO: 2885942 - RNA, 18 nt, Mycobacterium avium subsp. paratuberculosis
ggccccuaccgccgagcg

SEQ ID NO: 2885943 - RNA, 21 nt, Mycobacterium avium subsp. paratuberculosis
ggccccuaccgccgagcguga

SEQ ID NO: 2885944 - RNA, 15 nt, Mycobacterium avium subsp. paratuberculosis
ggccccuccagccgc

SEQ ID NO: 2885945 - RNA, 16 nt, Mycobacterium avium subsp. paratuberculosis
ggccccuccagccgcc

SEQ ID NO: 2885946 - RNA, 17 nt, Mycobacterium avium subsp. paratuberculosis
ggccccuccagccgccg

SEQ ID NO: 2885947 - RNA, 23 nt, Mycobacterium avium subsp. paratuberculosis
ggccccugcggggugucgaccca

SEQ ID NO: 2885948 - RNA, 18 nt, Mycobacterium avium subsp. paratuberculosis
ggccccuucgaugucgcc

SEQ ID NO: 2885949 - RNA, 21 nt, Mycobacterium avium subsp. paratuberculosis
ggccccuucgaugucgccggc

SEQ ID NO: 2885950 - RNA, 22 nt, Mycobacterium avium subsp. paratuberculosis
ggccccuucgaugucgccggcg

SEQ ID NO: 2885951 - RNA, 22 nt, Mycobacterium avium subsp. paratuberculosis
ggccccuuggcguauucggcgc

SEQ ID NO: 2885952 - RNA, 13 nt, Mycobacterium avium subsp. paratuberculosis
ggcccgaacaccg

SEQ ID NO: 2885953 - RNA, 22 nt, Mycobacterium avium subsp. paratuberculosis
ggcccgaacaucgccucggccg

SEQ ID NO: 2885954 - RNA, 12 nt, Mycobacterium avium subsp. paratuberculosis
ggcccgaccagc

SEQ ID NO: 2885955 - RNA, 15 nt, Mycobacterium avium subsp. paratuberculosis
ggcccgaccagcggg

SEQ ID NO: 2885956 - RNA, 21 nt, Mycobacterium avium subsp. paratuberculosis
ggcccgaccagcgggccgaca

SEQ ID NO: 2885957 - RNA, 13 nt, Mycobacterium avium subsp. paratuberculosis
ggcccgacccggu

SEQ ID NO: 2885958 - RNA, 12 nt, Mycobacterium avium subsp. paratuberculosis
ggcccgacgacg

SEQ ID NO: 2885959 - RNA, 13 nt, Mycobacterium avium subsp. paratuberculosis
ggcccgacgacgc

SEQ ID NO: 2885960 - RNA, 15 nt, Mycobacterium avium subsp. paratuberculosis
ggcccgacgacgccg

SEQ ID NO: 2885961 - RNA, 17 nt, Mycobacterium avium subsp. paratuberculosis
ggcccgacgacgccguc

SEQ ID NO: 2885962 - RNA, 14 nt, Mycobacterium avium subsp. paratuberculosis
ggcccgacggguuc

SEQ ID NO: 2885963 - RNA, 22 nt, Mycobacterium avium subsp. paratuberculosis
ggcccgacggguucgcgcagcc

SEQ ID NO: 2885964 - RNA, 15 nt, Mycobacterium avium subsp. paratuberculosis
ggcccgagcaccacc

SEQ ID NO: 2885965 - RNA, 13 nt, Mycobacterium avium subsp. paratuberculosis
ggcccgagcccga

SEQ ID NO: 2885966 - RNA, 15 nt, Mycobacterium avium subsp. paratuberculosis
ggcccgagcccgacg

SEQ ID NO: 2885967 - RNA, 17 nt, Mycobacterium avium subsp. paratuberculosis
ggcccgagcccgacggc

SEQ ID NO: 2885968 - RNA, 19 nt, Mycobacterium avium subsp. paratuberculosis
ggcccgagcccgacggcag

SEQ ID NO: 2885969 - RNA, 14 nt, Mycobacterium avium subsp. paratuberculosis
ggcccgagcccugc

SEQ ID NO: 2885970 - RNA, 20 nt, Mycobacterium avium subsp. paratuberculosis
ggcccgagcccugcgccagc

SEQ ID NO: 2885971 - RNA, 22 nt, Mycobacterium avium subsp. paratuberculosis
ggcccgagguccucgcgcaacu

SEQ ID NO: 2885972 - RNA, 21 nt, Mycobacterium avium subsp. paratuberculosis
ggcccgagugugcauccuggg

SEQ ID NO: 2885973 - RNA, 13 nt, Mycobacterium avium subsp. paratuberculosis
ggcccgaucacca

SEQ ID NO: 2885974 - RNA, 14 nt, Mycobacterium avium subsp. paratuberculosis
ggcccgaucaccag

SEQ ID NO: 2885975 - RNA, 20 nt, Mycobacterium avium subsp. paratuberculosis
ggcccgaucaccaggcccag

SEQ ID NO: 2885976 - RNA, 13 nt, Mycobacterium avium subsp. paratuberculosis
ggcccgaucaccg

SEQ ID NO: 2885977 - RNA, 16 nt, Mycobacterium avium subsp. paratuberculosis
ggcccgaucagggucc

SEQ ID NO: 2885978 - RNA, 13 nt, Mycobacterium avium subsp. paratuberculosis
ggcccgaucgcgg

SEQ ID NO: 2885979 - RNA, 15 nt, Mycobacterium avium subsp. paratuberculosis
ggcccgaucgcggcg

SEQ ID NO: 2885980 - RNA, 19 nt, Mycobacterium avium subsp. paratuberculosis
ggcccgaucgcggcgagcu

SEQ ID NO: 2885981 - RNA, 14 nt, Mycobacterium avium subsp. paratuberculosis
ggcccgaucgcguc

SEQ ID NO: 2885982 - RNA, 15 nt, Mycobacterium avium subsp. paratuberculosis
ggcccgaucgcgucg

SEQ ID NO: 2885983 - RNA, 19 nt, Mycobacterium avium subsp. paratuberculosis
ggcccgaucgcgucgacga

SEQ ID NO: 2885984 - RNA, 15 nt, Mycobacterium avium subsp. paratuberculosis
ggcccgaucucgcgc

SEQ ID NO: 2885985 - RNA, 17 nt, Mycobacterium avium subsp. paratuberculosis
ggcccgaucucgcgcgg

SEQ ID NO: 2885986 - RNA, 20 nt, Mycobacterium avium subsp. paratuberculosis
ggcccgaucucgcgcggguc

SEQ ID NO: 2885987 - RNA, 21 nt, Mycobacterium avium subsp. paratuberculosis
ggcccgaucucgcgcgggucg

SEQ ID NO: 2885988 - RNA, 15 nt, Mycobacterium avium subsp. paratuberculosis
ggcccgauggcggcc

SEQ ID NO: 2885989 - RNA, 22 nt, Mycobacterium avium subsp. paratuberculosis
ggcccgauggcggccugcagga

SEQ ID NO: 2885990 - RNA, 22 nt, Mycobacterium avium subsp. paratuberculosis
ggcccgcaacuguucgcggcug

SEQ ID NO: 2885991 - RNA, 11 nt, Mycobacterium avium subsp. paratuberculosis
ggcccgcacca

SEQ ID NO: 2885992 - RNA, 24 nt, Mycobacterium avium subsp. paratuberculosis
ggcccgcaccacccagcccuuggc

SEQ ID NO: 2885993 - RNA, 20 nt, Mycobacterium avium subsp. paratuberculosis
ggcccgcacggccgccaggg

SEQ ID NO: 2885994 - RNA, 22 nt, Mycobacterium avium subsp. paratuberculosis
ggcccgcacguagacggugucg

SEQ ID NO: 2885995 - RNA, 17 nt, Mycobacterium avium subsp. paratuberculosis
ggcccgcagccgcuggc

SEQ ID NO: 2885996 - RNA, 19 nt, Mycobacterium avium subsp. paratuberculosis
ggcccgcagccgcuggccg

SEQ ID NO: 2885997 - RNA, 13 nt, Mycobacterium avium subsp. paratuberculosis
ggcccgcagcgcc

SEQ ID NO: 2885998 - RNA, 14 nt, Mycobacterium avium subsp. paratuberculosis
ggcccgcagcgccu

SEQ ID NO: 2885999 - RNA, 17 nt, Mycobacterium avium subsp. paratuberculosis
ggcccgcagcgccucgg

SEQ ID NO: 2886000 - RNA, 20 nt, Mycobacterium avium subsp. paratuberculosis
ggcccgcagcgccucggcgu

SEQ ID NO: 2886001 - RNA, 21 nt, Mycobacterium avium subsp. paratuberculosis
ggcccgcagcgccucggcgug

SEQ ID NO: 2886002 - RNA, 14 nt, Mycobacterium avium subsp. paratuberculosis
ggcccgcagcucgg

SEQ ID NO: 2886003 - RNA, 20 nt, Mycobacterium avium subsp. paratuberculosis
ggcccgcaggaucgagccgg

SEQ ID NO: 2886004 - RNA, 23 nt, Mycobacterium avium subsp. paratuberculosis
ggcccgcaggaucgagccggccg

SEQ ID NO: 2886005 - RNA, 21 nt, Mycobacterium avium subsp. paratuberculosis
ggcccgccacccgaggccguu

SEQ ID NO: 2886006 - RNA, 11 nt, Mycobacterium avium subsp. paratuberculosis
ggcccgccaga

SEQ ID NO: 2886007 - RNA, 14 nt, Mycobacterium avium subsp. paratuberculosis
ggcccgccagaucg

SEQ ID NO: 2886008 - RNA, 15 nt, Mycobacterium avium subsp. paratuberculosis
ggcccgccagaucgc

SEQ ID NO: 2886009 - RNA, 18 nt, Mycobacterium avium subsp. paratuberculosis
ggcccgccaucgcccggu

SEQ ID NO: 2886010 - RNA, 12 nt, Mycobacterium avium subsp. paratuberculosis
ggcccgcccagc

SEQ ID NO: 2886011 - RNA, 16 nt, Mycobacterium avium subsp. paratuberculosis
ggcccgcccagcgcag

SEQ ID NO: 2886012 - RNA, 20 nt, Mycobacterium avium subsp. paratuberculosis
ggcccgccccugaggguguc

SEQ ID NO: 2886013 - RNA, 14 nt, Mycobacterium avium subsp. paratuberculosis
ggcccgcccgcagc

SEQ ID NO: 2886014 - RNA, 20 nt, Mycobacterium avium subsp. paratuberculosis
ggcccgcccgcagcggcggu

SEQ ID NO: 2886015 - RNA, 14 nt, Mycobacterium avium subsp. paratuberculosis
ggcccgcccggcgg

SEQ ID NO: 2886016 - RNA, 17 nt, Mycobacterium avium subsp. paratuberculosis
ggcccgcccggcggcgc

SEQ ID NO: 2886017 - RNA, 19 nt, Mycobacterium avium subsp. paratuberculosis
ggcccgccgaacgccuccg

SEQ ID NO: 2886018 - RNA, 20 nt, Mycobacterium avium subsp. paratuberculosis
ggcccgccgaacgccuccgc

SEQ ID NO: 2886019 - RNA, 22 nt, Mycobacterium avium subsp. paratuberculosis
ggcccgccgccggcgcuggcgc

SEQ ID NO: 2886020 - RNA, 16 nt, Mycobacterium avium subsp. paratuberculosis
ggcccgccgccggcgg

SEQ ID NO: 2886021 - RNA, 17 nt, Mycobacterium avium subsp. paratuberculosis
ggcccgccgccggcggc

SEQ ID NO: 2886022 - RNA, 14 nt, Mycobacterium avium subsp. paratuberculosis
ggcccgccgcgccc

SEQ ID NO: 2886023 - RNA, 17 nt, Mycobacterium avium subsp. paratuberculosis
ggcccgccgcgcccggc

SEQ ID NO: 2886024 - RNA, 18 nt, Mycobacterium avium subsp. paratuberculosis
ggcccgccgcgcccggcu

SEQ ID NO: 2886025 - RNA, 19 nt, Mycobacterium avium subsp. paratuberculosis
ggcccgccgcgcccggcuu

SEQ ID NO: 2886026 - RNA, 12 nt, Mycobacterium avium subsp. paratuberculosis
ggcccgccgcgg

SEQ ID NO: 2886027 - RNA, 21 nt, Mycobacterium avium subsp. paratuberculosis
ggcccgccgcggcuccagcag

SEQ ID NO: 2886028 - RNA, 19 nt, Mycobacterium avium subsp. paratuberculosis
ggcccgccgcucaccgccg

SEQ ID NO: 2886029 - RNA, 22 nt, Mycobacterium avium subsp. paratuberculosis
ggcccgccgcucaccgccgagc

SEQ ID NO: 2886030 - RNA, 13 nt, Mycobacterium avium subsp. paratuberculosis
ggcccgccgcugc

SEQ ID NO: 2886031 - RNA, 16 nt, Mycobacterium avium subsp. paratuberculosis
ggcccgccggagccga

SEQ ID NO: 2886032 - RNA, 19 nt, Mycobacterium avium subsp. paratuberculosis
ggcccgccggagccgaucg

SEQ ID NO: 2886033 - RNA, 15 nt, Mycobacterium avium subsp. paratuberculosis
ggcccgccgggccgg

SEQ ID NO: 2886034 - RNA, 16 nt, Mycobacterium avium subsp. paratuberculosis
ggcccgccgggcgcca

SEQ ID NO: 2886035 - RNA, 16 nt, Mycobacterium avium subsp. paratuberculosis
ggcccgccgggcgucg

SEQ ID NO: 2886036 - RNA, 19 nt, Mycobacterium avium subsp. paratuberculosis
ggcccgccgggcgucgcgc

SEQ ID NO: 2886037 - RNA, 21 nt, Mycobacterium avium subsp. paratuberculosis
ggcccgccgggcgucgcgcuc

SEQ ID NO: 2886038 - RNA, 20 nt, Mycobacterium avium subsp. paratuberculosis
ggcccgccgguggccgcgcu

SEQ ID NO: 2886039 - RNA, 15 nt, Mycobacterium avium subsp. paratuberculosis
ggcccgccgucgacc

SEQ ID NO: 2886040 - RNA, 19 nt, Mycobacterium avium subsp. paratuberculosis
ggcccgccgucgaccacga

SEQ ID NO: 2886041 - RNA, 17 nt, Mycobacterium avium subsp. paratuberculosis
ggcccgccucggcggcc

SEQ ID NO: 2886042 - RNA, 16 nt, Mycobacterium avium subsp. paratuberculosis
ggcccgccuuccggga

SEQ ID NO: 2886043 - RNA, 22 nt, Mycobacterium avium subsp. paratuberculosis
ggcccgcgacgucggagaucag

SEQ ID NO: 2886044 - RNA, 16 nt, Mycobacterium avium subsp. paratuberculosis
ggcccgcgcaccguca

SEQ ID NO: 2886045 - RNA, 18 nt, Mycobacterium avium subsp. paratuberculosis
ggcccgcgccccggcggc

SEQ ID NO: 2886046 - RNA, 13 nt, Mycobacterium avium subsp. paratuberculosis
ggcccgcgcccgc

SEQ ID NO: 2886047 - RNA, 16 nt, Mycobacterium avium subsp. paratuberculosis
ggcccgcgcccgcucg

SEQ ID NO: 2886048 - RNA, 16 nt, Mycobacterium avium subsp. paratuberculosis
ggcccgcgccgacggc

SEQ ID NO: 2886049 - RNA, 21 nt, Mycobacterium avium subsp. paratuberculosis
ggcccgcgccgcgucgucguc

SEQ ID NO: 2886050 - RNA, 23 nt, Mycobacterium avium subsp. paratuberculosis
ggcccgcgccgcgucgucgucga

SEQ ID NO: 2886051 - RNA, 15 nt, Mycobacterium avium subsp. paratuberculosis
ggcccgcgccggcgu

SEQ ID NO: 2886052 - RNA, 16 nt, Mycobacterium avium subsp. paratuberculosis
ggcccgcgccggcgug

SEQ ID NO: 2886053 - RNA, 19 nt, Mycobacterium avium subsp. paratuberculosis
ggcccgcgccggcgugucg

SEQ ID NO: 2886054 - RNA, 12 nt, Mycobacterium avium subsp. paratuberculosis
ggcccgcgcggc

SEQ ID NO: 2886055 - RNA, 14 nt, Mycobacterium avium subsp. paratuberculosis
ggcccgcgcggccg

SEQ ID NO: 2886056 - RNA, 16 nt, Mycobacterium avium subsp. paratuberculosis
ggcccgcgcggccgcc

SEQ ID NO: 2886057 - RNA, 20 nt, Mycobacterium avium subsp. paratuberculosis
ggcccgcgcggccgccaggu

SEQ ID NO: 2886058 - RNA, 14 nt, Mycobacterium avium subsp. paratuberculosis
ggcccgcgcggcgg

SEQ ID NO: 2886059 - RNA, 15 nt, Mycobacterium avium subsp. paratuberculosis
ggcccgcgcggcggu

SEQ ID NO: 2886060 - RNA, 22 nt, Mycobacterium avium subsp. paratuberculosis
ggcccgcgcggcggugucggug

SEQ ID NO: 2886061 - RNA, 23 nt, Mycobacterium avium subsp. paratuberculosis
ggcccgcgcggcggugucggugc

SEQ ID NO: 2886062 - RNA, 15 nt, Mycobacterium avium subsp. paratuberculosis
ggcccgcgcgggguc

SEQ ID NO: 2886063 - RNA, 23 nt, Mycobacterium avium subsp. paratuberculosis
ggcccgcggcggauccagcaccg

SEQ ID NO: 2886064 - RNA, 14 nt, Mycobacterium avium subsp. paratuberculosis
ggcccgcggcguca

SEQ ID NO: 2886065 - RNA, 12 nt, Mycobacterium avium subsp. paratuberculosis
ggcccgcggggc

SEQ ID NO: 2886066 - RNA, 20 nt, Mycobacterium avium subsp. paratuberculosis
ggcccgcggggcguacgcgc

SEQ ID NO: 2886067 - RNA, 21 nt, Mycobacterium avium subsp. paratuberculosis
ggcccgcggggcguacgcgcu

SEQ ID NO: 2886068 - RNA, 23 nt, Mycobacterium avium subsp. paratuberculosis
ggcccgcggggcguacgcgcugc

SEQ ID NO: 2886069 - RNA, 19 nt, Mycobacterium avium subsp. paratuberculosis
ggcccgcguaaccggcggc

SEQ ID NO: 2886070 - RNA, 22 nt, Mycobacterium avium subsp. paratuberculosis
ggcccgcguaaccggcggcggu

SEQ ID NO: 2886071 - RNA, 24 nt, Mycobacterium avium subsp. paratuberculosis
ggcccgcguaaccggcggcgguga

SEQ ID NO: 2886072 - RNA, 19 nt, Mycobacterium avium subsp. paratuberculosis
ggcccgcucaccugcggcc

SEQ ID NO: 2886073 - RNA, 13 nt, Mycobacterium avium subsp. paratuberculosis
ggcccgcucgaug

SEQ ID NO: 2886074 - RNA, 14 nt, Mycobacterium avium subsp. paratuberculosis
ggcccgcucgaugu

SEQ ID NO: 2886075 - RNA, 19 nt, Mycobacterium avium subsp. paratuberculosis
ggcccgcucgaugucggug

SEQ ID NO: 2886076 - RNA, 13 nt, Mycobacterium avium subsp. paratuberculosis
ggcccgcucggcg

SEQ ID NO: 2886077 - RNA, 18 nt, Mycobacterium avium subsp. paratuberculosis
ggcccgcucggcgggucg

SEQ ID NO: 2886078 - RNA, 15 nt, Mycobacterium avium subsp. paratuberculosis
ggcccgcucgggcca

SEQ ID NO: 2886079 - RNA, 17 nt, Mycobacterium avium subsp. paratuberculosis
ggcccgcugcagcgccg

SEQ ID NO: 2886080 - RNA, 18 nt, Mycobacterium avium subsp. paratuberculosis
ggcccgcugcagcgccga

SEQ ID NO: 2886081 - RNA, 15 nt, Mycobacterium avium subsp. paratuberculosis
ggcccgcugcgccga

SEQ ID NO: 2886082 - RNA, 16 nt, Mycobacterium avium subsp. paratuberculosis
ggcccgcugcgccgac

SEQ ID NO: 2886083 - RNA, 15 nt, Mycobacterium avium subsp. paratuberculosis
ggcccgcugcgcggc

SEQ ID NO: 2886084 - RNA, 13 nt, Mycobacterium avium subsp. paratuberculosis
ggcccgcugcggc

SEQ ID NO: 2886085 - RNA, 16 nt, Mycobacterium avium subsp. paratuberculosis
ggcccgcugcggcugg

SEQ ID NO: 2886086 - RNA, 20 nt, Mycobacterium avium subsp. paratuberculosis
ggcccgcugugguccucguc

SEQ ID NO: 2886087 - RNA, 20 nt, Mycobacterium avium subsp. paratuberculosis
ggcccgcuucaggcagcgca

SEQ ID NO: 2886088 - RNA, 14 nt, Mycobacterium avium subsp. paratuberculosis
ggcccggaccgccg

SEQ ID NO: 2886089 - RNA, 16 nt, Mycobacterium avium subsp. paratuberculosis
ggcccggaccgccgcg

SEQ ID NO: 2886090 - RNA, 14 nt, Mycobacterium avium subsp. paratuberculosis
ggcccggacggcca

SEQ ID NO: 2886091 - RNA, 22 nt, Mycobacterium avium subsp. paratuberculosis
ggcccggaucgucuugcggccc

SEQ ID NO: 2886092 - RNA, 17 nt, Mycobacterium avium subsp. paratuberculosis
ggcccggauggccgggc

SEQ ID NO: 2886093 - RNA, 13 nt, Mycobacterium avium subsp. paratuberculosis
ggcccggcaccgg

SEQ ID NO: 2886094 - RNA, 22 nt, Mycobacterium avium subsp. paratuberculosis
ggcccggcaccggugcggcggu

SEQ ID NO: 2886095 - RNA, 23 nt, Mycobacterium avium subsp. paratuberculosis
ggcccggcaccggugcggcggug

SEQ ID NO: 2886096 - RNA, 16 nt, Mycobacterium avium subsp. paratuberculosis
ggcccggcacuggcga

SEQ ID NO: 2886097 - RNA, 11 nt, Mycobacterium avium subsp. paratuberculosis
ggcccggcagc

SEQ ID NO: 2886098 - RNA, 14 nt, Mycobacterium avium subsp. paratuberculosis
ggcccggcagccgg

SEQ ID NO: 2886099 - RNA, 15 nt, Mycobacterium avium subsp. paratuberculosis
ggcccggcagccggg

SEQ ID NO: 2886100 - RNA, 18 nt, Mycobacterium avium subsp. paratuberculosis
ggcccggcccggcgaugc

SEQ ID NO: 2886101 - RNA, 13 nt, Mycobacterium avium subsp. paratuberculosis
ggcccggccggcg

SEQ ID NO: 2886102 - RNA, 14 nt, Mycobacterium avium subsp. paratuberculosis
ggcccggccggcgc

SEQ ID NO: 2886103 - RNA, 15 nt, Mycobacterium avium subsp. paratuberculosis
ggcccggccggcgcg

SEQ ID NO: 2886104 - RNA, 17 nt, Mycobacterium avium subsp. paratuberculosis
ggcccggcgaaucagca

SEQ ID NO: 2886105 - RNA, 13 nt, Mycobacterium avium subsp. paratuberculosis
ggcccggcgaugc

SEQ ID NO: 2886106 - RNA, 13 nt, Mycobacterium avium subsp. paratuberculosis
ggcccggcgcggc

SEQ ID NO: 2886107 - RNA, 14 nt, Mycobacterium avium subsp. paratuberculosis
ggcccggcgcggcc

SEQ ID NO: 2886108 - RNA, 19 nt, Mycobacterium avium subsp. paratuberculosis
ggcccggcgcggccggugc

SEQ ID NO: 2886109 - RNA, 15 nt, Mycobacterium avium subsp. paratuberculosis
ggcccggcgcggcgg

SEQ ID NO: 2886110 - RNA, 16 nt, Mycobacterium avium subsp. paratuberculosis
ggcccggcgcggcggc

SEQ ID NO: 2886111 - RNA, 18 nt, Mycobacterium avium subsp. paratuberculosis
ggcccggcgcggcggcgc

SEQ ID NO: 2886112 - RNA, 20 nt, Mycobacterium avium subsp. paratuberculosis
ggcccggcgcggcggcgccg

SEQ ID NO: 2886113 - RNA, 12 nt, Mycobacterium avium subsp. paratuberculosis
ggcccggcggcc

SEQ ID NO: 2886114 - RNA, 14 nt, Mycobacterium avium subsp. paratuberculosis
ggcccggcggccgg

SEQ ID NO: 2886115 - RNA, 19 nt, Mycobacterium avium subsp. paratuberculosis
ggcccggcggccggccgcg

SEQ ID NO: 2886116 - RNA, 11 nt, Mycobacterium avium subsp. paratuberculosis
ggcccggcguc

SEQ ID NO: 2886117 - RNA, 15 nt, Mycobacterium avium subsp. paratuberculosis
ggcccggcgugggcc

SEQ ID NO: 2886118 - RNA, 19 nt, Mycobacterium avium subsp. paratuberculosis
ggcccggcguuccagcgca

SEQ ID NO: 2886119 - RNA, 20 nt, Mycobacterium avium subsp. paratuberculosis
ggcccgggaagccgcagcag

SEQ ID NO: 2886120 - RNA, 22 nt, Mycobacterium avium subsp. paratuberculosis
ggcccgggaagccgcagcaggu

SEQ ID NO: 2886121 - RNA, 19 nt, Mycobacterium avium subsp. paratuberculosis
ggcccgggaugggccugga

SEQ ID NO: 2886122 - RNA, 15 nt, Mycobacterium avium subsp. paratuberculosis
ggcccgggcaggcau

SEQ ID NO: 2886123 - RNA, 16 nt, Mycobacterium avium subsp. paratuberculosis
ggcccgggccacaccc

SEQ ID NO: 2886124 - RNA, 20 nt, Mycobacterium avium subsp. paratuberculosis
ggcccgggcgauucgucguc

SEQ ID NO: 2886125 - RNA, 21 nt, Mycobacterium avium subsp. paratuberculosis
ggcccgggcgauucgucgucg

SEQ ID NO: 2886126 - RNA, 14 nt, Mycobacterium avium subsp. paratuberculosis
ggcccgggcgcuga

SEQ ID NO: 2886127 - RNA, 16 nt, Mycobacterium avium subsp. paratuberculosis
ggcccgggcgcugagc

SEQ ID NO: 2886128 - RNA, 13 nt, Mycobacterium avium subsp. paratuberculosis
ggcccgggcggcg

SEQ ID NO: 2886129 - RNA, 13 nt, Mycobacterium avium subsp. paratuberculosis
ggcccgggcgucc

SEQ ID NO: 2886130 - RNA, 19 nt, Mycobacterium avium subsp. paratuberculosis
ggcccggggacacccucgg

SEQ ID NO: 2886131 - RNA, 20 nt, Mycobacterium avium subsp. paratuberculosis
ggcccggggacacccucggg

SEQ ID NO: 2886132 - RNA, 21 nt, Mycobacterium avium subsp. paratuberculosis
ggcccggggacacccucgggg

SEQ ID NO: 2886133 - RNA, 12 nt, Mycobacterium avium subsp. paratuberculosis
ggcccggguggc

SEQ ID NO: 2886134 - RNA, 16 nt, Mycobacterium avium subsp. paratuberculosis
ggcccgguacagcgcc

SEQ ID NO: 2886135 - RNA, 17 nt, Mycobacterium avium subsp. paratuberculosis
ggcccgguacagcgccg

SEQ ID NO: 2886136 - RNA, 18 nt, Mycobacterium avium subsp. paratuberculosis
ggcccgguacagcgccgc

SEQ ID NO: 2886137 - RNA, 21 nt, Mycobacterium avium subsp. paratuberculosis
ggcccgguacagcgccgcggc

SEQ ID NO: 2886138 - RNA, 22 nt, Mycobacterium avium subsp. paratuberculosis
ggcccgguacagcgccgcggcc

SEQ ID NO: 2886139 - RNA, 23 nt, Mycobacterium avium subsp. paratuberculosis
ggcccgguacagcgccgcggcca

SEQ ID NO: 2886140 - RNA, 15 nt, Mycobacterium avium subsp. paratuberculosis
ggcccgguacaucga

SEQ ID NO: 2886141 - RNA, 18 nt, Mycobacterium avium subsp. paratuberculosis
ggcccgguacaucgacgc

SEQ ID NO: 2886142 - RNA, 19 nt, Mycobacterium avium subsp. paratuberculosis
ggcccgguacaucgacgcg

SEQ ID NO: 2886143 - RNA, 22 nt, Mycobacterium avium subsp. paratuberculosis
ggcccgguagauauggcccucc

SEQ ID NO: 2886144 - RNA, 22 nt, Mycobacterium avium subsp. paratuberculosis
ggcccgguccaguugugccgca

SEQ ID NO: 2886145 - RNA, 16 nt, Mycobacterium avium subsp. paratuberculosis
ggcccggucccgcguc

SEQ ID NO: 2886146 - RNA, 15 nt, Mycobacterium avium subsp. paratuberculosis
ggcccggucgacuug

SEQ ID NO: 2886147 - RNA, 20 nt, Mycobacterium avium subsp. paratuberculosis
ggcccggucgacuugggcgg

SEQ ID NO: 2886148 - RNA, 14 nt, Mycobacterium avium subsp. paratuberculosis
ggcccggucgucga

SEQ ID NO: 2886149 - RNA, 21 nt, Mycobacterium avium subsp. paratuberculosis
ggcccggucgucgagcaccgg

SEQ ID NO: 2886150 - RNA, 22 nt, Mycobacterium avium subsp. paratuberculosis
ggcccggucgucgagcaccggc

SEQ ID NO: 2886151 - RNA, 16 nt, Mycobacterium avium subsp. paratuberculosis
ggcccggucgucgccg

SEQ ID NO: 2886152 - RNA, 13 nt, Mycobacterium avium subsp. paratuberculosis
ggcccggugagcc

SEQ ID NO: 2886153 - RNA, 18 nt, Mycobacterium avium subsp. paratuberculosis
ggcccggugagccucagg

SEQ ID NO: 2886154 - RNA, 15 nt, Mycobacterium avium subsp. paratuberculosis
ggcccgguuccagcg

SEQ ID NO: 2886155 - RNA, 16 nt, Mycobacterium avium subsp. paratuberculosis
ggcccgguuccagcgg

SEQ ID NO: 2886156 - RNA, 20 nt, Mycobacterium avium subsp. paratuberculosis
ggcccgguuccagcggcacc

SEQ ID NO: 2886157 - RNA, 21 nt, Mycobacterium avium subsp. paratuberculosis
ggcccgguuccagcggcaccg

SEQ ID NO: 2886158 - RNA, 19 nt, Mycobacterium avium subsp. paratuberculosis
ggcccgguugagugcgccg

SEQ ID NO: 2886159 - RNA, 22 nt, Mycobacterium avium subsp. paratuberculosis
ggcccgguugagugcgccgugc

SEQ ID NO: 2886160 - RNA, 19 nt, Mycobacterium avium subsp. paratuberculosis
ggcccguagcucgcgccga

SEQ ID NO: 2886161 - RNA, 20 nt, Mycobacterium avium subsp. paratuberculosis
ggcccguagcucgcgccgac

SEQ ID NO: 2886162 - RNA, 21 nt, Mycobacterium avium subsp. paratuberculosis
ggcccguagcucgcgccgacc

SEQ ID NO: 2886163 - RNA, 20 nt, Mycobacterium avium subsp. paratuberculosis
ggcccguccagaucggccag

SEQ ID NO: 2886164 - RNA, 22 nt, Mycobacterium avium subsp. paratuberculosis
ggcccguccagaucggccagcg

SEQ ID NO: 2886165 - RNA, 14 nt, Mycobacterium avium subsp. paratuberculosis
ggcccguccccacc

SEQ ID NO: 2886166 - RNA, 18 nt, Mycobacterium avium subsp. paratuberculosis
ggcccguccccaccaccg

SEQ ID NO: 2886167 - RNA, 19 nt, Mycobacterium avium subsp. paratuberculosis
ggcccguccccaccaccga

SEQ ID NO: 2886168 - RNA, 17 nt, Mycobacterium avium subsp. paratuberculosis
ggcccguccgccccgcu

SEQ ID NO: 2886169 - RNA, 22 nt, Mycobacterium avium subsp. paratuberculosis
ggcccguccgccccgcugccgg

SEQ ID NO: 2886170 - RNA, 22 nt, Mycobacterium avium subsp. paratuberculosis
ggcccguccgcgaaucgauaac

SEQ ID NO: 2886171 - RNA, 12 nt, Mycobacterium avium subsp. paratuberculosis
ggcccgucgcca

SEQ ID NO: 2886172 - RNA, 15 nt, Mycobacterium avium subsp. paratuberculosis
ggcccgucgccacca

SEQ ID NO: 2886173 - RNA, 13 nt, Mycobacterium avium subsp. paratuberculosis
ggcccgucgccga

SEQ ID NO: 2886174 - RNA, 15 nt, Mycobacterium avium subsp. paratuberculosis
ggcccgucgccgauc

SEQ ID NO: 2886175 - RNA, 13 nt, Mycobacterium avium subsp. paratuberculosis
ggcccgucgccgg

SEQ ID NO: 2886176 - RNA, 17 nt, Mycobacterium avium subsp. paratuberculosis
ggcccgucgccggcgcg

SEQ ID NO: 2886177 - RNA, 14 nt, Mycobacterium avium subsp. paratuberculosis
ggcccgucgccgug

SEQ ID NO: 2886178 - RNA, 18 nt, Mycobacterium avium subsp. paratuberculosis
ggcccgucgccgugcguc

SEQ ID NO: 2886179 - RNA, 12 nt, Mycobacterium avium subsp. paratuberculosis
ggcccgucggcg

SEQ ID NO: 2886180 - RNA, 14 nt, Mycobacterium avium subsp. paratuberculosis
ggcccgucggcgug

SEQ ID NO: 2886181 - RNA, 15 nt, Mycobacterium avium subsp. paratuberculosis
ggcccgucggcguga

SEQ ID NO: 2886182 - RNA, 13 nt, Mycobacterium avium subsp. paratuberculosis
ggcccgugucgcg

SEQ ID NO: 2886183 - RNA, 16 nt, Mycobacterium avium subsp. paratuberculosis
ggcccgugucgcggcc

SEQ ID NO: 2886184 - RNA, 19 nt, Mycobacterium avium subsp. paratuberculosis
ggcccguugagcaccgcga

SEQ ID NO: 2886185 - RNA, 18 nt, Mycobacterium avium subsp. paratuberculosis
ggcccuauggcaucgcca

SEQ ID NO: 2886186 - RNA, 19 nt, Mycobacterium avium subsp. paratuberculosis
ggcccuauggcaucgccaa

SEQ ID NO: 2886187 - RNA, 14 nt, Mycobacterium avium subsp. paratuberculosis
ggcccucaucgucg

SEQ ID NO: 2886188 - RNA, 15 nt, Mycobacterium avium subsp. paratuberculosis
ggcccucaucgucga

SEQ ID NO: 2886189 - RNA, 16 nt, Mycobacterium avium subsp. paratuberculosis
ggcccucaucgucgac

SEQ ID NO: 2886190 - RNA, 20 nt, Mycobacterium avium subsp. paratuberculosis
ggcccucaucgucgacccgg

SEQ ID NO: 2886191 - RNA, 14 nt, Mycobacterium avium subsp. paratuberculosis
ggcccuccagcacc

SEQ ID NO: 2886192 - RNA, 17 nt, Mycobacterium avium subsp. paratuberculosis
ggcccucccccgagucg

SEQ ID NO: 2886193 - RNA, 14 nt, Mycobacterium avium subsp. paratuberculosis
ggcccuccugggug

SEQ ID NO: 2886194 - RNA, 15 nt, Mycobacterium avium subsp. paratuberculosis
ggcccuccuggguga

SEQ ID NO: 2886195 - RNA, 12 nt, Mycobacterium avium subsp. paratuberculosis
ggcccucgacgu

SEQ ID NO: 2886196 - RNA, 12 nt, Mycobacterium avium subsp. paratuberculosis
ggcccucgccgc

SEQ ID NO: 2886197 - RNA, 17 nt, Mycobacterium avium subsp. paratuberculosis
ggcccucgccgcgguca

SEQ ID NO: 2886198 - RNA, 21 nt, Mycobacterium avium subsp. paratuberculosis
ggcccucgcucaacccgucgc

SEQ ID NO: 2886199 - RNA, 19 nt, Mycobacterium avium subsp. paratuberculosis
ggcccucggaggugccgcg

SEQ ID NO: 2886200 - RNA, 23 nt, Mycobacterium avium subsp. paratuberculosis
ggcccucggaggugccgcgcggc

SEQ ID NO: 2886201 - RNA, 15 nt, Mycobacterium avium subsp. paratuberculosis
ggcccucggccagcc

SEQ ID NO: 2886202 - RNA, 15 nt, Mycobacterium avium subsp. paratuberculosis
ggcccucguccgaca

SEQ ID NO: 2886203 - RNA, 22 nt, Mycobacterium avium subsp. paratuberculosis
ggcccucguccgacagcgccug

SEQ ID NO: 2886204 - RNA, 15 nt, Mycobacterium avium subsp. paratuberculosis
ggcccucgucggcga

SEQ ID NO: 2886205 - RNA, 20 nt, Mycobacterium avium subsp. paratuberculosis
ggcccucgucggcgagcagc

SEQ ID NO: 2886206 - RNA, 12 nt, Mycobacterium avium subsp. paratuberculosis
ggcccugcagcg

SEQ ID NO: 2886207 - RNA, 14 nt, Mycobacterium avium subsp. paratuberculosis
ggcccugcagcgcc

SEQ ID NO: 2886208 - RNA, 23 nt, Mycobacterium avium subsp. paratuberculosis
ggcccugcagcgccuugaccgcg

SEQ ID NO: 2886209 - RNA, 15 nt, Mycobacterium avium subsp. paratuberculosis
ggcccugccagcgcc

SEQ ID NO: 2886210 - RNA, 16 nt, Mycobacterium avium subsp. paratuberculosis
ggcccugccagcgccc

SEQ ID NO: 2886211 - RNA, 18 nt, Mycobacterium avium subsp. paratuberculosis
ggcccugccagcgcccgc

SEQ ID NO: 2886212 - RNA, 17 nt, Mycobacterium avium subsp. paratuberculosis
ggcccugcgcggccugc

SEQ ID NO: 2886213 - RNA, 21 nt, Mycobacterium avium subsp. paratuberculosis
ggcccugcgcggccugcagca

SEQ ID NO: 2886214 - RNA, 12 nt, Mycobacterium avium subsp. paratuberculosis
ggcccugcggcc

SEQ ID NO: 2886215 - RNA, 13 nt, Mycobacterium avium subsp. paratuberculosis
ggcccugcggcca

SEQ ID NO: 2886216 - RNA, 15 nt, Mycobacterium avium subsp. paratuberculosis
ggcccugcggccagu

SEQ ID NO: 2886217 - RNA, 22 nt, Mycobacterium avium subsp. paratuberculosis
ggcccugcggccagugccgggc

SEQ ID NO: 2886218 - RNA, 14 nt, Mycobacterium avium subsp. paratuberculosis
ggcccugcucgucg

SEQ ID NO: 2886219 - RNA, 17 nt, Mycobacterium avium subsp. paratuberculosis
ggcccugcucgucguug

SEQ ID NO: 2886220 - RNA, 18 nt, Mycobacterium avium subsp. paratuberculosis
ggcccugcucgucguuga

SEQ ID NO: 2886221 - RNA, 17 nt, Mycobacterium avium subsp. paratuberculosis
ggcccugcucuucgcgc

SEQ ID NO: 2886222 - RNA, 19 nt, Mycobacterium avium subsp. paratuberculosis
ggcccugcucuucgcgcgc

SEQ ID NO: 2886223 - RNA, 22 nt, Mycobacterium avium subsp. paratuberculosis
ggcccugcucuucgcgcgcggc

SEQ ID NO: 2886224 - RNA, 23 nt, Mycobacterium avium subsp. paratuberculosis
ggcccugcucuucgcgcgcggcg

SEQ ID NO: 2886225 - RNA, 15 nt, Mycobacterium avium subsp. paratuberculosis
ggcccuggcagguga

SEQ ID NO: 2886226 - RNA, 21 nt, Mycobacterium avium subsp. paratuberculosis
ggcccuggcaggugagccggg

SEQ ID NO: 2886227 - RNA, 20 nt, Mycobacterium avium subsp. paratuberculosis
ggcccugguugagcaccgcg

SEQ ID NO: 2886228 - RNA, 16 nt, Mycobacterium avium subsp. paratuberculosis
ggcccuguucgccguc

SEQ ID NO: 2886229 - RNA, 15 nt, Mycobacterium avium subsp. paratuberculosis
ggcccuucgaccucg

SEQ ID NO: 2886230 - RNA, 16 nt, Mycobacterium avium subsp. paratuberculosis
ggcccuucucggacgc

SEQ ID NO: 2886231 - RNA, 21 nt, Mycobacterium avium subsp. paratuberculosis
ggcccuugccccaccaccgcc

SEQ ID NO: 2886232 - RNA, 19 nt, Mycobacterium avium subsp. paratuberculosis
ggccgaaaaaccugcggug

SEQ ID NO: 2886233 - RNA, 20 nt, Mycobacterium avium subsp. paratuberculosis
ggccgaaaaaccugcggugc

SEQ ID NO: 2886234 - RNA, 21 nt, Mycobacterium avium subsp. paratuberculosis
ggccgaaaaaccugcggugcc

SEQ ID NO: 2886235 - RNA, 16 nt, Mycobacterium avium subsp. paratuberculosis
ggccgaaacgcccggc

SEQ ID NO: 2886236 - RNA, 17 nt, Mycobacterium avium subsp. paratuberculosis
ggccgaaacgcccggcu

SEQ ID NO: 2886237 - RNA, 14 nt, Mycobacterium avium subsp. paratuberculosis
ggccgaaaucaacg

SEQ ID NO: 2886238 - RNA, 17 nt, Mycobacterium avium subsp. paratuberculosis
ggccgaaaucaacgcgc

SEQ ID NO: 2886239 - RNA, 21 nt, Mycobacterium avium subsp. paratuberculosis
ggccgaaaucaacgcgccgaa

SEQ ID NO: 2886240 - RNA, 22 nt, Mycobacterium avium subsp. paratuberculosis
ggccgaaaucaacgcgccgaac

SEQ ID NO: 2886241 - RNA, 15 nt, Mycobacterium avium subsp. paratuberculosis
ggccgaacacggccg

SEQ ID NO: 2886242 - RNA, 14 nt, Mycobacterium avium subsp. paratuberculosis
ggccgaacagcagc

SEQ ID NO: 2886243 - RNA, 15 nt, Mycobacterium avium subsp. paratuberculosis
ggccgaacagcagcg

SEQ ID NO: 2886244 - RNA, 16 nt, Mycobacterium avium subsp. paratuberculosis
ggccgaacagcagcga

SEQ ID NO: 2886245 - RNA, 14 nt, Mycobacterium avium subsp. paratuberculosis
ggccgaaccgcagc

SEQ ID NO: 2886246 - RNA, 17 nt, Mycobacterium avium subsp. paratuberculosis
ggccgaaccgcagccgg

SEQ ID NO: 2886247 - RNA, 17 nt, Mycobacterium avium subsp. paratuberculosis
ggccgaaccgcucgucg

SEQ ID NO: 2886248 - RNA, 12 nt, Mycobacterium avium subsp. paratuberculosis
ggccgaaccgga

SEQ ID NO: 2886249 - RNA, 14 nt, Mycobacterium avium subsp. paratuberculosis
ggccgaacgggucg

SEQ ID NO: 2886250 - RNA, 19 nt, Mycobacterium avium subsp. paratuberculosis
ggccgaacgggucggcgac

SEQ ID NO: 2886251 - RNA, 21 nt, Mycobacterium avium subsp. paratuberculosis
ggccgaacugcaucaugucca

SEQ ID NO: 2886252 - RNA, 17 nt, Mycobacterium avium subsp. paratuberculosis
ggccgaacugccgaugc

SEQ ID NO: 2886253 - RNA, 23 nt, Mycobacterium avium subsp. paratuberculosis
ggccgaacugccgaugcugagcg

SEQ ID NO: 2886254 - RNA, 20 nt, Mycobacterium avium subsp. paratuberculosis
ggccgaagaacgacuggcgg

SEQ ID NO: 2886255 - RNA, 21 nt, Mycobacterium avium subsp. paratuberculosis
ggccgaagaacgacuggcggc

SEQ ID NO: 2886256 - RNA, 18 nt, Mycobacterium avium subsp. paratuberculosis
ggccgaagaacucagccg

SEQ ID NO: 2886257 - RNA, 14 nt, Mycobacterium avium subsp. paratuberculosis
ggccgaagaccggg

SEQ ID NO: 2886258 - RNA, 13 nt, Mycobacterium avium subsp. paratuberculosis
ggccgaagacgau

SEQ ID NO: 2886259 - RNA, 15 nt, Mycobacterium avium subsp. paratuberculosis
ggccgaagacgauga

SEQ ID NO: 2886260 - RNA, 14 nt, Mycobacterium avium subsp. paratuberculosis
ggccgaagccgaca

SEQ ID NO: 2886261 - RNA, 23 nt, Mycobacterium avium subsp. paratuberculosis
ggccgaagccgacaccggguccc

SEQ ID NO: 2886262 - RNA, 14 nt, Mycobacterium avium subsp. paratuberculosis
ggccgaaggcggcg

SEQ ID NO: 2886263 - RNA, 15 nt, Mycobacterium avium subsp. paratuberculosis
ggccgaaggcggcgc

SEQ ID NO: 2886264 - RNA, 19 nt, Mycobacterium avium subsp. paratuberculosis
ggccgaaggcggcgccggc

SEQ ID NO: 2886265 - RNA, 18 nt, Mycobacterium avium subsp. paratuberculosis
ggccgaaggugggguuga

SEQ ID NO: 2886266 - RNA, 18 nt, Mycobacterium avium subsp. paratuberculosis
ggccgaauccggccggag

SEQ ID NO: 2886267 - RNA, 22 nt, Mycobacterium avium subsp. paratuberculosis
ggccgaauccggccggagaccg

SEQ ID NO: 2886268 - RNA, 17 nt, Mycobacterium avium subsp. paratuberculosis
ggccgacaacgacagca

SEQ ID NO: 2886269 - RNA, 22 nt, Mycobacterium avium subsp. paratuberculosis
ggccgacaacgacagcacccag

SEQ ID NO: 2886270 - RNA, 22 nt, Mycobacterium avium subsp. paratuberculosis
ggccgacaccccgaugccgaac

SEQ ID NO: 2886271 - RNA, 16 nt, Mycobacterium avium subsp. paratuberculosis
ggccgacagcacgccg

SEQ ID NO: 2886272 - RNA, 19 nt, Mycobacterium avium subsp. paratuberculosis
ggccgacagcacgccgggc

SEQ ID NO: 2886273 - RNA, 22 nt, Mycobacterium avium subsp. paratuberculosis
ggccgacagcacgccgggcaug

SEQ ID NO: 2886274 - RNA, 16 nt, Mycobacterium avium subsp. paratuberculosis
ggccgacagcgcgucg

SEQ ID NO: 2886275 - RNA, 19 nt, Mycobacterium avium subsp. paratuberculosis
ggccgacagcgcgucggcg

SEQ ID NO: 2886276 - RNA, 21 nt, Mycobacterium avium subsp. paratuberculosis
ggccgacagcgcgucggcgau

SEQ ID NO: 2886277 - RNA, 23 nt, Mycobacterium avium subsp. paratuberculosis
ggccgacagguagcaggcgcgca

SEQ ID NO: 2886278 - RNA, 13 nt, Mycobacterium avium subsp. paratuberculosis
ggccgacaucguc

SEQ ID NO: 2886279 - RNA, 17 nt, Mycobacterium avium subsp. paratuberculosis
ggccgacaucgucggcu

SEQ ID NO: 2886280 - RNA, 17 nt, Mycobacterium avium subsp. paratuberculosis
ggccgacauggacgcgg

SEQ ID NO: 2886281 - RNA, 22 nt, Mycobacterium avium subsp. paratuberculosis
ggccgaugaugaugccgcccau

SEQ ID NO: 2886282 - RNA, 20 nt, Mycobacterium avium subsp. paratuberculosis
ggccgauggcccaggccgcg

SEQ ID NO: 2886283 - RNA, 18 nt, Mycobacterium avium subsp. paratuberculosis
ggccgauggcgcccagcg

SEQ ID NO: 2886284 - RNA, 18 nt, Mycobacterium avium subsp. paratuberculosis
ggccgauggucagcugcc

SEQ ID NO: 2886285 - RNA, 19 nt, Mycobacterium avium subsp. paratuberculosis
ggccgauggucagcugccg

SEQ ID NO: 2886286 - RNA, 19 nt, Mycobacterium avium subsp. paratuberculosis
ggccgauggugguaccgac

SEQ ID NO: 2886287 - RNA, 18 nt, Mycobacterium avium subsp. paratuberculosis
ggccgauguucaccccga

SEQ ID NO: 2886288 - RNA, 21 nt, Mycobacterium avium subsp. paratuberculosis
ggccgauguucaccccgauca

SEQ ID NO: 2886289 - RNA, 17 nt, Mycobacterium avium subsp. paratuberculosis
ggccgauucggcgccgc

SEQ ID NO: 2886290 - RNA, 21 nt, Mycobacterium avium subsp. paratuberculosis
ggccgauucggcgccgcgacc

SEQ ID NO: 2886291 - RNA, 19 nt, Mycobacterium avium subsp. paratuberculosis
ggccgcaagcgaagccgug

SEQ ID NO: 2886292 - RNA, 20 nt, Mycobacterium avium subsp. paratuberculosis
ggccgcaauacggugcccgc

SEQ ID NO: 2886293 - RNA, 22 nt, Mycobacterium avium subsp. paratuberculosis
ggccgcaauacggugcccgccg

SEQ ID NO: 2886294 - RNA, 17 nt, Mycobacterium avium subsp. paratuberculosis
ggccgcaaucggcgccg

SEQ ID NO: 2886295 - RNA, 19 nt, Mycobacterium avium subsp. paratuberculosis
ggccgcaaucggcgccggc

SEQ ID NO: 2886296 - RNA, 15 nt, Mycobacterium avium subsp. paratuberculosis
ggccgcacaccacca

SEQ ID NO: 2886297 - RNA, 16 nt, Mycobacterium avium subsp. paratuberculosis
ggccgcacaccaccac

SEQ ID NO: 2886298 - RNA, 17 nt, Mycobacterium avium subsp. paratuberculosis
ggccgcacaccaccacg

SEQ ID NO: 2886299 - RNA, 22 nt, Mycobacterium avium subsp. paratuberculosis
ggccgcaccccacccgcgcgac

SEQ ID NO: 2886300 - RNA, 23 nt, Mycobacterium avium subsp. paratuberculosis
ggccgcaccccacccgcgcgaca

SEQ ID NO: 2886301 - RNA, 18 nt, Mycobacterium avium subsp. paratuberculosis
ggccgcacccccuccaca

SEQ ID NO: 2886302 - RNA, 22 nt, Mycobacterium avium subsp. paratuberculosis
ggccgcacccccuccacacggc

SEQ ID NO: 2886303 - RNA, 15 nt, Mycobacterium avium subsp. paratuberculosis
ggccgcaccugaucg

SEQ ID NO: 2886304 - RNA, 14 nt, Mycobacterium avium subsp. paratuberculosis
ggccgcaccuggca

SEQ ID NO: 2886305 - RNA, 20 nt, Mycobacterium avium subsp. paratuberculosis
ggccgcacgcgaacaccaga

SEQ ID NO: 2886306 - RNA, 17 nt, Mycobacterium avium subsp. paratuberculosis
ggccgcacggugcagca

SEQ ID NO: 2886307 - RNA, 20 nt, Mycobacterium avium subsp. paratuberculosis
ggccgcacggugcagcagcg

SEQ ID NO: 2886308 - RNA, 19 nt, Mycobacterium avium subsp. paratuberculosis
ggccgcacguauccgcggu

SEQ ID NO: 2886309 - RNA, 17 nt, Mycobacterium avium subsp. paratuberculosis
ggccgcacgucccgccc

SEQ ID NO: 2886310 - RNA, 21 nt, Mycobacterium avium subsp. paratuberculosis
ggccgcacgucccgcccggcg

SEQ ID NO: 2886311 - RNA, 18 nt, Mycobacterium avium subsp. paratuberculosis
ggccgcacuccgucgcga

SEQ ID NO: 2886312 - RNA, 13 nt, Mycobacterium avium subsp. paratuberculosis
ggccgcagcacca

SEQ ID NO: 2886313 - RNA, 14 nt, Mycobacterium avium subsp. paratuberculosis
ggccgcagcaccac

SEQ ID NO: 2886314 - RNA, 22 nt, Mycobacterium avium subsp. paratuberculosis
ggccgcagcaccaccucgugca

SEQ ID NO: 2886315 - RNA, 14 nt, Mycobacterium avium subsp. paratuberculosis
ggccgcagcagcga

SEQ ID NO: 2886316 - RNA, 19 nt, Mycobacterium avium subsp. paratuberculosis
ggccgcagcagcgaggccu

SEQ ID NO: 2886317 - RNA, 17 nt, Mycobacterium avium subsp. paratuberculosis
ggccgcagccgcgcggc

SEQ ID NO: 2886318 - RNA, 21 nt, Mycobacterium avium subsp. paratuberculosis
ggccgcagccgcgcggccggc

SEQ ID NO: 2886319 - RNA, 22 nt, Mycobacterium avium subsp. paratuberculosis
ggccgcagccgcgcggccggcc

SEQ ID NO: 2886320 - RNA, 13 nt, Mycobacterium avium subsp. paratuberculosis
ggccgcagcgacu

SEQ ID NO: 2886321 - RNA, 21 nt, Mycobacterium avium subsp. paratuberculosis
ggccgcagcgcaucgccggcg

SEQ ID NO: 2886322 - RNA, 22 nt, Mycobacterium avium subsp. paratuberculosis
ggccgcagcgcaucgccggcga

SEQ ID NO: 2886323 - RNA, 18 nt, Mycobacterium avium subsp. paratuberculosis
ggccgcagcgcaucguug

SEQ ID NO: 2886324 - RNA, 13 nt, Mycobacterium avium subsp. paratuberculosis
ggccgcagcgccc

SEQ ID NO: 2886325 - RNA, 17 nt, Mycobacterium avium subsp. paratuberculosis
ggccgcagcgcccggca

SEQ ID NO: 2886326 - RNA, 22 nt, Mycobacterium avium subsp. paratuberculosis
ggccgcagcgcccggcagcggu

SEQ ID NO: 2886327 - RNA, 12 nt, Mycobacterium avium subsp. paratuberculosis
ggccgcagcgcg

SEQ ID NO: 2886328 - RNA, 22 nt, Mycobacterium avium subsp. paratuberculosis
ggccgcagcgcgacgaacagca

SEQ ID NO: 2886329 - RNA, 17 nt, Mycobacterium avium subsp. paratuberculosis
ggccgcagcgcgcgggu

SEQ ID NO: 2886330 - RNA, 13 nt, Mycobacterium avium subsp. paratuberculosis
ggccgcagcgcgg

SEQ ID NO: 2886331 - RNA, 13 nt, Mycobacterium avium subsp. paratuberculosis
ggccgcagcggca

SEQ ID NO: 2886332 - RNA, 23 nt, Mycobacterium avium subsp. paratuberculosis
ggccgcagcggcaggucgucguc

SEQ ID NO: 2886333 - RNA, 22 nt, Mycobacterium avium subsp. paratuberculosis
ggccgcagcgggauuggcgcca

SEQ ID NO: 2886334 - RNA, 13 nt, Mycobacterium avium subsp. paratuberculosis
ggccgcagcgugg

SEQ ID NO: 2886335 - RNA, 19 nt, Mycobacterium avium subsp. paratuberculosis
ggccgcagcucgcccagca

SEQ ID NO: 2886336 - RNA, 14 nt, Mycobacterium avium subsp. paratuberculosis
ggccgcagcugcug

SEQ ID NO: 2886337 - RNA, 15 nt, Mycobacterium avium subsp. paratuberculosis
ggccgcaggcggcca

SEQ ID NO: 2886338 - RNA, 17 nt, Mycobacterium avium subsp. paratuberculosis
ggccgcaggcggccagc

SEQ ID NO: 2886339 - RNA, 19 nt, Mycobacterium avium subsp. paratuberculosis
ggccgcaggguggccagca

SEQ ID NO: 2886340 - RNA, 22 nt, Mycobacterium avium subsp. paratuberculosis
ggccgcaggguggccagcaccg

SEQ ID NO: 2886341 - RNA, 17 nt, Mycobacterium avium subsp. paratuberculosis
ggccgcauccagcgccg

SEQ ID NO: 2886342 - RNA, 18 nt, Mycobacterium avium subsp. paratuberculosis
ggccgcauccagcgccgc

SEQ ID NO: 2886343 - RNA, 21 nt, Mycobacterium avium subsp. paratuberculosis
ggccgcauccgcgagccgagc

SEQ ID NO: 2886344 - RNA, 21 nt, Mycobacterium avium subsp. paratuberculosis
ggccgcaucguugguccaggc

SEQ ID NO: 2886345 - RNA, 22 nt, Mycobacterium avium subsp. paratuberculosis
ggccgcaugucgaccucggcca

SEQ ID NO: 2886346 - RNA, 16 nt, Mycobacterium avium subsp. paratuberculosis
ggccgcauuuggcgua

SEQ ID NO: 2886347 - RNA, 22 nt, Mycobacterium avium subsp. paratuberculosis
ggccgccaaaucgaucacccaa

SEQ ID NO: 2886348 - RNA, 14 nt, Mycobacterium avium subsp. paratuberculosis
ggccgccaccgagg

SEQ ID NO: 2886349 - RNA, 14 nt, Mycobacterium avium subsp. paratuberculosis
ggccgccaccgcca

SEQ ID NO: 2886350 - RNA, 13 nt, Mycobacterium avium subsp. paratuberculosis
ggccgccacggcg

SEQ ID NO: 2886351 - RNA, 12 nt, Mycobacterium avium subsp. paratuberculosis
ggccgccagcac

SEQ ID NO: 2886352 - RNA, 14 nt, Mycobacterium avium subsp. paratuberculosis
ggccgccagcaccu

SEQ ID NO: 2886353 - RNA, 19 nt, Mycobacterium avium subsp. paratuberculosis
ggccgccagcaccucgcgg

SEQ ID NO: 2886354 - RNA, 20 nt, Mycobacterium avium subsp. paratuberculosis
ggccgccagcaccucgcggc

SEQ ID NO: 2886355 - RNA, 22 nt, Mycobacterium avium subsp. paratuberculosis
ggccgccagcaccucgcggcag

SEQ ID NO: 2886356 - RNA, 13 nt, Mycobacterium avium subsp. paratuberculosis
ggccgccagcagc

SEQ ID NO: 2886357 - RNA, 14 nt, Mycobacterium avium subsp. paratuberculosis
ggccgccagcagca

SEQ ID NO: 2886358 - RNA, 19 nt, Mycobacterium avium subsp. paratuberculosis
ggccgccagcagcacggca

SEQ ID NO: 2886359 - RNA, 20 nt, Mycobacterium avium subsp. paratuberculosis
ggccgccagcagcacggcaa

SEQ ID NO: 2886360 - RNA, 23 nt, Mycobacterium avium subsp. paratuberculosis
ggccgccagcaguguccagucgg

SEQ ID NO: 2886361 - RNA, 13 nt, Mycobacterium avium subsp. paratuberculosis
ggccgccagccgc

SEQ ID NO: 2886362 - RNA, 15 nt, Mycobacterium avium subsp. paratuberculosis
ggccgccagccgcgu

SEQ ID NO: 2886363 - RNA, 13 nt, Mycobacterium avium subsp. paratuberculosis
ggccgccagcgca

SEQ ID NO: 2886364 - RNA, 14 nt, Mycobacterium avium subsp. paratuberculosis
ggccgccagcgcac

SEQ ID NO: 2886365 - RNA, 14 nt, Mycobacterium avium subsp. paratuberculosis
ggccgccggcaccg

SEQ ID NO: 2886366 - RNA, 13 nt, Mycobacterium avium subsp. paratuberculosis
ggccgccggccag

SEQ ID NO: 2886367 - RNA, 15 nt, Mycobacterium avium subsp. paratuberculosis
ggccgccggccagcu

SEQ ID NO: 2886368 - RNA, 12 nt, Mycobacterium avium subsp. paratuberculosis
ggccgccggccg

SEQ ID NO: 2886369 - RNA, 13 nt, Mycobacterium avium subsp. paratuberculosis
ggccgccggccgc

SEQ ID NO: 2886370 - RNA, 14 nt, Mycobacterium avium subsp. paratuberculosis
ggccgccggccgcg

SEQ ID NO: 2886371 - RNA, 15 nt, Mycobacterium avium subsp. paratuberculosis
ggccgccggccgcgg

SEQ ID NO: 2886372 - RNA, 16 nt, Mycobacterium avium subsp. paratuberculosis
ggccgccggccgcggc

SEQ ID NO: 2886373 - RNA, 20 nt, Mycobacterium avium subsp. paratuberculosis
ggccgccggccgcucgcggg

SEQ ID NO: 2886374 - RNA, 12 nt, Mycobacterium avium subsp. paratuberculosis
ggccgccggcgg

SEQ ID NO: 2886375 - RNA, 17 nt, Mycobacterium avium subsp. paratuberculosis
ggccgccggcggccaau

SEQ ID NO: 2886376 - RNA, 17 nt, Mycobacterium avium subsp. paratuberculosis
ggccgccgggacgggca

SEQ ID NO: 2886377 - RNA, 18 nt, Mycobacterium avium subsp. paratuberculosis
ggccgccgggacgggcau

SEQ ID NO: 2886378 - RNA, 13 nt, Mycobacterium avium subsp. paratuberculosis
ggccgccgggccg

SEQ ID NO: 2886379 - RNA, 16 nt, Mycobacterium avium subsp. paratuberculosis
ggccgccgggccgccg

SEQ ID NO: 2886380 - RNA, 20 nt, Mycobacterium avium subsp. paratuberculosis
ggccgccgggccggcggcca

SEQ ID NO: 2886381 - RNA, 13 nt, Mycobacterium avium subsp. paratuberculosis
ggccgccggggcc

SEQ ID NO: 2886382 - RNA, 16 nt, Mycobacterium avium subsp. paratuberculosis
ggccgccggggcccca

SEQ ID NO: 2886383 - RNA, 19 nt, Mycobacterium avium subsp. paratuberculosis
ggccgccggguggcggggc

SEQ ID NO: 2886384 - RNA, 19 nt, Mycobacterium avium subsp. paratuberculosis
ggccgccguaucccugcca

SEQ ID NO: 2886385 - RNA, 20 nt, Mycobacterium avium subsp. paratuberculosis
ggccgccguaucccugccag

SEQ ID NO: 2886386 - RNA, 14 nt, Mycobacterium avium subsp. paratuberculosis
ggccgccgucgcca

SEQ ID NO: 2886387 - RNA, 15 nt, Mycobacterium avium subsp. paratuberculosis
ggccgccgucgccac

SEQ ID NO: 2886388 - RNA, 16 nt, Mycobacterium avium subsp. paratuberculosis
ggccgccgucgccacc

SEQ ID NO: 2886389 - RNA, 15 nt, Mycobacterium avium subsp. paratuberculosis
ggccgccgucgguau

SEQ ID NO: 2886390 - RNA, 18 nt, Mycobacterium avium subsp. paratuberculosis
ggccgccguggcccacgc

SEQ ID NO: 2886391 - RNA, 20 nt, Mycobacterium avium subsp. paratuberculosis
ggccgccucacgcagggcca

SEQ ID NO: 2886392 - RNA, 13 nt, Mycobacterium avium subsp. paratuberculosis
ggccgccucccgc

SEQ ID NO: 2886393 - RNA, 17 nt, Mycobacterium avium subsp. paratuberculosis
ggccgccucccgcagcg

SEQ ID NO: 2886394 - RNA, 21 nt, Mycobacterium avium subsp. paratuberculosis
ggccgccucccgcagcgccag

SEQ ID NO: 2886395 - RNA, 22 nt, Mycobacterium avium subsp. paratuberculosis
ggccgccucccgcagcgccagc

SEQ ID NO: 2886396 - RNA, 23 nt, Mycobacterium avium subsp. paratuberculosis
ggccgccucccgcagcgccagcg

SEQ ID NO: 2886397 - RNA, 22 nt, Mycobacterium avium subsp. paratuberculosis
ggccgccuccgguuugcgccgg

SEQ ID NO: 2886398 - RNA, 24 nt, Mycobacterium avium subsp. paratuberculosis
ggccgccuccgguuugcgccggcu

SEQ ID NO: 2886399 - RNA, 19 nt, Mycobacterium avium subsp. paratuberculosis
ggccgccucgaagucgccg

SEQ ID NO: 2886400 - RNA, 20 nt, Mycobacterium avium subsp. paratuberculosis
ggccgccucgaagucgccgg

SEQ ID NO: 2886401 - RNA, 22 nt, Mycobacterium avium subsp. paratuberculosis
ggccgccucgaagucgccggcc

SEQ ID NO: 2886402 - RNA, 16 nt, Mycobacterium avium subsp. paratuberculosis
ggccgccucgucgagc

SEQ ID NO: 2886403 - RNA, 15 nt, Mycobacterium avium subsp. paratuberculosis
ggccgccugcccggg

SEQ ID NO: 2886404 - RNA, 17 nt, Mycobacterium avium subsp. paratuberculosis
ggccgccugcccgggcg

SEQ ID NO: 2886405 - RNA, 15 nt, Mycobacterium avium subsp. paratuberculosis
ggccgccuggacgac

SEQ ID NO: 2886406 - RNA, 19 nt, Mycobacterium avium subsp. paratuberculosis
ggccgccuggacgacgucg

SEQ ID NO: 2886407 - RNA, 20 nt, Mycobacterium avium subsp. paratuberculosis
ggccgccuucacgaccggca

SEQ ID NO: 2886408 - RNA, 16 nt, Mycobacterium avium subsp. paratuberculosis
ggccgccuugaucuug

SEQ ID NO: 2886409 - RNA, 18 nt, Mycobacterium avium subsp. paratuberculosis
ggccgccuugggccgguc

SEQ ID NO: 2886410 - RNA, 16 nt, Mycobacterium avium subsp. paratuberculosis
ggccgccuuggugauc

SEQ ID NO: 2886411 - RNA, 20 nt, Mycobacterium avium subsp. paratuberculosis
ggccgccuuggugauccggg

SEQ ID NO: 2886412 - RNA, 21 nt, Mycobacterium avium subsp. paratuberculosis
ggccgcgaaaauaccgccggc

SEQ ID NO: 2886413 - RNA, 22 nt, Mycobacterium avium subsp. paratuberculosis
ggccgcgaaaauaccgccggcc

SEQ ID NO: 2886414 - RNA, 13 nt, Mycobacterium avium subsp. paratuberculosis
ggccgcgaacggc

SEQ ID NO: 2886415 - RNA, 16 nt, Mycobacterium avium subsp. paratuberculosis
ggccgcgaacggcccg

SEQ ID NO: 2886416 - RNA, 23 nt, Mycobacterium avium subsp. paratuberculosis
ggccgcgaacgggugaccggcgg

SEQ ID NO: 2886417 - RNA, 20 nt, Mycobacterium avium subsp. paratuberculosis
ggccgcgaagaugucgccgu

SEQ ID NO: 2886418 - RNA, 21 nt, Mycobacterium avium subsp. paratuberculosis
ggccgcgaagaugucgccgua

SEQ ID NO: 2886419 - RNA, 17 nt, Mycobacterium avium subsp. paratuberculosis
ggccgcgaaggcggcgu

SEQ ID NO: 2886420 - RNA, 19 nt, Mycobacterium avium subsp. paratuberculosis
ggccgcgaaggcggcgucg

SEQ ID NO: 2886421 - RNA, 20 nt, Mycobacterium avium subsp. paratuberculosis
ggccgcgaaggcggcgucga

SEQ ID NO: 2886422 - RNA, 15 nt, Mycobacterium avium subsp. paratuberculosis
ggccgcgacagccgg

SEQ ID NO: 2886423 - RNA, 13 nt, Mycobacterium avium subsp. paratuberculosis
ggccgcgacgccg

SEQ ID NO: 2886424 - RNA, 15 nt, Mycobacterium avium subsp. paratuberculosis
ggccgcgacgccgcc

SEQ ID NO: 2886425 - RNA, 17 nt, Mycobacterium avium subsp. paratuberculosis
ggccgcgacgccgccgc

SEQ ID NO: 2886426 - RNA, 16 nt, Mycobacterium avium subsp. paratuberculosis
ggccgcgacgcgcggu

SEQ ID NO: 2886427 - RNA, 22 nt, Mycobacterium avium subsp. paratuberculosis
ggccgcgacgggcugucccggc

SEQ ID NO: 2886428 - RNA, 15 nt, Mycobacterium avium subsp. paratuberculosis
ggccgcgacugcacc

SEQ ID NO: 2886429 - RNA, 20 nt, Mycobacterium avium subsp. paratuberculosis
ggccgcgagcacgacgucga

SEQ ID NO: 2886430 - RNA, 14 nt, Mycobacterium avium subsp. paratuberculosis
ggccgcgagcccgc

SEQ ID NO: 2886431 - RNA, 15 nt, Mycobacterium avium subsp. paratuberculosis
ggccgcgagcccgca

SEQ ID NO: 2886432 - RNA, 15 nt, Mycobacterium avium subsp. paratuberculosis
ggccgcgagcccggc

SEQ ID NO: 2886433 - RNA, 16 nt, Mycobacterium avium subsp. paratuberculosis
ggccgcgagcccggcg

SEQ ID NO: 2886434 - RNA, 21 nt, Mycobacterium avium subsp. paratuberculosis
ggccgcgagcgcuaccgcgcu

SEQ ID NO: 2886435 - RNA, 23 nt, Mycobacterium avium subsp. paratuberculosis
ggccgcgaggauuucgcucagcc

SEQ ID NO: 2886436 - RNA, 14 nt, Mycobacterium avium subsp. paratuberculosis
ggccgcgauccagc

SEQ ID NO: 2886437 - RNA, 18 nt, Mycobacterium avium subsp. paratuberculosis
ggccgcgauccagcgcug

SEQ ID NO: 2886438 - RNA, 20 nt, Mycobacterium avium subsp. paratuberculosis
ggccgcgauccagcgcuggc

SEQ ID NO: 2886439 - RNA, 15 nt, Mycobacterium avium subsp. paratuberculosis
ggccgcgaucgccaa

SEQ ID NO: 2886440 - RNA, 21 nt, Mycobacterium avium subsp. paratuberculosis
ggccgcgaucgccaacgcgcu

SEQ ID NO: 2886441 - RNA, 22 nt, Mycobacterium avium subsp. paratuberculosis
ggccgcgaucgccaacgcgcuc

SEQ ID NO: 2886442 - RNA, 23 nt, Mycobacterium avium subsp. paratuberculosis
ggccgcgaugaggcucaggccgg

SEQ ID NO: 2886443 - RNA, 13 nt, Mycobacterium avium subsp. paratuberculosis
ggccgcgaugucg

SEQ ID NO: 2886444 - RNA, 17 nt, Mycobacterium avium subsp. paratuberculosis
ggccgcgaugucggugg

SEQ ID NO: 2886445 - RNA, 15 nt, Mycobacterium avium subsp. paratuberculosis
ggccgcgcaccgccc

SEQ ID NO: 2886446 - RNA, 18 nt, Mycobacterium avium subsp. paratuberculosis
ggccgcgcaccgccccgc

SEQ ID NO: 2886447 - RNA, 22 nt, Mycobacterium avium subsp. paratuberculosis
ggccgcgcaccgccccgcccuu

SEQ ID NO: 2886448 - RNA, 19 nt, Mycobacterium avium subsp. paratuberculosis
ggccgcgcagaucgccagc

SEQ ID NO: 2886449 - RNA, 11 nt, Mycobacterium avium subsp. paratuberculosis
ggccgcgcagc

SEQ ID NO: 2886450 - RNA, 15 nt, Mycobacterium avium subsp. paratuberculosis
ggccgcggugaccgc

SEQ ID NO: 2886451 - RNA, 16 nt, Mycobacterium avium subsp. paratuberculosis
ggccgcggugaccgcg

SEQ ID NO: 2886452 - RNA, 20 nt, Mycobacterium avium subsp. paratuberculosis
ggccgcggugaccgcgccgc

SEQ ID NO: 2886453 - RNA, 23 nt, Mycobacterium avium subsp. paratuberculosis
ggccgcguacuucgcgcccugga

SEQ ID NO: 2886454 - RNA, 19 nt, Mycobacterium avium subsp. paratuberculosis
ggccgcguagcucgccgcg

SEQ ID NO: 2886455 - RNA, 24 nt, Mycobacterium avium subsp. paratuberculosis
ggccgcguagcucgccgcggccac

SEQ ID NO: 2886456 - RNA, 24 nt, Mycobacterium avium subsp. paratuberculosis
ggccgcguaggccuugcugagccg

SEQ ID NO: 2886457 - RNA, 13 nt, Mycobacterium avium subsp. paratuberculosis
ggccgcgucgacc

SEQ ID NO: 2886458 - RNA, 14 nt, Mycobacterium avium subsp. paratuberculosis
ggccgcgucgacca

SEQ ID NO: 2886459 - RNA, 17 nt, Mycobacterium avium subsp. paratuberculosis
ggccgcgucgaccagcc

SEQ ID NO: 2886460 - RNA, 19 nt, Mycobacterium avium subsp. paratuberculosis
ggccgcgucgaccagccgg

SEQ ID NO: 2886461 - RNA, 14 nt, Mycobacterium avium subsp. paratuberculosis
ggccgcgucgccga

SEQ ID NO: 2886462 - RNA, 15 nt, Mycobacterium avium subsp. paratuberculosis
ggccgcgucgccgac

SEQ ID NO: 2886463 - RNA, 15 nt, Mycobacterium avium subsp. paratuberculosis
ggccgcgucgccgau

SEQ ID NO: 2886464 - RNA, 12 nt, Mycobacterium avium subsp. paratuberculosis
ggccgcgucggc

SEQ ID NO: 2886465 - RNA, 18 nt, Mycobacterium avium subsp. paratuberculosis
ggccgcgucggcggcggc

SEQ ID NO: 2886466 - RNA, 15 nt, Mycobacterium avium subsp. paratuberculosis
ggccgcgucggcggu

SEQ ID NO: 2886467 - RNA, 16 nt, Mycobacterium avium subsp. paratuberculosis
ggccgcgucggcgguc

SEQ ID NO: 2886468 - RNA, 20 nt, Mycobacterium avium subsp. paratuberculosis
ggccgcgucggcggucgcca

SEQ ID NO: 2886469 - RNA, 22 nt, Mycobacterium avium subsp. paratuberculosis
ggccgcgucggcggucgccagc

SEQ ID NO: 2886470 - RNA, 13 nt, Mycobacterium avium subsp. paratuberculosis
ggccgcgucgggc

SEQ ID NO: 2886471 - RNA, 14 nt, Mycobacterium avium subsp. paratuberculosis
ggccgcgucgggca

SEQ ID NO: 2886472 - RNA, 16 nt, Mycobacterium avium subsp. paratuberculosis
ggccgcgugcaacaca

SEQ ID NO: 2886473 - RNA, 19 nt, Mycobacterium avium subsp. paratuberculosis
ggccgcgugcaacacaugg

SEQ ID NO: 2886474 - RNA, 21 nt, Mycobacterium avium subsp. paratuberculosis
ggccgcgugcaacacaugguc

SEQ ID NO: 2886475 - RNA, 20 nt, Mycobacterium avium subsp. paratuberculosis
ggccgcguuccaggaccuga

SEQ ID NO: 2886476 - RNA, 17 nt, Mycobacterium avium subsp. paratuberculosis
ggccgcguugucgacca

SEQ ID NO: 2886477 - RNA, 18 nt, Mycobacterium avium subsp. paratuberculosis
ggccgcguugucgaccac

SEQ ID NO: 2886478 - RNA, 15 nt, Mycobacterium avium subsp. paratuberculosis
ggccgcuacccggcg

SEQ ID NO: 2886479 - RNA, 22 nt, Mycobacterium avium subsp. paratuberculosis
ggccgcuaguuggugcugggca

SEQ ID NO: 2886480 - RNA, 13 nt, Mycobacterium avium subsp. paratuberculosis
ggccgcucagcgg

SEQ ID NO: 2886481 - RNA, 18 nt, Mycobacterium avium subsp. paratuberculosis
ggccgcucagcgggcggc

SEQ ID NO: 2886482 - RNA, 22 nt, Mycobacterium avium subsp. paratuberculosis
ggccgcucagcgggcggccagc

SEQ ID NO: 2886483 - RNA, 12 nt, Mycobacterium avium subsp. paratuberculosis
ggccgcucgcgg

SEQ ID NO: 2886484 - RNA, 19 nt, Mycobacterium avium subsp. paratuberculosis
ggccgcucgcgggccacag

SEQ ID NO: 2886485 - RNA, 15 nt, Mycobacterium avium subsp. paratuberculosis
ggccgcucggguguc

SEQ ID NO: 2886486 - RNA, 18 nt, Mycobacterium avium subsp. paratuberculosis
ggccgcucgggugucgcc

SEQ ID NO: 2886487 - RNA, 19 nt, Mycobacterium avium subsp. paratuberculosis
ggccgcucgggugucgccg

SEQ ID NO: 2886488 - RNA, 20 nt, Mycobacterium avium subsp. paratuberculosis
ggccgcucgggugucgccga

SEQ ID NO: 2886489 - RNA, 24 nt, Mycobacterium avium subsp. paratuberculosis
ggccgcucgggugucgccgagccg

SEQ ID NO: 2886490 - RNA, 13 nt, Mycobacterium avium subsp. paratuberculosis
ggccgcugcccgg

SEQ ID NO: 2886491 - RNA, 14 nt, Mycobacterium avium subsp. paratuberculosis
ggccgcugcccggg

SEQ ID NO: 2886492 - RNA, 13 nt, Mycobacterium avium subsp. paratuberculosis
ggccgcugcgccc

SEQ ID NO: 2886493 - RNA, 16 nt, Mycobacterium avium subsp. paratuberculosis
ggccgcugcgcccagc

SEQ ID NO: 2886494 - RNA, 17 nt, Mycobacterium avium subsp. paratuberculosis
ggccgcugcgcccagcg

SEQ ID NO: 2886495 - RNA, 18 nt, Mycobacterium avium subsp. paratuberculosis
ggccgcugcgcccagcgc

SEQ ID NO: 2886496 - RNA, 19 nt, Mycobacterium avium subsp. paratuberculosis
ggccgcugcgggcgggccg

SEQ ID NO: 2886497 - RNA, 13 nt, Mycobacterium avium subsp. paratuberculosis
ggccgcuggccgc

SEQ ID NO: 2886498 - RNA, 16 nt, Mycobacterium avium subsp. paratuberculosis
ggccgcuggccgcccc

SEQ ID NO: 2886499 - RNA, 15 nt, Mycobacterium avium subsp. paratuberculosis
ggccgcuggcguuga

SEQ ID NO: 2886500 - RNA, 14 nt, Mycobacterium avium subsp. paratuberculosis
ggccgcugguggug

SEQ ID NO: 2886501 - RNA, 15 nt, Mycobacterium avium subsp. paratuberculosis
ggccgcuggugguga

SEQ ID NO: 2886502 - RNA, 18 nt, Mycobacterium avium subsp. paratuberculosis
ggccgcugguggugauca

SEQ ID NO: 2886503 - RNA, 20 nt, Mycobacterium avium subsp. paratuberculosis
ggccgcugguggugaucacc

SEQ ID NO: 2886504 - RNA, 19 nt, Mycobacterium avium subsp. paratuberculosis
ggccgcuucccacccgguc

SEQ ID NO: 2886505 - RNA, 14 nt, Mycobacterium avium subsp. paratuberculosis
ggccgcuucggggu

SEQ ID NO: 2886506 - RNA, 21 nt, Mycobacterium avium subsp. paratuberculosis
ggccgcuuguucgggcccaca

SEQ ID NO: 2886507 - RNA, 19 nt, Mycobacterium avium subsp. paratuberculosis
ggccgcuuuccaccccggc

SEQ ID NO: 2886508 - RNA, 22 nt, Mycobacterium avium subsp. paratuberculosis
ggccgcuuuccaccccggcggu

SEQ ID NO: 2886509 - RNA, 15 nt, Mycobacterium avium subsp. paratuberculosis
ggccggaacagcugg

SEQ ID NO: 2886510 - RNA, 16 nt, Mycobacterium avium subsp. paratuberculosis
ggccggaacagcuggu

SEQ ID NO: 2886511 - RNA, 20 nt, Mycobacterium avium subsp. paratuberculosis
ggccggaacagcugguccca

SEQ ID NO: 2886512 - RNA, 18 nt, Mycobacterium avium subsp. paratuberculosis
ggccggaacgcccgaucu

SEQ ID NO: 2886513 - RNA, 21 nt, Mycobacterium avium subsp. paratuberculosis
ggccggaagaccguugacgac

SEQ ID NO: 2886514 - RNA, 16 nt, Mycobacterium avium subsp. paratuberculosis
ggccggacagaucgcc

SEQ ID NO: 2886515 - RNA, 18 nt, Mycobacterium avium subsp. paratuberculosis
gcucggcgccgaccucgg

SEQ ID NO: 2886516 - RNA, 20 nt, Mycobacterium avium subsp. paratuberculosis
gcucggcgccgaccucggcc

SEQ ID NO: 2886517 - RNA, 23 nt, Mycobacterium avium subsp. paratuberculosis
gcucggcgccgaccucggccagc

SEQ ID NO: 2886518 - RNA, 13 nt, Mycobacterium avium subsp. paratuberculosis
gcucggcgccgag

SEQ ID NO: 2886519 - RNA, 18 nt, Mycobacterium avium subsp. paratuberculosis
gcucggcgccgagcguga

SEQ ID NO: 2886520 - RNA, 12 nt, Mycobacterium avium subsp. paratuberculosis
gcucggcgccgc

SEQ ID NO: 2886521 - RNA, 13 nt, Mycobacterium avium subsp. paratuberculosis
gcucggcgccgcg

SEQ ID NO: 2886522 - RNA, 13 nt, Mycobacterium avium subsp. paratuberculosis
gcucggcgccggc

SEQ ID NO: 2886523 - RNA, 14 nt, Mycobacterium avium subsp. paratuberculosis
gcucggcgccggcc

SEQ ID NO: 2886524 - RNA, 15 nt, Mycobacterium avium subsp. paratuberculosis
gcucggcgccggccg

SEQ ID NO: 2886525 - RNA, 18 nt, Mycobacterium avium subsp. paratuberculosis
gcucggcgccggccguca

SEQ ID NO: 2886526 - RNA, 20 nt, Mycobacterium avium subsp. paratuberculosis
gcucggcgccggccgucacg

SEQ ID NO: 2886527 - RNA, 16 nt, Mycobacterium avium subsp. paratuberculosis
gcucggcgcgacguug

SEQ ID NO: 2886528 - RNA, 13 nt, Mycobacterium avium subsp. paratuberculosis
gcucggcgcgcgg

SEQ ID NO: 2886529 - RNA, 16 nt, Mycobacterium avium subsp. paratuberculosis
gcucggcgcgcggggc

SEQ ID NO: 2886530 - RNA, 18 nt, Mycobacterium avium subsp. paratuberculosis
gcucggcgcgcggggccg

SEQ ID NO: 2886531 - RNA, 15 nt, Mycobacterium avium subsp. paratuberculosis
gcucggcgcuccagc

SEQ ID NO: 2886532 - RNA, 16 nt, Mycobacterium avium subsp. paratuberculosis
gcucggcgcuccagcg

SEQ ID NO: 2886533 - RNA, 17 nt, Mycobacterium avium subsp. paratuberculosis
gcucggcgcuccagcgg

SEQ ID NO: 2886534 - RNA, 20 nt, Mycobacterium avium subsp. paratuberculosis
gcucggcgcugaacugcucg

SEQ ID NO: 2886535 - RNA, 21 nt, Mycobacterium avium subsp. paratuberculosis
gcucggcgcugucggcgggga

SEQ ID NO: 2886536 - RNA, 14 nt, Mycobacterium avium subsp. paratuberculosis
gcucggcggccaug

SEQ ID NO: 2886537 - RNA, 15 nt, Mycobacterium avium subsp. paratuberculosis
gcucggcggccaugu

SEQ ID NO: 2886538 - RNA, 12 nt, Mycobacterium avium subsp. paratuberculosis
gcucggcggccc

SEQ ID NO: 2886539 - RNA, 17 nt, Mycobacterium avium subsp. paratuberculosis
gcucggcggcccgcagg

SEQ ID NO: 2886540 - RNA, 15 nt, Mycobacterium avium subsp. paratuberculosis
gcucggcggcccgcc

SEQ ID NO: 2886541 - RNA, 16 nt, Mycobacterium avium subsp. paratuberculosis
gcucggcggcccgccg

SEQ ID NO: 2886542 - RNA, 17 nt, Mycobacterium avium subsp. paratuberculosis
gcucggcggcccgccgg

SEQ ID NO: 2886543 - RNA, 16 nt, Mycobacterium avium subsp. paratuberculosis
gcucggcggccgccag

SEQ ID NO: 2886544 - RNA, 19 nt, Mycobacterium avium subsp. paratuberculosis
gcucggcggccgccagcgu

SEQ ID NO: 2886545 - RNA, 12 nt, Mycobacterium avium subsp. paratuberculosis
gcucggcggccu

SEQ ID NO: 2886546 - RNA, 13 nt, Mycobacterium avium subsp. paratuberculosis
gcucggcggccuc

SEQ ID NO: 2886547 - RNA, 17 nt, Mycobacterium avium subsp. paratuberculosis
gcucggcggccucgccg

SEQ ID NO: 2886548 - RNA, 21 nt, Mycobacterium avium subsp. paratuberculosis
gcucggcggccucgccgucga

SEQ ID NO: 2886549 - RNA, 15 nt, Mycobacterium avium subsp. paratuberculosis
gcucggcggccugcu

SEQ ID NO: 2886550 - RNA, 16 nt, Mycobacterium avium subsp. paratuberculosis
gcucggcggccugcuu

SEQ ID NO: 2886551 - RNA, 15 nt, Mycobacterium avium subsp. paratuberculosis
gcucggcggcgacgg

SEQ ID NO: 2886552 - RNA, 21 nt, Mycobacterium avium subsp. paratuberculosis
gcucggcggcgacgguguccg

SEQ ID NO: 2886553 - RNA, 14 nt, Mycobacterium avium subsp. paratuberculosis
gcucggcggcgcag

SEQ ID NO: 2886554 - RNA, 22 nt, Mycobacterium avium subsp. paratuberculosis
gcucggcggcgcaggcgcgcac

SEQ ID NO: 2886555 - RNA, 15 nt, Mycobacterium avium subsp. paratuberculosis
gcucggcggcgccgu

SEQ ID NO: 2886556 - RNA, 13 nt, Mycobacterium avium subsp. paratuberculosis
gcucggcggcgcg

SEQ ID NO: 2886557 - RNA, 14 nt, Mycobacterium avium subsp. paratuberculosis
gcucggcggcgcgc

SEQ ID NO: 2886558 - RNA, 17 nt, Mycobacterium avium subsp. paratuberculosis
gcucggcggcgcgcagg

SEQ ID NO: 2886559 - RNA, 21 nt, Mycobacterium avium subsp. paratuberculosis
gcucggcggcgcgcaggcgcg

SEQ ID NO: 2886560 - RNA, 12 nt, Mycobacterium avium subsp. paratuberculosis
gcucggcggcgg

SEQ ID NO: 2886561 - RNA, 16 nt, Mycobacterium avium subsp. paratuberculosis
gcucggcggcgggguc

SEQ ID NO: 2886562 - RNA, 13 nt, Mycobacterium avium subsp. paratuberculosis
gcucggcggcguc

SEQ ID NO: 2886563 - RNA, 14 nt, Mycobacterium avium subsp. paratuberculosis
gcucggcggcgucg

SEQ ID NO: 2886564 - RNA, 15 nt, Mycobacterium avium subsp. paratuberculosis
gcucggcggcucagc

SEQ ID NO: 2886565 - RNA, 18 nt, Mycobacterium avium subsp. paratuberculosis
gcucggcgggcucccucg

SEQ ID NO: 2886566 - RNA, 23 nt, Mycobacterium avium subsp. paratuberculosis
gcucggcgggcucgcgcuggcgg

SEQ ID NO: 2886567 - RNA, 15 nt, Mycobacterium avium subsp. paratuberculosis
gcucggcggggggag

SEQ ID NO: 2886568 - RNA, 19 nt, Mycobacterium avium subsp. paratuberculosis
gcucggcgggucguagccg

SEQ ID NO: 2886569 - RNA, 22 nt, Mycobacterium avium subsp. paratuberculosis
gcucggcggguugcugagccgc

SEQ ID NO: 2886570 - RNA, 23 nt, Mycobacterium avium subsp. paratuberculosis
gcucggcggguugcugagccgcc

SEQ ID NO: 2886571 - RNA, 21 nt, Mycobacterium avium subsp. paratuberculosis
gcucggcguacaggccgucgg

SEQ ID NO: 2886572 - RNA, 21 nt, Mycobacterium avium subsp. paratuberculosis
gcucggcguauucgucgucgg

SEQ ID NO: 2886573 - RNA, 15 nt, Mycobacterium avium subsp. paratuberculosis
gcucggcguccagca

SEQ ID NO: 2886574 - RNA, 14 nt, Mycobacterium avium subsp. paratuberculosis
gcucggcgucccgc

SEQ ID NO: 2886575 - RNA, 18 nt, Mycobacterium avium subsp. paratuberculosis
gcucggcgucccgcgcca

SEQ ID NO: 2886576 - RNA, 16 nt, Mycobacterium avium subsp. paratuberculosis
gcucggcguggcgcuc

SEQ ID NO: 2886577 - RNA, 19 nt, Mycobacterium avium subsp. paratuberculosis
gcucggcguggcgcucagc

SEQ ID NO: 2886578 - RNA, 22 nt, Mycobacterium avium subsp. paratuberculosis
gcucggcguggcgcucagcggc

SEQ ID NO: 2886579 - RNA, 20 nt, Mycobacterium avium subsp. paratuberculosis
gcucggcguggucgaggccc

SEQ ID NO: 2886580 - RNA, 20 nt, Mycobacterium avium subsp. paratuberculosis
gcucggcguugagccggcgc

SEQ ID NO: 2886581 - RNA, 21 nt, Mycobacterium avium subsp. paratuberculosis
gcucggcguugagccggcgca

SEQ ID NO: 2886582 - RNA, 22 nt, Mycobacterium avium subsp. paratuberculosis
gcucggcguugagccggcgcac

SEQ ID NO: 2886583 - RNA, 20 nt, Mycobacterium avium subsp. paratuberculosis
gcucggcguuggcguagucg

SEQ ID NO: 2886584 - RNA, 13 nt, Mycobacterium avium subsp. paratuberculosis
gcucggcucggcc

SEQ ID NO: 2886585 - RNA, 14 nt, Mycobacterium avium subsp. paratuberculosis
gcucggcucggccg

SEQ ID NO: 2886586 - RNA, 17 nt, Mycobacterium avium subsp. paratuberculosis
gcucggcucggccggcc

SEQ ID NO: 2886587 - RNA, 19 nt, Mycobacterium avium subsp. paratuberculosis
gcucggcucggccggccgg

SEQ ID NO: 2886588 - RNA, 14 nt, Mycobacterium avium subsp. paratuberculosis
gcucggcugcaggc

SEQ ID NO: 2886589 - RNA, 21 nt, Mycobacterium avium subsp. paratuberculosis
gcucgggaacggucagccgcg

SEQ ID NO: 2886590 - RNA, 18 nt, Mycobacterium avium subsp. paratuberculosis
gcucgggcagcccgccga

SEQ ID NO: 2886591 - RNA, 19 nt, Mycobacterium avium subsp. paratuberculosis
gcucgggcagcccgccgac

SEQ ID NO: 2886592 - RNA, 14 nt, Mycobacterium avium subsp. paratuberculosis
gcucgggcagcgug

SEQ ID NO: 2886593 - RNA, 16 nt, Mycobacterium avium subsp. paratuberculosis
gcucgggcagcguguc

SEQ ID NO: 2886594 - RNA, 18 nt, Mycobacterium avium subsp. paratuberculosis
gcucgggcagcguguccc

SEQ ID NO: 2886595 - RNA, 14 nt, Mycobacterium avium subsp. paratuberculosis
gcucgggcccgcgc

SEQ ID NO: 2886596 - RNA, 16 nt, Mycobacterium avium subsp. paratuberculosis
gcucgggcccgcgcac

SEQ ID NO: 2886597 - RNA, 14 nt, Mycobacterium avium subsp. paratuberculosis
gcucgggccggcgc

SEQ ID NO: 2886598 - RNA, 16 nt, Mycobacterium avium subsp. paratuberculosis
gcucgggccggcgccg

SEQ ID NO: 2886599 - RNA, 18 nt, Mycobacterium avium subsp. paratuberculosis
gcucgggcgccucgaaca

SEQ ID NO: 2886600 - RNA, 19 nt, Mycobacterium avium subsp. paratuberculosis
gcucgggcgcgaacagcgc

SEQ ID NO: 2886601 - RNA, 21 nt, Mycobacterium avium subsp. paratuberculosis
gcucgggcgcgaacagcgccg

SEQ ID NO: 2886602 - RNA, 24 nt, Mycobacterium avium subsp. paratuberculosis
gcucgggcgcgaacagcgccgacu

SEQ ID NO: 2886603 - RNA, 17 nt, Mycobacterium avium subsp. paratuberculosis
gcucgggcgguggcgcc

SEQ ID NO: 2886604 - RNA, 18 nt, Mycobacterium avium subsp. paratuberculosis
gcucgggcuucggcguca

SEQ ID NO: 2886605 - RNA, 16 nt, Mycobacterium avium subsp. paratuberculosis
gcucggggcucgcggu

SEQ ID NO: 2886606 - RNA, 19 nt, Mycobacterium avium subsp. paratuberculosis
gcucggggcucgcggugug

SEQ ID NO: 2886607 - RNA, 18 nt, Mycobacterium avium subsp. paratuberculosis
gcucgggggugcccggcc

SEQ ID NO: 2886608 - RNA, 20 nt, Mycobacterium avium subsp. paratuberculosis
gcucgggguaguucagcgcg

SEQ ID NO: 2886609 - RNA, 18 nt, Mycobacterium avium subsp. paratuberculosis
gcucggggucggcgucgg

SEQ ID NO: 2886610 - RNA, 18 nt, Mycobacterium avium subsp. paratuberculosis
gcucgggugucgccgagc

SEQ ID NO: 2886611 - RNA, 17 nt, Mycobacterium avium subsp. paratuberculosis
gcucgguaugcggcgac

SEQ ID NO: 2886612 - RNA, 14 nt, Mycobacterium avium subsp. paratuberculosis
gcucggucaacccg

SEQ ID NO: 2886613 - RNA, 15 nt, Mycobacterium avium subsp. paratuberculosis
gcucggucaacccga

SEQ ID NO: 2886614 - RNA, 17 nt, Mycobacterium avium subsp. paratuberculosis
gcucggucaagccggcc

SEQ ID NO: 2886615 - RNA, 21 nt, Mycobacterium avium subsp. paratuberculosis
gcucggucaagccggccagca

SEQ ID NO: 2886616 - RNA, 22 nt, Mycobacterium avium subsp. paratuberculosis
gcucggucaagccggccagcag

SEQ ID NO: 2886617 - RNA, 18 nt, Mycobacterium avium subsp. paratuberculosis
gcucggucaccagcggcc

SEQ ID NO: 2886618 - RNA, 16 nt, Mycobacterium avium subsp. paratuberculosis
gcucggucaccccgga

SEQ ID NO: 2886619 - RNA, 14 nt, Mycobacterium avium subsp. paratuberculosis
gcucggucagcacc

SEQ ID NO: 2886620 - RNA, 15 nt, Mycobacterium avium subsp. paratuberculosis
gcucggucagcaccg

SEQ ID NO: 2886621 - RNA, 18 nt, Mycobacterium avium subsp. paratuberculosis
gcucggucagccgggcgg

SEQ ID NO: 2886622 - RNA, 22 nt, Mycobacterium avium subsp. paratuberculosis
gcucggucagccgggcggccuc

SEQ ID NO: 2886623 - RNA, 16 nt, Mycobacterium avium subsp. paratuberculosis
gcucggucaggcccag

SEQ ID NO: 2886624 - RNA, 20 nt, Mycobacterium avium subsp. paratuberculosis
gcucggucaggcccaggucg

SEQ ID NO: 2886625 - RNA, 17 nt, Mycobacterium avium subsp. paratuberculosis
gcucggucgccacggcc

SEQ ID NO: 2886626 - RNA, 18 nt, Mycobacterium avium subsp. paratuberculosis
gcucggucgccacggccg

SEQ ID NO: 2886627 - RNA, 14 nt, Mycobacterium avium subsp. paratuberculosis
gcucggucgcggcg

SEQ ID NO: 2886628 - RNA, 13 nt, Mycobacterium avium subsp. paratuberculosis
gcucggucgcggu

SEQ ID NO: 2886629 - RNA, 18 nt, Mycobacterium avium subsp. paratuberculosis
gcucggucgcggucggcg

SEQ ID NO: 2886630 - RNA, 22 nt, Mycobacterium avium subsp. paratuberculosis
gcucggucgcggucggcgcccg

SEQ ID NO: 2886631 - RNA, 15 nt, Mycobacterium avium subsp. paratuberculosis
gcucggugaucacca

SEQ ID NO: 2886632 - RNA, 16 nt, Mycobacterium avium subsp. paratuberculosis
gcucggugauccacgc

SEQ ID NO: 2886633 - RNA, 21 nt, Mycobacterium avium subsp. paratuberculosis
gcucggugaucugcaccagcg

SEQ ID NO: 2886634 - RNA, 18 nt, Mycobacterium avium subsp. paratuberculosis
gcucggugaugaucgccg

SEQ ID NO: 2886635 - RNA, 23 nt, Mycobacterium avium subsp. paratuberculosis
gcucggugaugaucgccgggucg

SEQ ID NO: 2886636 - RNA, 23 nt, Mycobacterium avium subsp. paratuberculosis
gcucggugaugccgagcgccgcg

SEQ ID NO: 2886637 - RNA, 18 nt, Mycobacterium avium subsp. paratuberculosis
gcucggugcagaccccgg

SEQ ID NO: 2886638 - RNA, 17 nt, Mycobacterium avium subsp. paratuberculosis
gcucggugcgcaccccg

SEQ ID NO: 2886639 - RNA, 18 nt, Mycobacterium avium subsp. paratuberculosis
gcucggugcgcauggcgu

SEQ ID NO: 2886640 - RNA, 12 nt, Mycobacterium avium subsp. paratuberculosis
gcucggugcgcc

SEQ ID NO: 2886641 - RNA, 21 nt, Mycobacterium avium subsp. paratuberculosis
gcucggugcgccagaucagcg

SEQ ID NO: 2886642 - RNA, 14 nt, Mycobacterium avium subsp. paratuberculosis
gcucgguggccggu

SEQ ID NO: 2886643 - RNA, 17 nt, Mycobacterium avium subsp. paratuberculosis
gcucgguggcgucggcg

SEQ ID NO: 2886644 - RNA, 22 nt, Mycobacterium avium subsp. paratuberculosis
gcucgguggcgucggcggccug

SEQ ID NO: 2886645 - RNA, 13 nt, Mycobacterium avium subsp. paratuberculosis
gcucguaacgcca

SEQ ID NO: 2886646 - RNA, 15 nt, Mycobacterium avium subsp. paratuberculosis
gcucguaacgccacg

SEQ ID NO: 2886647 - RNA, 16 nt, Mycobacterium avium subsp. paratuberculosis
gcucguaacgccacgg

SEQ ID NO: 2886648 - RNA, 21 nt, Mycobacterium avium subsp. paratuberculosis
gcucguaacgccacggcggcc

SEQ ID NO: 2886649 - RNA, 22 nt, Mycobacterium avium subsp. paratuberculosis
gcucguaacgccacggcggccg

SEQ ID NO: 2886650 - RNA, 23 nt, Mycobacterium avium subsp. paratuberculosis
gcucguaacgccacggcggccga

SEQ ID NO: 2886651 - RNA, 20 nt, Mycobacterium avium subsp. paratuberculosis
gcucguagcuggugcgcagc

SEQ ID NO: 2886652 - RNA, 17 nt, Mycobacterium avium subsp. paratuberculosis
gcucguaguuggggccg

SEQ ID NO: 2886653 - RNA, 19 nt, Mycobacterium avium subsp. paratuberculosis
gcucguaguuggggccggc

SEQ ID NO: 2886654 - RNA, 21 nt, Mycobacterium avium subsp. paratuberculosis
gcucguaguuggggccggccg

SEQ ID NO: 2886655 - RNA, 22 nt, Mycobacterium avium subsp. paratuberculosis
gcucguaguuggggccggccgc

SEQ ID NO: 2886656 - RNA, 17 nt, Mycobacterium avium subsp. paratuberculosis
gcucgucagcgcgggcc

SEQ ID NO: 2886657 - RNA, 18 nt, Mycobacterium avium subsp. paratuberculosis
gcucgucagcgcgggcca

SEQ ID NO: 2886658 - RNA, 14 nt, Mycobacterium avium subsp. paratuberculosis
gcucguccagcccg

SEQ ID NO: 2886659 - RNA, 16 nt, Mycobacterium avium subsp. paratuberculosis
gcucguccagcccggu

SEQ ID NO: 2886660 - RNA, 21 nt, Mycobacterium avium subsp. paratuberculosis
gcucguccagcccggucacca

SEQ ID NO: 2886661 - RNA, 17 nt, Mycobacterium avium subsp. paratuberculosis
gcucguccagcgugccg

SEQ ID NO: 2886662 - RNA, 21 nt, Mycobacterium avium subsp. paratuberculosis
gcucguccaggguggccagca

SEQ ID NO: 2886663 - RNA, 17 nt, Mycobacterium avium subsp. paratuberculosis
gcucguccuggcgcugg

SEQ ID NO: 2886664 - RNA, 18 nt, Mycobacterium avium subsp. paratuberculosis
gcucguccuggcgcuggu

SEQ ID NO: 2886665 - RNA, 19 nt, Mycobacterium avium subsp. paratuberculosis
gcucguccuggcgcuggug

SEQ ID NO: 2886666 - RNA, 17 nt, Mycobacterium avium subsp. paratuberculosis
gcucgucgacgcugacc

SEQ ID NO: 2886667 - RNA, 16 nt, Mycobacterium avium subsp. paratuberculosis
gcucgucgacguccuc

SEQ ID NO: 2886668 - RNA, 14 nt, Mycobacterium avium subsp. paratuberculosis
gcucgucgagcauc

SEQ ID NO: 2886669 - RNA, 18 nt, Mycobacterium avium subsp. paratuberculosis
gcucgucgagcauccggc

SEQ ID NO: 2886670 - RNA, 17 nt, Mycobacterium avium subsp. paratuberculosis
gcucgucgagccggccg

SEQ ID NO: 2886671 - RNA, 13 nt, Mycobacterium avium subsp. paratuberculosis
gcucgucgccgac

SEQ ID NO: 2886672 - RNA, 14 nt, Mycobacterium avium subsp. paratuberculosis
gcucgucgccgacc

SEQ ID NO: 2886673 - RNA, 23 nt, Mycobacterium avium subsp. paratuberculosis
gcucgucgcggaacagccggcuc

SEQ ID NO: 2886674 - RNA, 13 nt, Mycobacterium avium subsp. paratuberculosis
gcucgucgcggag

SEQ ID NO: 2886675 - RNA, 13 nt, Mycobacterium avium subsp. paratuberculosis
gcucgucggccag

SEQ ID NO: 2886676 - RNA, 17 nt, Mycobacterium avium subsp. paratuberculosis
gcucgucggccgacucg

SEQ ID NO: 2886677 - RNA, 12 nt, Mycobacterium avium subsp. paratuberculosis
gcucgucggcga

SEQ ID NO: 2886678 - RNA, 16 nt, Mycobacterium avium subsp. paratuberculosis
gcucgucggcgaacag

SEQ ID NO: 2886679 - RNA, 15 nt, Mycobacterium avium subsp. paratuberculosis
gcucgucggcgcgcc

SEQ ID NO: 2886680 - RNA, 16 nt, Mycobacterium avium subsp. paratuberculosis
gcucgucggcgcgcca

SEQ ID NO: 2886681 - RNA, 21 nt, Mycobacterium avium subsp. paratuberculosis
gcucgucggcgcgccacccga

SEQ ID NO: 2886682 - RNA, 17 nt, Mycobacterium avium subsp. paratuberculosis
gcucgucggcgcgggcc

SEQ ID NO: 2886683 - RNA, 19 nt, Mycobacterium avium subsp. paratuberculosis
gcucgucggcgcgggccag

SEQ ID NO: 2886684 - RNA, 21 nt, Mycobacterium avium subsp. paratuberculosis
gcucgucggcgcgggccagca

SEQ ID NO: 2886685 - RNA, 22 nt, Mycobacterium avium subsp. paratuberculosis
gcucgucggcgcgggccagcag

SEQ ID NO: 2886686 - RNA, 23 nt, Mycobacterium avium subsp. paratuberculosis
gcucgucggcgggcaccucggcc

SEQ ID NO: 2886687 - RNA, 24 nt, Mycobacterium avium subsp. paratuberculosis
gcucgucggcgggcaccucggcca

SEQ ID NO: 2886688 - RNA, 20 nt, Mycobacterium avium subsp. paratuberculosis
gcucgucgggaacgccgauc

SEQ ID NO: 2886689 - RNA, 20 nt, Mycobacterium avium subsp. paratuberculosis
gcucgucgggcacaucccgc

SEQ ID NO: 2886690 - RNA, 21 nt, Mycobacterium avium subsp. paratuberculosis
gcucgucgggcacaucccgca

SEQ ID NO: 2886691 - RNA, 20 nt, Mycobacterium avium subsp. paratuberculosis
gcucgucggguguggcgccg

SEQ ID NO: 2886692 - RNA, 15 nt, Mycobacterium avium subsp. paratuberculosis
gcucgucgucgguga

SEQ ID NO: 2886693 - RNA, 22 nt, Mycobacterium avium subsp. paratuberculosis
gcucgucgucggugaacgccgg

SEQ ID NO: 2886694 - RNA, 17 nt, Mycobacterium avium subsp. paratuberculosis
gcucgucgugauggcga

SEQ ID NO: 2886695 - RNA, 22 nt, Mycobacterium avium subsp. paratuberculosis
gcucgucgugggugacccggcc

SEQ ID NO: 2886696 - RNA, 18 nt, Mycobacterium avium subsp. paratuberculosis
gcucgucguugaccugcu

SEQ ID NO: 2886697 - RNA, 17 nt, Mycobacterium avium subsp. paratuberculosis
gcucgucguugcgcagc

SEQ ID NO: 2886698 - RNA, 21 nt, Mycobacterium avium subsp. paratuberculosis
gcucgucguugcgcagcgagu

SEQ ID NO: 2886699 - RNA, 14 nt, Mycobacterium avium subsp. paratuberculosis
gcucgugaccggcg

SEQ ID NO: 2886700 - RNA, 15 nt, Mycobacterium avium subsp. paratuberculosis
gcucgugaccggcgg

SEQ ID NO: 2886701 - RNA, 17 nt, Mycobacterium avium subsp. paratuberculosis
gcucgugaccggcggug

SEQ ID NO: 2886702 - RNA, 18 nt, Mycobacterium avium subsp. paratuberculosis
gcucgugaccggcggugu

SEQ ID NO: 2886703 - RNA, 17 nt, Mycobacterium avium subsp. paratuberculosis
gcucgugaugguccagc

SEQ ID NO: 2886704 - RNA, 18 nt, Mycobacterium avium subsp. paratuberculosis
gcucgugaugguccagca

SEQ ID NO: 2886705 - RNA, 20 nt, Mycobacterium avium subsp. paratuberculosis
gcucgugaugguccagcacc

SEQ ID NO: 2886706 - RNA, 22 nt, Mycobacterium avium subsp. paratuberculosis
gcucgugcaaaccggaccgccg

SEQ ID NO: 2886707 - RNA, 15 nt, Mycobacterium avium subsp. paratuberculosis
gcucgugcagccggc

SEQ ID NO: 2886708 - RNA, 18 nt, Mycobacterium avium subsp. paratuberculosis
gcucgugcagccggcggc

SEQ ID NO: 2886709 - RNA, 19 nt, Mycobacterium avium subsp. paratuberculosis
gcucgugcagccggcggcg

SEQ ID NO: 2886710 - RNA, 20 nt, Mycobacterium avium subsp. paratuberculosis
gcucguggaacgacgccaga

SEQ ID NO: 2886711 - RNA, 16 nt, Mycobacterium avium subsp. paratuberculosis
gcucguggcgggcccg

SEQ ID NO: 2886712 - RNA, 21 nt, Mycobacterium avium subsp. paratuberculosis
gcucgugggaaugcggcuggg

SEQ ID NO: 2886713 - RNA, 18 nt, Mycobacterium avium subsp. paratuberculosis
gcucguucgucaugacga

SEQ ID NO: 2886714 - RNA, 15 nt, Mycobacterium avium subsp. paratuberculosis
gcucguucucggcga

SEQ ID NO: 2886715 - RNA, 16 nt, Mycobacterium avium subsp. paratuberculosis
gcucguugagcacaca

SEQ ID NO: 2886716 - RNA, 15 nt, Mycobacterium avium subsp. paratuberculosis
gcucguugccggcgg

SEQ ID NO: 2886717 - RNA, 16 nt, Mycobacterium avium subsp. paratuberculosis
gcucguugccggcggc

SEQ ID NO: 2886718 - RNA, 17 nt, Mycobacterium avium subsp. paratuberculosis
gcucguugccggcggcc

SEQ ID NO: 2886719 - RNA, 19 nt, Mycobacterium avium subsp. paratuberculosis
gcucguugccggcggccag

SEQ ID NO: 2886720 - RNA, 19 nt, Mycobacterium avium subsp. paratuberculosis
gcucuaacuccgcucgggc

SEQ ID NO: 2886721 - RNA, 12 nt, Mycobacterium avium subsp. paratuberculosis
gcucuccugcuu

SEQ ID NO: 2886722 - RNA, 22 nt, Mycobacterium avium subsp. paratuberculosis
gcucuccugcuugaccguggag

SEQ ID NO: 2886723 - RNA, 15 nt, Mycobacterium avium subsp. paratuberculosis
gcucucgccggucag

SEQ ID NO: 2886724 - RNA, 20 nt, Mycobacterium avium subsp. paratuberculosis
gcucucgccggucagcacgu

SEQ ID NO: 2886725 - RNA, 15 nt, Mycobacterium avium subsp. paratuberculosis
gcucucgucgucggc

SEQ ID NO: 2886726 - RNA, 18 nt, Mycobacterium avium subsp. paratuberculosis
gcucucgucgucggcggg

SEQ ID NO: 2886727 - RNA, 13 nt, Mycobacterium avium subsp. paratuberculosis
gcucugccgggcc

SEQ ID NO: 2886728 - RNA, 14 nt, Mycobacterium avium subsp. paratuberculosis
gcucugccgggccg

SEQ ID NO: 2886729 - RNA, 21 nt, Mycobacterium avium subsp. paratuberculosis
gcucugccuacuugcggccgc

SEQ ID NO: 2886730 - RNA, 15 nt, Mycobacterium avium subsp. paratuberculosis
gcucugcgcgcggug

SEQ ID NO: 2886731 - RNA, 11 nt, Mycobacterium avium subsp. paratuberculosis
gcucuggccga

SEQ ID NO: 2886732 - RNA, 13 nt, Mycobacterium avium subsp. paratuberculosis
gcucuggccgauc

SEQ ID NO: 2886733 - RNA, 20 nt, Mycobacterium avium subsp. paratuberculosis
gcucugguuuuacacaccag

SEQ ID NO: 2886734 - RNA, 21 nt, Mycobacterium avium subsp. paratuberculosis
gcucugguuuuacacaccagc

SEQ ID NO: 2886735 - RNA, 16 nt, Mycobacterium avium subsp. paratuberculosis
gcucuguuggccgucg

SEQ ID NO: 2886736 - RNA, 18 nt, Mycobacterium avium subsp. paratuberculosis
gcucuguuggccgucgcu

SEQ ID NO: 2886737 - RNA, 18 nt, Mycobacterium avium subsp. paratuberculosis
gcucuucagcgcgacagc

SEQ ID NO: 2886738 - RNA, 21 nt, Mycobacterium avium subsp. paratuberculosis
gcucuucagcgcgacagccaa

SEQ ID NO: 2886739 - RNA, 13 nt, Mycobacterium avium subsp. paratuberculosis
gcucuucgacgac

SEQ ID NO: 2886740 - RNA, 13 nt, Mycobacterium avium subsp. paratuberculosis
gcucuucgacgau

SEQ ID NO: 2886741 - RNA, 20 nt, Mycobacterium avium subsp. paratuberculosis
gcucuucggcgccgagcguc

SEQ ID NO: 2886742 - RNA, 16 nt, Mycobacterium avium subsp. paratuberculosis
gcucuucggucaucgu

SEQ ID NO: 2886743 - RNA, 23 nt, Mycobacterium avium subsp. paratuberculosis
gcucuucggugguguggaucucc

SEQ ID NO: 2886744 - RNA, 22 nt, Mycobacterium avium subsp. paratuberculosis
gcucuucucguucugcgugcgg

SEQ ID NO: 2886745 - RNA, 23 nt, Mycobacterium avium subsp. paratuberculosis
gcucuugaaucgguucggccaga

SEQ ID NO: 2886746 - RNA, 16 nt, Mycobacterium avium subsp. paratuberculosis
gcucuugacggccgcg

SEQ ID NO: 2886747 - RNA, 20 nt, Mycobacterium avium subsp. paratuberculosis
gcucuugacggccgcggcgg

SEQ ID NO: 2886748 - RNA, 16 nt, Mycobacterium avium subsp. paratuberculosis
gcucuugcgggcggca

SEQ ID NO: 2886749 - RNA, 15 nt, Mycobacterium avium subsp. paratuberculosis
gcucuugggcggccg

SEQ ID NO: 2886750 - RNA, 23 nt, Mycobacterium avium subsp. paratuberculosis
gcucuuggugguggucgucgacg

SEQ ID NO: 2886751 - RNA, 18 nt, Mycobacterium avium subsp. paratuberculosis
gcugaaagcucgcgucga

SEQ ID NO: 2886752 - RNA, 14 nt, Mycobacterium avium subsp. paratuberculosis
gcugaaauccgggg

SEQ ID NO: 2886753 - RNA, 19 nt, Mycobacterium avium subsp. paratuberculosis
gcugaacaccaccaggccg

SEQ ID NO: 2886754 - RNA, 19 nt, Mycobacterium avium subsp. paratuberculosis
gcugaacacgaacccggcg

SEQ ID NO: 2886755 - RNA, 21 nt, Mycobacterium avium subsp. paratuberculosis
gcugaacacgaacccggcggc

SEQ ID NO: 2886756 - RNA, 13 nt, Mycobacterium avium subsp. paratuberculosis
gcugaacagcagc

SEQ ID NO: 2886757 - RNA, 14 nt, Mycobacterium avium subsp. paratuberculosis
gcugaacagcagca

SEQ ID NO: 2886758 - RNA, 14 nt, Mycobacterium avium subsp. paratuberculosis
gcugaacagcccga

SEQ ID NO: 2886759 - RNA, 13 nt, Mycobacterium avium subsp. paratuberculosis
gcugaacagcgcg

SEQ ID NO: 2886760 - RNA, 15 nt, Mycobacterium avium subsp. paratuberculosis
gcugaacagcgcgcc

SEQ ID NO: 2886761 - RNA, 14 nt, Mycobacterium avium subsp. paratuberculosis
gcugaaccaccgcg

SEQ ID NO: 2886762 - RNA, 16 nt, Mycobacterium avium subsp. paratuberculosis
gcugaaccaccgcgcc

SEQ ID NO: 2886763 - RNA, 21 nt, Mycobacterium avium subsp. paratuberculosis
gcugaaccaccgcgcccaccc

SEQ ID NO: 2886764 - RNA, 13 nt, Mycobacterium avium subsp. paratuberculosis
gcugaaccgguag

SEQ ID NO: 2886765 - RNA, 18 nt, Mycobacterium avium subsp. paratuberculosis
gcugaaccugcugggcgg

SEQ ID NO: 2886766 - RNA, 17 nt, Mycobacterium avium subsp. paratuberculosis
gcugaacgccugccggc

SEQ ID NO: 2886767 - RNA, 19 nt, Mycobacterium avium subsp. paratuberculosis
gcugaacgccugccggcgc

SEQ ID NO: 2886768 - RNA, 21 nt, Mycobacterium avium subsp. paratuberculosis
gcugaacgccugccggcgccg

SEQ ID NO: 2886769 - RNA, 23 nt, Mycobacterium avium subsp. paratuberculosis
gcugaacgccugccggcgccgga

SEQ ID NO: 2886770 - RNA, 20 nt, Mycobacterium avium subsp. paratuberculosis
gcugaacgcgauccaggugu

SEQ ID NO: 2886771 - RNA, 22 nt, Mycobacterium avium subsp. paratuberculosis
gcugaacgcggugggcaccagc

SEQ ID NO: 2886772 - RNA, 23 nt, Mycobacterium avium subsp. paratuberculosis
gcugaacgcggugggcaccagca

SEQ ID NO: 2886773 - RNA, 14 nt, Mycobacterium avium subsp. paratuberculosis
gcugaacgcgucgu

SEQ ID NO: 2886774 - RNA, 17 nt, Mycobacterium avium subsp. paratuberculosis
gcugaacgggcagccac

SEQ ID NO: 2886775 - RNA, 18 nt, Mycobacterium avium subsp. paratuberculosis
gcugaacgggcagccacg

SEQ ID NO: 2886776 - RNA, 16 nt, Mycobacterium avium subsp. paratuberculosis
gcugaacggugcccgc

SEQ ID NO: 2886777 - RNA, 18 nt, Mycobacterium avium subsp. paratuberculosis
gcugaacggugcccgccg

SEQ ID NO: 2886778 - RNA, 17 nt, Mycobacterium avium subsp. paratuberculosis
gcugaacucgacgucga

SEQ ID NO: 2886779 - RNA, 19 nt, Mycobacterium avium subsp. paratuberculosis
gcugaacucgacgucgacg

SEQ ID NO: 2886780 - RNA, 16 nt, Mycobacterium avium subsp. paratuberculosis
gcugaacugcucgacc

SEQ ID NO: 2886781 - RNA, 23 nt, Mycobacterium avium subsp. paratuberculosis
gcugaacugcucgaccagcgccg

SEQ ID NO: 2886782 - RNA, 20 nt, Mycobacterium avium subsp. paratuberculosis
gcugaagaagaugggcgccg

SEQ ID NO: 2886783 - RNA, 20 nt, Mycobacterium avium subsp. paratuberculosis
gcugaagaucaacagccgcc

SEQ ID NO: 2886784 - RNA, 14 nt, Mycobacterium avium subsp. paratuberculosis
gcugaagaucgaaa

SEQ ID NO: 2886785 - RNA, 23 nt, Mycobacterium avium subsp. paratuberculosis
gcugaagaucgaaaugaccgcgc

SEQ ID NO: 2886786 - RNA, 17 nt, Mycobacterium avium subsp. paratuberculosis
gcugaagcgcgaccccu

SEQ ID NO: 2886787 - RNA, 14 nt, Mycobacterium avium subsp. paratuberculosis
gcugaagcgcuggg

SEQ ID NO: 2886788 - RNA, 22 nt, Mycobacterium avium subsp. paratuberculosis
gcugaagugcacucggcgaugc

SEQ ID NO: 2886789 - RNA, 16 nt, Mycobacterium avium subsp. paratuberculosis
gcugaagugcagcgca

SEQ ID NO: 2886790 - RNA, 16 nt, Mycobacterium avium subsp. paratuberculosis
gcugaaguucaccacc

SEQ ID NO: 2886791 - RNA, 20 nt, Mycobacterium avium subsp. paratuberculosis
gcugaaguucaccaccgcgc

SEQ ID NO: 2886792 - RNA, 22 nt, Mycobacterium avium subsp. paratuberculosis
gcugaaguucaccaccgcgcug

SEQ ID NO: 2886793 - RNA, 23 nt, Mycobacterium avium subsp. paratuberculosis
gcugaaguucaccaccgcgcugc

SEQ ID NO: 2886794 - RNA, 19 nt, Mycobacterium avium subsp. paratuberculosis
gcugaaugaacgaccuggu

SEQ ID NO: 2886795 - RNA, 14 nt, Mycobacterium avium subsp. paratuberculosis
gcugacacccgacg

SEQ ID NO: 2886796 - RNA, 17 nt, Mycobacterium avium subsp. paratuberculosis
gcugaccaaggccgaca

SEQ ID NO: 2886797 - RNA, 14 nt, Mycobacterium avium subsp. paratuberculosis
gcugaccaccgagg

SEQ ID NO: 2886798 - RNA, 22 nt, Mycobacterium avium subsp. paratuberculosis
gcugaccagcgccucgcgggug

SEQ ID NO: 2886799 - RNA, 12 nt, Mycobacterium avium subsp. paratuberculosis
gcugaccagcgu

SEQ ID NO: 2886800 - RNA, 13 nt, Mycobacterium avium subsp. paratuberculosis
gcugaccaggccg

SEQ ID NO: 2886801 - RNA, 18 nt, Mycobacterium avium subsp. paratuberculosis
gcugaccaugacccacgg

SEQ ID NO: 2886802 - RNA, 12 nt, Mycobacterium avium subsp. paratuberculosis
gcugacccagcg

SEQ ID NO: 2886803 - RNA, 15 nt, Mycobacterium avium subsp. paratuberculosis
gcugacccagcgcgg

SEQ ID NO: 2886804 - RNA, 23 nt, Mycobacterium avium subsp. paratuberculosis
gcugaccccgcucggcguggcgc

SEQ ID NO: 2886805 - RNA, 14 nt, Mycobacterium avium subsp. paratuberculosis
gcugacccgcccgg

SEQ ID NO: 2886806 - RNA, 15 nt, Mycobacterium avium subsp. paratuberculosis
gcugacccgcccggg

SEQ ID NO: 2886807 - RNA, 16 nt, Mycobacterium avium subsp. paratuberculosis
gcugacccgccgcaac

SEQ ID NO: 2886808 - RNA, 18 nt, Mycobacterium avium subsp. paratuberculosis
gcugacccgggcggccug

SEQ ID NO: 2886809 - RNA, 21 nt, Mycobacterium avium subsp. paratuberculosis
gcugacccgggcggccugcug

SEQ ID NO: 2886810 - RNA, 14 nt, Mycobacterium avium subsp. paratuberculosis
gcugacccggucgc

SEQ ID NO: 2886811 - RNA, 15 nt, Mycobacterium avium subsp. paratuberculosis
gcugacccggucgcg

SEQ ID NO: 2886812 - RNA, 18 nt, Mycobacterium avium subsp. paratuberculosis
gcugacccggucgcggcc

SEQ ID NO: 2886813 - RNA, 17 nt, Mycobacterium avium subsp. paratuberculosis
gcugaccgacggcgacc

SEQ ID NO: 2886814 - RNA, 19 nt, Mycobacterium avium subsp. paratuberculosis
gcugaccgacggcgaccag

SEQ ID NO: 2886815 - RNA, 15 nt, Mycobacterium avium subsp. paratuberculosis
gcugaccgagcggcg

SEQ ID NO: 2886816 - RNA, 14 nt, Mycobacterium avium subsp. paratuberculosis
gcugaccgccagga

SEQ ID NO: 2886817 - RNA, 16 nt, Mycobacterium avium subsp. paratuberculosis
gcugaccggccaccuc

SEQ ID NO: 2886818 - RNA, 14 nt, Mycobacterium avium subsp. paratuberculosis
gcugaccggcggug

SEQ ID NO: 2886819 - RNA, 23 nt, Mycobacterium avium subsp. paratuberculosis
gcugaccggcggugccggccaga

SEQ ID NO: 2886820 - RNA, 12 nt, Mycobacterium avium subsp. paratuberculosis
gcugaccgucga

SEQ ID NO: 2886821 - RNA, 13 nt, Mycobacterium avium subsp. paratuberculosis
gcugaccgucgac

SEQ ID NO: 2886822 - RNA, 19 nt, Mycobacterium avium subsp. paratuberculosis
gcugaccguggugucggag

SEQ ID NO: 2886823 - RNA, 21 nt, Mycobacterium avium subsp. paratuberculosis
gcugaccucgacacgggccgc

SEQ ID NO: 2886824 - RNA, 15 nt, Mycobacterium avium subsp. paratuberculosis
gcugaccucgccgcc

SEQ ID NO: 2886825 - RNA, 19 nt, Mycobacterium avium subsp. paratuberculosis
gcugaccucgcgcaccggc

SEQ ID NO: 2886826 - RNA, 14 nt, Mycobacterium avium subsp. paratuberculosis
gcugaccugugcgc

SEQ ID NO: 2886827 - RNA, 20 nt, Mycobacterium avium subsp. paratuberculosis
gcugaccugugcgccccacg

SEQ ID NO: 2886828 - RNA, 23 nt, Mycobacterium avium subsp. paratuberculosis
gcugaccugugcgccccacggcg

SEQ ID NO: 2886829 - RNA, 19 nt, Mycobacterium avium subsp. paratuberculosis
gcugaccuucuuggucagc

SEQ ID NO: 2886830 - RNA, 20 nt, Mycobacterium avium subsp. paratuberculosis
gcugaccuucuuggucagcg

SEQ ID NO: 2886831 - RNA, 20 nt, Mycobacterium avium subsp. paratuberculosis
gcugacgaugcggccggcgg

SEQ ID NO: 2886832 - RNA, 13 nt, Mycobacterium avium subsp. paratuberculosis
gcugacgauggcg

SEQ ID NO: 2886833 - RNA, 19 nt, Mycobacterium avium subsp. paratuberculosis
gcugacgauggcgaccgcg

SEQ ID NO: 2886834 - RNA, 20 nt, Mycobacterium avium subsp. paratuberculosis
gcugacgauggcgaccgcgc

SEQ ID NO: 2886835 - RNA, 22 nt, Mycobacterium avium subsp. paratuberculosis
gcugacgauggcgaccgcgcag

SEQ ID NO: 2886836 - RNA, 20 nt, Mycobacterium avium subsp. paratuberculosis
gcugacgauucuugaccacc

SEQ ID NO: 2886837 - RNA, 13 nt, Mycobacterium avium subsp. paratuberculosis
gcugacgccgcgg

SEQ ID NO: 2886838 - RNA, 16 nt, Mycobacterium avium subsp. paratuberculosis
gcugacgccguugcgg

SEQ ID NO: 2886839 - RNA, 15 nt, Mycobacterium avium subsp. paratuberculosis
gcugacgcgaccgcg

SEQ ID NO: 2886840 - RNA, 17 nt, Mycobacterium avium subsp. paratuberculosis
gcugacgcgaccgcgcg

SEQ ID NO: 2886841 - RNA, 14 nt, Mycobacterium avium subsp. paratuberculosis
gcugacgcggcggg

SEQ ID NO: 2886842 - RNA, 17 nt, Mycobacterium avium subsp. paratuberculosis
gcugacggcgucguuga

SEQ ID NO: 2886843 - RNA, 20 nt, Mycobacterium avium subsp. paratuberculosis
gcugacgggaccgcacgccg

SEQ ID NO: 2886844 - RNA, 16 nt, Mycobacterium avium subsp. paratuberculosis
gcugacgggccggcgg

SEQ ID NO: 2886845 - RNA, 18 nt, Mycobacterium avium subsp. paratuberculosis
gcugacggucgccgacuc

SEQ ID NO: 2886846 - RNA, 19 nt, Mycobacterium avium subsp. paratuberculosis
gcugacgucgaaggugaug

SEQ ID NO: 2886847 - RNA, 22 nt, Mycobacterium avium subsp. paratuberculosis
gcugacgucgaugccggccagc

SEQ ID NO: 2886848 - RNA, 15 nt, Mycobacterium avium subsp. paratuberculosis
gcugacgucgucgcc

SEQ ID NO: 2886849 - RNA, 19 nt, Mycobacterium avium subsp. paratuberculosis
gcugacgucgucgcccacc

SEQ ID NO: 2886850 - RNA, 20 nt, Mycobacterium avium subsp. paratuberculosis
gcugacuccaucccgugcgg

SEQ ID NO: 2886851 - RNA, 20 nt, Mycobacterium avium subsp. paratuberculosis
gcugacugccggcgacggug

SEQ ID NO: 2886852 - RNA, 15 nt, Mycobacterium avium subsp. paratuberculosis
gcugacugcgaucgc

SEQ ID NO: 2886853 - RNA, 17 nt, Mycobacterium avium subsp. paratuberculosis
gcugacugcgaucgccg

SEQ ID NO: 2886854 - RNA, 24 nt, Mycobacterium avium subsp. paratuberculosis
gcugacuuucuugcugagcugcgc

SEQ ID NO: 2886855 - RNA, 22 nt, Mycobacterium avium subsp. paratuberculosis
gcugagcacccgcagcucgccg

SEQ ID NO: 2886856 - RNA, 23 nt, Mycobacterium avium subsp. paratuberculosis
gcugagcacccgcagcucgccga

SEQ ID NO: 2886857 - RNA, 16 nt, Mycobacterium avium subsp. paratuberculosis
gcugagcacccgcccg

SEQ ID NO: 2886858 - RNA, 17 nt, Mycobacterium avium subsp. paratuberculosis
gcugagcacccgcccgg

SEQ ID NO: 2886859 - RNA, 18 nt, Mycobacterium avium subsp. paratuberculosis
gcugagcacccgcccgga

SEQ ID NO: 2886860 - RNA, 13 nt, Mycobacterium avium subsp. paratuberculosis
gcugagcaccggg

SEQ ID NO: 2886861 - RNA, 16 nt, Mycobacterium avium subsp. paratuberculosis
gcugagcaccgggguc

SEQ ID NO: 2886862 - RNA, 17 nt, Mycobacterium avium subsp. paratuberculosis
gcugagcacggugggcg

SEQ ID NO: 2886863 - RNA, 22 nt, Mycobacterium avium subsp. paratuberculosis
gcugagcacggugggcgccggg

SEQ ID NO: 2886864 - RNA, 16 nt, Mycobacterium avium subsp. paratuberculosis
gcugagcagaucaucg

SEQ ID NO: 2886865 - RNA, 13 nt, Mycobacterium avium subsp. paratuberculosis
gcugagcagcacc

SEQ ID NO: 2886866 - RNA, 14 nt, Mycobacterium avium subsp. paratuberculosis
gcugagcagcaccc

SEQ ID NO: 2886867 - RNA, 12 nt, Mycobacterium avium subsp. paratuberculosis
gcugagcagcag

SEQ ID NO: 2886868 - RNA, 13 nt, Mycobacterium avium subsp. paratuberculosis
gcugagcagcccg

SEQ ID NO: 2886869 - RNA, 19 nt, Mycobacterium avium subsp. paratuberculosis
gcugagcagcccgaccacc

SEQ ID NO: 2886870 - RNA, 16 nt, Mycobacterium avium subsp. paratuberculosis
gcugagcagcucgcgg

SEQ ID NO: 2886871 - RNA, 18 nt, Mycobacterium avium subsp. paratuberculosis
gcugagcagcucgcggau

SEQ ID NO: 2886872 - RNA, 19 nt, Mycobacterium avium subsp. paratuberculosis
gcugagcagcucgcggauc

SEQ ID NO: 2886873 - RNA, 17 nt, Mycobacterium avium subsp. paratuberculosis
gcugagcagguccucga

SEQ ID NO: 2886874 - RNA, 15 nt, Mycobacterium avium subsp. paratuberculosis
gcugagccgccgagc

SEQ ID NO: 2886875 - RNA, 21 nt, Mycobacterium avium subsp. paratuberculosis
gcugagccgccgagccggcac

SEQ ID NO: 2886876 - RNA, 22 nt, Mycobacterium avium subsp. paratuberculosis
gcugagccgccgagccggcacg

SEQ ID NO: 2886877 - RNA, 17 nt, Mycobacterium avium subsp. paratuberculosis
gcugagccgcucgucga

SEQ ID NO: 2886878 - RNA, 13 nt, Mycobacterium avium subsp. paratuberculosis
gcugagccggccc

SEQ ID NO: 2886879 - RNA, 16 nt, Mycobacterium avium subsp. paratuberculosis
gcugagccggcccugc

SEQ ID NO: 2886880 - RNA, 20 nt, Mycobacterium avium subsp. paratuberculosis
gcugagccggcccugcggcc

SEQ ID NO: 2886881 - RNA, 17 nt, Mycobacterium avium subsp. paratuberculosis
gcugagcgccaggccau

SEQ ID NO: 2886882 - RNA, 14 nt, Mycobacterium avium subsp. paratuberculosis
gcugagcgggaagc

SEQ ID NO: 2886883 - RNA, 19 nt, Mycobacterium avium subsp. paratuberculosis
gcugagcggguaaccgcag

SEQ ID NO: 2886884 - RNA, 22 nt, Mycobacterium avium subsp. paratuberculosis
gcugagcggguaaccgcagccg

SEQ ID NO: 2886885 - RNA, 15 nt, Mycobacterium avium subsp. paratuberculosis
gcugagcgggucggc

SEQ ID NO: 2886886 - RNA, 19 nt, Mycobacterium avium subsp. paratuberculosis
gcugagcgggucggccggc

SEQ ID NO: 2886887 - RNA, 17 nt, Mycobacterium avium subsp. paratuberculosis
gcugagcguggugaagc

SEQ ID NO: 2886888 - RNA, 18 nt, Mycobacterium avium subsp. paratuberculosis
gcugagcguggugaagca

SEQ ID NO: 2886889 - RNA, 19 nt, Mycobacterium avium subsp. paratuberculosis
gcugagcugugccgcggug

SEQ ID NO: 2886890 - RNA, 18 nt, Mycobacterium avium subsp. paratuberculosis
gcugagcuucugcccggc

SEQ ID NO: 2886891 - RNA, 23 nt, Mycobacterium avium subsp. paratuberculosis
gcugagcuucugcccggccagca

SEQ ID NO: 2886892 - RNA, 16 nt, Mycobacterium avium subsp. paratuberculosis
gcugaggccgccccgg

SEQ ID NO: 2886893 - RNA, 21 nt, Mycobacterium avium subsp. paratuberculosis
gcugagguagucccgcgccug

SEQ ID NO: 2886894 - RNA, 23 nt, Mycobacterium avium subsp. paratuberculosis
gcugagguagucccgcgccuggc

SEQ ID NO: 2886895 - RNA, 22 nt, Mycobacterium avium subsp. paratuberculosis
gcugaguaugcagaugaugccg

SEQ ID NO: 2886896 - RNA, 21 nt, Mycobacterium avium subsp. paratuberculosis
gcugagucuacuuggccagcu

SEQ ID NO: 2886897 - RNA, 22 nt, Mycobacterium avium subsp. paratuberculosis
gcugagucuacuuggccagcug

SEQ ID NO: 2886898 - RNA, 23 nt, Mycobacterium avium subsp. paratuberculosis
gcugagucuacuuggccagcugc

SEQ ID NO: 2886899 - RNA, 18 nt, Mycobacterium avium subsp. paratuberculosis
gcugauagcccgccgcgg

SEQ ID NO: 2886900 - RNA, 20 nt, Mycobacterium avium subsp. paratuberculosis
gcugaucagccggcgagcgc

SEQ ID NO: 2886901 - RNA, 22 nt, Mycobacterium avium subsp. paratuberculosis
gcugaucagccggcgagcgcgc

SEQ ID NO: 2886902 - RNA, 19 nt, Mycobacterium avium subsp. paratuberculosis
gcugaucaugaagucgcgg

SEQ ID NO: 2886903 - RNA, 14 nt, Mycobacterium avium subsp. paratuberculosis
gcugauccagcagc

SEQ ID NO: 2886904 - RNA, 16 nt, Mycobacterium avium subsp. paratuberculosis
gcugauccccagcggc

SEQ ID NO: 2886905 - RNA, 19 nt, Mycobacterium avium subsp. paratuberculosis
gcugauccccagcggcacg

SEQ ID NO: 2886906 - RNA, 20 nt, Mycobacterium avium subsp. paratuberculosis
gcugauccccagcggcacga

SEQ ID NO: 2886907 - RNA, 21 nt, Mycobacterium avium subsp. paratuberculosis
gcugauccgcaggaugccgau

SEQ ID NO: 2886908 - RNA, 16 nt, Mycobacterium avium subsp. paratuberculosis
gcugauccgcgacgcc

SEQ ID NO: 2886909 - RNA, 15 nt, Mycobacterium avium subsp. paratuberculosis
gcugaucgaguccuc

SEQ ID NO: 2886910 - RNA, 19 nt, Mycobacterium avium subsp. paratuberculosis
gcugaucgaguccucgcgg

SEQ ID NO: 2886911 - RNA, 20 nt, Mycobacterium avium subsp. paratuberculosis
gcugaucgcgauccgggcgc

SEQ ID NO: 2886912 - RNA, 13 nt, Mycobacterium avium subsp. paratuberculosis
gcugaucgcggcc

SEQ ID NO: 2886913 - RNA, 16 nt, Mycobacterium avium subsp. paratuberculosis
gcugaucgcggccggc

SEQ ID NO: 2886914 - RNA, 17 nt, Mycobacterium avium subsp. paratuberculosis
gcugaucgcggccggcg

SEQ ID NO: 2886915 - RNA, 18 nt, Mycobacterium avium subsp. paratuberculosis
gcugaucgcggccggcga

SEQ ID NO: 2886916 - RNA, 14 nt, Mycobacterium avium subsp. paratuberculosis
gcugaucgcgucga

SEQ ID NO: 2886917 - RNA, 18 nt, Mycobacterium avium subsp. paratuberculosis
gcugaucgcgucgacggc

SEQ ID NO: 2886918 - RNA, 19 nt, Mycobacterium avium subsp. paratuberculosis
gcugaucgcgucgacggcg

SEQ ID NO: 2886919 - RNA, 20 nt, Mycobacterium avium subsp. paratuberculosis
gcugaucgcgucgacggcgc

SEQ ID NO: 2886920 - RNA, 15 nt, Mycobacterium avium subsp. paratuberculosis
gcugaucucgacggu

SEQ ID NO: 2886921 - RNA, 20 nt, Mycobacterium avium subsp. paratuberculosis
gcugaucucgacgguggccu

SEQ ID NO: 2886922 - RNA, 22 nt, Mycobacterium avium subsp. paratuberculosis
gcugaucucgacgguggccucg

SEQ ID NO: 2886923 - RNA, 17 nt, Mycobacterium avium subsp. paratuberculosis
gcugaucucggcggucu

SEQ ID NO: 2886924 - RNA, 19 nt, Mycobacterium avium subsp. paratuberculosis
gcugaucugcggcaccacg

SEQ ID NO: 2886925 - RNA, 17 nt, Mycobacterium avium subsp. paratuberculosis
gcugaucuggaugcggc

SEQ ID NO: 2886926 - RNA, 18 nt, Mycobacterium avium subsp. paratuberculosis
gcugaucuggaugcggcc

SEQ ID NO: 2886927 - RNA, 18 nt, Mycobacterium avium subsp. paratuberculosis
gcugaugcccuugcggaa

SEQ ID NO: 2886928 - RNA, 14 nt, Mycobacterium avium subsp. paratuberculosis
gcugaugccgccga

SEQ ID NO: 2886929 - RNA, 15 nt, Mycobacterium avium subsp. paratuberculosis
gcugaugccgccgaa

SEQ ID NO: 2886930 - RNA, 22 nt, Mycobacterium avium subsp. paratuberculosis
gcugaugccguccuugucgcgc

SEQ ID NO: 2886931 - RNA, 18 nt, Mycobacterium avium subsp. paratuberculosis
gcugaugcgcaacagcau

SEQ ID NO: 2886932 - RNA, 18 nt, Mycobacterium avium subsp. paratuberculosis
gcugaugcggacaccagu

SEQ ID NO: 2886933 - RNA, 13 nt, Mycobacterium avium subsp. paratuberculosis
gcugaugcggccg

SEQ ID NO: 2886934 - RNA, 16 nt, Mycobacterium avium subsp. paratuberculosis
gcugaugcggccggaa

SEQ ID NO: 2886935 - RNA, 22 nt, Mycobacterium avium subsp. paratuberculosis
gcugauggcacccucggugcuc

SEQ ID NO: 2886936 - RNA, 21 nt, Mycobacterium avium subsp. paratuberculosis
gcugauggcggcggcccgccg

SEQ ID NO: 2886937 - RNA, 20 nt, Mycobacterium avium subsp. paratuberculosis
gcugauguucaguucgucca

SEQ ID NO: 2886938 - RNA, 16 nt, Mycobacterium avium subsp. paratuberculosis
gcugcaacaacuucgg

SEQ ID NO: 2886939 - RNA, 20 nt, Mycobacterium avium subsp. paratuberculosis
gcugcaacaacuucggggug

SEQ ID NO: 2886940 - RNA, 12 nt, Mycobacterium avium subsp. paratuberculosis
gcugcaaccggu

SEQ ID NO: 2886941 - RNA, 14 nt, Mycobacterium avium subsp. paratuberculosis
gcugcaaccgguag

SEQ ID NO: 2886942 - RNA, 20 nt, Mycobacterium avium subsp. paratuberculosis
gcugcaaccgguccgccguc

SEQ ID NO: 2886943 - RNA, 22 nt, Mycobacterium avium subsp. paratuberculosis
gcugcaaccgguccgccgucgg

SEQ ID NO: 2886944 - RNA, 14 nt, Mycobacterium avium subsp. paratuberculosis
gcugcaacggcugg

SEQ ID NO: 2886945 - RNA, 16 nt, Mycobacterium avium subsp. paratuberculosis
gcugcaacggcuggcg

SEQ ID NO: 2886946 - RNA, 16 nt, Mycobacterium avium subsp. paratuberculosis
gcugcaccagcccguc

SEQ ID NO: 2886947 - RNA, 17 nt, Mycobacterium avium subsp. paratuberculosis
gcugcaccagcccgucg

SEQ ID NO: 2886948 - RNA, 19 nt, Mycobacterium avium subsp. paratuberculosis
gcugcaccagcccgucggc

SEQ ID NO: 2886949 - RNA, 20 nt, Mycobacterium avium subsp. paratuberculosis
gcugcaccagcccgucggcc

SEQ ID NO: 2886950 - RNA, 15 nt, Mycobacterium avium subsp. paratuberculosis
gcugcacccaccggc

SEQ ID NO: 2886951 - RNA, 20 nt, Mycobacterium avium subsp. paratuberculosis
gcugcacccaccggcccagc

SEQ ID NO: 2886952 - RNA, 22 nt, Mycobacterium avium subsp. paratuberculosis
gcugcacccaccggcccagccg

SEQ ID NO: 2886953 - RNA, 16 nt, Mycobacterium avium subsp. paratuberculosis
gcugcacccaccggcg

SEQ ID NO: 2886954 - RNA, 17 nt, Mycobacterium avium subsp. paratuberculosis
gcugcacccaccggcgc

SEQ ID NO: 2886955 - RNA, 18 nt, Mycobacterium avium subsp. paratuberculosis
gcugcacccaccggcgca

SEQ ID NO: 2886956 - RNA, 23 nt, Mycobacterium avium subsp. paratuberculosis
gcugcacccaccggcgcagcgcg

SEQ ID NO: 2886957 - RNA, 18 nt, Mycobacterium avium subsp. paratuberculosis
gcugcacccucugccacg

SEQ ID NO: 2886958 - RNA, 20 nt, Mycobacterium avium subsp. paratuberculosis
gcugcacccucugccacggc

SEQ ID NO: 2886959 - RNA, 23 nt, Mycobacterium avium subsp. paratuberculosis
gcugcacccucugccacggcgga

SEQ ID NO: 2886960 - RNA, 14 nt, Mycobacterium avium subsp. paratuberculosis
gcugcaccggggcc

SEQ ID NO: 2886961 - RNA, 18 nt, Mycobacterium avium subsp. paratuberculosis
gcugcaccggggccggcg

SEQ ID NO: 2886962 - RNA, 19 nt, Mycobacterium avium subsp. paratuberculosis
gcugcaccggggccggcgg

SEQ ID NO: 2886963 - RNA, 20 nt, Mycobacterium avium subsp. paratuberculosis
gcugcaccggggccggcggg

SEQ ID NO: 2886964 - RNA, 16 nt, Mycobacterium avium subsp. paratuberculosis
gcugcaccggguacac

SEQ ID NO: 2886965 - RNA, 20 nt, Mycobacterium avium subsp. paratuberculosis
gcugcaccggguacaccggc

SEQ ID NO: 2886966 - RNA, 22 nt, Mycobacterium avium subsp. paratuberculosis
gcugcaccggguacaccggcuc

SEQ ID NO: 2886967 - RNA, 19 nt, Mycobacterium avium subsp. paratuberculosis
gcugcaccguuuccggugc

SEQ ID NO: 2886968 - RNA, 14 nt, Mycobacterium avium subsp. paratuberculosis
gcugcacgacgacc

SEQ ID NO: 2886969 - RNA, 15 nt, Mycobacterium avium subsp. paratuberculosis
gcugcacgacgaccg

SEQ ID NO: 2886970 - RNA, 14 nt, Mycobacterium avium subsp. paratuberculosis
gcugcccgccgcgu

SEQ ID NO: 2886971 - RNA, 14 nt, Mycobacterium avium subsp. paratuberculosis
gcugcccgcgacgg

SEQ ID NO: 2886972 - RNA, 15 nt, Mycobacterium avium subsp. paratuberculosis
gcugcccgcgacggc

SEQ ID NO: 2886973 - RNA, 16 nt, Mycobacterium avium subsp. paratuberculosis
gcugcccgcgacggcg

SEQ ID NO: 2886974 - RNA, 22 nt, Mycobacterium avium subsp. paratuberculosis
gcugcccgcgacggcgagccgg

SEQ ID NO: 2886975 - RNA, 17 nt, Mycobacterium avium subsp. paratuberculosis
gcugcccgcgacugucg

SEQ ID NO: 2886976 - RNA, 12 nt, Mycobacterium avium subsp. paratuberculosis
gcugcccgcggc

SEQ ID NO: 2886977 - RNA, 13 nt, Mycobacterium avium subsp. paratuberculosis
gcugcccgcggcc

SEQ ID NO: 2886978 - RNA, 17 nt, Mycobacterium avium subsp. paratuberculosis
gcugcccgcggccgccg

SEQ ID NO: 2886979 - RNA, 23 nt, Mycobacterium avium subsp. paratuberculosis
gcugcccgcggccgccgccgcgg

SEQ ID NO: 2886980 - RNA, 17 nt, Mycobacterium avium subsp. paratuberculosis
gcugcccggaguccggc

SEQ ID NO: 2886981 - RNA, 13 nt, Mycobacterium avium subsp. paratuberculosis
gcugcccggcaac

SEQ ID NO: 2886982 - RNA, 15 nt, Mycobacterium avium subsp. paratuberculosis
gcugcccggcaaccg

SEQ ID NO: 2886983 - RNA, 14 nt, Mycobacterium avium subsp. paratuberculosis
gcugcccggcccgc

SEQ ID NO: 2886984 - RNA, 17 nt, Mycobacterium avium subsp. paratuberculosis
gcugcccggcccgccgc

SEQ ID NO: 2886985 - RNA, 23 nt, Mycobacterium avium subsp. paratuberculosis
gcugcccggcccgccgcugcagc

SEQ ID NO: 2886986 - RNA, 12 nt, Mycobacterium avium subsp. paratuberculosis
gcugcccggcgc

SEQ ID NO: 2886987 - RNA, 14 nt, Mycobacterium avium subsp. paratuberculosis
gcugcccggcgcca

SEQ ID NO: 2886988 - RNA, 13 nt, Mycobacterium avium subsp. paratuberculosis
gcugcccggcgcg

SEQ ID NO: 2886989 - RNA, 15 nt, Mycobacterium avium subsp. paratuberculosis
gcugcccggcgcgga

SEQ ID NO: 2886990 - RNA, 18 nt, Mycobacterium avium subsp. paratuberculosis
gcugcccggcgcggacag

SEQ ID NO: 2886991 - RNA, 23 nt, Mycobacterium avium subsp. paratuberculosis
gcugcccggcgcggacagcgcgg

SEQ ID NO: 2886992 - RNA, 14 nt, Mycobacterium avium subsp. paratuberculosis
gcugcccggcgcua

SEQ ID NO: 2886993 - RNA, 22 nt, Mycobacterium avium subsp. paratuberculosis
gcugcccgggcuguugaccacg

SEQ ID NO: 2886994 - RNA, 23 nt, Mycobacterium avium subsp. paratuberculosis
gcugcccgggcuguugaccacgg

SEQ ID NO: 2886995 - RNA, 17 nt, Mycobacterium avium subsp. paratuberculosis
gcugcccucggucgccg

SEQ ID NO: 2886996 - RNA, 17 nt, Mycobacterium avium subsp. paratuberculosis
gcugcccugaagcuggg

SEQ ID NO: 2886997 - RNA, 19 nt, Mycobacterium avium subsp. paratuberculosis
gcugcccugaagcugggcg

SEQ ID NO: 2886998 - RNA, 14 nt, Mycobacterium avium subsp. paratuberculosis
gcugccgaccucga

SEQ ID NO: 2886999 - RNA, 13 nt, Mycobacterium avium subsp. paratuberculosis
gcugccgacgaug

SEQ ID NO: 2887000 - RNA, 15 nt, Mycobacterium avium subsp. paratuberculosis
gcugccgacgauguc

SEQ ID NO: 2887001 - RNA, 21 nt, Mycobacterium avium subsp. paratuberculosis
gcugccgagcaccucgucgcc

SEQ ID NO: 2887002 - RNA, 19 nt, Mycobacterium avium subsp. paratuberculosis
gcugccgagguacgcgcug

SEQ ID NO: 2887003 - RNA, 14 nt, Mycobacterium avium subsp. paratuberculosis
gcugccgcaccccg

SEQ ID NO: 2887004 - RNA, 14 nt, Mycobacterium avium subsp. paratuberculosis
gcugccgcccccgc

SEQ ID NO: 2887005 - RNA, 17 nt, Mycobacterium avium subsp. paratuberculosis
gcugccgcccccgcugg

SEQ ID NO: 2887006 - RNA, 19 nt, Mycobacterium avium subsp. paratuberculosis
gcugccgcccccgcuggcg

SEQ ID NO: 2887007 - RNA, 16 nt, Mycobacterium avium subsp. paratuberculosis
gcugccgccgcagcag

SEQ ID NO: 2887008 - RNA, 13 nt, Mycobacterium avium subsp. paratuberculosis
gcugccgccgccg

SEQ ID NO: 2887009 - RNA, 14 nt, Mycobacterium avium subsp. paratuberculosis
gcugccgccgccgc

SEQ ID NO: 2887010 - RNA, 16 nt, Mycobacterium avium subsp. paratuberculosis
gcugccgccgccggcg

SEQ ID NO: 2887011 - RNA, 17 nt, Mycobacterium avium subsp. paratuberculosis
gcugccgccgccggcgg

SEQ ID NO: 2887012 - RNA, 13 nt, Mycobacterium avium subsp. paratuberculosis
gcugccgccggcc

SEQ ID NO: 2887013 - RNA, 18 nt, Mycobacterium avium subsp. paratuberculosis
gcugccgcgacucggugu

SEQ ID NO: 2887014 - RNA, 22 nt, Mycobacterium avium subsp. paratuberculosis
gcugccgcgacucggugucgcu

SEQ ID NO: 2887015 - RNA, 14 nt, Mycobacterium avium subsp. paratuberculosis
gcugccgcgccccg

SEQ ID NO: 2887016 - RNA, 16 nt, Mycobacterium avium subsp. paratuberculosis
gcugccgcgccccgag

SEQ ID NO: 2887017 - RNA, 18 nt, Mycobacterium avium subsp. paratuberculosis
gcugccgcgccccgagca

SEQ ID NO: 2887018 - RNA, 15 nt, Mycobacterium avium subsp. paratuberculosis
gcugccgcgccgcca

SEQ ID NO: 2887019 - RNA, 16 nt, Mycobacterium avium subsp. paratuberculosis
gcugccgcugcgccgg

SEQ ID NO: 2887020 - RNA, 18 nt, Mycobacterium avium subsp. paratuberculosis
gcugccgcugcgccggcg

SEQ ID NO: 2887021 - RNA, 13 nt, Mycobacterium avium subsp. paratuberculosis
gcugccgcuggcg

SEQ ID NO: 2887022 - RNA, 17 nt, Mycobacterium avium subsp. paratuberculosis
gcugccgcuggcgucga

SEQ ID NO: 2887023 - RNA, 17 nt, Mycobacterium avium subsp. paratuberculosis
gcugccggaacgagccg

SEQ ID NO: 2887024 - RNA, 18 nt, Mycobacterium avium subsp. paratuberculosis
gcugccggacaccccggc

SEQ ID NO: 2887025 - RNA, 19 nt, Mycobacterium avium subsp. paratuberculosis
gcugccggacaccccggcc

SEQ ID NO: 2887026 - RNA, 15 nt, Mycobacterium avium subsp. paratuberculosis
gcugccggaccucga

SEQ ID NO: 2887027 - RNA, 20 nt, Mycobacterium avium subsp. paratuberculosis
gcugccggaccucgaccagc

SEQ ID NO: 2887028 - RNA, 12 nt, Mycobacterium avium subsp. paratuberculosis
gcugccggccga

SEQ ID NO: 2887029 - RNA, 14 nt, Mycobacterium avium subsp. paratuberculosis
gcugccggccggca

SEQ ID NO: 2887030 - RNA, 15 nt, Mycobacterium avium subsp. paratuberculosis
gcugccggccggcag

SEQ ID NO: 2887031 - RNA, 13 nt, Mycobacterium avium subsp. paratuberculosis
gcugccggccggg

SEQ ID NO: 2887032 - RNA, 16 nt, Mycobacterium avium subsp. paratuberculosis
gcugccggccggggcg

SEQ ID NO: 2887033 - RNA, 12 nt, Mycobacterium avium subsp. paratuberculosis
gcugccggcgac

SEQ ID NO: 2887034 - RNA, 15 nt, Mycobacterium avium subsp. paratuberculosis
gcugccggcgaccag

SEQ ID NO: 2887035 - RNA, 16 nt, Mycobacterium avium subsp. paratuberculosis
gcugccggcgcacccg

SEQ ID NO: 2887036 - RNA, 14 nt, Mycobacterium avium subsp. paratuberculosis
gcugccggcggccg

SEQ ID NO: 2887037 - RNA, 19 nt, Mycobacterium avium subsp. paratuberculosis
gcugccggcggccgccggc

SEQ ID NO: 2887038 - RNA, 20 nt, Mycobacterium avium subsp. paratuberculosis
gcugccggcggccgccggca

SEQ ID NO: 2887039 - RNA, 22 nt, Mycobacterium avium subsp. paratuberculosis
gcugccggcggccgccggcacc

SEQ ID NO: 2887040 - RNA, 19 nt, Mycobacterium avium subsp. paratuberculosis
gcugccggggugcagcacc

SEQ ID NO: 2887041 - RNA, 18 nt, Mycobacterium avium subsp. paratuberculosis
gcugccguagcgcugggu

SEQ ID NO: 2887042 - RNA, 15 nt, Mycobacterium avium subsp. paratuberculosis
gcugccguccacccg

SEQ ID NO: 2887043 - RNA, 12 nt, Mycobacterium avium subsp. paratuberculosis
gcugccguccgg

SEQ ID NO: 2887044 - RNA, 16 nt, Mycobacterium avium subsp. paratuberculosis
gcugccguccggcggc

SEQ ID NO: 2887045 - RNA, 14 nt, Mycobacterium avium subsp. paratuberculosis
gcugccguucgccg

SEQ ID NO: 2887046 - RNA, 16 nt, Mycobacterium avium subsp. paratuberculosis
gcugccguucgccggu

SEQ ID NO: 2887047 - RNA, 18 nt, Mycobacterium avium subsp. paratuberculosis
gcugccguucgccgguac

SEQ ID NO: 2887048 - RNA, 19 nt, Mycobacterium avium subsp. paratuberculosis
gcugccguucgccgguacc

SEQ ID NO: 2887049 - RNA, 16 nt, Mycobacterium avium subsp. paratuberculosis
gcugccguugcgccag

SEQ ID NO: 2887050 - RNA, 19 nt, Mycobacterium avium subsp. paratuberculosis
gcugccguugcgccagcgg

SEQ ID NO: 2887051 - RNA, 15 nt, Mycobacterium avium subsp. paratuberculosis
gcugccucgacgaug

SEQ ID NO: 2887052 - RNA, 15 nt, Mycobacterium avium subsp. paratuberculosis
gcugcgaaucgucgg

SEQ ID NO: 2887053 - RNA, 19 nt, Mycobacterium avium subsp. paratuberculosis
gcugcgaaucgucggcgau

SEQ ID NO: 2887054 - RNA, 14 nt, Mycobacterium avium subsp. paratuberculosis
gcugcgacagcacg

SEQ ID NO: 2887055 - RNA, 15 nt, Mycobacterium avium subsp. paratuberculosis
gcugcgacagcacgg

SEQ ID NO: 2887056 - RNA, 19 nt, Mycobacterium avium subsp. paratuberculosis
gcugcgggucucgcccacc

SEQ ID NO: 2887057 - RNA, 18 nt, Mycobacterium avium subsp. paratuberculosis
gcugcgggugcggccagc

SEQ ID NO: 2887058 - RNA, 14 nt, Mycobacterium avium subsp. paratuberculosis
gcugcggguugcgg

SEQ ID NO: 2887059 - RNA, 18 nt, Mycobacterium avium subsp. paratuberculosis
gcugcggguugcgggcca

SEQ ID NO: 2887060 - RNA, 23 nt, Mycobacterium avium subsp. paratuberculosis
gcugcgguacacguggccgauca

SEQ ID NO: 2887061 - RNA, 15 nt, Mycobacterium avium subsp. paratuberculosis
gcugcgguuccgggc

SEQ ID NO: 2887062 - RNA, 16 nt, Mycobacterium avium subsp. paratuberculosis
gcugcgguuccgggcg

SEQ ID NO: 2887063 - RNA, 17 nt, Mycobacterium avium subsp. paratuberculosis
gcugcgguuccgggcgc

SEQ ID NO: 2887064 - RNA, 18 nt, Mycobacterium avium subsp. paratuberculosis
gcugcgguuccgggcgcu

SEQ ID NO: 2887065 - RNA, 14 nt, Mycobacterium avium subsp. paratuberculosis
gcugcgguuggccg

SEQ ID NO: 2887066 - RNA, 18 nt, Mycobacterium avium subsp. paratuberculosis
gcugcgguuggccggccg

SEQ ID NO: 2887067 - RNA, 22 nt, Mycobacterium avium subsp. paratuberculosis
gcugcgguuggccggccgggcg

SEQ ID NO: 2887068 - RNA, 23 nt, Mycobacterium avium subsp. paratuberculosis
gcugcgguuggccggccgggcgg

SEQ ID NO: 2887069 - RNA, 17 nt, Mycobacterium avium subsp. paratuberculosis
gcugcgucggcaccagc

SEQ ID NO: 2887070 - RNA, 20 nt, Mycobacterium avium subsp. paratuberculosis
gcugcgucggcaccagcggc

SEQ ID NO: 2887071 - RNA, 14 nt, Mycobacterium avium subsp. paratuberculosis
gcugcgugcccgga

SEQ ID NO: 2887072 - RNA, 12 nt, Mycobacterium avium subsp. paratuberculosis
gcugcguucggc

SEQ ID NO: 2887073 - RNA, 13 nt, Mycobacterium avium subsp. paratuberculosis
gcugcguucggcg

SEQ ID NO: 2887074 - RNA, 23 nt, Mycobacterium avium subsp. paratuberculosis
gcugcguucggcgaucagcugga

SEQ ID NO: 2887075 - RNA, 21 nt, Mycobacterium avium subsp. paratuberculosis
gcugcucaugagcccuccagc

SEQ ID NO: 2887076 - RNA, 14 nt, Mycobacterium avium subsp. paratuberculosis
gcugcuccgggggc

SEQ ID NO: 2887077 - RNA, 21 nt, Mycobacterium avium subsp. paratuberculosis
gcugcuccgggggcaccgcca

SEQ ID NO: 2887078 - RNA, 22 nt, Mycobacterium avium subsp. paratuberculosis
gcugcuccgggggcaccgccag

SEQ ID NO: 2887079 - RNA, 19 nt, Mycobacterium avium subsp. paratuberculosis
gcugcuccggguccgcggu

SEQ ID NO: 2887080 - RNA, 17 nt, Mycobacterium avium subsp. paratuberculosis
gcugcucgaaccgcgag

SEQ ID NO: 2887081 - RNA, 18 nt, Mycobacterium avium subsp. paratuberculosis
gcugcucgaaccgcgaga

SEQ ID NO: 2887082 - RNA, 15 nt, Mycobacterium avium subsp. paratuberculosis
gcugcucgaccucgg

SEQ ID NO: 2887083 - RNA, 16 nt, Mycobacterium avium subsp. paratuberculosis
gcugcucgaccucggc

SEQ ID NO: 2887084 - RNA, 20 nt, Mycobacterium avium subsp. paratuberculosis
gcugcucgaccucggcgacc

SEQ ID NO: 2887085 - RNA, 13 nt, Mycobacterium avium subsp. paratuberculosis
gcugcucgagggc

SEQ ID NO: 2887086 - RNA, 18 nt, Mycobacterium avium subsp. paratuberculosis
gcugcucgagggccucca

SEQ ID NO: 2887087 - RNA, 23 nt, Mycobacterium avium subsp. paratuberculosis
gcugcucgagggccuccaccacc

SEQ ID NO: 2887088 - RNA, 20 nt, Mycobacterium avium subsp. paratuberculosis
gcugcucgcgcugccgcgcg

SEQ ID NO: 2887089 - RNA, 22 nt, Mycobacterium avium subsp. paratuberculosis
gcugcucgcgcugccgcgcgcc

SEQ ID NO: 2887090 - RNA, 19 nt, Mycobacterium avium subsp. paratuberculosis
gcugcucggccaccgcgcg

SEQ ID NO: 2887091 - RNA, 20 nt, Mycobacterium avium subsp. paratuberculosis
gcugcucggccaccgcgcgg

SEQ ID NO: 2887092 - RNA, 22 nt, Mycobacterium avium subsp. paratuberculosis
gcugcucggccaccgcgcggug

SEQ ID NO: 2887093 - RNA, 13 nt, Mycobacterium avium subsp. paratuberculosis
gcugcucggcggg

SEQ ID NO: 2887094 - RNA, 14 nt, Mycobacterium avium subsp. paratuberculosis
gcugcucguccugg

SEQ ID NO: 2887095 - RNA, 16 nt, Mycobacterium avium subsp. paratuberculosis
gcugcucguccuggcg

SEQ ID NO: 2887096 - RNA, 16 nt, Mycobacterium avium subsp. paratuberculosis
gcugcucugcgcgcgg

SEQ ID NO: 2887097 - RNA, 19 nt, Mycobacterium avium subsp. paratuberculosis
gcugcucugcgcgcggugc

SEQ ID NO: 2887098 - RNA, 15 nt, Mycobacterium avium subsp. paratuberculosis
gcugcucuuguccgc

SEQ ID NO: 2887099 - RNA, 20 nt, Mycobacterium avium subsp. paratuberculosis
gcugcucuuguccgcguugg

SEQ ID NO: 2887100 - RNA, 23 nt, Mycobacterium avium subsp. paratuberculosis
gcugcugcacgacgaccgcgacg

SEQ ID NO: 2887101 - RNA, 12 nt, Mycobacterium avium subsp. paratuberculosis
gcugcugcagcg

SEQ ID NO: 2887102 - RNA, 14 nt, Mycobacterium avium subsp. paratuberculosis
gcugcugcagcgcc

SEQ ID NO: 2887103 - RNA, 15 nt, Mycobacterium avium subsp. paratuberculosis
gcugcugcagcgccc

SEQ ID NO: 2887104 - RNA, 17 nt, Mycobacterium avium subsp. paratuberculosis
gcugcugccccucgacg

SEQ ID NO: 2887105 - RNA, 18 nt, Mycobacterium avium subsp. paratuberculosis
gcugcugccccucgacga

SEQ ID NO: 2887106 - RNA, 15 nt, Mycobacterium avium subsp. paratuberculosis
gcugcugcccgcccg

SEQ ID NO: 2887107 - RNA, 18 nt, Mycobacterium avium subsp. paratuberculosis
gcugcugcccgcccgaga

SEQ ID NO: 2887108 - RNA, 19 nt, Mycobacterium avium subsp. paratuberculosis
gcugcugcccgcccgagag

SEQ ID NO: 2887109 - RNA, 14 nt, Mycobacterium avium subsp. paratuberculosis
gcugcugcgcggcg

SEQ ID NO: 2887110 - RNA, 12 nt, Mycobacterium avium subsp. paratuberculosis
gcugcugcggcc

SEQ ID NO: 2887111 - RNA, 12 nt, Mycobacterium avium subsp. paratuberculosis
gcugcugcucgg

SEQ ID NO: 2887112 - RNA, 15 nt, Mycobacterium avium subsp. paratuberculosis
gcugcugcugcccgc

SEQ ID NO: 2887113 - RNA, 17 nt, Mycobacterium avium subsp. paratuberculosis
gcugcugggacgggucg

SEQ ID NO: 2887114 - RNA, 20 nt, Mycobacterium avium subsp. paratuberculosis
gcugcugggacgggucggcg

SEQ ID NO: 2887115 - RNA, 22 nt, Mycobacterium avium subsp. paratuberculosis
gcugcugggacgggucggcggc

SEQ ID NO: 2887116 - RNA, 23 nt, Mycobacterium avium subsp. paratuberculosis
gcugcugggacgggucggcggcg

SEQ ID NO: 2887117 - RNA, 16 nt, Mycobacterium avium subsp. paratuberculosis
gcugcugggugccgcg

SEQ ID NO: 2887118 - RNA, 15 nt, Mycobacterium avium subsp. paratuberculosis
gcugcuucgucgccg

SEQ ID NO: 2887119 - RNA, 16 nt, Mycobacterium avium subsp. paratuberculosis
gcugcuucgucgccgg

SEQ ID NO: 2887120 - RNA, 23 nt, Mycobacterium avium subsp. paratuberculosis
gcugcuuugucucacgccucguc

SEQ ID NO: 2887121 - RNA, 21 nt, Mycobacterium avium subsp. paratuberculosis
gcuggaaaccucuugcggcgc

SEQ ID NO: 2887122 - RNA, 20 nt, Mycobacterium avium subsp. paratuberculosis
gcuggaacaccacggccggc

SEQ ID NO: 2887123 - RNA, 12 nt, Mycobacterium avium subsp. paratuberculosis
gcuggaacagcg

SEQ ID NO: 2887124 - RNA, 14 nt, Mycobacterium avium subsp. paratuberculosis
gcuggaacagcggg

SEQ ID NO: 2887125 - RNA, 15 nt, Mycobacterium avium subsp. paratuberculosis
gcuggaacagcgggc

SEQ ID NO: 2887126 - RNA, 18 nt, Mycobacterium avium subsp. paratuberculosis
gcuggaacagcgggccgg

SEQ ID NO: 2887127 - RNA, 19 nt, Mycobacterium avium subsp. paratuberculosis
gcuggaacagcgggccggc

SEQ ID NO: 2887128 - RNA, 20 nt, Mycobacterium avium subsp. paratuberculosis
gcuggaacagcgggccggcg

SEQ ID NO: 2887129 - RNA, 20 nt, Mycobacterium avium subsp. paratuberculosis
gcuggaaccgaaucggucga

SEQ ID NO: 2887130 - RNA, 22 nt, Mycobacterium avium subsp. paratuberculosis
gcuggaaccgaaucggucgacc

SEQ ID NO: 2887131 - RNA, 17 nt, Mycobacterium avium subsp. paratuberculosis
gcuggaaguucgcuggc

SEQ ID NO: 2887132 - RNA, 18 nt, Mycobacterium avium subsp. paratuberculosis
gcuggaaguucgcuggcg

SEQ ID NO: 2887133 - RNA, 15 nt, Mycobacterium avium subsp. paratuberculosis
gcuggaaucccgccu

SEQ ID NO: 2887134 - RNA, 20 nt, Mycobacterium avium subsp. paratuberculosis
gcuggaaucccgccucggcg

SEQ ID NO: 2887135 - RNA, 15 nt, Mycobacterium avium subsp. paratuberculosis
gcuggacaccacguc

SEQ ID NO: 2887136 - RNA, 22 nt, Mycobacterium avium subsp. paratuberculosis
gcuggacaccacgucgucggcc

SEQ ID NO: 2887137 - RNA, 20 nt, Mycobacterium avium subsp. paratuberculosis
gcuggacacccccgauccgc

SEQ ID NO: 2887138 - RNA, 22 nt, Mycobacterium avium subsp. paratuberculosis
gcuggacacccccgauccgccg

SEQ ID NO: 2887139 - RNA, 22 nt, Mycobacterium avium subsp. paratuberculosis
gcuggacagccacagcucgggc

SEQ ID NO: 2887140 - RNA, 22 nt, Mycobacterium avium subsp. paratuberculosis
gcuggcgaucaucgucgucacc

SEQ ID NO: 2887141 - RNA, 17 nt, Mycobacterium avium subsp. paratuberculosis
gcuggcgauggugccga

SEQ ID NO: 2887142 - RNA, 18 nt, Mycobacterium avium subsp. paratuberculosis
gcuggcgaugugaucgcg

SEQ ID NO: 2887143 - RNA, 20 nt, Mycobacterium avium subsp. paratuberculosis
gcuggcgaugugaucgcggc

SEQ ID NO: 2887144 - RNA, 16 nt, Mycobacterium avium subsp. paratuberculosis
gcuggcgcaggcgcug

SEQ ID NO: 2887145 - RNA, 16 nt, Mycobacterium avium subsp. paratuberculosis
gcuggcgcaggugugc

SEQ ID NO: 2887146 - RNA, 22 nt, Mycobacterium avium subsp. paratuberculosis
gcuggcgcaggugugcggcaag

SEQ ID NO: 2887147 - RNA, 14 nt, Mycobacterium avium subsp. paratuberculosis
gcuggcgccgaaca

SEQ ID NO: 2887148 - RNA, 23 nt, Mycobacterium avium subsp. paratuberculosis
gcuggcgccgaacagaugccugc

SEQ ID NO: 2887149 - RNA, 13 nt, Mycobacterium avium subsp. paratuberculosis
gcuggcgccggcg

SEQ ID NO: 2887150 - RNA, 17 nt, Mycobacterium avium subsp. paratuberculosis
gcuggcgccggcgucca

SEQ ID NO: 2887151 - RNA, 19 nt, Mycobacterium avium subsp. paratuberculosis
gcuggcgccggcguccagc

SEQ ID NO: 2887152 - RNA, 19 nt, Mycobacterium avium subsp. paratuberculosis
gcuggcgcgauagccggug

SEQ ID NO: 2887153 - RNA, 19 nt, Mycobacterium avium subsp. paratuberculosis
gcuggcgcugggagcgggc

SEQ ID NO: 2887154 - RNA, 23 nt, Mycobacterium avium subsp. paratuberculosis
gcuggcgcugggagcgggccacg

SEQ ID NO: 2887155 - RNA, 18 nt, Mycobacterium avium subsp. paratuberculosis
gcuggcgcuguaggcggc

SEQ ID NO: 2887156 - RNA, 14 nt, Mycobacterium avium subsp. paratuberculosis
gcuggcggccagcg

SEQ ID NO: 2887157 - RNA, 20 nt, Mycobacterium avium subsp. paratuberculosis
gcuggcggccaucgccgcgg

SEQ ID NO: 2887158 - RNA, 22 nt, Mycobacterium avium subsp. paratuberculosis
gcuggcggccaucgccgcggug

SEQ ID NO: 2887159 - RNA, 22 nt, Mycobacterium avium subsp. paratuberculosis
gcuggcggccuucuuggccgga

SEQ ID NO: 2887160 - RNA, 24 nt, Mycobacterium avium subsp. paratuberculosis
gcuggcggcgaucaccgccgcggc

SEQ ID NO: 2887161 - RNA, 21 nt, Mycobacterium avium subsp. paratuberculosis
gcuggcggggcgugcccggcg

SEQ ID NO: 2887162 - RNA, 20 nt, Mycobacterium avium subsp. paratuberculosis
gcuggcgggugguuggccgc

SEQ ID NO: 2887163 - RNA, 14 nt, Mycobacterium avium subsp. paratuberculosis
gcuggcguacgcca

SEQ ID NO: 2887164 - RNA, 16 nt, Mycobacterium avium subsp. paratuberculosis
gcuggcguagagccgc

SEQ ID NO: 2887165 - RNA, 18 nt, Mycobacterium avium subsp. paratuberculosis
gcuggcguagagccgcuc

SEQ ID NO: 2887166 - RNA, 19 nt, Mycobacterium avium subsp. paratuberculosis
gcuggcguagagccgcucg

SEQ ID NO: 2887167 - RNA, 20 nt, Mycobacterium avium subsp. paratuberculosis
gcuggcguagagccgcucgc

SEQ ID NO: 2887168 - RNA, 16 nt, Mycobacterium avium subsp. paratuberculosis
gcuggcguaggacagc

SEQ ID NO: 2887169 - RNA, 17 nt, Mycobacterium avium subsp. paratuberculosis
gcuggcguaggacagca

SEQ ID NO: 2887170 - RNA, 21 nt, Mycobacterium avium subsp. paratuberculosis
gcuggcguaggacagcagccg

SEQ ID NO: 2887171 - RNA, 14 nt, Mycobacterium avium subsp. paratuberculosis
gcuggcgucgaacg

SEQ ID NO: 2887172 - RNA, 22 nt, Mycobacterium avium subsp. paratuberculosis
gcuggcgugaaucuuggccagc

SEQ ID NO: 2887173 - RNA, 23 nt, Mycobacterium avium subsp. paratuberculosis
gcuggcgugaaucuuggccagca

SEQ ID NO: 2887174 - RNA, 21 nt, Mycobacterium avium subsp. paratuberculosis
gcuggcgugacagucgagggc

SEQ ID NO: 2887175 - RNA, 14 nt, Mycobacterium avium subsp. paratuberculosis
gcuggcgugacgcu

SEQ ID NO: 2887176 - RNA, 17 nt, Mycobacterium avium subsp. paratuberculosis
gcuggcgugacgcucga

SEQ ID NO: 2887177 - RNA, 17 nt, Mycobacterium avium subsp. paratuberculosis
gcuggcgugacgcucgc

SEQ ID NO: 2887178 - RNA, 18 nt, Mycobacterium avium subsp. paratuberculosis
gcuggcgugacgcucgcc

SEQ ID NO: 2887179 - RNA, 19 nt, Mycobacterium avium subsp. paratuberculosis
gcuggcgugacgcucgccg

SEQ ID NO: 2887180 - RNA, 21 nt, Mycobacterium avium subsp. paratuberculosis
gcuggcgugacgcucgccggc

SEQ ID NO: 2887181 - RNA, 19 nt, Mycobacterium avium subsp. paratuberculosis
gcuggcgugacgcucggcc

SEQ ID NO: 2887182 - RNA, 23 nt, Mycobacterium avium subsp. paratuberculosis
gcuggcgugacgcucggccgugg

SEQ ID NO: 2887183 - RNA, 15 nt, Mycobacterium avium subsp. paratuberculosis
gcuggcgugacgguc

SEQ ID NO: 2887184 - RNA, 19 nt, Mycobacterium avium subsp. paratuberculosis
gcuggcgugacggucgacc

SEQ ID NO: 2887185 - RNA, 22 nt, Mycobacterium avium subsp. paratuberculosis
gcuggcgugacggucgaccucg

SEQ ID NO: 2887186 - RNA, 16 nt, Mycobacterium avium subsp. paratuberculosis
gcuggcgugacguucg

SEQ ID NO: 2887187 - RNA, 17 nt, Mycobacterium avium subsp. paratuberculosis
gcuggcgugcggcgcgg

SEQ ID NO: 2887188 - RNA, 16 nt, Mycobacterium avium subsp. paratuberculosis
gcuggcguggcacccg

SEQ ID NO: 2887189 - RNA, 17 nt, Mycobacterium avium subsp. paratuberculosis
gcuggcguggcacccgg

SEQ ID NO: 2887190 - RNA, 14 nt, Mycobacterium avium subsp. paratuberculosis
gcucgccggcccga

SEQ ID NO: 2887191 - RNA, 20 nt, Mycobacterium avium subsp. paratuberculosis
gcucgccggcccgaccggag

SEQ ID NO: 2887192 - RNA, 17 nt, Mycobacterium avium subsp. paratuberculosis
gcucgccggccgcgggc

SEQ ID NO: 2887193 - RNA, 19 nt, Mycobacterium avium subsp. paratuberculosis
gcucgccggccgcgggcga

SEQ ID NO: 2887194 - RNA, 12 nt, Mycobacterium avium subsp. paratuberculosis
gcucgccggcgc

SEQ ID NO: 2887195 - RNA, 15 nt, Mycobacterium avium subsp. paratuberculosis
gcucgccggcgcgca

SEQ ID NO: 2887196 - RNA, 16 nt, Mycobacterium avium subsp. paratuberculosis
gcucgccggcgcgcac

SEQ ID NO: 2887197 - RNA, 20 nt, Mycobacterium avium subsp. paratuberculosis
gcucgccggcgcgcaccccg

SEQ ID NO: 2887198 - RNA, 19 nt, Mycobacterium avium subsp. paratuberculosis
gcucgccggcgcgcagcca

SEQ ID NO: 2887199 - RNA, 14 nt, Mycobacterium avium subsp. paratuberculosis
gcucgccggcgcgg

SEQ ID NO: 2887200 - RNA, 15 nt, Mycobacterium avium subsp. paratuberculosis
gcucgccggcgcgga

SEQ ID NO: 2887201 - RNA, 13 nt, Mycobacterium avium subsp. paratuberculosis
gcucgccggcggc

SEQ ID NO: 2887202 - RNA, 14 nt, Mycobacterium avium subsp. paratuberculosis
gcucgccggcggcc

SEQ ID NO: 2887203 - RNA, 15 nt, Mycobacterium avium subsp. paratuberculosis
gcucgccggcggccg

SEQ ID NO: 2887204 - RNA, 23 nt, Mycobacterium avium subsp. paratuberculosis
gcucgccggcggccgccacgcug

SEQ ID NO: 2887205 - RNA, 13 nt, Mycobacterium avium subsp. paratuberculosis
gcucgccggcguc

SEQ ID NO: 2887206 - RNA, 12 nt, Mycobacterium avium subsp. paratuberculosis
gcucgccggcua

SEQ ID NO: 2887207 - RNA, 15 nt, Mycobacterium avium subsp. paratuberculosis
gcucgccggcuaccg

SEQ ID NO: 2887208 - RNA, 14 nt, Mycobacterium avium subsp. paratuberculosis
gcucgccgggcugc

SEQ ID NO: 2887209 - RNA, 18 nt, Mycobacterium avium subsp. paratuberculosis
gcucgccggggacgacgg

SEQ ID NO: 2887210 - RNA, 22 nt, Mycobacterium avium subsp. paratuberculosis
gcucgccggggacgacggcggg

SEQ ID NO: 2887211 - RNA, 17 nt, Mycobacterium avium subsp. paratuberculosis
gcucgccgguggcggcg

SEQ ID NO: 2887212 - RNA, 19 nt, Mycobacterium avium subsp. paratuberculosis
gcucgccgguggcggcgac

SEQ ID NO: 2887213 - RNA, 21 nt, Mycobacterium avium subsp. paratuberculosis
gcucgccguagaauccgccgu

SEQ ID NO: 2887214 - RNA, 21 nt, Mycobacterium avium subsp. paratuberculosis
gcucgccgucacaccgcggcc

SEQ ID NO: 2887215 - RNA, 22 nt, Mycobacterium avium subsp. paratuberculosis
gcucgccgucacaccgcggcca

SEQ ID NO: 2887216 - RNA, 14 nt, Mycobacterium avium subsp. paratuberculosis
gcucgccgucggcc

SEQ ID NO: 2887217 - RNA, 17 nt, Mycobacterium avium subsp. paratuberculosis
gcucgccgucggccagc

SEQ ID NO: 2887218 - RNA, 21 nt, Mycobacterium avium subsp. paratuberculosis
gcucgccgucggccagcagcg

SEQ ID NO: 2887219 - RNA, 14 nt, Mycobacterium avium subsp. paratuberculosis
gcucgccguugcgg

SEQ ID NO: 2887220 - RNA, 13 nt, Mycobacterium avium subsp. paratuberculosis
gcucgccucaacg

SEQ ID NO: 2887221 - RNA, 21 nt, Mycobacterium avium subsp. paratuberculosis
gcucgcgaagcgcgaugcggc

SEQ ID NO: 2887222 - RNA, 21 nt, Mycobacterium avium subsp. paratuberculosis
gcucgcgagggcgggccagcu

SEQ ID NO: 2887223 - RNA, 13 nt, Mycobacterium avium subsp. paratuberculosis
gcucgcgcacccg

SEQ ID NO: 2887224 - RNA, 15 nt, Mycobacterium avium subsp. paratuberculosis
gcucgcgcacccgua

SEQ ID NO: 2887225 - RNA, 14 nt, Mycobacterium avium subsp. paratuberculosis
gcucgcgcaccggg

SEQ ID NO: 2887226 - RNA, 23 nt, Mycobacterium avium subsp. paratuberculosis
gcucgcgcaccgggaccagcgcg

SEQ ID NO: 2887227 - RNA, 15 nt, Mycobacterium avium subsp. paratuberculosis
gcucgcgcagcagcu

SEQ ID NO: 2887228 - RNA, 15 nt, Mycobacterium avium subsp. paratuberculosis
gcucgcgcagccggc

SEQ ID NO: 2887229 - RNA, 17 nt, Mycobacterium avium subsp. paratuberculosis
gcucgcgcagccggccg

SEQ ID NO: 2887230 - RNA, 16 nt, Mycobacterium avium subsp. paratuberculosis
gcucgcgcagcuggcc

SEQ ID NO: 2887231 - RNA, 17 nt, Mycobacterium avium subsp. paratuberculosis
gcucgcgcagcuggccg

SEQ ID NO: 2887232 - RNA, 18 nt, Mycobacterium avium subsp. paratuberculosis
gcucgcgcagcuggccgu

SEQ ID NO: 2887233 - RNA, 21 nt, Mycobacterium avium subsp. paratuberculosis
gcucgcgcagcuggccgugca

SEQ ID NO: 2887234 - RNA, 20 nt, Mycobacterium avium subsp. paratuberculosis
gcucgcgcaggaacuccagc

SEQ ID NO: 2887235 - RNA, 18 nt, Mycobacterium avium subsp. paratuberculosis
gcucgcgcccggccaggu

SEQ ID NO: 2887236 - RNA, 15 nt, Mycobacterium avium subsp. paratuberculosis
gcucgcgccgacccg

SEQ ID NO: 2887237 - RNA, 14 nt, Mycobacterium avium subsp. paratuberculosis
gcucgcgccgggcg

SEQ ID NO: 2887238 - RNA, 15 nt, Mycobacterium avium subsp. paratuberculosis
gcucgcgccgggcgg

SEQ ID NO: 2887239 - RNA, 16 nt, Mycobacterium avium subsp. paratuberculosis
gcucgcgccgggcggc

SEQ ID NO: 2887240 - RNA, 17 nt, Mycobacterium avium subsp. paratuberculosis
gcucgcgccgggcggcc

SEQ ID NO: 2887241 - RNA, 12 nt, Mycobacterium avium subsp. paratuberculosis
gcucgcgcggug

SEQ ID NO: 2887242 - RNA, 15 nt, Mycobacterium avium subsp. paratuberculosis
gcucgcgcucgucca

SEQ ID NO: 2887243 - RNA, 15 nt, Mycobacterium avium subsp. paratuberculosis
gcucgcgcugaagcc

SEQ ID NO: 2887244 - RNA, 15 nt, Mycobacterium avium subsp. paratuberculosis
gcucgcgcugcaugc

SEQ ID NO: 2887245 - RNA, 15 nt, Mycobacterium avium subsp. paratuberculosis
gcucgcgcugccgcg

SEQ ID NO: 2887246 - RNA, 13 nt, Mycobacterium avium subsp. paratuberculosis
gcucgcggauccg

SEQ ID NO: 2887247 - RNA, 17 nt, Mycobacterium avium subsp. paratuberculosis
gcucgcggauccgcagc

SEQ ID NO: 2887248 - RNA, 17 nt, Mycobacterium avium subsp. paratuberculosis
gcucgcggauccgggcc

SEQ ID NO: 2887249 - RNA, 21 nt, Mycobacterium avium subsp. paratuberculosis
gcucgcggauccgggccggcg

SEQ ID NO: 2887250 - RNA, 15 nt, Mycobacterium avium subsp. paratuberculosis
gcucgcggauguccg

SEQ ID NO: 2887251 - RNA, 13 nt, Mycobacterium avium subsp. paratuberculosis
gcucgcggccgua

SEQ ID NO: 2887252 - RNA, 15 nt, Mycobacterium avium subsp. paratuberculosis
gcucgcggccugcgg

SEQ ID NO: 2887253 - RNA, 23 nt, Mycobacterium avium subsp. paratuberculosis
gcucgcggccugcgggcgccggc

SEQ ID NO: 2887254 - RNA, 14 nt, Mycobacterium avium subsp. paratuberculosis
gcucgcggcgcagc

SEQ ID NO: 2887255 - RNA, 17 nt, Mycobacterium avium subsp. paratuberculosis
gcucgcggcgcagcucg

SEQ ID NO: 2887256 - RNA, 20 nt, Mycobacterium avium subsp. paratuberculosis
gcucgcggcgcagcucgcgc

SEQ ID NO: 2887257 - RNA, 20 nt, Mycobacterium avium subsp. paratuberculosis
gcucgcggcguaggcggcca

SEQ ID NO: 2887258 - RNA, 10 nt, Mycobacterium avium subsp. paratuberculosis
gcucgcgggc

SEQ ID NO: 2887259 - RNA, 20 nt, Mycobacterium avium subsp. paratuberculosis
gcucgcgggccacagcggcg

SEQ ID NO: 2887260 - RNA, 22 nt, Mycobacterium avium subsp. paratuberculosis
gcucgcgggccacagcggcgac

SEQ ID NO: 2887261 - RNA, 13 nt, Mycobacterium avium subsp. paratuberculosis
gcucgcgggcccg

SEQ ID NO: 2887262 - RNA, 16 nt, Mycobacterium avium subsp. paratuberculosis
gcucgcgggcccgcgc

SEQ ID NO: 2887263 - RNA, 19 nt, Mycobacterium avium subsp. paratuberculosis
gcucgcgggcccgcgccgc

SEQ ID NO: 2887264 - RNA, 20 nt, Mycobacterium avium subsp. paratuberculosis
gcucgcgggcgaugcggccc

SEQ ID NO: 2887265 - RNA, 19 nt, Mycobacterium avium subsp. paratuberculosis
gcucgcggggugucgugca

SEQ ID NO: 2887266 - RNA, 20 nt, Mycobacterium avium subsp. paratuberculosis
gcucgcgggugcgcugcagc

SEQ ID NO: 2887267 - RNA, 23 nt, Mycobacterium avium subsp. paratuberculosis
gcucgcgggugcgcugcagcgag

SEQ ID NO: 2887268 - RNA, 22 nt, Mycobacterium avium subsp. paratuberculosis
gcucgcgggugcggcgcugccg

SEQ ID NO: 2887269 - RNA, 22 nt, Mycobacterium avium subsp. paratuberculosis
gcucgcgggugucgagccacca

SEQ ID NO: 2887270 - RNA, 17 nt, Mycobacterium avium subsp. paratuberculosis
gcucgcggugcgcgcgc

SEQ ID NO: 2887271 - RNA, 19 nt, Mycobacterium avium subsp. paratuberculosis
gcucgcgguugggccgccg

SEQ ID NO: 2887272 - RNA, 20 nt, Mycobacterium avium subsp. paratuberculosis
gcucgcgguugggccgccgg

SEQ ID NO: 2887273 - RNA, 21 nt, Mycobacterium avium subsp. paratuberculosis
gcucgcgguugggccgccggc

SEQ ID NO: 2887274 - RNA, 18 nt, Mycobacterium avium subsp. paratuberculosis
gcucgcgguugggccggc

SEQ ID NO: 2887275 - RNA, 20 nt, Mycobacterium avium subsp. paratuberculosis
gcucgcgguugggccggcgc

SEQ ID NO: 2887276 - RNA, 13 nt, Mycobacterium avium subsp. paratuberculosis
gcucgcgucgacg

SEQ ID NO: 2887277 - RNA, 18 nt, Mycobacterium avium subsp. paratuberculosis
gcucgcguggccugggcg

SEQ ID NO: 2887278 - RNA, 21 nt, Mycobacterium avium subsp. paratuberculosis
gcucgcguucgggcccggccg

SEQ ID NO: 2887279 - RNA, 22 nt, Mycobacterium avium subsp. paratuberculosis
gcucgcguucgggcccggccgc

SEQ ID NO: 2887280 - RNA, 19 nt, Mycobacterium avium subsp. paratuberculosis
gcucgcuauaucgcaccgg

SEQ ID NO: 2887281 - RNA, 22 nt, Mycobacterium avium subsp. paratuberculosis
gcucgcuauaucgcaccggcgc

SEQ ID NO: 2887282 - RNA, 15 nt, Mycobacterium avium subsp. paratuberculosis
gcucgcucccgcgcg

SEQ ID NO: 2887283 - RNA, 16 nt, Mycobacterium avium subsp. paratuberculosis
gcucgcucccgcgcgg

SEQ ID NO: 2887284 - RNA, 19 nt, Mycobacterium avium subsp. paratuberculosis
gcucgcucccgcgcgggca

SEQ ID NO: 2887285 - RNA, 21 nt, Mycobacterium avium subsp. paratuberculosis
gcucgcugagcgggacgcgca

SEQ ID NO: 2887286 - RNA, 23 nt, Mycobacterium avium subsp. paratuberculosis
gcucgcugagcgggacgcgcaga

SEQ ID NO: 2887287 - RNA, 15 nt, Mycobacterium avium subsp. paratuberculosis
gcucgcugaucugcg

SEQ ID NO: 2887288 - RNA, 21 nt, Mycobacterium avium subsp. paratuberculosis
gcucgcugaucugcggcacca

SEQ ID NO: 2887289 - RNA, 16 nt, Mycobacterium avium subsp. paratuberculosis
gcucgcuugccagccg

SEQ ID NO: 2887290 - RNA, 17 nt, Mycobacterium avium subsp. paratuberculosis
gcucgcuugccagccgg

SEQ ID NO: 2887291 - RNA, 20 nt, Mycobacterium avium subsp. paratuberculosis
gcucggaaugaacugccgcg

SEQ ID NO: 2887292 - RNA, 14 nt, Mycobacterium avium subsp. paratuberculosis
gcucggacgacucg

SEQ ID NO: 2887293 - RNA, 15 nt, Mycobacterium avium subsp. paratuberculosis
gcucggaggaaccgu

SEQ ID NO: 2887294 - RNA, 18 nt, Mycobacterium avium subsp. paratuberculosis
gcucggaguaguccagca

SEQ ID NO: 2887295 - RNA, 17 nt, Mycobacterium avium subsp. paratuberculosis
gcucggaguucgcccgc

SEQ ID NO: 2887296 - RNA, 21 nt, Mycobacterium avium subsp. paratuberculosis
gcucggaguugcgcagccggg

SEQ ID NO: 2887297 - RNA, 23 nt, Mycobacterium avium subsp. paratuberculosis
gcucggaguugcgcagccgggcg

SEQ ID NO: 2887298 - RNA, 16 nt, Mycobacterium avium subsp. paratuberculosis
gcucggcaccagagcg

SEQ ID NO: 2887299 - RNA, 18 nt, Mycobacterium avium subsp. paratuberculosis
gcucggcaccagagcgcc

SEQ ID NO: 2887300 - RNA, 20 nt, Mycobacterium avium subsp. paratuberculosis
gcucggcaccagagcgccgg

SEQ ID NO: 2887301 - RNA, 14 nt, Mycobacterium avium subsp. paratuberculosis
gcucggcagccccg

SEQ ID NO: 2887302 - RNA, 16 nt, Mycobacterium avium subsp. paratuberculosis
gcucggcagccccguc

SEQ ID NO: 2887303 - RNA, 14 nt, Mycobacterium avium subsp. paratuberculosis
gcucggcagccggc

SEQ ID NO: 2887304 - RNA, 20 nt, Mycobacterium avium subsp. paratuberculosis
gcucggccaccagcgcccgc

SEQ ID NO: 2887305 - RNA, 17 nt, Mycobacterium avium subsp. paratuberculosis
gcucggccaccgcgcgg

SEQ ID NO: 2887306 - RNA, 18 nt, Mycobacterium avium subsp. paratuberculosis
gcucggccacgacgcgcc

SEQ ID NO: 2887307 - RNA, 14 nt, Mycobacterium avium subsp. paratuberculosis
gcucggccagcagc

SEQ ID NO: 2887308 - RNA, 16 nt, Mycobacterium avium subsp. paratuberculosis
gcucggccagcagcac

SEQ ID NO: 2887309 - RNA, 12 nt, Mycobacterium avium subsp. paratuberculosis
gcucggccagcg

SEQ ID NO: 2887310 - RNA, 16 nt, Mycobacterium avium subsp. paratuberculosis
gcucggccagcgcagc

SEQ ID NO: 2887311 - RNA, 20 nt, Mycobacterium avium subsp. paratuberculosis
gcucggccagcgcagcgacc

SEQ ID NO: 2887312 - RNA, 15 nt, Mycobacterium avium subsp. paratuberculosis
gcucggccagcgcgc

SEQ ID NO: 2887313 - RNA, 17 nt, Mycobacterium avium subsp. paratuberculosis
gcucggccagcgcgccg

SEQ ID NO: 2887314 - RNA, 18 nt, Mycobacterium avium subsp. paratuberculosis
gcucggccagcgcgccgc

SEQ ID NO: 2887315 - RNA, 16 nt, Mycobacterium avium subsp. paratuberculosis
gcucggccagggugac

SEQ ID NO: 2887316 - RNA, 14 nt, Mycobacterium avium subsp. paratuberculosis
gcucggccaucccc

SEQ ID NO: 2887317 - RNA, 20 nt, Mycobacterium avium subsp. paratuberculosis
gcucggccaucccggugccg

SEQ ID NO: 2887318 - RNA, 22 nt, Mycobacterium avium subsp. paratuberculosis
gcucggccaucccggugccgcu

SEQ ID NO: 2887319 - RNA, 18 nt, Mycobacterium avium subsp. paratuberculosis
gcucggccauccgggcgg

SEQ ID NO: 2887320 - RNA, 19 nt, Mycobacterium avium subsp. paratuberculosis
gcucggccauccgggcggc

SEQ ID NO: 2887321 - RNA, 12 nt, Mycobacterium avium subsp. paratuberculosis
gcucggcccgcu

SEQ ID NO: 2887322 - RNA, 12 nt, Mycobacterium avium subsp. paratuberculosis
gcucggccgaug

SEQ ID NO: 2887323 - RNA, 13 nt, Mycobacterium avium subsp. paratuberculosis
gcucggccgauga

SEQ ID NO: 2887324 - RNA, 14 nt, Mycobacterium avium subsp. paratuberculosis
gcucggccgccgac

SEQ ID NO: 2887325 - RNA, 16 nt, Mycobacterium avium subsp. paratuberculosis
gcucggccggggcgac

SEQ ID NO: 2887326 - RNA, 15 nt, Mycobacterium avium subsp. paratuberculosis
gcucggccguggccg

SEQ ID NO: 2887327 - RNA, 23 nt, Mycobacterium avium subsp. paratuberculosis
gcucggccguggccgucacgcug

SEQ ID NO: 2887328 - RNA, 19 nt, Mycobacterium avium subsp. paratuberculosis
gcucggccucaggcgucgg

SEQ ID NO: 2887329 - RNA, 23 nt, Mycobacterium avium subsp. paratuberculosis
gcucggccuuacgcugcgcgacc

SEQ ID NO: 2887330 - RNA, 18 nt, Mycobacterium avium subsp. paratuberculosis
gcucggccuucggggugg

SEQ ID NO: 2887331 - RNA, 20 nt, Mycobacterium avium subsp. paratuberculosis
gcucggccuugagccggucg

SEQ ID NO: 2887332 - RNA, 19 nt, Mycobacterium avium subsp. paratuberculosis
gcucggcgacaacagcgcc

SEQ ID NO: 2887333 - RNA, 16 nt, Mycobacterium avium subsp. paratuberculosis
gcucggcgaccgccgg

SEQ ID NO: 2887334 - RNA, 18 nt, Mycobacterium avium subsp. paratuberculosis
gcucggcgaccgccggug

SEQ ID NO: 2887335 - RNA, 13 nt, Mycobacterium avium subsp. paratuberculosis
gcucggcgaccug

SEQ ID NO: 2887336 - RNA, 19 nt, Mycobacterium avium subsp. paratuberculosis
gcucggcgaccugcggcuc

SEQ ID NO: 2887337 - RNA, 12 nt, Mycobacterium avium subsp. paratuberculosis
gcucggcgacgc

SEQ ID NO: 2887338 - RNA, 20 nt, Mycobacterium avium subsp. paratuberculosis
gcucggcgagcaaggcgagc

SEQ ID NO: 2887339 - RNA, 21 nt, Mycobacterium avium subsp. paratuberculosis
gcucggcgagcaaggcgagca

SEQ ID NO: 2887340 - RNA, 17 nt, Mycobacterium avium subsp. paratuberculosis
gcucggcgagcaccgug

SEQ ID NO: 2887341 - RNA, 13 nt, Mycobacterium avium subsp. paratuberculosis
gcucggcgagcug

SEQ ID NO: 2887342 - RNA, 18 nt, Mycobacterium avium subsp. paratuberculosis
gcucggcgagcugcgggu

SEQ ID NO: 2887343 - RNA, 21 nt, Mycobacterium avium subsp. paratuberculosis
gcucggcgagguagaccgccg

SEQ ID NO: 2887344 - RNA, 22 nt, Mycobacterium avium subsp. paratuberculosis
gcucggcgagguagaccgccga

SEQ ID NO: 2887345 - RNA, 13 nt, Mycobacterium avium subsp. paratuberculosis
gcucggcgagugc

SEQ ID NO: 2887346 - RNA, 11 nt, Mycobacterium avium subsp. paratuberculosis
gcucggcgauc

SEQ ID NO: 2887347 - RNA, 13 nt, Mycobacterium avium subsp. paratuberculosis
gcucggcgaucac

SEQ ID NO: 2887348 - RNA, 14 nt, Mycobacterium avium subsp. paratuberculosis
gcucggcgaucacc

SEQ ID NO: 2887349 - RNA, 16 nt, Mycobacterium avium subsp. paratuberculosis
gcucggcgaucaccgc

SEQ ID NO: 2887350 - RNA, 17 nt, Mycobacterium avium subsp. paratuberculosis
gcucggcgaucaccgcg

SEQ ID NO: 2887351 - RNA, 18 nt, Mycobacterium avium subsp. paratuberculosis
gcucggcgaucaccgcgu

SEQ ID NO: 2887352 - RNA, 23 nt, Mycobacterium avium subsp. paratuberculosis
gcucggcgaucaccgcguucucg

SEQ ID NO: 2887353 - RNA, 16 nt, Mycobacterium avium subsp. paratuberculosis
gcucggcgaucuggcg

SEQ ID NO: 2887354 - RNA, 17 nt, Mycobacterium avium subsp. paratuberculosis
gcucggcgaucuggcgg

SEQ ID NO: 2887355 - RNA, 18 nt, Mycobacterium avium subsp. paratuberculosis
gcucggcgaucuggcggu

SEQ ID NO: 2887356 - RNA, 22 nt, Mycobacterium avium subsp. paratuberculosis
gcucggcgaucuggcgguugga

SEQ ID NO: 2887357 - RNA, 15 nt, Mycobacterium avium subsp. paratuberculosis
gcucggcgcaacggg

SEQ ID NO: 2887358 - RNA, 13 nt, Mycobacterium avium subsp. paratuberculosis
gcucggcgcccca

SEQ ID NO: 2887359 - RNA, 15 nt, Mycobacterium avium subsp. paratuberculosis
gcucggcgccgaccu

SEQ ID NO: 2887360 - RNA, 19 nt, Mycobacterium avium subsp. paratuberculosis
gcguucugcaccagcucgg

SEQ ID NO: 2887361 - RNA, 16 nt, Mycobacterium avium subsp. paratuberculosis
gcguucugcaccgacu

SEQ ID NO: 2887362 - RNA, 19 nt, Mycobacterium avium subsp. paratuberculosis
gcguugaaagccgcgaacg

SEQ ID NO: 2887363 - RNA, 19 nt, Mycobacterium avium subsp. paratuberculosis
gcguugaccaacgccgccu

SEQ ID NO: 2887364 - RNA, 13 nt, Mycobacterium avium subsp. paratuberculosis
gcguugaccgggc

SEQ ID NO: 2887365 - RNA, 15 nt, Mycobacterium avium subsp. paratuberculosis
gcguugaccgggccg

SEQ ID NO: 2887366 - RNA, 19 nt, Mycobacterium avium subsp. paratuberculosis
gcguugaccgggccgcugg

SEQ ID NO: 2887367 - RNA, 20 nt, Mycobacterium avium subsp. paratuberculosis
gcguugaccgggccgcuggu

SEQ ID NO: 2887368 - RNA, 19 nt, Mycobacterium avium subsp. paratuberculosis
gcguugacgaugacgcggu

SEQ ID NO: 2887369 - RNA, 13 nt, Mycobacterium avium subsp. paratuberculosis
gcguugagcacgc

SEQ ID NO: 2887370 - RNA, 15 nt, Mycobacterium avium subsp. paratuberculosis
gcguugagccggcgc

SEQ ID NO: 2887371 - RNA, 16 nt, Mycobacterium avium subsp. paratuberculosis
gcguugagcgucgcca

SEQ ID NO: 2887372 - RNA, 20 nt, Mycobacterium avium subsp. paratuberculosis
gcguugagcgucgccaccac

SEQ ID NO: 2887373 - RNA, 21 nt, Mycobacterium avium subsp. paratuberculosis
gcguugagggcggggcagcag

SEQ ID NO: 2887374 - RNA, 17 nt, Mycobacterium avium subsp. paratuberculosis
gcguugaucagcgccag

SEQ ID NO: 2887375 - RNA, 15 nt, Mycobacterium avium subsp. paratuberculosis
gcguugaucgacgga

SEQ ID NO: 2887376 - RNA, 16 nt, Mycobacterium avium subsp. paratuberculosis
gcguugcagaacgcgc

SEQ ID NO: 2887377 - RNA, 18 nt, Mycobacterium avium subsp. paratuberculosis
gcguugcagaacgcgcgg

SEQ ID NO: 2887378 - RNA, 17 nt, Mycobacterium avium subsp. paratuberculosis
gcguugcagcgccgcgg

SEQ ID NO: 2887379 - RNA, 23 nt, Mycobacterium avium subsp. paratuberculosis
gcguugcagcgccgcggcgcccu

SEQ ID NO: 2887380 - RNA, 17 nt, Mycobacterium avium subsp. paratuberculosis
gcguugcauuucggcgu

SEQ ID NO: 2887381 - RNA, 13 nt, Mycobacterium avium subsp. paratuberculosis
gcguugcccgccg

SEQ ID NO: 2887382 - RNA, 16 nt, Mycobacterium avium subsp. paratuberculosis
gcguugcccgccgcgg

SEQ ID NO: 2887383 - RNA, 16 nt, Mycobacterium avium subsp. paratuberculosis
gcguugcccgucgccu

SEQ ID NO: 2887384 - RNA, 14 nt, Mycobacterium avium subsp. paratuberculosis
gcguugccgccggc

SEQ ID NO: 2887385 - RNA, 15 nt, Mycobacterium avium subsp. paratuberculosis
gcguugccgccggcg

SEQ ID NO: 2887386 - RNA, 14 nt, Mycobacterium avium subsp. paratuberculosis
gcguugccgcgcgc

SEQ ID NO: 2887387 - RNA, 23 nt, Mycobacterium avium subsp. paratuberculosis
gcguugccggccgaagugcucga

SEQ ID NO: 2887388 - RNA, 14 nt, Mycobacterium avium subsp. paratuberculosis
gcguugcgccagca

SEQ ID NO: 2887389 - RNA, 16 nt, Mycobacterium avium subsp. paratuberculosis
gcguugcgccagcagg

SEQ ID NO: 2887390 - RNA, 18 nt, Mycobacterium avium subsp. paratuberculosis
gcguugcgcggaccggcg

SEQ ID NO: 2887391 - RNA, 14 nt, Mycobacterium avium subsp. paratuberculosis
gcguugcgcggcgg

SEQ ID NO: 2887392 - RNA, 15 nt, Mycobacterium avium subsp. paratuberculosis
gcguugcgcggcggc

SEQ ID NO: 2887393 - RNA, 24 nt, Mycobacterium avium subsp. paratuberculosis
gcguugcgcucuguuggccgucgc

SEQ ID NO: 2887394 - RNA, 17 nt, Mycobacterium avium subsp. paratuberculosis
gcguugcggaucgaacg

SEQ ID NO: 2887395 - RNA, 17 nt, Mycobacterium avium subsp. paratuberculosis
gcguugcggccguccag

SEQ ID NO: 2887396 - RNA, 19 nt, Mycobacterium avium subsp. paratuberculosis
gcguugcgucccgcgccgg

SEQ ID NO: 2887397 - RNA, 16 nt, Mycobacterium avium subsp. paratuberculosis
gcguuggacagcucga

SEQ ID NO: 2887398 - RNA, 22 nt, Mycobacterium avium subsp. paratuberculosis
gcguuggacuccaccgccaccg

SEQ ID NO: 2887399 - RNA, 12 nt, Mycobacterium avium subsp. paratuberculosis
gcguuggccagc

SEQ ID NO: 2887400 - RNA, 13 nt, Mycobacterium avium subsp. paratuberculosis
gcguuggccagcg

SEQ ID NO: 2887401 - RNA, 16 nt, Mycobacterium avium subsp. paratuberculosis
gcguuggccagcgccu

SEQ ID NO: 2887402 - RNA, 19 nt, Mycobacterium avium subsp. paratuberculosis
gcguuggccagcgccucca

SEQ ID NO: 2887403 - RNA, 13 nt, Mycobacterium avium subsp. paratuberculosis
gcguuggcccgug

SEQ ID NO: 2887404 - RNA, 21 nt, Mycobacterium avium subsp. paratuberculosis
gcguuggccgagcagccgggc

SEQ ID NO: 2887405 - RNA, 12 nt, Mycobacterium avium subsp. paratuberculosis
gcguuggccgcc

SEQ ID NO: 2887406 - RNA, 13 nt, Mycobacterium avium subsp. paratuberculosis
gcguuggccggcu

SEQ ID NO: 2887407 - RNA, 15 nt, Mycobacterium avium subsp. paratuberculosis
gcguuggcgccgacg

SEQ ID NO: 2887408 - RNA, 21 nt, Mycobacterium avium subsp. paratuberculosis
gcguuggcgccgacgucaggg

SEQ ID NO: 2887409 - RNA, 21 nt, Mycobacterium avium subsp. paratuberculosis
gcguugguguagccgaacgug

SEQ ID NO: 2887410 - RNA, 17 nt, Mycobacterium avium subsp. paratuberculosis
gcguugguugcggcccc

SEQ ID NO: 2887411 - RNA, 21 nt, Mycobacterium avium subsp. paratuberculosis
gcguuguccagcagcgccggc

SEQ ID NO: 2887412 - RNA, 20 nt, Mycobacterium avium subsp. paratuberculosis
gcguugucgaccaccaggug

SEQ ID NO: 2887413 - RNA, 15 nt, Mycobacterium avium subsp. paratuberculosis
gcguuguugcucggc

SEQ ID NO: 2887414 - RNA, 17 nt, Mycobacterium avium subsp. paratuberculosis
gcguuucagcaacccga

SEQ ID NO: 2887415 - RNA, 22 nt, Mycobacterium avium subsp. paratuberculosis
gcguuuccuggugcaccaggua

SEQ ID NO: 2887416 - RNA, 21 nt, Mycobacterium avium subsp. paratuberculosis
gcguuuggccugcggcaacag

SEQ ID NO: 2887417 - RNA, 18 nt, Mycobacterium avium subsp. paratuberculosis
gcguuuuugugggugguc

SEQ ID NO: 2887418 - RNA, 20 nt, Mycobacterium avium subsp. paratuberculosis
gcuaaacaauggccccggcg

SEQ ID NO: 2887419 - RNA, 16 nt, Mycobacterium avium subsp. paratuberculosis
gcuaaaccccacggcc

SEQ ID NO: 2887420 - RNA, 16 nt, Mycobacterium avium subsp. paratuberculosis
gcuaaagccaccagcg

SEQ ID NO: 2887421 - RNA, 17 nt, Mycobacterium avium subsp. paratuberculosis
gcuaaagccgaccgccc

SEQ ID NO: 2887422 - RNA, 23 nt, Mycobacterium avium subsp. paratuberculosis
gcuaaccaccggugacgaccggc

SEQ ID NO: 2887423 - RNA, 18 nt, Mycobacterium avium subsp. paratuberculosis
gcuaacgccagcugggca

SEQ ID NO: 2887424 - RNA, 15 nt, Mycobacterium avium subsp. paratuberculosis
gcuaacgcgauguga

SEQ ID NO: 2887425 - RNA, 15 nt, Mycobacterium avium subsp. paratuberculosis
gcuaacgcuggucga

SEQ ID NO: 2887426 - RNA, 15 nt, Mycobacterium avium subsp. paratuberculosis
gcuaagccggcgucg

SEQ ID NO: 2887427 - RNA, 17 nt, Mycobacterium avium subsp. paratuberculosis
gcuaagccggcgucggg

SEQ ID NO: 2887428 - RNA, 20 nt, Mycobacterium avium subsp. paratuberculosis
gcuaaggccgcugcccggcg

SEQ ID NO: 2887429 - RNA, 13 nt, Mycobacterium avium subsp. paratuberculosis
gcuaaucgccgcg

SEQ ID NO: 2887430 - RNA, 15 nt, Mycobacterium avium subsp. paratuberculosis
gcuaaucgccgcgcg

SEQ ID NO: 2887431 - RNA, 21 nt, Mycobacterium avium subsp. paratuberculosis
gcuaauucgggccgccgcgcg

SEQ ID NO: 2887432 - RNA, 21 nt, Mycobacterium avium subsp. paratuberculosis
gcuacaaaaccaagaccgcgg

SEQ ID NO: 2887433 - RNA, 16 nt, Mycobacterium avium subsp. paratuberculosis
gcuaccagccccagga

SEQ ID NO: 2887434 - RNA, 23 nt, Mycobacterium avium subsp. paratuberculosis
gcuaccaggcgugcacccgguuc

SEQ ID NO: 2887435 - RNA, 16 nt, Mycobacterium avium subsp. paratuberculosis
gcuacccggcgaaccg

SEQ ID NO: 2887436 - RNA, 11 nt, Mycobacterium avium subsp. paratuberculosis
gcuaccgcgcg

SEQ ID NO: 2887437 - RNA, 15 nt, Mycobacterium avium subsp. paratuberculosis
gcuaccgcgcucacc

SEQ ID NO: 2887438 - RNA, 18 nt, Mycobacterium avium subsp. paratuberculosis
gcuaccgcgcucaccguc

SEQ ID NO: 2887439 - RNA, 13 nt, Mycobacterium avium subsp. paratuberculosis
gcuaccggcgcug

SEQ ID NO: 2887440 - RNA, 21 nt, Mycobacterium avium subsp. paratuberculosis
gcuaccuaggcgucgucggcc

SEQ ID NO: 2887441 - RNA, 17 nt, Mycobacterium avium subsp. paratuberculosis
gcuaccugaccagcggc

SEQ ID NO: 2887442 - RNA, 23 nt, Mycobacterium avium subsp. paratuberculosis
gcuacgccgaggcgcaggaggcg

SEQ ID NO: 2887443 - RNA, 23 nt, Mycobacterium avium subsp. paratuberculosis
gcuacgccggcucggucuccucc

SEQ ID NO: 2887444 - RNA, 21 nt, Mycobacterium avium subsp. paratuberculosis
gcuacggacgcauccacggcc

SEQ ID NO: 2887445 - RNA, 15 nt, Mycobacterium avium subsp. paratuberculosis
gcucgaacacccggc

SEQ ID NO: 2887446 - RNA, 19 nt, Mycobacterium avium subsp. paratuberculosis
gcucgaacacccggcuucg

SEQ ID NO: 2887447 - RNA, 19 nt, Mycobacterium avium subsp. paratuberculosis
gcucgaacaccgucgagga

SEQ ID NO: 2887448 - RNA, 14 nt, Mycobacterium avium subsp. paratuberculosis
gcucgaaccgcgag

SEQ ID NO: 2887449 - RNA, 22 nt, Mycobacterium avium subsp. paratuberculosis
gcucgaacgcgccgaucgagac

SEQ ID NO: 2887450 - RNA, 15 nt, Mycobacterium avium subsp. paratuberculosis
gcucgaacucaccgg

SEQ ID NO: 2887451 - RNA, 14 nt, Mycobacterium avium subsp. paratuberculosis
gcucgaagcccagg

SEQ ID NO: 2887452 - RNA, 15 nt, Mycobacterium avium subsp. paratuberculosis
gcucgaaggugcccg

SEQ ID NO: 2887453 - RNA, 17 nt, Mycobacterium avium subsp. paratuberculosis
gcucgaaggugcccgca

SEQ ID NO: 2887454 - RNA, 19 nt, Mycobacterium avium subsp. paratuberculosis
gcucgaaguggcagcgcuc

SEQ ID NO: 2887455 - RNA, 15 nt, Mycobacterium avium subsp. paratuberculosis
gcucgacaggcagcc

SEQ ID NO: 2887456 - RNA, 17 nt, Mycobacterium avium subsp. paratuberculosis
gcucgacaggcagcccg

SEQ ID NO: 2887457 - RNA, 19 nt, Mycobacterium avium subsp. paratuberculosis
gcucgacaggcagcccggc

SEQ ID NO: 2887458 - RNA, 22 nt, Mycobacterium avium subsp. paratuberculosis
gcucgacaggcagcccggcugc

SEQ ID NO: 2887459 - RNA, 14 nt, Mycobacterium avium subsp. paratuberculosis
gcucgaccagcccc

SEQ ID NO: 2887460 - RNA, 21 nt, Mycobacterium avium subsp. paratuberculosis
gcucgaccagcccccgcgggu

SEQ ID NO: 2887461 - RNA, 13 nt, Mycobacterium avium subsp. paratuberculosis
gcucgaccagccg

SEQ ID NO: 2887462 - RNA, 14 nt, Mycobacterium avium subsp. paratuberculosis
gcucgaccagccgg

SEQ ID NO: 2887463 - RNA, 16 nt, Mycobacterium avium subsp. paratuberculosis
gcucgaccagcgccga

SEQ ID NO: 2887464 - RNA, 19 nt, Mycobacterium avium subsp. paratuberculosis
gcucgaccagcgccgaggu

SEQ ID NO: 2887465 - RNA, 13 nt, Mycobacterium avium subsp. paratuberculosis
gcucgaccgcggc

SEQ ID NO: 2887466 - RNA, 17 nt, Mycobacterium avium subsp. paratuberculosis
gcucgaccgcggcgaug

SEQ ID NO: 2887467 - RNA, 14 nt, Mycobacterium avium subsp. paratuberculosis
gcucgaccucggcg

SEQ ID NO: 2887468 - RNA, 15 nt, Mycobacterium avium subsp. paratuberculosis
gcucgaccucggcga

SEQ ID NO: 2887469 - RNA, 19 nt, Mycobacterium avium subsp. paratuberculosis
gcucgaccucggcgaccag

SEQ ID NO: 2887470 - RNA, 20 nt, Mycobacterium avium subsp. paratuberculosis
gcucgaccucggcgaccagc

SEQ ID NO: 2887471 - RNA, 22 nt, Mycobacterium avium subsp. paratuberculosis
gcucgaccucggcgaccagcga

SEQ ID NO: 2887472 - RNA, 17 nt, Mycobacterium avium subsp. paratuberculosis
gcucgaccucggcggcc

SEQ ID NO: 2887473 - RNA, 19 nt, Mycobacterium avium subsp. paratuberculosis
gcucgaccucggcggccag

SEQ ID NO: 2887474 - RNA, 23 nt, Mycobacterium avium subsp. paratuberculosis
gcucgaccucggcggccagcgcg

SEQ ID NO: 2887475 - RNA, 22 nt, Mycobacterium avium subsp. paratuberculosis
gcucgacgaacuccgcgcgcgg

SEQ ID NO: 2887476 - RNA, 23 nt, Mycobacterium avium subsp. paratuberculosis
gcucgacgaacuccgcgcgcggc

SEQ ID NO: 2887477 - RNA, 15 nt, Mycobacterium avium subsp. paratuberculosis
gcucgacgaccucgc

SEQ ID NO: 2887478 - RNA, 14 nt, Mycobacterium avium subsp. paratuberculosis
gcucgacgacuucg

SEQ ID NO: 2887479 - RNA, 17 nt, Mycobacterium avium subsp. paratuberculosis
gcucgacgaggcgggcg

SEQ ID NO: 2887480 - RNA, 18 nt, Mycobacterium avium subsp. paratuberculosis
gcucgacgaggcgggcga

SEQ ID NO: 2887481 - RNA, 20 nt, Mycobacterium avium subsp. paratuberculosis
gcucgacgaguuccucgugc

SEQ ID NO: 2887482 - RNA, 20 nt, Mycobacterium avium subsp. paratuberculosis
gcucgacgaugucgacgccc

SEQ ID NO: 2887483 - RNA, 14 nt, Mycobacterium avium subsp. paratuberculosis
gcucgacggcaccc

SEQ ID NO: 2887484 - RNA, 16 nt, Mycobacterium avium subsp. paratuberculosis
gcucgacggcacccgg

SEQ ID NO: 2887485 - RNA, 18 nt, Mycobacterium avium subsp. paratuberculosis
gcucgacggcacccggcc

SEQ ID NO: 2887486 - RNA, 21 nt, Mycobacterium avium subsp. paratuberculosis
gcucgacggcacccggcccua

SEQ ID NO: 2887487 - RNA, 17 nt, Mycobacterium avium subsp. paratuberculosis
gcucgacggccggcguc

SEQ ID NO: 2887488 - RNA, 13 nt, Mycobacterium avium subsp. paratuberculosis
gcucgacggccug

SEQ ID NO: 2887489 - RNA, 19 nt, Mycobacterium avium subsp. paratuberculosis
gcucgacggccugcacguc

SEQ ID NO: 2887490 - RNA, 16 nt, Mycobacterium avium subsp. paratuberculosis
gcucgagcaacaccac

SEQ ID NO: 2887491 - RNA, 17 nt, Mycobacterium avium subsp. paratuberculosis
gcucgagcacaucggcg

SEQ ID NO: 2887492 - RNA, 18 nt, Mycobacterium avium subsp. paratuberculosis
gcucgagcacaucggcgu

SEQ ID NO: 2887493 - RNA, 16 nt, Mycobacterium avium subsp. paratuberculosis
gcucgagcaucacgaa

SEQ ID NO: 2887494 - RNA, 16 nt, Mycobacterium avium subsp. paratuberculosis
gccgguccggcggcac

SEQ ID NO: 2887495 - RNA, 18 nt, Mycobacterium avium subsp. paratuberculosis
gccgguccggcggcacca

SEQ ID NO: 2887496 - RNA, 20 nt, Mycobacterium avium subsp. paratuberculosis
gccgguccgugcacggccaa

SEQ ID NO: 2887497 - RNA, 22 nt, Mycobacterium avium subsp. paratuberculosis
gccgguccuggccaacucgacc

SEQ ID NO: 2887498 - RNA, 21 nt, Mycobacterium avium subsp. paratuberculosis
gccgguccugggccuccggcg

SEQ ID NO: 2887499 - RNA, 22 nt, Mycobacterium avium subsp. paratuberculosis
gccgguccugggccuccggcgg

SEQ ID NO: 2887500 - RNA, 23 nt, Mycobacterium avium subsp. paratuberculosis
gccgguccugggccuccggcggc

SEQ ID NO: 2887501 - RNA, 17 nt, Mycobacterium avium subsp. paratuberculosis
gccgguccuuggccugc

SEQ ID NO: 2887502 - RNA, 16 nt, Mycobacterium avium subsp. paratuberculosis
gccggucgaacgccag

SEQ ID NO: 2887503 - RNA, 17 nt, Mycobacterium avium subsp. paratuberculosis
gccggucgaacgccagc

SEQ ID NO: 2887504 - RNA, 20 nt, Mycobacterium avium subsp. paratuberculosis
gccggucgaacgccagcgcc

SEQ ID NO: 2887505 - RNA, 13 nt, Mycobacterium avium subsp. paratuberculosis
gccggucgaaggc

SEQ ID NO: 2887506 - RNA, 12 nt, Mycobacterium avium subsp. paratuberculosis
gccggucgacgc

SEQ ID NO: 2887507 - RNA, 21 nt, Mycobacterium avium subsp. paratuberculosis
cgggcaucgcugguggccgac

SEQ ID NO: 2887508 - RNA, 23 nt, Mycobacterium avium subsp. paratuberculosis
cgggcaucgcugguggccgacgu

SEQ ID NO: 2887509 - RNA, 15 nt, Mycobacterium avium subsp. paratuberculosis
cgggcaucggcuggu

SEQ ID NO: 2887510 - RNA, 20 nt, Mycobacterium avium subsp. paratuberculosis
cgggcaucggcuggucggcg

SEQ ID NO: 2887511 - RNA, 21 nt, Mycobacterium avium subsp. paratuberculosis
cgggcaucggcuggucggcgg

SEQ ID NO: 2887512 - RNA, 21 nt, Mycobacterium avium subsp. paratuberculosis
cgggcaucucguugucgucgg

SEQ ID NO: 2887513 - RNA, 19 nt, Mycobacterium avium subsp. paratuberculosis
cgggcaugaaccaggccgc

SEQ ID NO: 2887514 - RNA, 22 nt, Mycobacterium avium subsp. paratuberculosis
cgggcaugaaccaggccgcgcu

SEQ ID NO: 2887515 - RNA, 13 nt, Mycobacterium avium subsp. paratuberculosis
cgggcaugccggc

SEQ ID NO: 2887516 - RNA, 15 nt, Mycobacterium avium subsp. paratuberculosis
cgggcaugccggccg

SEQ ID NO: 2887517 - RNA, 16 nt, Mycobacterium avium subsp. paratuberculosis
cgggcaugccggccgg

SEQ ID NO: 2887518 - RNA, 18 nt, Mycobacterium avium subsp. paratuberculosis
cgggcaugccgucggcgc

SEQ ID NO: 2887519 - RNA, 19 nt, Mycobacterium avium subsp. paratuberculosis
cgggcaugccgucggcgcc

SEQ ID NO: 2887520 - RNA, 21 nt, Mycobacterium avium subsp. paratuberculosis
cgggcaugccgucggcgcccg

SEQ ID NO: 2887521 - RNA, 23 nt, Mycobacterium avium subsp. paratuberculosis
cgggcaugccgucggcgcccggc

SEQ ID NO: 2887522 - RNA, 17 nt, Mycobacterium avium subsp. paratuberculosis
cgggcauuggcagcucg

SEQ ID NO: 2887523 - RNA, 19 nt, Mycobacterium avium subsp. paratuberculosis
cgggcauuggcagcucggg

SEQ ID NO: 2887524 - RNA, 22 nt, Mycobacterium avium subsp. paratuberculosis
cgggcauuggcagcucgggcag

SEQ ID NO: 2887525 - RNA, 19 nt, Mycobacterium avium subsp. paratuberculosis
cgggccaacgguucggccg

SEQ ID NO: 2887526 - RNA, 21 nt, Mycobacterium avium subsp. paratuberculosis
cgggccaacgguucggccgcu

SEQ ID NO: 2887527 - RNA, 16 nt, Mycobacterium avium subsp. paratuberculosis
cgggccaacugggugg

SEQ ID NO: 2887528 - RNA, 15 nt, Mycobacterium avium subsp. paratuberculosis
cgggccaagcaccgg

SEQ ID NO: 2887529 - RNA, 23 nt, Mycobacterium avium subsp. paratuberculosis
cgggccaauuacgcugcggcgcc

SEQ ID NO: 2887530 - RNA, 21 nt, Mycobacterium avium subsp. paratuberculosis
cgggccacaacaaggugugga

SEQ ID NO: 2887531 - RNA, 15 nt, Mycobacterium avium subsp. paratuberculosis
cgggccacacacugc

SEQ ID NO: 2887532 - RNA, 22 nt, Mycobacterium avium subsp. paratuberculosis
cgggccacacacugcugcgcag

SEQ ID NO: 2887533 - RNA, 16 nt, Mycobacterium avium subsp. paratuberculosis
cgggccacacccgucg

SEQ ID NO: 2887534 - RNA, 15 nt, Mycobacterium avium subsp. paratuberculosis
cgggccacagcggcg

SEQ ID NO: 2887535 - RNA, 20 nt, Mycobacterium avium subsp. paratuberculosis
cgggccacagcggcgacagc

SEQ ID NO: 2887536 - RNA, 20 nt, Mycobacterium avium subsp. paratuberculosis
cgggccaccacaguggccgc

SEQ ID NO: 2887537 - RNA, 19 nt, Mycobacterium avium subsp. paratuberculosis
gcgucguaguugcggccgg

SEQ ID NO: 2887538 - RNA, 21 nt, Mycobacterium avium subsp. paratuberculosis
gcgucguaguugcggccggcg

SEQ ID NO: 2887539 - RNA, 21 nt, Mycobacterium avium subsp. paratuberculosis
gcgucguccaugcccgcccac

SEQ ID NO: 2887540 - RNA, 19 nt, Mycobacterium avium subsp. paratuberculosis
gcgucguccgacaccaccu

SEQ ID NO: 2887541 - RNA, 16 nt, Mycobacterium avium subsp. paratuberculosis
gcgucgucgagcaccg

SEQ ID NO: 2887542 - RNA, 18 nt, Mycobacterium avium subsp. paratuberculosis
gcgucgucgagcaccggc

SEQ ID NO: 2887543 - RNA, 19 nt, Mycobacterium avium subsp. paratuberculosis
gcgucgucgagcaccggca

SEQ ID NO: 2887544 - RNA, 20 nt, Mycobacterium avium subsp. paratuberculosis
gcgucgucgagcaccggcag

SEQ ID NO: 2887545 - RNA, 21 nt, Mycobacterium avium subsp. paratuberculosis
gcgucgucgagcaccggcagc

SEQ ID NO: 2887546 - RNA, 13 nt, Mycobacterium avium subsp. paratuberculosis
gcgucgucgauga

SEQ ID NO: 2887547 - RNA, 20 nt, Mycobacterium avium subsp. paratuberculosis
gcgucgucgaugaacaucgc

SEQ ID NO: 2887548 - RNA, 19 nt, Mycobacterium avium subsp. paratuberculosis
gcgucgucgauggccacca

SEQ ID NO: 2887549 - RNA, 22 nt, Mycobacterium avium subsp. paratuberculosis
gcgucgucgccguggcggcccg

SEQ ID NO: 2887550 - RNA, 13 nt, Mycobacterium avium subsp. paratuberculosis
gcgucgucggccc

SEQ ID NO: 2887551 - RNA, 18 nt, Mycobacterium avium subsp. paratuberculosis
gcgucgucggccggcucg

SEQ ID NO: 2887552 - RNA, 15 nt, Mycobacterium avium subsp. paratuberculosis
gcgucgucggcggcg

SEQ ID NO: 2887553 - RNA, 16 nt, Mycobacterium avium subsp. paratuberculosis
gcgucgucggcgggcu

SEQ ID NO: 2887554 - RNA, 23 nt, Mycobacterium avium subsp. paratuberculosis
gcgucgucggcgggcugcagcga

SEQ ID NO: 2887555 - RNA, 20 nt, Mycobacterium avium subsp. paratuberculosis
gcgucgucggucaggccggc

SEQ ID NO: 2887556 - RNA, 21 nt, Mycobacterium avium subsp. paratuberculosis
gcgucgucggucaggccggcg

SEQ ID NO: 2887557 - RNA, 23 nt, Mycobacterium avium subsp. paratuberculosis
gcgucgucggucaggccggcgcc

SEQ ID NO: 2887558 - RNA, 13 nt, Mycobacterium avium subsp. paratuberculosis
gcgucgucgucga

SEQ ID NO: 2887559 - RNA, 16 nt, Mycobacterium avium subsp. paratuberculosis
gcgucgucgucgaccg

SEQ ID NO: 2887560 - RNA, 18 nt, Mycobacterium avium subsp. paratuberculosis
gcgucgucgucgaccguc

SEQ ID NO: 2887561 - RNA, 22 nt, Mycobacterium avium subsp. paratuberculosis
gcgucgucgucgaccgucaggu

SEQ ID NO: 2887562 - RNA, 18 nt, Mycobacterium avium subsp. paratuberculosis
gcgucgucgucgagccgc

SEQ ID NO: 2887563 - RNA, 20 nt, Mycobacterium avium subsp. paratuberculosis
gcgucgucgucgagccgcuc

SEQ ID NO: 2887564 - RNA, 15 nt, Mycobacterium avium subsp. paratuberculosis
gcgucgucgucgcag

SEQ ID NO: 2887565 - RNA, 20 nt, Mycobacterium avium subsp. paratuberculosis
gcgucgucgucgcagugccc

SEQ ID NO: 2887566 - RNA, 17 nt, Mycobacterium avium subsp. paratuberculosis
gcgucgucuuggccugc

SEQ ID NO: 2887567 - RNA, 22 nt, Mycobacterium avium subsp. paratuberculosis
gcgucgugcaacucccgcgccg

SEQ ID NO: 2887568 - RNA, 15 nt, Mycobacterium avium subsp. paratuberculosis
gcgucgugccgagcg

SEQ ID NO: 2887569 - RNA, 16 nt, Mycobacterium avium subsp. paratuberculosis
gcgucgugccgagcgu

SEQ ID NO: 2887570 - RNA, 18 nt, Mycobacterium avium subsp. paratuberculosis
gcgucgugccgagcguga

SEQ ID NO: 2887571 - RNA, 15 nt, Mycobacterium avium subsp. paratuberculosis
gcgucgugcggccgg

SEQ ID NO: 2887572 - RNA, 16 nt, Mycobacterium avium subsp. paratuberculosis
gcgucgugcggccggc

SEQ ID NO: 2887573 - RNA, 17 nt, Mycobacterium avium subsp. paratuberculosis
gcgucgugcggccggcg

SEQ ID NO: 2887574 - RNA, 18 nt, Mycobacterium avium subsp. paratuberculosis
gcgucgugcggccggcgc

SEQ ID NO: 2887575 - RNA, 19 nt, Mycobacterium avium subsp. paratuberculosis
gcgucgugcggccggcgcc

SEQ ID NO: 2887576 - RNA, 20 nt, Mycobacterium avium subsp. paratuberculosis
gcgucgugcggccggcgccg

SEQ ID NO: 2887577 - RNA, 22 nt, Mycobacterium avium subsp. paratuberculosis
gcgucgugcgggcuccgcacga

SEQ ID NO: 2887578 - RNA, 24 nt, Mycobacterium avium subsp. paratuberculosis
gcgucgugcgggcuccgcacgacc

SEQ ID NO: 2887579 - RNA, 15 nt, Mycobacterium avium subsp. paratuberculosis
gcgucguggcccugc

SEQ ID NO: 2887580 - RNA, 19 nt, Mycobacterium avium subsp. paratuberculosis
gcgucguggcccugcucgu

SEQ ID NO: 2887581 - RNA, 16 nt, Mycobacterium avium subsp. paratuberculosis
gcgucguggucgacgc

SEQ ID NO: 2887582 - RNA, 17 nt, Mycobacterium avium subsp. paratuberculosis
gcgucguggucgacgcc

SEQ ID NO: 2887583 - RNA, 22 nt, Mycobacterium avium subsp. paratuberculosis
gcgucguggucgacgccguggu

SEQ ID NO: 2887584 - RNA, 15 nt, Mycobacterium avium subsp. paratuberculosis
gcgucguguccgggc

SEQ ID NO: 2887585 - RNA, 16 nt, Mycobacterium avium subsp. paratuberculosis
gcgucguguccgggcc

SEQ ID NO: 2887586 - RNA, 18 nt, Mycobacterium avium subsp. paratuberculosis
gcgucguguccgggcccg

SEQ ID NO: 2887587 - RNA, 20 nt, Mycobacterium avium subsp. paratuberculosis
gcgucguugaacgcgcgggu

SEQ ID NO: 2887588 - RNA, 22 nt, Mycobacterium avium subsp. paratuberculosis
gcgucguugaacgcgcgggugc

SEQ ID NO: 2887589 - RNA, 17 nt, Mycobacterium avium subsp. paratuberculosis
gcgucguugagcaggcu

SEQ ID NO: 2887590 - RNA, 16 nt, Mycobacterium avium subsp. paratuberculosis
gcgucguugagugcgc

SEQ ID NO: 2887591 - RNA, 16 nt, Mycobacterium avium subsp. paratuberculosis
gcgucguugucgucgc

SEQ ID NO: 2887592 - RNA, 18 nt, Mycobacterium avium subsp. paratuberculosis
gcgucguugucgucgccg

SEQ ID NO: 2887593 - RNA, 19 nt, Mycobacterium avium subsp. paratuberculosis
gcgucguugucgucgccgg

SEQ ID NO: 2887594 - RNA, 22 nt, Mycobacterium avium subsp. paratuberculosis
gcgucguugucgucgccggccg

SEQ ID NO: 2887595 - RNA, 23 nt, Mycobacterium avium subsp. paratuberculosis
gcgucguugucgucgccggccgc

SEQ ID NO: 2887596 - RNA, 15 nt, Mycobacterium avium subsp. paratuberculosis
gcgucucagucggcc

SEQ ID NO: 2887597 - RNA, 18 nt, Mycobacterium avium subsp. paratuberculosis
gcgucucagucggccacc

SEQ ID NO: 2887598 - RNA, 19 nt, Mycobacterium avium subsp. paratuberculosis
gcgucucagucggccaccg

SEQ ID NO: 2887599 - RNA, 20 nt, Mycobacterium avium subsp. paratuberculosis
gcgucucagucggccaccgc

SEQ ID NO: 2887600 - RNA, 23 nt, Mycobacterium avium subsp. paratuberculosis
gcgucucccgggugcgcgucgcg

SEQ ID NO: 2887601 - RNA, 13 nt, Mycobacterium avium subsp. paratuberculosis
gcgucuccggcgg

SEQ ID NO: 2887602 - RNA, 17 nt, Mycobacterium avium subsp. paratuberculosis
gcgucuccggcgggcug

SEQ ID NO: 2887603 - RNA, 16 nt, Mycobacterium avium subsp. paratuberculosis
gcgucuccucgaccgc

SEQ ID NO: 2887604 - RNA, 13 nt, Mycobacterium avium subsp. paratuberculosis
gcgucucgaaccg

SEQ ID NO: 2887605 - RNA, 15 nt, Mycobacterium avium subsp. paratuberculosis
gcgucucgaccgcgg

SEQ ID NO: 2887606 - RNA, 17 nt, Mycobacterium avium subsp. paratuberculosis
gcgucucgacggcgccg

SEQ ID NO: 2887607 - RNA, 17 nt, Mycobacterium avium subsp. paratuberculosis
gcgucucgaucgacgac

SEQ ID NO: 2887608 - RNA, 19 nt, Mycobacterium avium subsp. paratuberculosis
gcgucucgaugaccucgcg

SEQ ID NO: 2887609 - RNA, 15 nt, Mycobacterium avium subsp. paratuberculosis
gcgucucgccgggga

SEQ ID NO: 2887610 - RNA, 12 nt, Mycobacterium avium subsp. paratuberculosis
gcgucucggcga

SEQ ID NO: 2887611 - RNA, 16 nt, Mycobacterium avium subsp. paratuberculosis
gcgucucggcggccga

SEQ ID NO: 2887612 - RNA, 22 nt, Mycobacterium avium subsp. paratuberculosis
gcgucucggcggccgagcgcac

SEQ ID NO: 2887613 - RNA, 19 nt, Mycobacterium avium subsp. paratuberculosis
gcgucucggcgucucggcg

SEQ ID NO: 2887614 - RNA, 20 nt, Mycobacterium avium subsp. paratuberculosis
gcgucucggcgucucggcgu

SEQ ID NO: 2887615 - RNA, 22 nt, Mycobacterium avium subsp. paratuberculosis
gcgucugccuugcugacgccgc

SEQ ID NO: 2887616 - RNA, 16 nt, Mycobacterium avium subsp. paratuberculosis
gcgucugcgccccggc

SEQ ID NO: 2887617 - RNA, 13 nt, Mycobacterium avium subsp. paratuberculosis
gcgucugcucgcc

SEQ ID NO: 2887618 - RNA, 17 nt, Mycobacterium avium subsp. paratuberculosis
gcgucugcucgccagac

SEQ ID NO: 2887619 - RNA, 15 nt, Mycobacterium avium subsp. paratuberculosis
gcgucugcucgccgg

SEQ ID NO: 2887620 - RNA, 17 nt, Mycobacterium avium subsp. paratuberculosis
gcgucugcucgccggcu

SEQ ID NO: 2887621 - RNA, 11 nt, Mycobacterium avium subsp. paratuberculosis
gcgugagcgag

SEQ ID NO: 2887622 - RNA, 21 nt, Mycobacterium avium subsp. paratuberculosis
gcgugagcucaaccgguccaa

SEQ ID NO: 2887623 - RNA, 17 nt, Mycobacterium avium subsp. paratuberculosis
gcgugaucccgauccuc

SEQ ID NO: 2887624 - RNA, 17 nt, Mycobacterium avium subsp. paratuberculosis
gcgugauccggaaugcg

SEQ ID NO: 2887625 - RNA, 17 nt, Mycobacterium avium subsp. paratuberculosis
gcgugaucggugcccgc

SEQ ID NO: 2887626 - RNA, 20 nt, Mycobacterium avium subsp. paratuberculosis
gcgugaucggugcccgcggg

SEQ ID NO: 2887627 - RNA, 18 nt, Mycobacterium avium subsp. paratuberculosis
gcgugaugaccagggccu

SEQ ID NO: 2887628 - RNA, 21 nt, Mycobacterium avium subsp. paratuberculosis
gcgugaugaccagggccucgu

SEQ ID NO: 2887629 - RNA, 17 nt, Mycobacterium avium subsp. paratuberculosis
gcgugaugacggcggcg

SEQ ID NO: 2887630 - RNA, 16 nt, Mycobacterium avium subsp. paratuberculosis
gcgugaugcagcaggu

SEQ ID NO: 2887631 - RNA, 15 nt, Mycobacterium avium subsp. paratuberculosis
gcgugaugggugggc

SEQ ID NO: 2887632 - RNA, 19 nt, Mycobacterium avium subsp. paratuberculosis
gcgugcaacugcguggccg

SEQ ID NO: 2887633 - RNA, 18 nt, Mycobacterium avium subsp. paratuberculosis
gcgugcacacccgcagcg

SEQ ID NO: 2887634 - RNA, 16 nt, Mycobacterium avium subsp. paratuberculosis
gcgugcacaggccgcc

SEQ ID NO: 2887635 - RNA, 18 nt, Mycobacterium avium subsp. paratuberculosis
gcgugcacaggccgccgc

SEQ ID NO: 2887636 - RNA, 19 nt, Mycobacterium avium subsp. paratuberculosis
gcgugcacaggccgccgca

SEQ ID NO: 2887637 - RNA, 12 nt, Mycobacterium avium subsp. paratuberculosis
gcgugcacccgg

SEQ ID NO: 2887638 - RNA, 15 nt, Mycobacterium avium subsp. paratuberculosis
gcgugcacccgguuc

SEQ ID NO: 2887639 - RNA, 13 nt, Mycobacterium avium subsp. paratuberculosis
gcgugcaccgccc

SEQ ID NO: 2887640 - RNA, 21 nt, Mycobacterium avium subsp. paratuberculosis
gcgugcaccugugaggcaccg

SEQ ID NO: 2887641 - RNA, 20 nt, Mycobacterium avium subsp. paratuberculosis
gcgugcacgaacgcggccag

SEQ ID NO: 2887642 - RNA, 21 nt, Mycobacterium avium subsp. paratuberculosis
gcgugcacgaacgcggccagc

SEQ ID NO: 2887643 - RNA, 13 nt, Mycobacterium avium subsp. paratuberculosis
gcgugcagcacgc

SEQ ID NO: 2887644 - RNA, 15 nt, Mycobacterium avium subsp. paratuberculosis
gcgugcagcacgccc

SEQ ID NO: 2887645 - RNA, 19 nt, Mycobacterium avium subsp. paratuberculosis
gcgugcagcacgcccucgg

SEQ ID NO: 2887646 - RNA, 20 nt, Mycobacterium avium subsp. paratuberculosis
gcgugcagcacgcccucggc

SEQ ID NO: 2887647 - RNA, 13 nt, Mycobacterium avium subsp. paratuberculosis
gcgugcagcccgc

SEQ ID NO: 2887648 - RNA, 14 nt, Mycobacterium avium subsp. paratuberculosis
gcgugcagccgggc

SEQ ID NO: 2887649 - RNA, 15 nt, Mycobacterium avium subsp. paratuberculosis
gcgugcagccgggcg

SEQ ID NO: 2887650 - RNA, 14 nt, Mycobacterium avium subsp. paratuberculosis
gcgugcagcgcggc

SEQ ID NO: 2887651 - RNA, 19 nt, Mycobacterium avium subsp. paratuberculosis
gcgugcagcgcggcgauga

SEQ ID NO: 2887652 - RNA, 18 nt, Mycobacterium avium subsp. paratuberculosis
gcgugcaggccgcgggug

SEQ ID NO: 2887653 - RNA, 19 nt, Mycobacterium avium subsp. paratuberculosis
gcgugcaggccgcgggugg

SEQ ID NO: 2887654 - RNA, 20 nt, Mycobacterium avium subsp. paratuberculosis
gcgugcaggccgcggguggc

SEQ ID NO: 2887655 - RNA, 22 nt, Mycobacterium avium subsp. paratuberculosis
gcgugccaaccacuugaagccg

SEQ ID NO: 2887656 - RNA, 19 nt, Mycobacterium avium subsp. paratuberculosis
gcgugccaagcguauccgg

SEQ ID NO: 2887657 - RNA, 20 nt, Mycobacterium avium subsp. paratuberculosis
gcgugccaagcguauccggc

SEQ ID NO: 2887658 - RNA, 21 nt, Mycobacterium avium subsp. paratuberculosis
gcgugccaagcguauccggcc

SEQ ID NO: 2887659 - RNA, 16 nt, Mycobacterium avium subsp. paratuberculosis
gcgugccacagcauga

SEQ ID NO: 2887660 - RNA, 13 nt, Mycobacterium avium subsp. paratuberculosis
gcgugccaccgcu

SEQ ID NO: 2887661 - RNA, 16 nt, Mycobacterium avium subsp. paratuberculosis
gcgugccaccgcuggg

SEQ ID NO: 2887662 - RNA, 22 nt, Mycobacterium avium subsp. paratuberculosis
gcgugccaccgcugggcggcgc

SEQ ID NO: 2887663 - RNA, 14 nt, Mycobacterium avium subsp. paratuberculosis
gcgugccagcagcu

SEQ ID NO: 2887664 - RNA, 15 nt, Mycobacterium avium subsp. paratuberculosis
gcgugccagggcagc

SEQ ID NO: 2887665 - RNA, 17 nt, Mycobacterium avium subsp. paratuberculosis
gcgugccagggcagcgc

SEQ ID NO: 2887666 - RNA, 23 nt, Mycobacterium avium subsp. paratuberculosis
gcgugccagggcagcgcgaccag

SEQ ID NO: 2887667 - RNA, 14 nt, Mycobacterium avium subsp. paratuberculosis
gcgugcccgcgccc

SEQ ID NO: 2887668 - RNA, 15 nt, Mycobacterium avium subsp. paratuberculosis
gcgugcccgcgccca

SEQ ID NO: 2887669 - RNA, 21 nt, Mycobacterium avium subsp. paratuberculosis
gcgugcccgcgcccaccugga

SEQ ID NO: 2887670 - RNA, 12 nt, Mycobacterium avium subsp. paratuberculosis
gcgugcccggcg

SEQ ID NO: 2887671 - RNA, 17 nt, Mycobacterium avium subsp. paratuberculosis
gcgugcccggcgcacag

SEQ ID NO: 2887672 - RNA, 16 nt, Mycobacterium avium subsp. paratuberculosis
gcgugccgaacggcgc

SEQ ID NO: 2887673 - RNA, 14 nt, Mycobacterium avium subsp. paratuberculosis
gcgugccgaccagc

SEQ ID NO: 2887674 - RNA, 15 nt, Mycobacterium avium subsp. paratuberculosis
gcgugccgaccagcc

SEQ ID NO: 2887675 - RNA, 17 nt, Mycobacterium avium subsp. paratuberculosis
gcgugccgaccagccga

SEQ ID NO: 2887676 - RNA, 17 nt, Mycobacterium avium subsp. paratuberculosis
gcgugccgcgcaccacc

SEQ ID NO: 2887677 - RNA, 19 nt, Mycobacterium avium subsp. paratuberculosis
gcgugccgcgcaccaccuc

SEQ ID NO: 2887678 - RNA, 13 nt, Mycobacterium avium subsp. paratuberculosis
gcgugccgcuggg

SEQ ID NO: 2887679 - RNA, 15 nt, Mycobacterium avium subsp. paratuberculosis
gcgugccggacaccg

SEQ ID NO: 2887680 - RNA, 19 nt, Mycobacterium avium subsp. paratuberculosis
gcgugccggacaccggcac

SEQ ID NO: 2887681 - RNA, 22 nt, Mycobacterium avium subsp. paratuberculosis
gcgugccggaugcggucgauga

SEQ ID NO: 2887682 - RNA, 12 nt, Mycobacterium avium subsp. paratuberculosis
gcgugccggccc

SEQ ID NO: 2887683 - RNA, 14 nt, Mycobacterium avium subsp. paratuberculosis
gcgugccggcccgg

SEQ ID NO: 2887684 - RNA, 15 nt, Mycobacterium avium subsp. paratuberculosis
gcgugccggcccggc

SEQ ID NO: 2887685 - RNA, 16 nt, Mycobacterium avium subsp. paratuberculosis
gcgugccggcccggcg

SEQ ID NO: 2887686 - RNA, 22 nt, Mycobacterium avium subsp. paratuberculosis
gcgugccggcccggcgggucag

SEQ ID NO: 2887687 - RNA, 12 nt, Mycobacterium avium subsp. paratuberculosis
gcgugccggcgg

SEQ ID NO: 2887688 - RNA, 13 nt, Mycobacterium avium subsp. paratuberculosis
gcgugccggcggc

SEQ ID NO: 2887689 - RNA, 16 nt, Mycobacterium avium subsp. paratuberculosis
gcgugccggcggcgga

SEQ ID NO: 2887690 - RNA, 17 nt, Mycobacterium avium subsp. paratuberculosis
gcgugccgggauagccg

SEQ ID NO: 2887691 - RNA, 13 nt, Mycobacterium avium subsp. paratuberculosis
gcgugccgggcgg

SEQ ID NO: 2887692 - RNA, 12 nt, Mycobacterium avium subsp. paratuberculosis
gcgugccgucca

SEQ ID NO: 2887693 - RNA, 18 nt, Mycobacterium avium subsp. paratuberculosis
gcgugcgacucggucacg

SEQ ID NO: 2887694 - RNA, 13 nt, Mycobacterium avium subsp. paratuberculosis
gcgugcgcccgac

SEQ ID NO: 2887695 - RNA, 14 nt, Mycobacterium avium subsp. paratuberculosis
gcgugcgcccgacg

SEQ ID NO: 2887696 - RNA, 15 nt, Mycobacterium avium subsp. paratuberculosis
gcgugcgccgcggcg

SEQ ID NO: 2887697 - RNA, 13 nt, Mycobacterium avium subsp. paratuberculosis
gcgugcgcggccg

SEQ ID NO: 2887698 - RNA, 15 nt, Mycobacterium avium subsp. paratuberculosis
gcgugcgcggccgcc

SEQ ID NO: 2887699 - RNA, 19 nt, Mycobacterium avium subsp. paratuberculosis
gcgugcgcggccgcccagu

SEQ ID NO: 2887700 - RNA, 21 nt, Mycobacterium avium subsp. paratuberculosis
gcgugcgcguggggcgucgcc

SEQ ID NO: 2887701 - RNA, 15 nt, Mycobacterium avium subsp. paratuberculosis
gcgugcgcgugggug

SEQ ID NO: 2887702 - RNA, 12 nt, Mycobacterium avium subsp. paratuberculosis
gcgugcgcucga

SEQ ID NO: 2887703 - RNA, 14 nt, Mycobacterium avium subsp. paratuberculosis
gcgugcgcucgacc

SEQ ID NO: 2887704 - RNA, 21 nt, Mycobacterium avium subsp. paratuberculosis
gcgugcgcucgaccucggcgg

SEQ ID NO: 2887705 - RNA, 13 nt, Mycobacterium avium subsp. paratuberculosis
gcgugcggccgca

SEQ ID NO: 2887706 - RNA, 15 nt, Mycobacterium avium subsp. paratuberculosis
gcguggugcgcccgu

SEQ ID NO: 2887707 - RNA, 22 nt, Mycobacterium avium subsp. paratuberculosis
gcgugguggaaggugacgucgc

SEQ ID NO: 2887708 - RNA, 22 nt, Mycobacterium avium subsp. paratuberculosis
gcguggugggcagaugcccgcu

SEQ ID NO: 2887709 - RNA, 18 nt, Mycobacterium avium subsp. paratuberculosis
gcgugguggggccgauga

SEQ ID NO: 2887710 - RNA, 15 nt, Mycobacterium avium subsp. paratuberculosis
gcgugguucaggcgu

SEQ ID NO: 2887711 - RNA, 21 nt, Mycobacterium avium subsp. paratuberculosis
gcguguagccugcggccugca

SEQ ID NO: 2887712 - RNA, 19 nt, Mycobacterium avium subsp. paratuberculosis
gcguguaguacaggccgua

SEQ ID NO: 2887713 - RNA, 21 nt, Mycobacterium avium subsp. paratuberculosis
gcguguaguccaggucgaucu

SEQ ID NO: 2887714 - RNA, 16 nt, Mycobacterium avium subsp. paratuberculosis
gcgugucacuacccgc

SEQ ID NO: 2887715 - RNA, 20 nt, Mycobacterium avium subsp. paratuberculosis
gcgugucacuacccgcgaug

SEQ ID NO: 2887716 - RNA, 16 nt, Mycobacterium avium subsp. paratuberculosis
gcgugucgccggggcg

SEQ ID NO: 2887717 - RNA, 13 nt, Mycobacterium avium subsp. paratuberculosis
gcgugucggcgau

SEQ ID NO: 2887718 - RNA, 18 nt, Mycobacterium avium subsp. paratuberculosis
gcgugucggcgaucgcgc

SEQ ID NO: 2887719 - RNA, 18 nt, Mycobacterium avium subsp. paratuberculosis
gcgugucggcgccaccgg

SEQ ID NO: 2887720 - RNA, 19 nt, Mycobacterium avium subsp. paratuberculosis
gcgugucggggucggcgcc

SEQ ID NO: 2887721 - RNA, 18 nt, Mycobacterium avium subsp. paratuberculosis
gcgugucgugugcgugac

SEQ ID NO: 2887722 - RNA, 19 nt, Mycobacterium avium subsp. paratuberculosis
gcgugucgugugcgugacg

SEQ ID NO: 2887723 - RNA, 14 nt, Mycobacterium avium subsp. paratuberculosis
gcgugugcccagca

SEQ ID NO: 2887724 - RNA, 15 nt, Mycobacterium avium subsp. paratuberculosis
gcgugugcccagcac

SEQ ID NO: 2887725 - RNA, 17 nt, Mycobacterium avium subsp. paratuberculosis
gcgugugcccagcacga

SEQ ID NO: 2887726 - RNA, 13 nt, Mycobacterium avium subsp. paratuberculosis
gcgugugcccgcc

SEQ ID NO: 2887727 - RNA, 16 nt, Mycobacterium avium subsp. paratuberculosis
gcgugugcccgccucg

SEQ ID NO: 2887728 - RNA, 13 nt, Mycobacterium avium subsp. paratuberculosis
gcguguggcccug

SEQ ID NO: 2887729 - RNA, 18 nt, Mycobacterium avium subsp. paratuberculosis
gcgugugggcucgcccgg

SEQ ID NO: 2887730 - RNA, 18 nt, Mycobacterium avium subsp. paratuberculosis
gcguguuccuugcggccg

SEQ ID NO: 2887731 - RNA, 23 nt, Mycobacterium avium subsp. paratuberculosis
gcguguuccuugcggccgccgau

SEQ ID NO: 2887732 - RNA, 17 nt, Mycobacterium avium subsp. paratuberculosis
gcguguuggacgcccgc

SEQ ID NO: 2887733 - RNA, 18 nt, Mycobacterium avium subsp. paratuberculosis
gcguguuggacgcccgcu

SEQ ID NO: 2887734 - RNA, 12 nt, Mycobacterium avium subsp. paratuberculosis
gcguucacccgc

SEQ ID NO: 2887735 - RNA, 13 nt, Mycobacterium avium subsp. paratuberculosis
gcguucacccgcg

SEQ ID NO: 2887736 - RNA, 16 nt, Mycobacterium avium subsp. paratuberculosis
gcguucacccgcgccc

SEQ ID NO: 2887737 - RNA, 19 nt, Mycobacterium avium subsp. paratuberculosis
gcguucacccgcgcccgca

SEQ ID NO: 2887738 - RNA, 13 nt, Mycobacterium avium subsp. paratuberculosis
gcguucagcagcg

SEQ ID NO: 2887739 - RNA, 16 nt, Mycobacterium avium subsp. paratuberculosis
gcguucagcagcgcgg

SEQ ID NO: 2887740 - RNA, 18 nt, Mycobacterium avium subsp. paratuberculosis
gcguucagccggagccgg

SEQ ID NO: 2887741 - RNA, 16 nt, Mycobacterium avium subsp. paratuberculosis
gcguucagcggcaccg

SEQ ID NO: 2887742 - RNA, 19 nt, Mycobacterium avium subsp. paratuberculosis
gcguucagggugcaggccc

SEQ ID NO: 2887743 - RNA, 23 nt, Mycobacterium avium subsp. paratuberculosis
gcguucaucguccacaccgggaa

SEQ ID NO: 2887744 - RNA, 21 nt, Mycobacterium avium subsp. paratuberculosis
gcguucaucgugccgaacgug

SEQ ID NO: 2887745 - RNA, 23 nt, Mycobacterium avium subsp. paratuberculosis
gcguuccagcacccggcccacgc

SEQ ID NO: 2887746 - RNA, 18 nt, Mycobacterium avium subsp. paratuberculosis
gcguuccagcacgcccag

SEQ ID NO: 2887747 - RNA, 13 nt, Mycobacterium avium subsp. paratuberculosis
gcguuccagcauc

SEQ ID NO: 2887748 - RNA, 16 nt, Mycobacterium avium subsp. paratuberculosis
gcguuccagcgcacac

SEQ ID NO: 2887749 - RNA, 15 nt, Mycobacterium avium subsp. paratuberculosis
gcguuccagguccgc

SEQ ID NO: 2887750 - RNA, 20 nt, Mycobacterium avium subsp. paratuberculosis
gcguuccagguucagcccgg

SEQ ID NO: 2887751 - RNA, 20 nt, Mycobacterium avium subsp. paratuberculosis
gcguuccaucugcucguggu

SEQ ID NO: 2887752 - RNA, 22 nt, Mycobacterium avium subsp. paratuberculosis
gcgcacgcccaugaucacaccg

SEQ ID NO: 2887753 - RNA, 15 nt, Mycobacterium avium subsp. paratuberculosis
gcgcacgcggacacg

SEQ ID NO: 2887754 - RNA, 19 nt, Mycobacterium avium subsp. paratuberculosis
gcgcacgcucgcggugcgc

SEQ ID NO: 2887755 - RNA, 20 nt, Mycobacterium avium subsp. paratuberculosis
gcgcacgcucgcggugcgcg

SEQ ID NO: 2887756 - RNA, 15 nt, Mycobacterium avium subsp. paratuberculosis
gcgcacgcugcuggu

SEQ ID NO: 2887757 - RNA, 22 nt, Mycobacterium avium subsp. paratuberculosis
gcgcacgcuggccggcagcguc

SEQ ID NO: 2887758 - RNA, 19 nt, Mycobacterium avium subsp. paratuberculosis
gcgcacgcuuuuucgcgaa

SEQ ID NO: 2887759 - RNA, 12 nt, Mycobacterium avium subsp. paratuberculosis
gcgcacggcgcg

SEQ ID NO: 2887760 - RNA, 17 nt, Mycobacterium avium subsp. paratuberculosis
gcgcacggcgcgcaccg

SEQ ID NO: 2887761 - RNA, 20 nt, Mycobacterium avium subsp. paratuberculosis
gcgcacggcgcgcaccgcgg

SEQ ID NO: 2887762 - RNA, 13 nt, Mycobacterium avium subsp. paratuberculosis
gcgcacggugccc

SEQ ID NO: 2887763 - RNA, 17 nt, Mycobacterium avium subsp. paratuberculosis
gcgcacggugcccgucg

SEQ ID NO: 2887764 - RNA, 19 nt, Mycobacterium avium subsp. paratuberculosis
gcgcacggugcccgucggc

SEQ ID NO: 2887765 - RNA, 21 nt, Mycobacterium avium subsp. paratuberculosis
gcgcacguaccgguacagcga

SEQ ID NO: 2887766 - RNA, 23 nt, Mycobacterium avium subsp. paratuberculosis
gcgcacguaccgguacagcgacu

SEQ ID NO: 2887767 - RNA, 17 nt, Mycobacterium avium subsp. paratuberculosis
gcgcacguagcccagcg

SEQ ID NO: 2887768 - RNA, 15 nt, Mycobacterium avium subsp. paratuberculosis
gcgcacgucaccgcg

SEQ ID NO: 2887769 - RNA, 17 nt, Mycobacterium avium subsp. paratuberculosis
gcgcacgucaccgcgcu

SEQ ID NO: 2887770 - RNA, 16 nt, Mycobacterium avium subsp. paratuberculosis
gcgcacgucgaggucg

SEQ ID NO: 2887771 - RNA, 21 nt, Mycobacterium avium subsp. paratuberculosis
gcgcacgucgaggucggacgc

SEQ ID NO: 2887772 - RNA, 22 nt, Mycobacterium avium subsp. paratuberculosis
gcgcacgucgaggucggacgcc

SEQ ID NO: 2887773 - RNA, 16 nt, Mycobacterium avium subsp. paratuberculosis
gcgcacgucgccgccg

SEQ ID NO: 2887774 - RNA, 18 nt, Mycobacterium avium subsp. paratuberculosis
gcgcacgucgccgccgca

SEQ ID NO: 2887775 - RNA, 12 nt, Mycobacterium avium subsp. paratuberculosis
gcgcacgucggc

SEQ ID NO: 2887776 - RNA, 13 nt, Mycobacterium avium subsp. paratuberculosis
gcgcacgucggcc

SEQ ID NO: 2887777 - RNA, 16 nt, Mycobacterium avium subsp. paratuberculosis
gcgcacgucggccgcc

SEQ ID NO: 2887778 - RNA, 19 nt, Mycobacterium avium subsp. paratuberculosis
gcgcacgucggccgccagg

SEQ ID NO: 2887779 - RNA, 21 nt, Mycobacterium avium subsp. paratuberculosis
gcgcacgucggccgccagggc

SEQ ID NO: 2887780 - RNA, 21 nt, Mycobacterium avium subsp. paratuberculosis
gcgcacguggcugaccgacgg

SEQ ID NO: 2887781 - RNA, 12 nt, Mycobacterium avium subsp. paratuberculosis
gcgcacguuggc

SEQ ID NO: 2887782 - RNA, 17 nt, Mycobacterium avium subsp. paratuberculosis
gcgcacguuggcggcca

SEQ ID NO: 2887783 - RNA, 18 nt, Mycobacterium avium subsp. paratuberculosis
gcgcacguuggcggccag

SEQ ID NO: 2887784 - RNA, 19 nt, Mycobacterium avium subsp. paratuberculosis
gcgcacguuggcggccagc

SEQ ID NO: 2887785 - RNA, 23 nt, Mycobacterium avium subsp. paratuberculosis
gcgcacuccaucacgaccucgaa

SEQ ID NO: 2887786 - RNA, 18 nt, Mycobacterium avium subsp. paratuberculosis
gcgcacucgaacggcccg

SEQ ID NO: 2887787 - RNA, 19 nt, Mycobacterium avium subsp. paratuberculosis
gcgcacucgaacggcccgg

SEQ ID NO: 2887788 - RNA, 22 nt, Mycobacterium avium subsp. paratuberculosis
gcgcacucgaacggcccggacg

SEQ ID NO: 2887789 - RNA, 16 nt, Mycobacterium avium subsp. paratuberculosis
gcgcacuucgcgggcg

SEQ ID NO: 2887790 - RNA, 18 nt, Mycobacterium avium subsp. paratuberculosis
gcgcacuucgcgggcggc

SEQ ID NO: 2887791 - RNA, 20 nt, Mycobacterium avium subsp. paratuberculosis
gcgcacuucgcgggcggcgc

SEQ ID NO: 2887792 - RNA, 21 nt, Mycobacterium avium subsp. paratuberculosis
gcgcacuucgcgggcggcgca

SEQ ID NO: 2887793 - RNA, 21 nt, Mycobacterium avium subsp. paratuberculosis
gcgcagaaaccccacgaucgc

SEQ ID NO: 2887794 - RNA, 16 nt, Mycobacterium avium subsp. paratuberculosis
gcgcagaacaccaccg

SEQ ID NO: 2887795 - RNA, 19 nt, Mycobacterium avium subsp. paratuberculosis
gcgcagaacaccaccgcca

SEQ ID NO: 2887796 - RNA, 20 nt, Mycobacterium avium subsp. paratuberculosis
gcgcagaacaccaccgccag

SEQ ID NO: 2887797 - RNA, 22 nt, Mycobacterium avium subsp. paratuberculosis
gcgcagaacaccaccgccaggu

SEQ ID NO: 2887798 - RNA, 15 nt, Mycobacterium avium subsp. paratuberculosis
gcgcagaaccgcacc

SEQ ID NO: 2887799 - RNA, 16 nt, Mycobacterium avium subsp. paratuberculosis
gcgcagaaccgcaccc

SEQ ID NO: 2887800 - RNA, 17 nt, Mycobacterium avium subsp. paratuberculosis
gcgcagaaccgcacccc

SEQ ID NO: 2887801 - RNA, 17 nt, Mycobacterium avium subsp. paratuberculosis
gcgcagaagcuaacgcc

SEQ ID NO: 2887802 - RNA, 20 nt, Mycobacterium avium subsp. paratuberculosis
gcgcagaagcuaacgccagc

SEQ ID NO: 2887803 - RNA, 21 nt, Mycobacterium avium subsp. paratuberculosis
gcgcagaagcuaacgccagcu

SEQ ID NO: 2887804 - RNA, 22 nt, Mycobacterium avium subsp. paratuberculosis
gcgcagaagcuaacgccagcug

SEQ ID NO: 2887805 - RNA, 21 nt, Mycobacterium avium subsp. paratuberculosis
gcgcagauagccguacacggc

SEQ ID NO: 2887806 - RNA, 19 nt, Mycobacterium avium subsp. paratuberculosis
gcgcagaucgagaucaggg

SEQ ID NO: 2887807 - RNA, 16 nt, Mycobacterium avium subsp. paratuberculosis
gcgcagaucgccagca

SEQ ID NO: 2887808 - RNA, 17 nt, Mycobacterium avium subsp. paratuberculosis
gcgcagaucgccagcac

SEQ ID NO: 2887809 - RNA, 22 nt, Mycobacterium avium subsp. paratuberculosis
gcgcagaucgccagcaccggcg

SEQ ID NO: 2887810 - RNA, 20 nt, Mycobacterium avium subsp. paratuberculosis
gcgcagaucgcgcaucaccc

SEQ ID NO: 2887811 - RNA, 23 nt, Mycobacterium avium subsp. paratuberculosis
gcgcagaucgcgcaucacccggc

SEQ ID NO: 2887812 - RNA, 14 nt, Mycobacterium avium subsp. paratuberculosis
gcgcagaucgucga

SEQ ID NO: 2887813 - RNA, 16 nt, Mycobacterium avium subsp. paratuberculosis
gcgcagaucgucgacc

SEQ ID NO: 2887814 - RNA, 15 nt, Mycobacterium avium subsp. paratuberculosis
gcgcagaugaccggc

SEQ ID NO: 2887815 - RNA, 17 nt, Mycobacterium avium subsp. paratuberculosis
gcgcagaugaccggccu

SEQ ID NO: 2887816 - RNA, 22 nt, Mycobacterium avium subsp. paratuberculosis
gcgcagaugaccggccugcagc

SEQ ID NO: 2887817 - RNA, 17 nt, Mycobacterium avium subsp. paratuberculosis
gcgcagcacaaaagggc

SEQ ID NO: 2887818 - RNA, 20 nt, Mycobacterium avium subsp. paratuberculosis
gcgcagcaccauccgcgcga

SEQ ID NO: 2887819 - RNA, 13 nt, Mycobacterium avium subsp. paratuberculosis
gcgcagcaccgac

SEQ ID NO: 2887820 - RNA, 14 nt, Mycobacterium avium subsp. paratuberculosis
gcgcagcaccgacu

SEQ ID NO: 2887821 - RNA, 13 nt, Mycobacterium avium subsp. paratuberculosis
gcgcagcaccgcg

SEQ ID NO: 2887822 - RNA, 18 nt, Mycobacterium avium subsp. paratuberculosis
gcgcagcaccgcgucggc

SEQ ID NO: 2887823 - RNA, 19 nt, Mycobacterium avium subsp. paratuberculosis
gcgcagcaccgcgucggcg

SEQ ID NO: 2887824 - RNA, 22 nt, Mycobacterium avium subsp. paratuberculosis
gcgcagcaccgcgucggcgcug

SEQ ID NO: 2887825 - RNA, 12 nt, Mycobacterium avium subsp. paratuberculosis
gcgcagcaccgu

SEQ ID NO: 2887826 - RNA, 14 nt, Mycobacterium avium subsp. paratuberculosis
gcgcagcaccguca

SEQ ID NO: 2887827 - RNA, 15 nt, Mycobacterium avium subsp. paratuberculosis
gcgcagcaccuccga

SEQ ID NO: 2887828 - RNA, 18 nt, Mycobacterium avium subsp. paratuberculosis
gcgcagcaccuccgacag

SEQ ID NO: 2887829 - RNA, 21 nt, Mycobacterium avium subsp. paratuberculosis
gcgcagcaccuccgacagccc

SEQ ID NO: 2887830 - RNA, 11 nt, Mycobacterium avium subsp. paratuberculosis
gcgcagcacga

SEQ ID NO: 2887831 - RNA, 14 nt, Mycobacterium avium subsp. paratuberculosis
gcgcagcacgauga

SEQ ID NO: 2887832 - RNA, 12 nt, Mycobacterium avium subsp. paratuberculosis
gcgcagcacggc

SEQ ID NO: 2887833 - RNA, 15 nt, Mycobacterium avium subsp. paratuberculosis
gcgcagcacggccac

SEQ ID NO: 2887834 - RNA, 16 nt, Mycobacterium avium subsp. paratuberculosis
gcgcagcacggccacu

SEQ ID NO: 2887835 - RNA, 20 nt, Mycobacterium avium subsp. paratuberculosis
gcgcagcacguguucgggau

SEQ ID NO: 2887836 - RNA, 18 nt, Mycobacterium avium subsp. paratuberculosis
gcgcagcacugagcggca

SEQ ID NO: 2887837 - RNA, 12 nt, Mycobacterium avium subsp. paratuberculosis
gcgcagcagcag

SEQ ID NO: 2887838 - RNA, 15 nt, Mycobacterium avium subsp. paratuberculosis
gcgcagcagcgccag

SEQ ID NO: 2887839 - RNA, 21 nt, Mycobacterium avium subsp. paratuberculosis
gcgcagcagcgccagcagcgg

SEQ ID NO: 2887840 - RNA, 13 nt, Mycobacterium avium subsp. paratuberculosis
gcgcagcagcggc

SEQ ID NO: 2887841 - RNA, 14 nt, Mycobacterium avium subsp. paratuberculosis
gcgcagcagcggga

SEQ ID NO: 2887842 - RNA, 22 nt, Mycobacterium avium subsp. paratuberculosis
gcgcagcagcguuccgucggcg

SEQ ID NO: 2887843 - RNA, 23 nt, Mycobacterium avium subsp. paratuberculosis
gcgcagcagcguuccgucggcga

SEQ ID NO: 2887844 - RNA, 19 nt, Mycobacterium avium subsp. paratuberculosis
gcgcagcagcugcacccgc

SEQ ID NO: 2887845 - RNA, 17 nt, Mycobacterium avium subsp. paratuberculosis
gcgcagcaggcgccggu

SEQ ID NO: 2887846 - RNA, 15 nt, Mycobacterium avium subsp. paratuberculosis
gcgcagcaucacguc

SEQ ID NO: 2887847 - RNA, 19 nt, Mycobacterium avium subsp. paratuberculosis
gcgcagcaucacgucggcg

SEQ ID NO: 2887848 - RNA, 21 nt, Mycobacterium avium subsp. paratuberculosis
gcgcagcaucacgucggcgag

SEQ ID NO: 2887849 - RNA, 14 nt, Mycobacterium avium subsp. paratuberculosis
gcgcagcauccgca

SEQ ID NO: 2887850 - RNA, 17 nt, Mycobacterium avium subsp. paratuberculosis
gcgcagcauccgcacca

SEQ ID NO: 2887851 - RNA, 20 nt, Mycobacterium avium subsp. paratuberculosis
gcgcagcauccgcaccaggu

SEQ ID NO: 2887852 - RNA, 13 nt, Mycobacterium avium subsp. paratuberculosis
gcgcagcaucggc

SEQ ID NO: 2887853 - RNA, 15 nt, Mycobacterium avium subsp. paratuberculosis
gcgcagcaucggcag

SEQ ID NO: 2887854 - RNA, 20 nt, Mycobacterium avium subsp. paratuberculosis
gcgcagcaucggcagaucgu

SEQ ID NO: 2887855 - RNA, 21 nt, Mycobacterium avium subsp. paratuberculosis
gcgcagcaucuccgagucggc

SEQ ID NO: 2887856 - RNA, 22 nt, Mycobacterium avium subsp. paratuberculosis
gcgcagcaucuccgagucggcg

SEQ ID NO: 2887857 - RNA, 23 nt, Mycobacterium avium subsp. paratuberculosis
gcgcagcaucuccgagucggcgu

SEQ ID NO: 2887858 - RNA, 19 nt, Mycobacterium avium subsp. paratuberculosis
gcgcagcauggcccacagg

SEQ ID NO: 2887859 - RNA, 21 nt, Mycobacterium avium subsp. paratuberculosis
gcgcagcauggcccacaggac

SEQ ID NO: 2887860 - RNA, 12 nt, Mycobacterium avium subsp. paratuberculosis
gcgcagccaccg

SEQ ID NO: 2887861 - RNA, 14 nt, Mycobacterium avium subsp. paratuberculosis
gcgcagccaccgcc

SEQ ID NO: 2887862 - RNA, 16 nt, Mycobacterium avium subsp. paratuberculosis
gcgcagccaccgcccg

SEQ ID NO: 2887863 - RNA, 14 nt, Mycobacterium avium subsp. paratuberculosis
gcgcagccacgagc

SEQ ID NO: 2887864 - RNA, 16 nt, Mycobacterium avium subsp. paratuberculosis
gcgcagccacgagccc

SEQ ID NO: 2887865 - RNA, 19 nt, Mycobacterium avium subsp. paratuberculosis
gcgcagccacgagcccagc

SEQ ID NO: 2887866 - RNA, 20 nt, Mycobacterium avium subsp. paratuberculosis
gcgcagccacgagcccagcc

SEQ ID NO: 2887867 - RNA, 22 nt, Mycobacterium avium subsp. paratuberculosis
gcgcagccacgagcccagccgu

SEQ ID NO: 2887868 - RNA, 20 nt, Mycobacterium avium subsp. paratuberculosis
gcgcagccagaccucgccga

SEQ ID NO: 2887869 - RNA, 22 nt, Mycobacterium avium subsp. paratuberculosis
gcgcagccagaccucgccgacg

SEQ ID NO: 2887870 - RNA, 15 nt, Mycobacterium avium subsp. paratuberculosis
gcgcagccagcgccg

SEQ ID NO: 2887871 - RNA, 20 nt, Mycobacterium avium subsp. paratuberculosis
gcgcagccagcgccgcacug

SEQ ID NO: 2887872 - RNA, 15 nt, Mycobacterium avium subsp. paratuberculosis
gcgcagccagcucgg

SEQ ID NO: 2887873 - RNA, 16 nt, Mycobacterium avium subsp. paratuberculosis
gcgcagccagcucggc

SEQ ID NO: 2887874 - RNA, 18 nt, Mycobacterium avium subsp. paratuberculosis
gcgcagccagcucggcgu

SEQ ID NO: 2887875 - RNA, 11 nt, Mycobacterium avium subsp. paratuberculosis
gcgcagccagg

SEQ ID NO: 2887876 - RNA, 15 nt, Mycobacterium avium subsp. paratuberculosis
gcgcagccaggugaa

SEQ ID NO: 2887877 - RNA, 15 nt, Mycobacterium avium subsp. paratuberculosis
gcgcagcccagccag

SEQ ID NO: 2887878 - RNA, 17 nt, Mycobacterium avium subsp. paratuberculosis
gcgcagcccagccagcg

SEQ ID NO: 2887879 - RNA, 13 nt, Mycobacterium avium subsp. paratuberculosis
gcgcagcccccgg

SEQ ID NO: 2887880 - RNA, 14 nt, Mycobacterium avium subsp. paratuberculosis
gcgcagcccgagcg

SEQ ID NO: 2887881 - RNA, 17 nt, Mycobacterium avium subsp. paratuberculosis
gcgcagcccgagcggca

SEQ ID NO: 2887882 - RNA, 13 nt, Mycobacterium avium subsp. paratuberculosis
gcgcagcccgccg

SEQ ID NO: 2887883 - RNA, 14 nt, Mycobacterium avium subsp. paratuberculosis
gcgcagcccgccgg

SEQ ID NO: 2887884 - RNA, 16 nt, Mycobacterium avium subsp. paratuberculosis
gcgcagcccggcgguu

SEQ ID NO: 2887885 - RNA, 18 nt, Mycobacterium avium subsp. paratuberculosis
gcgcagcccggcgguuga

SEQ ID NO: 2887886 - RNA, 17 nt, Mycobacterium avium subsp. paratuberculosis
gcgcagccgaucgacga

SEQ ID NO: 2887887 - RNA, 13 nt, Mycobacterium avium subsp. paratuberculosis
gcgcagccgccgg

SEQ ID NO: 2887888 - RNA, 12 nt, Mycobacterium avium subsp. paratuberculosis
gcgcagccgcgg

SEQ ID NO: 2887889 - RNA, 13 nt, Mycobacterium avium subsp. paratuberculosis
gcgcagccgcggu

SEQ ID NO: 2887890 - RNA, 16 nt, Mycobacterium avium subsp. paratuberculosis
gcgcagccgcgguggc

SEQ ID NO: 2887891 - RNA, 18 nt, Mycobacterium avium subsp. paratuberculosis
gcgcagccgcgguggcgg

SEQ ID NO: 2887892 - RNA, 14 nt, Mycobacterium avium subsp. paratuberculosis
gcgcagccgcugca

SEQ ID NO: 2887893 - RNA, 17 nt, Mycobacterium avium subsp. paratuberculosis
gcgcagccgcugcagcg

SEQ ID NO: 2887894 - RNA, 18 nt, Mycobacterium avium subsp. paratuberculosis
gcgcagccgcugcagcgc

SEQ ID NO: 2887895 - RNA, 20 nt, Mycobacterium avium subsp. paratuberculosis
gcgcagccgcugcagcgccg

SEQ ID NO: 2887896 - RNA, 22 nt, Mycobacterium avium subsp. paratuberculosis
gcgcagccgcugcagcgccgcc

SEQ ID NO: 2887897 - RNA, 14 nt, Mycobacterium avium subsp. paratuberculosis
gcgcagccggccac

SEQ ID NO: 2887898 - RNA, 15 nt, Mycobacterium avium subsp. paratuberculosis
gcgcagccggccacc

SEQ ID NO: 2887899 - RNA, 18 nt, Mycobacterium avium subsp. paratuberculosis
gcgcagccggccaccgcc

SEQ ID NO: 2887900 - RNA, 21 nt, Mycobacterium avium subsp. paratuberculosis
gcgcagccggccaccgcccca

SEQ ID NO: 2887901 - RNA, 13 nt, Mycobacterium avium subsp. paratuberculosis
gcgcagccggccg

SEQ ID NO: 2887902 - RNA, 17 nt, Mycobacterium avium subsp. paratuberculosis
gcgcagccggccgaccg

SEQ ID NO: 2887903 - RNA, 19 nt, Mycobacterium avium subsp. paratuberculosis
gcgcagccggccguccacg

SEQ ID NO: 2887904 - RNA, 16 nt, Mycobacterium avium subsp. paratuberculosis
gcgcagccgggcggcg

SEQ ID NO: 2887905 - RNA, 17 nt, Mycobacterium avium subsp. paratuberculosis
gcgcagccgggcggcgc

SEQ ID NO: 2887906 - RNA, 18 nt, Mycobacterium avium subsp. paratuberculosis
gcgcagccgggcggcgcu

SEQ ID NO: 2887907 - RNA, 15 nt, Mycobacterium avium subsp. paratuberculosis
gcgcagccgggcggu

SEQ ID NO: 2887908 - RNA, 16 nt, Mycobacterium avium subsp. paratuberculosis
gcgcagccgggcggug

SEQ ID NO: 2887909 - RNA, 23 nt, Mycobacterium avium subsp. paratuberculosis
gcgcagccgucgcaucagcucgg

SEQ ID NO: 2887910 - RNA, 16 nt, Mycobacterium avium subsp. paratuberculosis
gcgcagcgaacgucag

SEQ ID NO: 2887911 - RNA, 20 nt, Mycobacterium avium subsp. paratuberculosis
gcgcagcgaacgucaggauc

SEQ ID NO: 2887912 - RNA, 16 nt, Mycobacterium avium subsp. paratuberculosis
gcgcagcgaagcgagg

SEQ ID NO: 2887913 - RNA, 16 nt, Mycobacterium avium subsp. paratuberculosis
gcgcagcgagucggcg

SEQ ID NO: 2887914 - RNA, 15 nt, Mycobacterium avium subsp. paratuberculosis
gcgcagcgcagcacc

SEQ ID NO: 2887915 - RNA, 16 nt, Mycobacterium avium subsp. paratuberculosis
gcgcagcgcagcacca

SEQ ID NO: 2887916 - RNA, 20 nt, Mycobacterium avium subsp. paratuberculosis
gcgcagcgcagcaccauccg

SEQ ID NO: 2887917 - RNA, 17 nt, Mycobacterium avium subsp. paratuberculosis
gcgcagcgcccaggcgu

SEQ ID NO: 2887918 - RNA, 18 nt, Mycobacterium avium subsp. paratuberculosis
gcgcagcgccgcgccgac

SEQ ID NO: 2887919 - RNA, 13 nt, Mycobacterium avium subsp. paratuberculosis
gcgcagcgccguc

SEQ ID NO: 2887920 - RNA, 17 nt, Mycobacterium avium subsp. paratuberculosis
gcgcagcgccgucucga

SEQ ID NO: 2887921 - RNA, 14 nt, Mycobacterium avium subsp. paratuberculosis
gcgcagcgccucgg

SEQ ID NO: 2887922 - RNA, 19 nt, Mycobacterium avium subsp. paratuberculosis
gcgcagcgccucggcggcc

SEQ ID NO: 2887923 - RNA, 20 nt, Mycobacterium avium subsp. paratuberculosis
gcgcagcgccucggcggccc

SEQ ID NO: 2887924 - RNA, 13 nt, Mycobacterium avium subsp. paratuberculosis
gcgcagcgcgucg

SEQ ID NO: 2887925 - RNA, 17 nt, Mycobacterium avium subsp. paratuberculosis
gcgcagcgcgucgcgcc

SEQ ID NO: 2887926 - RNA, 19 nt, Mycobacterium avium subsp. paratuberculosis
gcgcagcgcgucgcgcccg

SEQ ID NO: 2887927 - RNA, 16 nt, Mycobacterium avium subsp. paratuberculosis
gcgcagcgcgucgggc

SEQ ID NO: 2887928 - RNA, 18 nt, Mycobacterium avium subsp. paratuberculosis
gcgcagcgcgucgggcuc

SEQ ID NO: 2887929 - RNA, 23 nt, Mycobacterium avium subsp. paratuberculosis
gcgcagcgcgucgggcucggccg

SEQ ID NO: 2887930 - RNA, 16 nt, Mycobacterium avium subsp. paratuberculosis
gcgcagcgcgucgucg

SEQ ID NO: 2887931 - RNA, 17 nt, Mycobacterium avium subsp. paratuberculosis
gcgcagcgcgucgucgg

SEQ ID NO: 2887932 - RNA, 19 nt, Mycobacterium avium subsp. paratuberculosis
gcgcagcgcgucgucgguc

SEQ ID NO: 2887933 - RNA, 13 nt, Mycobacterium avium subsp. paratuberculosis
gcgcagcggcccg

SEQ ID NO: 2887934 - RNA, 20 nt, Mycobacterium avium subsp. paratuberculosis
gcgcagcggggaggcccagc

SEQ ID NO: 2887935 - RNA, 21 nt, Mycobacterium avium subsp. paratuberculosis
gcgcagcggggaggcccagcc

SEQ ID NO: 2887936 - RNA, 16 nt, Mycobacterium avium subsp. paratuberculosis
gcgcagcggggcgcgc

SEQ ID NO: 2887937 - RNA, 20 nt, Mycobacterium avium subsp. paratuberculosis
gcgcagcggggcgcgcaggc

SEQ ID NO: 2887938 - RNA, 15 nt, Mycobacterium avium subsp. paratuberculosis
gcgcagcgucggcgu

SEQ ID NO: 2887939 - RNA, 21 nt, Mycobacterium avium subsp. paratuberculosis
gcgcagcgucggcgugcccgc

SEQ ID NO: 2887940 - RNA, 23 nt, Mycobacterium avium subsp. paratuberculosis
gcgcagcgucggcgugcccgccg

SEQ ID NO: 2887941 - RNA, 16 nt, Mycobacterium avium subsp. paratuberculosis
gcgcagcgucucccgg

SEQ ID NO: 2887942 - RNA, 22 nt, Mycobacterium avium subsp. paratuberculosis
gcgcagcgucuccucgaccgcc

SEQ ID NO: 2887943 - RNA, 14 nt, Mycobacterium avium subsp. paratuberculosis
gcgcagcgucucga

SEQ ID NO: 2887944 - RNA, 21 nt, Mycobacterium avium subsp. paratuberculosis
gcgcagcgucucgaucgacga

SEQ ID NO: 2887945 - RNA, 22 nt, Mycobacterium avium subsp. paratuberculosis
gcgcagcgucucgaucgacgac

SEQ ID NO: 2887946 - RNA, 19 nt, Mycobacterium avium subsp. paratuberculosis
gcgcagcgucuugcccagc

SEQ ID NO: 2887947 - RNA, 20 nt, Mycobacterium avium subsp. paratuberculosis
gcgcagcgucuugcccagcg

SEQ ID NO: 2887948 - RNA, 17 nt, Mycobacterium avium subsp. paratuberculosis
gcgcagcgugucggggu

SEQ ID NO: 2887949 - RNA, 13 nt, Mycobacterium avium subsp. paratuberculosis
gcgcagcucgacg

SEQ ID NO: 2887950 - RNA, 23 nt, Mycobacterium avium subsp. paratuberculosis
gcgcagcucgacgaccucgccga

SEQ ID NO: 2887951 - RNA, 24 nt, Mycobacterium avium subsp. paratuberculosis
gcgcagcucgacgaccucgccgac

SEQ ID NO: 2887952 - RNA, 16 nt, Mycobacterium avium subsp. paratuberculosis
gcgcagcucgcgcagc

SEQ ID NO: 2887953 - RNA, 18 nt, Mycobacterium avium subsp. paratuberculosis
gcgcagcucgcgcagccg

SEQ ID NO: 2887954 - RNA, 19 nt, Mycobacterium avium subsp. paratuberculosis
gcgcagcucgcgcagccgg

SEQ ID NO: 2887955 - RNA, 20 nt, Mycobacterium avium subsp. paratuberculosis
gcgcagcucgcgcagccggc

SEQ ID NO: 2887956 - RNA, 21 nt, Mycobacterium avium subsp. paratuberculosis
gcgcagcucgcgcagccggcc

SEQ ID NO: 2887957 - RNA, 19 nt, Mycobacterium avium subsp. paratuberculosis
gcgcagcucgcgcagcugg

SEQ ID NO: 2887958 - RNA, 22 nt, Mycobacterium avium subsp. paratuberculosis
gcgcagcucgcgcagcuggccg

SEQ ID NO: 2887959 - RNA, 21 nt, Mycobacterium avium subsp. paratuberculosis
gcgcagcucggggucggcguc

SEQ ID NO: 2887960 - RNA, 20 nt, Mycobacterium avium subsp. paratuberculosis
gcgcagcucuaugcccuuga

SEQ ID NO: 2887961 - RNA, 17 nt, Mycobacterium avium subsp. paratuberculosis
gcgcagcugcagcuccu

SEQ ID NO: 2887962 - RNA, 17 nt, Mycobacterium avium subsp. paratuberculosis
gcgcagcugcgccgcgu

SEQ ID NO: 2887963 - RNA, 22 nt, Mycobacterium avium subsp. paratuberculosis
gcgcagcugcgccgcgucgacg

SEQ ID NO: 2887964 - RNA, 23 nt, Mycobacterium avium subsp. paratuberculosis
gcgcagcugcgccgcgucgacgc

SEQ ID NO: 2887965 - RNA, 13 nt, Mycobacterium avium subsp. paratuberculosis
gcgcagcuggccg

SEQ ID NO: 2887966 - RNA, 17 nt, Mycobacterium avium subsp. paratuberculosis
gcgcagcuggccgugca

SEQ ID NO: 2887967 - RNA, 20 nt, Mycobacterium avium subsp. paratuberculosis
gcgcagcuggccgugcaccg

SEQ ID NO: 2887968 - RNA, 12 nt, Mycobacterium avium subsp. paratuberculosis
gcgcagcuggga

SEQ ID NO: 2887969 - RNA, 14 nt, Mycobacterium avium subsp. paratuberculosis
gcgcagcugggaga

SEQ ID NO: 2887970 - RNA, 15 nt, Mycobacterium avium subsp. paratuberculosis
gcgcaggaacagcga

SEQ ID NO: 2887971 - RNA, 19 nt, Mycobacterium avium subsp. paratuberculosis
gcgcaggaacuccagcagc

SEQ ID NO: 2887972 - RNA, 20 nt, Mycobacterium avium subsp. paratuberculosis
gcgcaggaugcccagcacca

SEQ ID NO: 2887973 - RNA, 21 nt, Mycobacterium avium subsp. paratuberculosis
gcgcaggaugcccagcaccac

SEQ ID NO: 2887974 - RNA, 15 nt, Mycobacterium avium subsp. paratuberculosis
gcgcaggccccggcg

SEQ ID NO: 2887975 - RNA, 17 nt, Mycobacterium avium subsp. paratuberculosis
gcgcaggccccggcgcg

SEQ ID NO: 2887976 - RNA, 18 nt, Mycobacterium avium subsp. paratuberculosis
gcgcaggccccggcgcgc

SEQ ID NO: 2887977 - RNA, 15 nt, Mycobacterium avium subsp. paratuberculosis
gcgcaggccccgggg

SEQ ID NO: 2887978 - RNA, 14 nt, Mycobacterium avium subsp. paratuberculosis
gcgcaggccgccga

SEQ ID NO: 2887979 - RNA, 16 nt, Mycobacterium avium subsp. paratuberculosis
gcgcaggccgccgacg

SEQ ID NO: 2887980 - RNA, 20 nt, Mycobacterium avium subsp. paratuberculosis
gcgcaggccgccgacgacgg

SEQ ID NO: 2887981 - RNA, 15 nt, Mycobacterium avium subsp. paratuberculosis
gcgcaggccggucac

SEQ ID NO: 2887982 - RNA, 14 nt, Mycobacterium avium subsp. paratuberculosis
gcgcaggcgcgcac

SEQ ID NO: 2887983 - RNA, 16 nt, Mycobacterium avium subsp. paratuberculosis
gcgcaggcgcgcacca

SEQ ID NO: 2887984 - RNA, 17 nt, Mycobacterium avium subsp. paratuberculosis
gcgcaggcgcgcaccau

SEQ ID NO: 2887985 - RNA, 14 nt, Mycobacterium avium subsp. paratuberculosis
gcgcaggcgcgcgg

SEQ ID NO: 2887986 - RNA, 17 nt, Mycobacterium avium subsp. paratuberculosis
gcgcaggcgcgcggcca

SEQ ID NO: 2887987 - RNA, 16 nt, Mycobacterium avium subsp. paratuberculosis
gcgcaggcgcugagcg

SEQ ID NO: 2887988 - RNA, 22 nt, Mycobacterium avium subsp. paratuberculosis
gcgcaggcgcugagcggguaac

SEQ ID NO: 2887989 - RNA, 13 nt, Mycobacterium avium subsp. paratuberculosis
gcgcaggcggcga

SEQ ID NO: 2887990 - RNA, 22 nt, Mycobacterium avium subsp. paratuberculosis
gcgcaggcggcgcgcagccggc

SEQ ID NO: 2887991 - RNA, 23 nt, Mycobacterium avium subsp. paratuberculosis
gcgcaggcggcgcgcagccggcc

SEQ ID NO: 2887992 - RNA, 19 nt, Mycobacterium avium subsp. paratuberculosis
gcgcaggcuggcaucgucg

SEQ ID NO: 2887993 - RNA, 22 nt, Mycobacterium avium subsp. paratuberculosis
gcgcaggcuggcaucgucggcg

SEQ ID NO: 2887994 - RNA, 17 nt, Mycobacterium avium subsp. paratuberculosis
gcgcagggacgggcgug

SEQ ID NO: 2887995 - RNA, 21 nt, Mycobacterium avium subsp. paratuberculosis
gcgcagggacgggcgugacgg

SEQ ID NO: 2887996 - RNA, 22 nt, Mycobacterium avium subsp. paratuberculosis
gcgcagggacgggcgugacgga

SEQ ID NO: 2887997 - RNA, 20 nt, Mycobacterium avium subsp. paratuberculosis
gcgcagggccagcgccucgg

SEQ ID NO: 2887998 - RNA, 22 nt, Mycobacterium avium subsp. paratuberculosis
gcgcagggccagcgccucggcg

SEQ ID NO: 2887999 - RNA, 23 nt, Mycobacterium avium subsp. paratuberculosis
gcgcagggccagcgccucggcgu

SEQ ID NO: 2888000 - RNA, 17 nt, Mycobacterium avium subsp. paratuberculosis
gcgcagggcgaacggcg

SEQ ID NO: 2888001 - RNA, 14 nt, Mycobacterium avium subsp. paratuberculosis
gcgcagggcggccg

SEQ ID NO: 2888002 - RNA, 16 nt, Mycobacterium avium subsp. paratuberculosis
gcgcagggucagcgcu

SEQ ID NO: 2888003 - RNA, 19 nt, Mycobacterium avium subsp. paratuberculosis
gcgcagguacgcggcguug

SEQ ID NO: 2888004 - RNA, 17 nt, Mycobacterium avium subsp. paratuberculosis
gcgcagguagccgccgu

SEQ ID NO: 2888005 - RNA, 16 nt, Mycobacterium avium subsp. paratuberculosis
gcgggcccgucgccgg

SEQ ID NO: 2888006 - RNA, 18 nt, Mycobacterium avium subsp. paratuberculosis
gcgggcccgucgccggcg

SEQ ID NO: 2888007 - RNA, 21 nt, Mycobacterium avium subsp. paratuberculosis
gcgggcccgucgccggcgcgc

SEQ ID NO: 2888008 - RNA, 22 nt, Mycobacterium avium subsp. paratuberculosis
gcgggcccgucgccggcgcgca

SEQ ID NO: 2888009 - RNA, 23 nt, Mycobacterium avium subsp. paratuberculosis
gcgggccgaaccggaagaucagc

SEQ ID NO: 2888010 - RNA, 21 nt, Mycobacterium avium subsp. paratuberculosis
gcgggccgaagaccgggccga

SEQ ID NO: 2888011 - RNA, 18 nt, Mycobacterium avium subsp. paratuberculosis
gcgggccgacagcacgcc

SEQ ID NO: 2888012 - RNA, 23 nt, Mycobacterium avium subsp. paratuberculosis
gcgggccgacagcacgccgggca

SEQ ID NO: 2888013 - RNA, 15 nt, Mycobacterium avium subsp. paratuberculosis
gcgggccgacccggc

SEQ ID NO: 2888014 - RNA, 14 nt, Mycobacterium avium subsp. paratuberculosis
gcgggccgaccguc

SEQ ID NO: 2888015 - RNA, 16 nt, Mycobacterium avium subsp. paratuberculosis
gcgggccgagcguucg

SEQ ID NO: 2888016 - RNA, 22 nt, Mycobacterium avium subsp. paratuberculosis
gcgggccgagcguucggcgcgg

SEQ ID NO: 2888017 - RNA, 18 nt, Mycobacterium avium subsp. paratuberculosis
gcgggccgaucagugccg

SEQ ID NO: 2888018 - RNA, 23 nt, Mycobacterium avium subsp. paratuberculosis
gcgggccgcaauacggugcccgc

SEQ ID NO: 2888019 - RNA, 14 nt, Mycobacterium avium subsp. paratuberculosis
gcgggccgcagcgc

SEQ ID NO: 2888020 - RNA, 17 nt, Mycobacterium avium subsp. paratuberculosis
gcgggccgcagcgcgcg

SEQ ID NO: 2888021 - RNA, 14 nt, Mycobacterium avium subsp. paratuberculosis
gcgggccgccaggu

SEQ ID NO: 2888022 - RNA, 14 nt, Mycobacterium avium subsp. paratuberculosis
gcgggccgcccggc

SEQ ID NO: 2888023 - RNA, 15 nt, Mycobacterium avium subsp. paratuberculosis
gcgggccgcccggcg

SEQ ID NO: 2888024 - RNA, 12 nt, Mycobacterium avium subsp. paratuberculosis
gcgggccgccgg

SEQ ID NO: 2888025 - RNA, 15 nt, Mycobacterium avium subsp. paratuberculosis
gcgggccgccgggug

SEQ ID NO: 2888026 - RNA, 18 nt, Mycobacterium avium subsp. paratuberculosis
gcgggccgcuucgaggug

SEQ ID NO: 2888027 - RNA, 20 nt, Mycobacterium avium subsp. paratuberculosis
gcgggccgcuucgaggugca

SEQ ID NO: 2888028 - RNA, 15 nt, Mycobacterium avium subsp. paratuberculosis
gcgggccggagccuu

SEQ ID NO: 2888029 - RNA, 16 nt, Mycobacterium avium subsp. paratuberculosis
gcgggccggcacccgg

SEQ ID NO: 2888030 - RNA, 14 nt, Mycobacterium avium subsp. paratuberculosis
gcgggccggcgccg

SEQ ID NO: 2888031 - RNA, 16 nt, Mycobacterium avium subsp. paratuberculosis
gcgggccggcgccggu

SEQ ID NO: 2888032 - RNA, 17 nt, Mycobacterium avium subsp. paratuberculosis
gcgggccggcgccggug

SEQ ID NO: 2888033 - RNA, 15 nt, Mycobacterium avium subsp. paratuberculosis
gcgggccggcgucgu

SEQ ID NO: 2888034 - RNA, 18 nt, Mycobacterium avium subsp. paratuberculosis
gcgggccgguccccggcg

SEQ ID NO: 2888035 - RNA, 18 nt, Mycobacterium avium subsp. paratuberculosis
gcgggccguggcaccggg

SEQ ID NO: 2888036 - RNA, 19 nt, Mycobacterium avium subsp. paratuberculosis
gcgggccguugccgguccc

SEQ ID NO: 2888037 - RNA, 23 nt, Mycobacterium avium subsp. paratuberculosis
gcgggccuaggaccccggcugcu

SEQ ID NO: 2888038 - RNA, 16 nt, Mycobacterium avium subsp. paratuberculosis
gcgggccucgccgcuu

SEQ ID NO: 2888039 - RNA, 18 nt, Mycobacterium avium subsp. paratuberculosis
gcgggccucgccgcuucg

SEQ ID NO: 2888040 - RNA, 14 nt, Mycobacterium avium subsp. paratuberculosis
gcgggccugcucgu

SEQ ID NO: 2888041 - RNA, 15 nt, Mycobacterium avium subsp. paratuberculosis
gcgggccugcucguc

SEQ ID NO: 2888042 - RNA, 17 nt, Mycobacterium avium subsp. paratuberculosis
gcgggccugcucgucgg

SEQ ID NO: 2888043 - RNA, 23 nt, Mycobacterium avium subsp. paratuberculosis
gcgggccugggcaauggccgcga

SEQ ID NO: 2888044 - RNA, 19 nt, Mycobacterium avium subsp. paratuberculosis
gcgggccuucuucucgacg

SEQ ID NO: 2888045 - RNA, 19 nt, Mycobacterium avium subsp. paratuberculosis
gcgggccuugagcaccgcg

SEQ ID NO: 2888046 - RNA, 20 nt, Mycobacterium avium subsp. paratuberculosis
gcgggccuugagcaccgcgu

SEQ ID NO: 2888047 - RNA, 17 nt, Mycobacterium avium subsp. paratuberculosis
gcgggccuuggcgaggu

SEQ ID NO: 2888048 - RNA, 18 nt, Mycobacterium avium subsp. paratuberculosis
gcgggcgaaaucucgaag

SEQ ID NO: 2888049 - RNA, 17 nt, Mycobacterium avium subsp. paratuberculosis
gcgggcgaacgaccggg

SEQ ID NO: 2888050 - RNA, 18 nt, Mycobacterium avium subsp. paratuberculosis
gcgggcggggcccgggcc

SEQ ID NO: 2888051 - RNA, 13 nt, Mycobacterium avium subsp. paratuberculosis
gcgggcggggccu

SEQ ID NO: 2888052 - RNA, 15 nt, Mycobacterium avium subsp. paratuberculosis
gcgggcggggccugc

SEQ ID NO: 2888053 - RNA, 17 nt, Mycobacterium avium subsp. paratuberculosis
gcgggcggggccugcgg

SEQ ID NO: 2888054 - RNA, 12 nt, Mycobacterium avium subsp. paratuberculosis
gcgggcggggcg

SEQ ID NO: 2888055 - RNA, 21 nt, Mycobacterium avium subsp. paratuberculosis
gcgggcgggggaucggcggga

SEQ ID NO: 2888056 - RNA, 23 nt, Mycobacterium avium subsp. paratuberculosis
gcgggcgggggaucggcgggacc

SEQ ID NO: 2888057 - RNA, 18 nt, Mycobacterium avium subsp. paratuberculosis
gcgggcggucgcgcagcc

SEQ ID NO: 2888058 - RNA, 14 nt, Mycobacterium avium subsp. paratuberculosis
gcgggcguccacga

SEQ ID NO: 2888059 - RNA, 17 nt, Mycobacterium avium subsp. paratuberculosis
gcgggcguccacgaaac

SEQ ID NO: 2888060 - RNA, 17 nt, Mycobacterium avium subsp. paratuberculosis
gcgggcguccucgucgg

SEQ ID NO: 2888061 - RNA, 20 nt, Mycobacterium avium subsp. paratuberculosis
gcgggcguccucgucggcga

SEQ ID NO: 2888062 - RNA, 15 nt, Mycobacterium avium subsp. paratuberculosis
gcgggcguccugcgg

SEQ ID NO: 2888063 - RNA, 16 nt, Mycobacterium avium subsp. paratuberculosis
gcgggcguccugcggg

SEQ ID NO: 2888064 - RNA, 17 nt, Mycobacterium avium subsp. paratuberculosis
gcgggcguccugcgggg

SEQ ID NO: 2888065 - RNA, 20 nt, Mycobacterium avium subsp. paratuberculosis
gcgggcgugccgaacggcgc

SEQ ID NO: 2888066 - RNA, 13 nt, Mycobacterium avium subsp. paratuberculosis
gcgggcgugcggu

SEQ ID NO: 2888067 - RNA, 18 nt, Mycobacterium avium subsp. paratuberculosis
gcgggcguggcggucggu

SEQ ID NO: 2888068 - RNA, 18 nt, Mycobacterium avium subsp. paratuberculosis
gcgggcguucaucaccug

SEQ ID NO: 2888069 - RNA, 23 nt, Mycobacterium avium subsp. paratuberculosis
gcgggcguucaucaccuggucgg

SEQ ID NO: 2888070 - RNA, 16 nt, Mycobacterium avium subsp. paratuberculosis
gcgggcguuggcuucc

SEQ ID NO: 2888071 - RNA, 15 nt, Mycobacterium avium subsp. paratuberculosis
gcgggcuaggcucgg

SEQ ID NO: 2888072 - RNA, 18 nt, Mycobacterium avium subsp. paratuberculosis
gcgggcuaggcucggcag

SEQ ID NO: 2888073 - RNA, 20 nt, Mycobacterium avium subsp. paratuberculosis
gcgggcuaggcucggcagcc

SEQ ID NO: 2888074 - RNA, 23 nt, Mycobacterium avium subsp. paratuberculosis
gcgggcuaggcucggcagccggc

SEQ ID NO: 2888075 - RNA, 15 nt, Mycobacterium avium subsp. paratuberculosis
gcgggcucccgcucg

SEQ ID NO: 2888076 - RNA, 17 nt, Mycobacterium avium subsp. paratuberculosis
gcgggcucccucgucgc

SEQ ID NO: 2888077 - RNA, 20 nt, Mycobacterium avium subsp. paratuberculosis
gcgggcuccgcacgaccuga

SEQ ID NO: 2888078 - RNA, 23 nt, Mycobacterium avium subsp. paratuberculosis
gcgggcucgaacaacccggccgc

SEQ ID NO: 2888079 - RNA, 13 nt, Mycobacterium avium subsp. paratuberculosis
gcgggcucgagcc

SEQ ID NO: 2888080 - RNA, 17 nt, Mycobacterium avium subsp. paratuberculosis
gcgggcucgagccccag

SEQ ID NO: 2888081 - RNA, 12 nt, Mycobacterium avium subsp. paratuberculosis
gcgggcucgccg

SEQ ID NO: 2888082 - RNA, 18 nt, Mycobacterium avium subsp. paratuberculosis
gcgggcucgccggcccga

SEQ ID NO: 2888083 - RNA, 19 nt, Mycobacterium avium subsp. paratuberculosis
gcgggcucgccggcccgac

SEQ ID NO: 2888084 - RNA, 15 nt, Mycobacterium avium subsp. paratuberculosis
gcgggcucgcgcugg

SEQ ID NO: 2888085 - RNA, 17 nt, Mycobacterium avium subsp. paratuberculosis
gcgggcucgcgcuggcg

SEQ ID NO: 2888086 - RNA, 20 nt, Mycobacterium avium subsp. paratuberculosis
gcgggcucgcggccugcggg

SEQ ID NO: 2888087 - RNA, 14 nt, Mycobacterium avium subsp. paratuberculosis
gcgggcucggacga

SEQ ID NO: 2888088 - RNA, 19 nt, Mycobacterium avium subsp. paratuberculosis
gcgggcucggaguugcgca

SEQ ID NO: 2888089 - RNA, 15 nt, Mycobacterium avium subsp. paratuberculosis
gcgggcugacgucga

SEQ ID NO: 2888090 - RNA, 18 nt, Mycobacterium avium subsp. paratuberculosis
gcgggcugcaccagggcg

SEQ ID NO: 2888091 - RNA, 22 nt, Mycobacterium avium subsp. paratuberculosis
gcgggcugcaccagggcgucga

SEQ ID NO: 2888092 - RNA, 14 nt, Mycobacterium avium subsp. paratuberculosis
gcgggcugcagcga

SEQ ID NO: 2888093 - RNA, 16 nt, Mycobacterium avium subsp. paratuberculosis
gcgggcugcagggccg

SEQ ID NO: 2888094 - RNA, 17 nt, Mycobacterium avium subsp. paratuberculosis
gcgggcugcagggccgg

SEQ ID NO: 2888095 - RNA, 13 nt, Mycobacterium avium subsp. paratuberculosis
gcgggcugcggcg

SEQ ID NO: 2888096 - RNA, 14 nt, Mycobacterium avium subsp. paratuberculosis
gcgggcugcggcga

SEQ ID NO: 2888097 - RNA, 20 nt, Mycobacterium avium subsp. paratuberculosis
gcgggcuggaguggucaggc

SEQ ID NO: 2888098 - RNA, 12 nt, Mycobacterium avium subsp. paratuberculosis
gcgggcuggcgu

SEQ ID NO: 2888099 - RNA, 16 nt, Mycobacterium avium subsp. paratuberculosis
gcgggcuggugcgcag

SEQ ID NO: 2888100 - RNA, 21 nt, Mycobacterium avium subsp. paratuberculosis
gcgggcuggugcgcagccguc

SEQ ID NO: 2888101 - RNA, 24 nt, Mycobacterium avium subsp. paratuberculosis
gcgggcuggugcgcagccgucgca

SEQ ID NO: 2888102 - RNA, 19 nt, Mycobacterium avium subsp. paratuberculosis
gcgggcuguccgcguggcc

SEQ ID NO: 2888103 - RNA, 16 nt, Mycobacterium avium subsp. paratuberculosis
gcgggcugucggcgcc

SEQ ID NO: 2888104 - RNA, 17 nt, Mycobacterium avium subsp. paratuberculosis
gcgggcugugccggcgg

SEQ ID NO: 2888105 - RNA, 19 nt, Mycobacterium avium subsp. paratuberculosis
gcggggaaggugcgggcgg

SEQ ID NO: 2888106 - RNA, 20 nt, Mycobacterium avium subsp. paratuberculosis
gcggggaaguaguaccccgg

SEQ ID NO: 2888107 - RNA, 21 nt, Mycobacterium avium subsp. paratuberculosis
gcggggacagugcgggcucga

SEQ ID NO: 2888108 - RNA, 18 nt, Mycobacterium avium subsp. paratuberculosis
gcggggaggcccagcccg

SEQ ID NO: 2888109 - RNA, 23 nt, Mycobacterium avium subsp. paratuberculosis
gcggggaggcccagcccgccgcg

SEQ ID NO: 2888110 - RNA, 21 nt, Mycobacterium avium subsp. paratuberculosis
gcggggaggucgucgcgucca

SEQ ID NO: 2888111 - RNA, 13 nt, Mycobacterium avium subsp. paratuberculosis
gcggggcagcagu

SEQ ID NO: 2888112 - RNA, 15 nt, Mycobacterium avium subsp. paratuberculosis
gcggggccaccaggc

SEQ ID NO: 2888113 - RNA, 16 nt, Mycobacterium avium subsp. paratuberculosis
gcggggccaccaggcg

SEQ ID NO: 2888114 - RNA, 23 nt, Mycobacterium avium subsp. paratuberculosis
gcggggccaccaggcgccgucga

SEQ ID NO: 2888115 - RNA, 12 nt, Mycobacterium avium subsp. paratuberculosis
gcggggcccggg

SEQ ID NO: 2888116 - RNA, 19 nt, Mycobacterium avium subsp. paratuberculosis
gcggggcccgggccggagg

SEQ ID NO: 2888117 - RNA, 15 nt, Mycobacterium avium subsp. paratuberculosis
gcggggccgcggccg

SEQ ID NO: 2888118 - RNA, 17 nt, Mycobacterium avium subsp. paratuberculosis
gcggggccgcggccggc

SEQ ID NO: 2888119 - RNA, 12 nt, Mycobacterium avium subsp. paratuberculosis
gcggggccggcg

SEQ ID NO: 2888120 - RNA, 15 nt, Mycobacterium avium subsp. paratuberculosis
gcggggccggcgcgg

SEQ ID NO: 2888121 - RNA, 17 nt, Mycobacterium avium subsp. paratuberculosis
gcggggccggcgcggug

SEQ ID NO: 2888122 - RNA, 20 nt, Mycobacterium avium subsp. paratuberculosis
gcggggccggcgcggugggc

SEQ ID NO: 2888123 - RNA, 14 nt, Mycobacterium avium subsp. paratuberculosis
gcggggccggcgcu

SEQ ID NO: 2888124 - RNA, 17 nt, Mycobacterium avium subsp. paratuberculosis
gcggggccuccaccagc

SEQ ID NO: 2888125 - RNA, 20 nt, Mycobacterium avium subsp. paratuberculosis
gcggggccucgucgccgcgg

SEQ ID NO: 2888126 - RNA, 16 nt, Mycobacterium avium subsp. paratuberculosis
gcggggccugcgggac

SEQ ID NO: 2888127 - RNA, 17 nt, Mycobacterium avium subsp. paratuberculosis
gcggggcgaacccggcg

SEQ ID NO: 2888128 - RNA, 15 nt, Mycobacterium avium subsp. paratuberculosis
gcggggcgaccuugc

SEQ ID NO: 2888129 - RNA, 21 nt, Mycobacterium avium subsp. paratuberculosis
gcggggcgaccuugcgcagcc

SEQ ID NO: 2888130 - RNA, 14 nt, Mycobacterium avium subsp. paratuberculosis
gcggggcgagcugg

SEQ ID NO: 2888131 - RNA, 14 nt, Mycobacterium avium subsp. paratuberculosis
gcggggcgaguuca

SEQ ID NO: 2888132 - RNA, 21 nt, Mycobacterium avium subsp. paratuberculosis
gcggggcgccgacagucgcgg

SEQ ID NO: 2888133 - RNA, 16 nt, Mycobacterium avium subsp. paratuberculosis
gcggggcgcgaggcgc

SEQ ID NO: 2888134 - RNA, 17 nt, Mycobacterium avium subsp. paratuberculosis
gcggggcgcgaggcgcg

SEQ ID NO: 2888135 - RNA, 13 nt, Mycobacterium avium subsp. paratuberculosis
gcgggucgcgcgg

SEQ ID NO: 2888136 - RNA, 15 nt, Mycobacterium avium subsp. paratuberculosis
gcgggucgcgcggcu

SEQ ID NO: 2888137 - RNA, 15 nt, Mycobacterium avium subsp. paratuberculosis
gcgggucgcgcugcg

SEQ ID NO: 2888138 - RNA, 18 nt, Mycobacterium avium subsp. paratuberculosis
gcgggucgcgcugcggga

SEQ ID NO: 2888139 - RNA, 18 nt, Mycobacterium avium subsp. paratuberculosis
gcgggucgcuggccgcga

SEQ ID NO: 2888140 - RNA, 13 nt, Mycobacterium avium subsp. paratuberculosis
gcgggucggccgg

SEQ ID NO: 2888141 - RNA, 15 nt, Mycobacterium avium subsp. paratuberculosis
gcgggucggccggcg

SEQ ID NO: 2888142 - RNA, 16 nt, Mycobacterium avium subsp. paratuberculosis
gcgggucggccggcgg

SEQ ID NO: 2888143 - RNA, 15 nt, Mycobacterium avium subsp. paratuberculosis
gcgggucggcgacgg

SEQ ID NO: 2888144 - RNA, 17 nt, Mycobacterium avium subsp. paratuberculosis
gcgggucggcgacggcg

SEQ ID NO: 2888145 - RNA, 13 nt, Mycobacterium avium subsp. paratuberculosis
gcgggucggcgcc

SEQ ID NO: 2888146 - RNA, 16 nt, Mycobacterium avium subsp. paratuberculosis
gcgggucggcgccggc

SEQ ID NO: 2888147 - RNA, 17 nt, Mycobacterium avium subsp. paratuberculosis
gcgggucggcgccggcc

SEQ ID NO: 2888148 - RNA, 17 nt, Mycobacterium avium subsp. paratuberculosis
gcgggucggcgucaccc

SEQ ID NO: 2888149 - RNA, 14 nt, Mycobacterium avium subsp. paratuberculosis
gcgggucggugggc

SEQ ID NO: 2888150 - RNA, 17 nt, Mycobacterium avium subsp. paratuberculosis
gcgggucggugggcagc

SEQ ID NO: 2888151 - RNA, 14 nt, Mycobacterium avium subsp. paratuberculosis
gcgggucgguggug

SEQ ID NO: 2888152 - RNA, 15 nt, Mycobacterium avium subsp. paratuberculosis
gcgggucggugguga

SEQ ID NO: 2888153 - RNA, 20 nt, Mycobacterium avium subsp. paratuberculosis
gcgggucgguggugaucgcg

SEQ ID NO: 2888154 - RNA, 21 nt, Mycobacterium avium subsp. paratuberculosis
gcgggucgguggugaucgcgg

SEQ ID NO: 2888155 - RNA, 12 nt, Mycobacterium avium subsp. paratuberculosis
gcgggucgucga

SEQ ID NO: 2888156 - RNA, 15 nt, Mycobacterium avium subsp. paratuberculosis
gcgggucgucgacgu

SEQ ID NO: 2888157 - RNA, 16 nt, Mycobacterium avium subsp. paratuberculosis
gcgggucgucgacguc

SEQ ID NO: 2888158 - RNA, 17 nt, Mycobacterium avium subsp. paratuberculosis
gcgggucgucgacgucg

SEQ ID NO: 2888159 - RNA, 17 nt, Mycobacterium avium subsp. paratuberculosis
gcgggucgucgaugccc

SEQ ID NO: 2888160 - RNA, 18 nt, Mycobacterium avium subsp. paratuberculosis
gcgggucgucgggccggg

SEQ ID NO: 2888161 - RNA, 23 nt, Mycobacterium avium subsp. paratuberculosis
gcgggucgugcaucggcgccugc

SEQ ID NO: 2888162 - RNA, 17 nt, Mycobacterium avium subsp. paratuberculosis
gcgggucguuggcggcg

SEQ ID NO: 2888163 - RNA, 22 nt, Mycobacterium avium subsp. paratuberculosis
gcgggucguuggcggcgguggg

SEQ ID NO: 2888164 - RNA, 21 nt, Mycobacterium avium subsp. paratuberculosis
gcgggucguuuggugguggcg

SEQ ID NO: 2888165 - RNA, 14 nt, Mycobacterium avium subsp. paratuberculosis
gcgggucucgaacc

SEQ ID NO: 2888166 - RNA, 17 nt, Mycobacterium avium subsp. paratuberculosis
gcgggucucgaaccggg

SEQ ID NO: 2888167 - RNA, 18 nt, Mycobacterium avium subsp. paratuberculosis
gcgggucucgaaccgggc

SEQ ID NO: 2888168 - RNA, 19 nt, Mycobacterium avium subsp. paratuberculosis
gcgggucucgaaccgggcg

SEQ ID NO: 2888169 - RNA, 20 nt, Mycobacterium avium subsp. paratuberculosis
gcgggucucgaaccgggcgg

SEQ ID NO: 2888170 - RNA, 13 nt, Mycobacterium avium subsp. paratuberculosis
gcgggucucgccc

SEQ ID NO: 2888171 - RNA, 16 nt, Mycobacterium avium subsp. paratuberculosis
gcgggucucgcccacc

SEQ ID NO: 2888172 - RNA, 14 nt, Mycobacterium avium subsp. paratuberculosis
gcgggucuggcucg

SEQ ID NO: 2888173 - RNA, 21 nt, Mycobacterium avium subsp. paratuberculosis
gcgggucuggcucggcaccag

SEQ ID NO: 2888174 - RNA, 17 nt, Mycobacterium avium subsp. paratuberculosis
gcgggucugugaccacg

SEQ ID NO: 2888175 - RNA, 20 nt, Mycobacterium avium subsp. paratuberculosis
gcgggugaagaucacguuca

SEQ ID NO: 2888176 - RNA, 19 nt, Mycobacterium avium subsp. paratuberculosis
gcgggugaaucgacaccgc

SEQ ID NO: 2888177 - RNA, 22 nt, Mycobacterium avium subsp. paratuberculosis
gcgggugaaucgacaccgcacg

SEQ ID NO: 2888178 - RNA, 17 nt, Mycobacterium avium subsp. paratuberculosis
gcgggugaccgacagca

SEQ ID NO: 2888179 - RNA, 20 nt, Mycobacterium avium subsp. paratuberculosis
gcgggugaccggcgccgggu

SEQ ID NO: 2888180 - RNA, 21 nt, Mycobacterium avium subsp. paratuberculosis
gcgggugaccggcgccggguc

SEQ ID NO: 2888181 - RNA, 14 nt, Mycobacterium avium subsp. paratuberculosis
gcgggugacgauca

SEQ ID NO: 2888182 - RNA, 16 nt, Mycobacterium avium subsp. paratuberculosis
gcgggugacgaucugg

SEQ ID NO: 2888183 - RNA, 24 nt, Mycobacterium avium subsp. paratuberculosis
gcgggugagaaagucgaucuggcg

SEQ ID NO: 2888184 - RNA, 14 nt, Mycobacterium avium subsp. paratuberculosis
gcgggugagccggu

SEQ ID NO: 2888185 - RNA, 17 nt, Mycobacterium avium subsp. paratuberculosis
gcgggugagccggucga

SEQ ID NO: 2888186 - RNA, 19 nt, Mycobacterium avium subsp. paratuberculosis
gcgggugaggacgcccggc

SEQ ID NO: 2888187 - RNA, 17 nt, Mycobacterium avium subsp. paratuberculosis
gcgggugaggccaggcg

SEQ ID NO: 2888188 - RNA, 16 nt, Mycobacterium avium subsp. paratuberculosis
gcgggugaggggcgcg

SEQ ID NO: 2888189 - RNA, 17 nt, Mycobacterium avium subsp. paratuberculosis
gcgggugaggggcgcgc

SEQ ID NO: 2888190 - RNA, 19 nt, Mycobacterium avium subsp. paratuberculosis
gcgggugaggggcgcgcgc

SEQ ID NO: 2888191 - RNA, 22 nt, Mycobacterium avium subsp. paratuberculosis
gcgggugaggggcgcgcgccgg

SEQ ID NO: 2888192 - RNA, 18 nt, Mycobacterium avium subsp. paratuberculosis
gcgggugaguagccgaua

SEQ ID NO: 2888193 - RNA, 17 nt, Mycobacterium avium subsp. paratuberculosis
gcgggugauccagcccu

SEQ ID NO: 2888194 - RNA, 16 nt, Mycobacterium avium subsp. paratuberculosis
gcgggugaucugcgcc

SEQ ID NO: 2888195 - RNA, 22 nt, Mycobacterium avium subsp. paratuberculosis
gcgggugaucuuggccuccacc

SEQ ID NO: 2888196 - RNA, 22 nt, Mycobacterium avium subsp. paratuberculosis
gcgggugaugccguacauggug

SEQ ID NO: 2888197 - RNA, 16 nt, Mycobacterium avium subsp. paratuberculosis
gcgggugcagccggau

SEQ ID NO: 2888198 - RNA, 20 nt, Mycobacterium avium subsp. paratuberculosis
gcgggugcagccggaucucg

SEQ ID NO: 2888199 - RNA, 14 nt, Mycobacterium avium subsp. paratuberculosis
gcgggugccgaaca

SEQ ID NO: 2888200 - RNA, 13 nt, Mycobacterium avium subsp. paratuberculosis
gcgggugcgacgg

SEQ ID NO: 2888201 - RNA, 14 nt, Mycobacterium avium subsp. paratuberculosis
gcgggugcgacggc

SEQ ID NO: 2888202 - RNA, 16 nt, Mycobacterium avium subsp. paratuberculosis
gcgggugcgacggcaa

SEQ ID NO: 2888203 - RNA, 13 nt, Mycobacterium avium subsp. paratuberculosis
gcgggugcgcucg

SEQ ID NO: 2888204 - RNA, 17 nt, Mycobacterium avium subsp. paratuberculosis
gcgggugcgcucgacgg

SEQ ID NO: 2888205 - RNA, 19 nt, Mycobacterium avium subsp. paratuberculosis
gcgggugcgcucgacggcc

SEQ ID NO: 2888206 - RNA, 16 nt, Mycobacterium avium subsp. paratuberculosis
gcgggugcgcugcagc

SEQ ID NO: 2888207 - RNA, 17 nt, Mycobacterium avium subsp. paratuberculosis
gcgggugcggcacggca

SEQ ID NO: 2888208 - RNA, 15 nt, Mycobacterium avium subsp. paratuberculosis
gcgggugcggccagc

SEQ ID NO: 2888209 - RNA, 17 nt, Mycobacterium avium subsp. paratuberculosis
gcgggugcggccagcgc

SEQ ID NO: 2888210 - RNA, 13 nt, Mycobacterium avium subsp. paratuberculosis
gcgggugcggccc

SEQ ID NO: 2888211 - RNA, 14 nt, Mycobacterium avium subsp. paratuberculosis
gcgggugcggccca

SEQ ID NO: 2888212 - RNA, 14 nt, Mycobacterium avium subsp. paratuberculosis
gcgggugcggccgg

SEQ ID NO: 2888213 - RNA, 19 nt, Mycobacterium avium subsp. paratuberculosis
gcgggugcggccgguugcc

SEQ ID NO: 2888214 - RNA, 13 nt, Mycobacterium avium subsp. paratuberculosis
gcgggugcgggcg

SEQ ID NO: 2888215 - RNA, 17 nt, Mycobacterium avium subsp. paratuberculosis
gcgggugcgggcguccu

SEQ ID NO: 2888216 - RNA, 21 nt, Mycobacterium avium subsp. paratuberculosis
gcgggugcucagccuagccuu

SEQ ID NO: 2888217 - RNA, 15 nt, Mycobacterium avium subsp. paratuberculosis
gcgggugcugggcgg

SEQ ID NO: 2888218 - RNA, 18 nt, Mycobacterium avium subsp. paratuberculosis
gcgggugcugggcggauc

SEQ ID NO: 2888219 - RNA, 21 nt, Mycobacterium avium subsp. paratuberculosis
gcggguggaucuugacggcga

SEQ ID NO: 2888220 - RNA, 21 nt, Mycobacterium avium subsp. paratuberculosis
gcggucgcgcagccgccgggc

SEQ ID NO: 2888221 - RNA, 18 nt, Mycobacterium avium subsp. paratuberculosis
gcggucgcgcagccgggc

SEQ ID NO: 2888222 - RNA, 19 nt, Mycobacterium avium subsp. paratuberculosis
gcggucgcgcagccgggcg

SEQ ID NO: 2888223 - RNA, 22 nt, Mycobacterium avium subsp. paratuberculosis
gcggucgcgcagccgggcggcg

SEQ ID NO: 2888224 - RNA, 13 nt, Mycobacterium avium subsp. paratuberculosis
gcggucgcgccag

SEQ ID NO: 2888225 - RNA, 15 nt, Mycobacterium avium subsp. paratuberculosis
gcggucgcgccagac

SEQ ID NO: 2888226 - RNA, 16 nt, Mycobacterium avium subsp. paratuberculosis
gcggucgcgccagacg

SEQ ID NO: 2888227 - RNA, 20 nt, Mycobacterium avium subsp. paratuberculosis
gcggucgcgccagacgucca

SEQ ID NO: 2888228 - RNA, 15 nt, Mycobacterium avium subsp. paratuberculosis
gcggucgcgcgccgg

SEQ ID NO: 2888229 - RNA, 16 nt, Mycobacterium avium subsp. paratuberculosis
gcggucgcgcgccggc

SEQ ID NO: 2888230 - RNA, 20 nt, Mycobacterium avium subsp. paratuberculosis
gcggucgcgcgccggcgcag

SEQ ID NO: 2888231 - RNA, 21 nt, Mycobacterium avium subsp. paratuberculosis
gcggucgcgcgccggcgcagc

SEQ ID NO: 2888232 - RNA, 15 nt, Mycobacterium avium subsp. paratuberculosis
gcggucgcggaaccg

SEQ ID NO: 2888233 - RNA, 16 nt, Mycobacterium avium subsp. paratuberculosis
gcggucgcggaaccgg

SEQ ID NO: 2888234 - RNA, 20 nt, Mycobacterium avium subsp. paratuberculosis
gcggucgcggaaccggccgg

SEQ ID NO: 2888235 - RNA, 22 nt, Mycobacterium avium subsp. paratuberculosis
gcggucgcggaaccggccgggg

SEQ ID NO: 2888236 - RNA, 19 nt, Mycobacterium avium subsp. paratuberculosis
gcggucgcggcgccgguuu

SEQ ID NO: 2888237 - RNA, 17 nt, Mycobacterium avium subsp. paratuberculosis
gcggucgcggugcccag

SEQ ID NO: 2888238 - RNA, 17 nt, Mycobacterium avium subsp. paratuberculosis
gcggucgcgucgucggc

SEQ ID NO: 2888239 - RNA, 18 nt, Mycobacterium avium subsp. paratuberculosis
gcggucgcgucgucggcg

SEQ ID NO: 2888240 - RNA, 19 nt, Mycobacterium avium subsp. paratuberculosis
gcggucgcgucgucggcgg

SEQ ID NO: 2888241 - RNA, 22 nt, Mycobacterium avium subsp. paratuberculosis
gcggucgcugaccccgcucggc

SEQ ID NO: 2888242 - RNA, 19 nt, Mycobacterium avium subsp. paratuberculosis
gcggucgcugacccgccgc

SEQ ID NO: 2888243 - RNA, 14 nt, Mycobacterium avium subsp. paratuberculosis
gcggucgcugcagc

SEQ ID NO: 2888244 - RNA, 22 nt, Mycobacterium avium subsp. paratuberculosis
gcggucgcugcagcggcggcca

SEQ ID NO: 2888245 - RNA, 23 nt, Mycobacterium avium subsp. paratuberculosis
gcggucgcugcagcggcggccag

SEQ ID NO: 2888246 - RNA, 20 nt, Mycobacterium avium subsp. paratuberculosis
gcggucggaucgagcucgca

SEQ ID NO: 2888247 - RNA, 15 nt, Mycobacterium avium subsp. paratuberculosis
gcggucggcaacccg

SEQ ID NO: 2888248 - RNA, 17 nt, Mycobacterium avium subsp. paratuberculosis
gcggucggcaacccgac

SEQ ID NO: 2888249 - RNA, 18 nt, Mycobacterium avium subsp. paratuberculosis
gcggucggcaacccgacc

SEQ ID NO: 2888250 - RNA, 22 nt, Mycobacterium avium subsp. paratuberculosis
gcggucggcauagcgccgcucg

SEQ ID NO: 2888251 - RNA, 23 nt, Mycobacterium avium subsp. paratuberculosis
gcggucggcauagcgccgcucgg

SEQ ID NO: 2888252 - RNA, 11 nt, Mycobacterium avium subsp. paratuberculosis
gcggucggcgc

SEQ ID NO: 2888253 - RNA, 17 nt, Mycobacterium avium subsp. paratuberculosis
gcggucggcgcccggcc

SEQ ID NO: 2888254 - RNA, 20 nt, Mycobacterium avium subsp. paratuberculosis
gcggucggcgccgaucacgc

SEQ ID NO: 2888255 - RNA, 22 nt, Mycobacterium avium subsp. paratuberculosis
gcggucggcgccgaucacgccg

SEQ ID NO: 2888256 - RNA, 12 nt, Mycobacterium avium subsp. paratuberculosis
gcggucggcgcg

SEQ ID NO: 2888257 - RNA, 16 nt, Mycobacterium avium subsp. paratuberculosis
gcggucggcgcggggc

SEQ ID NO: 2888258 - RNA, 12 nt, Mycobacterium avium subsp. paratuberculosis
gcggucggcggc

SEQ ID NO: 2888259 - RNA, 14 nt, Mycobacterium avium subsp. paratuberculosis
gcggucggcggcgu

SEQ ID NO: 2888260 - RNA, 13 nt, Mycobacterium avium subsp. paratuberculosis
gcggucggcgguu

SEQ ID NO: 2888261 - RNA, 16 nt, Mycobacterium avium subsp. paratuberculosis
gcggucggcgucgcuc

SEQ ID NO: 2888262 - RNA, 22 nt, Mycobacterium avium subsp. paratuberculosis
gcggucggggaauuccggcgcg

SEQ ID NO: 2888263 - RNA, 23 nt, Mycobacterium avium subsp. paratuberculosis
gcggucggggaauuccggcgcga

SEQ ID NO: 2888264 - RNA, 13 nt, Mycobacterium avium subsp. paratuberculosis
gcggucgguggcg

SEQ ID NO: 2888265 - RNA, 19 nt, Mycobacterium avium subsp. paratuberculosis
gcggucgguggcggugccg

SEQ ID NO: 2888266 - RNA, 20 nt, Mycobacterium avium subsp. paratuberculosis
gcggucgguggcggugccgc

SEQ ID NO: 2888267 - RNA, 22 nt, Mycobacterium avium subsp. paratuberculosis
gcggucgguggcggugccgcgg

SEQ ID NO: 2888268 - RNA, 21 nt, Mycobacterium avium subsp. paratuberculosis
gcggucgguucauccacucgg

SEQ ID NO: 2888269 - RNA, 11 nt, Mycobacterium avium subsp. paratuberculosis
gcggucgucgc

SEQ ID NO: 2888270 - RNA, 20 nt, Mycobacterium avium subsp. paratuberculosis
gcggucgucgcccaccgacg

SEQ ID NO: 2888271 - RNA, 22 nt, Mycobacterium avium subsp. paratuberculosis
gcggucgucgcccaccgacgcg

SEQ ID NO: 2888272 - RNA, 14 nt, Mycobacterium avium subsp. paratuberculosis
gcggucgucgcccg

SEQ ID NO: 2888273 - RNA, 16 nt, Mycobacterium avium subsp. paratuberculosis
gcggucgucgcccguc

SEQ ID NO: 2888274 - RNA, 21 nt, Mycobacterium avium subsp. paratuberculosis
gcggucgucgcccgucucggc

SEQ ID NO: 2888275 - RNA, 22 nt, Mycobacterium avium subsp. paratuberculosis
gcggucgucgcccgucucggcg

SEQ ID NO: 2888276 - RNA, 20 nt, Mycobacterium avium subsp. paratuberculosis
gcggucgucgucgucgguga

SEQ ID NO: 2888277 - RNA, 22 nt, Mycobacterium avium subsp. paratuberculosis
gcggucgucuucuuggccgcgg

SEQ ID NO: 2888278 - RNA, 12 nt, Mycobacterium avium subsp. paratuberculosis
gcggucgugcgg

SEQ ID NO: 2888279 - RNA, 20 nt, Mycobacterium avium subsp. paratuberculosis
gcggucgugcggcugcccag

SEQ ID NO: 2888280 - RNA, 16 nt, Mycobacterium avium subsp. paratuberculosis
gcggucgugcgggaug

SEQ ID NO: 2888281 - RNA, 14 nt, Mycobacterium avium subsp. paratuberculosis
gcggucucgaucug

SEQ ID NO: 2888282 - RNA, 21 nt, Mycobacterium avium subsp. paratuberculosis
gcggucucgaucugcaccagc

SEQ ID NO: 2888283 - RNA, 24 nt, Mycobacterium avium subsp. paratuberculosis
gcggucucgaucugcaccagcgcg

SEQ ID NO: 2888284 - RNA, 13 nt, Mycobacterium avium subsp. paratuberculosis
gcggucugcgcca

SEQ ID NO: 2888285 - RNA, 14 nt, Mycobacterium avium subsp. paratuberculosis
gcggucugcgcccg

SEQ ID NO: 2888286 - RNA, 20 nt, Mycobacterium avium subsp. paratuberculosis
gcggucugcggugcgcccag

SEQ ID NO: 2888287 - RNA, 15 nt, Mycobacterium avium subsp. paratuberculosis
gcggucugucgcgcg

SEQ ID NO: 2888288 - RNA, 16 nt, Mycobacterium avium subsp. paratuberculosis
gcggucugucgcgcga

SEQ ID NO: 2888289 - RNA, 16 nt, Mycobacterium avium subsp. paratuberculosis
gcggucuucuuggccg

SEQ ID NO: 2888290 - RNA, 17 nt, Mycobacterium avium subsp. paratuberculosis
gcggucuucuuggccgc

SEQ ID NO: 2888291 - RNA, 19 nt, Mycobacterium avium subsp. paratuberculosis
gcggucuucuuggccgcgc

SEQ ID NO: 2888292 - RNA, 16 nt, Mycobacterium avium subsp. paratuberculosis
gcggucuuggcggcca

SEQ ID NO: 2888293 - RNA, 20 nt, Mycobacterium avium subsp. paratuberculosis
gcggucuuggcggccagcgc

SEQ ID NO: 2888294 - RNA, 13 nt, Mycobacterium avium subsp. paratuberculosis
gcggugaacgcgg

SEQ ID NO: 2888295 - RNA, 15 nt, Mycobacterium avium subsp. paratuberculosis
gcggugaagucggug

SEQ ID NO: 2888296 - RNA, 22 nt, Mycobacterium avium subsp. paratuberculosis
gcggugaaguugccgccgccgg

SEQ ID NO: 2888297 - RNA, 18 nt, Mycobacterium avium subsp. paratuberculosis
gcggugaauugggcgagu

SEQ ID NO: 2888298 - RNA, 16 nt, Mycobacterium avium subsp. paratuberculosis
gcggugacaucgccac

SEQ ID NO: 2888299 - RNA, 17 nt, Mycobacterium avium subsp. paratuberculosis
gcggugacaucgccacc

SEQ ID NO: 2888300 - RNA, 19 nt, Mycobacterium avium subsp. paratuberculosis
gcggugacaucgccaccug

SEQ ID NO: 2888301 - RNA, 20 nt, Mycobacterium avium subsp. paratuberculosis
gcggugacaucgccaccugg

SEQ ID NO: 2888302 - RNA, 15 nt, Mycobacterium avium subsp. paratuberculosis
gcggugacaugcccg

SEQ ID NO: 2888303 - RNA, 18 nt, Mycobacterium avium subsp. paratuberculosis
gcggugacaugcccgggc

SEQ ID NO: 2888304 - RNA, 15 nt, Mycobacterium avium subsp. paratuberculosis
gcggugccgcggcgg

SEQ ID NO: 2888305 - RNA, 13 nt, Mycobacterium avium subsp. paratuberculosis
gcggugccggcca

SEQ ID NO: 2888306 - RNA, 14 nt, Mycobacterium avium subsp. paratuberculosis
gcggugccggccag

SEQ ID NO: 2888307 - RNA, 17 nt, Mycobacterium avium subsp. paratuberculosis
gcggugccggccagauc

SEQ ID NO: 2888308 - RNA, 18 nt, Mycobacterium avium subsp. paratuberculosis
gcggugccggccagaucg

SEQ ID NO: 2888309 - RNA, 13 nt, Mycobacterium avium subsp. paratuberculosis
gcggugccgggcc

SEQ ID NO: 2888310 - RNA, 17 nt, Mycobacterium avium subsp. paratuberculosis
gcggugccgggccaggu

SEQ ID NO: 2888311 - RNA, 17 nt, Mycobacterium avium subsp. paratuberculosis
gcggugccgggugcuga

SEQ ID NO: 2888312 - RNA, 16 nt, Mycobacterium avium subsp. paratuberculosis
gcggugccguccucgg

SEQ ID NO: 2888313 - RNA, 19 nt, Mycobacterium avium subsp. paratuberculosis
gcggugccguccucggccg

SEQ ID NO: 2888314 - RNA, 21 nt, Mycobacterium avium subsp. paratuberculosis
gcggugccguccucggccgcc

SEQ ID NO: 2888315 - RNA, 18 nt, Mycobacterium avium subsp. paratuberculosis
gcggugcgcagccgcugc

SEQ ID NO: 2888316 - RNA, 21 nt, Mycobacterium avium subsp. paratuberculosis
gcggugcgcagucgcuggucg

SEQ ID NO: 2888317 - RNA, 18 nt, Mycobacterium avium subsp. paratuberculosis
gcggugcgccacgcccgc

SEQ ID NO: 2888318 - RNA, 14 nt, Mycobacterium avium subsp. paratuberculosis
gcggugcgcccagg

SEQ ID NO: 2888319 - RNA, 22 nt, Mycobacterium avium subsp. paratuberculosis
gcggugcgcccagguacuccuc

SEQ ID NO: 2888320 - RNA, 13 nt, Mycobacterium avium subsp. paratuberculosis
gcggugcggcccg

SEQ ID NO: 2888321 - RNA, 14 nt, Mycobacterium avium subsp. paratuberculosis
gcggugcggcccgc

SEQ ID NO: 2888322 - RNA, 15 nt, Mycobacterium avium subsp. paratuberculosis
gcggugcggcccgcg

SEQ ID NO: 2888323 - RNA, 12 nt, Mycobacterium avium subsp. paratuberculosis
gcggugcggccg

SEQ ID NO: 2888324 - RNA, 15 nt, Mycobacterium avium subsp. paratuberculosis
gcggugcggccgcgc

SEQ ID NO: 2888325 - RNA, 12 nt, Mycobacterium avium subsp. paratuberculosis
gcggugcggcgg

SEQ ID NO: 2888326 - RNA, 14 nt, Mycobacterium avium subsp. paratuberculosis
gcggugcggcucgg

SEQ ID NO: 2888327 - RNA, 16 nt, Mycobacterium avium subsp. paratuberculosis
gcggugcggcucgggc

SEQ ID NO: 2888328 - RNA, 18 nt, Mycobacterium avium subsp. paratuberculosis
gcggugcggcucgggcgg

SEQ ID NO: 2888329 - RNA, 13 nt, Mycobacterium avium subsp. paratuberculosis
gcggugcggggcc

SEQ ID NO: 2888330 - RNA, 14 nt, Mycobacterium avium subsp. paratuberculosis
gcggugcggggccg

SEQ ID NO: 2888331 - RNA, 17 nt, Mycobacterium avium subsp. paratuberculosis
gcggugcggggccgcgg

SEQ ID NO: 2888332 - RNA, 21 nt, Mycobacterium avium subsp. paratuberculosis
gcggugcggggccgcggccgg

SEQ ID NO: 2888333 - RNA, 22 nt, Mycobacterium avium subsp. paratuberculosis
gcggugcggggccgcggccggc

SEQ ID NO: 2888334 - RNA, 16 nt, Mycobacterium avium subsp. paratuberculosis
gcggugcggucgcgca

SEQ ID NO: 2888335 - RNA, 23 nt, Mycobacterium avium subsp. paratuberculosis
gcggugcggucgcgcagccgggc

SEQ ID NO: 2888336 - RNA, 15 nt, Mycobacterium avium subsp. paratuberculosis
gcggugcggugcgcc

SEQ ID NO: 2888337 - RNA, 17 nt, Mycobacterium avium subsp. paratuberculosis
gcggugcggugcgccgc

SEQ ID NO: 2888338 - RNA, 16 nt, Mycobacterium avium subsp. paratuberculosis
gcggugcgucgaauca

SEQ ID NO: 2888339 - RNA, 15 nt, Mycobacterium avium subsp. paratuberculosis
gcggugcgucgggcg

SEQ ID NO: 2888340 - RNA, 17 nt, Mycobacterium avium subsp. paratuberculosis
gcggugcgucgggcgcc

SEQ ID NO: 2888341 - RNA, 18 nt, Mycobacterium avium subsp. paratuberculosis
gcggugcgucgggcgccg

SEQ ID NO: 2888342 - RNA, 15 nt, Mycobacterium avium subsp. paratuberculosis
gcggugcucgcccug

SEQ ID NO: 2888343 - RNA, 14 nt, Mycobacterium avium subsp. paratuberculosis
gcggugcucgcgcc

SEQ ID NO: 2888344 - RNA, 23 nt, Mycobacterium avium subsp. paratuberculosis
gcggugcucgcgccgggcggccu

SEQ ID NO: 2888345 - RNA, 16 nt, Mycobacterium avium subsp. paratuberculosis
gcggugcucggcgcgc

SEQ ID NO: 2888346 - RNA, 18 nt, Mycobacterium avium subsp. paratuberculosis
gcggugcucgucgagcau

SEQ ID NO: 2888347 - RNA, 19 nt, Mycobacterium avium subsp. paratuberculosis
gcggugcucucgucgucgg

SEQ ID NO: 2888348 - RNA, 18 nt, Mycobacterium avium subsp. paratuberculosis
gcggugcugccgugccga

SEQ ID NO: 2888349 - RNA, 18 nt, Mycobacterium avium subsp. paratuberculosis
gcggugcuuaccggccgg

SEQ ID NO: 2888350 - RNA, 19 nt, Mycobacterium avium subsp. paratuberculosis
gcggugcuuaccggccggc

SEQ ID NO: 2888351 - RNA, 20 nt, Mycobacterium avium subsp. paratuberculosis
gcggugcuuaccggccggcc

SEQ ID NO: 2888352 - RNA, 15 nt, Mycobacterium avium subsp. paratuberculosis
gcgguggaacccagc

SEQ ID NO: 2888353 - RNA, 20 nt, Mycobacterium avium subsp. paratuberculosis
gcgguggagcacagcacggc

SEQ ID NO: 2888354 - RNA, 13 nt, Mycobacterium avium subsp. paratuberculosis
gcgguggccacgc

SEQ ID NO: 2888355 - RNA, 14 nt, Mycobacterium avium subsp. paratuberculosis
gcgguggccacggc

SEQ ID NO: 2888356 - RNA, 15 nt, Mycobacterium avium subsp. paratuberculosis
gcgguggccacggcg

SEQ ID NO: 2888357 - RNA, 12 nt, Mycobacterium avium subsp. paratuberculosis
gcgguggccagc

SEQ ID NO: 2888358 - RNA, 13 nt, Mycobacterium avium subsp. paratuberculosis
gcgguggccagca

SEQ ID NO: 2888359 - RNA, 17 nt, Mycobacterium avium subsp. paratuberculosis
gcgguggccaugcgcga

SEQ ID NO: 2888360 - RNA, 21 nt, Mycobacterium avium subsp. paratuberculosis
gcgguggcccgguacagcgcc

SEQ ID NO: 2888361 - RNA, 18 nt, Mycobacterium avium subsp. paratuberculosis
gcgguggccgaaccgcuc

SEQ ID NO: 2888362 - RNA, 12 nt, Mycobacterium avium subsp. paratuberculosis
gcgguggccggg

SEQ ID NO: 2888363 - RNA, 14 nt, Mycobacterium avium subsp. paratuberculosis
gcgguggccgggau

SEQ ID NO: 2888364 - RNA, 19 nt, Mycobacterium avium subsp. paratuberculosis
gcgguggccguaaccgccg

SEQ ID NO: 2888365 - RNA, 13 nt, Mycobacterium avium subsp. paratuberculosis
gcgguggccucgg

SEQ ID NO: 2888366 - RNA, 23 nt, Mycobacterium avium subsp. paratuberculosis
gcgguggccucgggggugaaggc

SEQ ID NO: 2888367 - RNA, 12 nt, Mycobacterium avium subsp. paratuberculosis
gcgguggccugc

SEQ ID NO: 2888368 - RNA, 17 nt, Mycobacterium avium subsp. paratuberculosis
gcgguggccugcccggc

SEQ ID NO: 2888369 - RNA, 12 nt, Mycobacterium avium subsp. paratuberculosis
gcgguggccugg

SEQ ID NO: 2888370 - RNA, 22 nt, Mycobacterium avium subsp. paratuberculosis
gcgguggccuggucggcgaccu

SEQ ID NO: 2888371 - RNA, 21 nt, Mycobacterium avium subsp. paratuberculosis
gcgguggcgaacugcaccagc

SEQ ID NO: 2888372 - RNA, 13 nt, Mycobacterium avium subsp. paratuberculosis
gcgguggcgauga

SEQ ID NO: 2888373 - RNA, 19 nt, Mycobacterium avium subsp. paratuberculosis
gcgguggcgcacaacccgg

SEQ ID NO: 2888374 - RNA, 23 nt, Mycobacterium avium subsp. paratuberculosis
gcgguggcgcacaacccggacag

SEQ ID NO: 2888375 - RNA, 23 nt, Mycobacterium avium subsp. paratuberculosis
gcgguggcgccgcgggcggucgc

SEQ ID NO: 2888376 - RNA, 15 nt, Mycobacterium avium subsp. paratuberculosis
gcgguggcgccgggg

SEQ ID NO: 2888377 - RNA, 21 nt, Mycobacterium avium subsp. paratuberculosis
gcgguggcgccggggcgggcg

SEQ ID NO: 2888378 - RNA, 12 nt, Mycobacterium avium subsp. paratuberculosis
gcgguggcggcg

SEQ ID NO: 2888379 - RNA, 13 nt, Mycobacterium avium subsp. paratuberculosis
gcgguggcggcga

SEQ ID NO: 2888380 - RNA, 14 nt, Mycobacterium avium subsp. paratuberculosis
gcgguggcggcgaa

SEQ ID NO: 2888381 - RNA, 18 nt, Mycobacterium avium subsp. paratuberculosis
gcggugggaauccacagc

SEQ ID NO: 2888382 - RNA, 16 nt, Mycobacterium avium subsp. paratuberculosis
gcggugggcaccagca

SEQ ID NO: 2888383 - RNA, 17 nt, Mycobacterium avium subsp. paratuberculosis
gcggugggcaccagcag

SEQ ID NO: 2888384 - RNA, 18 nt, Mycobacterium avium subsp. paratuberculosis
gcggugggcaccagcagc

SEQ ID NO: 2888385 - RNA, 22 nt, Mycobacterium avium subsp. paratuberculosis
gcggugggcaccagcagcgcga

SEQ ID NO: 2888386 - RNA, 23 nt, Mycobacterium avium subsp. paratuberculosis
gcggugggcgcauaaaccugguu

SEQ ID NO: 2888387 - RNA, 21 nt, Mycobacterium avium subsp. paratuberculosis
gcggugggcgcugguccucgg

SEQ ID NO: 2888388 - RNA, 13 nt, Mycobacterium avium subsp. paratuberculosis
gcggugggcggcg

SEQ ID NO: 2888389 - RNA, 15 nt, Mycobacterium avium subsp. paratuberculosis
gcgguugaccgccga

SEQ ID NO: 2888390 - RNA, 17 nt, Mycobacterium avium subsp. paratuberculosis
gcgguugaccgccgaca

SEQ ID NO: 2888391 - RNA, 21 nt, Mycobacterium avium subsp. paratuberculosis
gcgguugaccgccgacaccac

SEQ ID NO: 2888392 - RNA, 22 nt, Mycobacterium avium subsp. paratuberculosis
gcgguugaccgccgacaccacc

SEQ ID NO: 2888393 - RNA, 23 nt, Mycobacterium avium subsp. paratuberculosis
gcgguugaucacaccgucggcga

SEQ ID NO: 2888394 - RNA, 20 nt, Mycobacterium avium subsp. paratuberculosis
gcgguugccccaccccggac

SEQ ID NO: 2888395 - RNA, 23 nt, Mycobacterium avium subsp. paratuberculosis
gcgguugccccaccccggacggc

SEQ ID NO: 2888396 - RNA, 13 nt, Mycobacterium avium subsp. paratuberculosis
gcgguugcccgca

SEQ ID NO: 2888397 - RNA, 21 nt, Mycobacterium avium subsp. paratuberculosis
gcgguugcggguggcggccgg

SEQ ID NO: 2888398 - RNA, 13 nt, Mycobacterium avium subsp. paratuberculosis
gcgguugcgguug

SEQ ID NO: 2888399 - RNA, 16 nt, Mycobacterium avium subsp. paratuberculosis
gcgguugcucgucggc

SEQ ID NO: 2888400 - RNA, 19 nt, Mycobacterium avium subsp. paratuberculosis
gcgguugcucgucggccga

SEQ ID NO: 2888401 - RNA, 20 nt, Mycobacterium avium subsp. paratuberculosis
gcgguuggacaggccggcga

SEQ ID NO: 2888402 - RNA, 22 nt, Mycobacterium avium subsp. paratuberculosis
gcgguuggacaggccggcgacg

SEQ ID NO: 2888403 - RNA, 13 nt, Mycobacterium avium subsp. paratuberculosis
gcgguuggcccgc

SEQ ID NO: 2888404 - RNA, 14 nt, Mycobacterium avium subsp. paratuberculosis
gcgguuggcccgcg

SEQ ID NO: 2888405 - RNA, 15 nt, Mycobacterium avium subsp. paratuberculosis
gcgguuggcccgcgg

SEQ ID NO: 2888406 - RNA, 18 nt, Mycobacterium avium subsp. paratuberculosis
gcgguuggcccgcggcgc

SEQ ID NO: 2888407 - RNA, 14 nt, Mycobacterium avium subsp. paratuberculosis
gcgguuggccggaa

SEQ ID NO: 2888408 - RNA, 17 nt, Mycobacterium avium subsp. paratuberculosis
gcgguuggccggaaucg

SEQ ID NO: 2888409 - RNA, 15 nt, Mycobacterium avium subsp. paratuberculosis
gcgguuggccggccg

SEQ ID NO: 2888410 - RNA, 16 nt, Mycobacterium avium subsp. paratuberculosis
gcgguuggccggccgg

SEQ ID NO: 2888411 - RNA, 17 nt, Mycobacterium avium subsp. paratuberculosis
gcgguugggccgccggc

SEQ ID NO: 2888412 - RNA, 19 nt, Mycobacterium avium subsp. paratuberculosis
gcgguugggccgccggccg

SEQ ID NO: 2888413 - RNA, 20 nt, Mycobacterium avium subsp. paratuberculosis
gcgguugggccgccggccgc

SEQ ID NO: 2888414 - RNA, 15 nt, Mycobacterium avium subsp. paratuberculosis
gcgguugggccggcg

SEQ ID NO: 2888415 - RNA, 18 nt, Mycobacterium avium subsp. paratuberculosis
gcgguugggccggcgccc

SEQ ID NO: 2888416 - RNA, 17 nt, Mycobacterium avium subsp. paratuberculosis
gcgguuggucaccaggu

SEQ ID NO: 2888417 - RNA, 21 nt, Mycobacterium avium subsp. paratuberculosis
gcgguuggucaccaggucgcg

SEQ ID NO: 2888418 - RNA, 22 nt, Mycobacterium avium subsp. paratuberculosis
gcgguuggucaccaggucgcgg

SEQ ID NO: 2888419 - RNA, 18 nt, Mycobacterium avium subsp. paratuberculosis
gcgguuuccggcgauucg

SEQ ID NO: 2888420 - RNA, 22 nt, Mycobacterium avium subsp. paratuberculosis
gcgguuuccggcgauucgauca

SEQ ID NO: 2888421 - RNA, 15 nt, Mycobacterium avium subsp. paratuberculosis
gcgguuuggucagcg

SEQ ID NO: 2888422 - RNA, 17 nt, Mycobacterium avium subsp. paratuberculosis
gcgguuuggucagcgcc

SEQ ID NO: 2888423 - RNA, 12 nt, Mycobacterium avium subsp. paratuberculosis
gcguacaccagg

SEQ ID NO: 2888424 - RNA, 20 nt, Mycobacterium avium subsp. paratuberculosis
gcguacaccagggugccgcc

SEQ ID NO: 2888425 - RNA, 13 nt, Mycobacterium avium subsp. paratuberculosis
gcguacaccggcu

SEQ ID NO: 2888426 - RNA, 18 nt, Mycobacterium avium subsp. paratuberculosis
gcguacaccggcugaccg

SEQ ID NO: 2888427 - RNA, 20 nt, Mycobacterium avium subsp. paratuberculosis
gcguacaccggcugaccggc

SEQ ID NO: 2888428 - RNA, 15 nt, Mycobacterium avium subsp. paratuberculosis
gcguacacggcccgc

SEQ ID NO: 2888429 - RNA, 18 nt, Mycobacterium avium subsp. paratuberculosis
gcguacacguagaaggcg

SEQ ID NO: 2888430 - RNA, 23 nt, Mycobacterium avium subsp. paratuberculosis
gcguacacguagaaggcgccguc

SEQ ID NO: 2888431 - RNA, 19 nt, Mycobacterium avium subsp. paratuberculosis
gcguacagcaauccgcuga

SEQ ID NO: 2888432 - RNA, 17 nt, Mycobacterium avium subsp. paratuberculosis
gcguacagcagcugccc

SEQ ID NO: 2888433 - RNA, 14 nt, Mycobacterium avium subsp. paratuberculosis
gcguacagccagcc

SEQ ID NO: 2888434 - RNA, 17 nt, Mycobacterium avium subsp. paratuberculosis
gcguacagccagcccgu

SEQ ID NO: 2888435 - RNA, 13 nt, Mycobacterium avium subsp. paratuberculosis
gcguacagcccgc

SEQ ID NO: 2888436 - RNA, 17 nt, Mycobacterium avium subsp. paratuberculosis
gcguacagcccgcggau

SEQ ID NO: 2888437 - RNA, 21 nt, Mycobacterium avium subsp. paratuberculosis
gcguacagcccgcggaucgcg

SEQ ID NO: 2888438 - RNA, 13 nt, Mycobacterium avium subsp. paratuberculosis
gcguacagcgccc

SEQ ID NO: 2888439 - RNA, 14 nt, Mycobacterium avium subsp. paratuberculosis
gcguacagcgcccg

SEQ ID NO: 2888440 - RNA, 14 nt, Mycobacterium avium subsp. paratuberculosis
gcguacagcggcgc

SEQ ID NO: 2888441 - RNA, 16 nt, Mycobacterium avium subsp. paratuberculosis
gcguacagcggcgcca

SEQ ID NO: 2888442 - RNA, 19 nt, Mycobacterium avium subsp. paratuberculosis
gcguacagcgggucguugg

SEQ ID NO: 2888443 - RNA, 18 nt, Mycobacterium avium subsp. paratuberculosis
gcguacaggccgucgggg

SEQ ID NO: 2888444 - RNA, 16 nt, Mycobacterium avium subsp. paratuberculosis
gcguacagggcgucgg

SEQ ID NO: 2888445 - RNA, 17 nt, Mycobacterium avium subsp. paratuberculosis
gcguacccaggucggcg

SEQ ID NO: 2888446 - RNA, 20 nt, Mycobacterium avium subsp. paratuberculosis
gcguacccaggucggcguga

SEQ ID NO: 2888447 - RNA, 12 nt, Mycobacterium avium subsp. paratuberculosis
gcguacccgccc

SEQ ID NO: 2888448 - RNA, 22 nt, Mycobacterium avium subsp. paratuberculosis
gcguacccgcgcggcgucggcc

SEQ ID NO: 2888449 - RNA, 16 nt, Mycobacterium avium subsp. paratuberculosis
gcguaccgcggcggcg

SEQ ID NO: 2888450 - RNA, 18 nt, Mycobacterium avium subsp. paratuberculosis
gcguacgacaucucgacg

SEQ ID NO: 2888451 - RNA, 19 nt, Mycobacterium avium subsp. paratuberculosis
gcguacgacaucucgacgg

SEQ ID NO: 2888452 - RNA, 23 nt, Mycobacterium avium subsp. paratuberculosis
gcguacgaccguagccggucggc

SEQ ID NO: 2888453 - RNA, 17 nt, Mycobacterium avium subsp. paratuberculosis
gcguacgcgauggcggc

SEQ ID NO: 2888454 - RNA, 23 nt, Mycobacterium avium subsp. paratuberculosis
gcguacgcgauggcggcgcgcuc

SEQ ID NO: 2888455 - RNA, 21 nt, Mycobacterium avium subsp. paratuberculosis
gcguacggguugggcggggcg

SEQ ID NO: 2888456 - RNA, 22 nt, Mycobacterium avium subsp. paratuberculosis
gcguacucgcacagccggcgcg

SEQ ID NO: 2888457 - RNA, 14 nt, Mycobacterium avium subsp. paratuberculosis
gcguacugcucggc

SEQ ID NO: 2888458 - RNA, 16 nt, Mycobacterium avium subsp. paratuberculosis
gcguacugcucggcgc

SEQ ID NO: 2888459 - RNA, 13 nt, Mycobacterium avium subsp. paratuberculosis
gcguagaccagcg

SEQ ID NO: 2888460 - RNA, 18 nt, Mycobacterium avium subsp. paratuberculosis
gcguagaccagcgacgcc

SEQ ID NO: 2888461 - RNA, 16 nt, Mycobacterium avium subsp. paratuberculosis
gcguagcagucggccu

SEQ ID NO: 2888462 - RNA, 21 nt, Mycobacterium avium subsp. paratuberculosis
gcguagcagucggccugcagc

SEQ ID NO: 2888463 - RNA, 23 nt, Mycobacterium avium subsp. paratuberculosis
gcguagcccuaccggcucggccc

SEQ ID NO: 2888464 - RNA, 13 nt, Mycobacterium avium subsp. paratuberculosis
gcguagccgacca

SEQ ID NO: 2888465 - RNA, 14 nt, Mycobacterium avium subsp. paratuberculosis
gcguagccgccggu

SEQ ID NO: 2888466 - RNA, 23 nt, Mycobacterium avium subsp. paratuberculosis
gcguagcgccagucgcggcgaac

SEQ ID NO: 2888467 - RNA, 14 nt, Mycobacterium avium subsp. paratuberculosis
gcguagcgccgccc

SEQ ID NO: 2888468 - RNA, 17 nt, Mycobacterium avium subsp. paratuberculosis
gcguagcgccgcccguc

SEQ ID NO: 2888469 - RNA, 22 nt, Mycobacterium avium subsp. paratuberculosis
gcguagcggaagcugccguugc

SEQ ID NO: 2888470 - RNA, 13 nt, Mycobacterium avium subsp. paratuberculosis
gcguagcggcccg

SEQ ID NO: 2888471 - RNA, 14 nt, Mycobacterium avium subsp. paratuberculosis
gcguagcggugaaa

SEQ ID NO: 2888472 - RNA, 16 nt, Mycobacterium avium subsp. paratuberculosis
gcguagcugcaggcga

SEQ ID NO: 2888473 - RNA, 14 nt, Mycobacterium avium subsp. paratuberculosis
gcguaggacagcag

SEQ ID NO: 2888474 - RNA, 20 nt, Mycobacterium avium subsp. paratuberculosis
gcgucagcaucgccgucguc

SEQ ID NO: 2888475 - RNA, 21 nt, Mycobacterium avium subsp. paratuberculosis
gcgucagcaucgccgucguca

SEQ ID NO: 2888476 - RNA, 16 nt, Mycobacterium avium subsp. paratuberculosis
gcgucagccgucgucg

SEQ ID NO: 2888477 - RNA, 19 nt, Mycobacterium avium subsp. paratuberculosis
gcgucagccgucgucgucc

SEQ ID NO: 2888478 - RNA, 13 nt, Mycobacterium avium subsp. paratuberculosis
gcgucagcggcgg

SEQ ID NO: 2888479 - RNA, 14 nt, Mycobacterium avium subsp. paratuberculosis
gcgucagcggcggg

SEQ ID NO: 2888480 - RNA, 15 nt, Mycobacterium avium subsp. paratuberculosis
gcgucagcggcgggc

SEQ ID NO: 2888481 - RNA, 16 nt, Mycobacterium avium subsp. paratuberculosis
gcgucaggauggugaa

SEQ ID NO: 2888482 - RNA, 15 nt, Mycobacterium avium subsp. paratuberculosis
gcgucaggcgcuggg

SEQ ID NO: 2888483 - RNA, 17 nt, Mycobacterium avium subsp. paratuberculosis
gcgucaggcgcugggug

SEQ ID NO: 2888484 - RNA, 15 nt, Mycobacterium avium subsp. paratuberculosis
gcgucagggcgacuc

SEQ ID NO: 2888485 - RNA, 24 nt, Mycobacterium avium subsp. paratuberculosis
gcgucagggcgacuccggcgccgg

SEQ ID NO: 2888486 - RNA, 17 nt, Mycobacterium avium subsp. paratuberculosis
gcgucagggguuggcgc

SEQ ID NO: 2888487 - RNA, 19 nt, Mycobacterium avium subsp. paratuberculosis
gcgucagggguuggcgcgc

SEQ ID NO: 2888488 - RNA, 22 nt, Mycobacterium avium subsp. paratuberculosis
gcgucagggguuggcgcgcaga

SEQ ID NO: 2888489 - RNA, 19 nt, Mycobacterium avium subsp. paratuberculosis
gcgucaggucaccgagcgg

SEQ ID NO: 2888490 - RNA, 20 nt, Mycobacterium avium subsp. paratuberculosis
gcgucaggucaccgagcggg

SEQ ID NO: 2888491 - RNA, 14 nt, Mycobacterium avium subsp. paratuberculosis
gcgucagguccgcg

SEQ ID NO: 2888492 - RNA, 15 nt, Mycobacterium avium subsp. paratuberculosis
gcgucaucacgugcu

SEQ ID NO: 2888493 - RNA, 16 nt, Mycobacterium avium subsp. paratuberculosis
gcgucaucacgugcug

SEQ ID NO: 2888494 - RNA, 20 nt, Mycobacterium avium subsp. paratuberculosis
gcgucaucacgugcuggcgc

SEQ ID NO: 2888495 - RNA, 21 nt, Mycobacterium avium subsp. paratuberculosis
gcgucaucgacuugccgccgc

SEQ ID NO: 2888496 - RNA, 22 nt, Mycobacterium avium subsp. paratuberculosis
gcgucaucgacuugccgccgca

SEQ ID NO: 2888497 - RNA, 15 nt, Mycobacterium avium subsp. paratuberculosis
gcgucaucgggcccg

SEQ ID NO: 2888498 - RNA, 16 nt, Mycobacterium avium subsp. paratuberculosis
gcgucaucgggcccga

SEQ ID NO: 2888499 - RNA, 22 nt, Mycobacterium avium subsp. paratuberculosis
gcgucauggagaucaccgcgua

SEQ ID NO: 2888500 - RNA, 17 nt, Mycobacterium avium subsp. paratuberculosis
gcgucauggccgucggg

SEQ ID NO: 2888501 - RNA, 21 nt, Mycobacterium avium subsp. paratuberculosis
gcgucauggccgucgggucgg

SEQ ID NO: 2888502 - RNA, 14 nt, Mycobacterium avium subsp. paratuberculosis
gcgucauggugcgc

SEQ ID NO: 2888503 - RNA, 17 nt, Mycobacterium avium subsp. paratuberculosis
gcgucauuccgccgcgc

SEQ ID NO: 2888504 - RNA, 20 nt, Mycobacterium avium subsp. paratuberculosis
gcgucauuccgccgcgcccg

SEQ ID NO: 2888505 - RNA, 23 nt, Mycobacterium avium subsp. paratuberculosis
gcgucauuccgccgcgcccgucg

SEQ ID NO: 2888506 - RNA, 16 nt, Mycobacterium avium subsp. paratuberculosis
gcguccaaccgcggac

SEQ ID NO: 2888507 - RNA, 16 nt, Mycobacterium avium subsp. paratuberculosis
gcguccaccagcacgc

SEQ ID NO: 2888508 - RNA, 18 nt, Mycobacterium avium subsp. paratuberculosis
gcguccaccagcacgccg

SEQ ID NO: 2888509 - RNA, 21 nt, Mycobacterium avium subsp. paratuberculosis
gcguccaccagcacgccguug

SEQ ID NO: 2888510 - RNA, 17 nt, Mycobacterium avium subsp. paratuberculosis
gcguccaccggucgacg

SEQ ID NO: 2888511 - RNA, 16 nt, Mycobacterium avium subsp. paratuberculosis
gcguccacgaaaccca

SEQ ID NO: 2888512 - RNA, 15 nt, Mycobacterium avium subsp. paratuberculosis
gcguccacgaccccg

SEQ ID NO: 2888513 - RNA, 17 nt, Mycobacterium avium subsp. paratuberculosis
gcguccacgaccccggc

SEQ ID NO: 2888514 - RNA, 21 nt, Mycobacterium avium subsp. paratuberculosis
gcguccacgaccccggcggca

SEQ ID NO: 2888515 - RNA, 23 nt, Mycobacterium avium subsp. paratuberculosis
gcguccacuccaauacggcccgg

SEQ ID NO: 2888516 - RNA, 16 nt, Mycobacterium avium subsp. paratuberculosis
gcguccagaccggccg

SEQ ID NO: 2888517 - RNA, 17 nt, Mycobacterium avium subsp. paratuberculosis
gcguccagcaccugcuc

SEQ ID NO: 2888518 - RNA, 13 nt, Mycobacterium avium subsp. paratuberculosis
gcguccagcagca

SEQ ID NO: 2888519 - RNA, 14 nt, Mycobacterium avium subsp. paratuberculosis
gcguccagcaugcc

SEQ ID NO: 2888520 - RNA, 12 nt, Mycobacterium avium subsp. paratuberculosis
gcguccagccag

SEQ ID NO: 2888521 - RNA, 16 nt, Mycobacterium avium subsp. paratuberculosis
gcguccagccagcguu

SEQ ID NO: 2888522 - RNA, 13 nt, Mycobacterium avium subsp. paratuberculosis
gcguccagcgagg

SEQ ID NO: 2888523 - RNA, 22 nt, Mycobacterium avium subsp. paratuberculosis
gcguccagcgaggggguggguc

SEQ ID NO: 2888524 - RNA, 15 nt, Mycobacterium avium subsp. paratuberculosis
gcguccagcgccgcc

SEQ ID NO: 2888525 - RNA, 14 nt, Mycobacterium avium subsp. paratuberculosis
gcguccagcgcggu

SEQ ID NO: 2888526 - RNA, 15 nt, Mycobacterium avium subsp. paratuberculosis
gcguccagcgcggug

SEQ ID NO: 2888527 - RNA, 17 nt, Mycobacterium avium subsp. paratuberculosis
gcguccagcgcggugag

SEQ ID NO: 2888528 - RNA, 19 nt, Mycobacterium avium subsp. paratuberculosis
gcguccagcggguugccgc

SEQ ID NO: 2888529 - RNA, 23 nt, Mycobacterium avium subsp. paratuberculosis
gcguccagcggguugccgcuggc

SEQ ID NO: 2888530 - RNA, 18 nt, Mycobacterium avium subsp. paratuberculosis
gcguccagcugcgcgccg

SEQ ID NO: 2888531 - RNA, 21 nt, Mycobacterium avium subsp. paratuberculosis
gcguccagcugcgcgccggcg

SEQ ID NO: 2888532 - RNA, 22 nt, Mycobacterium avium subsp. paratuberculosis
gcguccagcugcgcgccggcgg

SEQ ID NO: 2888533 - RNA, 17 nt, Mycobacterium avium subsp. paratuberculosis
gcguccaggcgcaccgc

SEQ ID NO: 2888534 - RNA, 20 nt, Mycobacterium avium subsp. paratuberculosis
gcguccaggcgcaccgccac

SEQ ID NO: 2888535 - RNA, 16 nt, Mycobacterium avium subsp. paratuberculosis
gcguccagggccaccg

SEQ ID NO: 2888536 - RNA, 17 nt, Mycobacterium avium subsp. paratuberculosis
gcguccagggccaccgc

SEQ ID NO: 2888537 - RNA, 22 nt, Mycobacterium avium subsp. paratuberculosis
gcguccagggccaccgcgucgc

SEQ ID NO: 2888538 - RNA, 21 nt, Mycobacterium avium subsp. paratuberculosis
gcguccaguagccgccgggcg

SEQ ID NO: 2888539 - RNA, 14 nt, Mycobacterium avium subsp. paratuberculosis
gcguccaguccggc

SEQ ID NO: 2888540 - RNA, 16 nt, Mycobacterium avium subsp. paratuberculosis
gcguccaguccggcgu

SEQ ID NO: 2888541 - RNA, 16 nt, Mycobacterium avium subsp. paratuberculosis
gcguccagucgauguc

SEQ ID NO: 2888542 - RNA, 22 nt, Mycobacterium avium subsp. paratuberculosis
gcguccagucgaugucgguggc

SEQ ID NO: 2888543 - RNA, 19 nt, Mycobacterium avium subsp. paratuberculosis
gcguccagugcaugccggc

SEQ ID NO: 2888544 - RNA, 20 nt, Mycobacterium avium subsp. paratuberculosis
gcguccagugcaugccggcc

SEQ ID NO: 2888545 - RNA, 21 nt, Mycobacterium avium subsp. paratuberculosis
gcguccaguucggccagcgcg

SEQ ID NO: 2888546 - RNA, 23 nt, Mycobacterium avium subsp. paratuberculosis
gcguccaguugcggcacgccgac

SEQ ID NO: 2888547 - RNA, 23 nt, Mycobacterium avium subsp. paratuberculosis
gcguccaugcucuugcgggcggc

SEQ ID NO: 2888548 - RNA, 19 nt, Mycobacterium avium subsp. paratuberculosis
gcguccauggucgagccgc

SEQ ID NO: 2888549 - RNA, 21 nt, Mycobacterium avium subsp. paratuberculosis
gcguccauguaguucagcagc

SEQ ID NO: 2888550 - RNA, 13 nt, Mycobacterium avium subsp. paratuberculosis
gcgucccacaucu

SEQ ID NO: 2888551 - RNA, 18 nt, Mycobacterium avium subsp. paratuberculosis
gcgucccacaucuccuug

SEQ ID NO: 2888552 - RNA, 16 nt, Mycobacterium avium subsp. paratuberculosis
gcgucccacgugguga

SEQ ID NO: 2888553 - RNA, 19 nt, Mycobacterium avium subsp. paratuberculosis
gcgucccagugcucgacca

SEQ ID NO: 2888554 - RNA, 13 nt, Mycobacterium avium subsp. paratuberculosis
gcguccccgcgcc

SEQ ID NO: 2888555 - RNA, 14 nt, Mycobacterium avium subsp. paratuberculosis
gcguccccggcggu

SEQ ID NO: 2888556 - RNA, 14 nt, Mycobacterium avium subsp. paratuberculosis
gcgucccgcgccac

SEQ ID NO: 2888557 - RNA, 20 nt, Mycobacterium avium subsp. paratuberculosis
gcgucccgcgccacguaucg

SEQ ID NO: 2888558 - RNA, 22 nt, Mycobacterium avium subsp. paratuberculosis
gcgucgaacgggccgggcaccg

SEQ ID NO: 2888559 - RNA, 21 nt, Mycobacterium avium subsp. paratuberculosis
gcgucgaagaagucguucagc

SEQ ID NO: 2888560 - RNA, 13 nt, Mycobacterium avium subsp. paratuberculosis
gcgucgacacccc

SEQ ID NO: 2888561 - RNA, 18 nt, Mycobacterium avium subsp. paratuberculosis
gcgucgacaccccgcucg

SEQ ID NO: 2888562 - RNA, 19 nt, Mycobacterium avium subsp. paratuberculosis
gcgucgacaccccgcucgg

SEQ ID NO: 2888563 - RNA, 14 nt, Mycobacterium avium subsp. paratuberculosis
gcgucgacacccgg

SEQ ID NO: 2888564 - RNA, 17 nt, Mycobacterium avium subsp. paratuberculosis
gcgucgacagccggucg

SEQ ID NO: 2888565 - RNA, 20 nt, Mycobacterium avium subsp. paratuberculosis
gcgucgacagccggucgcgc

SEQ ID NO: 2888566 - RNA, 13 nt, Mycobacterium avium subsp. paratuberculosis
gcgucgaccaccg

SEQ ID NO: 2888567 - RNA, 14 nt, Mycobacterium avium subsp. paratuberculosis
gcgucgaccaccgc

SEQ ID NO: 2888568 - RNA, 22 nt, Mycobacterium avium subsp. paratuberculosis
gcgucgaccaccgccggcccgg

SEQ ID NO: 2888569 - RNA, 23 nt, Mycobacterium avium subsp. paratuberculosis
gcgucgaccaccgccggcccggc

SEQ ID NO: 2888570 - RNA, 12 nt, Mycobacterium avium subsp. paratuberculosis
gcgucgaccagc

SEQ ID NO: 2888571 - RNA, 13 nt, Mycobacterium avium subsp. paratuberculosis
gcgucgaccagcc

SEQ ID NO: 2888572 - RNA, 14 nt, Mycobacterium avium subsp. paratuberculosis
gcgucgaccagccg

SEQ ID NO: 2888573 - RNA, 15 nt, Mycobacterium avium subsp. paratuberculosis
gcgucgaccagccgc

SEQ ID NO: 2888574 - RNA, 18 nt, Mycobacterium avium subsp. paratuberculosis
gcgucgaccagccgcauc

SEQ ID NO: 2888575 - RNA, 16 nt, Mycobacterium avium subsp. paratuberculosis
gcgucgaccagccggu

SEQ ID NO: 2888576 - RNA, 12 nt, Mycobacterium avium subsp. paratuberculosis
gcgucgaccgcc

SEQ ID NO: 2888577 - RNA, 23 nt, Mycobacterium avium subsp. paratuberculosis
gcgucgaccgccccgccgguguc

SEQ ID NO: 2888578 - RNA, 14 nt, Mycobacterium avium subsp. paratuberculosis
gcgucgaccgccgc

SEQ ID NO: 2888579 - RNA, 15 nt, Mycobacterium avium subsp. paratuberculosis
gcgucgacgacggcg

SEQ ID NO: 2888580 - RNA, 18 nt, Mycobacterium avium subsp. paratuberculosis
gcgucgacgacggcgccg

SEQ ID NO: 2888581 - RNA, 24 nt, Mycobacterium avium subsp. paratuberculosis
gcgucgacgacggcgccgcgucgg

SEQ ID NO: 2888582 - RNA, 22 nt, Mycobacterium avium subsp. paratuberculosis
gcgucgacgauggcguccaccg

SEQ ID NO: 2888583 - RNA, 21 nt, Mycobacterium avium subsp. paratuberculosis
gcgucgacgauggucuggaug

SEQ ID NO: 2888584 - RNA, 19 nt, Mycobacterium avium subsp. paratuberculosis
gcgucgacgccgcugccgg

SEQ ID NO: 2888585 - RNA, 23 nt, Mycobacterium avium subsp. paratuberculosis
gcgucgacgccgcugccggggug

SEQ ID NO: 2888586 - RNA, 12 nt, Mycobacterium avium subsp. paratuberculosis
gcgucgacgcgc

SEQ ID NO: 2888587 - RNA, 17 nt, Mycobacterium avium subsp. paratuberculosis
gcgucgacgcggugaca

SEQ ID NO: 2888588 - RNA, 16 nt, Mycobacterium avium subsp. paratuberculosis
gcgucgacggcaagca

SEQ ID NO: 2888589 - RNA, 17 nt, Mycobacterium avium subsp. paratuberculosis
gcgucgacggcgccgga

SEQ ID NO: 2888590 - RNA, 13 nt, Mycobacterium avium subsp. paratuberculosis
gcgucgacgucgg

SEQ ID NO: 2888591 - RNA, 18 nt, Mycobacterium avium subsp. paratuberculosis
gcgucgacgucgggcacg

SEQ ID NO: 2888592 - RNA, 21 nt, Mycobacterium avium subsp. paratuberculosis
gcgucgacgucgggcacgguc

SEQ ID NO: 2888593 - RNA, 14 nt, Mycobacterium avium subsp. paratuberculosis
gcgucgacgugcgc

SEQ ID NO: 2888594 - RNA, 16 nt, Mycobacterium avium subsp. paratuberculosis
gcgucgacgugcgcgg

SEQ ID NO: 2888595 - RNA, 17 nt, Mycobacterium avium subsp. paratuberculosis
gcgucgacgugcgcggc

SEQ ID NO: 2888596 - RNA, 20 nt, Mycobacterium avium subsp. paratuberculosis
gcgucgacgugcgcggcguu

SEQ ID NO: 2888597 - RNA, 20 nt, Mycobacterium avium subsp. paratuberculosis
gcgucgacguucgccgccag

SEQ ID NO: 2888598 - RNA, 23 nt, Mycobacterium avium subsp. paratuberculosis
gcgucgacguucgccgccagcac

SEQ ID NO: 2888599 - RNA, 16 nt, Mycobacterium avium subsp. paratuberculosis
gcgucgacugcaccga

SEQ ID NO: 2888600 - RNA, 17 nt, Mycobacterium avium subsp. paratuberculosis
gcgucgacugcaccgac

SEQ ID NO: 2888601 - RNA, 18 nt, Mycobacterium avium subsp. paratuberculosis
gcgucgacugcaccgacu

SEQ ID NO: 2888602 - RNA, 15 nt, Mycobacterium avium subsp. paratuberculosis
gcgucgagcaccugg

SEQ ID NO: 2888603 - RNA, 15 nt, Mycobacterium avium subsp. paratuberculosis
gcgucgagcagcacc

SEQ ID NO: 2888604 - RNA, 16 nt, Mycobacterium avium subsp. paratuberculosis
gcgucgagcagcacca

SEQ ID NO: 2888605 - RNA, 14 nt, Mycobacterium avium subsp. paratuberculosis
gcgucgagcgcguc

SEQ ID NO: 2888606 - RNA, 14 nt, Mycobacterium avium subsp. paratuberculosis
gcgucgagcguggg

SEQ ID NO: 2888607 - RNA, 16 nt, Mycobacterium avium subsp. paratuberculosis
gcgucgagcgugggcc

SEQ ID NO: 2888608 - RNA, 15 nt, Mycobacterium avium subsp. paratuberculosis
gcgucgaguucgccg

SEQ ID NO: 2888609 - RNA, 19 nt, Mycobacterium avium subsp. paratuberculosis
gcgucgaucagcgcgccgc

SEQ ID NO: 2888610 - RNA, 16 nt, Mycobacterium avium subsp. paratuberculosis
gcgucgaugaccucgc

SEQ ID NO: 2888611 - RNA, 17 nt, Mycobacterium avium subsp. paratuberculosis
gcgucgaugaccucgcg

SEQ ID NO: 2888612 - RNA, 18 nt, Mycobacterium avium subsp. paratuberculosis
gcgucgaugaccucgcgc

SEQ ID NO: 2888613 - RNA, 16 nt, Mycobacterium avium subsp. paratuberculosis
gcgucgaugaugccgg

SEQ ID NO: 2888614 - RNA, 19 nt, Mycobacterium avium subsp. paratuberculosis
gcgucgaugccgaucacgg

SEQ ID NO: 2888615 - RNA, 15 nt, Mycobacterium avium subsp. paratuberculosis
gcgucgaugccggcg

SEQ ID NO: 2888616 - RNA, 17 nt, Mycobacterium avium subsp. paratuberculosis
gcgucgaugccggcgau

SEQ ID NO: 2888617 - RNA, 15 nt, Mycobacterium avium subsp. paratuberculosis
gcgucgaugcgcgcc

SEQ ID NO: 2888618 - RNA, 17 nt, Mycobacterium avium subsp. paratuberculosis
gcgucgaugcgcgccac

SEQ ID NO: 2888619 - RNA, 17 nt, Mycobacterium avium subsp. paratuberculosis
gcgucgaugcgggcccg

SEQ ID NO: 2888620 - RNA, 17 nt, Mycobacterium avium subsp. paratuberculosis
gcgucgaugucgcccgg

SEQ ID NO: 2888621 - RNA, 20 nt, Mycobacterium avium subsp. paratuberculosis
gcgucgaugucgcccggcgc

SEQ ID NO: 2888622 - RNA, 22 nt, Mycobacterium avium subsp. paratuberculosis
gcgucgaugucgucgucgacgc

SEQ ID NO: 2888623 - RNA, 20 nt, Mycobacterium avium subsp. paratuberculosis
gcgucgaugugggccgcagc

SEQ ID NO: 2888624 - RNA, 21 nt, Mycobacterium avium subsp. paratuberculosis
gcgucgaugugggccgcagca

SEQ ID NO: 2888625 - RNA, 15 nt, Mycobacterium avium subsp. paratuberculosis
gcgucgcacagcgcc

SEQ ID NO: 2888626 - RNA, 16 nt, Mycobacterium avium subsp. paratuberculosis
gcgucgcacagcgccg

SEQ ID NO: 2888627 - RNA, 17 nt, Mycobacterium avium subsp. paratuberculosis
gcgucgcacagcgccgc

SEQ ID NO: 2888628 - RNA, 15 nt, Mycobacterium avium subsp. paratuberculosis
gcgucgcacguggug

SEQ ID NO: 2888629 - RNA, 17 nt, Mycobacterium avium subsp. paratuberculosis
gcgucgcagaucccgcc

SEQ ID NO: 2888630 - RNA, 19 nt, Mycobacterium avium subsp. paratuberculosis
gcgucgcagaucccgccgg

SEQ ID NO: 2888631 - RNA, 20 nt, Mycobacterium avium subsp. paratuberculosis
gcgucgcagaucccgccggc

SEQ ID NO: 2888632 - RNA, 21 nt, Mycobacterium avium subsp. paratuberculosis
gcgucgcagugccggugcagc

SEQ ID NO: 2888633 - RNA, 18 nt, Mycobacterium avium subsp. paratuberculosis
gcgucgccaauccggcgg

SEQ ID NO: 2888634 - RNA, 14 nt, Mycobacterium avium subsp. paratuberculosis
gcgucgccaccacc

SEQ ID NO: 2888635 - RNA, 17 nt, Mycobacterium avium subsp. paratuberculosis
gcgucgccaccaccuuc

SEQ ID NO: 2888636 - RNA, 13 nt, Mycobacterium avium subsp. paratuberculosis
gcgucgccagccg

SEQ ID NO: 2888637 - RNA, 14 nt, Mycobacterium avium subsp. paratuberculosis
gcgucgccagccgc

SEQ ID NO: 2888638 - RNA, 20 nt, Mycobacterium avium subsp. paratuberculosis
gcgucgccagccgccggcuc

SEQ ID NO: 2888639 - RNA, 21 nt, Mycobacterium avium subsp. paratuberculosis
gcgucgccaugccgucgcgca

SEQ ID NO: 2888640 - RNA, 13 nt, Mycobacterium avium subsp. paratuberculosis
gcgucgcccacgc

SEQ ID NO: 2888641 - RNA, 16 nt, Mycobacterium avium subsp. paratuberculosis
gcgucgcccacgccgg

SEQ ID NO: 2888642 - RNA, 17 nt, Mycobacterium avium subsp. paratuberculosis
gcgucgcccacgccggu

SEQ ID NO: 2888643 - RNA, 15 nt, Mycobacterium avium subsp. paratuberculosis
gcgucggcgccggcc

SEQ ID NO: 2888644 - RNA, 13 nt, Mycobacterium avium subsp. paratuberculosis
gcgucggcgcgca

SEQ ID NO: 2888645 - RNA, 14 nt, Mycobacterium avium subsp. paratuberculosis
gcgucggcgcgcac

SEQ ID NO: 2888646 - RNA, 16 nt, Mycobacterium avium subsp. paratuberculosis
gcgucggcgcgcaccg

SEQ ID NO: 2888647 - RNA, 17 nt, Mycobacterium avium subsp. paratuberculosis
gcgucggcgcgcaccgc

SEQ ID NO: 2888648 - RNA, 15 nt, Mycobacterium avium subsp. paratuberculosis
gcgucggcgcgugcc

SEQ ID NO: 2888649 - RNA, 14 nt, Mycobacterium avium subsp. paratuberculosis
gcgucggcgcuggc

SEQ ID NO: 2888650 - RNA, 21 nt, Mycobacterium avium subsp. paratuberculosis
gcgucggcgcuggccagcgcg

SEQ ID NO: 2888651 - RNA, 14 nt, Mycobacterium avium subsp. paratuberculosis
gcgucggcggccug

SEQ ID NO: 2888652 - RNA, 15 nt, Mycobacterium avium subsp. paratuberculosis
gcgucggcggccugc

SEQ ID NO: 2888653 - RNA, 16 nt, Mycobacterium avium subsp. paratuberculosis
gcgucggcggccugcu

SEQ ID NO: 2888654 - RNA, 23 nt, Mycobacterium avium subsp. paratuberculosis
gcgucggcggccugcuccagcga

SEQ ID NO: 2888655 - RNA, 16 nt, Mycobacterium avium subsp. paratuberculosis
gcgucggcggccuuga

SEQ ID NO: 2888656 - RNA, 14 nt, Mycobacterium avium subsp. paratuberculosis
gcgucggcggcggc

SEQ ID NO: 2888657 - RNA, 15 nt, Mycobacterium avium subsp. paratuberculosis
gcgucggcgggcgug

SEQ ID NO: 2888658 - RNA, 18 nt, Mycobacterium avium subsp. paratuberculosis
gcgucggcgggcgugccg

SEQ ID NO: 2888659 - RNA, 17 nt, Mycobacterium avium subsp. paratuberculosis
gcgucggcggucgccag

SEQ ID NO: 2888660 - RNA, 19 nt, Mycobacterium avium subsp. paratuberculosis
gcgucggcggucgccagcg

SEQ ID NO: 2888661 - RNA, 20 nt, Mycobacterium avium subsp. paratuberculosis
gcgucggcggucgccagcgc

SEQ ID NO: 2888662 - RNA, 23 nt, Mycobacterium avium subsp. paratuberculosis
gcgucggcggucgccagcgccac

SEQ ID NO: 2888663 - RNA, 14 nt, Mycobacterium avium subsp. paratuberculosis
gcgucggcgguggu

SEQ ID NO: 2888664 - RNA, 18 nt, Mycobacterium avium subsp. paratuberculosis
gcgucggcggugguccgc

SEQ ID NO: 2888665 - RNA, 16 nt, Mycobacterium avium subsp. paratuberculosis
gcgucggcguccaugc

SEQ ID NO: 2888666 - RNA, 18 nt, Mycobacterium avium subsp. paratuberculosis
gcgucggcguccaugcuc

SEQ ID NO: 2888667 - RNA, 16 nt, Mycobacterium avium subsp. paratuberculosis
gcgucggcgucgaacg

SEQ ID NO: 2888668 - RNA, 18 nt, Mycobacterium avium subsp. paratuberculosis
gcgucggcgucgaacggc

SEQ ID NO: 2888669 - RNA, 20 nt, Mycobacterium avium subsp. paratuberculosis
gcgucggcgucgaacggcgu

SEQ ID NO: 2888670 - RNA, 14 nt, Mycobacterium avium subsp. paratuberculosis
gcgucggcgucggg

SEQ ID NO: 2888671 - RNA, 16 nt, Mycobacterium avium subsp. paratuberculosis
gcgucggcgugcccgc

SEQ ID NO: 2888672 - RNA, 17 nt, Mycobacterium avium subsp. paratuberculosis
gcgucggcgugcccgcc

SEQ ID NO: 2888673 - RNA, 23 nt, Mycobacterium avium subsp. paratuberculosis
gcgucggcgugcccgccgaccag

SEQ ID NO: 2888674 - RNA, 12 nt, Mycobacterium avium subsp. paratuberculosis
gcgucgggcacc

SEQ ID NO: 2888675 - RNA, 16 nt, Mycobacterium avium subsp. paratuberculosis
gcgucgggcagcagcu

SEQ ID NO: 2888676 - RNA, 13 nt, Mycobacterium avium subsp. paratuberculosis
gcgucgggcaggu

SEQ ID NO: 2888677 - RNA, 14 nt, Mycobacterium avium subsp. paratuberculosis
gcgucgggccgggg

SEQ ID NO: 2888678 - RNA, 17 nt, Mycobacterium avium subsp. paratuberculosis
gcgucgggccgggggcg

SEQ ID NO: 2888679 - RNA, 21 nt, Mycobacterium avium subsp. paratuberculosis
gcgucgggccgggggcggcgg

SEQ ID NO: 2888680 - RNA, 16 nt, Mycobacterium avium subsp. paratuberculosis
gcgucgggcgccggcg

SEQ ID NO: 2888681 - RNA, 16 nt, Mycobacterium avium subsp. paratuberculosis
gcgucgggcgggugga

SEQ ID NO: 2888682 - RNA, 15 nt, Mycobacterium avium subsp. paratuberculosis
gcgucgggcucgcgg

SEQ ID NO: 2888683 - RNA, 16 nt, Mycobacterium avium subsp. paratuberculosis
gcgucgggcucggccg

SEQ ID NO: 2888684 - RNA, 18 nt, Mycobacterium avium subsp. paratuberculosis
gcgucgggcucggccgcc

SEQ ID NO: 2888685 - RNA, 19 nt, Mycobacterium avium subsp. paratuberculosis
gcgucgggcucggccgccg

SEQ ID NO: 2888686 - RNA, 22 nt, Mycobacterium avium subsp. paratuberculosis
gcgcaggucacccuccucgcgg

SEQ ID NO: 2888687 - RNA, 17 nt, Mycobacterium avium subsp. paratuberculosis
gcgcagguccacccgcc

SEQ ID NO: 2888688 - RNA, 18 nt, Mycobacterium avium subsp. paratuberculosis
gcgcagguccacccgccc

SEQ ID NO: 2888689 - RNA, 16 nt, Mycobacterium avium subsp. paratuberculosis
gcgcagguccggcagc

SEQ ID NO: 2888690 - RNA, 19 nt, Mycobacterium avium subsp. paratuberculosis
gcgcagguccggcagcgcg

SEQ ID NO: 2888691 - RNA, 20 nt, Mycobacterium avium subsp. paratuberculosis
gcgcagguccggcagcgcgc

SEQ ID NO: 2888692 - RNA, 21 nt, Mycobacterium avium subsp. paratuberculosis
gcgcagguccggcagcgcgcc

SEQ ID NO: 2888693 - RNA, 22 nt, Mycobacterium avium subsp. paratuberculosis
gcgcagguccggcagcgcgccc

SEQ ID NO: 2888694 - RNA, 21 nt, Mycobacterium avium subsp. paratuberculosis
gcgcagguccguggugaucgc

SEQ ID NO: 2888695 - RNA, 16 nt, Mycobacterium avium subsp. paratuberculosis
gcgcagguccucggac

SEQ ID NO: 2888696 - RNA, 22 nt, Mycobacterium avium subsp. paratuberculosis
gcgcagguccucggacucgucg

SEQ ID NO: 2888697 - RNA, 13 nt, Mycobacterium avium subsp. paratuberculosis
gcgcaggucgggc

SEQ ID NO: 2888698 - RNA, 18 nt, Mycobacterium avium subsp. paratuberculosis
gcgcaggucgggccggcc

SEQ ID NO: 2888699 - RNA, 21 nt, Mycobacterium avium subsp. paratuberculosis
gcgcaggugaucaaagccggu

SEQ ID NO: 2888700 - RNA, 23 nt, Mycobacterium avium subsp. paratuberculosis
gcgcaggugaucaaagccggugg

SEQ ID NO: 2888701 - RNA, 17 nt, Mycobacterium avium subsp. paratuberculosis
gcgcaggugggcggugc

SEQ ID NO: 2888702 - RNA, 20 nt, Mycobacterium avium subsp. paratuberculosis
gcgcaggugggcggugcgca

SEQ ID NO: 2888703 - RNA, 17 nt, Mycobacterium avium subsp. paratuberculosis
gcgcaggugugcggcaa

SEQ ID NO: 2888704 - RNA, 21 nt, Mycobacterium avium subsp. paratuberculosis
gcgcaggugugcggcaagcga

SEQ ID NO: 2888705 - RNA, 17 nt, Mycobacterium avium subsp. paratuberculosis
gcgcagguuguccagcc

SEQ ID NO: 2888706 - RNA, 18 nt, Mycobacterium avium subsp. paratuberculosis
gcgcagguuguccagccg

SEQ ID NO: 2888707 - RNA, 19 nt, Mycobacterium avium subsp. paratuberculosis
gcgcagguugucggccaac

SEQ ID NO: 2888708 - RNA, 14 nt, Mycobacterium avium subsp. paratuberculosis
gcgcaguagccgac

SEQ ID NO: 2888709 - RNA, 18 nt, Mycobacterium avium subsp. paratuberculosis
gcgcaguagccgacgugc

SEQ ID NO: 2888710 - RNA, 22 nt, Mycobacterium avium subsp. paratuberculosis
gcgcaguagccgacgugcccga

SEQ ID NO: 2888711 - RNA, 18 nt, Mycobacterium avium subsp. paratuberculosis
gcgcagucgcaggccccg

SEQ ID NO: 2888712 - RNA, 15 nt, Mycobacterium avium subsp. paratuberculosis
gcgcagucgcugguc

SEQ ID NO: 2888713 - RNA, 16 nt, Mycobacterium avium subsp. paratuberculosis
gcgcagucggccggau

SEQ ID NO: 2888714 - RNA, 22 nt, Mycobacterium avium subsp. paratuberculosis
gcgcagucggccggauucucgc

SEQ ID NO: 2888715 - RNA, 15 nt, Mycobacterium avium subsp. paratuberculosis
gcgcagucggcgucg

SEQ ID NO: 2888716 - RNA, 17 nt, Mycobacterium avium subsp. paratuberculosis
gcgcaguucgaccggca

SEQ ID NO: 2888717 - RNA, 14 nt, Mycobacterium avium subsp. paratuberculosis
gcgcaguugcgcgg

SEQ ID NO: 2888718 - RNA, 15 nt, Mycobacterium avium subsp. paratuberculosis
gcgcaguugcgcggc

SEQ ID NO: 2888719 - RNA, 17 nt, Mycobacterium avium subsp. paratuberculosis
gcgcaguugcgcggcgg

SEQ ID NO: 2888720 - RNA, 19 nt, Mycobacterium avium subsp. paratuberculosis
gcgcaguugcgcggcgggc

SEQ ID NO: 2888721 - RNA, 20 nt, Mycobacterium avium subsp. paratuberculosis
gcgcauaaaccugguuggcg

SEQ ID NO: 2888722 - RNA, 21 nt, Mycobacterium avium subsp. paratuberculosis
gcgcauaaaccugguuggcga

SEQ ID NO: 2888723 - RNA, 22 nt, Mycobacterium avium subsp. paratuberculosis
gcgcauaaaccugguuggcgac

SEQ ID NO: 2888724 - RNA, 14 nt, Mycobacterium avium subsp. paratuberculosis
gcgcaucacccggc

SEQ ID NO: 2888725 - RNA, 15 nt, Mycobacterium avium subsp. paratuberculosis
gcgcaucacccggcg

SEQ ID NO: 2888726 - RNA, 16 nt, Mycobacterium avium subsp. paratuberculosis
gcgcaucacccggcgc

SEQ ID NO: 2888727 - RNA, 17 nt, Mycobacterium avium subsp. paratuberculosis
gcgcaucacccggcgcg

SEQ ID NO: 2888728 - RNA, 20 nt, Mycobacterium avium subsp. paratuberculosis
gcgcaucacccggcgcgcgg

SEQ ID NO: 2888729 - RNA, 22 nt, Mycobacterium avium subsp. paratuberculosis
gcgcaucaccgaggucaccgcg

SEQ ID NO: 2888730 - RNA, 22 nt, Mycobacterium avium subsp. paratuberculosis
gcgcaucaccuucugcgucggc

SEQ ID NO: 2888731 - RNA, 20 nt, Mycobacterium avium subsp. paratuberculosis
gcgcaucagcgccaccagca

SEQ ID NO: 2888732 - RNA, 14 nt, Mycobacterium avium subsp. paratuberculosis
gcgcaucagcgggg

SEQ ID NO: 2888733 - RNA, 16 nt, Mycobacterium avium subsp. paratuberculosis
gcgcaucagcggggcg

SEQ ID NO: 2888734 - RNA, 21 nt, Mycobacterium avium subsp. paratuberculosis
gcgcaucagcggggcguccag

SEQ ID NO: 2888735 - RNA, 14 nt, Mycobacterium avium subsp. paratuberculosis
gcgcaucagcucuu

SEQ ID NO: 2888736 - RNA, 19 nt, Mycobacterium avium subsp. paratuberculosis
gcgcaucaucgcccagcgc

SEQ ID NO: 2888737 - RNA, 20 nt, Mycobacterium avium subsp. paratuberculosis
gcgcaucaucgcccagcgca

SEQ ID NO: 2888738 - RNA, 23 nt, Mycobacterium avium subsp. paratuberculosis
gcgcaucaugcguuugccgucga

SEQ ID NO: 2888739 - RNA, 17 nt, Mycobacterium avium subsp. paratuberculosis
gcgcaucaugucgaaga

SEQ ID NO: 2888740 - RNA, 14 nt, Mycobacterium avium subsp. paratuberculosis
gcgcaucccgaucg

SEQ ID NO: 2888741 - RNA, 14 nt, Mycobacterium avium subsp. paratuberculosis
gcgcaucccgucga

SEQ ID NO: 2888742 - RNA, 16 nt, Mycobacterium avium subsp. paratuberculosis
gcgcaucccgucgacc

SEQ ID NO: 2888743 - RNA, 17 nt, Mycobacterium avium subsp. paratuberculosis
gcgcaucccgucgacca

SEQ ID NO: 2888744 - RNA, 18 nt, Mycobacterium avium subsp. paratuberculosis
gcgcaucccgucgaccag

SEQ ID NO: 2888745 - RNA, 13 nt, Mycobacterium avium subsp. paratuberculosis
gcgcauccgacac

SEQ ID NO: 2888746 - RNA, 16 nt, Mycobacterium avium subsp. paratuberculosis
gcgcauccgacaccgc

SEQ ID NO: 2888747 - RNA, 18 nt, Mycobacterium avium subsp. paratuberculosis
gcgcauccgacaccgccu

SEQ ID NO: 2888748 - RNA, 14 nt, Mycobacterium avium subsp. paratuberculosis
gcgcauccgcaccg

SEQ ID NO: 2888749 - RNA, 15 nt, Mycobacterium avium subsp. paratuberculosis
gcgcauccgcaccga

SEQ ID NO: 2888750 - RNA, 23 nt, Mycobacterium avium subsp. paratuberculosis
gcgcauccgcaccgagaccaugc

SEQ ID NO: 2888751 - RNA, 19 nt, Mycobacterium avium subsp. paratuberculosis
gcgcauccucauagccggc

SEQ ID NO: 2888752 - RNA, 21 nt, Mycobacterium avium subsp. paratuberculosis
gcgcaucgacugcgacacccg

SEQ ID NO: 2888753 - RNA, 22 nt, Mycobacterium avium subsp. paratuberculosis
gcgcaucgacugcgacacccgc

SEQ ID NO: 2888754 - RNA, 12 nt, Mycobacterium avium subsp. paratuberculosis
gcgcaucgagcu

SEQ ID NO: 2888755 - RNA, 13 nt, Mycobacterium avium subsp. paratuberculosis
gcgcaucgccggc

SEQ ID NO: 2888756 - RNA, 15 nt, Mycobacterium avium subsp. paratuberculosis
gcgcaucgccggcga

SEQ ID NO: 2888757 - RNA, 16 nt, Mycobacterium avium subsp. paratuberculosis
gcgcaucgccggcgau

SEQ ID NO: 2888758 - RNA, 16 nt, Mycobacterium avium subsp. paratuberculosis
gcgcaucgccggcgcg

SEQ ID NO: 2888759 - RNA, 18 nt, Mycobacterium avium subsp. paratuberculosis
gcgcaucgccggcgcgcu

SEQ ID NO: 2888760 - RNA, 18 nt, Mycobacterium avium subsp. paratuberculosis
gcgcaucgccguccacgg

SEQ ID NO: 2888761 - RNA, 21 nt, Mycobacterium avium subsp. paratuberculosis
gcgcaucgccucggcggccgc

SEQ ID NO: 2888762 - RNA, 14 nt, Mycobacterium avium subsp. paratuberculosis
gcgcaucgcgggcc

SEQ ID NO: 2888763 - RNA, 15 nt, Mycobacterium avium subsp. paratuberculosis
gcgcaucgcgggcca

SEQ ID NO: 2888764 - RNA, 19 nt, Mycobacterium avium subsp. paratuberculosis
gcgcaucgcgggccaccgg

SEQ ID NO: 2888765 - RNA, 20 nt, Mycobacterium avium subsp. paratuberculosis
gcgcaucgcgggccaccggc

SEQ ID NO: 2888766 - RNA, 21 nt, Mycobacterium avium subsp. paratuberculosis
gcgcaucgcgggccaccggcg

SEQ ID NO: 2888767 - RNA, 16 nt, Mycobacterium avium subsp. paratuberculosis
gcgcaucggcgacgcc

SEQ ID NO: 2888768 - RNA, 18 nt, Mycobacterium avium subsp. paratuberculosis
gcgcaucggcgacgccgc

SEQ ID NO: 2888769 - RNA, 20 nt, Mycobacterium avium subsp. paratuberculosis
gcgcaucggcgacgccgccg

SEQ ID NO: 2888770 - RNA, 22 nt, Mycobacterium avium subsp. paratuberculosis
gcgcaucggcgacgccgccguc

SEQ ID NO: 2888771 - RNA, 13 nt, Mycobacterium avium subsp. paratuberculosis
gcgcaucggucac

SEQ ID NO: 2888772 - RNA, 18 nt, Mycobacterium avium subsp. paratuberculosis
gcgcaucggucaccagcu

SEQ ID NO: 2888773 - RNA, 20 nt, Mycobacterium avium subsp. paratuberculosis
gcgcaucggucagcaacagc

SEQ ID NO: 2888774 - RNA, 17 nt, Mycobacterium avium subsp. paratuberculosis
gcgcaucgucgcggcgc

SEQ ID NO: 2888775 - RNA, 16 nt, Mycobacterium avium subsp. paratuberculosis
gcgcaucguugccggc

SEQ ID NO: 2888776 - RNA, 17 nt, Mycobacterium avium subsp. paratuberculosis
gcgcaucguugccggcg

SEQ ID NO: 2888777 - RNA, 18 nt, Mycobacterium avium subsp. paratuberculosis
gcgcaucguugccggcgg

SEQ ID NO: 2888778 - RNA, 21 nt, Mycobacterium avium subsp. paratuberculosis
gcgcaucguugccggcggcga

SEQ ID NO: 2888779 - RNA, 14 nt, Mycobacterium avium subsp. paratuberculosis
gcgcaucugcucgg

SEQ ID NO: 2888780 - RNA, 15 nt, Mycobacterium avium subsp. paratuberculosis
gcgcaucugcucggc

SEQ ID NO: 2888781 - RNA, 16 nt, Mycobacterium avium subsp. paratuberculosis
gcgcaucugcucggcg

SEQ ID NO: 2888782 - RNA, 17 nt, Mycobacterium avium subsp. paratuberculosis
gcgcaucuugaucucgc

SEQ ID NO: 2888783 - RNA, 17 nt, Mycobacterium avium subsp. paratuberculosis
gcgcaugaccgauccgc

SEQ ID NO: 2888784 - RNA, 20 nt, Mycobacterium avium subsp. paratuberculosis
gcgcaugaccgauccgccgg

SEQ ID NO: 2888785 - RNA, 21 nt, Mycobacterium avium subsp. paratuberculosis
gcgcaugaccgauccgccggc

SEQ ID NO: 2888786 - RNA, 20 nt, Mycobacterium avium subsp. paratuberculosis
gcgcaugacggccugcacca

SEQ ID NO: 2888787 - RNA, 21 nt, Mycobacterium avium subsp. paratuberculosis
gcgcaugacggccugcaccac

SEQ ID NO: 2888788 - RNA, 15 nt, Mycobacterium avium subsp. paratuberculosis
gcgcauggagaugcu

SEQ ID NO: 2888789 - RNA, 16 nt, Mycobacterium avium subsp. paratuberculosis
gcgcauggcgugcuga

SEQ ID NO: 2888790 - RNA, 20 nt, Mycobacterium avium subsp. paratuberculosis
gcgcauggucagguaggcgu

SEQ ID NO: 2888791 - RNA, 23 nt, Mycobacterium avium subsp. paratuberculosis
gcgcauggucagguaggcgucga

SEQ ID NO: 2888792 - RNA, 17 nt, Mycobacterium avium subsp. paratuberculosis
gcgcauguaggacaccc

SEQ ID NO: 2888793 - RNA, 14 nt, Mycobacterium avium subsp. paratuberculosis
gcgcauucaccagc

SEQ ID NO: 2888794 - RNA, 16 nt, Mycobacterium avium subsp. paratuberculosis
gcgcauucaccagcug

SEQ ID NO: 2888795 - RNA, 17 nt, Mycobacterium avium subsp. paratuberculosis
gcgcauucaccagcugu

SEQ ID NO: 2888796 - RNA, 17 nt, Mycobacterium avium subsp. paratuberculosis
gcgcauucggcgacgcu

SEQ ID NO: 2888797 - RNA, 22 nt, Mycobacterium avium subsp. paratuberculosis
gcgcauucggcgacgcucaggc

SEQ ID NO: 2888798 - RNA, 21 nt, Mycobacterium avium subsp. paratuberculosis
gcgccaacaacucgacgcucg

SEQ ID NO: 2888799 - RNA, 23 nt, Mycobacterium avium subsp. paratuberculosis
gcgccaacaacucgacgcucggc

SEQ ID NO: 2888800 - RNA, 15 nt, Mycobacterium avium subsp. paratuberculosis
gcgccaacauggcgc

SEQ ID NO: 2888801 - RNA, 19 nt, Mycobacterium avium subsp. paratuberculosis
gcgccaaccuguuuggcug

SEQ ID NO: 2888802 - RNA, 18 nt, Mycobacterium avium subsp. paratuberculosis
gcgccaacgaggcacggc

SEQ ID NO: 2888803 - RNA, 21 nt, Mycobacterium avium subsp. paratuberculosis
gcgccaacgcuuuugcggguc

SEQ ID NO: 2888804 - RNA, 21 nt, Mycobacterium avium subsp. paratuberculosis
gcgccaacugaauuccuggcc

SEQ ID NO: 2888805 - RNA, 23 nt, Mycobacterium avium subsp. paratuberculosis
gcgccaacugaauuccuggccgg

SEQ ID NO: 2888806 - RNA, 13 nt, Mycobacterium avium subsp. paratuberculosis
gcgccaaugguuu

SEQ ID NO: 2888807 - RNA, 22 nt, Mycobacterium avium subsp. paratuberculosis
gcgccacaacagguucgacagc

SEQ ID NO: 2888808 - RNA, 23 nt, Mycobacterium avium subsp. paratuberculosis
gcgccacaacagguucgacagcg

SEQ ID NO: 2888809 - RNA, 19 nt, Mycobacterium avium subsp. paratuberculosis
gcgccacaacuggucgugc

SEQ ID NO: 2888810 - RNA, 22 nt, Mycobacterium avium subsp. paratuberculosis
gcgccacaauggauccgaucag

SEQ ID NO: 2888811 - RNA, 16 nt, Mycobacterium avium subsp. paratuberculosis
gcgccacagcagcacc

SEQ ID NO: 2888812 - RNA, 17 nt, Mycobacterium avium subsp. paratuberculosis
gcgccacagcagcacca

SEQ ID NO: 2888813 - RNA, 20 nt, Mycobacterium avium subsp. paratuberculosis
gcgccacagcagcaccagcg

SEQ ID NO: 2888814 - RNA, 21 nt, Mycobacterium avium subsp. paratuberculosis
gcgccacagcagcaccagcgc

SEQ ID NO: 2888815 - RNA, 14 nt, Mycobacterium avium subsp. paratuberculosis
gcgccacagccggg

SEQ ID NO: 2888816 - RNA, 15 nt, Mycobacterium avium subsp. paratuberculosis
gcgccacagccgggg

SEQ ID NO: 2888817 - RNA, 24 nt, Mycobacterium avium subsp. paratuberculosis
gcgccacagccggggaucgcgcag

SEQ ID NO: 2888818 - RNA, 21 nt, Mycobacterium avium subsp. paratuberculosis
gcgccacagcgucucgaccgc

SEQ ID NO: 2888819 - RNA, 15 nt, Mycobacterium avium subsp. paratuberculosis
gcgccacaucagcuc

SEQ ID NO: 2888820 - RNA, 17 nt, Mycobacterium avium subsp. paratuberculosis
gcgccacaucagcucgg

SEQ ID NO: 2888821 - RNA, 18 nt, Mycobacterium avium subsp. paratuberculosis
gcgccacaucagcucggc

SEQ ID NO: 2888822 - RNA, 21 nt, Mycobacterium avium subsp. paratuberculosis
gcgccacaucagcucggcggc

SEQ ID NO: 2888823 - RNA, 22 nt, Mycobacterium avium subsp. paratuberculosis
gcgccacaucagcucggcggcc

SEQ ID NO: 2888824 - RNA, 23 nt, Mycobacterium avium subsp. paratuberculosis
gcgccacaucagcucggcggccu

SEQ ID NO: 2888825 - RNA, 15 nt, Mycobacterium avium subsp. paratuberculosis
gcgccaccagcaccg

SEQ ID NO: 2888826 - RNA, 17 nt, Mycobacterium avium subsp. paratuberculosis
gcgccaccagcaccggg

SEQ ID NO: 2888827 - RNA, 14 nt, Mycobacterium avium subsp. paratuberculosis
gcgccaccagccac

SEQ ID NO: 2888828 - RNA, 21 nt, Mycobacterium avium subsp. paratuberculosis
gcgccaccagccacaccgccg

SEQ ID NO: 2888829 - RNA, 22 nt, Mycobacterium avium subsp. paratuberculosis
gcgccaccagccacaccgccgc

SEQ ID NO: 2888830 - RNA, 14 nt, Mycobacterium avium subsp. paratuberculosis
gcgccaccagcucc

SEQ ID NO: 2888831 - RNA, 18 nt, Mycobacterium avium subsp. paratuberculosis
gcgccaccagcuccucga

SEQ ID NO: 2888832 - RNA, 15 nt, Mycobacterium avium subsp. paratuberculosis
gcgccaccaggcggu

SEQ ID NO: 2888833 - RNA, 14 nt, Mycobacterium avium subsp. paratuberculosis
gcgccaccccgaac

SEQ ID NO: 2888834 - RNA, 20 nt, Mycobacterium avium subsp. paratuberculosis
gcgccaccccgaacccggcc

SEQ ID NO: 2888835 - RNA, 21 nt, Mycobacterium avium subsp. paratuberculosis
gcgccaccccgaacccggcca

SEQ ID NO: 2888836 - RNA, 23 nt, Mycobacterium avium subsp. paratuberculosis
gcgccaccccgaacccggccagc

SEQ ID NO: 2888837 - RNA, 14 nt, Mycobacterium avium subsp. paratuberculosis
gcgccaccccggga

SEQ ID NO: 2888838 - RNA, 17 nt, Mycobacterium avium subsp. paratuberculosis
gcgccaccccgggaacg

SEQ ID NO: 2888839 - RNA, 14 nt, Mycobacterium avium subsp. paratuberculosis
gcgccacccgacga

SEQ ID NO: 2888840 - RNA, 16 nt, Mycobacterium avium subsp. paratuberculosis
gcgccacccgcaugcu

SEQ ID NO: 2888841 - RNA, 16 nt, Mycobacterium avium subsp. paratuberculosis
gcgccaccgacaccac

SEQ ID NO: 2888842 - RNA, 18 nt, Mycobacterium avium subsp. paratuberculosis
gcgccaccgacaccaccg

SEQ ID NO: 2888843 - RNA, 19 nt, Mycobacterium avium subsp. paratuberculosis
gcgccaccgacaccaccgg

SEQ ID NO: 2888844 - RNA, 21 nt, Mycobacterium avium subsp. paratuberculosis
gcgccaccgacaccaccggcc

SEQ ID NO: 2888845 - RNA, 15 nt, Mycobacterium avium subsp. paratuberculosis
gcgccaccgcggggc

SEQ ID NO: 2888846 - RNA, 20 nt, Mycobacterium avium subsp. paratuberculosis
gcgccaccgcggggcugggc

SEQ ID NO: 2888847 - RNA, 21 nt, Mycobacterium avium subsp. paratuberculosis
gcgccaccgcggggcugggcg

SEQ ID NO: 2888848 - RNA, 13 nt, Mycobacterium avium subsp. paratuberculosis
gcgccaccggcug

SEQ ID NO: 2888849 - RNA, 19 nt, Mycobacterium avium subsp. paratuberculosis
gcgccaccggcuggccgga

SEQ ID NO: 2888850 - RNA, 19 nt, Mycobacterium avium subsp. paratuberculosis
gcgccaccgggaccugcug

SEQ ID NO: 2888851 - RNA, 20 nt, Mycobacterium avium subsp. paratuberculosis
gcgccaccggguaagugucg

SEQ ID NO: 2888852 - RNA, 13 nt, Mycobacterium avium subsp. paratuberculosis
gcgccaccuccga

SEQ ID NO: 2888853 - RNA, 15 nt, Mycobacterium avium subsp. paratuberculosis
gcgccacgaccagcg

SEQ ID NO: 2888854 - RNA, 21 nt, Mycobacterium avium subsp. paratuberculosis
gcgccacgaccagcggcagca

SEQ ID NO: 2888855 - RNA, 22 nt, Mycobacterium avium subsp. paratuberculosis
gcgccacgacguacccccgcac

SEQ ID NO: 2888856 - RNA, 18 nt, Mycobacterium avium subsp. paratuberculosis
gcgccacgacugcgcggc

SEQ ID NO: 2888857 - RNA, 19 nt, Mycobacterium avium subsp. paratuberculosis
gcgccacgacugcgcggcc

SEQ ID NO: 2888858 - RNA, 21 nt, Mycobacterium avium subsp. paratuberculosis
gcgccacgacugcgcggccgg

SEQ ID NO: 2888859 - RNA, 23 nt, Mycobacterium avium subsp. paratuberculosis
gcgccacgacugcgcggccggcg

SEQ ID NO: 2888860 - RNA, 15 nt, Mycobacterium avium subsp. paratuberculosis
gcgccacgcacaccg

SEQ ID NO: 2888861 - RNA, 16 nt, Mycobacterium avium subsp. paratuberculosis
gcgccacgcacaccgc

SEQ ID NO: 2888862 - RNA, 20 nt, Mycobacterium avium subsp. paratuberculosis
gcgccacgcacaccgcgcgc

SEQ ID NO: 2888863 - RNA, 19 nt, Mycobacterium avium subsp. paratuberculosis
gcgccacgccgcccccgcc

SEQ ID NO: 2888864 - RNA, 13 nt, Mycobacterium avium subsp. paratuberculosis
gcgccacgccgcg

SEQ ID NO: 2888865 - RNA, 22 nt, Mycobacterium avium subsp. paratuberculosis
gcgccacgccgcgauccgggca

SEQ ID NO: 2888866 - RNA, 18 nt, Mycobacterium avium subsp. paratuberculosis
gcgccacgcgcagggcga

SEQ ID NO: 2888867 - RNA, 19 nt, Mycobacterium avium subsp. paratuberculosis
gcgccacgcucaugcccgc

SEQ ID NO: 2888868 - RNA, 22 nt, Mycobacterium avium subsp. paratuberculosis
gcgccacgcucaugcccgccac

SEQ ID NO: 2888869 - RNA, 17 nt, Mycobacterium avium subsp. paratuberculosis
gcgccacgcuggcguga

SEQ ID NO: 2888870 - RNA, 21 nt, Mycobacterium avium subsp. paratuberculosis
gcgccacggguugagccagac

SEQ ID NO: 2888871 - RNA, 20 nt, Mycobacterium avium subsp. paratuberculosis
gcgccacgguggcggucagg

SEQ ID NO: 2888872 - RNA, 17 nt, Mycobacterium avium subsp. paratuberculosis
gcgccacguaucgcgcc

SEQ ID NO: 2888873 - RNA, 15 nt, Mycobacterium avium subsp. paratuberculosis
gcgccacguggucga

SEQ ID NO: 2888874 - RNA, 13 nt, Mycobacterium avium subsp. paratuberculosis
gcgccacugccgc

SEQ ID NO: 2888875 - RNA, 14 nt, Mycobacterium avium subsp. paratuberculosis
gcgccacugccgcc

SEQ ID NO: 2888876 - RNA, 17 nt, Mycobacterium avium subsp. paratuberculosis
gcgccacugccgccgcc

SEQ ID NO: 2888877 - RNA, 22 nt, Mycobacterium avium subsp. paratuberculosis
gcgccacugccgccgcccaggc

SEQ ID NO: 2888878 - RNA, 15 nt, Mycobacterium avium subsp. paratuberculosis
gcgccacuggcuggu

SEQ ID NO: 2888879 - RNA, 17 nt, Mycobacterium avium subsp. paratuberculosis
gcgccacuggcugguca

SEQ ID NO: 2888880 - RNA, 19 nt, Mycobacterium avium subsp. paratuberculosis
gcgccacuggcuggucacc

SEQ ID NO: 2888881 - RNA, 18 nt, Mycobacterium avium subsp. paratuberculosis
gcgccagacguccagcgc

SEQ ID NO: 2888882 - RNA, 19 nt, Mycobacterium avium subsp. paratuberculosis
gcgccagacguccagcgcc

SEQ ID NO: 2888883 - RNA, 20 nt, Mycobacterium avium subsp. paratuberculosis
gcgccagacguccagcgccg

SEQ ID NO: 2888884 - RNA, 22 nt, Mycobacterium avium subsp. paratuberculosis
gcgccagacguccagcgccgcc

SEQ ID NO: 2888885 - RNA, 14 nt, Mycobacterium avium subsp. paratuberculosis
gcgccagagcgcga

SEQ ID NO: 2888886 - RNA, 23 nt, Mycobacterium avium subsp. paratuberculosis
gcgccagagcgcgaaaaccagca

SEQ ID NO: 2888887 - RNA, 18 nt, Mycobacterium avium subsp. paratuberculosis
gcgccagaucagcguggu

SEQ ID NO: 2888888 - RNA, 17 nt, Mycobacterium avium subsp. paratuberculosis
gcgccagaucccgcagc

SEQ ID NO: 2888889 - RNA, 18 nt, Mycobacterium avium subsp. paratuberculosis
gcgccagaucccgcagcu

SEQ ID NO: 2888890 - RNA, 15 nt, Mycobacterium avium subsp. paratuberculosis
gcgccagaucgcuga

SEQ ID NO: 2888891 - RNA, 19 nt, Mycobacterium avium subsp. paratuberculosis
gcgccagaucgcugaugcg

SEQ ID NO: 2888892 - RNA, 23 nt, Mycobacterium avium subsp. paratuberculosis
gcgccagauuccgaaaggggucg

SEQ ID NO: 2888893 - RNA, 21 nt, Mycobacterium avium subsp. paratuberculosis
gcgccagcaacacccagccgc

SEQ ID NO: 2888894 - RNA, 13 nt, Mycobacterium avium subsp. paratuberculosis
gcgccagcaccgc

SEQ ID NO: 2888895 - RNA, 19 nt, Mycobacterium avium subsp. paratuberculosis
gcgccagcaccgccugggu

SEQ ID NO: 2888896 - RNA, 19 nt, Mycobacterium avium subsp. paratuberculosis
gcgccagcaccgggcccag

SEQ ID NO: 2888897 - RNA, 12 nt, Mycobacterium avium subsp. paratuberculosis
gcgccagcaccu

SEQ ID NO: 2888898 - RNA, 16 nt, Mycobacterium avium subsp. paratuberculosis
gcgccagcaccucgaa

SEQ ID NO: 2888899 - RNA, 21 nt, Mycobacterium avium subsp. paratuberculosis
gcgccagcaccucgaacgccg

SEQ ID NO: 2888900 - RNA, 17 nt, Mycobacterium avium subsp. paratuberculosis
gcgccagcaccucggcg

SEQ ID NO: 2888901 - RNA, 18 nt, Mycobacterium avium subsp. paratuberculosis
gcgccagcaccucggcga

SEQ ID NO: 2888902 - RNA, 21 nt, Mycobacterium avium subsp. paratuberculosis
gcgccagcaccucggcgacca

SEQ ID NO: 2888903 - RNA, 23 nt, Mycobacterium avium subsp. paratuberculosis
gcgccagcaccucggcgaccacg

SEQ ID NO: 2888904 - RNA, 22 nt, Mycobacterium avium subsp. paratuberculosis
gcgccagcacggccaccagcag

SEQ ID NO: 2888905 - RNA, 11 nt, Mycobacterium avium subsp. paratuberculosis
gcgccagcagc

SEQ ID NO: 2888906 - RNA, 15 nt, Mycobacterium avium subsp. paratuberculosis
gcgccagcagcaccu

SEQ ID NO: 2888907 - RNA, 17 nt, Mycobacterium avium subsp. paratuberculosis
gcgccagcagcaccuga

SEQ ID NO: 2888908 - RNA, 15 nt, Mycobacterium avium subsp. paratuberculosis
gcgccagcagcagcg

SEQ ID NO: 2888909 - RNA, 16 nt, Mycobacterium avium subsp. paratuberculosis
gcgccagcagcagcgc

SEQ ID NO: 2888910 - RNA, 18 nt, Mycobacterium avium subsp. paratuberculosis
gcgccagcagcagcgcgg

SEQ ID NO: 2888911 - RNA, 24 nt, Mycobacterium avium subsp. paratuberculosis
gcgccagcagcagcgcggcauggc

SEQ ID NO: 2888912 - RNA, 12 nt, Mycobacterium avium subsp. paratuberculosis
gcgccagcagcg

SEQ ID NO: 2888913 - RNA, 14 nt, Mycobacterium avium subsp. paratuberculosis
gcgccagcagcggc

SEQ ID NO: 2888914 - RNA, 19 nt, Mycobacterium avium subsp. paratuberculosis
gcgccagcagcggcacccg

SEQ ID NO: 2888915 - RNA, 21 nt, Mycobacterium avium subsp. paratuberculosis
gcgccagcagcggcacccggu

SEQ ID NO: 2888916 - RNA, 22 nt, Mycobacterium avium subsp. paratuberculosis
gcgccagcagggcaucucccgc

SEQ ID NO: 2888917 - RNA, 14 nt, Mycobacterium avium subsp. paratuberculosis
gcgccagcccgccc

SEQ ID NO: 2888918 - RNA, 19 nt, Mycobacterium avium subsp. paratuberculosis
gcgccagcccgcccagcgc

SEQ ID NO: 2888919 - RNA, 20 nt, Mycobacterium avium subsp. paratuberculosis
gcgccagcccgcccagcgcc

SEQ ID NO: 2888920 - RNA, 22 nt, Mycobacterium avium subsp. paratuberculosis
gcgccagcccgcccagcgccac

SEQ ID NO: 2888921 - RNA, 15 nt, Mycobacterium avium subsp. paratuberculosis
gcgccagcccgccga

SEQ ID NO: 2888922 - RNA, 20 nt, Mycobacterium avium subsp. paratuberculosis
gcgccagcccgccgaaccag

SEQ ID NO: 2888923 - RNA, 13 nt, Mycobacterium avium subsp. paratuberculosis
gcgccagcccggu

SEQ ID NO: 2888924 - RNA, 14 nt, Mycobacterium avium subsp. paratuberculosis
gcgccagccgcacc

SEQ ID NO: 2888925 - RNA, 15 nt, Mycobacterium avium subsp. paratuberculosis
gcgccagccgcaccg

SEQ ID NO: 2888926 - RNA, 17 nt, Mycobacterium avium subsp. paratuberculosis
gcgccagccgcaccgcg

SEQ ID NO: 2888927 - RNA, 18 nt, Mycobacterium avium subsp. paratuberculosis
gcgccagccgcaccgcga

SEQ ID NO: 2888928 - RNA, 16 nt, Mycobacterium avium subsp. paratuberculosis
gcgccagccgccgccg

SEQ ID NO: 2888929 - RNA, 20 nt, Mycobacterium avium subsp. paratuberculosis
gcgccagccgccgccgacca

SEQ ID NO: 2888930 - RNA, 17 nt, Mycobacterium avium subsp. paratuberculosis
gcgccagccgucgccgc

SEQ ID NO: 2888931 - RNA, 12 nt, Mycobacterium avium subsp. paratuberculosis
gcgccagcgacg

SEQ ID NO: 2888932 - RNA, 14 nt, Mycobacterium avium subsp. paratuberculosis
gcgccagcgacggc

SEQ ID NO: 2888933 - RNA, 15 nt, Mycobacterium avium subsp. paratuberculosis
gcgccagcgacggcc

SEQ ID NO: 2888934 - RNA, 12 nt, Mycobacterium avium subsp. paratuberculosis
gcgccagcgagu

SEQ ID NO: 2888935 - RNA, 13 nt, Mycobacterium avium subsp. paratuberculosis
gcgccagcgccag

SEQ ID NO: 2888936 - RNA, 16 nt, Mycobacterium avium subsp. paratuberculosis
gcgccagcgccagcgu

SEQ ID NO: 2888937 - RNA, 17 nt, Mycobacterium avium subsp. paratuberculosis
gcgccagcgccagcgug

SEQ ID NO: 2888938 - RNA, 24 nt, Mycobacterium avium subsp. paratuberculosis
gcgccagcgccggguugcaggcgc

SEQ ID NO: 2888939 - RNA, 13 nt, Mycobacterium avium subsp. paratuberculosis
gcgccagcgcgcc

SEQ ID NO: 2888940 - RNA, 16 nt, Mycobacterium avium subsp. paratuberculosis
gcgccagcgcgcccgc

SEQ ID NO: 2888941 - RNA, 17 nt, Mycobacterium avium subsp. paratuberculosis
gcgccagcgcgcccgcc

SEQ ID NO: 2888942 - RNA, 13 nt, Mycobacterium avium subsp. paratuberculosis
gcgccagcgcggu

SEQ ID NO: 2888943 - RNA, 14 nt, Mycobacterium avium subsp. paratuberculosis
gcgccagcgcggug

SEQ ID NO: 2888944 - RNA, 15 nt, Mycobacterium avium subsp. paratuberculosis
gcgccagcgcggugc

SEQ ID NO: 2888945 - RNA, 21 nt, Mycobacterium avium subsp. paratuberculosis
gcgccagcgcggugcccagcc

SEQ ID NO: 2888946 - RNA, 23 nt, Mycobacterium avium subsp. paratuberculosis
gcgccagcgcggugcccagccag

SEQ ID NO: 2888947 - RNA, 12 nt, Mycobacterium avium subsp. paratuberculosis
gcgccagcgcgu

SEQ ID NO: 2888948 - RNA, 16 nt, Mycobacterium avium subsp. paratuberculosis
gcgccagcgcgugcgg

SEQ ID NO: 2888949 - RNA, 14 nt, Mycobacterium avium subsp. paratuberculosis
gcgccagcggccga

SEQ ID NO: 2888950 - RNA, 16 nt, Mycobacterium avium subsp. paratuberculosis
gcgccagcgggauacc

SEQ ID NO: 2888951 - RNA, 21 nt, Mycobacterium avium subsp. paratuberculosis
gcgccagcgugaacagcgccc

SEQ ID NO: 2888952 - RNA, 15 nt, Mycobacterium avium subsp. paratuberculosis
gcgccagcguggcca

SEQ ID NO: 2888953 - RNA, 17 nt, Mycobacterium avium subsp. paratuberculosis
gcgccagcguggccagc

SEQ ID NO: 2888954 - RNA, 14 nt, Mycobacterium avium subsp. paratuberculosis
gcgccagcuccagc

SEQ ID NO: 2888955 - RNA, 15 nt, Mycobacterium avium subsp. paratuberculosis
gcgccagcuccagca

SEQ ID NO: 2888956 - RNA, 16 nt, Mycobacterium avium subsp. paratuberculosis
gcgccagcuccagcag

SEQ ID NO: 2888957 - RNA, 19 nt, Mycobacterium avium subsp. paratuberculosis
gcgccagcuccagcagccc

SEQ ID NO: 2888958 - RNA, 22 nt, Mycobacterium avium subsp. paratuberculosis
gcgccagcuccagcagcccggg

SEQ ID NO: 2888959 - RNA, 23 nt, Mycobacterium avium subsp. paratuberculosis
gcgccagcuccagcagcccgggc

SEQ ID NO: 2888960 - RNA, 13 nt, Mycobacterium avium subsp. paratuberculosis
gcgccagcucggc

SEQ ID NO: 2888961 - RNA, 15 nt, Mycobacterium avium subsp. paratuberculosis
gcgccagcucggcgg

SEQ ID NO: 2888962 - RNA, 16 nt, Mycobacterium avium subsp. paratuberculosis
gcgccagcucggcggc

SEQ ID NO: 2888963 - RNA, 17 nt, Mycobacterium avium subsp. paratuberculosis
gcgccagcucggcggcc

SEQ ID NO: 2888964 - RNA, 18 nt, Mycobacterium avium subsp. paratuberculosis
gcgccagcucggcggccg

SEQ ID NO: 2888965 - RNA, 19 nt, Mycobacterium avium subsp. paratuberculosis
gcgccagcucggcggccgg

SEQ ID NO: 2888966 - RNA, 12 nt, Mycobacterium avium subsp. paratuberculosis
gcgccagcuggg

SEQ ID NO: 2888967 - RNA, 15 nt, Mycobacterium avium subsp. paratuberculosis
gcgccagcugggugg

SEQ ID NO: 2888968 - RNA, 23 nt, Mycobacterium avium subsp. paratuberculosis
gcgccaggaccagcgggucgaug

SEQ ID NO: 2888969 - RNA, 16 nt, Mycobacterium avium subsp. paratuberculosis
gcgccaggauccgccc

SEQ ID NO: 2888970 - RNA, 17 nt, Mycobacterium avium subsp. paratuberculosis
gcgccaggauccgcccg

SEQ ID NO: 2888971 - RNA, 20 nt, Mycobacterium avium subsp. paratuberculosis
gcgccaggauccgcccgccg

SEQ ID NO: 2888972 - RNA, 21 nt, Mycobacterium avium subsp. paratuberculosis
gcgccaggauccgcccgccgg

SEQ ID NO: 2888973 - RNA, 15 nt, Mycobacterium avium subsp. paratuberculosis
gcgccaggccauggc

SEQ ID NO: 2888974 - RNA, 21 nt, Mycobacterium avium subsp. paratuberculosis
gcgccaggccauggcgcaccg

SEQ ID NO: 2888975 - RNA, 22 nt, Mycobacterium avium subsp. paratuberculosis
gcgccaggccggcgacgccggc

SEQ ID NO: 2888976 - RNA, 15 nt, Mycobacterium avium subsp. paratuberculosis
gcgccagggucuggc

SEQ ID NO: 2888977 - RNA, 21 nt, Mycobacterium avium subsp. paratuberculosis
gcgccagggucuggcccggug

SEQ ID NO: 2888978 - RNA, 21 nt, Mycobacterium avium subsp. paratuberculosis
gcgccagggugccccgcaccg

SEQ ID NO: 2888979 - RNA, 20 nt, Mycobacterium avium subsp. paratuberculosis
gcgccaggucgaagaggugc

SEQ ID NO: 2888980 - RNA, 14 nt, Mycobacterium avium subsp. paratuberculosis
gcgccaggucgggg

SEQ ID NO: 2888981 - RNA, 15 nt, Mycobacterium avium subsp. paratuberculosis
gcgccaggucggggu

SEQ ID NO: 2888982 - RNA, 16 nt, Mycobacterium avium subsp. paratuberculosis
gcgccaggugggugaa

SEQ ID NO: 2888983 - RNA, 21 nt, Mycobacterium avium subsp. paratuberculosis
gcgccagguuguaggugcccg

SEQ ID NO: 2888984 - RNA, 19 nt, Mycobacterium avium subsp. paratuberculosis
gcgccagucgcggcgaacc

SEQ ID NO: 2888985 - RNA, 23 nt, Mycobacterium avium subsp. paratuberculosis
gcgccagucgcggcgaaccagca

SEQ ID NO: 2888986 - RNA, 18 nt, Mycobacterium avium subsp. paratuberculosis
gcgccaguugcucgggug

SEQ ID NO: 2888987 - RNA, 19 nt, Mycobacterium avium subsp. paratuberculosis
gcgccaguugcucggguga

SEQ ID NO: 2888988 - RNA, 16 nt, Mycobacterium avium subsp. paratuberculosis
gcgccaguuugccguc

SEQ ID NO: 2888989 - RNA, 22 nt, Mycobacterium avium subsp. paratuberculosis
gcgccauccccgcuucggcucg

SEQ ID NO: 2888990 - RNA, 23 nt, Mycobacterium avium subsp. paratuberculosis
gcgccauccccgcuucggcucgg

SEQ ID NO: 2888991 - RNA, 16 nt, Mycobacterium avium subsp. paratuberculosis
gcgccauccgcagccc

SEQ ID NO: 2888992 - RNA, 19 nt, Mycobacterium avium subsp. paratuberculosis
gcgccauccgcagcccguc

SEQ ID NO: 2888993 - RNA, 21 nt, Mycobacterium avium subsp. paratuberculosis
gcgccauccgcagcccgucga

SEQ ID NO: 2888994 - RNA, 15 nt, Mycobacterium avium subsp. paratuberculosis
gcgccaucguggccg

SEQ ID NO: 2888995 - RNA, 21 nt, Mycobacterium avium subsp. paratuberculosis
gcgccaucuucacgugcgcgg

SEQ ID NO: 2888996 - RNA, 23 nt, Mycobacterium avium subsp. paratuberculosis
gcgccaucuucacgugcgcggcg

SEQ ID NO: 2888997 - RNA, 16 nt, Mycobacterium avium subsp. paratuberculosis
gcgccaugaacggcgg

SEQ ID NO: 2888998 - RNA, 21 nt, Mycobacterium avium subsp. paratuberculosis
gcgccaugaacggcggggccu

SEQ ID NO: 2888999 - RNA, 19 nt, Mycobacterium avium subsp. paratuberculosis
gcgccaugaacuccgacuc

SEQ ID NO: 2889000 - RNA, 16 nt, Mycobacterium avium subsp. paratuberculosis
gcgccaugccgccgac

SEQ ID NO: 2889001 - RNA, 21 nt, Mycobacterium avium subsp. paratuberculosis
gcgccaugccgccgaccgccg

SEQ ID NO: 2889002 - RNA, 14 nt, Mycobacterium avium subsp. paratuberculosis
gcgccaugcgccgc

SEQ ID NO: 2889003 - RNA, 15 nt, Mycobacterium avium subsp. paratuberculosis
gcgccaugcgccgcg

SEQ ID NO: 2889004 - RNA, 14 nt, Mycobacterium avium subsp. paratuberculosis
gcgccaugcugccc

SEQ ID NO: 2889005 - RNA, 15 nt, Mycobacterium avium subsp. paratuberculosis
gcgccaugcugcccu

SEQ ID NO: 2889006 - RNA, 20 nt, Mycobacterium avium subsp. paratuberculosis
gcgccauggcccacgacguc

SEQ ID NO: 2889007 - RNA, 15 nt, Mycobacterium avium subsp. paratuberculosis
gcgccauguccggca

SEQ ID NO: 2889008 - RNA, 18 nt, Mycobacterium avium subsp. paratuberculosis
gcgccauguccggcaggc

SEQ ID NO: 2889009 - RNA, 18 nt, Mycobacterium avium subsp. paratuberculosis
gcgccauguccuugguga

SEQ ID NO: 2889010 - RNA, 16 nt, Mycobacterium avium subsp. paratuberculosis
gcgccauugucggauc

SEQ ID NO: 2889011 - RNA, 13 nt, Mycobacterium avium subsp. paratuberculosis
gcgcccacagcag

SEQ ID NO: 2889012 - RNA, 14 nt, Mycobacterium avium subsp. paratuberculosis
gcgcccacagcagg

SEQ ID NO: 2889013 - RNA, 16 nt, Mycobacterium avium subsp. paratuberculosis
gcgcccacagcaggua

SEQ ID NO: 2889014 - RNA, 21 nt, Mycobacterium avium subsp. paratuberculosis
gcgcccacagguccagcgucc

SEQ ID NO: 2889015 - RNA, 17 nt, Mycobacterium avium subsp. paratuberculosis
gcgcccacaguccgccc

SEQ ID NO: 2889016 - RNA, 20 nt, Mycobacterium avium subsp. paratuberculosis
gcgcccacaguccgcccagc

SEQ ID NO: 2889017 - RNA, 23 nt, Mycobacterium avium subsp. paratuberculosis
gcgcccacccgaugaccggcccg

SEQ ID NO: 2889018 - RNA, 13 nt, Mycobacterium avium subsp. paratuberculosis
gcgcccacccgcg

SEQ ID NO: 2889019 - RNA, 19 nt, Mycobacterium avium subsp. paratuberculosis
gcgcccacccgcgcacgcu

SEQ ID NO: 2889020 - RNA, 15 nt, Mycobacterium avium subsp. paratuberculosis
gcgcccacccgcgcc

SEQ ID NO: 2889021 - RNA, 16 nt, Mycobacterium avium subsp. paratuberculosis
gcgcccacccgcgccg

SEQ ID NO: 2889022 - RNA, 18 nt, Mycobacterium avium subsp. paratuberculosis
gcgcccacccgcgccggc

SEQ ID NO: 2889023 - RNA, 20 nt, Mycobacterium avium subsp. paratuberculosis
gcgcccacccguuggcaggc

SEQ ID NO: 2889024 - RNA, 22 nt, Mycobacterium avium subsp. paratuberculosis
gcgcccacccguuggcaggccc

SEQ ID NO: 2889025 - RNA, 21 nt, Mycobacterium avium subsp. paratuberculosis
gcgcccaccgcggcgcgcggc

SEQ ID NO: 2889026 - RNA, 15 nt, Mycobacterium avium subsp. paratuberculosis
gcgcccaccgcucgu

SEQ ID NO: 2889027 - RNA, 16 nt, Mycobacterium avium subsp. paratuberculosis
gcgcccaccgcucguc

SEQ ID NO: 2889028 - RNA, 21 nt, Mycobacterium avium subsp. paratuberculosis
gcgcccaccuggaggccaacg

SEQ ID NO: 2889029 - RNA, 14 nt, Mycobacterium avium subsp. paratuberculosis
gcgcccacggccac

SEQ ID NO: 2889030 - RNA, 18 nt, Mycobacterium avium subsp. paratuberculosis
gcgcccagaagccccggu

SEQ ID NO: 2889031 - RNA, 20 nt, Mycobacterium avium subsp. paratuberculosis
gcgcccagaugccgccgcca

SEQ ID NO: 2889032 - RNA, 22 nt, Mycobacterium avium subsp. paratuberculosis
gcgcccagaugccgccgccagc

SEQ ID NO: 2889033 - RNA, 16 nt, Mycobacterium avium subsp. paratuberculosis
gcgcccagaugccggc

SEQ ID NO: 2889034 - RNA, 17 nt, Mycobacterium avium subsp. paratuberculosis
gcgcccagcaaacccag

SEQ ID NO: 2889035 - RNA, 21 nt, Mycobacterium avium subsp. paratuberculosis
gcgcccagcaaacccagcacc

SEQ ID NO: 2889036 - RNA, 13 nt, Mycobacterium avium subsp. paratuberculosis
gcgcccagcaccc

SEQ ID NO: 2889037 - RNA, 14 nt, Mycobacterium avium subsp. paratuberculosis
gcgcccagcacccg

SEQ ID NO: 2889038 - RNA, 14 nt, Mycobacterium avium subsp. paratuberculosis
gcgcccagcacguc

SEQ ID NO: 2889039 - RNA, 19 nt, Mycobacterium avium subsp. paratuberculosis
gcgcccagcacgucaccgc

SEQ ID NO: 2889040 - RNA, 17 nt, Mycobacterium avium subsp. paratuberculosis
gcgcccagccccagcac

SEQ ID NO: 2889041 - RNA, 12 nt, Mycobacterium avium subsp. paratuberculosis
gcgcccagcccg

SEQ ID NO: 2889042 - RNA, 20 nt, Mycobacterium avium subsp. paratuberculosis
gcgcccagcccgagcaccag

SEQ ID NO: 2889043 - RNA, 21 nt, Mycobacterium avium subsp. paratuberculosis
gcgcccagcccgagcaccagc

SEQ ID NO: 2889044 - RNA, 22 nt, Mycobacterium avium subsp. paratuberculosis
gcgcccagcccgagcaccagcg

SEQ ID NO: 2889045 - RNA, 15 nt, Mycobacterium avium subsp. paratuberculosis
gcgcccagccgagcc

SEQ ID NO: 2889046 - RNA, 13 nt, Mycobacterium avium subsp. paratuberculosis
gcgcccagcgagc

SEQ ID NO: 2889047 - RNA, 14 nt, Mycobacterium avium subsp. paratuberculosis
gcgcccagcgagcu

SEQ ID NO: 2889048 - RNA, 17 nt, Mycobacterium avium subsp. paratuberculosis
gcgcccagcgagcugcc

SEQ ID NO: 2889049 - RNA, 13 nt, Mycobacterium avium subsp. paratuberculosis
gcgcccagcgcgc

SEQ ID NO: 2889050 - RNA, 14 nt, Mycobacterium avium subsp. paratuberculosis
gcgcccagcggcga

SEQ ID NO: 2889051 - RNA, 15 nt, Mycobacterium avium subsp. paratuberculosis
gcgcccagcggcgau

SEQ ID NO: 2889052 - RNA, 17 nt, Mycobacterium avium subsp. paratuberculosis
gcgcccagcggcgaugc

SEQ ID NO: 2889053 - RNA, 18 nt, Mycobacterium avium subsp. paratuberculosis
gcgcccagcggcgaugcc

SEQ ID NO: 2889054 - RNA, 19 nt, Mycobacterium avium subsp. paratuberculosis
gcgcccagcggcgaugccc

SEQ ID NO: 2889055 - RNA, 19 nt, Mycobacterium avium subsp. paratuberculosis
gcgcccagcgucucggcgg

SEQ ID NO: 2889056 - RNA, 22 nt, Mycobacterium avium subsp. paratuberculosis
gcgcccagcgucucggcggccg

SEQ ID NO: 2889057 - RNA, 21 nt, Mycobacterium avium subsp. paratuberculosis
gcgcccagcguggucacccgc

SEQ ID NO: 2889058 - RNA, 22 nt, Mycobacterium avium subsp. paratuberculosis
gcgcccagcguggucacccgca

SEQ ID NO: 2889059 - RNA, 18 nt, Mycobacterium avium subsp. paratuberculosis
gcgcccaggaacgcgccg

SEQ ID NO: 2889060 - RNA, 22 nt, Mycobacterium avium subsp. paratuberculosis
gcgcccaggaacgcgccggcgc

SEQ ID NO: 2889061 - RNA, 16 nt, Mycobacterium avium subsp. paratuberculosis
gcgcccaggaacuggu

SEQ ID NO: 2889062 - RNA, 18 nt, Mycobacterium avium subsp. paratuberculosis
gcgcccaggaugacgccg

SEQ ID NO: 2889063 - RNA, 12 nt, Mycobacterium avium subsp. paratuberculosis
gcgcccaggccc

SEQ ID NO: 2889064 - RNA, 14 nt, Mycobacterium avium subsp. paratuberculosis
gcgcccaggcccga

SEQ ID NO: 2889065 - RNA, 18 nt, Mycobacterium avium subsp. paratuberculosis
gcgcccaggcugaacacc

SEQ ID NO: 2889066 - RNA, 17 nt, Mycobacterium avium subsp. paratuberculosis
gcgcccaggggagcggc

SEQ ID NO: 2889067 - RNA, 14 nt, Mycobacterium avium subsp. paratuberculosis
gcgcccaggggucc

SEQ ID NO: 2889068 - RNA, 18 nt, Mycobacterium avium subsp. paratuberculosis
gcgcccagguacuccucg

SEQ ID NO: 2889069 - RNA, 19 nt, Mycobacterium avium subsp. paratuberculosis
gcgcccagguacuccucgg

SEQ ID NO: 2889070 - RNA, 13 nt, Mycobacterium avium subsp. paratuberculosis
gcgcccaggucca

SEQ ID NO: 2889071 - RNA, 18 nt, Mycobacterium avium subsp. paratuberculosis
gcgcccagguccaccagg

SEQ ID NO: 2889072 - RNA, 13 nt, Mycobacterium avium subsp. paratuberculosis
gcgcccauccggc

SEQ ID NO: 2889073 - RNA, 14 nt, Mycobacterium avium subsp. paratuberculosis
gcgcccauccggcg

SEQ ID NO: 2889074 - RNA, 17 nt, Mycobacterium avium subsp. paratuberculosis
gcgcccauccggcgccg

SEQ ID NO: 2889075 - RNA, 18 nt, Mycobacterium avium subsp. paratuberculosis
gcgcccauccggcgccgc

SEQ ID NO: 2889076 - RNA, 15 nt, Mycobacterium avium subsp. paratuberculosis
gcgcccaucgcggcc

SEQ ID NO: 2889077 - RNA, 22 nt, Mycobacterium avium subsp. paratuberculosis
gcgcccaucgcggccgcccggu

SEQ ID NO: 2889078 - RNA, 19 nt, Mycobacterium avium subsp. paratuberculosis
gcgcccaugaacgcgucgc

SEQ ID NO: 2889079 - RNA, 21 nt, Mycobacterium avium subsp. paratuberculosis
gcgcccaugaacgcgucgccg

SEQ ID NO: 2889080 - RNA, 22 nt, Mycobacterium avium subsp. paratuberculosis
gcgcccaugaacgcgucgccgu

SEQ ID NO: 2889081 - RNA, 23 nt, Mycobacterium avium subsp. paratuberculosis
gcgcccaugaacgcgucgccgug

SEQ ID NO: 2889082 - RNA, 13 nt, Mycobacterium avium subsp. paratuberculosis
gcgccccaacggu

SEQ ID NO: 2889083 - RNA, 17 nt, Mycobacterium avium subsp. paratuberculosis
gcgccccaacggugauc

SEQ ID NO: 2889084 - RNA, 22 nt, Mycobacterium avium subsp. paratuberculosis
gcgccccacggucuuugccggc

SEQ ID NO: 2889085 - RNA, 13 nt, Mycobacterium avium subsp. paratuberculosis
gcgccccagacgu

SEQ ID NO: 2889086 - RNA, 23 nt, Mycobacterium avium subsp. paratuberculosis
gcgccccagcacgaucccgccgc

SEQ ID NO: 2889087 - RNA, 13 nt, Mycobacterium avium subsp. paratuberculosis
gcgccccagcccc

SEQ ID NO: 2889088 - RNA, 13 nt, Mycobacterium avium subsp. paratuberculosis
gcgccccagcucc

SEQ ID NO: 2889089 - RNA, 13 nt, Mycobacterium avium subsp. paratuberculosis
gcgccccagggcc

SEQ ID NO: 2889090 - RNA, 19 nt, Mycobacterium avium subsp. paratuberculosis
gcgccccagugcaggcagg

SEQ ID NO: 2889091 - RNA, 22 nt, Mycobacterium avium subsp. paratuberculosis
gcgccccagugcaggcaggccc

SEQ ID NO: 2889092 - RNA, 18 nt, Mycobacterium avium subsp. paratuberculosis
gcgccccccugcucgcug

SEQ ID NO: 2889093 - RNA, 13 nt, Mycobacterium avium subsp. paratuberculosis
gcgcccccgagga

SEQ ID NO: 2889094 - RNA, 22 nt, Mycobacterium avium subsp. paratuberculosis
gcgcccccgaggagacgucggc

SEQ ID NO: 2889095 - RNA, 23 nt, Mycobacterium avium subsp. paratuberculosis
gcgcccccgaggagacgucggcc

SEQ ID NO: 2889096 - RNA, 14 nt, Mycobacterium avium subsp. paratuberculosis
gcgccccgacaucg

SEQ ID NO: 2889097 - RNA, 18 nt, Mycobacterium avium subsp. paratuberculosis
gcgccccgacaucgccau

SEQ ID NO: 2889098 - RNA, 14 nt, Mycobacterium avium subsp. paratuberculosis
gcgccccgagcagc

SEQ ID NO: 2889099 - RNA, 22 nt, Mycobacterium avium subsp. paratuberculosis
gcgccccgagcagcgggucguc

SEQ ID NO: 2889100 - RNA, 24 nt, Mycobacterium avium subsp. paratuberculosis
gcgccccgcccugcuugaacagca

SEQ ID NO: 2889101 - RNA, 12 nt, Mycobacterium avium subsp. paratuberculosis
gcgccccgccgg

SEQ ID NO: 2889102 - RNA, 17 nt, Mycobacterium avium subsp. paratuberculosis
gcgccccgccgggggag

SEQ ID NO: 2889103 - RNA, 14 nt, Mycobacterium avium subsp. paratuberculosis
gcgccccgcuggua

SEQ ID NO: 2889104 - RNA, 13 nt, Mycobacterium avium subsp. paratuberculosis
gcgccccggcccg

SEQ ID NO: 2889105 - RNA, 15 nt, Mycobacterium avium subsp. paratuberculosis
gcgccccggcccggc

SEQ ID NO: 2889106 - RNA, 16 nt, Mycobacterium avium subsp. paratuberculosis
gcgccccggcccggcg

SEQ ID NO: 2889107 - RNA, 17 nt, Mycobacterium avium subsp. paratuberculosis
gcgccccggcccggcga

SEQ ID NO: 2889108 - RNA, 14 nt, Mycobacterium avium subsp. paratuberculosis
gcgccccggcccgu

SEQ ID NO: 2889109 - RNA, 13 nt, Mycobacterium avium subsp. paratuberculosis
gcgccccggccug

SEQ ID NO: 2889110 - RNA, 18 nt, Mycobacterium avium subsp. paratuberculosis
gcgccccggcgcagcgcc

SEQ ID NO: 2889111 - RNA, 22 nt, Mycobacterium avium subsp. paratuberculosis
gcgccccggcgcagcgccgcgc

SEQ ID NO: 2889112 - RNA, 16 nt, Mycobacterium avium subsp. paratuberculosis
gcgccccggcgcgccu

SEQ ID NO: 2889113 - RNA, 17 nt, Mycobacterium avium subsp. paratuberculosis
gcgccccggcgcgccug

SEQ ID NO: 2889114 - RNA, 20 nt, Mycobacterium avium subsp. paratuberculosis
gcgccccggcgcgccugcgc

SEQ ID NO: 2889115 - RNA, 22 nt, Mycobacterium avium subsp. paratuberculosis
gcgccccggcgcgccugcgcgg

SEQ ID NO: 2889116 - RNA, 14 nt, Mycobacterium avium subsp. paratuberculosis
gcgccccggcggcc

SEQ ID NO: 2889117 - RNA, 15 nt, Mycobacterium avium subsp. paratuberculosis
gcgccccggcggcca

SEQ ID NO: 2889118 - RNA, 17 nt, Mycobacterium avium subsp. paratuberculosis
gcgccccggcggccacg

SEQ ID NO: 2889119 - RNA, 13 nt, Mycobacterium avium subsp. paratuberculosis
gcgccccggcggg

SEQ ID NO: 2889120 - RNA, 19 nt, Mycobacterium avium subsp. paratuberculosis
gcgccccggcgggcggccg

SEQ ID NO: 2889121 - RNA, 20 nt, Mycobacterium avium subsp. paratuberculosis
gcgccccggcgggcggccga

SEQ ID NO: 2889122 - RNA, 13 nt, Mycobacterium avium subsp. paratuberculosis
gcgccccggcguc

SEQ ID NO: 2889123 - RNA, 14 nt, Mycobacterium avium subsp. paratuberculosis
gcgccccggcgucg

SEQ ID NO: 2889124 - RNA, 16 nt, Mycobacterium avium subsp. paratuberculosis
gcgccccggcgucgau

SEQ ID NO: 2889125 - RNA, 18 nt, Mycobacterium avium subsp. paratuberculosis
gcgccccggcgucgauga

SEQ ID NO: 2889126 - RNA, 19 nt, Mycobacterium avium subsp. paratuberculosis
gcgccccgggauccgaggc

SEQ ID NO: 2889127 - RNA, 13 nt, Mycobacterium avium subsp. paratuberculosis
gcgccccgggcag

SEQ ID NO: 2889128 - RNA, 14 nt, Mycobacterium avium subsp. paratuberculosis
gcgccccggucccg

SEQ ID NO: 2889129 - RNA, 18 nt, Mycobacterium avium subsp. paratuberculosis
gcgccccggucccgccgg

SEQ ID NO: 2889130 - RNA, 21 nt, Mycobacterium avium subsp. paratuberculosis
gcgccccggucccgccgguga

SEQ ID NO: 2889131 - RNA, 21 nt, Mycobacterium avium subsp. paratuberculosis
gcgcccgacauccaggaccgc

SEQ ID NO: 2889132 - RNA, 13 nt, Mycobacterium avium subsp. paratuberculosis
gcgcccgacgaug

SEQ ID NO: 2889133 - RNA, 19 nt, Mycobacterium avium subsp. paratuberculosis
gcgcccgacgaugcggggc

SEQ ID NO: 2889134 - RNA, 15 nt, Mycobacterium avium subsp. paratuberculosis
gcgcccgacgccgga

SEQ ID NO: 2889135 - RNA, 19 nt, Mycobacterium avium subsp. paratuberculosis
gcgcccgacggucgccacc

SEQ ID NO: 2889136 - RNA, 20 nt, Mycobacterium avium subsp. paratuberculosis
gcgcccgacggucgccacca

SEQ ID NO: 2889137 - RNA, 12 nt, Mycobacterium avium subsp. paratuberculosis
gcgcccgagccg

SEQ ID NO: 2889138 - RNA, 13 nt, Mycobacterium avium subsp. paratuberculosis
gcgcccgagccgc

SEQ ID NO: 2889139 - RNA, 14 nt, Mycobacterium avium subsp. paratuberculosis
gcgcccgagccgca

SEQ ID NO: 2889140 - RNA, 16 nt, Mycobacterium avium subsp. paratuberculosis
gcgcccgagccgcaca

SEQ ID NO: 2889141 - RNA, 22 nt, Mycobacterium avium subsp. paratuberculosis
gcgcccgagucacccggcuggc

SEQ ID NO: 2889142 - RNA, 14 nt, Mycobacterium avium subsp. paratuberculosis
gcgcccgaucggca

SEQ ID NO: 2889143 - RNA, 18 nt, Mycobacterium avium subsp. paratuberculosis
gcgcccgaucggcacccg

SEQ ID NO: 2889144 - RNA, 19 nt, Mycobacterium avium subsp. paratuberculosis
gcgcccgaucggcacccgc

SEQ ID NO: 2889145 - RNA, 20 nt, Mycobacterium avium subsp. paratuberculosis
gcgcccgaucggcacccgca

SEQ ID NO: 2889146 - RNA, 16 nt, Mycobacterium avium subsp. paratuberculosis
gcgcccgaucggcgug

SEQ ID NO: 2889147 - RNA, 19 nt, Mycobacterium avium subsp. paratuberculosis
gcgcccgauggaggugccg

SEQ ID NO: 2889148 - RNA, 15 nt, Mycobacterium avium subsp. paratuberculosis
gcgcccgauuccccg

SEQ ID NO: 2889149 - RNA, 18 nt, Mycobacterium avium subsp. paratuberculosis
gcgcccgauuccccggcg

SEQ ID NO: 2889150 - RNA, 17 nt, Mycobacterium avium subsp. paratuberculosis
gcgcccgauucgcggcc

SEQ ID NO: 2889151 - RNA, 18 nt, Mycobacterium avium subsp. paratuberculosis
gcgcccgauucgcggcca

SEQ ID NO: 2889152 - RNA, 21 nt, Mycobacterium avium subsp. paratuberculosis
gcgcccgcauguucucgagcc

SEQ ID NO: 2889153 - RNA, 23 nt, Mycobacterium avium subsp. paratuberculosis
gcgcccgccccgacgugcagcgc

SEQ ID NO: 2889154 - RNA, 12 nt, Mycobacterium avium subsp. paratuberculosis
gcgcccgcccgg

SEQ ID NO: 2889155 - RNA, 17 nt, Mycobacterium avium subsp. paratuberculosis
gcgcccgcccggacacc

SEQ ID NO: 2889156 - RNA, 16 nt, Mycobacterium avium subsp. paratuberculosis
gcgcccgcccggcccg

SEQ ID NO: 2889157 - RNA, 19 nt, Mycobacterium avium subsp. paratuberculosis
gcgcccgcccggcccggcg

SEQ ID NO: 2889158 - RNA, 21 nt, Mycobacterium avium subsp. paratuberculosis
gcgcccgcccggcccggcgcg

SEQ ID NO: 2889159 - RNA, 22 nt, Mycobacterium avium subsp. paratuberculosis
gcgcccgcccggcccggcgcgg

SEQ ID NO: 2889160 - RNA, 12 nt, Mycobacterium avium subsp. paratuberculosis
gcgcccgccgaa

SEQ ID NO: 2889161 - RNA, 21 nt, Mycobacterium avium subsp. paratuberculosis
gcgcccgccgaacaccggcag

SEQ ID NO: 2889162 - RNA, 22 nt, Mycobacterium avium subsp. paratuberculosis
gcgcccgccgaacaccggcagc

SEQ ID NO: 2889163 - RNA, 17 nt, Mycobacterium avium subsp. paratuberculosis
gcgcccgccgcaacgcg

SEQ ID NO: 2889164 - RNA, 14 nt, Mycobacterium avium subsp. paratuberculosis
gcgcccgccgccac

SEQ ID NO: 2889165 - RNA, 18 nt, Mycobacterium avium subsp. paratuberculosis
gcgcccgccgccaccacg

SEQ ID NO: 2889166 - RNA, 19 nt, Mycobacterium avium subsp. paratuberculosis
gcgcccgccgccaccacgg

SEQ ID NO: 2889167 - RNA, 23 nt, Mycobacterium avium subsp. paratuberculosis
gcgcccgccgccaccacggcagu

SEQ ID NO: 2889168 - RNA, 13 nt, Mycobacterium avium subsp. paratuberculosis
gcgcccgccgcgu

SEQ ID NO: 2889169 - RNA, 22 nt, Mycobacterium avium subsp. paratuberculosis
gcgcccgccgcguacaccggcu

SEQ ID NO: 2889170 - RNA, 12 nt, Mycobacterium avium subsp. paratuberculosis
gcgcccgccggc

SEQ ID NO: 2889171 - RNA, 15 nt, Mycobacterium avium subsp. paratuberculosis
gcgcccgccggccca

SEQ ID NO: 2889172 - RNA, 16 nt, Mycobacterium avium subsp. paratuberculosis
gcgcccgccggcccag

SEQ ID NO: 2889173 - RNA, 17 nt, Mycobacterium avium subsp. paratuberculosis
gcgcccgccggcccagc

SEQ ID NO: 2889174 - RNA, 18 nt, Mycobacterium avium subsp. paratuberculosis
gcgcccgccggcccagcu

SEQ ID NO: 2889175 - RNA, 20 nt, Mycobacterium avium subsp. paratuberculosis
gcgcccgccggcccagcucc

SEQ ID NO: 2889176 - RNA, 22 nt, Mycobacterium avium subsp. paratuberculosis
gcgcccgccggcccagcuccac

SEQ ID NO: 2889177 - RNA, 18 nt, Mycobacterium avium subsp. paratuberculosis
gcgcccgcgaacacgcga

SEQ ID NO: 2889178 - RNA, 15 nt, Mycobacterium avium subsp. paratuberculosis
gcgcccgcgccaccc

SEQ ID NO: 2889179 - RNA, 15 nt, Mycobacterium avium subsp. paratuberculosis
gcgcccgcgcgaucg

SEQ ID NO: 2889180 - RNA, 19 nt, Mycobacterium avium subsp. paratuberculosis
gcgcccgcgcgaucggcga

SEQ ID NO: 2889181 - RNA, 24 nt, Mycobacterium avium subsp. paratuberculosis
gcgcccgcgcgaucggcgagccgg

SEQ ID NO: 2889182 - RNA, 13 nt, Mycobacterium avium subsp. paratuberculosis
gcgcccgcgcggg

SEQ ID NO: 2889183 - RNA, 15 nt, Mycobacterium avium subsp. paratuberculosis
gcgcccgcgcgggcu

SEQ ID NO: 2889184 - RNA, 16 nt, Mycobacterium avium subsp. paratuberculosis
gcgcccgcgcgggcug

SEQ ID NO: 2889185 - RNA, 18 nt, Mycobacterium avium subsp. paratuberculosis
gcgcccgcgcgugggcca

SEQ ID NO: 2889186 - RNA, 13 nt, Mycobacterium avium subsp. paratuberculosis
gcgcccgcggcca

SEQ ID NO: 2889187 - RNA, 20 nt, Mycobacterium avium subsp. paratuberculosis
gcgcccgcggccaucgccug

SEQ ID NO: 2889188 - RNA, 13 nt, Mycobacterium avium subsp. paratuberculosis
gcgcccgcggccu

SEQ ID NO: 2889189 - RNA, 14 nt, Mycobacterium avium subsp. paratuberculosis
gcgcccgcggccuc

SEQ ID NO: 2889190 - RNA, 21 nt, Mycobacterium avium subsp. paratuberculosis
gcgcccgcggccuccagccgc

SEQ ID NO: 2889191 - RNA, 12 nt, Mycobacterium avium subsp. paratuberculosis
gcgcccgcggcg

SEQ ID NO: 2889192 - RNA, 14 nt, Mycobacterium avium subsp. paratuberculosis
gcgcccgcggcgcg

SEQ ID NO: 2889193 - RNA, 17 nt, Mycobacterium avium subsp. paratuberculosis
gcgcccgcggcgcgcag

SEQ ID NO: 2889194 - RNA, 19 nt, Mycobacterium avium subsp. paratuberculosis
gcgcccgcggcgcgcaggu

SEQ ID NO: 2889195 - RNA, 18 nt, Mycobacterium avium subsp. paratuberculosis
gcgcccgcgggugcagcc

SEQ ID NO: 2889196 - RNA, 23 nt, Mycobacterium avium subsp. paratuberculosis
gcgcccgcgggugcagccggauc

SEQ ID NO: 2889197 - RNA, 15 nt, Mycobacterium avium subsp. paratuberculosis
gcgcccgcuccggcg

SEQ ID NO: 2889198 - RNA, 15 nt, Mycobacterium avium subsp. paratuberculosis
gcgcccgcugcgcgg

SEQ ID NO: 2889199 - RNA, 15 nt, Mycobacterium avium subsp. paratuberculosis
gcgcccgcugcggcg

SEQ ID NO: 2889200 - RNA, 21 nt, Mycobacterium avium subsp. paratuberculosis
gcgcccgcuugauggcggcgc

SEQ ID NO: 2889201 - RNA, 22 nt, Mycobacterium avium subsp. paratuberculosis
gcgcccgcuugauggcggcgcg

SEQ ID NO: 2889202 - RNA, 19 nt, Mycobacterium avium subsp. paratuberculosis
gcgcccggaaagcgcgggc

SEQ ID NO: 2889203 - RNA, 12 nt, Mycobacterium avium subsp. paratuberculosis
gcgcccggaaug

SEQ ID NO: 2889204 - RNA, 18 nt, Mycobacterium avium subsp. paratuberculosis
gcgcccggaugucgggcg

SEQ ID NO: 2889205 - RNA, 19 nt, Mycobacterium avium subsp. paratuberculosis
gcgcccggaugucgggcga

SEQ ID NO: 2889206 - RNA, 13 nt, Mycobacterium avium subsp. paratuberculosis
gcgcccggcaccg

SEQ ID NO: 2889207 - RNA, 15 nt, Mycobacterium avium subsp. paratuberculosis
gcgcccggcaccgcg

SEQ ID NO: 2889208 - RNA, 16 nt, Mycobacterium avium subsp. paratuberculosis
gcgcccggcaccgcgg

SEQ ID NO: 2889209 - RNA, 17 nt, Mycobacterium avium subsp. paratuberculosis
gcgcccggcaccgcggc

SEQ ID NO: 2889210 - RNA, 19 nt, Mycobacterium avium subsp. paratuberculosis
gcgcccggcaccgcggcgg

SEQ ID NO: 2889211 - RNA, 16 nt, Mycobacterium avium subsp. paratuberculosis
gcgcccggcagccgcu

SEQ ID NO: 2889212 - RNA, 14 nt, Mycobacterium avium subsp. paratuberculosis
gcgcccggcagcgg

SEQ ID NO: 2889213 - RNA, 16 nt, Mycobacterium avium subsp. paratuberculosis
gcgcccggccagccgg

SEQ ID NO: 2889214 - RNA, 20 nt, Mycobacterium avium subsp. paratuberculosis
gcgcccggccagccggccgc

SEQ ID NO: 2889215 - RNA, 21 nt, Mycobacterium avium subsp. paratuberculosis
gcgcccggccagccggccgcu

SEQ ID NO: 2889216 - RNA, 16 nt, Mycobacterium avium subsp. paratuberculosis
gcgcccggcccagccg

SEQ ID NO: 2889217 - RNA, 18 nt, Mycobacterium avium subsp. paratuberculosis
gcgcccggcccagccgcu

SEQ ID NO: 2889218 - RNA, 20 nt, Mycobacterium avium subsp. paratuberculosis
gcgcccggcccagccgcugc

SEQ ID NO: 2889219 - RNA, 22 nt, Mycobacterium avium subsp. paratuberculosis
gcgcccggcgaccaccagccgc

SEQ ID NO: 2889220 - RNA, 17 nt, Mycobacterium avium subsp. paratuberculosis
gcgcccggcgacgcggc

SEQ ID NO: 2889221 - RNA, 11 nt, Mycobacterium avium subsp. paratuberculosis
gcgcccggcgc

SEQ ID NO: 2889222 - RNA, 13 nt, Mycobacterium avium subsp. paratuberculosis
gcgcccggcgccc

SEQ ID NO: 2889223 - RNA, 14 nt, Mycobacterium avium subsp. paratuberculosis
gcgcccggcgcccg

SEQ ID NO: 2889224 - RNA, 16 nt, Mycobacterium avium subsp. paratuberculosis
gcgcccggcgcccggc

SEQ ID NO: 2889225 - RNA, 18 nt, Mycobacterium avium subsp. paratuberculosis
gcgcccggcgcccggcgc

SEQ ID NO: 2889226 - RNA, 15 nt, Mycobacterium avium subsp. paratuberculosis
gcgcccggcgccggc

SEQ ID NO: 2889227 - RNA, 18 nt, Mycobacterium avium subsp. paratuberculosis
gcgcccggcgccggcccg

SEQ ID NO: 2889228 - RNA, 16 nt, Mycobacterium avium subsp. paratuberculosis
gcgcccggcgcgccac

SEQ ID NO: 2889229 - RNA, 13 nt, Mycobacterium avium subsp. paratuberculosis
gcgcccggcgggc

SEQ ID NO: 2889230 - RNA, 20 nt, Mycobacterium avium subsp. paratuberculosis
gcgcccggcuccccgaccac

SEQ ID NO: 2889231 - RNA, 12 nt, Mycobacterium avium subsp. paratuberculosis
gcgcccgggcca

SEQ ID NO: 2889232 - RNA, 13 nt, Mycobacterium avium subsp. paratuberculosis
gcgcccgggcgcg

SEQ ID NO: 2889233 - RNA, 20 nt, Mycobacterium avium subsp. paratuberculosis
gcgcccgggcguucccgcgc

SEQ ID NO: 2889234 - RNA, 13 nt, Mycobacterium avium subsp. paratuberculosis
gcgcccggguggg

SEQ ID NO: 2889235 - RNA, 18 nt, Mycobacterium avium subsp. paratuberculosis
gcgcccgggugggcggga

SEQ ID NO: 2889236 - RNA, 21 nt, Mycobacterium avium subsp. paratuberculosis
gcgcccggucaggaacccggc

SEQ ID NO: 2889237 - RNA, 22 nt, Mycobacterium avium subsp. paratuberculosis
gcgcccggucaggaacccggcc

SEQ ID NO: 2889238 - RNA, 19 nt, Mycobacterium avium subsp. paratuberculosis
gcgcccggucgaggucggc

SEQ ID NO: 2889239 - RNA, 23 nt, Mycobacterium avium subsp. paratuberculosis
gcgcccggucgaggucggccagc

SEQ ID NO: 2889240 - RNA, 17 nt, Mycobacterium avium subsp. paratuberculosis
gcgcccguagccgcggu

SEQ ID NO: 2889241 - RNA, 17 nt, Mycobacterium avium subsp. paratuberculosis
gcgcccguagcggcgga

SEQ ID NO: 2889242 - RNA, 15 nt, Mycobacterium avium subsp. paratuberculosis
gcgcccgucacgcug

SEQ ID NO: 2889243 - RNA, 22 nt, Mycobacterium avium subsp. paratuberculosis
gcgcccgucgagcgucacgcug

SEQ ID NO: 2889244 - RNA, 16 nt, Mycobacterium avium subsp. paratuberculosis
gcgcccgucgucgccg

SEQ ID NO: 2889245 - RNA, 14 nt, Mycobacterium avium subsp. paratuberculosis
gcgcccgucgucgg

SEQ ID NO: 2889246 - RNA, 15 nt, Mycobacterium avium subsp. paratuberculosis
gcgcccgucgucggu

SEQ ID NO: 2889247 - RNA, 19 nt, Mycobacterium avium subsp. paratuberculosis
gcgcccuaacgugcccggc

SEQ ID NO: 2889248 - RNA, 20 nt, Mycobacterium avium subsp. paratuberculosis
gcgcccuaacgugcccggcc

SEQ ID NO: 2889249 - RNA, 22 nt, Mycobacterium avium subsp. paratuberculosis
gcgcccucgauaauggcggccg

SEQ ID NO: 2889250 - RNA, 23 nt, Mycobacterium avium subsp. paratuberculosis
gcgcccucgaugcgcaccgugcc

SEQ ID NO: 2889251 - RNA, 12 nt, Mycobacterium avium subsp. paratuberculosis
gcgcccucgccg

SEQ ID NO: 2889252 - RNA, 15 nt, Mycobacterium avium subsp. paratuberculosis
gcgcccucgccgacc

SEQ ID NO: 2889253 - RNA, 15 nt, Mycobacterium avium subsp. paratuberculosis
gcgcccucgccggcg

SEQ ID NO: 2889254 - RNA, 22 nt, Mycobacterium avium subsp. paratuberculosis
gcgcccucgccggcggcgcccg

SEQ ID NO: 2889255 - RNA, 14 nt, Mycobacterium avium subsp. paratuberculosis
gcgcccucggcgau

SEQ ID NO: 2889256 - RNA, 13 nt, Mycobacterium avium subsp. paratuberculosis
gcgcccugcaccc

SEQ ID NO: 2889257 - RNA, 17 nt, Mycobacterium avium subsp. paratuberculosis
gcgcccugcacccagcc

SEQ ID NO: 2889258 - RNA, 16 nt, Mycobacterium avium subsp. paratuberculosis
gcgcccugcacgaaca

SEQ ID NO: 2889259 - RNA, 23 nt, Mycobacterium avium subsp. paratuberculosis
gcgcccugcgaauacccgcccag

SEQ ID NO: 2889260 - RNA, 14 nt, Mycobacterium avium subsp. paratuberculosis
gcgcccugcgagcc

SEQ ID NO: 2889261 - RNA, 15 nt, Mycobacterium avium subsp. paratuberculosis
gcgcccugcgagccc

SEQ ID NO: 2889262 - RNA, 15 nt, Mycobacterium avium subsp. paratuberculosis
gcgcccugcgcgccc

SEQ ID NO: 2889263 - RNA, 21 nt, Mycobacterium avium subsp. paratuberculosis
gcgcccugcugggagcggccc

SEQ ID NO: 2889264 - RNA, 19 nt, Mycobacterium avium subsp. paratuberculosis
gcgcccuggaucgcgccuu

SEQ ID NO: 2889265 - RNA, 16 nt, Mycobacterium avium subsp. paratuberculosis
gcgcccuucccggucg

SEQ ID NO: 2889266 - RNA, 18 nt, Mycobacterium avium subsp. paratuberculosis
gcgcccuucccggucggc

SEQ ID NO: 2889267 - RNA, 15 nt, Mycobacterium avium subsp. paratuberculosis
gcgcccuucggcgcc

SEQ ID NO: 2889268 - RNA, 16 nt, Mycobacterium avium subsp. paratuberculosis
gcgcccuucggcgccc

SEQ ID NO: 2889269 - RNA, 17 nt, Mycobacterium avium subsp. paratuberculosis
gcgcccuucggcgcccg

SEQ ID NO: 2889270 - RNA, 18 nt, Mycobacterium avium subsp. paratuberculosis
gcgcccuucggcgcccgc

SEQ ID NO: 2889271 - RNA, 19 nt, Mycobacterium avium subsp. paratuberculosis
gcgcccuucuucgcgggug

SEQ ID NO: 2889272 - RNA, 20 nt, Mycobacterium avium subsp. paratuberculosis
gcgcccuucuucgcgggugc

SEQ ID NO: 2889273 - RNA, 17 nt, Mycobacterium avium subsp. paratuberculosis
gcgcccuugagcucggc

SEQ ID NO: 2889274 - RNA, 18 nt, Mycobacterium avium subsp. paratuberculosis
gcgcccuugagcucggcc

SEQ ID NO: 2889275 - RNA, 16 nt, Mycobacterium avium subsp. paratuberculosis
gcgcccuugagcuucc

SEQ ID NO: 2889276 - RNA, 20 nt, Mycobacterium avium subsp. paratuberculosis
gcgcccuugagcuucccggc

SEQ ID NO: 2889277 - RNA, 21 nt, Mycobacterium avium subsp. paratuberculosis
gcgcccuugagcuucccggcg

SEQ ID NO: 2889278 - RNA, 22 nt, Mycobacterium avium subsp. paratuberculosis
gcgcccuugagcuucccggcgg

SEQ ID NO: 2889279 - RNA, 23 nt, Mycobacterium avium subsp. paratuberculosis
gcgcccuugagcuucccggcggu

SEQ ID NO: 2889280 - RNA, 18 nt, Mycobacterium avium subsp. paratuberculosis
gcgcccuugccgaugccg

SEQ ID NO: 2889281 - RNA, 19 nt, Mycobacterium avium subsp. paratuberculosis
gcgccgaaaaacgcgacgg

SEQ ID NO: 2889282 - RNA, 20 nt, Mycobacterium avium subsp. paratuberculosis
gcgccgaaaaacgcgacggc

SEQ ID NO: 2889283 - RNA, 14 nt, Mycobacterium avium subsp. paratuberculosis
gcgccgaacaacgg

SEQ ID NO: 2889284 - RNA, 15 nt, Mycobacterium avium subsp. paratuberculosis
gcgccgaacaacggc

SEQ ID NO: 2889285 - RNA, 20 nt, Mycobacterium avium subsp. paratuberculosis
gcgccgaacaacggcggacc

SEQ ID NO: 2889286 - RNA, 21 nt, Mycobacterium avium subsp. paratuberculosis
gcgccgaacaacggcggaccg

SEQ ID NO: 2889287 - RNA, 23 nt, Mycobacterium avium subsp. paratuberculosis
gcgccgaacaacggcggaccggc

SEQ ID NO: 2889288 - RNA, 16 nt, Mycobacterium avium subsp. paratuberculosis
gcgccgaacaccacgc

SEQ ID NO: 2889289 - RNA, 18 nt, Mycobacterium avium subsp. paratuberculosis
gcgccgaacaccacgccg

SEQ ID NO: 2889290 - RNA, 22 nt, Mycobacterium avium subsp. paratuberculosis
gcgccgaacaccacgccgagca

SEQ ID NO: 2889291 - RNA, 17 nt, Mycobacterium avium subsp. paratuberculosis
gcgccgaacaccugcgg

SEQ ID NO: 2889292 - RNA, 16 nt, Mycobacterium avium subsp. paratuberculosis
gcgccgaaccggguga

SEQ ID NO: 2889293 - RNA, 17 nt, Mycobacterium avium subsp. paratuberculosis
gcgccgaacgcaccacc

SEQ ID NO: 2889294 - RNA, 22 nt, Mycobacterium avium subsp. paratuberculosis
gcgccgaacgcaccaccgcggu

SEQ ID NO: 2889295 - RNA, 14 nt, Mycobacterium avium subsp. paratuberculosis
gcgccgaacgccgg

SEQ ID NO: 2889296 - RNA, 15 nt, Mycobacterium avium subsp. paratuberculosis
gcgccgaacgccgga

SEQ ID NO: 2889297 - RNA, 20 nt, Mycobacterium avium subsp. paratuberculosis
gcgccgaacgucgagcgcgg

SEQ ID NO: 2889298 - RNA, 21 nt, Mycobacterium avium subsp. paratuberculosis
gcgccgaacgucgagcgcggc

SEQ ID NO: 2889299 - RNA, 16 nt, Mycobacterium avium subsp. paratuberculosis
gcgccgaacgugcacu

SEQ ID NO: 2889300 - RNA, 22 nt, Mycobacterium avium subsp. paratuberculosis
gcgccgaacgugcacucagggc

SEQ ID NO: 2889301 - RNA, 16 nt, Mycobacterium avium subsp. paratuberculosis
gcgccgaacucggcgc

SEQ ID NO: 2889302 - RNA, 17 nt, Mycobacterium avium subsp. paratuberculosis
gcgccgaacucggcgcc

SEQ ID NO: 2889303 - RNA, 20 nt, Mycobacterium avium subsp. paratuberculosis
gcgccgaacucggcgccgcc

SEQ ID NO: 2889304 - RNA, 22 nt, Mycobacterium avium subsp. paratuberculosis
gcgccgaacucggcgccgccgg

SEQ ID NO: 2889305 - RNA, 17 nt, Mycobacterium avium subsp. paratuberculosis
gcgccgaagauggccag

SEQ ID NO: 2889306 - RNA, 19 nt, Mycobacterium avium subsp. paratuberculosis
gcgccgaagauggccagcg

SEQ ID NO: 2889307 - RNA, 20 nt, Mycobacterium avium subsp. paratuberculosis
gcgccgaagauggccagcgc

SEQ ID NO: 2889308 - RNA, 21 nt, Mycobacterium avium subsp. paratuberculosis
gcgccgaagauggccagcgcg

SEQ ID NO: 2889309 - RNA, 22 nt, Mycobacterium avium subsp. paratuberculosis
gcgccgaagauggccagcgcgg

SEQ ID NO: 2889310 - RNA, 14 nt, Mycobacterium avium subsp. paratuberculosis
gcgccgaagcccgc

SEQ ID NO: 2889311 - RNA, 15 nt, Mycobacterium avium subsp. paratuberculosis
gcgccgaagcccgca

SEQ ID NO: 2889312 - RNA, 18 nt, Mycobacterium avium subsp. paratuberculosis
gcgccgaagcccgcagcg

SEQ ID NO: 2889313 - RNA, 19 nt, Mycobacterium avium subsp. paratuberculosis
gcgccgaagccgucgaccc

SEQ ID NO: 2889314 - RNA, 21 nt, Mycobacterium avium subsp. paratuberculosis
gcgccgaagccgucgaccccg

SEQ ID NO: 2889315 - RNA, 19 nt, Mycobacterium avium subsp. paratuberculosis
gcgccgaaguugucggguu

SEQ ID NO: 2889316 - RNA, 15 nt, Mycobacterium avium subsp. paratuberculosis
gcgccgaaucggcug

SEQ ID NO: 2889317 - RNA, 21 nt, Mycobacterium avium subsp. paratuberculosis
gcgccgaaucggcuguggcgc

SEQ ID NO: 2889318 - RNA, 16 nt, Mycobacterium avium subsp. paratuberculosis
gcgccgaaugccacgc

SEQ ID NO: 2889319 - RNA, 22 nt, Mycobacterium avium subsp. paratuberculosis
gcgccgacagaugcggcaccag

SEQ ID NO: 2889320 - RNA, 15 nt, Mycobacterium avium subsp. paratuberculosis
gcgccgacagcugag

SEQ ID NO: 2889321 - RNA, 21 nt, Mycobacterium avium subsp. paratuberculosis
gcgccgacagcugagcagccc

SEQ ID NO: 2889322 - RNA, 22 nt, Mycobacterium avium subsp. paratuberculosis
gcgccgacagcugagcagcccg

SEQ ID NO: 2889323 - RNA, 16 nt, Mycobacterium avium subsp. paratuberculosis
gcgccgacagucgcgg

SEQ ID NO: 2889324 - RNA, 21 nt, Mycobacterium avium subsp. paratuberculosis
gcgccgacagucgcgggcagc

SEQ ID NO: 2889325 - RNA, 12 nt, Mycobacterium avium subsp. paratuberculosis
gcgccgaccacg

SEQ ID NO: 2889326 - RNA, 22 nt, Mycobacterium avium subsp. paratuberculosis
gcgccgaccacggccccagccg

SEQ ID NO: 2889327 - RNA, 23 nt, Mycobacterium avium subsp. paratuberculosis
gcgccgaccacggccccagccgc

SEQ ID NO: 2889328 - RNA, 14 nt, Mycobacterium avium subsp. paratuberculosis
gcgccgaccagcgc

SEQ ID NO: 2889329 - RNA, 16 nt, Mycobacterium avium subsp. paratuberculosis
gcgccgaccagcgcgu

SEQ ID NO: 2889330 - RNA, 18 nt, Mycobacterium avium subsp. paratuberculosis
gcgccgaccagcgcguug

SEQ ID NO: 2889331 - RNA, 19 nt, Mycobacterium avium subsp. paratuberculosis
gcgccgaccagcgcguuga

SEQ ID NO: 2889332 - RNA, 16 nt, Mycobacterium avium subsp. paratuberculosis
gcgccgacccccgccg

SEQ ID NO: 2889333 - RNA, 23 nt, Mycobacterium avium subsp. paratuberculosis
gcgccgacccccgccgcgucggu

SEQ ID NO: 2889334 - RNA, 13 nt, Mycobacterium avium subsp. paratuberculosis
gcgccgacccgcc

SEQ ID NO: 2889335 - RNA, 15 nt, Mycobacterium avium subsp. paratuberculosis
gcgccgacccgcccg

SEQ ID NO: 2889336 - RNA, 21 nt, Mycobacterium avium subsp. paratuberculosis
gcgccgacccgcccgccgggc

SEQ ID NO: 2889337 - RNA, 12 nt, Mycobacterium avium subsp. paratuberculosis
gcgccgaccgcg

SEQ ID NO: 2889338 - RNA, 14 nt, Mycobacterium avium subsp. paratuberculosis
gcgccgaccgcgau

SEQ ID NO: 2889339 - RNA, 14 nt, Mycobacterium avium subsp. paratuberculosis
gcgccgaccucggc

SEQ ID NO: 2889340 - RNA, 17 nt, Mycobacterium avium subsp. paratuberculosis
gcgccgaccucggccag

SEQ ID NO: 2889341 - RNA, 18 nt, Mycobacterium avium subsp. paratuberculosis
gcgccgaccucggccagc

SEQ ID NO: 2889342 - RNA, 21 nt, Mycobacterium avium subsp. paratuberculosis
gcgccgaccucggccagcgug

SEQ ID NO: 2889343 - RNA, 19 nt, Mycobacterium avium subsp. paratuberculosis
gcgccgaccucgucggcgg

SEQ ID NO: 2889344 - RNA, 20 nt, Mycobacterium avium subsp. paratuberculosis
gcgccgaccucgucggcggu

SEQ ID NO: 2889345 - RNA, 23 nt, Mycobacterium avium subsp. paratuberculosis
gcgccgaccucgucggcggugcc

SEQ ID NO: 2889346 - RNA, 20 nt, Mycobacterium avium subsp. paratuberculosis
gcgccgaccuggucgccgaa

SEQ ID NO: 2889347 - RNA, 15 nt, Mycobacterium avium subsp. paratuberculosis
gcgccgacgaccagu

SEQ ID NO: 2889348 - RNA, 15 nt, Mycobacterium avium subsp. paratuberculosis
gcgccgacgacgucg

SEQ ID NO: 2889349 - RNA, 18 nt, Mycobacterium avium subsp. paratuberculosis
gcgccgacgacgucgcgc

SEQ ID NO: 2889350 - RNA, 13 nt, Mycobacterium avium subsp. paratuberculosis
gcgccgacgaucc

SEQ ID NO: 2889351 - RNA, 14 nt, Mycobacterium avium subsp. paratuberculosis
gcgccgacgauccc

SEQ ID NO: 2889352 - RNA, 17 nt, Mycobacterium avium subsp. paratuberculosis
gcgccgacgaucccggc

SEQ ID NO: 2889353 - RNA, 19 nt, Mycobacterium avium subsp. paratuberculosis
gcgccgacgaucccggcga

SEQ ID NO: 2889354 - RNA, 21 nt, Mycobacterium avium subsp. paratuberculosis
gcgccgacgaucccggcgagc

SEQ ID NO: 2889355 - RNA, 15 nt, Mycobacterium avium subsp. paratuberculosis
gcgccgacgcccaca

SEQ ID NO: 2889356 - RNA, 17 nt, Mycobacterium avium subsp. paratuberculosis
gcgccgacgcccacagc

SEQ ID NO: 2889357 - RNA, 21 nt, Mycobacterium avium subsp. paratuberculosis
gcgccgacgcccacagcgcca

SEQ ID NO: 2889358 - RNA, 14 nt, Mycobacterium avium subsp. paratuberculosis
gcgccgacggccag

SEQ ID NO: 2889359 - RNA, 16 nt, Mycobacterium avium subsp. paratuberculosis
gcgccgacggccagca

SEQ ID NO: 2889360 - RNA, 15 nt, Mycobacterium avium subsp. paratuberculosis
gcgccgacgggcccg

SEQ ID NO: 2889361 - RNA, 19 nt, Mycobacterium avium subsp. paratuberculosis
gcgccgacgggcccgcgcc

SEQ ID NO: 2889362 - RNA, 21 nt, Mycobacterium avium subsp. paratuberculosis
gcgccgacgggcccgcgccuu

SEQ ID NO: 2889363 - RNA, 15 nt, Mycobacterium avium subsp. paratuberculosis
gcgccgacgggguuc

SEQ ID NO: 2889364 - RNA, 15 nt, Mycobacterium avium subsp. paratuberculosis
gcgccgacgucaggg

SEQ ID NO: 2889365 - RNA, 16 nt, Mycobacterium avium subsp. paratuberculosis
gcgccgacgucagggg

SEQ ID NO: 2889366 - RNA, 18 nt, Mycobacterium avium subsp. paratuberculosis
gcgccgacgucaggggug

SEQ ID NO: 2889367 - RNA, 21 nt, Mycobacterium avium subsp. paratuberculosis
gcgccgacuugaucgcggcgu

SEQ ID NO: 2889368 - RNA, 22 nt, Mycobacterium avium subsp. paratuberculosis
gcgccgacuugaucgcggcgua

SEQ ID NO: 2889369 - RNA, 17 nt, Mycobacterium avium subsp. paratuberculosis
gcgccgacuuggugcca

SEQ ID NO: 2889370 - RNA, 21 nt, Mycobacterium avium subsp. paratuberculosis
gcgccgacuuggugccaugcc

SEQ ID NO: 2889371 - RNA, 20 nt, Mycobacterium avium subsp. paratuberculosis
gcgccgagaacaggccgagc

SEQ ID NO: 2889372 - RNA, 21 nt, Mycobacterium avium subsp. paratuberculosis
gcgccgagaacaggccgagcg

SEQ ID NO: 2889373 - RNA, 17 nt, Mycobacterium avium subsp. paratuberculosis
gcgccgagacacauucg

SEQ ID NO: 2889374 - RNA, 21 nt, Mycobacterium avium subsp. paratuberculosis
gcgccgagacacauucgcgug

SEQ ID NO: 2889375 - RNA, 15 nt, Mycobacterium avium subsp. paratuberculosis
gcgccgagaccagcc

SEQ ID NO: 2889376 - RNA, 17 nt, Mycobacterium avium subsp. paratuberculosis
gcgccgagaccagccag

SEQ ID NO: 2889377 - RNA, 18 nt, Mycobacterium avium subsp. paratuberculosis
gcgccgagacgugguggu

SEQ ID NO: 2889378 - RNA, 23 nt, Mycobacterium avium subsp. paratuberculosis
gcgccgagacgugguggugcgga

SEQ ID NO: 2889379 - RNA, 15 nt, Mycobacterium avium subsp. paratuberculosis
gcgccgagagcgcgu

SEQ ID NO: 2889380 - RNA, 17 nt, Mycobacterium avium subsp. paratuberculosis
gcgccgagagcgcgucg

SEQ ID NO: 2889381 - RNA, 16 nt, Mycobacterium avium subsp. paratuberculosis
gcgccgagaucgcggu

SEQ ID NO: 2889382 - RNA, 17 nt, Mycobacterium avium subsp. paratuberculosis
gcgccgagaucgcggug

SEQ ID NO: 2889383 - RNA, 20 nt, Mycobacterium avium subsp. paratuberculosis
gcgccgagaucgcgguggcg

SEQ ID NO: 2889384 - RNA, 16 nt, Mycobacterium avium subsp. paratuberculosis
gcgccgagcaaccggg

SEQ ID NO: 2889385 - RNA, 16 nt, Mycobacterium avium subsp. paratuberculosis
gcgccgagcacgaacg

SEQ ID NO: 2889386 - RNA, 23 nt, Mycobacterium avium subsp. paratuberculosis
gcgccgagcacgaacgcggccgc

SEQ ID NO: 2889387 - RNA, 14 nt, Mycobacterium avium subsp. paratuberculosis
gcgccgagcacggc

SEQ ID NO: 2889388 - RNA, 15 nt, Mycobacterium avium subsp. paratuberculosis
gcgccgagcagcugg

SEQ ID NO: 2889389 - RNA, 17 nt, Mycobacterium avium subsp. paratuberculosis
gcgccgagcagcuggga

SEQ ID NO: 2889390 - RNA, 15 nt, Mycobacterium avium subsp. paratuberculosis
gcgccgagccgaggc

SEQ ID NO: 2889391 - RNA, 21 nt, Mycobacterium avium subsp. paratuberculosis
gcgccgagcgucacgcuggcg

SEQ ID NO: 2889392 - RNA, 17 nt, Mycobacterium avium subsp. paratuberculosis
gcgccgaggaacugcag

SEQ ID NO: 2889393 - RNA, 21 nt, Mycobacterium avium subsp. paratuberculosis
gcgccgaggaucuugaucgcg

SEQ ID NO: 2889394 - RNA, 15 nt, Mycobacterium avium subsp. paratuberculosis
gcgccgaggccagca

SEQ ID NO: 2889395 - RNA, 16 nt, Mycobacterium avium subsp. paratuberculosis
gcgccgaggccagcac

SEQ ID NO: 2889396 - RNA, 22 nt, Mycobacterium avium subsp. paratuberculosis
gcgccgaggccagcacgccggu

SEQ ID NO: 2889397 - RNA, 18 nt, Mycobacterium avium subsp. paratuberculosis
gcgccgaggcgcucggcc

SEQ ID NO: 2889398 - RNA, 19 nt, Mycobacterium avium subsp. paratuberculosis
gcgccgaggcgcucggccc

SEQ ID NO: 2889399 - RNA, 21 nt, Mycobacterium avium subsp. paratuberculosis
gcgccgaggcgcucggcccgc

SEQ ID NO: 2889400 - RNA, 18 nt, Mycobacterium avium subsp. paratuberculosis
gcgccgaggucaccgcgg

SEQ ID NO: 2889401 - RNA, 22 nt, Mycobacterium avium subsp. paratuberculosis
gcgccgaggucaccgcgggaau

SEQ ID NO: 2889402 - RNA, 14 nt, Mycobacterium avium subsp. paratuberculosis
gcgccgaggugcug

SEQ ID NO: 2889403 - RNA, 14 nt, Mycobacterium avium subsp. paratuberculosis
gcgccgagguggcc

SEQ ID NO: 2889404 - RNA, 19 nt, Mycobacterium avium subsp. paratuberculosis
gcgccgagguggcccgcca

SEQ ID NO: 2889405 - RNA, 15 nt, Mycobacterium avium subsp. paratuberculosis
gcgccgagguggccg

SEQ ID NO: 2889406 - RNA, 19 nt, Mycobacterium avium subsp. paratuberculosis
gcgccgagguggccgccag

SEQ ID NO: 2889407 - RNA, 19 nt, Mycobacterium avium subsp. paratuberculosis
gcgccgaguccgggccgcc

SEQ ID NO: 2889408 - RNA, 21 nt, Mycobacterium avium subsp. paratuberculosis
gcgccgaguccgggccgccgg

SEQ ID NO: 2889409 - RNA, 23 nt, Mycobacterium avium subsp. paratuberculosis
gcgccgaucacgaacagguccgc

SEQ ID NO: 2889410 - RNA, 15 nt, Mycobacterium avium subsp. paratuberculosis
gcgccgauccggcuc

SEQ ID NO: 2889411 - RNA, 21 nt, Mycobacterium avium subsp. paratuberculosis
gcgccgauccggcuccacagc

SEQ ID NO: 2889412 - RNA, 12 nt, Mycobacterium avium subsp. paratuberculosis
gcgccgaucgag

SEQ ID NO: 2889413 - RNA, 14 nt, Mycobacterium avium subsp. paratuberculosis
gcgccgaucgccca

SEQ ID NO: 2889414 - RNA, 16 nt, Mycobacterium avium subsp. paratuberculosis
gcgccgaucgcccagu

SEQ ID NO: 2889415 - RNA, 18 nt, Mycobacterium avium subsp. paratuberculosis
gcgccgaucgcccagugc

SEQ ID NO: 2889416 - RNA, 14 nt, Mycobacterium avium subsp. paratuberculosis
gcgccgaucgcgcg

SEQ ID NO: 2889417 - RNA, 14 nt, Mycobacterium avium subsp. paratuberculosis
gcgccgaucugcuc

SEQ ID NO: 2889418 - RNA, 17 nt, Mycobacterium avium subsp. paratuberculosis
gcgccgaucugcucggc

SEQ ID NO: 2889419 - RNA, 19 nt, Mycobacterium avium subsp. paratuberculosis
gcgccgaucugcucggcug

SEQ ID NO: 2889420 - RNA, 21 nt, Mycobacterium avium subsp. paratuberculosis
gcgccgaucugcucggcugca

SEQ ID NO: 2889421 - RNA, 18 nt, Mycobacterium avium subsp. paratuberculosis
gcgccgaugcauuggugc

SEQ ID NO: 2889422 - RNA, 21 nt, Mycobacterium avium subsp. paratuberculosis
gcgccgaugcccgccccggac

SEQ ID NO: 2889423 - RNA, 12 nt, Mycobacterium avium subsp. paratuberculosis
gcgccgaugccg

SEQ ID NO: 2889424 - RNA, 22 nt, Mycobacterium avium subsp. paratuberculosis
gcgccgaugccgaacgucacca

SEQ ID NO: 2889425 - RNA, 14 nt, Mycobacterium avium subsp. paratuberculosis
gcgccgaugccgcg

SEQ ID NO: 2889426 - RNA, 15 nt, Mycobacterium avium subsp. paratuberculosis
gcgccgaugccgcgc

SEQ ID NO: 2889427 - RNA, 21 nt, Mycobacterium avium subsp. paratuberculosis
gcgccgaugccgcgcugcgcc

SEQ ID NO: 2889428 - RNA, 16 nt, Mycobacterium avium subsp. paratuberculosis
gcgccgauggcgaagc

SEQ ID NO: 2889429 - RNA, 19 nt, Mycobacterium avium subsp. paratuberculosis
gcgccgauggcgaagccca

SEQ ID NO: 2889430 - RNA, 22 nt, Mycobacterium avium subsp. paratuberculosis
gcgccgauggcgaagcccaugc

SEQ ID NO: 2889431 - RNA, 22 nt, Mycobacterium avium subsp. paratuberculosis
gcgccgauggugacgauccggu

SEQ ID NO: 2889432 - RNA, 16 nt, Mycobacterium avium subsp. paratuberculosis
gcgccgauggugcccu

SEQ ID NO: 2889433 - RNA, 13 nt, Mycobacterium avium subsp. paratuberculosis
gcgccgauguggc

SEQ ID NO: 2889434 - RNA, 18 nt, Mycobacterium avium subsp. paratuberculosis
gcgccgauguggccggcg

SEQ ID NO: 2889435 - RNA, 20 nt, Mycobacterium avium subsp. paratuberculosis
gcgccgauguggccggcgau

SEQ ID NO: 2889436 - RNA, 16 nt, Mycobacterium avium subsp. paratuberculosis
gcgccgcaacggcgca

SEQ ID NO: 2889437 - RNA, 18 nt, Mycobacterium avium subsp. paratuberculosis
gcgccgcaacggcgcaac

SEQ ID NO: 2889438 - RNA, 21 nt, Mycobacterium avium subsp. paratuberculosis
gcgccgcaacggcucccaggc

SEQ ID NO: 2889439 - RNA, 13 nt, Mycobacterium avium subsp. paratuberculosis
gcgccgcacagcc

SEQ ID NO: 2889440 - RNA, 15 nt, Mycobacterium avium subsp. paratuberculosis
gcgccgcacagccgg

SEQ ID NO: 2889441 - RNA, 17 nt, Mycobacterium avium subsp. paratuberculosis
gcgccgcacagccggcg

SEQ ID NO: 2889442 - RNA, 21 nt, Mycobacterium avium subsp. paratuberculosis
gcgccgcacagccggcggcgg

SEQ ID NO: 2889443 - RNA, 13 nt, Mycobacterium avium subsp. paratuberculosis
gcgccgcaccucg

SEQ ID NO: 2889444 - RNA, 14 nt, Mycobacterium avium subsp. paratuberculosis
gcgccgcaccucgc

SEQ ID NO: 2889445 - RNA, 20 nt, Mycobacterium avium subsp. paratuberculosis
gcgccgcaccucgccgaucu

SEQ ID NO: 2889446 - RNA, 16 nt, Mycobacterium avium subsp. paratuberculosis
gcgccgcacugcacgg

SEQ ID NO: 2889447 - RNA, 21 nt, Mycobacterium avium subsp. paratuberculosis
gcgccgcacugcacggccucg

SEQ ID NO: 2889448 - RNA, 13 nt, Mycobacterium avium subsp. paratuberculosis
gcgccgcagcgcg

SEQ ID NO: 2889449 - RNA, 14 nt, Mycobacterium avium subsp. paratuberculosis
gcgccgcagcgcgc

SEQ ID NO: 2889450 - RNA, 17 nt, Mycobacterium avium subsp. paratuberculosis
gcgccgcagcggcgccg

SEQ ID NO: 2889451 - RNA, 13 nt, Mycobacterium avium subsp. paratuberculosis
gcgccgcagcucg

SEQ ID NO: 2889452 - RNA, 20 nt, Mycobacterium avium subsp. paratuberculosis
gcgccgcaggagaucggcgc

SEQ ID NO: 2889453 - RNA, 23 nt, Mycobacterium avium subsp. paratuberculosis
gcgccgcaggagaucggcgcgga

SEQ ID NO: 2889454 - RNA, 21 nt, Mycobacterium avium subsp. paratuberculosis
gcgccgcaugaugcggccaug

SEQ ID NO: 2889455 - RNA, 22 nt, Mycobacterium avium subsp. paratuberculosis
gcgccgcaugaugcggccauga

SEQ ID NO: 2889456 - RNA, 12 nt, Mycobacterium avium subsp. paratuberculosis
gcgccgcaugcc

SEQ ID NO: 2889457 - RNA, 20 nt, Mycobacterium avium subsp. paratuberculosis
gcgccgcauuggugccggcc

SEQ ID NO: 2889458 - RNA, 22 nt, Mycobacterium avium subsp. paratuberculosis
gcgccgcauuggugccggccuc

SEQ ID NO: 2889459 - RNA, 23 nt, Mycobacterium avium subsp. paratuberculosis
gcgccgcauuggugccggccucg

SEQ ID NO: 2889460 - RNA, 14 nt, Mycobacterium avium subsp. paratuberculosis
gcgccgccaaccag

SEQ ID NO: 2889461 - RNA, 17 nt, Mycobacterium avium subsp. paratuberculosis
gcgccgccaaccagguc

SEQ ID NO: 2889462 - RNA, 22 nt, Mycobacterium avium subsp. paratuberculosis
gcgccgccaaccaggucgcggc

SEQ ID NO: 2889463 - RNA, 15 nt, Mycobacterium avium subsp. paratuberculosis
gcgccgccacaccuc

SEQ ID NO: 2889464 - RNA, 20 nt, Mycobacterium avium subsp. paratuberculosis
gcgccgccacaccucggcga

SEQ ID NO: 2889465 - RNA, 21 nt, Mycobacterium avium subsp. paratuberculosis
gcgccgccacaccucggcgac

SEQ ID NO: 2889466 - RNA, 13 nt, Mycobacterium avium subsp. paratuberculosis
gcgccgccaccgg

SEQ ID NO: 2889467 - RNA, 15 nt, Mycobacterium avium subsp. paratuberculosis
gcgccgccaccggcc

SEQ ID NO: 2889468 - RNA, 11 nt, Mycobacterium avium subsp. paratuberculosis
gcgccgccacg

SEQ ID NO: 2889469 - RNA, 12 nt, Mycobacterium avium subsp. paratuberculosis
gcgccgccacgc

SEQ ID NO: 2889470 - RNA, 14 nt, Mycobacterium avium subsp. paratuberculosis
gcgccgccacgcgg

SEQ ID NO: 2889471 - RNA, 16 nt, Mycobacterium avium subsp. paratuberculosis
gcgccgccacgcggcg

SEQ ID NO: 2889472 - RNA, 17 nt, Mycobacterium avium subsp. paratuberculosis
gcgccgccacgcggcgc

SEQ ID NO: 2889473 - RNA, 20 nt, Mycobacterium avium subsp. paratuberculosis
gcgccgccacgcggcgcgca

SEQ ID NO: 2889474 - RNA, 21 nt, Mycobacterium avium subsp. paratuberculosis
gcgccgccacggcacgucgag

SEQ ID NO: 2889475 - RNA, 19 nt, Mycobacterium avium subsp. paratuberculosis
gcgccgccacggccaccgc

SEQ ID NO: 2889476 - RNA, 14 nt, Mycobacterium avium subsp. paratuberculosis
gcgccgccagccgc

SEQ ID NO: 2889477 - RNA, 12 nt, Mycobacterium avium subsp. paratuberculosis
gcgccgccaggg

SEQ ID NO: 2889478 - RNA, 20 nt, Mycobacterium avium subsp. paratuberculosis
gcgccgccagggcgcggcgc

SEQ ID NO: 2889479 - RNA, 17 nt, Mycobacterium avium subsp. paratuberculosis
gcgccgcccacaccgac

SEQ ID NO: 2889480 - RNA, 16 nt, Mycobacterium avium subsp. paratuberculosis
gcgccgcccaccagca

SEQ ID NO: 2889481 - RNA, 17 nt, Mycobacterium avium subsp. paratuberculosis
gcgccgcccaccagcac

SEQ ID NO: 2889482 - RNA, 21 nt, Mycobacterium avium subsp. paratuberculosis
gcgccgcccaccagcacaccg

SEQ ID NO: 2889483 - RNA, 18 nt, Mycobacterium avium subsp. paratuberculosis
gcgccgcccaccuuccca

SEQ ID NO: 2889484 - RNA, 17 nt, Mycobacterium avium subsp. paratuberculosis
gcgccgcccagcgguga

SEQ ID NO: 2889485 - RNA, 15 nt, Mycobacterium avium subsp. paratuberculosis
gcgccgcccccgcgg

SEQ ID NO: 2889486 - RNA, 16 nt, Mycobacterium avium subsp. paratuberculosis
gcgccgcccccgcggc

SEQ ID NO: 2889487 - RNA, 13 nt, Mycobacterium avium subsp. paratuberculosis
gcgccgcccgcac

SEQ ID NO: 2889488 - RNA, 17 nt, Mycobacterium avium subsp. paratuberculosis
gcgccgcccgcaccugc

SEQ ID NO: 2889489 - RNA, 20 nt, Mycobacterium avium subsp. paratuberculosis
gcgccgcccgcaccugcgcg

SEQ ID NO: 2889490 - RNA, 23 nt, Mycobacterium avium subsp. paratuberculosis
gcgccgcccgcaccugcgcgccg

SEQ ID NO: 2889491 - RNA, 14 nt, Mycobacterium avium subsp. paratuberculosis
gcgccgcccgcagu

SEQ ID NO: 2889492 - RNA, 15 nt, Mycobacterium avium subsp. paratuberculosis
gcgccgcccgcaguu

SEQ ID NO: 2889493 - RNA, 21 nt, Mycobacterium avium subsp. paratuberculosis
gcgccgcccgcaguucggccg

SEQ ID NO: 2889494 - RNA, 13 nt, Mycobacterium avium subsp. paratuberculosis
gcgccgcccggcg

SEQ ID NO: 2889495 - RNA, 14 nt, Mycobacterium avium subsp. paratuberculosis
gcgccgcccggcga

SEQ ID NO: 2889496 - RNA, 16 nt, Mycobacterium avium subsp. paratuberculosis
gcgccgcccggcgauc

SEQ ID NO: 2889497 - RNA, 13 nt, Mycobacterium avium subsp. paratuberculosis
gcgccgcccgggc

SEQ ID NO: 2889498 - RNA, 14 nt, Mycobacterium avium subsp. paratuberculosis
gcgccgcccgggcc

SEQ ID NO: 2889499 - RNA, 15 nt, Mycobacterium avium subsp. paratuberculosis
gcgccgcccgggccc

SEQ ID NO: 2889500 - RNA, 16 nt, Mycobacterium avium subsp. paratuberculosis
gcgccgcccgggcccg

SEQ ID NO: 2889501 - RNA, 15 nt, Mycobacterium avium subsp. paratuberculosis
gcgccgcccgggcgg

SEQ ID NO: 2889502 - RNA, 16 nt, Mycobacterium avium subsp. paratuberculosis
gcgccgcccgggcggc

SEQ ID NO: 2889503 - RNA, 12 nt, Mycobacterium avium subsp. paratuberculosis
gcgccgcccguc

SEQ ID NO: 2889504 - RNA, 18 nt, Mycobacterium avium subsp. paratuberculosis
gcgccgcccguccagcgc

SEQ ID NO: 2889505 - RNA, 14 nt, Mycobacterium avium subsp. paratuberculosis
gcgccgcccucgcc

SEQ ID NO: 2889506 - RNA, 17 nt, Mycobacterium avium subsp. paratuberculosis
gcgccgcccucgccgaa

SEQ ID NO: 2889507 - RNA, 22 nt, Mycobacterium avium subsp. paratuberculosis
gcgccgcccucgccgaaccggg

SEQ ID NO: 2889508 - RNA, 19 nt, Mycobacterium avium subsp. paratuberculosis
gcgccgccgaacagcagcg

SEQ ID NO: 2889509 - RNA, 12 nt, Mycobacterium avium subsp. paratuberculosis
gcgccgccgacc

SEQ ID NO: 2889510 - RNA, 23 nt, Mycobacterium avium subsp. paratuberculosis
gcgccgccgagcaacagcccgac

SEQ ID NO: 2889511 - RNA, 14 nt, Mycobacterium avium subsp. paratuberculosis
gcgccgccgagccg

SEQ ID NO: 2889512 - RNA, 19 nt, Mycobacterium avium subsp. paratuberculosis
gcgccgccgagccgcgggu

SEQ ID NO: 2889513 - RNA, 21 nt, Mycobacterium avium subsp. paratuberculosis
gcgccgccgagccgcggguga

SEQ ID NO: 2889514 - RNA, 14 nt, Mycobacterium avium subsp. paratuberculosis
gcgccgccgccagc

SEQ ID NO: 2889515 - RNA, 16 nt, Mycobacterium avium subsp. paratuberculosis
gcgccgccgccagcca

SEQ ID NO: 2889516 - RNA, 18 nt, Mycobacterium avium subsp. paratuberculosis
gcgccgccgccagccagc

SEQ ID NO: 2889517 - RNA, 21 nt, Mycobacterium avium subsp. paratuberculosis
gcgccgccgccagccagccgg

SEQ ID NO: 2889518 - RNA, 12 nt, Mycobacterium avium subsp. paratuberculosis
gcgccgccgccc

SEQ ID NO: 2889519 - RNA, 16 nt, Mycobacterium avium subsp. paratuberculosis
gcgccgccgcccuggc

SEQ ID NO: 2889520 - RNA, 17 nt, Mycobacterium avium subsp. paratuberculosis
gcgccgccgccgcccac

SEQ ID NO: 2889521 - RNA, 18 nt, Mycobacterium avium subsp. paratuberculosis
gcgccgccgccgcccacg

SEQ ID NO: 2889522 - RNA, 19 nt, Mycobacterium avium subsp. paratuberculosis
gcgccgccgccgcccacgc

SEQ ID NO: 2889523 - RNA, 23 nt, Mycobacterium avium subsp. paratuberculosis
gcgccgccgccgcccacgccgcc

SEQ ID NO: 2889524 - RNA, 14 nt, Mycobacterium avium subsp. paratuberculosis
gcgccgccgcgcag

SEQ ID NO: 2889525 - RNA, 21 nt, Mycobacterium avium subsp. paratuberculosis
gcgccgccgcgcaggccgccg

SEQ ID NO: 2889526 - RNA, 22 nt, Mycobacterium avium subsp. paratuberculosis
gcgccgccgcgcaggccgccga

SEQ ID NO: 2889527 - RNA, 21 nt, Mycobacterium avium subsp. paratuberculosis
gcgccgccgcgucgugccgag

SEQ ID NO: 2889528 - RNA, 22 nt, Mycobacterium avium subsp. paratuberculosis
gcgccgccgcgucgugccgagc

SEQ ID NO: 2889529 - RNA, 23 nt, Mycobacterium avium subsp. paratuberculosis
gcgccgccgcgucgugccgagcg

SEQ ID NO: 2889530 - RNA, 12 nt, Mycobacterium avium subsp. paratuberculosis
gcgccgccggcg

SEQ ID NO: 2889531 - RNA, 15 nt, Mycobacterium avium subsp. paratuberculosis
gcgccgccggcgucg

SEQ ID NO: 2889532 - RNA, 13 nt, Mycobacterium avium subsp. paratuberculosis
gcgccgccggggc

SEQ ID NO: 2889533 - RNA, 17 nt, Mycobacterium avium subsp. paratuberculosis
gcgccgccggggcgucg

SEQ ID NO: 2889534 - RNA, 19 nt, Mycobacterium avium subsp. paratuberculosis
gcgccgccggggcgucgga

SEQ ID NO: 2889535 - RNA, 15 nt, Mycobacterium avium subsp. paratuberculosis
gcgccgccggucgcc

SEQ ID NO: 2889536 - RNA, 18 nt, Mycobacterium avium subsp. paratuberculosis
gcgccgccguucgccggc

SEQ ID NO: 2889537 - RNA, 15 nt, Mycobacterium avium subsp. paratuberculosis
gcgccgccuccgggc

SEQ ID NO: 2889538 - RNA, 23 nt, Mycobacterium avium subsp. paratuberculosis
gcgccgccuccgggcugccguag

SEQ ID NO: 2889539 - RNA, 13 nt, Mycobacterium avium subsp. paratuberculosis
gcgccgcgacccc

SEQ ID NO: 2889540 - RNA, 19 nt, Mycobacterium avium subsp. paratuberculosis
gcgccgcgaccccggaccg

SEQ ID NO: 2889541 - RNA, 23 nt, Mycobacterium avium subsp. paratuberculosis
gcgccgcgacgaacugccguuga

SEQ ID NO: 2889542 - RNA, 14 nt, Mycobacterium avium subsp. paratuberculosis
gcgccgcgacgucg

SEQ ID NO: 2889543 - RNA, 19 nt, Mycobacterium avium subsp. paratuberculosis
gcgccgcgagcgcagcagg

SEQ ID NO: 2889544 - RNA, 18 nt, Mycobacterium avium subsp. paratuberculosis
gcgccgcgaucucggcgg

SEQ ID NO: 2889545 - RNA, 19 nt, Mycobacterium avium subsp. paratuberculosis
gcgccgcgaucucggcgga

SEQ ID NO: 2889546 - RNA, 14 nt, Mycobacterium avium subsp. paratuberculosis
gcgccgcgaugauc

SEQ ID NO: 2889547 - RNA, 12 nt, Mycobacterium avium subsp. paratuberculosis
gcgccgcgcagc

SEQ ID NO: 2889548 - RNA, 15 nt, Mycobacterium avium subsp. paratuberculosis
gcgccgcgcagccag

SEQ ID NO: 2889549 - RNA, 18 nt, Mycobacterium avium subsp. paratuberculosis
gcgccgcgcagccagacc

SEQ ID NO: 2889550 - RNA, 14 nt, Mycobacterium avium subsp. paratuberculosis
gcgccgcgccgacc

SEQ ID NO: 2889551 - RNA, 14 nt, Mycobacterium avium subsp. paratuberculosis
gcgccgcgccgccu

SEQ ID NO: 2889552 - RNA, 15 nt, Mycobacterium avium subsp. paratuberculosis
gcgccgcgccgccuu

SEQ ID NO: 2889553 - RNA, 13 nt, Mycobacterium avium subsp. paratuberculosis
gcgccgcgccggc

SEQ ID NO: 2889554 - RNA, 14 nt, Mycobacterium avium subsp. paratuberculosis
gcgccgcgccggca

SEQ ID NO: 2889555 - RNA, 12 nt, Mycobacterium avium subsp. paratuberculosis
gcgccgcgcgcc

SEQ ID NO: 2889556 - RNA, 14 nt, Mycobacterium avium subsp. paratuberculosis
gcgccgcgcgcccu

SEQ ID NO: 2889557 - RNA, 20 nt, Mycobacterium avium subsp. paratuberculosis
gcgccgcgcgcgcggccucc

SEQ ID NO: 2889558 - RNA, 14 nt, Mycobacterium avium subsp. paratuberculosis
gcgccgcgcuggcc

SEQ ID NO: 2889559 - RNA, 12 nt, Mycobacterium avium subsp. paratuberculosis
gcgccgcggaug

SEQ ID NO: 2889560 - RNA, 12 nt, Mycobacterium avium subsp. paratuberculosis
gcgccgcggcca

SEQ ID NO: 2889561 - RNA, 13 nt, Mycobacterium avium subsp. paratuberculosis
gcgccgcggccac

SEQ ID NO: 2889562 - RNA, 15 nt, Mycobacterium avium subsp. paratuberculosis
gcgccgcggccaccg

SEQ ID NO: 2889563 - RNA, 15 nt, Mycobacterium avium subsp. paratuberculosis
gcgccgcggccagcc

SEQ ID NO: 2889564 - RNA, 17 nt, Mycobacterium avium subsp. paratuberculosis
gcgccgcggccagccgg

SEQ ID NO: 2889565 - RNA, 18 nt, Mycobacterium avium subsp. paratuberculosis
gcgccgcggccagcgccc

SEQ ID NO: 2889566 - RNA, 19 nt, Mycobacterium avium subsp. paratuberculosis
gcgccgcggccagcgcccc

SEQ ID NO: 2889567 - RNA, 12 nt, Mycobacterium avium subsp. paratuberculosis
gcgccgcggccc

SEQ ID NO: 2889568 - RNA, 13 nt, Mycobacterium avium subsp. paratuberculosis
gcgccgcggcccu

SEQ ID NO: 2889569 - RNA, 15 nt, Mycobacterium avium subsp. paratuberculosis
gcgccgcggcccugc

SEQ ID NO: 2889570 - RNA, 22 nt, Mycobacterium avium subsp. paratuberculosis
gcgccgcggcccugcagcgccu

SEQ ID NO: 2889571 - RNA, 15 nt, Mycobacterium avium subsp. paratuberculosis
gcgccgcggccggug

SEQ ID NO: 2889572 - RNA, 17 nt, Mycobacterium avium subsp. paratuberculosis
gcgccgcggccggugcc

SEQ ID NO: 2889573 - RNA, 16 nt, Mycobacterium avium subsp. paratuberculosis
gcgccgcggccguugc

SEQ ID NO: 2889574 - RNA, 23 nt, Mycobacterium avium subsp. paratuberculosis
gcgccgcggccguugcucucggc

SEQ ID NO: 2889575 - RNA, 15 nt, Mycobacterium avium subsp. paratuberculosis
gcgccgcggcgaaaa

SEQ ID NO: 2889576 - RNA, 14 nt, Mycobacterium avium subsp. paratuberculosis
gcgccgcggcgccc

SEQ ID NO: 2889577 - RNA, 16 nt, Mycobacterium avium subsp. paratuberculosis
gcgccgcggcgcccuc

SEQ ID NO: 2889578 - RNA, 21 nt, Mycobacterium avium subsp. paratuberculosis
gcgccgcggcgcccucgccgg

SEQ ID NO: 2889579 - RNA, 22 nt, Mycobacterium avium subsp. paratuberculosis
gcgccgcggcgcccucgccggc

SEQ ID NO: 2889580 - RNA, 21 nt, Mycobacterium avium subsp. paratuberculosis
gcgccgcggcgccgccacggc

SEQ ID NO: 2889581 - RNA, 16 nt, Mycobacterium avium subsp. paratuberculosis
gcgccgcggcgcuuga

SEQ ID NO: 2889582 - RNA, 13 nt, Mycobacterium avium subsp. paratuberculosis
gcgccgcggcggc

SEQ ID NO: 2889583 - RNA, 16 nt, Mycobacterium avium subsp. paratuberculosis
gcgccgcggcggcucg

SEQ ID NO: 2889584 - RNA, 17 nt, Mycobacterium avium subsp. paratuberculosis
gcgccgcgggcgccgua

SEQ ID NO: 2889585 - RNA, 20 nt, Mycobacterium avium subsp. paratuberculosis
gcgccgcgggcggucgcgca

SEQ ID NO: 2889586 - RNA, 12 nt, Mycobacterium avium subsp. paratuberculosis
gcgccgcggggc

SEQ ID NO: 2889587 - RNA, 13 nt, Mycobacterium avium subsp. paratuberculosis
gcgccgcggguga

SEQ ID NO: 2889588 - RNA, 19 nt, Mycobacterium avium subsp. paratuberculosis
gcgccgcgggugcggcacg

SEQ ID NO: 2889589 - RNA, 18 nt, Mycobacterium avium subsp. paratuberculosis
gcgccgcgguagcggacc

SEQ ID NO: 2889590 - RNA, 17 nt, Mycobacterium avium subsp. paratuberculosis
gcgccgcguaccagcgc

SEQ ID NO: 2889591 - RNA, 18 nt, Mycobacterium avium subsp. paratuberculosis
gcgccgcguaccagcgcc

SEQ ID NO: 2889592 - RNA, 19 nt, Mycobacterium avium subsp. paratuberculosis
gcgccgcguaccagcgcca

SEQ ID NO: 2889593 - RNA, 20 nt, Mycobacterium avium subsp. paratuberculosis
gcgccgcguaccagcgccac

SEQ ID NO: 2889594 - RNA, 21 nt, Mycobacterium avium subsp. paratuberculosis
gcgccgcguaccagcgccacg

SEQ ID NO: 2889595 - RNA, 22 nt, Mycobacterium avium subsp. paratuberculosis
gcgccgcguaggucuucgguga

SEQ ID NO: 2889596 - RNA, 16 nt, Mycobacterium avium subsp. paratuberculosis
gcgccgcgucgacgcc

SEQ ID NO: 2889597 - RNA, 17 nt, Mycobacterium avium subsp. paratuberculosis
gcgccgcgucgacgccg

SEQ ID NO: 2889598 - RNA, 18 nt, Mycobacterium avium subsp. paratuberculosis
gcgccgcgucgcgccgcc

SEQ ID NO: 2889599 - RNA, 20 nt, Mycobacterium avium subsp. paratuberculosis
gcgccgcgucggaccccgau

SEQ ID NO: 2889600 - RNA, 14 nt, Mycobacterium avium subsp. paratuberculosis
gcgccgcgucgucg

SEQ ID NO: 2889601 - RNA, 15 nt, Mycobacterium avium subsp. paratuberculosis
gcgccgcgucgucgu

SEQ ID NO: 2889602 - RNA, 18 nt, Mycobacterium avium subsp. paratuberculosis
gcgccgcgucgucgucga

SEQ ID NO: 2889603 - RNA, 18 nt, Mycobacterium avium subsp. paratuberculosis
gcgccgcguucacccgcg

SEQ ID NO: 2889604 - RNA, 14 nt, Mycobacterium avium subsp. paratuberculosis
gcgccgcguucggc

SEQ ID NO: 2889605 - RNA, 17 nt, Mycobacterium avium subsp. paratuberculosis
gcgccgcguucggcggc

SEQ ID NO: 2889606 - RNA, 19 nt, Mycobacterium avium subsp. paratuberculosis
gcgccgcguucggcggcgc

SEQ ID NO: 2889607 - RNA, 14 nt, Mycobacterium avium subsp. paratuberculosis
gcgccgcucgaccc

SEQ ID NO: 2889608 - RNA, 19 nt, Mycobacterium avium subsp. paratuberculosis
gcgccgcucgaccccucgg

SEQ ID NO: 2889609 - RNA, 22 nt, Mycobacterium avium subsp. paratuberculosis
gcgccgcucggaguucgcccgc

SEQ ID NO: 2889610 - RNA, 13 nt, Mycobacterium avium subsp. paratuberculosis
gcgccgcucggcc

SEQ ID NO: 2889611 - RNA, 16 nt, Mycobacterium avium subsp. paratuberculosis
gcgccgcucggccagc

SEQ ID NO: 2889612 - RNA, 19 nt, Mycobacterium avium subsp. paratuberculosis
gcgccgcucggccagcagc

SEQ ID NO: 2889613 - RNA, 14 nt, Mycobacterium avium subsp. paratuberculosis
gcgccgcucggccg

SEQ ID NO: 2889614 - RNA, 14 nt, Mycobacterium avium subsp. paratuberculosis
gcgccgcucgucgg

SEQ ID NO: 2889615 - RNA, 19 nt, Mycobacterium avium subsp. paratuberculosis
gcgccgcucgucggccagc

SEQ ID NO: 2889616 - RNA, 22 nt, Mycobacterium avium subsp. paratuberculosis
gcgccgcucgucggccagcgag

SEQ ID NO: 2889617 - RNA, 16 nt, Mycobacterium avium subsp. paratuberculosis
gcgccgcugacugcga

SEQ ID NO: 2889618 - RNA, 22 nt, Mycobacterium avium subsp. paratuberculosis
gcgccgcugacugcgaucgccg

SEQ ID NO: 2889619 - RNA, 14 nt, Mycobacterium avium subsp. paratuberculosis
gcgccgcugcgggc

SEQ ID NO: 2889620 - RNA, 19 nt, Mycobacterium avium subsp. paratuberculosis
gcgccgcugcgggccaucg

SEQ ID NO: 2889621 - RNA, 19 nt, Mycobacterium avium subsp. paratuberculosis
gcgccggaccgauccggcg

SEQ ID NO: 2889622 - RNA, 21 nt, Mycobacterium avium subsp. paratuberculosis
gcgccggaccgauccggcgcc

SEQ ID NO: 2889623 - RNA, 17 nt, Mycobacterium avium subsp. paratuberculosis
gcgccggacggcccgca

SEQ ID NO: 2889624 - RNA, 21 nt, Mycobacterium avium subsp. paratuberculosis
gcgccggacucgaagaucgcc

SEQ ID NO: 2889625 - RNA, 17 nt, Mycobacterium avium subsp. paratuberculosis
gcgccggaggccagcuc

SEQ ID NO: 2889626 - RNA, 18 nt, Mycobacterium avium subsp. paratuberculosis
gcgccggaggccagcucg

SEQ ID NO: 2889627 - RNA, 19 nt, Mycobacterium avium subsp. paratuberculosis
gcgccggaggccagcucga

SEQ ID NO: 2889628 - RNA, 22 nt, Mycobacterium avium subsp. paratuberculosis
gcgccggaggccagcucgaccg

SEQ ID NO: 2889629 - RNA, 17 nt, Mycobacterium avium subsp. paratuberculosis
gcgccggaggggcgacg

SEQ ID NO: 2889630 - RNA, 22 nt, Mycobacterium avium subsp. paratuberculosis
gcgccggaggggcgacgggccg

SEQ ID NO: 2889631 - RNA, 14 nt, Mycobacterium avium subsp. paratuberculosis
gcgccggaucggcc

SEQ ID NO: 2889632 - RNA, 18 nt, Mycobacterium avium subsp. paratuberculosis
gcgccggaucggcccccg

SEQ ID NO: 2889633 - RNA, 22 nt, Mycobacterium avium subsp. paratuberculosis
gcgccggaucggcccccgggcc

SEQ ID NO: 2889634 - RNA, 17 nt, Mycobacterium avium subsp. paratuberculosis
gcgccggaugcugcgca

SEQ ID NO: 2889635 - RNA, 18 nt, Mycobacterium avium subsp. paratuberculosis
gcgccggaugggcgcacg

SEQ ID NO: 2889636 - RNA, 16 nt, Mycobacterium avium subsp. paratuberculosis
gcgccggaugguccgc

SEQ ID NO: 2889637 - RNA, 20 nt, Mycobacterium avium subsp. paratuberculosis
gcgccggauucggcgcggcu

SEQ ID NO: 2889638 - RNA, 16 nt, Mycobacterium avium subsp. paratuberculosis
gcgccggauugucgcu

SEQ ID NO: 2889639 - RNA, 18 nt, Mycobacterium avium subsp. paratuberculosis
gcgccggauugucgcugu

SEQ ID NO: 2889640 - RNA, 17 nt, Mycobacterium avium subsp. paratuberculosis
gcgccggcaacuggccg

SEQ ID NO: 2889641 - RNA, 19 nt, Mycobacterium avium subsp. paratuberculosis
gcgccggcaacuggccgcc

SEQ ID NO: 2889642 - RNA, 15 nt, Mycobacterium avium subsp. paratuberculosis
gcgccggcaccagca

SEQ ID NO: 2889643 - RNA, 16 nt, Mycobacterium avium subsp. paratuberculosis
gcgccggcaccagcag

SEQ ID NO: 2889644 - RNA, 20 nt, Mycobacterium avium subsp. paratuberculosis
gcgccggcaccagcagccgc

SEQ ID NO: 2889645 - RNA, 19 nt, Mycobacterium avium subsp. paratuberculosis
gcgccggcacucgucgugg

SEQ ID NO: 2889646 - RNA, 20 nt, Mycobacterium avium subsp. paratuberculosis
gcgccggcacugcugcccgc

SEQ ID NO: 2889647 - RNA, 22 nt, Mycobacterium avium subsp. paratuberculosis
gcgccggcacugcugcccgcga

SEQ ID NO: 2889648 - RNA, 21 nt, Mycobacterium avium subsp. paratuberculosis
gcgccggcagauugguucggc

SEQ ID NO: 2889649 - RNA, 23 nt, Mycobacterium avium subsp. paratuberculosis
gcgccggcagauugguucggccg

SEQ ID NO: 2889650 - RNA, 18 nt, Mycobacterium avium subsp. paratuberculosis
gcgccggcagcaaccggc

SEQ ID NO: 2889651 - RNA, 21 nt, Mycobacterium avium subsp. paratuberculosis
gcgccggcagcaaccggcggc

SEQ ID NO: 2889652 - RNA, 15 nt, Mycobacterium avium subsp. paratuberculosis
gcgccggcagcgccu

SEQ ID NO: 2889653 - RNA, 21 nt, Mycobacterium avium subsp. paratuberculosis
gcgccggcagcgccucccgga

SEQ ID NO: 2889654 - RNA, 14 nt, Mycobacterium avium subsp. paratuberculosis
gcgccggcagcggc

SEQ ID NO: 2889655 - RNA, 12 nt, Mycobacterium avium subsp. paratuberculosis
gcgccggcaucc

SEQ ID NO: 2889656 - RNA, 19 nt, Mycobacterium avium subsp. paratuberculosis
gcgccggcauccagcacgg

SEQ ID NO: 2889657 - RNA, 20 nt, Mycobacterium avium subsp. paratuberculosis
gcgccggcauccagcacggc

SEQ ID NO: 2889658 - RNA, 14 nt, Mycobacterium avium subsp. paratuberculosis
gcgccggccagcac

SEQ ID NO: 2889659 - RNA, 15 nt, Mycobacterium avium subsp. paratuberculosis
gcgccggccagcacc

SEQ ID NO: 2889660 - RNA, 18 nt, Mycobacterium avium subsp. paratuberculosis
gcgccggccagcaccacg

SEQ ID NO: 2889661 - RNA, 22 nt, Mycobacterium avium subsp. paratuberculosis
gcgccggccagcaccacgguga

SEQ ID NO: 2889662 - RNA, 17 nt, Mycobacterium avium subsp. paratuberculosis
gcgccggccagcacggc

SEQ ID NO: 2889663 - RNA, 19 nt, Mycobacterium avium subsp. paratuberculosis
gcgccggccagcacggcgg

SEQ ID NO: 2889664 - RNA, 20 nt, Mycobacterium avium subsp. paratuberculosis
gcgccggccagcacggcggc

SEQ ID NO: 2889665 - RNA, 16 nt, Mycobacterium avium subsp. paratuberculosis
gcgccggccagcagca

SEQ ID NO: 2889666 - RNA, 17 nt, Mycobacterium avium subsp. paratuberculosis
gcgccggccagcagcag

SEQ ID NO: 2889667 - RNA, 19 nt, Mycobacterium avium subsp. paratuberculosis
gcgccggccagcagcaggu

SEQ ID NO: 2889668 - RNA, 14 nt, Mycobacterium avium subsp. paratuberculosis
gcgccggccagccg

SEQ ID NO: 2889669 - RNA, 15 nt, Mycobacterium avium subsp. paratuberculosis
gcgccggccagccgg

SEQ ID NO: 2889670 - RNA, 16 nt, Mycobacterium avium subsp. paratuberculosis
gcgccggccagccggc

SEQ ID NO: 2889671 - RNA, 14 nt, Mycobacterium avium subsp. paratuberculosis
gcgccggccagcgg

SEQ ID NO: 2889672 - RNA, 15 nt, Mycobacterium avium subsp. paratuberculosis
gcgccggccagcggc

SEQ ID NO: 2889673 - RNA, 18 nt, Mycobacterium avium subsp. paratuberculosis
gcgccggccagcggcuug

SEQ ID NO: 2889674 - RNA, 20 nt, Mycobacterium avium subsp. paratuberculosis
gcgccggccagcggcuuggc

SEQ ID NO: 2889675 - RNA, 22 nt, Mycobacterium avium subsp. paratuberculosis
gcgccggccagcggcuuggccg

SEQ ID NO: 2889676 - RNA, 22 nt, Mycobacterium avium subsp. paratuberculosis
gcgccggcccgauaggccgacu

SEQ ID NO: 2889677 - RNA, 14 nt, Mycobacterium avium subsp. paratuberculosis
gcgccggcccgcgg

SEQ ID NO: 2889678 - RNA, 15 nt, Mycobacterium avium subsp. paratuberculosis
gcgccggcccgcggc

SEQ ID NO: 2889679 - RNA, 17 nt, Mycobacterium avium subsp. paratuberculosis
gcgccggcccgcggcgg

SEQ ID NO: 2889680 - RNA, 12 nt, Mycobacterium avium subsp. paratuberculosis
gcgccggccgcc

SEQ ID NO: 2889681 - RNA, 13 nt, Mycobacterium avium subsp. paratuberculosis
gcgccggccgccg

SEQ ID NO: 2889682 - RNA, 17 nt, Mycobacterium avium subsp. paratuberculosis
gcgccggccgccgcgau

SEQ ID NO: 2889683 - RNA, 15 nt, Mycobacterium avium subsp. paratuberculosis
gcgccggccggagcg

SEQ ID NO: 2889684 - RNA, 17 nt, Mycobacterium avium subsp. paratuberculosis
gcgccggccggagcgga

SEQ ID NO: 2889685 - RNA, 13 nt, Mycobacterium avium subsp. paratuberculosis
gcgccggccggca

SEQ ID NO: 2889686 - RNA, 15 nt, Mycobacterium avium subsp. paratuberculosis
gcgccggccggcgcg

SEQ ID NO: 2889687 - RNA, 20 nt, Mycobacterium avium subsp. paratuberculosis
gcgccggccggcgcgugcgc

SEQ ID NO: 2889688 - RNA, 20 nt, Mycobacterium avium subsp. paratuberculosis
gcgccggccggcggucaggc

SEQ ID NO: 2889689 - RNA, 12 nt, Mycobacterium avium subsp. paratuberculosis
gcgccggccggg

SEQ ID NO: 2889690 - RNA, 15 nt, Mycobacterium avium subsp. paratuberculosis
gcgccggccgggcug

SEQ ID NO: 2889691 - RNA, 22 nt, Mycobacterium avium subsp. paratuberculosis
gcgccggcgauaggcggccagc

SEQ ID NO: 2889692 - RNA, 12 nt, Mycobacterium avium subsp. paratuberculosis
gcgccggcgaug

SEQ ID NO: 2889693 - RNA, 13 nt, Mycobacterium avium subsp. paratuberculosis
gcgccggcgauga

SEQ ID NO: 2889694 - RNA, 20 nt, Mycobacterium avium subsp. paratuberculosis
gcgccggcgcagcggcccga

SEQ ID NO: 2889695 - RNA, 13 nt, Mycobacterium avium subsp. paratuberculosis
gcgccggcgcgca

SEQ ID NO: 2889696 - RNA, 20 nt, Mycobacterium avium subsp. paratuberculosis
gcgccggcgcgcaacagcgu

SEQ ID NO: 2889697 - RNA, 15 nt, Mycobacterium avium subsp. paratuberculosis
gcgccggcgcgcagc

SEQ ID NO: 2889698 - RNA, 16 nt, Mycobacterium avium subsp. paratuberculosis
gcgccggcgcgcagcc

SEQ ID NO: 2889699 - RNA, 17 nt, Mycobacterium avium subsp. paratuberculosis
gcgccggcgcgcgagcg

SEQ ID NO: 2889700 - RNA, 19 nt, Mycobacterium avium subsp. paratuberculosis
gcgccggcgcgcgagcguc

SEQ ID NO: 2889701 - RNA, 21 nt, Mycobacterium avium subsp. paratuberculosis
gcgccggcgcgcgagcgucac

SEQ ID NO: 2889702 - RNA, 13 nt, Mycobacterium avium subsp. paratuberculosis
gcgccggcgcggc

SEQ ID NO: 2889703 - RNA, 15 nt, Mycobacterium avium subsp. paratuberculosis
gcgccggcgcggcca

SEQ ID NO: 2889704 - RNA, 19 nt, Mycobacterium avium subsp. paratuberculosis
gcgccggcgcggccagcug

SEQ ID NO: 2889705 - RNA, 14 nt, Mycobacterium avium subsp. paratuberculosis
gcgccggcgcgggc

SEQ ID NO: 2889706 - RNA, 16 nt, Mycobacterium avium subsp. paratuberculosis
gcgccggcgcgggcau

SEQ ID NO: 2889707 - RNA, 18 nt, Mycobacterium avium subsp. paratuberculosis
gcgccggcgcgggcauga

SEQ ID NO: 2889708 - RNA, 23 nt, Mycobacterium avium subsp. paratuberculosis
gcgccggcgcgggggcggccuga

SEQ ID NO: 2889709 - RNA, 14 nt, Mycobacterium avium subsp. paratuberculosis
gcgccggcgcgucc

SEQ ID NO: 2889710 - RNA, 18 nt, Mycobacterium avium subsp. paratuberculosis
gcgccggcgcguccggag

SEQ ID NO: 2889711 - RNA, 13 nt, Mycobacterium avium subsp. paratuberculosis
gcgccggcggcca

SEQ ID NO: 2889712 - RNA, 13 nt, Mycobacterium avium subsp. paratuberculosis
gcgccggcggccg

SEQ ID NO: 2889713 - RNA, 15 nt, Mycobacterium avium subsp. paratuberculosis
gcgccggcggccgcc

SEQ ID NO: 2889714 - RNA, 18 nt, Mycobacterium avium subsp. paratuberculosis
gcgccggcggccgcgacg

SEQ ID NO: 2889715 - RNA, 19 nt, Mycobacterium avium subsp. paratuberculosis
gcgccggcggccgcgacgg

SEQ ID NO: 2889716 - RNA, 15 nt, Mycobacterium avium subsp. paratuberculosis
gcgccggcggcggcg

SEQ ID NO: 2889717 - RNA, 20 nt, Mycobacterium avium subsp. paratuberculosis
gcgccggcgggugagccggu

SEQ ID NO: 2889718 - RNA, 21 nt, Mycobacterium avium subsp. paratuberculosis
gcgccggcgguaugcccgggc

SEQ ID NO: 2889719 - RNA, 15 nt, Mycobacterium avium subsp. paratuberculosis
gcgccggcggucgac

SEQ ID NO: 2889720 - RNA, 18 nt, Mycobacterium avium subsp. paratuberculosis
gcgccggcggucgacacg

SEQ ID NO: 2889721 - RNA, 12 nt, Mycobacterium avium subsp. paratuberculosis
gcgccggcggug

SEQ ID NO: 2889722 - RNA, 18 nt, Mycobacterium avium subsp. paratuberculosis
gcgccggcggugcggcgg

SEQ ID NO: 2889723 - RNA, 15 nt, Mycobacterium avium subsp. paratuberculosis
gcgccggcggugucg

SEQ ID NO: 2889724 - RNA, 11 nt, Mycobacterium avium subsp. paratuberculosis
gcgccggcguc

SEQ ID NO: 2889725 - RNA, 19 nt, Mycobacterium avium subsp. paratuberculosis
gcgccggcguccagcgccg

SEQ ID NO: 2889726 - RNA, 19 nt, Mycobacterium avium subsp. paratuberculosis
gcgccggcuccaccgcgcc

SEQ ID NO: 2889727 - RNA, 22 nt, Mycobacterium avium subsp. paratuberculosis
gcgccggcuccaccgcgccggc

SEQ ID NO: 2889728 - RNA, 14 nt, Mycobacterium avium subsp. paratuberculosis
gcgccggcuccgca

SEQ ID NO: 2889729 - RNA, 13 nt, Mycobacterium avium subsp. paratuberculosis
gcgccggcugccc

SEQ ID NO: 2889730 - RNA, 23 nt, Mycobacterium avium subsp. paratuberculosis
gcgccgggaaaguuguagcgcag

SEQ ID NO: 2889731 - RNA, 23 nt, Mycobacterium avium subsp. paratuberculosis
gcgccgggaucacacgcgcgccc

SEQ ID NO: 2889732 - RNA, 16 nt, Mycobacterium avium subsp. paratuberculosis
gcgccgggaucggcag

SEQ ID NO: 2889733 - RNA, 17 nt, Mycobacterium avium subsp. paratuberculosis
gcgccgggaucggcagc

SEQ ID NO: 2889734 - RNA, 19 nt, Mycobacterium avium subsp. paratuberculosis
gcgccgggaucggcagcgc

SEQ ID NO: 2889735 - RNA, 17 nt, Mycobacterium avium subsp. paratuberculosis
gcgccgggcaacagcgc

SEQ ID NO: 2889736 - RNA, 23 nt, Mycobacterium avium subsp. paratuberculosis
gcgccgggcaacagcgcgccggc

SEQ ID NO: 2889737 - RNA, 22 nt, Mycobacterium avium subsp. paratuberculosis
gcgccgggcaccaccaccgaca

SEQ ID NO: 2889738 - RNA, 15 nt, Mycobacterium avium subsp. paratuberculosis
gcgccgggcagcccg

SEQ ID NO: 2889739 - RNA, 19 nt, Mycobacterium avium subsp. paratuberculosis
gcgccgggcagcccgccgc

SEQ ID NO: 2889740 - RNA, 23 nt, Mycobacterium avium subsp. paratuberculosis
gcgccgggcagcccgccgcggau

SEQ ID NO: 2889741 - RNA, 18 nt, Mycobacterium avium subsp. paratuberculosis
gcgccgggcagcccgggu

SEQ ID NO: 2889742 - RNA, 14 nt, Mycobacterium avium subsp. paratuberculosis
gcgccgggcccggu

SEQ ID NO: 2889743 - RNA, 16 nt, Mycobacterium avium subsp. paratuberculosis
gcgccgggcccggucc

SEQ ID NO: 2889744 - RNA, 19 nt, Mycobacterium avium subsp. paratuberculosis
gcgccgggcgaagucgccg

SEQ ID NO: 2889745 - RNA, 21 nt, Mycobacterium avium subsp. paratuberculosis
gcgccgggcgaagucgccggc

SEQ ID NO: 2889746 - RNA, 13 nt, Mycobacterium avium subsp. paratuberculosis
gcgccgggcgccc

SEQ ID NO: 2889747 - RNA, 21 nt, Mycobacterium avium subsp. paratuberculosis
gcgccgggcgcccgagccgca

SEQ ID NO: 2889748 - RNA, 13 nt, Mycobacterium avium subsp. paratuberculosis
gcgccgggcggcc

SEQ ID NO: 2889749 - RNA, 16 nt, Mycobacterium avium subsp. paratuberculosis
gcgccgggcggcccgc

SEQ ID NO: 2889750 - RNA, 17 nt, Mycobacterium avium subsp. paratuberculosis
gcgccgggcggcccgcc

SEQ ID NO: 2889751 - RNA, 20 nt, Mycobacterium avium subsp. paratuberculosis
gcgccgggcggccucggcgu

SEQ ID NO: 2889752 - RNA, 20 nt, Mycobacterium avium subsp. paratuberculosis
gcgccgggguccucucggcg

SEQ ID NO: 2889753 - RNA, 22 nt, Mycobacterium avium subsp. paratuberculosis
gcgccgggguccucucggcgcc

SEQ ID NO: 2889754 - RNA, 14 nt, Mycobacterium avium subsp. paratuberculosis
gcgccggggugggc

SEQ ID NO: 2889755 - RNA, 22 nt, Mycobacterium avium subsp. paratuberculosis
gcgccgggucauccccgugcgg

SEQ ID NO: 2889756 - RNA, 14 nt, Mycobacterium avium subsp. paratuberculosis
gcgccggguccagc

SEQ ID NO: 2889757 - RNA, 15 nt, Mycobacterium avium subsp. paratuberculosis
gcgccggguccagcc

SEQ ID NO: 2889758 - RNA, 16 nt, Mycobacterium avium subsp. paratuberculosis
gcgccggguccagccg

SEQ ID NO: 2889759 - RNA, 11 nt, Mycobacterium avium subsp. paratuberculosis
gcgccgggucg

SEQ ID NO: 2889760 - RNA, 17 nt, Mycobacterium avium subsp. paratuberculosis
gcgccgggucgcggugg

SEQ ID NO: 2889761 - RNA, 12 nt, Mycobacterium avium subsp. paratuberculosis
gcgccggguggc

SEQ ID NO: 2889762 - RNA, 18 nt, Mycobacterium avium subsp. paratuberculosis
gcgccggguggccggggc

SEQ ID NO: 2889763 - RNA, 20 nt, Mycobacterium avium subsp. paratuberculosis
gcgccggguggccggggcca

SEQ ID NO: 2889764 - RNA, 22 nt, Mycobacterium avium subsp. paratuberculosis
gcgccggguugcaggcgcccag

SEQ ID NO: 2889765 - RNA, 21 nt, Mycobacterium avium subsp. paratuberculosis
gcgccgguaaugggcgaucga

SEQ ID NO: 2889766 - RNA, 18 nt, Mycobacterium avium subsp. paratuberculosis
gcgccgguagagcgccag

SEQ ID NO: 2889767 - RNA, 15 nt, Mycobacterium avium subsp. paratuberculosis
gcgccgguagcgaca

SEQ ID NO: 2889768 - RNA, 14 nt, Mycobacterium avium subsp. paratuberculosis
gcgccgguaggcgc

SEQ ID NO: 2889769 - RNA, 18 nt, Mycobacterium avium subsp. paratuberculosis
gcgccgguaggcgcgggu

SEQ ID NO: 2889770 - RNA, 20 nt, Mycobacterium avium subsp. paratuberculosis
gcgccgguaggcgcggguga

SEQ ID NO: 2889771 - RNA, 17 nt, Mycobacterium avium subsp. paratuberculosis
gcgccgguaggcggcca

SEQ ID NO: 2889772 - RNA, 18 nt, Mycobacterium avium subsp. paratuberculosis
gcgccgguaggcggccag

SEQ ID NO: 2889773 - RNA, 23 nt, Mycobacterium avium subsp. paratuberculosis
gcgccgguaggcggccagcgccc

SEQ ID NO: 2889774 - RNA, 19 nt, Mycobacterium avium subsp. paratuberculosis
gcgccgguauauucgcgau

SEQ ID NO: 2889775 - RNA, 16 nt, Mycobacterium avium subsp. paratuberculosis
gcgccgguaucgagca

SEQ ID NO: 2889776 - RNA, 21 nt, Mycobacterium avium subsp. paratuberculosis
gcgccgguaucgagcaccagc

SEQ ID NO: 2889777 - RNA, 18 nt, Mycobacterium avium subsp. paratuberculosis
gcgccggucagaccccgu

SEQ ID NO: 2889778 - RNA, 21 nt, Mycobacterium avium subsp. paratuberculosis
gcgccggucagcggcaacacg

SEQ ID NO: 2889779 - RNA, 15 nt, Mycobacterium avium subsp. paratuberculosis
gcgccggucccgcgg

SEQ ID NO: 2889780 - RNA, 16 nt, Mycobacterium avium subsp. paratuberculosis
gcgccggucccgcggc

SEQ ID NO: 2889781 - RNA, 18 nt, Mycobacterium avium subsp. paratuberculosis
gcgccggucccgcggcgg

SEQ ID NO: 2889782 - RNA, 19 nt, Mycobacterium avium subsp. paratuberculosis
gcgccggucccgcggcggc

SEQ ID NO: 2889783 - RNA, 22 nt, Mycobacterium avium subsp. paratuberculosis
gcgccggucccgcggcggcgcc

SEQ ID NO: 2889784 - RNA, 13 nt, Mycobacterium avium subsp. paratuberculosis
gcgccggucggcg

SEQ ID NO: 2889785 - RNA, 14 nt, Mycobacterium avium subsp. paratuberculosis
gcgccggucggcgg

SEQ ID NO: 2889786 - RNA, 21 nt, Mycobacterium avium subsp. paratuberculosis
gcgccggucguagcgucgggg

SEQ ID NO: 2889787 - RNA, 16 nt, Mycobacterium avium subsp. paratuberculosis
gcgccggugaagcggg

SEQ ID NO: 2889788 - RNA, 16 nt, Mycobacterium avium subsp. paratuberculosis
gcgccggugaccccgu

SEQ ID NO: 2889789 - RNA, 22 nt, Mycobacterium avium subsp. paratuberculosis
gcgccggugaccccgucgaacg

SEQ ID NO: 2889790 - RNA, 16 nt, Mycobacterium avium subsp. paratuberculosis
gcgccggugcccacgc

SEQ ID NO: 2889791 - RNA, 14 nt, Mycobacterium avium subsp. paratuberculosis
gcgccggugccgca

SEQ ID NO: 2889792 - RNA, 16 nt, Mycobacterium avium subsp. paratuberculosis
gcgccggugccgcagc

SEQ ID NO: 2889793 - RNA, 18 nt, Mycobacterium avium subsp. paratuberculosis
gcgccggugccgcagccg

SEQ ID NO: 2889794 - RNA, 15 nt, Mycobacterium avium subsp. paratuberculosis
gcgccgguguucggc

SEQ ID NO: 2889795 - RNA, 19 nt, Mycobacterium avium subsp. paratuberculosis
gcgccgguguucggcgcca

SEQ ID NO: 2889796 - RNA, 20 nt, Mycobacterium avium subsp. paratuberculosis
gcgccgguguucggcgccag

SEQ ID NO: 2889797 - RNA, 21 nt, Mycobacterium avium subsp. paratuberculosis
gcgccgguguucggcgccagc

SEQ ID NO: 2889798 - RNA, 22 nt, Mycobacterium avium subsp. paratuberculosis
gcgccgguguucggcgccagcc

SEQ ID NO: 2889799 - RNA, 24 nt, Mycobacterium avium subsp. paratuberculosis
gcgccgguguucggcgccagccgc

SEQ ID NO: 2889800 - RNA, 13 nt, Mycobacterium avium subsp. paratuberculosis
gcgccgguucgcu

SEQ ID NO: 2889801 - RNA, 19 nt, Mycobacterium avium subsp. paratuberculosis
gcgccgguucgcuggcggc

SEQ ID NO: 2889802 - RNA, 22 nt, Mycobacterium avium subsp. paratuberculosis
gcgccgguucgcuggcggccag

SEQ ID NO: 2889803 - RNA, 17 nt, Mycobacterium avium subsp. paratuberculosis
gcgccgguuuccaggac

SEQ ID NO: 2889804 - RNA, 18 nt, Mycobacterium avium subsp. paratuberculosis
gcgccgguuuccaggacg

SEQ ID NO: 2889805 - RNA, 17 nt, Mycobacterium avium subsp. paratuberculosis
gcgccgguuuucggcgu

SEQ ID NO: 2889806 - RNA, 16 nt, Mycobacterium avium subsp. paratuberculosis
gcgccguagcggccca

SEQ ID NO: 2889807 - RNA, 17 nt, Mycobacterium avium subsp. paratuberculosis
gcgccguagcggcccag

SEQ ID NO: 2889808 - RNA, 14 nt, Mycobacterium avium subsp. paratuberculosis
gcgccguaggccgc

SEQ ID NO: 2889809 - RNA, 15 nt, Mycobacterium avium subsp. paratuberculosis
gcgccguaggccgcg

SEQ ID NO: 2889810 - RNA, 16 nt, Mycobacterium avium subsp. paratuberculosis
gcgccguaggccgcgc

SEQ ID NO: 2889811 - RNA, 19 nt, Mycobacterium avium subsp. paratuberculosis
gcgccguauuggcaggcga

SEQ ID NO: 2889812 - RNA, 14 nt, Mycobacterium avium subsp. paratuberculosis
gcgccgucaccggc

SEQ ID NO: 2889813 - RNA, 15 nt, Mycobacterium avium subsp. paratuberculosis
gcgccgucaccggcu

SEQ ID NO: 2889814 - RNA, 17 nt, Mycobacterium avium subsp. paratuberculosis
gcgccgucaccggcugc

SEQ ID NO: 2889815 - RNA, 18 nt, Mycobacterium avium subsp. paratuberculosis
gcgccgucaucaccgccg

SEQ ID NO: 2889816 - RNA, 21 nt, Mycobacterium avium subsp. paratuberculosis
gcgccgucaucaccgccgagg

SEQ ID NO: 2889817 - RNA, 16 nt, Mycobacterium avium subsp. paratuberculosis
gcgccgucaucgacac

SEQ ID NO: 2889818 - RNA, 18 nt, Mycobacterium avium subsp. paratuberculosis
gcgccgucaucgacaccg

SEQ ID NO: 2889819 - RNA, 13 nt, Mycobacterium avium subsp. paratuberculosis
gcgccgucccagc

SEQ ID NO: 2889820 - RNA, 14 nt, Mycobacterium avium subsp. paratuberculosis
gcgccgucccagcc

SEQ ID NO: 2889821 - RNA, 15 nt, Mycobacterium avium subsp. paratuberculosis
gcgccgucccagccg

SEQ ID NO: 2889822 - RNA, 17 nt, Mycobacterium avium subsp. paratuberculosis
gcgccgucccagccgga

SEQ ID NO: 2889823 - RNA, 19 nt, Mycobacterium avium subsp. paratuberculosis
gcgccgucccagccggaca

SEQ ID NO: 2889824 - RNA, 14 nt, Mycobacterium avium subsp. paratuberculosis
gcgccguccgcacc

SEQ ID NO: 2889825 - RNA, 16 nt, Mycobacterium avium subsp. paratuberculosis
gcgccguccgcaccgc

SEQ ID NO: 2889826 - RNA, 21 nt, Mycobacterium avium subsp. paratuberculosis
gcgccguccgcaccgcgacga

SEQ ID NO: 2889827 - RNA, 14 nt, Mycobacterium avium subsp. paratuberculosis
gcgccguccgcggc

SEQ ID NO: 2889828 - RNA, 18 nt, Mycobacterium avium subsp. paratuberculosis
gcgccguccggccacgac

SEQ ID NO: 2889829 - RNA, 21 nt, Mycobacterium avium subsp. paratuberculosis
gcgccguccggccacgaccuc

SEQ ID NO: 2889830 - RNA, 21 nt, Mycobacterium avium subsp. paratuberculosis
gcgccguccuccucgucggcu

SEQ ID NO: 2889831 - RNA, 14 nt, Mycobacterium avium subsp. paratuberculosis
gcgccgucgaacac

SEQ ID NO: 2889832 - RNA, 18 nt, Mycobacterium avium subsp. paratuberculosis
gcgccgucgaacacguug

SEQ ID NO: 2889833 - RNA, 22 nt, Mycobacterium avium subsp. paratuberculosis
gcgccgucgaacacguugcgca

SEQ ID NO: 2889834 - RNA, 18 nt, Mycobacterium avium subsp. paratuberculosis
gcgccgucgaccagcuug

SEQ ID NO: 2889835 - RNA, 13 nt, Mycobacterium avium subsp. paratuberculosis
gcgccgucgaucc

SEQ ID NO: 2889836 - RNA, 22 nt, Mycobacterium avium subsp. paratuberculosis
gcgccgucgauccacccaccgg

SEQ ID NO: 2889837 - RNA, 23 nt, Mycobacterium avium subsp. paratuberculosis
gcgccgucgauccacccaccggc

SEQ ID NO: 2889838 - RNA, 18 nt, Mycobacterium avium subsp. paratuberculosis
gcgccgucgauggcgcgg

SEQ ID NO: 2889839 - RNA, 22 nt, Mycobacterium avium subsp. paratuberculosis
gcgccgucgauggcgcggccca

SEQ ID NO: 2889840 - RNA, 13 nt, Mycobacterium avium subsp. paratuberculosis
gcgccgucgccga

SEQ ID NO: 2889841 - RNA, 18 nt, Mycobacterium avium subsp. paratuberculosis
gcgccgucgccgacguug

SEQ ID NO: 2889842 - RNA, 24 nt, Mycobacterium avium subsp. paratuberculosis
gcgccgucgccggacucgaucgcc

SEQ ID NO: 2889843 - RNA, 16 nt, Mycobacterium avium subsp. paratuberculosis
gcgccgucggcccacg

SEQ ID NO: 2889844 - RNA, 12 nt, Mycobacterium avium subsp. paratuberculosis
gcgccgucggcg

SEQ ID NO: 2889845 - RNA, 23 nt, Mycobacterium avium subsp. paratuberculosis
gcgccgucggcgaugcggugguc

SEQ ID NO: 2889846 - RNA, 13 nt, Mycobacterium avium subsp. paratuberculosis
gcgccgucggcgg

SEQ ID NO: 2889847 - RNA, 13 nt, Mycobacterium avium subsp. paratuberculosis
gcgccgucggcgu

SEQ ID NO: 2889848 - RNA, 20 nt, Mycobacterium avium subsp. paratuberculosis
gcgccgucggcguucagcgg

SEQ ID NO: 2889849 - RNA, 22 nt, Mycobacterium avium subsp. paratuberculosis
gcgccgucggcguucagcggca

SEQ ID NO: 2889850 - RNA, 22 nt, Mycobacterium avium subsp. paratuberculosis
gcgccgucggggcugaguucgg

SEQ ID NO: 2889851 - RNA, 22 nt, Mycobacterium avium subsp. paratuberculosis
gcgccgucggugggggccaggc

SEQ ID NO: 2889852 - RNA, 23 nt, Mycobacterium avium subsp. paratuberculosis
gcgccgucggugggggccaggcg

SEQ ID NO: 2889853 - RNA, 20 nt, Mycobacterium avium subsp. paratuberculosis
gcgccgucgucgagcaccac

SEQ ID NO: 2889854 - RNA, 22 nt, Mycobacterium avium subsp. paratuberculosis
gcgccgucgucgagcaccaccc

SEQ ID NO: 2889855 - RNA, 22 nt, Mycobacterium avium subsp. paratuberculosis
gcgccgucgucggacaccagca

SEQ ID NO: 2889856 - RNA, 15 nt, Mycobacterium avium subsp. paratuberculosis
gcgccgucgucgucg

SEQ ID NO: 2889857 - RNA, 18 nt, Mycobacterium avium subsp. paratuberculosis
gcgccgucgucgucggcc

SEQ ID NO: 2889858 - RNA, 16 nt, Mycobacterium avium subsp. paratuberculosis
gcgccgucuccggcgu

SEQ ID NO: 2889859 - RNA, 17 nt, Mycobacterium avium subsp. paratuberculosis
gcgccgucuccggcgua

SEQ ID NO: 2889860 - RNA, 19 nt, Mycobacterium avium subsp. paratuberculosis
gcgccgucuccucgaccag

SEQ ID NO: 2889861 - RNA, 20 nt, Mycobacterium avium subsp. paratuberculosis
gcgccgucuccucgaccagc

SEQ ID NO: 2889862 - RNA, 15 nt, Mycobacterium avium subsp. paratuberculosis
gcgccgucucgaccc

SEQ ID NO: 2889863 - RNA, 21 nt, Mycobacterium avium subsp. paratuberculosis
gcgccgucucgacccgggcca

SEQ ID NO: 2889864 - RNA, 16 nt, Mycobacterium avium subsp. paratuberculosis
gcgccgucuuccgggc

SEQ ID NO: 2889865 - RNA, 20 nt, Mycobacterium avium subsp. paratuberculosis
gcgccgucuuccgggccacc

SEQ ID NO: 2889866 - RNA, 20 nt, Mycobacterium avium subsp. paratuberculosis
gcgccgugaacugugcggug

SEQ ID NO: 2889867 - RNA, 21 nt, Mycobacterium avium subsp. paratuberculosis
gcgccgugaacugugcggugc

SEQ ID NO: 2889868 - RNA, 14 nt, Mycobacterium avium subsp. paratuberculosis
gcgccgugaagggc

SEQ ID NO: 2889869 - RNA, 20 nt, Mycobacterium avium subsp. paratuberculosis
gcgccgugaagggcccgccg

SEQ ID NO: 2889870 - RNA, 21 nt, Mycobacterium avium subsp. paratuberculosis
gcgccgugaagggcccgccgg

SEQ ID NO: 2889871 - RNA, 18 nt, Mycobacterium avium subsp. paratuberculosis
gcgccgugcagcacgccg

SEQ ID NO: 2889872 - RNA, 18 nt, Mycobacterium avium subsp. paratuberculosis
gcgccgugcaggaugacc

SEQ ID NO: 2889873 - RNA, 19 nt, Mycobacterium avium subsp. paratuberculosis
gcgccgugcccaacacgcc

SEQ ID NO: 2889874 - RNA, 15 nt, Mycobacterium avium subsp. paratuberculosis
gcgccgugccgcgcg

SEQ ID NO: 2889875 - RNA, 17 nt, Mycobacterium avium subsp. paratuberculosis
gcgccgugccgcgcggc

SEQ ID NO: 2889876 - RNA, 18 nt, Mycobacterium avium subsp. paratuberculosis
gcgccgugccgcgcggcg

SEQ ID NO: 2889877 - RNA, 19 nt, Mycobacterium avium subsp. paratuberculosis
gcgccgugccgcgcggcga

SEQ ID NO: 2889878 - RNA, 20 nt, Mycobacterium avium subsp. paratuberculosis
gcgccgugccgcgcggcgau

SEQ ID NO: 2889879 - RNA, 14 nt, Mycobacterium avium subsp. paratuberculosis
gcgccgugcgccag

SEQ ID NO: 2889880 - RNA, 18 nt, Mycobacterium avium subsp. paratuberculosis
gcgccgugcgccagcgac

SEQ ID NO: 2889881 - RNA, 13 nt, Mycobacterium avium subsp. paratuberculosis
gcgccguggccca

SEQ ID NO: 2889882 - RNA, 22 nt, Mycobacterium avium subsp. paratuberculosis
gcgccguggcccauguggccug

SEQ ID NO: 2889883 - RNA, 15 nt, Mycobacterium avium subsp. paratuberculosis
gcgccguggcccggu

SEQ ID NO: 2889884 - RNA, 17 nt, Mycobacterium avium subsp. paratuberculosis
gcgccguggcccggucg

SEQ ID NO: 2889885 - RNA, 20 nt, Mycobacterium avium subsp. paratuberculosis
gcgccguggcccggucggag

SEQ ID NO: 2889886 - RNA, 21 nt, Mycobacterium avium subsp. paratuberculosis
gcgccguggcccggucggagu

SEQ ID NO: 2889887 - RNA, 22 nt, Mycobacterium avium subsp. paratuberculosis
gcgccgugggcgucacgcauca

SEQ ID NO: 2889888 - RNA, 17 nt, Mycobacterium avium subsp. paratuberculosis
gcgccguugaccggccg

SEQ ID NO: 2889889 - RNA, 19 nt, Mycobacterium avium subsp. paratuberculosis
gcgccguugauugcgcccg

SEQ ID NO: 2889890 - RNA, 21 nt, Mycobacterium avium subsp. paratuberculosis
gcgccguugauugcgcccgcc

SEQ ID NO: 2889891 - RNA, 23 nt, Mycobacterium avium subsp. paratuberculosis
gcgccguugauugcgcccgccga

SEQ ID NO: 2889892 - RNA, 14 nt, Mycobacterium avium subsp. paratuberculosis
gcgccguugguggu

SEQ ID NO: 2889893 - RNA, 17 nt, Mycobacterium avium subsp. paratuberculosis
gcgccguuguaggccgc

SEQ ID NO: 2889894 - RNA, 21 nt, Mycobacterium avium subsp. paratuberculosis
gcgccguuguaggccgcgcgg

SEQ ID NO: 2889895 - RNA, 19 nt, Mycobacterium avium subsp. paratuberculosis
gcgccguuucggacgagcc

SEQ ID NO: 2889896 - RNA, 23 nt, Mycobacterium avium subsp. paratuberculosis
gcgccguuucggacgagccgucg

SEQ ID NO: 2889897 - RNA, 14 nt, Mycobacterium avium subsp. paratuberculosis
gcgccuaccgggug

SEQ ID NO: 2889898 - RNA, 16 nt, Mycobacterium avium subsp. paratuberculosis
gcgccuaccggguggc

SEQ ID NO: 2889899 - RNA, 20 nt, Mycobacterium avium subsp. paratuberculosis
gcgccucagcagcugcuggc

SEQ ID NO: 2889900 - RNA, 22 nt, Mycobacterium avium subsp. paratuberculosis
gcgccuccauucgggccagcgc

SEQ ID NO: 2889901 - RNA, 14 nt, Mycobacterium avium subsp. paratuberculosis
gcgccucccggacc

SEQ ID NO: 2889902 - RNA, 17 nt, Mycobacterium avium subsp. paratuberculosis
gcgccucccggaccacc

SEQ ID NO: 2889903 - RNA, 18 nt, Mycobacterium avium subsp. paratuberculosis
gcgccucccggaccacca

SEQ ID NO: 2889904 - RNA, 14 nt, Mycobacterium avium subsp. paratuberculosis
gcgccuccgacgac

SEQ ID NO: 2889905 - RNA, 15 nt, Mycobacterium avium subsp. paratuberculosis
gcgccuccgacgacg

SEQ ID NO: 2889906 - RNA, 18 nt, Mycobacterium avium subsp. paratuberculosis
gcgccuccgacgacgauu

SEQ ID NO: 2889907 - RNA, 19 nt, Mycobacterium avium subsp. paratuberculosis
gcgccuccgacgacgauug

SEQ ID NO: 2889908 - RNA, 12 nt, Mycobacterium avium subsp. paratuberculosis
gcgccuccgccc

SEQ ID NO: 2889909 - RNA, 13 nt, Mycobacterium avium subsp. paratuberculosis
gcgccuccgcccg

SEQ ID NO: 2889910 - RNA, 14 nt, Mycobacterium avium subsp. paratuberculosis
gcgccuccgcccgg

SEQ ID NO: 2889911 - RNA, 16 nt, Mycobacterium avium subsp. paratuberculosis
gcgccucgaacaucgg

SEQ ID NO: 2889912 - RNA, 19 nt, Mycobacterium avium subsp. paratuberculosis
gcgccucgaacaucggcac

SEQ ID NO: 2889913 - RNA, 20 nt, Mycobacterium avium subsp. paratuberculosis
gcgccucgagcaacggccgc

SEQ ID NO: 2889914 - RNA, 16 nt, Mycobacterium avium subsp. paratuberculosis
gcgccucgagcaccac

SEQ ID NO: 2889915 - RNA, 18 nt, Mycobacterium avium subsp. paratuberculosis
gcgccucgagcaccacgg

SEQ ID NO: 2889916 - RNA, 19 nt, Mycobacterium avium subsp. paratuberculosis
gcgccucgagcaccacggc

SEQ ID NO: 2889917 - RNA, 23 nt, Mycobacterium avium subsp. paratuberculosis
gcgccucgagcaccacggcccgc

SEQ ID NO: 2889918 - RNA, 23 nt, Mycobacterium avium subsp. paratuberculosis
gcgccucgaucaacgccgggucg

SEQ ID NO: 2889919 - RNA, 17 nt, Mycobacterium avium subsp. paratuberculosis
gcgccucgaugcgggug

SEQ ID NO: 2889920 - RNA, 13 nt, Mycobacterium avium subsp. paratuberculosis
gcgccucgccgac

SEQ ID NO: 2889921 - RNA, 16 nt, Mycobacterium avium subsp. paratuberculosis
gcgccucgccgaccuu

SEQ ID NO: 2889922 - RNA, 16 nt, Mycobacterium avium subsp. paratuberculosis
gcgccucgccgggccc

SEQ ID NO: 2889923 - RNA, 18 nt, Mycobacterium avium subsp. paratuberculosis
gcgccucgcuaaucgccg

SEQ ID NO: 2889924 - RNA, 19 nt, Mycobacterium avium subsp. paratuberculosis
gcgccucgcuaaucgccgc

SEQ ID NO: 2889925 - RNA, 12 nt, Mycobacterium avium subsp. paratuberculosis
gcgccucggccu

SEQ ID NO: 2889926 - RNA, 14 nt, Mycobacterium avium subsp. paratuberculosis
gcgccucggccucg

SEQ ID NO: 2889927 - RNA, 14 nt, Mycobacterium avium subsp. paratuberculosis
gcgccucggccugc

SEQ ID NO: 2889928 - RNA, 15 nt, Mycobacterium avium subsp. paratuberculosis
gcgccucggccugcg

SEQ ID NO: 2889929 - RNA, 19 nt, Mycobacterium avium subsp. paratuberculosis
gcgccucggccugcgcccg

SEQ ID NO: 2889930 - RNA, 13 nt, Mycobacterium avium subsp. paratuberculosis
gcgccucggcgau

SEQ ID NO: 2889931 - RNA, 18 nt, Mycobacterium avium subsp. paratuberculosis
gcgccucggcgaucggcc

SEQ ID NO: 2889932 - RNA, 12 nt, Mycobacterium avium subsp. paratuberculosis
gcgccucggcgc

SEQ ID NO: 2889933 - RNA, 19 nt, Mycobacterium avium subsp. paratuberculosis
gcgccucggcgccucggcg

SEQ ID NO: 2889934 - RNA, 20 nt, Mycobacterium avium subsp. paratuberculosis
gcgccucggcgccucggcgu

SEQ ID NO: 2889935 - RNA, 14 nt, Mycobacterium avium subsp. paratuberculosis
gcgccucggcggcc

SEQ ID NO: 2889936 - RNA, 16 nt, Mycobacterium avium subsp. paratuberculosis
gcgccucggcggcccc

SEQ ID NO: 2889937 - RNA, 16 nt, Mycobacterium avium subsp. paratuberculosis
gcgccucggcgggccg

SEQ ID NO: 2889938 - RNA, 19 nt, Mycobacterium avium subsp. paratuberculosis
gcgccucggcgggccgccc

SEQ ID NO: 2889939 - RNA, 22 nt, Mycobacterium avium subsp. paratuberculosis
gcgccucggcgggccgcccggc

SEQ ID NO: 2889940 - RNA, 17 nt, Mycobacterium avium subsp. paratuberculosis
gcgccucggcgucaccg

SEQ ID NO: 2889941 - RNA, 18 nt, Mycobacterium avium subsp. paratuberculosis
gcgccucggcgucaccgc

SEQ ID NO: 2889942 - RNA, 20 nt, Mycobacterium avium subsp. paratuberculosis
gcgccucggcgucaccgcgg

SEQ ID NO: 2889943 - RNA, 14 nt, Mycobacterium avium subsp. paratuberculosis
gcgccucggcgucc

SEQ ID NO: 2889944 - RNA, 21 nt, Mycobacterium avium subsp. paratuberculosis
gcgccucggcgucccggcguc

SEQ ID NO: 2889945 - RNA, 21 nt, Mycobacterium avium subsp. paratuberculosis
gcgccucggcguggcaggcga

SEQ ID NO: 2889946 - RNA, 21 nt, Mycobacterium avium subsp. paratuberculosis
gcgccucggugaagccgcgga

SEQ ID NO: 2889947 - RNA, 20 nt, Mycobacterium avium subsp. paratuberculosis
gcgccucgucgagccgggcc

SEQ ID NO: 2889948 - RNA, 19 nt, Mycobacterium avium subsp. paratuberculosis
gcgccucgugcaugugcuc

SEQ ID NO: 2889949 - RNA, 21 nt, Mycobacterium avium subsp. paratuberculosis
gcgccucgugcaugugcucgg

SEQ ID NO: 2889950 - RNA, 16 nt, Mycobacterium avium subsp. paratuberculosis
gcgccucguugagcac

SEQ ID NO: 2889951 - RNA, 16 nt, Mycobacterium avium subsp. paratuberculosis
gcgccugauccgcggu

SEQ ID NO: 2889952 - RNA, 17 nt, Mycobacterium avium subsp. paratuberculosis
gcgccugcaccggcgac

SEQ ID NO: 2889953 - RNA, 18 nt, Mycobacterium avium subsp. paratuberculosis
gcgccugcaccggcgacg

SEQ ID NO: 2889954 - RNA, 19 nt, Mycobacterium avium subsp. paratuberculosis
gcgccugcaccggcgacgg

SEQ ID NO: 2889955 - RNA, 16 nt, Mycobacterium avium subsp. paratuberculosis
gcgccugcacgcaggc

SEQ ID NO: 2889956 - RNA, 17 nt, Mycobacterium avium subsp. paratuberculosis
gcgccugcacggugccg

SEQ ID NO: 2889957 - RNA, 21 nt, Mycobacterium avium subsp. paratuberculosis
gcgccugccuggccacguggu

SEQ ID NO: 2889958 - RNA, 16 nt, Mycobacterium avium subsp. paratuberculosis
gcgccugcgcggcggc

SEQ ID NO: 2889959 - RNA, 16 nt, Mycobacterium avium subsp. paratuberculosis
gcgccugcugccagga

SEQ ID NO: 2889960 - RNA, 16 nt, Mycobacterium avium subsp. paratuberculosis
gcgccuggcgcagggc

SEQ ID NO: 2889961 - RNA, 20 nt, Mycobacterium avium subsp. paratuberculosis
gcgccugggcguacagcggc

SEQ ID NO: 2889962 - RNA, 21 nt, Mycobacterium avium subsp. paratuberculosis
gcgccugggcguacagcggcg

SEQ ID NO: 2889963 - RNA, 24 nt, Mycobacterium avium subsp. paratuberculosis
gcgccugggcguacagcggcgcca

SEQ ID NO: 2889964 - RNA, 17 nt, Mycobacterium avium subsp. paratuberculosis
gcgccugguccucccgg

SEQ ID NO: 2889965 - RNA, 16 nt, Mycobacterium avium subsp. paratuberculosis
gcgccuucgacccggu

SEQ ID NO: 2889966 - RNA, 19 nt, Mycobacterium avium subsp. paratuberculosis
gcgccuucgacccgguggc

SEQ ID NO: 2889967 - RNA, 13 nt, Mycobacterium avium subsp. paratuberculosis
gcgccuucggcgc

SEQ ID NO: 2889968 - RNA, 20 nt, Mycobacterium avium subsp. paratuberculosis
gcgccuucggcgccagcccg

SEQ ID NO: 2889969 - RNA, 19 nt, Mycobacterium avium subsp. paratuberculosis
gcgccuucuugcugcccgc

SEQ ID NO: 2889970 - RNA, 16 nt, Mycobacterium avium subsp. paratuberculosis
gcgccuucuuggccgc

SEQ ID NO: 2889971 - RNA, 17 nt, Mycobacterium avium subsp. paratuberculosis
gcgccuucuuggcggcg

SEQ ID NO: 2889972 - RNA, 18 nt, Mycobacterium avium subsp. paratuberculosis
gcgccuucuuggcggcgg

SEQ ID NO: 2889973 - RNA, 15 nt, Mycobacterium avium subsp. paratuberculosis
gcgccuugaccgcgu

SEQ ID NO: 2889974 - RNA, 15 nt, Mycobacterium avium subsp. paratuberculosis
gcgccuugccgacga

SEQ ID NO: 2889975 - RNA, 23 nt, Mycobacterium avium subsp. paratuberculosis
gcgccuugccgacgacgucguag

SEQ ID NO: 2889976 - RNA, 15 nt, Mycobacterium avium subsp. paratuberculosis
gcgccuugccgucga

SEQ ID NO: 2889977 - RNA, 19 nt, Mycobacterium avium subsp. paratuberculosis
gcgccuugccgucgagcag

SEQ ID NO: 2889978 - RNA, 16 nt, Mycobacterium avium subsp. paratuberculosis
gcgccuuggccucggu

SEQ ID NO: 2889979 - RNA, 16 nt, Mycobacterium avium subsp. paratuberculosis
gcgccuuugacguucg

SEQ ID NO: 2889980 - RNA, 17 nt, Mycobacterium avium subsp. paratuberculosis
gcgccuuugacguucgc

SEQ ID NO: 2889981 - RNA, 16 nt, Mycobacterium avium subsp. paratuberculosis
gcgccuuuugcacccg

SEQ ID NO: 2889982 - RNA, 18 nt, Mycobacterium avium subsp. paratuberculosis
gcgccuuuugcacccgcc

SEQ ID NO: 2889983 - RNA, 20 nt, Mycobacterium avium subsp. paratuberculosis
gcgccuuuugcacccgccau

SEQ ID NO: 2889984 - RNA, 19 nt, Mycobacterium avium subsp. paratuberculosis
gcgcgaaaaaacggcggcg

SEQ ID NO: 2889985 - RNA, 20 nt, Mycobacterium avium subsp. paratuberculosis
gcgcgaaaaaacggcggcgg

SEQ ID NO: 2889986 - RNA, 18 nt, Mycobacterium avium subsp. paratuberculosis
gcgcgaaaaccagcaccg

SEQ ID NO: 2889987 - RNA, 20 nt, Mycobacterium avium subsp. paratuberculosis
gcgcgaaaaccagcaccggc

SEQ ID NO: 2889988 - RNA, 21 nt, Mycobacterium avium subsp. paratuberculosis
gcgcgaaaaccagcaccggca

SEQ ID NO: 2889989 - RNA, 15 nt, Mycobacterium avium subsp. paratuberculosis
gcgcgaaacccccgg

SEQ ID NO: 2889990 - RNA, 19 nt, Mycobacterium avium subsp. paratuberculosis
gcgcgaaagcagcaacggc

SEQ ID NO: 2889991 - RNA, 22 nt, Mycobacterium avium subsp. paratuberculosis
gcgcgaaagcagcaacggcggc

SEQ ID NO: 2889992 - RNA, 23 nt, Mycobacterium avium subsp. paratuberculosis
gcgcgaaagcagcaacggcggcg

SEQ ID NO: 2889993 - RNA, 14 nt, Mycobacterium avium subsp. paratuberculosis
gcgcgaaagcgcga

SEQ ID NO: 2889994 - RNA, 16 nt, Mycobacterium avium subsp. paratuberculosis
gcgcgaaagcgcgagg

SEQ ID NO: 2889995 - RNA, 19 nt, Mycobacterium avium subsp. paratuberculosis
gcgcgaaaggcccaccgcu

SEQ ID NO: 2889996 - RNA, 20 nt, Mycobacterium avium subsp. paratuberculosis
gcgcgaaaggcccaccgcug

SEQ ID NO: 2889997 - RNA, 21 nt, Mycobacterium avium subsp. paratuberculosis
gcgcgaaaggcccaccgcugg

SEQ ID NO: 2889998 - RNA, 17 nt, Mycobacterium avium subsp. paratuberculosis
gcgcgaaauacgacgag

SEQ ID NO: 2889999 - RNA, 19 nt, Mycobacterium avium subsp. paratuberculosis
gcgcgaacaaucgcugcga

SEQ ID NO: 2890000 - RNA, 15 nt, Mycobacterium avium subsp. paratuberculosis
gcgcgaacagcgaag

SEQ ID NO: 2890001 - RNA, 21 nt, Mycobacterium avium subsp. paratuberculosis
gcgcgaacagcgaagccacgg

SEQ ID NO: 2890002 - RNA, 22 nt, Mycobacterium avium subsp. paratuberculosis
gcgcgaacagcgaagccacgga

SEQ ID NO: 2890003 - RNA, 15 nt, Mycobacterium avium subsp. paratuberculosis
gcgcgaacagcgccg

SEQ ID NO: 2890004 - RNA, 18 nt, Mycobacterium avium subsp. paratuberculosis
gcgcgaacagcgccgacu

SEQ ID NO: 2890005 - RNA, 21 nt, Mycobacterium avium subsp. paratuberculosis
gcgcgaacagcgccgacuugg

SEQ ID NO: 2890006 - RNA, 16 nt, Mycobacterium avium subsp. paratuberculosis
gcgcgaacagcgcggc

SEQ ID NO: 2890007 - RNA, 17 nt, Mycobacterium avium subsp. paratuberculosis
gcgcgaacagcgcggcc

SEQ ID NO: 2890008 - RNA, 18 nt, Mycobacterium avium subsp. paratuberculosis
gcgcgaacagcgcggcca

SEQ ID NO: 2890009 - RNA, 20 nt, Mycobacterium avium subsp. paratuberculosis
gcgcgaacagcgcggccacc

SEQ ID NO: 2890010 - RNA, 21 nt, Mycobacterium avium subsp. paratuberculosis
gcgcgaacagcgcggccacca

SEQ ID NO: 2890011 - RNA, 14 nt, Mycobacterium avium subsp. paratuberculosis
gcgcgaaccgggcc

SEQ ID NO: 2890012 - RNA, 15 nt, Mycobacterium avium subsp. paratuberculosis
gcgcgaaccgggcca

SEQ ID NO: 2890013 - RNA, 18 nt, Mycobacterium avium subsp. paratuberculosis
gcgcgaaccgggccagga

SEQ ID NO: 2890014 - RNA, 19 nt, Mycobacterium avium subsp. paratuberculosis
gcgcgaagcccucgaagca

SEQ ID NO: 2890015 - RNA, 14 nt, Mycobacterium avium subsp. paratuberculosis
gcgcgaagcugggg

SEQ ID NO: 2890016 - RNA, 19 nt, Mycobacterium avium subsp. paratuberculosis
gcgcgaagguggcgccggu

SEQ ID NO: 2890017 - RNA, 21 nt, Mycobacterium avium subsp. paratuberculosis
gcgcgaagucccacugcccgu

SEQ ID NO: 2890018 - RNA, 22 nt, Mycobacterium avium subsp. paratuberculosis
gcgcgaagucccacugcccgua

SEQ ID NO: 2890019 - RNA, 14 nt, Mycobacterium avium subsp. paratuberculosis
gcgcgaaucccggc

SEQ ID NO: 2890020 - RNA, 20 nt, Mycobacterium avium subsp. paratuberculosis
gcgcgaauuccucagcgccc

SEQ ID NO: 2890021 - RNA, 13 nt, Mycobacterium avium subsp. paratuberculosis
gcgcgacaagcag

SEQ ID NO: 2890022 - RNA, 14 nt, Mycobacterium avium subsp. paratuberculosis
gcgcgacaccgcgg

SEQ ID NO: 2890023 - RNA, 15 nt, Mycobacterium avium subsp. paratuberculosis
gcgcgacaccgcggc

SEQ ID NO: 2890024 - RNA, 18 nt, Mycobacterium avium subsp. paratuberculosis
gcgcgacaccggacugcu

SEQ ID NO: 2890025 - RNA, 21 nt, Mycobacterium avium subsp. paratuberculosis
gcgcgacaccggacugcuugg

SEQ ID NO: 2890026 - RNA, 21 nt, Mycobacterium avium subsp. paratuberculosis
gcgcgacaucaccgcgggcgc

SEQ ID NO: 2890027 - RNA, 12 nt, Mycobacterium avium subsp. paratuberculosis
gcgcgacaucgc

SEQ ID NO: 2890028 - RNA, 18 nt, Mycobacterium avium subsp. paratuberculosis
gcgcgacaucgccggcga

SEQ ID NO: 2890029 - RNA, 23 nt, Mycobacterium avium subsp. paratuberculosis
gcgcgacaucgccggcgaccgug

SEQ ID NO: 2890030 - RNA, 19 nt, Mycobacterium avium subsp. paratuberculosis
gcgcgaccaaacgcagcgu

SEQ ID NO: 2890031 - RNA, 20 nt, Mycobacterium avium subsp. paratuberculosis
gcgcgaccaaacgcagcguc

SEQ ID NO: 2890032 - RNA, 12 nt, Mycobacterium avium subsp. paratuberculosis
gcgcgaccacau

SEQ ID NO: 2890033 - RNA, 13 nt, Mycobacterium avium subsp. paratuberculosis
gcgcgaccagccc

SEQ ID NO: 2890034 - RNA, 14 nt, Mycobacterium avium subsp. paratuberculosis
gcgcgaccagcccg

SEQ ID NO: 2890035 - RNA, 16 nt, Mycobacterium avium subsp. paratuberculosis
gcgcgaccagcccggc

SEQ ID NO: 2890036 - RNA, 17 nt, Mycobacterium avium subsp. paratuberculosis
gcgcgaccagcccggcc

SEQ ID NO: 2890037 - RNA, 23 nt, Mycobacterium avium subsp. paratuberculosis
gcgcgaccagcccggccgccgag

SEQ ID NO: 2890038 - RNA, 14 nt, Mycobacterium avium subsp. paratuberculosis
gcgcgaccagcggc

SEQ ID NO: 2890039 - RNA, 17 nt, Mycobacterium avium subsp. paratuberculosis
gcgcgaccagcggcagc

SEQ ID NO: 2890040 - RNA, 13 nt, Mycobacterium avium subsp. paratuberculosis
gcgcgaccaguac

SEQ ID NO: 2890041 - RNA, 19 nt, Mycobacterium avium subsp. paratuberculosis
gcgcgaccaguaccgggcc

SEQ ID NO: 2890042 - RNA, 19 nt, Mycobacterium avium subsp. paratuberculosis
gcgcgaccagugcaccucg

SEQ ID NO: 2890043 - RNA, 23 nt, Mycobacterium avium subsp. paratuberculosis
gcgcgaccagugcaccucgacga

SEQ ID NO: 2890044 - RNA, 19 nt, Mycobacterium avium subsp. paratuberculosis
gcgcgaccaucagcccggu

SEQ ID NO: 2890045 - RNA, 20 nt, Mycobacterium avium subsp. paratuberculosis
gcgcgaccccuacgggcgca

SEQ ID NO: 2890046 - RNA, 22 nt, Mycobacterium avium subsp. paratuberculosis
gcgcgaccccuacgggcgcacc

SEQ ID NO: 2890047 - RNA, 14 nt, Mycobacterium avium subsp. paratuberculosis
gcgcgacccgcucg

SEQ ID NO: 2890048 - RNA, 15 nt, Mycobacterium avium subsp. paratuberculosis
gcgcgacccgcucga

SEQ ID NO: 2890049 - RNA, 16 nt, Mycobacterium avium subsp. paratuberculosis
gcgcgacccgcucgac

SEQ ID NO: 2890050 - RNA, 17 nt, Mycobacterium avium subsp. paratuberculosis
gcgcgacccgcucgacg

SEQ ID NO: 2890051 - RNA, 22 nt, Mycobacterium avium subsp. paratuberculosis
gcgcgacccgcucgacgcgcac

SEQ ID NO: 2890052 - RNA, 15 nt, Mycobacterium avium subsp. paratuberculosis
gcgcgaccucggugg

SEQ ID NO: 2890053 - RNA, 17 nt, Mycobacterium avium subsp. paratuberculosis
gcgcgaccucgguggug

SEQ ID NO: 2890054 - RNA, 19 nt, Mycobacterium avium subsp. paratuberculosis
gcgcgaccucuucgcugga

SEQ ID NO: 2890055 - RNA, 21 nt, Mycobacterium avium subsp. paratuberculosis
gcgcgaccugcuuggcggccu

SEQ ID NO: 2890056 - RNA, 15 nt, Mycobacterium avium subsp. paratuberculosis
gcgcgacgaacagca

SEQ ID NO: 2890057 - RNA, 13 nt, Mycobacterium avium subsp. paratuberculosis
gcgcgacgaaucc

SEQ ID NO: 2890058 - RNA, 13 nt, Mycobacterium avium subsp. paratuberculosis
gcgcgacgcacgc

SEQ ID NO: 2890059 - RNA, 15 nt, Mycobacterium avium subsp. paratuberculosis
gcgcgacgcacgccg

SEQ ID NO: 2890060 - RNA, 18 nt, Mycobacterium avium subsp. paratuberculosis
gcgcgacgcacgccggcg

SEQ ID NO: 2890061 - RNA, 19 nt, Mycobacterium avium subsp. paratuberculosis
gcgcgacgccgacgcccag

SEQ ID NO: 2890062 - RNA, 21 nt, Mycobacterium avium subsp. paratuberculosis
gcgcgacgccgacgcccagcg

SEQ ID NO: 2890063 - RNA, 12 nt, Mycobacterium avium subsp. paratuberculosis
gcgcgacgccgu

SEQ ID NO: 2890064 - RNA, 13 nt, Mycobacterium avium subsp. paratuberculosis
gcgcgacgccguc

SEQ ID NO: 2890065 - RNA, 14 nt, Mycobacterium avium subsp. paratuberculosis
gcgcgacgccguca

SEQ ID NO: 2890066 - RNA, 12 nt, Mycobacterium avium subsp. paratuberculosis
gcgcgacgcgca

SEQ ID NO: 2890067 - RNA, 16 nt, Mycobacterium avium subsp. paratuberculosis
gcgcgacgcgcaugcc

SEQ ID NO: 2890068 - RNA, 14 nt, Mycobacterium avium subsp. paratuberculosis
gcgcgacgcugaug

SEQ ID NO: 2890069 - RNA, 17 nt, Mycobacterium avium subsp. paratuberculosis
gcgcgacggccucgccg

SEQ ID NO: 2890070 - RNA, 18 nt, Mycobacterium avium subsp. paratuberculosis
gcgcgacggccucgccgu

SEQ ID NO: 2890071 - RNA, 16 nt, Mycobacterium avium subsp. paratuberculosis
gcgcgacggcgcguga

SEQ ID NO: 2890072 - RNA, 14 nt, Mycobacterium avium subsp. paratuberculosis
gcgcgacggcggcg

SEQ ID NO: 2890073 - RNA, 15 nt, Mycobacterium avium subsp. paratuberculosis
gcgcgacggcggcga

SEQ ID NO: 2890074 - RNA, 14 nt, Mycobacterium avium subsp. paratuberculosis
gcgcgacgggcacc

SEQ ID NO: 2890075 - RNA, 17 nt, Mycobacterium avium subsp. paratuberculosis
gcgcgacgggcacccgc

SEQ ID NO: 2890076 - RNA, 15 nt, Mycobacterium avium subsp. paratuberculosis
gcgcgacgggcugcu

SEQ ID NO: 2890077 - RNA, 20 nt, Mycobacterium avium subsp. paratuberculosis
gcgcgacgggcugcugcacg

SEQ ID NO: 2890078 - RNA, 16 nt, Mycobacterium avium subsp. paratuberculosis
gcgcgacggucacgcu

SEQ ID NO: 2890079 - RNA, 20 nt, Mycobacterium avium subsp. paratuberculosis
gcgcgacgguguaggacgcc

SEQ ID NO: 2890080 - RNA, 16 nt, Mycobacterium avium subsp. paratuberculosis
gcgcgacgucgaccgc

SEQ ID NO: 2890081 - RNA, 19 nt, Mycobacterium avium subsp. paratuberculosis
gcgcgacgugccggcgaug

SEQ ID NO: 2890082 - RNA, 17 nt, Mycobacterium avium subsp. paratuberculosis
gcgcgacugggcgccca

SEQ ID NO: 2890083 - RNA, 19 nt, Mycobacterium avium subsp. paratuberculosis
gcgcgacugggcgcccacc

SEQ ID NO: 2890084 - RNA, 22 nt, Mycobacterium avium subsp. paratuberculosis
gcgcgacugggcgcccacccgu

SEQ ID NO: 2890085 - RNA, 19 nt, Mycobacterium avium subsp. paratuberculosis
gcgcgagaguaucgccacg

SEQ ID NO: 2890086 - RNA, 22 nt, Mycobacterium avium subsp. paratuberculosis
gcgcgagaguaucgccacgccg

SEQ ID NO: 2890087 - RNA, 15 nt, Mycobacterium avium subsp. paratuberculosis
gcgcgagauggcgau

SEQ ID NO: 2890088 - RNA, 20 nt, Mycobacterium avium subsp. paratuberculosis
gcgcgagcagacgcaaaagc

SEQ ID NO: 2890089 - RNA, 16 nt, Mycobacterium avium subsp. paratuberculosis
gcgcgagcaucaccgu

SEQ ID NO: 2890090 - RNA, 17 nt, Mycobacterium avium subsp. paratuberculosis
gcgcgagcaucaccguc

SEQ ID NO: 2890091 - RNA, 23 nt, Mycobacterium avium subsp. paratuberculosis
gcgcgagcaucaccgucaucucg

SEQ ID NO: 2890092 - RNA, 13 nt, Mycobacterium avium subsp. paratuberculosis
gcgcgagccgaaa

SEQ ID NO: 2890093 - RNA, 19 nt, Mycobacterium avium subsp. paratuberculosis
gcgcgagcgcagcgccagg

SEQ ID NO: 2890094 - RNA, 12 nt, Mycobacterium avium subsp. paratuberculosis
gcgcgagcgcgc

SEQ ID NO: 2890095 - RNA, 13 nt, Mycobacterium avium subsp. paratuberculosis
gcgcgagcgcgcu

SEQ ID NO: 2890096 - RNA, 14 nt, Mycobacterium avium subsp. paratuberculosis
gcgcgagcgcgcug

SEQ ID NO: 2890097 - RNA, 20 nt, Mycobacterium avium subsp. paratuberculosis
gcgcgagcgucacgcuggcg

SEQ ID NO: 2890098 - RNA, 19 nt, Mycobacterium avium subsp. paratuberculosis
gcgcgaggacgauggacga

SEQ ID NO: 2890099 - RNA, 18 nt, Mycobacterium avium subsp. paratuberculosis
gcgcgaggaggggucggu

SEQ ID NO: 2890100 - RNA, 19 nt, Mycobacterium avium subsp. paratuberculosis
gcgcgaggaggggucggug

SEQ ID NO: 2890101 - RNA, 20 nt, Mycobacterium avium subsp. paratuberculosis
gcgcgaggaggggucggugc

SEQ ID NO: 2890102 - RNA, 13 nt, Mycobacterium avium subsp. paratuberculosis
gcgcgaggcgcga

SEQ ID NO: 2890103 - RNA, 16 nt, Mycobacterium avium subsp. paratuberculosis
gcgcgaggcgcggggc

SEQ ID NO: 2890104 - RNA, 13 nt, Mycobacterium avium subsp. paratuberculosis
gcgcgaggcgggu

SEQ ID NO: 2890105 - RNA, 19 nt, Mycobacterium avium subsp. paratuberculosis
gcgcgaggcggguaggcgu

SEQ ID NO: 2890106 - RNA, 20 nt, Mycobacterium avium subsp. paratuberculosis
gcgcgaggucgacggagucg

SEQ ID NO: 2890107 - RNA, 12 nt, Mycobacterium avium subsp. paratuberculosis
gcgcgagucgag

SEQ ID NO: 2890108 - RNA, 14 nt, Mycobacterium avium subsp. paratuberculosis
gcgcgagucgagca

SEQ ID NO: 2890109 - RNA, 15 nt, Mycobacterium avium subsp. paratuberculosis
gcgcgagucgagcac

SEQ ID NO: 2890110 - RNA, 18 nt, Mycobacterium avium subsp. paratuberculosis
gcgcgagucgagcaccgc

SEQ ID NO: 2890111 - RNA, 21 nt, Mycobacterium avium subsp. paratuberculosis
gcgcgagucgagcaccgcgac

SEQ ID NO: 2890112 - RNA, 23 nt, Mycobacterium avium subsp. paratuberculosis
gcgcgagucgagcaccgcgacca

SEQ ID NO: 2890113 - RNA, 24 nt, Mycobacterium avium subsp. paratuberculosis
gcgcgagucgagcaccgcgaccac

SEQ ID NO: 2890114 - RNA, 14 nt, Mycobacterium avium subsp. paratuberculosis
gcgcgauagccggu

SEQ ID NO: 2890115 - RNA, 16 nt, Mycobacterium avium subsp. paratuberculosis
gcgcgauagccgguga

SEQ ID NO: 2890116 - RNA, 21 nt, Mycobacterium avium subsp. paratuberculosis
gcgcgaucaacgggucgagca

SEQ ID NO: 2890117 - RNA, 14 nt, Mycobacterium avium subsp. paratuberculosis
gcgcgaucagcgcc

SEQ ID NO: 2890118 - RNA, 15 nt, Mycobacterium avium subsp. paratuberculosis
gcgcgaucagcgccg

SEQ ID NO: 2890119 - RNA, 16 nt, Mycobacterium avium subsp. paratuberculosis
gcgcgaucagcgccgu

SEQ ID NO: 2890120 - RNA, 17 nt, Mycobacterium avium subsp. paratuberculosis
gcgcgaucagcgccguc

SEQ ID NO: 2890121 - RNA, 17 nt, Mycobacterium avium subsp. paratuberculosis
gcgcgaucaggccggcc

SEQ ID NO: 2890122 - RNA, 21 nt, Mycobacterium avium subsp. paratuberculosis
gcgcgaucaggccggccacca

SEQ ID NO: 2890123 - RNA, 22 nt, Mycobacterium avium subsp. paratuberculosis
gcgcgaucaggccggccaccag

SEQ ID NO: 2890124 - RNA, 16 nt, Mycobacterium avium subsp. paratuberculosis
gcgcgaucaggcugcc

SEQ ID NO: 2890125 - RNA, 20 nt, Mycobacterium avium subsp. paratuberculosis
gcgcgauccacuccgagguc

SEQ ID NO: 2890126 - RNA, 13 nt, Mycobacterium avium subsp. paratuberculosis
gcgcgauccgggg

SEQ ID NO: 2890127 - RNA, 15 nt, Mycobacterium avium subsp. paratuberculosis
gcgcgaucgccggau

SEQ ID NO: 2890128 - RNA, 15 nt, Mycobacterium avium subsp. paratuberculosis
gcgcgaucgccggga

SEQ ID NO: 2890129 - RNA, 15 nt, Mycobacterium avium subsp. paratuberculosis
gcgcgaucgccggug

SEQ ID NO: 2890130 - RNA, 22 nt, Mycobacterium avium subsp. paratuberculosis
gcgcgaucgccggugcggccgc

SEQ ID NO: 2890131 - RNA, 12 nt, Mycobacterium avium subsp. paratuberculosis
gcgcgaucggcc

SEQ ID NO: 2890132 - RNA, 18 nt, Mycobacterium avium subsp. paratuberculosis
gcgcgaucggccgcugcc

SEQ ID NO: 2890133 - RNA, 16 nt, Mycobacterium avium subsp. paratuberculosis
gcgcgaucggcgagcc

SEQ ID NO: 2890134 - RNA, 14 nt, Mycobacterium avium subsp. paratuberculosis
gcgcgaucgguguc

SEQ ID NO: 2890135 - RNA, 16 nt, Mycobacterium avium subsp. paratuberculosis
gcgcgaucggugucca

SEQ ID NO: 2890136 - RNA, 21 nt, Mycobacterium avium subsp. paratuberculosis
gcgcgaucgguguccagccgc

SEQ ID NO: 2890137 - RNA, 14 nt, Mycobacterium avium subsp. paratuberculosis
gcgcgaucgucgac

SEQ ID NO: 2890138 - RNA, 15 nt, Mycobacterium avium subsp. paratuberculosis
gcgcgaucgucgacc

SEQ ID NO: 2890139 - RNA, 20 nt, Mycobacterium avium subsp. paratuberculosis
gcgcgaucuccgucaccgug

SEQ ID NO: 2890140 - RNA, 22 nt, Mycobacterium avium subsp. paratuberculosis
gcgcgaucuccgucaccguggu

SEQ ID NO: 2890141 - RNA, 14 nt, Mycobacterium avium subsp. paratuberculosis
gcgcgaucuccuug

SEQ ID NO: 2890142 - RNA, 15 nt, Mycobacterium avium subsp. paratuberculosis
gcgcgaugaucgccg

SEQ ID NO: 2890143 - RNA, 12 nt, Mycobacterium avium subsp. paratuberculosis
gcgcgaugcggc

SEQ ID NO: 2890144 - RNA, 14 nt, Mycobacterium avium subsp. paratuberculosis
gcgcgaugcggcuc

SEQ ID NO: 2890145 - RNA, 13 nt, Mycobacterium avium subsp. paratuberculosis
gcgcgaugcgggc

SEQ ID NO: 2890146 - RNA, 14 nt, Mycobacterium avium subsp. paratuberculosis
gcgcgaugcgggcg

SEQ ID NO: 2890147 - RNA, 17 nt, Mycobacterium avium subsp. paratuberculosis
gcgcgaugcgggcgccg

SEQ ID NO: 2890148 - RNA, 18 nt, Mycobacterium avium subsp. paratuberculosis
gcgcgaugcgggcgccga

SEQ ID NO: 2890149 - RNA, 19 nt, Mycobacterium avium subsp. paratuberculosis
gcgcgaugcgggcgccgaa

SEQ ID NO: 2890150 - RNA, 17 nt, Mycobacterium avium subsp. paratuberculosis
gcgcgauggacagcagc

SEQ ID NO: 2890151 - RNA, 19 nt, Mycobacterium avium subsp. paratuberculosis
gcgcgauggacagcagcca

SEQ ID NO: 2890152 - RNA, 20 nt, Mycobacterium avium subsp. paratuberculosis
gcgcgauggcgugccggcgc

SEQ ID NO: 2890153 - RNA, 16 nt, Mycobacterium avium subsp. paratuberculosis
gcgcgauguccgacag

SEQ ID NO: 2890154 - RNA, 21 nt, Mycobacterium avium subsp. paratuberculosis
gcgcgauguccgacagcccgc

SEQ ID NO: 2890155 - RNA, 16 nt, Mycobacterium avium subsp. paratuberculosis
gcgcgaugucgacggu

SEQ ID NO: 2890156 - RNA, 13 nt, Mycobacterium avium subsp. paratuberculosis
gcgcgcaacagcg

SEQ ID NO: 2890157 - RNA, 18 nt, Mycobacterium avium subsp. paratuberculosis
gcgcgcaacgacgaaguc

SEQ ID NO: 2890158 - RNA, 20 nt, Mycobacterium avium subsp. paratuberculosis
gcgcgcaacgaggcgguggu

SEQ ID NO: 2890159 - RNA, 22 nt, Mycobacterium avium subsp. paratuberculosis
gcgcgcaacgcuuucgggucga

SEQ ID NO: 2890160 - RNA, 21 nt, Mycobacterium avium subsp. paratuberculosis
gcgcgcaacucguccaccagc

SEQ ID NO: 2890161 - RNA, 22 nt, Mycobacterium avium subsp. paratuberculosis
gcgcgcaacucguccaccagcu

SEQ ID NO: 2890162 - RNA, 22 nt, Mycobacterium avium subsp. paratuberculosis
gcgcgcacaauucggucagcgc

SEQ ID NO: 2890163 - RNA, 14 nt, Mycobacterium avium subsp. paratuberculosis
gcgcgcacagcgcc

SEQ ID NO: 2890164 - RNA, 16 nt, Mycobacterium avium subsp. paratuberculosis
gcgcgcacagcgccac

SEQ ID NO: 2890165 - RNA, 23 nt, Mycobacterium avium subsp. paratuberculosis
gcgcgcacagcgccacaccgaag

SEQ ID NO: 2890166 - RNA, 17 nt, Mycobacterium avium subsp. paratuberculosis
gcgcgcaccacgugcgc

SEQ ID NO: 2890167 - RNA, 20 nt, Mycobacterium avium subsp. paratuberculosis
gcgcgcaccacgugcgcgaa

SEQ ID NO: 2890168 - RNA, 15 nt, Mycobacterium avium subsp. paratuberculosis
gcgcgcaccagcucg

SEQ ID NO: 2890169 - RNA, 17 nt, Mycobacterium avium subsp. paratuberculosis
gcgcgcaccagcucggc

SEQ ID NO: 2890170 - RNA, 18 nt, Mycobacterium avium subsp. paratuberculosis
gcgcgcaccagcucggcg

SEQ ID NO: 2890171 - RNA, 23 nt, Mycobacterium avium subsp. paratuberculosis
gcgcgcaccagcucggcgcuguc

SEQ ID NO: 2890172 - RNA, 13 nt, Mycobacterium avium subsp. paratuberculosis
gcgcgcaccaggc

SEQ ID NO: 2890173 - RNA, 19 nt, Mycobacterium avium subsp. paratuberculosis
gcgcgcaccaucgcgaugg

SEQ ID NO: 2890174 - RNA, 14 nt, Mycobacterium avium subsp. paratuberculosis
gcgcgcaccccggc

SEQ ID NO: 2890175 - RNA, 15 nt, Mycobacterium avium subsp. paratuberculosis
gcgcgcaccgcgggc

SEQ ID NO: 2890176 - RNA, 14 nt, Mycobacterium avium subsp. paratuberculosis
gcgcgcacggcagc

SEQ ID NO: 2890177 - RNA, 19 nt, Mycobacterium avium subsp. paratuberculosis
gcgcgcacggcagcccgac

SEQ ID NO: 2890178 - RNA, 21 nt, Mycobacterium avium subsp. paratuberculosis
gcgcgcacguuggcggccagc

SEQ ID NO: 2890179 - RNA, 23 nt, Mycobacterium avium subsp. paratuberculosis
gcgcgcacguuggcggccagcgc

SEQ ID NO: 2890180 - RNA, 12 nt, Mycobacterium avium subsp. paratuberculosis
gcgcgcagaaca

SEQ ID NO: 2890181 - RNA, 18 nt, Mycobacterium avium subsp. paratuberculosis
gcgcgcagaacaccaccg

SEQ ID NO: 2890182 - RNA, 20 nt, Mycobacterium avium subsp. paratuberculosis
gcgcgcagaacaccaccgcc

SEQ ID NO: 2890183 - RNA, 21 nt, Mycobacterium avium subsp. paratuberculosis
gcgcgcagaacaccaccgcca

SEQ ID NO: 2890184 - RNA, 22 nt, Mycobacterium avium subsp. paratuberculosis
gcgcgcagaacaccaccgccag

SEQ ID NO: 2890185 - RNA, 21 nt, Mycobacterium avium subsp. paratuberculosis
gcgcgcagaucgucgaccugc

SEQ ID NO: 2890186 - RNA, 21 nt, Mycobacterium avium subsp. paratuberculosis
gcgcgcagcaauugacgccga

SEQ ID NO: 2890187 - RNA, 12 nt, Mycobacterium avium subsp. paratuberculosis
gcgcgcagcacc

SEQ ID NO: 2890188 - RNA, 15 nt, Mycobacterium avium subsp. paratuberculosis
gcgcgcagcaggcgc

SEQ ID NO: 2890189 - RNA, 16 nt, Mycobacterium avium subsp. paratuberculosis
gcgcgcagcaggcgcc

SEQ ID NO: 2890190 - RNA, 15 nt, Mycobacterium avium subsp. paratuberculosis
gcgcgcagccacgag

SEQ ID NO: 2890191 - RNA, 17 nt, Mycobacterium avium subsp. paratuberculosis
gcgcgcagccacgagcc

SEQ ID NO: 2890192 - RNA, 19 nt, Mycobacterium avium subsp. paratuberculosis
gcgcgcagccacgagccca

SEQ ID NO: 2890193 - RNA, 17 nt, Mycobacterium avium subsp. paratuberculosis
gcgcgcagccagucgcc

SEQ ID NO: 2890194 - RNA, 12 nt, Mycobacterium avium subsp. paratuberculosis
gcgcgcagccca

SEQ ID NO: 2890195 - RNA, 15 nt, Mycobacterium avium subsp. paratuberculosis
gcgcgcagccggccg

SEQ ID NO: 2890196 - RNA, 21 nt, Mycobacterium avium subsp. paratuberculosis
gcgcgcagccggccguccacg

SEQ ID NO: 2890197 - RNA, 13 nt, Mycobacterium avium subsp. paratuberculosis
gcgcgcagcgugu

SEQ ID NO: 2890198 - RNA, 12 nt, Mycobacterium avium subsp. paratuberculosis
gcgcgcagcucg

SEQ ID NO: 2890199 - RNA, 19 nt, Mycobacterium avium subsp. paratuberculosis
gcgcgcagcucgcgcagcc

SEQ ID NO: 2890200 - RNA, 20 nt, Mycobacterium avium subsp. paratuberculosis
gcgcgcagcucgcgcagccg

SEQ ID NO: 2890201 - RNA, 22 nt, Mycobacterium avium subsp. paratuberculosis
gcgcgcagcucgcgcagccggc

SEQ ID NO: 2890202 - RNA, 12 nt, Mycobacterium avium subsp. paratuberculosis
gcgcgcaggcgc

SEQ ID NO: 2890203 - RNA, 17 nt, Mycobacterium avium subsp. paratuberculosis
gcgcgcaggcgcaccac

SEQ ID NO: 2890204 - RNA, 21 nt, Mycobacterium avium subsp. paratuberculosis
gcgcgcaggcgcaccaccagc

SEQ ID NO: 2890205 - RNA, 13 nt, Mycobacterium avium subsp. paratuberculosis
gcgcgcaggcgcg

SEQ ID NO: 2890206 - RNA, 18 nt, Mycobacterium avium subsp. paratuberculosis
gcgcgcaggcgcgcggcc

SEQ ID NO: 2890207 - RNA, 19 nt, Mycobacterium avium subsp. paratuberculosis
gcgcgcaggcgcgcggcca

SEQ ID NO: 2890208 - RNA, 13 nt, Mycobacterium avium subsp. paratuberculosis
gcgcgcaggcgcu

SEQ ID NO: 2890209 - RNA, 15 nt, Mycobacterium avium subsp. paratuberculosis
gcgcgcaggcgcuga

SEQ ID NO: 2890210 - RNA, 12 nt, Mycobacterium avium subsp. paratuberculosis
gcgcgcaggcug

SEQ ID NO: 2890211 - RNA, 15 nt, Mycobacterium avium subsp. paratuberculosis
gcgcgcagguagccg

SEQ ID NO: 2890212 - RNA, 17 nt, Mycobacterium avium subsp. paratuberculosis
gcgcgcagguagccgcc

SEQ ID NO: 2890213 - RNA, 21 nt, Mycobacterium avium subsp. paratuberculosis
gcgcgcagguagccgccguag

SEQ ID NO: 2890214 - RNA, 12 nt, Mycobacterium avium subsp. paratuberculosis
gcgcgcaggucg

SEQ ID NO: 2890215 - RNA, 12 nt, Mycobacterium avium subsp. paratuberculosis
gcgcgcagucgc

SEQ ID NO: 2890216 - RNA, 18 nt, Mycobacterium avium subsp. paratuberculosis
gcgcgcagucgcaggccc

SEQ ID NO: 2890217 - RNA, 21 nt, Mycobacterium avium subsp. paratuberculosis
gcgcgcaguugcgcggcgggc

SEQ ID NO: 2890218 - RNA, 19 nt, Mycobacterium avium subsp. paratuberculosis
gcgcgcauagaggcguuga

SEQ ID NO: 2890219 - RNA, 19 nt, Mycobacterium avium subsp. paratuberculosis
gcgcgcaucaccgagguca

SEQ ID NO: 2890220 - RNA, 22 nt, Mycobacterium avium subsp. paratuberculosis
gcgcgcaucaccgaggucaccg

SEQ ID NO: 2890221 - RNA, 14 nt, Mycobacterium avium subsp. paratuberculosis
gcgcgcaucgccgu

SEQ ID NO: 2890222 - RNA, 16 nt, Mycobacterium avium subsp. paratuberculosis
gcgcgcaucgcgggcc

SEQ ID NO: 2890223 - RNA, 20 nt, Mycobacterium avium subsp. paratuberculosis
gcgcgcaucgucgcggcgcu

SEQ ID NO: 2890224 - RNA, 23 nt, Mycobacterium avium subsp. paratuberculosis
gcgcgcaucucgaaugcggcugc

SEQ ID NO: 2890225 - RNA, 16 nt, Mycobacterium avium subsp. paratuberculosis
gcgcgcaucugcucgg

SEQ ID NO: 2890226 - RNA, 20 nt, Mycobacterium avium subsp. paratuberculosis
gcgcgcaucugcucggcguc

SEQ ID NO: 2890227 - RNA, 11 nt, Mycobacterium avium subsp. paratuberculosis
gcgcgccaacu

SEQ ID NO: 2890228 - RNA, 16 nt, Mycobacterium avium subsp. paratuberculosis
gcgcgccaccaggcgg

SEQ ID NO: 2890229 - RNA, 13 nt, Mycobacterium avium subsp. paratuberculosis
gcgcgccagcagc

SEQ ID NO: 2890230 - RNA, 14 nt, Mycobacterium avium subsp. paratuberculosis
gcgcgccagcagcg

SEQ ID NO: 2890231 - RNA, 16 nt, Mycobacterium avium subsp. paratuberculosis
gcgcgccagcagcgcg

SEQ ID NO: 2890232 - RNA, 17 nt, Mycobacterium avium subsp. paratuberculosis
gcgcgccagcagcgcgc

SEQ ID NO: 2890233 - RNA, 18 nt, Mycobacterium avium subsp. paratuberculosis
gcgcgccagcagcgcgcc

SEQ ID NO: 2890234 - RNA, 14 nt, Mycobacterium avium subsp. paratuberculosis
gcgcgccagcgcgu

SEQ ID NO: 2890235 - RNA, 17 nt, Mycobacterium avium subsp. paratuberculosis
gcgcgccagcgcgugcg

SEQ ID NO: 2890236 - RNA, 20 nt, Mycobacterium avium subsp. paratuberculosis
gcgcgccagcgucugcugcg

SEQ ID NO: 2890237 - RNA, 17 nt, Mycobacterium avium subsp. paratuberculosis
gcgcgccaggucgaaga

SEQ ID NO: 2890238 - RNA, 14 nt, Mycobacterium avium subsp. paratuberculosis
gcgcgcccacccgc

SEQ ID NO: 2890239 - RNA, 19 nt, Mycobacterium avium subsp. paratuberculosis
gcgcgcccacccgcgccgg

SEQ ID NO: 2890240 - RNA, 22 nt, Mycobacterium avium subsp. paratuberculosis
gcgcgcccacccgcgccggcag

SEQ ID NO: 2890241 - RNA, 12 nt, Mycobacterium avium subsp. paratuberculosis
gcgcgcccaggc

SEQ ID NO: 2890242 - RNA, 14 nt, Mycobacterium avium subsp. paratuberculosis
gcgcgcccaggccc

SEQ ID NO: 2890243 - RNA, 15 nt, Mycobacterium avium subsp. paratuberculosis
gcgcgcccaggcccg

SEQ ID NO: 2890244 - RNA, 16 nt, Mycobacterium avium subsp. paratuberculosis
gcgcgccccggcccgg

SEQ ID NO: 2890245 - RNA, 17 nt, Mycobacterium avium subsp. paratuberculosis
gcgcgccccggcccggc

SEQ ID NO: 2890246 - RNA, 16 nt, Mycobacterium avium subsp. paratuberculosis
gcgcgccccggcccgu

SEQ ID NO: 2890247 - RNA, 17 nt, Mycobacterium avium subsp. paratuberculosis
gcgcgccccggcccguc

SEQ ID NO: 2890248 - RNA, 18 nt, Mycobacterium avium subsp. paratuberculosis
gcgcgccccgggauccga

SEQ ID NO: 2890249 - RNA, 21 nt, Mycobacterium avium subsp. paratuberculosis
gcgcgccccgggauccgaggc

SEQ ID NO: 2890250 - RNA, 17 nt, Mycobacterium avium subsp. paratuberculosis
gcgcgccccggucccgc

SEQ ID NO: 2890251 - RNA, 19 nt, Mycobacterium avium subsp. paratuberculosis
gcgcgccccggucccgccg

SEQ ID NO: 2890252 - RNA, 20 nt, Mycobacterium avium subsp. paratuberculosis
gcgcgccccggucccgccgg

SEQ ID NO: 2890253 - RNA, 21 nt, Mycobacterium avium subsp. paratuberculosis
gcgcgccccggucccgccggu

SEQ ID NO: 2890254 - RNA, 20 nt, Mycobacterium avium subsp. paratuberculosis
gcgcgcccgagucacccggc

SEQ ID NO: 2890255 - RNA, 14 nt, Mycobacterium avium subsp. paratuberculosis
gcgcgcccgcggcc

SEQ ID NO: 2890256 - RNA, 16 nt, Mycobacterium avium subsp. paratuberculosis
gcgcgcccgcggccau

SEQ ID NO: 2890257 - RNA, 18 nt, Mycobacterium avium subsp. paratuberculosis
gcgcgcccgcggccaucg

SEQ ID NO: 2890258 - RNA, 19 nt, Mycobacterium avium subsp. paratuberculosis
gcgcgcccgcggccaucgc

SEQ ID NO: 2890259 - RNA, 16 nt, Mycobacterium avium subsp. paratuberculosis
gcgcgcccggcaccgc

SEQ ID NO: 2890260 - RNA, 20 nt, Mycobacterium avium subsp. paratuberculosis
gcgcgcccggcaccgcggcg

SEQ ID NO: 2890261 - RNA, 21 nt, Mycobacterium avium subsp. paratuberculosis
gcgcgcccggcaccgcggcgg

SEQ ID NO: 2890262 - RNA, 14 nt, Mycobacterium avium subsp. paratuberculosis
gcgcgcccuagucg

SEQ ID NO: 2890263 - RNA, 18 nt, Mycobacterium avium subsp. paratuberculosis
gcgcgcccuagucgacgc

SEQ ID NO: 2890264 - RNA, 19 nt, Mycobacterium avium subsp. paratuberculosis
gcgcgcccuagucgacgcc

SEQ ID NO: 2890265 - RNA, 23 nt, Mycobacterium avium subsp. paratuberculosis
gcgcgcccugaggcccggugagc

SEQ ID NO: 2890266 - RNA, 19 nt, Mycobacterium avium subsp. paratuberculosis
gcgcgccgaacaccugcgg

SEQ ID NO: 2890267 - RNA, 18 nt, Mycobacterium avium subsp. paratuberculosis
gcgcgccgaagauggcca

SEQ ID NO: 2890268 - RNA, 13 nt, Mycobacterium avium subsp. paratuberculosis
gcgcgccgaccac

SEQ ID NO: 2890269 - RNA, 19 nt, Mycobacterium avium subsp. paratuberculosis
gcgcgccgaccacggcccc

SEQ ID NO: 2890270 - RNA, 14 nt, Mycobacterium avium subsp. paratuberculosis
gcgcgccgaccgcg

SEQ ID NO: 2890271 - RNA, 16 nt, Mycobacterium avium subsp. paratuberculosis
gcgcgccgaccgcgag

SEQ ID NO: 2890272 - RNA, 23 nt, Mycobacterium avium subsp. paratuberculosis
gcgcgccgagagcgcgucgacgc

SEQ ID NO: 2890273 - RNA, 23 nt, Mycobacterium avium subsp. paratuberculosis
gcgcgccgagguggcccgccacg

SEQ ID NO: 2890274 - RNA, 19 nt, Mycobacterium avium subsp. paratuberculosis
gcgcgccgaugccgcgcug

SEQ ID NO: 2890275 - RNA, 20 nt, Mycobacterium avium subsp. paratuberculosis
gcgcgccgaugccgcgcugc

SEQ ID NO: 2890276 - RNA, 14 nt, Mycobacterium avium subsp. paratuberculosis
gcgcgccgaugugg

SEQ ID NO: 2890277 - RNA, 22 nt, Mycobacterium avium subsp. paratuberculosis
gcgcgccgauguggccggcgau

SEQ ID NO: 2890278 - RNA, 16 nt, Mycobacterium avium subsp. paratuberculosis
gcgcgccgcaaccguc

SEQ ID NO: 2890279 - RNA, 14 nt, Mycobacterium avium subsp. paratuberculosis
gcgcgccgcacagc

SEQ ID NO: 2890280 - RNA, 12 nt, Mycobacterium avium subsp. paratuberculosis
gcgcgccgcagc

SEQ ID NO: 2890281 - RNA, 23 nt, Mycobacterium avium subsp. paratuberculosis
gcgcgccgcagcgcgcgcucggu

SEQ ID NO: 2890282 - RNA, 21 nt, Mycobacterium avium subsp. paratuberculosis
gcgcgccgcaggagaucggcg

SEQ ID NO: 2890283 - RNA, 14 nt, Mycobacterium avium subsp. paratuberculosis
gcgcgccgcccagc

SEQ ID NO: 2890284 - RNA, 16 nt, Mycobacterium avium subsp. paratuberculosis
gcgcgccgcccagcgg

SEQ ID NO: 2890285 - RNA, 20 nt, Mycobacterium avium subsp. paratuberculosis
gcgcgccgcccagcggcccc

SEQ ID NO: 2890286 - RNA, 23 nt, Mycobacterium avium subsp. paratuberculosis
gcgcgccgcccucgccgaaccgg

SEQ ID NO: 2890287 - RNA, 23 nt, Mycobacterium avium subsp. paratuberculosis
gcgcgccgccgaugugaucggcg

SEQ ID NO: 2890288 - RNA, 16 nt, Mycobacterium avium subsp. paratuberculosis
gcgcgccgccgccgcc

SEQ ID NO: 2890289 - RNA, 17 nt, Mycobacterium avium subsp. paratuberculosis
gcgcgccgccgccgccc

SEQ ID NO: 2890290 - RNA, 20 nt, Mycobacterium avium subsp. paratuberculosis
gcgcgccgccgccgcccacg

SEQ ID NO: 2890291 - RNA, 13 nt, Mycobacterium avium subsp. paratuberculosis
gcgcgccgcgcug

SEQ ID NO: 2890292 - RNA, 20 nt, Mycobacterium avium subsp. paratuberculosis
gcgcgccgcguucggcggcg

SEQ ID NO: 2890293 - RNA, 23 nt, Mycobacterium avium subsp. paratuberculosis
gcgcgccgcguucggcggcgcgc

SEQ ID NO: 2890294 - RNA, 19 nt, Mycobacterium avium subsp. paratuberculosis
gcgcgccgcugacugcgau

SEQ ID NO: 2890295 - RNA, 15 nt, Mycobacterium avium subsp. paratuberculosis
gcgcgccggccagca

SEQ ID NO: 2890296 - RNA, 20 nt, Mycobacterium avium subsp. paratuberculosis
gcgcgccggccagcacggcg

SEQ ID NO: 2890297 - RNA, 12 nt, Mycobacterium avium subsp. paratuberculosis
gcgcgccggccc

SEQ ID NO: 2890298 - RNA, 14 nt, Mycobacterium avium subsp. paratuberculosis
gcgcgccggcccga

SEQ ID NO: 2890299 - RNA, 13 nt, Mycobacterium avium subsp. paratuberculosis
gcgcgccggccgg

SEQ ID NO: 2890300 - RNA, 18 nt, Mycobacterium avium subsp. paratuberculosis
gcgcgccggccggagcgg

SEQ ID NO: 2890301 - RNA, 16 nt, Mycobacterium avium subsp. paratuberculosis
gcgcgccggccggcac

SEQ ID NO: 2890302 - RNA, 11 nt, Mycobacterium avium subsp. paratuberculosis
gcgcgccggcg

SEQ ID NO: 2890303 - RNA, 12 nt, Mycobacterium avium subsp. paratuberculosis
gcgcgccggcga

SEQ ID NO: 2890304 - RNA, 12 nt, Mycobacterium avium subsp. paratuberculosis
gcgcgccggcgc

SEQ ID NO: 2890305 - RNA, 15 nt, Mycobacterium avium subsp. paratuberculosis
gcgcgccggcgcagc

SEQ ID NO: 2890306 - RNA, 20 nt, Mycobacterium avium subsp. paratuberculosis
gcgcgccggcgcagcggccc

SEQ ID NO: 2890307 - RNA, 17 nt, Mycobacterium avium subsp. paratuberculosis
gcgcgccggcgcgcagc

SEQ ID NO: 2890308 - RNA, 19 nt, Mycobacterium avium subsp. paratuberculosis
gcgcgccggcgcgcagcca

SEQ ID NO: 2890309 - RNA, 13 nt, Mycobacterium avium subsp. paratuberculosis
gcgcgccggcggc

SEQ ID NO: 2890310 - RNA, 16 nt, Mycobacterium avium subsp. paratuberculosis
gcgcgccggcggccgc

SEQ ID NO: 2890311 - RNA, 15 nt, Mycobacterium avium subsp. paratuberculosis
gcgcgccggcgucgg

SEQ ID NO: 2890312 - RNA, 15 nt, Mycobacterium avium subsp. paratuberculosis
gcgcgccgggcagcc

SEQ ID NO: 2890313 - RNA, 16 nt, Mycobacterium avium subsp. paratuberculosis
gcgcgccgggcagccc

SEQ ID NO: 2890314 - RNA, 17 nt, Mycobacterium avium subsp. paratuberculosis
gcgcgccgucccagccg

SEQ ID NO: 2890315 - RNA, 20 nt, Mycobacterium avium subsp. paratuberculosis
gcgcgccgucggcgaugcgg

SEQ ID NO: 2890316 - RNA, 15 nt, Mycobacterium avium subsp. paratuberculosis
gcgcgccgucggcgu

SEQ ID NO: 2890317 - RNA, 11 nt, Mycobacterium avium subsp. paratuberculosis
gcgcgccgucu

SEQ ID NO: 2890318 - RNA, 15 nt, Mycobacterium avium subsp. paratuberculosis
gcgcgccgugacgcc

SEQ ID NO: 2890319 - RNA, 18 nt, Mycobacterium avium subsp. paratuberculosis
gcgcgccuccgacgacga

SEQ ID NO: 2890320 - RNA, 23 nt, Mycobacterium avium subsp. paratuberculosis
gcgcgcgaaaaaacggcggcgga

SEQ ID NO: 2890321 - RNA, 20 nt, Mycobacterium avium subsp. paratuberculosis
gcgcgcgaaggcucgccacg

SEQ ID NO: 2890322 - RNA, 14 nt, Mycobacterium avium subsp. paratuberculosis
gcgcgcgaccgcga

SEQ ID NO: 2890323 - RNA, 14 nt, Mycobacterium avium subsp. paratuberculosis
gcgcgcgacggcgc

SEQ ID NO: 2890324 - RNA, 20 nt, Mycobacterium avium subsp. paratuberculosis
gcgcgcgagacaccucgucg

SEQ ID NO: 2890325 - RNA, 14 nt, Mycobacterium avium subsp. paratuberculosis
gcgcgcgagcguca

SEQ ID NO: 2890326 - RNA, 18 nt, Mycobacterium avium subsp. paratuberculosis
gcgcgcgagcgucacgcu

SEQ ID NO: 2890327 - RNA, 14 nt, Mycobacterium avium subsp. paratuberculosis
gcgcgcgaucagcg

SEQ ID NO: 2890328 - RNA, 14 nt, Mycobacterium avium subsp. paratuberculosis
gcgcgcgaucgccg

SEQ ID NO: 2890329 - RNA, 16 nt, Mycobacterium avium subsp. paratuberculosis
gcgcgcgaucgccggu

SEQ ID NO: 2890330 - RNA, 23 nt, Mycobacterium avium subsp. paratuberculosis
gcgcgcgaucgccggugcggccg

SEQ ID NO: 2890331 - RNA, 16 nt, Mycobacterium avium subsp. paratuberculosis
gcgcgcgaucgguguc

SEQ ID NO: 2890332 - RNA, 20 nt, Mycobacterium avium subsp. paratuberculosis
gcgcgcgauggacagcagcc

SEQ ID NO: 2890333 - RNA, 14 nt, Mycobacterium avium subsp. paratuberculosis
gcgcgcgccacgac

SEQ ID NO: 2890334 - RNA, 14 nt, Mycobacterium avium subsp. paratuberculosis
gcgcgcgccccagc

SEQ ID NO: 2890335 - RNA, 13 nt, Mycobacterium avium subsp. paratuberculosis
gcgcgcgccgauc

SEQ ID NO: 2890336 - RNA, 13 nt, Mycobacterium avium subsp. paratuberculosis
gcgcgcgccgcag

SEQ ID NO: 2890337 - RNA, 15 nt, Mycobacterium avium subsp. paratuberculosis
gcgcgcgccgcagcg

SEQ ID NO: 2890338 - RNA, 12 nt, Mycobacterium avium subsp. paratuberculosis
gcgcgcgccgcc

SEQ ID NO: 2890339 - RNA, 22 nt, Mycobacterium avium subsp. paratuberculosis
gcgcgcgccgcccccgcggcgu

SEQ ID NO: 2890340 - RNA, 14 nt, Mycobacterium avium subsp. paratuberculosis
gcgcgcgccgggau

SEQ ID NO: 2890341 - RNA, 13 nt, Mycobacterium avium subsp. paratuberculosis
gcgcgcgcgccac

SEQ ID NO: 2890342 - RNA, 14 nt, Mycobacterium avium subsp. paratuberculosis
gcgcgcgcgccacg

SEQ ID NO: 2890343 - RNA, 14 nt, Mycobacterium avium subsp. paratuberculosis
gcgcgcgcgcucgg

SEQ ID NO: 2890344 - RNA, 15 nt, Mycobacterium avium subsp. paratuberculosis
gcgcgcgcgcucggc

SEQ ID NO: 2890345 - RNA, 14 nt, Mycobacterium avium subsp. paratuberculosis
gcgcgcgcuggugc

SEQ ID NO: 2890346 - RNA, 12 nt, Mycobacterium avium subsp. paratuberculosis
gcgcgcggcacg

SEQ ID NO: 2890347 - RNA, 13 nt, Mycobacterium avium subsp. paratuberculosis
gcgcgcggcacgg

SEQ ID NO: 2890348 - RNA, 15 nt, Mycobacterium avium subsp. paratuberculosis
gcgcgcggccaccgc

SEQ ID NO: 2890349 - RNA, 20 nt, Mycobacterium avium subsp. paratuberculosis
gcgcgcggccaccgcgcgcu

SEQ ID NO: 2890350 - RNA, 16 nt, Mycobacterium avium subsp. paratuberculosis
gcgcgcggccuccagc

SEQ ID NO: 2890351 - RNA, 17 nt, Mycobacterium avium subsp. paratuberculosis
gcgcgcggccuccagcc

SEQ ID NO: 2890352 - RNA, 13 nt, Mycobacterium avium subsp. paratuberculosis
gcgcgcggcgacg

SEQ ID NO: 2890353 - RNA, 13 nt, Mycobacterium avium subsp. paratuberculosis
gcgcgcggcgcag

SEQ ID NO: 2890354 - RNA, 13 nt, Mycobacterium avium subsp. paratuberculosis
gcgcgcggcgccg

SEQ ID NO: 2890355 - RNA, 17 nt, Mycobacterium avium subsp. paratuberculosis
gcgcgcggcgcggagcc

SEQ ID NO: 2890356 - RNA, 18 nt, Mycobacterium avium subsp. paratuberculosis
gcgcgcggcgcggagccg

SEQ ID NO: 2890357 - RNA, 22 nt, Mycobacterium avium subsp. paratuberculosis
gcgcgcggcgcggagccggccg

SEQ ID NO: 2890358 - RNA, 21 nt, Mycobacterium avium subsp. paratuberculosis
gcgcgcggcggauguccuggu

SEQ ID NO: 2890359 - RNA, 15 nt, Mycobacterium avium subsp. paratuberculosis
gcgcgcggcggccac

SEQ ID NO: 2890360 - RNA, 16 nt, Mycobacterium avium subsp. paratuberculosis
gcgcgcggcggccacc

SEQ ID NO: 2890361 - RNA, 18 nt, Mycobacterium avium subsp. paratuberculosis
gcgcgcggcggccaccgc

SEQ ID NO: 2890362 - RNA, 20 nt, Mycobacterium avium subsp. paratuberculosis
gcgcgcggcgucaggggugc

SEQ ID NO: 2890363 - RNA, 13 nt, Mycobacterium avium subsp. paratuberculosis
gcgcgcgggccag

SEQ ID NO: 2890364 - RNA, 16 nt, Mycobacterium avium subsp. paratuberculosis
gcgcgcgggccagcgu

SEQ ID NO: 2890365 - RNA, 12 nt, Mycobacterium avium subsp. paratuberculosis
gcgcgcgggcgu

SEQ ID NO: 2890366 - RNA, 13 nt, Mycobacterium avium subsp. paratuberculosis
gcgcgcgggcguc

SEQ ID NO: 2890367 - RNA, 13 nt, Mycobacterium avium subsp. paratuberculosis
gcgcgcggggccg

SEQ ID NO: 2890368 - RNA, 14 nt, Mycobacterium avium subsp. paratuberculosis
gcgcgcggggccgg

SEQ ID NO: 2890369 - RNA, 15 nt, Mycobacterium avium subsp. paratuberculosis
gcgcgcggggccggc

SEQ ID NO: 2890370 - RNA, 16 nt, Mycobacterium avium subsp. paratuberculosis
gcgcgcggggccggcg

SEQ ID NO: 2890371 - RNA, 17 nt, Mycobacterium avium subsp. paratuberculosis
gcgcgcggggccggcgc

SEQ ID NO: 2890372 - RNA, 19 nt, Mycobacterium avium subsp. paratuberculosis
gcgcgcggggccggcgcgg

SEQ ID NO: 2890373 - RNA, 20 nt, Mycobacterium avium subsp. paratuberculosis
gcgcgcggggccggcgcggu

SEQ ID NO: 2890374 - RNA, 21 nt, Mycobacterium avium subsp. paratuberculosis
gcgcgcggggccggcgcggug

SEQ ID NO: 2890375 - RNA, 22 nt, Mycobacterium avium subsp. paratuberculosis
gcgcgcggggccggcgcggugc

SEQ ID NO: 2890376 - RNA, 20 nt, Mycobacterium avium subsp. paratuberculosis
gcgcgcggggugucgcggcu

SEQ ID NO: 2890377 - RNA, 22 nt, Mycobacterium avium subsp. paratuberculosis
gcgcgcggggugucgcggcugc

SEQ ID NO: 2890378 - RNA, 14 nt, Mycobacterium avium subsp. paratuberculosis
gcgcgcggugauga

SEQ ID NO: 2890379 - RNA, 17 nt, Mycobacterium avium subsp. paratuberculosis
gcgcgcggugcacgguc

SEQ ID NO: 2890380 - RNA, 17 nt, Mycobacterium avium subsp. paratuberculosis
gcgcgcggugcgccagc

SEQ ID NO: 2890381 - RNA, 12 nt, Mycobacterium avium subsp. paratuberculosis
gcgcgcgguggu

SEQ ID NO: 2890382 - RNA, 13 nt, Mycobacterium avium subsp. paratuberculosis
gcgcgcgucgacg

SEQ ID NO: 2890383 - RNA, 14 nt, Mycobacterium avium subsp. paratuberculosis
gcgcgcgucgacgu

SEQ ID NO: 2890384 - RNA, 23 nt, Mycobacterium avium subsp. paratuberculosis
gcgcgcguuguccagcagcgccg

SEQ ID NO: 2890385 - RNA, 17 nt, Mycobacterium avium subsp. paratuberculosis
gcgcgcucaaccgccca

SEQ ID NO: 2890386 - RNA, 12 nt, Mycobacterium avium subsp. paratuberculosis
gcgcgcucggcg

SEQ ID NO: 2890387 - RNA, 13 nt, Mycobacterium avium subsp. paratuberculosis
gcgcgcucggcgu

SEQ ID NO: 2890388 - RNA, 14 nt, Mycobacterium avium subsp. paratuberculosis
gcgcgcucggcguu

SEQ ID NO: 2890389 - RNA, 12 nt, Mycobacterium avium subsp. paratuberculosis
gcgcgcucgggg

SEQ ID NO: 2890390 - RNA, 20 nt, Mycobacterium avium subsp. paratuberculosis
gcgcgcucgggggugcccgg

SEQ ID NO: 2890391 - RNA, 21 nt, Mycobacterium avium subsp. paratuberculosis
gcgcgcucggucagcaccggg

SEQ ID NO: 2890392 - RNA, 13 nt, Mycobacterium avium subsp. paratuberculosis
gcgcgcucggugc

SEQ ID NO: 2890393 - RNA, 23 nt, Mycobacterium avium subsp. paratuberculosis
gcgcgcucgguggacagguagcg

SEQ ID NO: 2890394 - RNA, 13 nt, Mycobacterium avium subsp. paratuberculosis
gcgcgcucgucgu

SEQ ID NO: 2890395 - RNA, 15 nt, Mycobacterium avium subsp. paratuberculosis
gcgcgcucgucgucg

SEQ ID NO: 2890396 - RNA, 15 nt, Mycobacterium avium subsp. paratuberculosis
gcgcgcugcagcauc

SEQ ID NO: 2890397 - RNA, 14 nt, Mycobacterium avium subsp. paratuberculosis
gcgcgcugccgcgc

SEQ ID NO: 2890398 - RNA, 16 nt, Mycobacterium avium subsp. paratuberculosis
gcgcgcugccgcgccc

SEQ ID NO: 2890399 - RNA, 23 nt, Mycobacterium avium subsp. paratuberculosis
gcgcgcugccgcgccccgagcag

SEQ ID NO: 2890400 - RNA, 15 nt, Mycobacterium avium subsp. paratuberculosis
gcgcgcugcggcguc

SEQ ID NO: 2890401 - RNA, 21 nt, Mycobacterium avium subsp. paratuberculosis
gcgcgcugggcuaacgcuggu

SEQ ID NO: 2890402 - RNA, 16 nt, Mycobacterium avium subsp. paratuberculosis
gcgcgcuggugcgggc

SEQ ID NO: 2890403 - RNA, 23 nt, Mycobacterium avium subsp. paratuberculosis
gcgcgcuggugcgggccagcacg

SEQ ID NO: 2890404 - RNA, 22 nt, Mycobacterium avium subsp. paratuberculosis
gcgcgcuguaggucgcguacgg

SEQ ID NO: 2890405 - RNA, 13 nt, Mycobacterium avium subsp. paratuberculosis
gcgcgcugugcgc

SEQ ID NO: 2890406 - RNA, 20 nt, Mycobacterium avium subsp. paratuberculosis
gcgcgcuuaauacagcgcgu

SEQ ID NO: 2890407 - RNA, 23 nt, Mycobacterium avium subsp. paratuberculosis
gcgcgcuuaauacagcgcguugg

SEQ ID NO: 2890408 - RNA, 17 nt, Mycobacterium avium subsp. paratuberculosis
gcgcgcuugcgcucggu

SEQ ID NO: 2890409 - RNA, 23 nt, Mycobacterium avium subsp. paratuberculosis
gcgcgcuugcgcucggucgcggc

SEQ ID NO: 2890410 - RNA, 22 nt, Mycobacterium avium subsp. paratuberculosis
gcgcggaaacuccuggccccga

SEQ ID NO: 2890411 - RNA, 16 nt, Mycobacterium avium subsp. paratuberculosis
gcgcggaacgcgccgg

SEQ ID NO: 2890412 - RNA, 18 nt, Mycobacterium avium subsp. paratuberculosis
gcgcggaacgcgccgggc

SEQ ID NO: 2890413 - RNA, 15 nt, Mycobacterium avium subsp. paratuberculosis
gcgcggaaugcucga

SEQ ID NO: 2890414 - RNA, 19 nt, Mycobacterium avium subsp. paratuberculosis
gcgcggaaugcucgacacg

SEQ ID NO: 2890415 - RNA, 16 nt, Mycobacterium avium subsp. paratuberculosis
gcgcggacaccagguu

SEQ ID NO: 2890416 - RNA, 18 nt, Mycobacterium avium subsp. paratuberculosis
gcgcggacagcugcgcgg

SEQ ID NO: 2890417 - RNA, 12 nt, Mycobacterium avium subsp. paratuberculosis
gcgcggaccgca

SEQ ID NO: 2890418 - RNA, 15 nt, Mycobacterium avium subsp. paratuberculosis
gcgcggaccgcaccc

SEQ ID NO: 2890419 - RNA, 15 nt, Mycobacterium avium subsp. paratuberculosis
gcgcggacgcggcgg

SEQ ID NO: 2890420 - RNA, 12 nt, Mycobacterium avium subsp. paratuberculosis
gcgcggagauca

SEQ ID NO: 2890421 - RNA, 15 nt, Mycobacterium avium subsp. paratuberculosis
gcgcggagaucaccc

SEQ ID NO: 2890422 - RNA, 22 nt, Mycobacterium avium subsp. paratuberculosis
gcgcggagaucaccccuggcgg

SEQ ID NO: 2890423 - RNA, 13 nt, Mycobacterium avium subsp. paratuberculosis
gcgcggagccggc

SEQ ID NO: 2890424 - RNA, 20 nt, Mycobacterium avium subsp. paratuberculosis
gcgcggagccggccgccgaa

SEQ ID NO: 2890425 - RNA, 17 nt, Mycobacterium avium subsp. paratuberculosis
gcgcggaucucgcgcag

SEQ ID NO: 2890426 - RNA, 16 nt, Mycobacterium avium subsp. paratuberculosis
gcgcggaugcccaggc

SEQ ID NO: 2890427 - RNA, 16 nt, Mycobacterium avium subsp. paratuberculosis
gcgcggauggguggcg

SEQ ID NO: 2890428 - RNA, 20 nt, Mycobacterium avium subsp. paratuberculosis
gcgcggauggguggcgauca

SEQ ID NO: 2890429 - RNA, 16 nt, Mycobacterium avium subsp. paratuberculosis
gcgcggauuccagcgc

SEQ ID NO: 2890430 - RNA, 18 nt, Mycobacterium avium subsp. paratuberculosis
gcgcggauuccagcgcga

SEQ ID NO: 2890431 - RNA, 19 nt, Mycobacterium avium subsp. paratuberculosis
gcgcggauuccagcgcgac

SEQ ID NO: 2890432 - RNA, 21 nt, Mycobacterium avium subsp. paratuberculosis
gcgcggcgacgguggcgggcc

SEQ ID NO: 2890433 - RNA, 14 nt, Mycobacterium avium subsp. paratuberculosis
gcgcggcgacguga

SEQ ID NO: 2890434 - RNA, 15 nt, Mycobacterium avium subsp. paratuberculosis
gcgcggcgagcggca

SEQ ID NO: 2890435 - RNA, 21 nt, Mycobacterium avium subsp. paratuberculosis
gcgcggcgaucagcagcaccc

SEQ ID NO: 2890436 - RNA, 18 nt, Mycobacterium avium subsp. paratuberculosis
gcgcggcgaucagcugcu

SEQ ID NO: 2890437 - RNA, 23 nt, Mycobacterium avium subsp. paratuberculosis
gcgcggcgaucgucaugccuugg

SEQ ID NO: 2890438 - RNA, 19 nt, Mycobacterium avium subsp. paratuberculosis
gcgcggcgaucucggcggc

SEQ ID NO: 2890439 - RNA, 22 nt, Mycobacterium avium subsp. paratuberculosis
gcgcggcgaugaccgccugcgg

SEQ ID NO: 2890440 - RNA, 12 nt, Mycobacterium avium subsp. paratuberculosis
gcgcggcgaugc

SEQ ID NO: 2890441 - RNA, 13 nt, Mycobacterium avium subsp. paratuberculosis
gcgcggcgaugcg

SEQ ID NO: 2890442 - RNA, 21 nt, Mycobacterium avium subsp. paratuberculosis
gcgcggcgaugcgcuccagca

SEQ ID NO: 2890443 - RNA, 18 nt, Mycobacterium avium subsp. paratuberculosis
gcgcggcgauggccgaca

SEQ ID NO: 2890444 - RNA, 13 nt, Mycobacterium avium subsp. paratuberculosis
gcgcggcgcaccg

SEQ ID NO: 2890445 - RNA, 18 nt, Mycobacterium avium subsp. paratuberculosis
gcgcggcgcaccgagucg

SEQ ID NO: 2890446 - RNA, 15 nt, Mycobacterium avium subsp. paratuberculosis
gcgcggcgcaccgcc

SEQ ID NO: 2890447 - RNA, 18 nt, Mycobacterium avium subsp. paratuberculosis
gcgcggcgcaccgcccgc

SEQ ID NO: 2890448 - RNA, 20 nt, Mycobacterium avium subsp. paratuberculosis
gcgcggcgcagcgcgauguc

SEQ ID NO: 2890449 - RNA, 15 nt, Mycobacterium avium subsp. paratuberculosis
gcgcggcgccagcgg

SEQ ID NO: 2890450 - RNA, 13 nt, Mycobacterium avium subsp. paratuberculosis
gcgcggcgcccag

SEQ ID NO: 2890451 - RNA, 14 nt, Mycobacterium avium subsp. paratuberculosis
gcgcggcgcccagg

SEQ ID NO: 2890452 - RNA, 12 nt, Mycobacterium avium subsp. paratuberculosis
gcgcggcgcccc

SEQ ID NO: 2890453 - RNA, 15 nt, Mycobacterium avium subsp. paratuberculosis
gcgcggcgcccccgc

SEQ ID NO: 2890454 - RNA, 17 nt, Mycobacterium avium subsp. paratuberculosis
gcgcggcgcccccgcga

SEQ ID NO: 2890455 - RNA, 14 nt, Mycobacterium avium subsp. paratuberculosis
gcgcggcgccgcgu

SEQ ID NO: 2890456 - RNA, 21 nt, Mycobacterium avium subsp. paratuberculosis
gcgcggcgcgaggcgcggggc

SEQ ID NO: 2890457 - RNA, 12 nt, Mycobacterium avium subsp. paratuberculosis
gcgcggcgcgcg

SEQ ID NO: 2890458 - RNA, 15 nt, Mycobacterium avium subsp. paratuberculosis
gcgcggcgcggagcc

SEQ ID NO: 2890459 - RNA, 18 nt, Mycobacterium avium subsp. paratuberculosis
gcgcggcgcggagccggc

SEQ ID NO: 2890460 - RNA, 13 nt, Mycobacterium avium subsp. paratuberculosis
gcgcggcggaggu

SEQ ID NO: 2890461 - RNA, 18 nt, Mycobacterium avium subsp. paratuberculosis
gcgcggcggaggucagcg

SEQ ID NO: 2890462 - RNA, 21 nt, Mycobacterium avium subsp. paratuberculosis
gcgcggcggaggucagcggcc

SEQ ID NO: 2890463 - RNA, 22 nt, Mycobacterium avium subsp. paratuberculosis
gcgcggcggaggucagcggccc

SEQ ID NO: 2890464 - RNA, 12 nt, Mycobacterium avium subsp. paratuberculosis
gcgcggcggcaa

SEQ ID NO: 2890465 - RNA, 23 nt, Mycobacterium avium subsp. paratuberculosis
gcgcggcggcaaccagcuccggc

SEQ ID NO: 2890466 - RNA, 15 nt, Mycobacterium avium subsp. paratuberculosis
gcgcggcggccaccu

SEQ ID NO: 2890467 - RNA, 21 nt, Mycobacterium avium subsp. paratuberculosis
gcgcggcggccaccucggcgg

SEQ ID NO: 2890468 - RNA, 13 nt, Mycobacterium avium subsp. paratuberculosis
gcgcggcggccag

SEQ ID NO: 2890469 - RNA, 12 nt, Mycobacterium avium subsp. paratuberculosis
gcgcggcggccg

SEQ ID NO: 2890470 - RNA, 14 nt, Mycobacterium avium subsp. paratuberculosis
gcgcggcggccggc

SEQ ID NO: 2890471 - RNA, 14 nt, Mycobacterium avium subsp. paratuberculosis
gcgcggcggccucg

SEQ ID NO: 2890472 - RNA, 18 nt, Mycobacterium avium subsp. paratuberculosis
gcgcggcggccucggugg

SEQ ID NO: 2890473 - RNA, 20 nt, Mycobacterium avium subsp. paratuberculosis
gcgcggcggccucggugguc

SEQ ID NO: 2890474 - RNA, 12 nt, Mycobacterium avium subsp. paratuberculosis
gcgcggcggcgc

SEQ ID NO: 2890475 - RNA, 13 nt, Mycobacterium avium subsp. paratuberculosis
gcgcggcggcgcc

SEQ ID NO: 2890476 - RNA, 14 nt, Mycobacterium avium subsp. paratuberculosis
gcgcggcggcgccg

SEQ ID NO: 2890477 - RNA, 22 nt, Mycobacterium avium subsp. paratuberculosis
gcgcggcggcgccgucgccgau

SEQ ID NO: 2890478 - RNA, 15 nt, Mycobacterium avium subsp. paratuberculosis
gcgcggcggcggcgc

SEQ ID NO: 2890479 - RNA, 13 nt, Mycobacterium avium subsp. paratuberculosis
gcgcggcggcguc

SEQ ID NO: 2890480 - RNA, 12 nt, Mycobacterium avium subsp. paratuberculosis
gcgcggcgggcc

SEQ ID NO: 2890481 - RNA, 13 nt, Mycobacterium avium subsp. paratuberculosis
gcgcggcgggcca

SEQ ID NO: 2890482 - RNA, 14 nt, Mycobacterium avium subsp. paratuberculosis
gcgcggcgggccag

SEQ ID NO: 2890483 - RNA, 13 nt, Mycobacterium avium subsp. paratuberculosis
gcgcggcgggccc

SEQ ID NO: 2890484 - RNA, 14 nt, Mycobacterium avium subsp. paratuberculosis
gcgcggcgggcccg

SEQ ID NO: 2890485 - RNA, 15 nt, Mycobacterium avium subsp. paratuberculosis
gcgcggcgggcccgc

SEQ ID NO: 2890486 - RNA, 15 nt, Mycobacterium avium subsp. paratuberculosis
gcgcggcgguccagc

SEQ ID NO: 2890487 - RNA, 18 nt, Mycobacterium avium subsp. paratuberculosis
gcgcggcggucgcgcgcc

SEQ ID NO: 2890488 - RNA, 20 nt, Mycobacterium avium subsp. paratuberculosis
gcgcggcggucgcgcgccgg

SEQ ID NO: 2890489 - RNA, 21 nt, Mycobacterium avium subsp. paratuberculosis
gcgcggcggucgcgcgccggc

SEQ ID NO: 2890490 - RNA, 12 nt, Mycobacterium avium subsp. paratuberculosis
gcgcggcgguga

SEQ ID NO: 2890491 - RNA, 12 nt, Mycobacterium avium subsp. paratuberculosis
gcgcggcggugc

SEQ ID NO: 2890492 - RNA, 14 nt, Mycobacterium avium subsp. paratuberculosis
gcgcggcggugcuc

SEQ ID NO: 2890493 - RNA, 15 nt, Mycobacterium avium subsp. paratuberculosis
gcgcggcggugcucg

SEQ ID NO: 2890494 - RNA, 13 nt, Mycobacterium avium subsp. paratuberculosis
gcgcggcgguggu

SEQ ID NO: 2890495 - RNA, 17 nt, Mycobacterium avium subsp. paratuberculosis
gcgcggcggugucggug

SEQ ID NO: 2890496 - RNA, 18 nt, Mycobacterium avium subsp. paratuberculosis
gcgcggcguagccgccgg

SEQ ID NO: 2890497 - RNA, 19 nt, Mycobacterium avium subsp. paratuberculosis
gcgcggcguagccgccggu

SEQ ID NO: 2890498 - RNA, 14 nt, Mycobacterium avium subsp. paratuberculosis
gcgcggcgucaggg

SEQ ID NO: 2890499 - RNA, 20 nt, Mycobacterium avium subsp. paratuberculosis
gcgcggcgucaggggugcca

SEQ ID NO: 2890500 - RNA, 17 nt, Mycobacterium avium subsp. paratuberculosis
gcgcggcguccaccagc

SEQ ID NO: 2890501 - RNA, 18 nt, Mycobacterium avium subsp. paratuberculosis
gcgcggcguccaccagca

SEQ ID NO: 2890502 - RNA, 15 nt, Mycobacterium avium subsp. paratuberculosis
gcgcggcguccucga

SEQ ID NO: 2890503 - RNA, 16 nt, Mycobacterium avium subsp. paratuberculosis
gcgcggcguccucgau

SEQ ID NO: 2890504 - RNA, 17 nt, Mycobacterium avium subsp. paratuberculosis
gcgcggcgugguagccg

SEQ ID NO: 2890505 - RNA, 18 nt, Mycobacterium avium subsp. paratuberculosis
gcgcggcguucagcagcg

SEQ ID NO: 2890506 - RNA, 17 nt, Mycobacterium avium subsp. paratuberculosis
gcgcggcguucuccagc

SEQ ID NO: 2890507 - RNA, 23 nt, Mycobacterium avium subsp. paratuberculosis
gcgcggcguucuccagcacccgc

SEQ ID NO: 2890508 - RNA, 22 nt, Mycobacterium avium subsp. paratuberculosis
gcgcggcuaauucagcugcgga

SEQ ID NO: 2890509 - RNA, 22 nt, Mycobacterium avium subsp. paratuberculosis
gcgcggcuacagcaacauccug

SEQ ID NO: 2890510 - RNA, 23 nt, Mycobacterium avium subsp. paratuberculosis
gcgcggcucacgacuccuggccg

SEQ ID NO: 2890511 - RNA, 12 nt, Mycobacterium avium subsp. paratuberculosis
gcgcggcucgcg

SEQ ID NO: 2890512 - RNA, 13 nt, Mycobacterium avium subsp. paratuberculosis
gcgcggcucgcgg

SEQ ID NO: 2890513 - RNA, 15 nt, Mycobacterium avium subsp. paratuberculosis
gcgcggcucgcgggc

SEQ ID NO: 2890514 - RNA, 19 nt, Mycobacterium avium subsp. paratuberculosis
gcgcggcuggccgucgucg

SEQ ID NO: 2890515 - RNA, 20 nt, Mycobacterium avium subsp. paratuberculosis
gcgcggcuggccgucgucga

SEQ ID NO: 2890516 - RNA, 22 nt, Mycobacterium avium subsp. paratuberculosis
gcgcggcuuuuggcgucguuga

SEQ ID NO: 2890517 - RNA, 21 nt, Mycobacterium avium subsp. paratuberculosis
gcgcggugaagucggugccca

SEQ ID NO: 2890518 - RNA, 17 nt, Mycobacterium avium subsp. paratuberculosis
gcgcggugagcagcaug

SEQ ID NO: 2890519 - RNA, 15 nt, Mycobacterium avium subsp. paratuberculosis
gcgcggugaugaccu

SEQ ID NO: 2890520 - RNA, 16 nt, Mycobacterium avium subsp. paratuberculosis
gcgcggugaugaccuc

SEQ ID NO: 2890521 - RNA, 17 nt, Mycobacterium avium subsp. paratuberculosis
gcgcggugaugugcagg

SEQ ID NO: 2890522 - RNA, 21 nt, Mycobacterium avium subsp. paratuberculosis
gcgcggugauguugucgaaca

SEQ ID NO: 2890523 - RNA, 13 nt, Mycobacterium avium subsp. paratuberculosis
gcgcggugcacca

SEQ ID NO: 2890524 - RNA, 19 nt, Mycobacterium avium subsp. paratuberculosis
gcgcggugcaccaggacgc

SEQ ID NO: 2890525 - RNA, 14 nt, Mycobacterium avium subsp. paratuberculosis
gcgcggugcacggu

SEQ ID NO: 2890526 - RNA, 19 nt, Mycobacterium avium subsp. paratuberculosis
gcgcggugcccagccaggc

SEQ ID NO: 2890527 - RNA, 14 nt, Mycobacterium avium subsp. paratuberculosis
gcgcggugcccgga

SEQ ID NO: 2890528 - RNA, 20 nt, Mycobacterium avium subsp. paratuberculosis
gcgcggugcgccagcgccgg

SEQ ID NO: 2890529 - RNA, 22 nt, Mycobacterium avium subsp. paratuberculosis
gcgcggugcgccgacagcugag

SEQ ID NO: 2890530 - RNA, 15 nt, Mycobacterium avium subsp. paratuberculosis
gcgcggugcucgccc

SEQ ID NO: 2890531 - RNA, 15 nt, Mycobacterium avium subsp. paratuberculosis
gcgcggugcucggcg

SEQ ID NO: 2890532 - RNA, 12 nt, Mycobacterium avium subsp. paratuberculosis
gcgcgguggcgc

SEQ ID NO: 2890533 - RNA, 12 nt, Mycobacterium avium subsp. paratuberculosis
gcgcgguggcgu

SEQ ID NO: 2890534 - RNA, 16 nt, Mycobacterium avium subsp. paratuberculosis
gcgcggugggcggcgg

SEQ ID NO: 2890535 - RNA, 15 nt, Mycobacterium avium subsp. paratuberculosis
gcgcgguggucagca

SEQ ID NO: 2890536 - RNA, 18 nt, Mycobacterium avium subsp. paratuberculosis
gcgcgguggucagcaccg

SEQ ID NO: 2890537 - RNA, 21 nt, Mycobacterium avium subsp. paratuberculosis
gcgcgguggucagcaccggcg

SEQ ID NO: 2890538 - RNA, 22 nt, Mycobacterium avium subsp. paratuberculosis
gcgcggugguguugcggugguc

SEQ ID NO: 2890539 - RNA, 19 nt, Mycobacterium avium subsp. paratuberculosis
gcgcgguguacagcgcgcc

SEQ ID NO: 2890540 - RNA, 15 nt, Mycobacterium avium subsp. paratuberculosis
gcgcggugucgacgu

SEQ ID NO: 2890541 - RNA, 22 nt, Mycobacterium avium subsp. paratuberculosis
gcgcggugucgacgucgguggu

SEQ ID NO: 2890542 - RNA, 18 nt, Mycobacterium avium subsp. paratuberculosis
gcgcggugugcggcggcu

SEQ ID NO: 2890543 - RNA, 23 nt, Mycobacterium avium subsp. paratuberculosis
gcgcggugugggcgauggcggcg

SEQ ID NO: 2890544 - RNA, 22 nt, Mycobacterium avium subsp. paratuberculosis
gcgcgguguuuggccgcgcagc

SEQ ID NO: 2890545 - RNA, 23 nt, Mycobacterium avium subsp. paratuberculosis
gcgcgguguuuggccgcgcagcu

SEQ ID NO: 2890546 - RNA, 16 nt, Mycobacterium avium subsp. paratuberculosis
gcgcgguuccggcgug

SEQ ID NO: 2890547 - RNA, 22 nt, Mycobacterium avium subsp. paratuberculosis
gcgcgguuccggcgugcagcac

SEQ ID NO: 2890548 - RNA, 22 nt, Mycobacterium avium subsp. paratuberculosis
gcgcgguucuuggcguaguggu

SEQ ID NO: 2890549 - RNA, 15 nt, Mycobacterium avium subsp. paratuberculosis
gcgcgguugcccgca

SEQ ID NO: 2890550 - RNA, 18 nt, Mycobacterium avium subsp. paratuberculosis
gcgcgguugcccgcaccc

SEQ ID NO: 2890551 - RNA, 16 nt, Mycobacterium avium subsp. paratuberculosis
gcgcgguugucguuga

SEQ ID NO: 2890552 - RNA, 18 nt, Mycobacterium avium subsp. paratuberculosis
gcgcgguuuccggcgauu

SEQ ID NO: 2890553 - RNA, 21 nt, Mycobacterium avium subsp. paratuberculosis
gcgcgguuuccggcgauucga

SEQ ID NO: 2890554 - RNA, 15 nt, Mycobacterium avium subsp. paratuberculosis
gcgcgguuucggcgu

SEQ ID NO: 2890555 - RNA, 23 nt, Mycobacterium avium subsp. paratuberculosis
gcgcguaaaggaugucgccgcag

SEQ ID NO: 2890556 - RNA, 17 nt, Mycobacterium avium subsp. paratuberculosis
gcgcguacacgaugccc

SEQ ID NO: 2890557 - RNA, 13 nt, Mycobacterium avium subsp. paratuberculosis
gcgcguacagguc

SEQ ID NO: 2890558 - RNA, 14 nt, Mycobacterium avium subsp. paratuberculosis
gcgcguacaggucg

SEQ ID NO: 2890559 - RNA, 16 nt, Mycobacterium avium subsp. paratuberculosis
gcgcguagagcaucag

SEQ ID NO: 2890560 - RNA, 20 nt, Mycobacterium avium subsp. paratuberculosis
gcgcguagagcaucaggucg

SEQ ID NO: 2890561 - RNA, 14 nt, Mycobacterium avium subsp. paratuberculosis
gcgcguagucggcg

SEQ ID NO: 2890562 - RNA, 15 nt, Mycobacterium avium subsp. paratuberculosis
gcgcguagucggcgu

SEQ ID NO: 2890563 - RNA, 16 nt, Mycobacterium avium subsp. paratuberculosis
gcgcguagucggcguc

SEQ ID NO: 2890564 - RNA, 22 nt, Mycobacterium avium subsp. paratuberculosis
gcgcguagucggcgucggccac

SEQ ID NO: 2890565 - RNA, 20 nt, Mycobacterium avium subsp. paratuberculosis
gcgcguauuccagcgccagc

SEQ ID NO: 2890566 - RNA, 19 nt, Mycobacterium avium subsp. paratuberculosis
gcgcgucacgcuggcguga

SEQ ID NO: 2890567 - RNA, 13 nt, Mycobacterium avium subsp. paratuberculosis
gcgcgucagccgu

SEQ ID NO: 2890568 - RNA, 14 nt, Mycobacterium avium subsp. paratuberculosis
gcgcguccaaccgc

SEQ ID NO: 2890569 - RNA, 18 nt, Mycobacterium avium subsp. paratuberculosis
gcgcguccaaccgcggac

SEQ ID NO: 2890570 - RNA, 15 nt, Mycobacterium avium subsp. paratuberculosis
gcgcguccaggugcg

SEQ ID NO: 2890571 - RNA, 17 nt, Mycobacterium avium subsp. paratuberculosis
gcgcguccaggugcgcc

SEQ ID NO: 2890572 - RNA, 16 nt, Mycobacterium avium subsp. paratuberculosis
gcgcguccauggucga

SEQ ID NO: 2890573 - RNA, 19 nt, Mycobacterium avium subsp. paratuberculosis
gcgcguccauggucgagcc

SEQ ID NO: 2890574 - RNA, 12 nt, Mycobacterium avium subsp. paratuberculosis
gcgcguccgcgg

SEQ ID NO: 2890575 - RNA, 14 nt, Mycobacterium avium subsp. paratuberculosis
gcgcguccggaggu

SEQ ID NO: 2890576 - RNA, 23 nt, Mycobacterium avium subsp. paratuberculosis
gcgcguccggaggugccggccgg

SEQ ID NO: 2890577 - RNA, 16 nt, Mycobacterium avium subsp. paratuberculosis
gcgcgucgacaccccg

SEQ ID NO: 2890578 - RNA, 18 nt, Mycobacterium avium subsp. paratuberculosis
gcgcgucgacaccccgcu

SEQ ID NO: 2890579 - RNA, 17 nt, Mycobacterium avium subsp. paratuberculosis
gcgcgucgaccagccgc

SEQ ID NO: 2890580 - RNA, 20 nt, Mycobacterium avium subsp. paratuberculosis
gcgcgucgacguucgccgcc

SEQ ID NO: 2890581 - RNA, 12 nt, Mycobacterium avium subsp. paratuberculosis
gcgcgucgagca

SEQ ID NO: 2890582 - RNA, 16 nt, Mycobacterium avium subsp. paratuberculosis
gcgcgucgagcagcac

SEQ ID NO: 2890583 - RNA, 17 nt, Mycobacterium avium subsp. paratuberculosis
gcgcgucgaggucgcgc

SEQ ID NO: 2890584 - RNA, 18 nt, Mycobacterium avium subsp. paratuberculosis
gcgcgucgaggucgcgca

SEQ ID NO: 2890585 - RNA, 20 nt, Mycobacterium avium subsp. paratuberculosis
gcgcgucgaggucgcgcagc

SEQ ID NO: 2890586 - RNA, 21 nt, Mycobacterium avium subsp. paratuberculosis
gcgcgucgaggucgucgggcg

SEQ ID NO: 2890587 - RNA, 14 nt, Mycobacterium avium subsp. paratuberculosis
gcgcgucgaucgcg

SEQ ID NO: 2890588 - RNA, 15 nt, Mycobacterium avium subsp. paratuberculosis
gcgcgucgcgcagcg

SEQ ID NO: 2890589 - RNA, 15 nt, Mycobacterium avium subsp. paratuberculosis
gcgcgucgcgcccgg

SEQ ID NO: 2890590 - RNA, 19 nt, Mycobacterium avium subsp. paratuberculosis
gcgcgucgcgguggagcac

SEQ ID NO: 2890591 - RNA, 14 nt, Mycobacterium avium subsp. paratuberculosis
gcgcgucgcugccg

SEQ ID NO: 2890592 - RNA, 13 nt, Mycobacterium avium subsp. paratuberculosis
gcgcgucgcuggg

SEQ ID NO: 2890593 - RNA, 20 nt, Mycobacterium avium subsp. paratuberculosis
gcgcgucgcugggcagccgu

SEQ ID NO: 2890594 - RNA, 20 nt, Mycobacterium avium subsp. paratuberculosis
gcgcgucggccagcaccacc

SEQ ID NO: 2890595 - RNA, 21 nt, Mycobacterium avium subsp. paratuberculosis
gcgcgucggccagcaccacca

SEQ ID NO: 2890596 - RNA, 14 nt, Mycobacterium avium subsp. paratuberculosis
gcgcgucggccgca

SEQ ID NO: 2890597 - RNA, 15 nt, Mycobacterium avium subsp. paratuberculosis
gcgcgucggccgcac

SEQ ID NO: 2890598 - RNA, 16 nt, Mycobacterium avium subsp. paratuberculosis
gcgcgucggccgcaca

SEQ ID NO: 2890599 - RNA, 15 nt, Mycobacterium avium subsp. paratuberculosis
gcgcgucggcgaccg

SEQ ID NO: 2890600 - RNA, 18 nt, Mycobacterium avium subsp. paratuberculosis
gcgcgucgggcucgcggu

SEQ ID NO: 2890601 - RNA, 14 nt, Mycobacterium avium subsp. paratuberculosis
gcgcgucgggggug

SEQ ID NO: 2890602 - RNA, 19 nt, Mycobacterium avium subsp. paratuberculosis
gcgcuaccgcgcucaccgu

SEQ ID NO: 2890603 - RNA, 20 nt, Mycobacterium avium subsp. paratuberculosis
gcgcuaccgcgcucaccguc

SEQ ID NO: 2890604 - RNA, 16 nt, Mycobacterium avium subsp. paratuberculosis
gcgcuacgccggcucg

SEQ ID NO: 2890605 - RNA, 18 nt, Mycobacterium avium subsp. paratuberculosis
gcgcuacgccggcucggu

SEQ ID NO: 2890606 - RNA, 19 nt, Mycobacterium avium subsp. paratuberculosis
gcgcuacgccggcucgguc

SEQ ID NO: 2890607 - RNA, 19 nt, Mycobacterium avium subsp. paratuberculosis
gcgcuagcugcgccggcuu

SEQ ID NO: 2890608 - RNA, 16 nt, Mycobacterium avium subsp. paratuberculosis
gcgcucaacccgggcc

SEQ ID NO: 2890609 - RNA, 13 nt, Mycobacterium avium subsp. paratuberculosis
gcgcucaaccgcc

SEQ ID NO: 2890610 - RNA, 15 nt, Mycobacterium avium subsp. paratuberculosis
gcgcucaaccgccca

SEQ ID NO: 2890611 - RNA, 17 nt, Mycobacterium avium subsp. paratuberculosis
gcgcucaaccgcccagc

SEQ ID NO: 2890612 - RNA, 23 nt, Mycobacterium avium subsp. paratuberculosis
gcgcucaagaugauugcgugccc

SEQ ID NO: 2890613 - RNA, 22 nt, Mycobacterium avium subsp. paratuberculosis
gcgcucaccgcaucgaaccgcc

SEQ ID NO: 2890614 - RNA, 13 nt, Mycobacterium avium subsp. paratuberculosis
gcgcucaccgcga

SEQ ID NO: 2890615 - RNA, 14 nt, Mycobacterium avium subsp. paratuberculosis
gcgcucaccggcgu

SEQ ID NO: 2890616 - RNA, 16 nt, Mycobacterium avium subsp. paratuberculosis
gcgcucagcacgcgga

SEQ ID NO: 2890617 - RNA, 17 nt, Mycobacterium avium subsp. paratuberculosis
gcgcucagcgcggccac

SEQ ID NO: 2890618 - RNA, 20 nt, Mycobacterium avium subsp. paratuberculosis
gcgcucagcgcggccacacc

SEQ ID NO: 2890619 - RNA, 18 nt, Mycobacterium avium subsp. paratuberculosis
gcgcucagcgcggcgggc

SEQ ID NO: 2890620 - RNA, 13 nt, Mycobacterium avium subsp. paratuberculosis
gcgcucagcggca

SEQ ID NO: 2890621 - RNA, 16 nt, Mycobacterium avium subsp. paratuberculosis
gcgcucagcggcagcg

SEQ ID NO: 2890622 - RNA, 19 nt, Mycobacterium avium subsp. paratuberculosis
gcgcucagcggcagcgucg

SEQ ID NO: 2890623 - RNA, 13 nt, Mycobacterium avium subsp. paratuberculosis
gcgcucagugcac

SEQ ID NO: 2890624 - RNA, 21 nt, Mycobacterium avium subsp. paratuberculosis
gcgcucagugcacgcucggcg

SEQ ID NO: 2890625 - RNA, 21 nt, Mycobacterium avium subsp. paratuberculosis
gcgcucaucaggcggccggcc

SEQ ID NO: 2890626 - RNA, 23 nt, Mycobacterium avium subsp. paratuberculosis
gcgcucaucaggcggccggcccg

SEQ ID NO: 2890627 - RNA, 13 nt, Mycobacterium avium subsp. paratuberculosis
gcgcuccaccacc

SEQ ID NO: 2890628 - RNA, 23 nt, Mycobacterium avium subsp. paratuberculosis
gcgcuccaccagguucgcgcagc

SEQ ID NO: 2890629 - RNA, 12 nt, Mycobacterium avium subsp. paratuberculosis
gcgcuccagcag

SEQ ID NO: 2890630 - RNA, 13 nt, Mycobacterium avium subsp. paratuberculosis
gcgcuccagcagg

SEQ ID NO: 2890631 - RNA, 19 nt, Mycobacterium avium subsp. paratuberculosis
gcgcuccagcaggcuggcg

SEQ ID NO: 2890632 - RNA, 21 nt, Mycobacterium avium subsp. paratuberculosis
gcgcuccagcaggcuggcguu

SEQ ID NO: 2890633 - RNA, 14 nt, Mycobacterium avium subsp. paratuberculosis
gcgcuccagcgggc

SEQ ID NO: 2890634 - RNA, 17 nt, Mycobacterium avium subsp. paratuberculosis
gcgcuccagcgggcggc

SEQ ID NO: 2890635 - RNA, 18 nt, Mycobacterium avium subsp. paratuberculosis
gcgcuccagcgggcggcg

SEQ ID NO: 2890636 - RNA, 20 nt, Mycobacterium avium subsp. paratuberculosis
gcgcucccgauggcucgcgg

SEQ ID NO: 2890637 - RNA, 13 nt, Mycobacterium avium subsp. paratuberculosis
gcgcucccggcgc

SEQ ID NO: 2890638 - RNA, 14 nt, Mycobacterium avium subsp. paratuberculosis
gcgcucccggcgcc

SEQ ID NO: 2890639 - RNA, 16 nt, Mycobacterium avium subsp. paratuberculosis
gcgcucccggcgccgc

SEQ ID NO: 2890640 - RNA, 17 nt, Mycobacterium avium subsp. paratuberculosis
gcgcucccggcgccgcc

SEQ ID NO: 2890641 - RNA, 13 nt, Mycobacterium avium subsp. paratuberculosis
gcgcuccguuggg

SEQ ID NO: 2890642 - RNA, 13 nt, Mycobacterium avium subsp. paratuberculosis
gcgcuccucgacg

SEQ ID NO: 2890643 - RNA, 14 nt, Mycobacterium avium subsp. paratuberculosis
gcgcuccucgacgu

SEQ ID NO: 2890644 - RNA, 14 nt, Mycobacterium avium subsp. paratuberculosis
gcgcuccugccagc

SEQ ID NO: 2890645 - RNA, 17 nt, Mycobacterium avium subsp. paratuberculosis
gcgcuccugccagcggc

SEQ ID NO: 2890646 - RNA, 21 nt, Mycobacterium avium subsp. paratuberculosis
gcgcuccugccagcggcgcaa

SEQ ID NO: 2890647 - RNA, 17 nt, Mycobacterium avium subsp. paratuberculosis
gcgcuccuggccggacg

SEQ ID NO: 2890648 - RNA, 20 nt, Mycobacterium avium subsp. paratuberculosis
gcgcucgaacucaccggugg

SEQ ID NO: 2890649 - RNA, 21 nt, Mycobacterium avium subsp. paratuberculosis
gcgcucgaacucaccgguggc

SEQ ID NO: 2890650 - RNA, 22 nt, Mycobacterium avium subsp. paratuberculosis
gcgcucgaacucaccgguggcc

SEQ ID NO: 2890651 - RNA, 15 nt, Mycobacterium avium subsp. paratuberculosis
gcgcucgaccucggc

SEQ ID NO: 2890652 - RNA, 20 nt, Mycobacterium avium subsp. paratuberculosis
gcgcucgaccucggcggcca

SEQ ID NO: 2890653 - RNA, 21 nt, Mycobacterium avium subsp. paratuberculosis
gcgcucgaccucggcggccag

SEQ ID NO: 2890654 - RNA, 19 nt, Mycobacterium avium subsp. paratuberculosis
gcgcucgacgaggcgggcg

SEQ ID NO: 2890655 - RNA, 20 nt, Mycobacterium avium subsp. paratuberculosis
gcgcucgacgaugucgacgc

SEQ ID NO: 2890656 - RNA, 12 nt, Mycobacterium avium subsp. paratuberculosis
gcgcucgacggc

SEQ ID NO: 2890657 - RNA, 14 nt, Mycobacterium avium subsp. paratuberculosis
gcgcucgacggccu

SEQ ID NO: 2890658 - RNA, 22 nt, Mycobacterium avium subsp. paratuberculosis
gcgcucgauggaauucgucggc

SEQ ID NO: 2890659 - RNA, 17 nt, Mycobacterium avium subsp. paratuberculosis
gcgcucgcacaacccgc

SEQ ID NO: 2890660 - RNA, 12 nt, Mycobacterium avium subsp. paratuberculosis
gcgcucgcacca

SEQ ID NO: 2890661 - RNA, 16 nt, Mycobacterium avium subsp. paratuberculosis
gcgcucgcaccagcgc

SEQ ID NO: 2890662 - RNA, 17 nt, Mycobacterium avium subsp. paratuberculosis
gcgcucgcaccagcgcu

SEQ ID NO: 2890663 - RNA, 18 nt, Mycobacterium avium subsp. paratuberculosis
gcgcucgcaccagcgcuu

SEQ ID NO: 2890664 - RNA, 14 nt, Mycobacterium avium subsp. paratuberculosis
gcgcucgccgcgcg

SEQ ID NO: 2890665 - RNA, 16 nt, Mycobacterium avium subsp. paratuberculosis
gcgcucgccgcgcggc

SEQ ID NO: 2890666 - RNA, 12 nt, Mycobacterium avium subsp. paratuberculosis
gcgcucgccguc

SEQ ID NO: 2890667 - RNA, 13 nt, Mycobacterium avium subsp. paratuberculosis
gcgcucgccgucg

SEQ ID NO: 2890668 - RNA, 16 nt, Mycobacterium avium subsp. paratuberculosis
gcgcucgccgucggcc

SEQ ID NO: 2890669 - RNA, 18 nt, Mycobacterium avium subsp. paratuberculosis
gcgcucgccgucggccag

SEQ ID NO: 2890670 - RNA, 22 nt, Mycobacterium avium subsp. paratuberculosis
gcgcucgcggauguccgaccgg

SEQ ID NO: 2890671 - RNA, 13 nt, Mycobacterium avium subsp. paratuberculosis
gcgcucgcgggug

SEQ ID NO: 2890672 - RNA, 17 nt, Mycobacterium avium subsp. paratuberculosis
gcgcucgcgggugcgcu

SEQ ID NO: 2890673 - RNA, 14 nt, Mycobacterium avium subsp. paratuberculosis
gcgcucggcccgcu

SEQ ID NO: 2890674 - RNA, 13 nt, Mycobacterium avium subsp. paratuberculosis
gcgcucggccggg

SEQ ID NO: 2890675 - RNA, 14 nt, Mycobacterium avium subsp. paratuberculosis
gcgcucggccgggu

SEQ ID NO: 2890676 - RNA, 15 nt, Mycobacterium avium subsp. paratuberculosis
gcgcucggccggguu

SEQ ID NO: 2890677 - RNA, 23 nt, Mycobacterium avium subsp. paratuberculosis
gcgcucggccggguuguccuggc

SEQ ID NO: 2890678 - RNA, 12 nt, Mycobacterium avium subsp. paratuberculosis
gcgcucggcgac

SEQ ID NO: 2890679 - RNA, 14 nt, Mycobacterium avium subsp. paratuberculosis
gcgcucggcgaccg

SEQ ID NO: 2890680 - RNA, 18 nt, Mycobacterium avium subsp. paratuberculosis
gcgcucggcgaccgccgg

SEQ ID NO: 2890681 - RNA, 19 nt, Mycobacterium avium subsp. paratuberculosis
gcgcucgggggugcccggc

SEQ ID NO: 2890682 - RNA, 13 nt, Mycobacterium avium subsp. paratuberculosis
gcgcucggucgcg

SEQ ID NO: 2890683 - RNA, 15 nt, Mycobacterium avium subsp. paratuberculosis
gcgcucggucgcggc

SEQ ID NO: 2890684 - RNA, 19 nt, Mycobacterium avium subsp. paratuberculosis
gcgcucggucgcggcgauc

SEQ ID NO: 2890685 - RNA, 14 nt, Mycobacterium avium subsp. paratuberculosis
gcgcucggugcugg

SEQ ID NO: 2890686 - RNA, 16 nt, Mycobacterium avium subsp. paratuberculosis
gcgcucguccagggug

SEQ ID NO: 2890687 - RNA, 15 nt, Mycobacterium avium subsp. paratuberculosis
gcgcuggaucugccc

SEQ ID NO: 2890688 - RNA, 13 nt, Mycobacterium avium subsp. paratuberculosis
gcgcuggccagcg

SEQ ID NO: 2890689 - RNA, 19 nt, Mycobacterium avium subsp. paratuberculosis
gcgcuggccagcgcgacgg

SEQ ID NO: 2890690 - RNA, 20 nt, Mycobacterium avium subsp. paratuberculosis
gcgcuggccagcgcgacggc

SEQ ID NO: 2890691 - RNA, 16 nt, Mycobacterium avium subsp. paratuberculosis
gcgcuggccagcguca

SEQ ID NO: 2890692 - RNA, 17 nt, Mycobacterium avium subsp. paratuberculosis
gcgcuggccgaccccga

SEQ ID NO: 2890693 - RNA, 12 nt, Mycobacterium avium subsp. paratuberculosis
gcgcuggccgcg

SEQ ID NO: 2890694 - RNA, 17 nt, Mycobacterium avium subsp. paratuberculosis
gcgcuggccgcgaacgg

SEQ ID NO: 2890695 - RNA, 18 nt, Mycobacterium avium subsp. paratuberculosis
gcgcuggccgcggccagc

SEQ ID NO: 2890696 - RNA, 13 nt, Mycobacterium avium subsp. paratuberculosis
gcgcuggccggcc

SEQ ID NO: 2890697 - RNA, 22 nt, Mycobacterium avium subsp. paratuberculosis
gcgcuggccggccaccagcggc

SEQ ID NO: 2890698 - RNA, 16 nt, Mycobacterium avium subsp. paratuberculosis
gcgcuggcgaacaugg

SEQ ID NO: 2890699 - RNA, 17 nt, Mycobacterium avium subsp. paratuberculosis
gcgcuggcgauggugcc

SEQ ID NO: 2890700 - RNA, 19 nt, Mycobacterium avium subsp. paratuberculosis
gcgcuggcgauggugccga

SEQ ID NO: 2890701 - RNA, 15 nt, Mycobacterium avium subsp. paratuberculosis
gcgcuggcgcaggcg

SEQ ID NO: 2890702 - RNA, 16 nt, Mycobacterium avium subsp. paratuberculosis
gcgcuggcgcgccgua

SEQ ID NO: 2890703 - RNA, 13 nt, Mycobacterium avium subsp. paratuberculosis
gcgcuggcggcca

SEQ ID NO: 2890704 - RNA, 19 nt, Mycobacterium avium subsp. paratuberculosis
gcgcugggagcgggccacg

SEQ ID NO: 2890705 - RNA, 21 nt, Mycobacterium avium subsp. paratuberculosis
gcgcugggagcgggccacgca

SEQ ID NO: 2890706 - RNA, 22 nt, Mycobacterium avium subsp. paratuberculosis
gcgcugggcuaacgcuggucga

SEQ ID NO: 2890707 - RNA, 23 nt, Mycobacterium avium subsp. paratuberculosis
gcgcugggcuaacgcuggucgaa

SEQ ID NO: 2890708 - RNA, 19 nt, Mycobacterium avium subsp. paratuberculosis
gcgcugggugaacaccccg

SEQ ID NO: 2890709 - RNA, 22 nt, Mycobacterium avium subsp. paratuberculosis
gcgcugggugaacaccccgcgg

SEQ ID NO: 2890710 - RNA, 14 nt, Mycobacterium avium subsp. paratuberculosis
gcgcugggugcggg

SEQ ID NO: 2890711 - RNA, 22 nt, Mycobacterium avium subsp. paratuberculosis
gcgcugggugcgggcugcacca

SEQ ID NO: 2890712 - RNA, 21 nt, Mycobacterium avium subsp. paratuberculosis
gcgcuggguguuccccgggcg

SEQ ID NO: 2890713 - RNA, 18 nt, Mycobacterium avium subsp. paratuberculosis
gcgcugguaccgguugcc

SEQ ID NO: 2890714 - RNA, 20 nt, Mycobacterium avium subsp. paratuberculosis
gcgcugguaguacaccgggc

SEQ ID NO: 2890715 - RNA, 22 nt, Mycobacterium avium subsp. paratuberculosis
gcgcugguaguggcgugcggcc

SEQ ID NO: 2890716 - RNA, 23 nt, Mycobacterium avium subsp. paratuberculosis
gcgcugguaguggcgugcggccu

SEQ ID NO: 2890717 - RNA, 19 nt, Mycobacterium avium subsp. paratuberculosis
gcgcuggucaacucgaccc

SEQ ID NO: 2890718 - RNA, 11 nt, Mycobacterium avium subsp. paratuberculosis
gcgcuggucgg

SEQ ID NO: 2890719 - RNA, 13 nt, Mycobacterium avium subsp. paratuberculosis
gcgcuggucggcg

SEQ ID NO: 2890720 - RNA, 15 nt, Mycobacterium avium subsp. paratuberculosis
gcgcuggucggcgaa

SEQ ID NO: 2890721 - RNA, 17 nt, Mycobacterium avium subsp. paratuberculosis
gcgcuggucggcgaacc

SEQ ID NO: 2890722 - RNA, 14 nt, Mycobacterium avium subsp. paratuberculosis
gcgcuggucggcgg

SEQ ID NO: 2890723 - RNA, 15 nt, Mycobacterium avium subsp. paratuberculosis
gcgcuggucggcggg

SEQ ID NO: 2890724 - RNA, 23 nt, Mycobacterium avium subsp. paratuberculosis
gcgcuggucggcgggcagcgagu

SEQ ID NO: 2890725 - RNA, 18 nt, Mycobacterium avium subsp. paratuberculosis
gcgcuggugcagcagggc

SEQ ID NO: 2890726 - RNA, 22 nt, Mycobacterium avium subsp. paratuberculosis
gcgcuggugcgggccagcacga

SEQ ID NO: 2890727 - RNA, 15 nt, Mycobacterium avium subsp. paratuberculosis
gcgcuggugcugccg

SEQ ID NO: 2890728 - RNA, 22 nt, Mycobacterium avium subsp. paratuberculosis
gcgcuguaccgcgagaucagcg

SEQ ID NO: 2890729 - RNA, 16 nt, Mycobacterium avium subsp. paratuberculosis
gcgcuguaggcggcgu

SEQ ID NO: 2890730 - RNA, 21 nt, Mycobacterium avium subsp. paratuberculosis
gcgcuguccacguccugccag

SEQ ID NO: 2890731 - RNA, 18 nt, Mycobacterium avium subsp. paratuberculosis
gcgcuguccucgucgggg

SEQ ID NO: 2890732 - RNA, 13 nt, Mycobacterium avium subsp. paratuberculosis
gcgcuguccuggu

SEQ ID NO: 2890733 - RNA, 16 nt, Mycobacterium avium subsp. paratuberculosis
gcgcuguccuggucgc

SEQ ID NO: 2890734 - RNA, 16 nt, Mycobacterium avium subsp. paratuberculosis
gcgcugucgcgggccc

SEQ ID NO: 2890735 - RNA, 20 nt, Mycobacterium avium subsp. paratuberculosis
gcgcugucgcgggcccgcgu

SEQ ID NO: 2890736 - RNA, 12 nt, Mycobacterium avium subsp. paratuberculosis
gcgcugucggcg

SEQ ID NO: 2890737 - RNA, 16 nt, Mycobacterium avium subsp. paratuberculosis
gcgcugucggcgggga

SEQ ID NO: 2890738 - RNA, 16 nt, Mycobacterium avium subsp. paratuberculosis
gcgcuguggugacggc

SEQ ID NO: 2890739 - RNA, 20 nt, Mycobacterium avium subsp. paratuberculosis
gcgcuguggugacggcccca

SEQ ID NO: 2890740 - RNA, 21 nt, Mycobacterium avium subsp. paratuberculosis
gcgcuuaauacagcgcguugg

SEQ ID NO: 2890741 - RNA, 18 nt, Mycobacterium avium subsp. paratuberculosis
gcgcuucgggugcgggug

SEQ ID NO: 2890742 - RNA, 15 nt, Mycobacterium avium subsp. paratuberculosis
gcgcuugaccucgcc

SEQ ID NO: 2890743 - RNA, 16 nt, Mycobacterium avium subsp. paratuberculosis
gcgcuugaccucgccg

SEQ ID NO: 2890744 - RNA, 22 nt, Mycobacterium avium subsp. paratuberculosis
gcgcuugaccucgccgagcagc

SEQ ID NO: 2890745 - RNA, 15 nt, Mycobacterium avium subsp. paratuberculosis
gcgcuugacgaacgc

SEQ ID NO: 2890746 - RNA, 23 nt, Mycobacterium avium subsp. paratuberculosis
gcgcuugacgaacgccaccacgg

SEQ ID NO: 2890747 - RNA, 16 nt, Mycobacterium avium subsp. paratuberculosis
gcgcuugacggccggg

SEQ ID NO: 2890748 - RNA, 15 nt, Mycobacterium avium subsp. paratuberculosis
gcgcuugccgcgacc

SEQ ID NO: 2890749 - RNA, 13 nt, Mycobacterium avium subsp. paratuberculosis
gcgcuugcgaccg

SEQ ID NO: 2890750 - RNA, 15 nt, Mycobacterium avium subsp. paratuberculosis
gcgcuugcgaccgcc

SEQ ID NO: 2890751 - RNA, 17 nt, Mycobacterium avium subsp. paratuberculosis
gcgcuugcgaccgccgc

SEQ ID NO: 2890752 - RNA, 15 nt, Mycobacterium avium subsp. paratuberculosis
gcgcuugcgaucgcc

SEQ ID NO: 2890753 - RNA, 18 nt, Mycobacterium avium subsp. paratuberculosis
gcgcuugcgaucgccgcg

SEQ ID NO: 2890754 - RNA, 16 nt, Mycobacterium avium subsp. paratuberculosis
gcgcuugcggcgcagc

SEQ ID NO: 2890755 - RNA, 19 nt, Mycobacterium avium subsp. paratuberculosis
gcgcuugcggcgcagccag

SEQ ID NO: 2890756 - RNA, 21 nt, Mycobacterium avium subsp. paratuberculosis
gcgcuugcggcgcagccagcu

SEQ ID NO: 2890757 - RNA, 22 nt, Mycobacterium avium subsp. paratuberculosis
gcgcuugcguucccagcccggc

SEQ ID NO: 2890758 - RNA, 23 nt, Mycobacterium avium subsp. paratuberculosis
gcgcuugcguucccagcccggcc

SEQ ID NO: 2890759 - RNA, 20 nt, Mycobacterium avium subsp. paratuberculosis
gcgcuugggucgccgggucu

SEQ ID NO: 2890760 - RNA, 17 nt, Mycobacterium avium subsp. paratuberculosis
gcgcuugguggcgacga

SEQ ID NO: 2890761 - RNA, 15 nt, Mycobacterium avium subsp. paratuberculosis
gcgcuugucagcggc

SEQ ID NO: 2890762 - RNA, 17 nt, Mycobacterium avium subsp. paratuberculosis
gcgcuugucagcggccu

SEQ ID NO: 2890763 - RNA, 18 nt, Mycobacterium avium subsp. paratuberculosis
gcgcuugucagcggccuc

SEQ ID NO: 2890764 - RNA, 13 nt, Mycobacterium avium subsp. paratuberculosis
gcgcuugucggcg

SEQ ID NO: 2890765 - RNA, 14 nt, Mycobacterium avium subsp. paratuberculosis
gcgcuugucggcgu

SEQ ID NO: 2890766 - RNA, 15 nt, Mycobacterium avium subsp. paratuberculosis
gcgcuugucggcgug

SEQ ID NO: 2890767 - RNA, 16 nt, Mycobacterium avium subsp. paratuberculosis
gcgcuugucggcgugg

SEQ ID NO: 2890768 - RNA, 17 nt, Mycobacterium avium subsp. paratuberculosis
gcgcuuucccugcucga

SEQ ID NO: 2890769 - RNA, 22 nt, Mycobacterium avium subsp. paratuberculosis
gcgcuuucgaagugacgccgcu

SEQ ID NO: 2890770 - RNA, 14 nt, Mycobacterium avium subsp. paratuberculosis
gcgcuuucgccgaa

SEQ ID NO: 2890771 - RNA, 16 nt, Mycobacterium avium subsp. paratuberculosis
gcgcuuucgcgcacgc

SEQ ID NO: 2890772 - RNA, 15 nt, Mycobacterium avium subsp. paratuberculosis
gcggacgcggccagc

SEQ ID NO: 2890773 - RNA, 20 nt, Mycobacterium avium subsp. paratuberculosis
gcggacgcggccagcgcccg

SEQ ID NO: 2890774 - RNA, 19 nt, Mycobacterium avium subsp. paratuberculosis
gcggacgcguugaaagucc

SEQ ID NO: 2890775 - RNA, 22 nt, Mycobacterium avium subsp. paratuberculosis
gcggacggaucgagucccgcgc

SEQ ID NO: 2890776 - RNA, 24 nt, Mycobacterium avium subsp. paratuberculosis
gcggacggaucgagucccgcgcgg

SEQ ID NO: 2890777 - RNA, 15 nt, Mycobacterium avium subsp. paratuberculosis
gcggacggcaccgac

SEQ ID NO: 2890778 - RNA, 21 nt, Mycobacterium avium subsp. paratuberculosis
gcggacggccagcccgucggg

SEQ ID NO: 2890779 - RNA, 22 nt, Mycobacterium avium subsp. paratuberculosis
gcggacggcgaacuuggccgac

SEQ ID NO: 2890780 - RNA, 15 nt, Mycobacterium avium subsp. paratuberculosis
gcggacgggaccacc

SEQ ID NO: 2890781 - RNA, 17 nt, Mycobacterium avium subsp. paratuberculosis
gcggacgggaccacccg

SEQ ID NO: 2890782 - RNA, 13 nt, Mycobacterium avium subsp. paratuberculosis
gcggacgggccgc

SEQ ID NO: 2890783 - RNA, 16 nt, Mycobacterium avium subsp. paratuberculosis
gcggacgggccgcauc

SEQ ID NO: 2890784 - RNA, 18 nt, Mycobacterium avium subsp. paratuberculosis
gcggacgggccgcauccg

SEQ ID NO: 2890785 - RNA, 20 nt, Mycobacterium avium subsp. paratuberculosis
gcggacggguugggcgccag

SEQ ID NO: 2890786 - RNA, 21 nt, Mycobacterium avium subsp. paratuberculosis
gcggacggguugggcgccagc

SEQ ID NO: 2890787 - RNA, 17 nt, Mycobacterium avium subsp. paratuberculosis
gcggacggucccgacgc

SEQ ID NO: 2890788 - RNA, 15 nt, Mycobacterium avium subsp. paratuberculosis
gcggacggucgccga

SEQ ID NO: 2890789 - RNA, 17 nt, Mycobacterium avium subsp. paratuberculosis
gcggacggucgccgacg

SEQ ID NO: 2890790 - RNA, 19 nt, Mycobacterium avium subsp. paratuberculosis
gcggacggucgccgacgua

SEQ ID NO: 2890791 - RNA, 20 nt, Mycobacterium avium subsp. paratuberculosis
gcggacggucgccgacguag

SEQ ID NO: 2890792 - RNA, 16 nt, Mycobacterium avium subsp. paratuberculosis
gcggacgugauaucgg

SEQ ID NO: 2890793 - RNA, 14 nt, Mycobacterium avium subsp. paratuberculosis
gcggacucggcgaa

SEQ ID NO: 2890794 - RNA, 23 nt, Mycobacterium avium subsp. paratuberculosis
gcggacucguuggggccaccaga

SEQ ID NO: 2890795 - RNA, 17 nt, Mycobacterium avium subsp. paratuberculosis
gcggacugcccgaccgc

SEQ ID NO: 2890796 - RNA, 21 nt, Mycobacterium avium subsp. paratuberculosis
gcggacuggcugagcagcacc

SEQ ID NO: 2890797 - RNA, 21 nt, Mycobacterium avium subsp. paratuberculosis
gcggacuggugggcgucgugg

SEQ ID NO: 2890798 - RNA, 22 nt, Mycobacterium avium subsp. paratuberculosis
gcggagaaggugucgcacugcu

SEQ ID NO: 2890799 - RNA, 12 nt, Mycobacterium avium subsp. paratuberculosis
gcggagaucacc

SEQ ID NO: 2890800 - RNA, 16 nt, Mycobacterium avium subsp. paratuberculosis
gcggagaugacgugga

SEQ ID NO: 2890801 - RNA, 13 nt, Mycobacterium avium subsp. paratuberculosis
gcggagaugcugg

SEQ ID NO: 2890802 - RNA, 14 nt, Mycobacterium avium subsp. paratuberculosis
gcggagaugcuggu

SEQ ID NO: 2890803 - RNA, 23 nt, Mycobacterium avium subsp. paratuberculosis
gcggagaugcuggugacgccgcu

SEQ ID NO: 2890804 - RNA, 22 nt, Mycobacterium avium subsp. paratuberculosis
gcggagaugguggucaccacca

SEQ ID NO: 2890805 - RNA, 14 nt, Mycobacterium avium subsp. paratuberculosis
gcggagccggccgc

SEQ ID NO: 2890806 - RNA, 15 nt, Mycobacterium avium subsp. paratuberculosis
gcggagccggccgcc

SEQ ID NO: 2890807 - RNA, 16 nt, Mycobacterium avium subsp. paratuberculosis
gcggagccggccgccg

SEQ ID NO: 2890808 - RNA, 13 nt, Mycobacterium avium subsp. paratuberculosis
gcggagcggcggu

SEQ ID NO: 2890809 - RNA, 15 nt, Mycobacterium avium subsp. paratuberculosis
gcggagcggcgguca

SEQ ID NO: 2890810 - RNA, 17 nt, Mycobacterium avium subsp. paratuberculosis
gcggagcgggucagcgu

SEQ ID NO: 2890811 - RNA, 14 nt, Mycobacterium avium subsp. paratuberculosis
gcggagcgucgcga

SEQ ID NO: 2890812 - RNA, 15 nt, Mycobacterium avium subsp. paratuberculosis
gcggagcgucgcgau

SEQ ID NO: 2890813 - RNA, 22 nt, Mycobacterium avium subsp. paratuberculosis
gcggagcguuccagguucagcc

SEQ ID NO: 2890814 - RNA, 13 nt, Mycobacterium avium subsp. paratuberculosis
gcggaggaugccg

SEQ ID NO: 2890815 - RNA, 15 nt, Mycobacterium avium subsp. paratuberculosis
gcggaggaugccggc

SEQ ID NO: 2890816 - RNA, 21 nt, Mycobacterium avium subsp. paratuberculosis
gcggaggaugccggccagcuu

SEQ ID NO: 2890817 - RNA, 16 nt, Mycobacterium avium subsp. paratuberculosis
gcggaggccugcgcgg

SEQ ID NO: 2890818 - RNA, 18 nt, Mycobacterium avium subsp. paratuberculosis
gcggaggccugcgcggcc

SEQ ID NO: 2890819 - RNA, 20 nt, Mycobacterium avium subsp. paratuberculosis
gcggaggccugcgcggccgc

SEQ ID NO: 2890820 - RNA, 20 nt, Mycobacterium avium subsp. paratuberculosis
gcggaggcgagcagccgggu

SEQ ID NO: 2890821 - RNA, 13 nt, Mycobacterium avium subsp. paratuberculosis
gcggaggucagcg

SEQ ID NO: 2890822 - RNA, 15 nt, Mycobacterium avium subsp. paratuberculosis
gcggaggucagcggc

SEQ ID NO: 2890823 - RNA, 16 nt, Mycobacterium avium subsp. paratuberculosis
gcggaggucagcggcc

SEQ ID NO: 2890824 - RNA, 19 nt, Mycobacterium avium subsp. paratuberculosis
gcggaggucagcggcccga

SEQ ID NO: 2890825 - RNA, 21 nt, Mycobacterium avium subsp. paratuberculosis
gcggaggucagcggcccgauc

SEQ ID NO: 2890826 - RNA, 21 nt, Mycobacterium avium subsp. paratuberculosis
gcggaggucauggcgaccgcg

SEQ ID NO: 2890827 - RNA, 15 nt, Mycobacterium avium subsp. paratuberculosis
gcggagugaccgcca

SEQ ID NO: 2890828 - RNA, 16 nt, Mycobacterium avium subsp. paratuberculosis
gcggagugaccgccag

SEQ ID NO: 2890829 - RNA, 17 nt, Mycobacterium avium subsp. paratuberculosis
gcggagugaccgccagc

SEQ ID NO: 2890830 - RNA, 23 nt, Mycobacterium avium subsp. paratuberculosis
gcggagugaccgccagcaccgcg

SEQ ID NO: 2890831 - RNA, 20 nt, Mycobacterium avium subsp. paratuberculosis
gcggaguuuggacaucacgu

SEQ ID NO: 2890832 - RNA, 15 nt, Mycobacterium avium subsp. paratuberculosis
gcggauaaccgucca

SEQ ID NO: 2890833 - RNA, 19 nt, Mycobacterium avium subsp. paratuberculosis
gcggauacgcccggccacc

SEQ ID NO: 2890834 - RNA, 16 nt, Mycobacterium avium subsp. paratuberculosis
gcggauagaggcggcg

SEQ ID NO: 2890835 - RNA, 17 nt, Mycobacterium avium subsp. paratuberculosis
gcggauagaggcggcgc

SEQ ID NO: 2890836 - RNA, 17 nt, Mycobacterium avium subsp. paratuberculosis
gcggauagcccagcgug

SEQ ID NO: 2890837 - RNA, 14 nt, Mycobacterium avium subsp. paratuberculosis
gcggaucagcaccg

SEQ ID NO: 2890838 - RNA, 16 nt, Mycobacterium avium subsp. paratuberculosis
gcggaucagcaccgac

SEQ ID NO: 2890839 - RNA, 17 nt, Mycobacterium avium subsp. paratuberculosis
gcggaucagcaccgacg

SEQ ID NO: 2890840 - RNA, 19 nt, Mycobacterium avium subsp. paratuberculosis
gcggaucagcaccgacgcg

SEQ ID NO: 2890841 - RNA, 14 nt, Mycobacterium avium subsp. paratuberculosis
gcggaucagcagga

SEQ ID NO: 2890842 - RNA, 21 nt, Mycobacterium avium subsp. paratuberculosis
gcggaucagcaggaccgggau

SEQ ID NO: 2890843 - RNA, 13 nt, Mycobacterium avium subsp. paratuberculosis
gcggaucaggucg

SEQ ID NO: 2890844 - RNA, 15 nt, Mycobacterium avium subsp. paratuberculosis
gcggaucaggucggu

SEQ ID NO: 2890845 - RNA, 16 nt, Mycobacterium avium subsp. paratuberculosis
gcggaucaggucgguc

SEQ ID NO: 2890846 - RNA, 19 nt, Mycobacterium avium subsp. paratuberculosis
gcggaucaggucggucacc

SEQ ID NO: 2890847 - RNA, 16 nt, Mycobacterium avium subsp. paratuberculosis
gcggaucaugcgcguc

SEQ ID NO: 2890848 - RNA, 23 nt, Mycobacterium avium subsp. paratuberculosis
gcggaucaugcgcgucauggccg

SEQ ID NO: 2890849 - RNA, 20 nt, Mycobacterium avium subsp. paratuberculosis
gcggauccagcaccgccacg

SEQ ID NO: 2890850 - RNA, 23 nt, Mycobacterium avium subsp. paratuberculosis
gcggauccagguggggcacgggc

SEQ ID NO: 2890851 - RNA, 16 nt, Mycobacterium avium subsp. paratuberculosis
gcggauccccgcgcug

SEQ ID NO: 2890852 - RNA, 18 nt, Mycobacterium avium subsp. paratuberculosis
gcggauccccgcgcuggg

SEQ ID NO: 2890853 - RNA, 15 nt, Mycobacterium avium subsp. paratuberculosis
gcggaucccgguucc

SEQ ID NO: 2890854 - RNA, 23 nt, Mycobacterium avium subsp. paratuberculosis
gcggaucccgguucccgugcugg

SEQ ID NO: 2890855 - RNA, 14 nt, Mycobacterium avium subsp. paratuberculosis
gcggauccgcgugg

SEQ ID NO: 2890856 - RNA, 15 nt, Mycobacterium avium subsp. paratuberculosis
gcggauccgcguggc

SEQ ID NO: 2890857 - RNA, 14 nt, Mycobacterium avium subsp. paratuberculosis
gcggcaacacgccg

SEQ ID NO: 2890858 - RNA, 15 nt, Mycobacterium avium subsp. paratuberculosis
gcggcaacacgccgg

SEQ ID NO: 2890859 - RNA, 16 nt, Mycobacterium avium subsp. paratuberculosis
gcggcaacacgccggc

SEQ ID NO: 2890860 - RNA, 18 nt, Mycobacterium avium subsp. paratuberculosis
gcggcaacacgccggcgg

SEQ ID NO: 2890861 - RNA, 19 nt, Mycobacterium avium subsp. paratuberculosis
gcggcaacacgccggcggc

SEQ ID NO: 2890862 - RNA, 20 nt, Mycobacterium avium subsp. paratuberculosis
gcggcaacacgccggcggcc

SEQ ID NO: 2890863 - RNA, 15 nt, Mycobacterium avium subsp. paratuberculosis
gcggcaacagcacca

SEQ ID NO: 2890864 - RNA, 17 nt, Mycobacterium avium subsp. paratuberculosis
gcggcaacagcaccagc

SEQ ID NO: 2890865 - RNA, 19 nt, Mycobacterium avium subsp. paratuberculosis
gcggcaacagcaccagcac

SEQ ID NO: 2890866 - RNA, 14 nt, Mycobacterium avium subsp. paratuberculosis
gcggcaaccagcuc

SEQ ID NO: 2890867 - RNA, 22 nt, Mycobacterium avium subsp. paratuberculosis
gcggcaaccagcuccggcaacg

SEQ ID NO: 2890868 - RNA, 23 nt, Mycobacterium avium subsp. paratuberculosis
gcggcaaccagcuccggcaacga

SEQ ID NO: 2890869 - RNA, 14 nt, Mycobacterium avium subsp. paratuberculosis
gcggcaacgccagc

SEQ ID NO: 2890870 - RNA, 17 nt, Mycobacterium avium subsp. paratuberculosis
gcggcaacgccagccag

SEQ ID NO: 2890871 - RNA, 16 nt, Mycobacterium avium subsp. paratuberculosis
gcggcaacggccauga

SEQ ID NO: 2890872 - RNA, 15 nt, Mycobacterium avium subsp. paratuberculosis
gcggcaacggguugc

SEQ ID NO: 2890873 - RNA, 19 nt, Mycobacterium avium subsp. paratuberculosis
gcggcaacggguugcgaaa

SEQ ID NO: 2890874 - RNA, 17 nt, Mycobacterium avium subsp. paratuberculosis
gcggcaacugggcggcc

SEQ ID NO: 2890875 - RNA, 21 nt, Mycobacterium avium subsp. paratuberculosis
gcggcaagcccuuuggcggcc

SEQ ID NO: 2890876 - RNA, 15 nt, Mycobacterium avium subsp. paratuberculosis
gcggcaaggcgcaga

SEQ ID NO: 2890877 - RNA, 22 nt, Mycobacterium avium subsp. paratuberculosis
gcggcaaggcguuccaucugcu

SEQ ID NO: 2890878 - RNA, 16 nt, Mycobacterium avium subsp. paratuberculosis
gcggcaaugccguugg

SEQ ID NO: 2890879 - RNA, 20 nt, Mycobacterium avium subsp. paratuberculosis
gcggcaauugaauucgacca

SEQ ID NO: 2890880 - RNA, 15 nt, Mycobacterium avium subsp. paratuberculosis
gcggcacaccagcgu

SEQ ID NO: 2890881 - RNA, 18 nt, Mycobacterium avium subsp. paratuberculosis
gcggcacaccagcguucg

SEQ ID NO: 2890882 - RNA, 20 nt, Mycobacterium avium subsp. paratuberculosis
gcggcacaccagcguucguc

SEQ ID NO: 2890883 - RNA, 16 nt, Mycobacterium avium subsp. paratuberculosis
gcggcacaccgcgcga

SEQ ID NO: 2890884 - RNA, 19 nt, Mycobacterium avium subsp. paratuberculosis
gcggcacaccgcgcgaacg

SEQ ID NO: 2890885 - RNA, 21 nt, Mycobacterium avium subsp. paratuberculosis
gcggcacaggcgaaucggcgc

SEQ ID NO: 2890886 - RNA, 16 nt, Mycobacterium avium subsp. paratuberculosis
gcggcaccaacccgau

SEQ ID NO: 2890887 - RNA, 21 nt, Mycobacterium avium subsp. paratuberculosis
gcggcaccaacccgaucggcc

SEQ ID NO: 2890888 - RNA, 14 nt, Mycobacterium avium subsp. paratuberculosis
gcggcaccaccagc

SEQ ID NO: 2890889 - RNA, 15 nt, Mycobacterium avium subsp. paratuberculosis
gcggcaccaccagcg

SEQ ID NO: 2890890 - RNA, 16 nt, Mycobacterium avium subsp. paratuberculosis
gcggcaccaccagcgu

SEQ ID NO: 2890891 - RNA, 17 nt, Mycobacterium avium subsp. paratuberculosis
gcggcaccaccagcgug

SEQ ID NO: 2890892 - RNA, 14 nt, Mycobacterium avium subsp. paratuberculosis
gcggcaccacccgc

SEQ ID NO: 2890893 - RNA, 15 nt, Mycobacterium avium subsp. paratuberculosis
gcggcaccacccgcg

SEQ ID NO: 2890894 - RNA, 19 nt, Mycobacterium avium subsp. paratuberculosis
gcggcaccacccgcggccg

SEQ ID NO: 2890895 - RNA, 22 nt, Mycobacterium avium subsp. paratuberculosis
gcggcaccacccgcggccggcc

SEQ ID NO: 2890896 - RNA, 23 nt, Mycobacterium avium subsp. paratuberculosis
gcggcaccacccgcggccggccc

SEQ ID NO: 2890897 - RNA, 15 nt, Mycobacterium avium subsp. paratuberculosis
gcggcaccacccggu

SEQ ID NO: 2890898 - RNA, 12 nt, Mycobacterium avium subsp. paratuberculosis
gcggcaccacgc

SEQ ID NO: 2890899 - RNA, 18 nt, Mycobacterium avium subsp. paratuberculosis
gcggcaccacgcugugcu

SEQ ID NO: 2890900 - RNA, 21 nt, Mycobacterium avium subsp. paratuberculosis
gcggcaccacgcugugcucga

SEQ ID NO: 2890901 - RNA, 16 nt, Mycobacterium avium subsp. paratuberculosis
gcggcaccagcccgcc

SEQ ID NO: 2890902 - RNA, 17 nt, Mycobacterium avium subsp. paratuberculosis
gcggcaccagcccgccg

SEQ ID NO: 2890903 - RNA, 20 nt, Mycobacterium avium subsp. paratuberculosis
gcggcaccagcccgccgucg

SEQ ID NO: 2890904 - RNA, 18 nt, Mycobacterium avium subsp. paratuberculosis
gcggcaccagguaccggc

SEQ ID NO: 2890905 - RNA, 20 nt, Mycobacterium avium subsp. paratuberculosis
gcggcaccagguaccggcgg

SEQ ID NO: 2890906 - RNA, 22 nt, Mycobacterium avium subsp. paratuberculosis
gcggcaccagguaccggcgggc

SEQ ID NO: 2890907 - RNA, 23 nt, Mycobacterium avium subsp. paratuberculosis
gcggcaccagguaccggcgggcg

SEQ ID NO: 2890908 - RNA, 16 nt, Mycobacterium avium subsp. paratuberculosis
gcggcaccagucgcgc

SEQ ID NO: 2890909 - RNA, 13 nt, Mycobacterium avium subsp. paratuberculosis
gcggcacccgguc

SEQ ID NO: 2890910 - RNA, 16 nt, Mycobacterium avium subsp. paratuberculosis
gcggcacccgguccgg

SEQ ID NO: 2890911 - RNA, 20 nt, Mycobacterium avium subsp. paratuberculosis
gcggcacccgguccggcccg

SEQ ID NO: 2890912 - RNA, 21 nt, Mycobacterium avium subsp. paratuberculosis
gcggcacccgguccggcccgg

SEQ ID NO: 2890913 - RNA, 22 nt, Mycobacterium avium subsp. paratuberculosis
gcggcacccgguccggcccggg

SEQ ID NO: 2890914 - RNA, 19 nt, Mycobacterium avium subsp. paratuberculosis
gcggcaccgaucggcacgu

SEQ ID NO: 2890915 - RNA, 12 nt, Mycobacterium avium subsp. paratuberculosis
gcggcaccgcca

SEQ ID NO: 2890916 - RNA, 22 nt, Mycobacterium avium subsp. paratuberculosis
gcggcaccgccaucggcaucgc

SEQ ID NO: 2890917 - RNA, 12 nt, Mycobacterium avium subsp. paratuberculosis
gcggcaccgccc

SEQ ID NO: 2890918 - RNA, 13 nt, Mycobacterium avium subsp. paratuberculosis
gcggcaccgcccg

SEQ ID NO: 2890919 - RNA, 22 nt, Mycobacterium avium subsp. paratuberculosis
gcggcaccgcccggguugucga

SEQ ID NO: 2890920 - RNA, 13 nt, Mycobacterium avium subsp. paratuberculosis
gcggcaccgccgc

SEQ ID NO: 2890921 - RNA, 14 nt, Mycobacterium avium subsp. paratuberculosis
gcggcaccgccgcg

SEQ ID NO: 2890922 - RNA, 17 nt, Mycobacterium avium subsp. paratuberculosis
gcggcaccgccgcggug

SEQ ID NO: 2890923 - RNA, 18 nt, Mycobacterium avium subsp. paratuberculosis
gcggcaccgccgcggugg

SEQ ID NO: 2890924 - RNA, 21 nt, Mycobacterium avium subsp. paratuberculosis
gcggcaccgccgcgguggguc

SEQ ID NO: 2890925 - RNA, 12 nt, Mycobacterium avium subsp. paratuberculosis
gcggcaccgcgg

SEQ ID NO: 2890926 - RNA, 14 nt, Mycobacterium avium subsp. paratuberculosis
gcggcaccgcggcu

SEQ ID NO: 2890927 - RNA, 20 nt, Mycobacterium avium subsp. paratuberculosis
gcggcaccgcggcucggucg

SEQ ID NO: 2890928 - RNA, 13 nt, Mycobacterium avium subsp. paratuberculosis
gcggcaccgcugc

SEQ ID NO: 2890929 - RNA, 17 nt, Mycobacterium avium subsp. paratuberculosis
gcggcaccgcugccggc

SEQ ID NO: 2890930 - RNA, 19 nt, Mycobacterium avium subsp. paratuberculosis
gcggcaccgcugccggccg

SEQ ID NO: 2890931 - RNA, 20 nt, Mycobacterium avium subsp. paratuberculosis
gcggcaccgcugccggccga

SEQ ID NO: 2890932 - RNA, 21 nt, Mycobacterium avium subsp. paratuberculosis
gcggcaccgcugccggccgaa

SEQ ID NO: 2890933 - RNA, 12 nt, Mycobacterium avium subsp. paratuberculosis
gcggcaccggcg

SEQ ID NO: 2890934 - RNA, 14 nt, Mycobacterium avium subsp. paratuberculosis
gcggcaccggcgaa

SEQ ID NO: 2890935 - RNA, 14 nt, Mycobacterium avium subsp. paratuberculosis
gcggcaccuccagc

SEQ ID NO: 2890936 - RNA, 15 nt, Mycobacterium avium subsp. paratuberculosis
gcggcaccuccagcc

SEQ ID NO: 2890937 - RNA, 17 nt, Mycobacterium avium subsp. paratuberculosis
gcggcaccuccagcccg

SEQ ID NO: 2890938 - RNA, 23 nt, Mycobacterium avium subsp. paratuberculosis
gcggcaccuccagcccggcgaug

SEQ ID NO: 2890939 - RNA, 13 nt, Mycobacterium avium subsp. paratuberculosis
gcggcaccucggc

SEQ ID NO: 2890940 - RNA, 15 nt, Mycobacterium avium subsp. paratuberculosis
gcggcaccucggccu

SEQ ID NO: 2890941 - RNA, 20 nt, Mycobacterium avium subsp. paratuberculosis
gcggcaccucggccuugacc

SEQ ID NO: 2890942 - RNA, 18 nt, Mycobacterium avium subsp. paratuberculosis
gcggcaggucggccagcg

SEQ ID NO: 2890943 - RNA, 19 nt, Mycobacterium avium subsp. paratuberculosis
gcggcaggucggccagcgc

SEQ ID NO: 2890944 - RNA, 22 nt, Mycobacterium avium subsp. paratuberculosis
gcggcaggucggccagcgccgc

SEQ ID NO: 2890945 - RNA, 15 nt, Mycobacterium avium subsp. paratuberculosis
gcggcaggucggcgg

SEQ ID NO: 2890946 - RNA, 16 nt, Mycobacterium avium subsp. paratuberculosis
gcggcaggucggcggg

SEQ ID NO: 2890947 - RNA, 20 nt, Mycobacterium avium subsp. paratuberculosis
gcggcaggucggcgggagcc

SEQ ID NO: 2890948 - RNA, 22 nt, Mycobacterium avium subsp. paratuberculosis
gcggcaggucggcgggagccgg

SEQ ID NO: 2890949 - RNA, 23 nt, Mycobacterium avium subsp. paratuberculosis
gcggcaggucggcgggagccggc

SEQ ID NO: 2890950 - RNA, 15 nt, Mycobacterium avium subsp. paratuberculosis
gcggcaggucgucgu

SEQ ID NO: 2890951 - RNA, 20 nt, Mycobacterium avium subsp. paratuberculosis
gcggcaggugaaggugcccc

SEQ ID NO: 2890952 - RNA, 22 nt, Mycobacterium avium subsp. paratuberculosis
gcggcaggugaaggugccccac

SEQ ID NO: 2890953 - RNA, 17 nt, Mycobacterium avium subsp. paratuberculosis
gcggcagguggggcagc

SEQ ID NO: 2890954 - RNA, 19 nt, Mycobacterium avium subsp. paratuberculosis
gcggcagguggggcagcac

SEQ ID NO: 2890955 - RNA, 12 nt, Mycobacterium avium subsp. paratuberculosis
gcggcagguggu

SEQ ID NO: 2890956 - RNA, 17 nt, Mycobacterium avium subsp. paratuberculosis
gcggcagguggucggug

SEQ ID NO: 2890957 - RNA, 17 nt, Mycobacterium avium subsp. paratuberculosis
gcggcagguugcgcugg

SEQ ID NO: 2890958 - RNA, 14 nt, Mycobacterium avium subsp. paratuberculosis
gcggcagguugggg

SEQ ID NO: 2890959 - RNA, 18 nt, Mycobacterium avium subsp. paratuberculosis
gcggcagguuggggacgg

SEQ ID NO: 2890960 - RNA, 20 nt, Mycobacterium avium subsp. paratuberculosis
gcggcagguuggggacggcg

SEQ ID NO: 2890961 - RNA, 21 nt, Mycobacterium avium subsp. paratuberculosis
gcggcagguuggggacggcga

SEQ ID NO: 2890962 - RNA, 22 nt, Mycobacterium avium subsp. paratuberculosis
gcggcagguuggggacggcgag

SEQ ID NO: 2890963 - RNA, 19 nt, Mycobacterium avium subsp. paratuberculosis
gcggcaguagcgcaccggu

SEQ ID NO: 2890964 - RNA, 15 nt, Mycobacterium avium subsp. paratuberculosis
gcggcaguccggcga

SEQ ID NO: 2890965 - RNA, 17 nt, Mycobacterium avium subsp. paratuberculosis
gcggcagugcgccgucc

SEQ ID NO: 2890966 - RNA, 20 nt, Mycobacterium avium subsp. paratuberculosis
gcggcagugcgccgucccgg

SEQ ID NO: 2890967 - RNA, 20 nt, Mycobacterium avium subsp. paratuberculosis
gcggcauaguccagcucgcg

SEQ ID NO: 2890968 - RNA, 23 nt, Mycobacterium avium subsp. paratuberculosis
gcggcauaguccagcucgcgaag

SEQ ID NO: 2890969 - RNA, 14 nt, Mycobacterium avium subsp. paratuberculosis
gcggcauccccagc

SEQ ID NO: 2890970 - RNA, 22 nt, Mycobacterium avium subsp. paratuberculosis
gcggcauccccagcugggccgc

SEQ ID NO: 2890971 - RNA, 15 nt, Mycobacterium avium subsp. paratuberculosis
gcggcaucccuggug

SEQ ID NO: 2890972 - RNA, 21 nt, Mycobacterium avium subsp. paratuberculosis
gcggcaucccuggugaccgac

SEQ ID NO: 2890973 - RNA, 14 nt, Mycobacterium avium subsp. paratuberculosis
gcggcaucgaggac

SEQ ID NO: 2890974 - RNA, 15 nt, Mycobacterium avium subsp. paratuberculosis
gcggcaucgaggacc

SEQ ID NO: 2890975 - RNA, 23 nt, Mycobacterium avium subsp. paratuberculosis
gcggcaucgaggaccggcgccgg

SEQ ID NO: 2890976 - RNA, 15 nt, Mycobacterium avium subsp. paratuberculosis
gcggcaucgccgcca

SEQ ID NO: 2890977 - RNA, 16 nt, Mycobacterium avium subsp. paratuberculosis
gcggcaucgccgccaa

SEQ ID NO: 2890978 - RNA, 17 nt, Mycobacterium avium subsp. paratuberculosis
gcggcaucgccgccaag

SEQ ID NO: 2890979 - RNA, 12 nt, Mycobacterium avium subsp. paratuberculosis
gcggcaucgcgc

SEQ ID NO: 2890980 - RNA, 13 nt, Mycobacterium avium subsp. paratuberculosis
gcggcaucgcgcc

SEQ ID NO: 2890981 - RNA, 14 nt, Mycobacterium avium subsp. paratuberculosis
gcggcaucgcgccg

SEQ ID NO: 2890982 - RNA, 16 nt, Mycobacterium avium subsp. paratuberculosis
gcggcaucgcgccgca

SEQ ID NO: 2890983 - RNA, 19 nt, Mycobacterium avium subsp. paratuberculosis
gcggcaucgcgcgcggcgg

SEQ ID NO: 2890984 - RNA, 21 nt, Mycobacterium avium subsp. paratuberculosis
gcggcaucgcgcgcggcggcc

SEQ ID NO: 2890985 - RNA, 17 nt, Mycobacterium avium subsp. paratuberculosis
gcggcaucgucaccucg

SEQ ID NO: 2890986 - RNA, 13 nt, Mycobacterium avium subsp. paratuberculosis
gcggcaucgucgg

SEQ ID NO: 2890987 - RNA, 18 nt, Mycobacterium avium subsp. paratuberculosis
gcggcaucgucggggacg

SEQ ID NO: 2890988 - RNA, 15 nt, Mycobacterium avium subsp. paratuberculosis
gcggcaugaccggcc

SEQ ID NO: 2890989 - RNA, 16 nt, Mycobacterium avium subsp. paratuberculosis
gcggcaugaccggcca

SEQ ID NO: 2890990 - RNA, 17 nt, Mycobacterium avium subsp. paratuberculosis
gcggcaugaccggccag

SEQ ID NO: 2890991 - RNA, 18 nt, Mycobacterium avium subsp. paratuberculosis
gcggcaugaccggccagc

SEQ ID NO: 2890992 - RNA, 11 nt, Mycobacterium avium subsp. paratuberculosis
gcggcaugccc

SEQ ID NO: 2890993 - RNA, 17 nt, Mycobacterium avium subsp. paratuberculosis
gcggcaugccgcccggg

SEQ ID NO: 2890994 - RNA, 15 nt, Mycobacterium avium subsp. paratuberculosis
gcggcauggcuggcg

SEQ ID NO: 2890995 - RNA, 17 nt, Mycobacterium avium subsp. paratuberculosis
gcggcauggcuggcggc

SEQ ID NO: 2890996 - RNA, 18 nt, Mycobacterium avium subsp. paratuberculosis
gcggcauggcuggcggca

SEQ ID NO: 2890997 - RNA, 19 nt, Mycobacterium avium subsp. paratuberculosis
gcggcauggcuggcggcaa

SEQ ID NO: 2890998 - RNA, 21 nt, Mycobacterium avium subsp. paratuberculosis
gcggcauggcuggcggcaacg

SEQ ID NO: 2890999 - RNA, 16 nt, Mycobacterium avium subsp. paratuberculosis
gcggccaacccgggcg

SEQ ID NO: 2891000 - RNA, 19 nt, Mycobacterium avium subsp. paratuberculosis
gcggccaacccgggcgcca

SEQ ID NO: 2891001 - RNA, 14 nt, Mycobacterium avium subsp. paratuberculosis
gcggccaacgccca

SEQ ID NO: 2891002 - RNA, 16 nt, Mycobacterium avium subsp. paratuberculosis
gcggccaacgcccacc

SEQ ID NO: 2891003 - RNA, 23 nt, Mycobacterium avium subsp. paratuberculosis
gcggccaacgcccaccacaucgg

SEQ ID NO: 2891004 - RNA, 14 nt, Mycobacterium avium subsp. paratuberculosis
gcggccaacgccuc

SEQ ID NO: 2891005 - RNA, 22 nt, Mycobacterium avium subsp. paratuberculosis
gcggccaacgccucgucgaccg

SEQ ID NO: 2891006 - RNA, 15 nt, Mycobacterium avium subsp. paratuberculosis
gcggccaacgcgacg

SEQ ID NO: 2891007 - RNA, 18 nt, Mycobacterium avium subsp. paratuberculosis
gcggccaagugcggucgg

SEQ ID NO: 2891008 - RNA, 13 nt, Mycobacterium avium subsp. paratuberculosis
gcggccaauccca

SEQ ID NO: 2891009 - RNA, 16 nt, Mycobacterium avium subsp. paratuberculosis
gcggccaaucgcugug

SEQ ID NO: 2891010 - RNA, 16 nt, Mycobacterium avium subsp. paratuberculosis
gcggccacaccgauca

SEQ ID NO: 2891011 - RNA, 17 nt, Mycobacterium avium subsp. paratuberculosis
gcggccacaccgaucag

SEQ ID NO: 2891012 - RNA, 19 nt, Mycobacterium avium subsp. paratuberculosis
gcggccacaccgaucagca

SEQ ID NO: 2891013 - RNA, 14 nt, Mycobacterium avium subsp. paratuberculosis
gcggccacaccggg

SEQ ID NO: 2891014 - RNA, 17 nt, Mycobacterium avium subsp. paratuberculosis
gcggccacaccggggcc

SEQ ID NO: 2891015 - RNA, 18 nt, Mycobacterium avium subsp. paratuberculosis
gcggccacaccggggcca

SEQ ID NO: 2891016 - RNA, 19 nt, Mycobacterium avium subsp. paratuberculosis
gcggccacaccggggccag

SEQ ID NO: 2891017 - RNA, 14 nt, Mycobacterium avium subsp. paratuberculosis
gcggccacacuggc

SEQ ID NO: 2891018 - RNA, 19 nt, Mycobacterium avium subsp. paratuberculosis
gcggccacacuggccaugc

SEQ ID NO: 2891019 - RNA, 16 nt, Mycobacterium avium subsp. paratuberculosis
gcggccacacuggcgu

SEQ ID NO: 2891020 - RNA, 21 nt, Mycobacterium avium subsp. paratuberculosis
gcggccacacuggcgugacgc

SEQ ID NO: 2891021 - RNA, 21 nt, Mycobacterium avium subsp. paratuberculosis
gcggccaccaacggcagcagc

SEQ ID NO: 2891022 - RNA, 12 nt, Mycobacterium avium subsp. paratuberculosis
gcggccaccacc

SEQ ID NO: 2891023 - RNA, 15 nt, Mycobacterium avium subsp. paratuberculosis
gcggccaccaccacg

SEQ ID NO: 2891024 - RNA, 18 nt, Mycobacterium avium subsp. paratuberculosis
gcggccaccaccacggcc

SEQ ID NO: 2891025 - RNA, 22 nt, Mycobacterium avium subsp. paratuberculosis
gcggccaccaccacggccaugc

SEQ ID NO: 2891026 - RNA, 14 nt, Mycobacterium avium subsp. paratuberculosis
gcggccaccaccgc

SEQ ID NO: 2891027 - RNA, 15 nt, Mycobacterium avium subsp. paratuberculosis
gcggccagcgcgcgg

SEQ ID NO: 2891028 - RNA, 22 nt, Mycobacterium avium subsp. paratuberculosis
gcggccagcgcgcgggcguccu

SEQ ID NO: 2891029 - RNA, 14 nt, Mycobacterium avium subsp. paratuberculosis
gcggccagcggcag

SEQ ID NO: 2891030 - RNA, 13 nt, Mycobacterium avium subsp. paratuberculosis
gcggccagcggcg

SEQ ID NO: 2891031 - RNA, 16 nt, Mycobacterium avium subsp. paratuberculosis
gcggccagcggcgccg

SEQ ID NO: 2891032 - RNA, 16 nt, Mycobacterium avium subsp. paratuberculosis
gcggccagcguggcgc

SEQ ID NO: 2891033 - RNA, 18 nt, Mycobacterium avium subsp. paratuberculosis
gcggccagcguggcgcgc

SEQ ID NO: 2891034 - RNA, 13 nt, Mycobacterium avium subsp. paratuberculosis
gcggccagcuccc

SEQ ID NO: 2891035 - RNA, 19 nt, Mycobacterium avium subsp. paratuberculosis
gcggccagcucccgggcgg

SEQ ID NO: 2891036 - RNA, 20 nt, Mycobacterium avium subsp. paratuberculosis
gcggccagcucccgggcggc

SEQ ID NO: 2891037 - RNA, 18 nt, Mycobacterium avium subsp. paratuberculosis
gcggccagcucggcccgc

SEQ ID NO: 2891038 - RNA, 19 nt, Mycobacterium avium subsp. paratuberculosis
gcggccagcucggcccgcu

SEQ ID NO: 2891039 - RNA, 22 nt, Mycobacterium avium subsp. paratuberculosis
gcggccagcugcccgccgacgc

SEQ ID NO: 2891040 - RNA, 14 nt, Mycobacterium avium subsp. paratuberculosis
gcggccaggccggc

SEQ ID NO: 2891041 - RNA, 17 nt, Mycobacterium avium subsp. paratuberculosis
gcggccagggcggcgcc

SEQ ID NO: 2891042 - RNA, 18 nt, Mycobacterium avium subsp. paratuberculosis
gcggccagggcggcgccg

SEQ ID NO: 2891043 - RNA, 20 nt, Mycobacterium avium subsp. paratuberculosis
gcggccagggcggcgccggc

SEQ ID NO: 2891044 - RNA, 20 nt, Mycobacterium avium subsp. paratuberculosis
gcggccaggguagaggcggc

SEQ ID NO: 2891045 - RNA, 14 nt, Mycobacterium avium subsp. paratuberculosis
gcggccaggguguc

SEQ ID NO: 2891046 - RNA, 19 nt, Mycobacterium avium subsp. paratuberculosis
gcggccagggugucccagc

SEQ ID NO: 2891047 - RNA, 23 nt, Mycobacterium avium subsp. paratuberculosis
gcggccagggugucccagcgcca

SEQ ID NO: 2891048 - RNA, 16 nt, Mycobacterium avium subsp. paratuberculosis
gcggccagugccgggc

SEQ ID NO: 2891049 - RNA, 18 nt, Mycobacterium avium subsp. paratuberculosis
gcggccagugccgggcca

SEQ ID NO: 2891050 - RNA, 18 nt, Mycobacterium avium subsp. paratuberculosis
gcggccaguucgagcgcc

SEQ ID NO: 2891051 - RNA, 20 nt, Mycobacterium avium subsp. paratuberculosis
gcggccaguucgagcgccgc

SEQ ID NO: 2891052 - RNA, 23 nt, Mycobacterium avium subsp. paratuberculosis
gcggccaguucgagcgccgcggc

SEQ ID NO: 2891053 - RNA, 17 nt, Mycobacterium avium subsp. paratuberculosis
gcggccaguugacguug

SEQ ID NO: 2891054 - RNA, 13 nt, Mycobacterium avium subsp. paratuberculosis
gcggccaucgccg

SEQ ID NO: 2891055 - RNA, 15 nt, Mycobacterium avium subsp. paratuberculosis
gcggccaucgccgcc

SEQ ID NO: 2891056 - RNA, 17 nt, Mycobacterium avium subsp. paratuberculosis
gcggccaucgccgccau

SEQ ID NO: 2891057 - RNA, 16 nt, Mycobacterium avium subsp. paratuberculosis
gcggccaucgccgcgg

SEQ ID NO: 2891058 - RNA, 17 nt, Mycobacterium avium subsp. paratuberculosis
gcggccaucgccgcggu

SEQ ID NO: 2891059 - RNA, 18 nt, Mycobacterium avium subsp. paratuberculosis
gcggccaucgccgcggug

SEQ ID NO: 2891060 - RNA, 20 nt, Mycobacterium avium subsp. paratuberculosis
gcggccaucgccgcgguggc

SEQ ID NO: 2891061 - RNA, 15 nt, Mycobacterium avium subsp. paratuberculosis
gcggccaucgccuga

SEQ ID NO: 2891062 - RNA, 23 nt, Mycobacterium avium subsp. paratuberculosis
gcggccaucgccugagcaaccgg

SEQ ID NO: 2891063 - RNA, 23 nt, Mycobacterium avium subsp. paratuberculosis
gcggccaucucgugcccgggccc

SEQ ID NO: 2891064 - RNA, 16 nt, Mycobacterium avium subsp. paratuberculosis
gcggccauggucgcgg

SEQ ID NO: 2891065 - RNA, 18 nt, Mycobacterium avium subsp. paratuberculosis
gcggccauggucgcggcc

SEQ ID NO: 2891066 - RNA, 17 nt, Mycobacterium avium subsp. paratuberculosis
gcggccauguccccgcc

SEQ ID NO: 2891067 - RNA, 20 nt, Mycobacterium avium subsp. paratuberculosis
gcggccauguccccgccggu

SEQ ID NO: 2891068 - RNA, 21 nt, Mycobacterium avium subsp. paratuberculosis
gcggccauguccccgccggug

SEQ ID NO: 2891069 - RNA, 22 nt, Mycobacterium avium subsp. paratuberculosis
gcggccauguccccgccggugg

SEQ ID NO: 2891070 - RNA, 24 nt, Mycobacterium avium subsp. paratuberculosis
gcggccauguccccgccgguggcg

SEQ ID NO: 2891071 - RNA, 17 nt, Mycobacterium avium subsp. paratuberculosis
gcggccauucaucgcgc

SEQ ID NO: 2891072 - RNA, 22 nt, Mycobacterium avium subsp. paratuberculosis
gcggccauucaucgcgcaccag

SEQ ID NO: 2891073 - RNA, 23 nt, Mycobacterium avium subsp. paratuberculosis
gcggccauucaucgcgcaccagg

SEQ ID NO: 2891074 - RNA, 21 nt, Mycobacterium avium subsp. paratuberculosis
gcggcccaacacgcccugcag

SEQ ID NO: 2891075 - RNA, 14 nt, Mycobacterium avium subsp. paratuberculosis
gcggcccacccgca

SEQ ID NO: 2891076 - RNA, 22 nt, Mycobacterium avium subsp. paratuberculosis
gcggcccacccgcagggcgccg

SEQ ID NO: 2891077 - RNA, 18 nt, Mycobacterium avium subsp. paratuberculosis
gcggcccacccggauguc

SEQ ID NO: 2891078 - RNA, 16 nt, Mycobacterium avium subsp. paratuberculosis
gcggcccaccgcgacc

SEQ ID NO: 2891079 - RNA, 18 nt, Mycobacterium avium subsp. paratuberculosis
gcggcccaccgcgacccg

SEQ ID NO: 2891080 - RNA, 22 nt, Mycobacterium avium subsp. paratuberculosis
gcggcccaccgcgacccggccg

SEQ ID NO: 2891081 - RNA, 14 nt, Mycobacterium avium subsp. paratuberculosis
gcggcccaccgcgu

SEQ ID NO: 2891082 - RNA, 16 nt, Mycobacterium avium subsp. paratuberculosis
gcggcccaccgcgucg

SEQ ID NO: 2891083 - RNA, 19 nt, Mycobacterium avium subsp. paratuberculosis
gcggcccaccgcgucgcag

SEQ ID NO: 2891084 - RNA, 12 nt, Mycobacterium avium subsp. paratuberculosis
gcggcccagcac

SEQ ID NO: 2891085 - RNA, 16 nt, Mycobacterium avium subsp. paratuberculosis
gcggcccagcaccacc

SEQ ID NO: 2891086 - RNA, 14 nt, Mycobacterium avium subsp. paratuberculosis
gcggcccagcccgg

SEQ ID NO: 2891087 - RNA, 15 nt, Mycobacterium avium subsp. paratuberculosis
gcggcccagcccggc

SEQ ID NO: 2891088 - RNA, 19 nt, Mycobacterium avium subsp. paratuberculosis
gcggcccagcccggccagc

SEQ ID NO: 2891089 - RNA, 20 nt, Mycobacterium avium subsp. paratuberculosis
gcggcccagcccggccagca

SEQ ID NO: 2891090 - RNA, 21 nt, Mycobacterium avium subsp. paratuberculosis
gcggcccagcccggccagcac

SEQ ID NO: 2891091 - RNA, 12 nt, Mycobacterium avium subsp. paratuberculosis
gcggcccagcgu

SEQ ID NO: 2891092 - RNA, 13 nt, Mycobacterium avium subsp. paratuberculosis
gcggcccagcguc

SEQ ID NO: 2891093 - RNA, 23 nt, Mycobacterium avium subsp. paratuberculosis
gcggcccagcgucaacucgucgg

SEQ ID NO: 2891094 - RNA, 16 nt, Mycobacterium avium subsp. paratuberculosis
gcggcccagcucggug

SEQ ID NO: 2891095 - RNA, 17 nt, Mycobacterium avium subsp. paratuberculosis
gcggcccagcucgguga

SEQ ID NO: 2891096 - RNA, 19 nt, Mycobacterium avium subsp. paratuberculosis
gcggcccagggcgcucugg

SEQ ID NO: 2891097 - RNA, 21 nt, Mycobacterium avium subsp. paratuberculosis
gcggcccagguauucguugcc

SEQ ID NO: 2891098 - RNA, 22 nt, Mycobacterium avium subsp. paratuberculosis
gcggcccagguauucguugccc

SEQ ID NO: 2891099 - RNA, 22 nt, Mycobacterium avium subsp. paratuberculosis
gcggcccagguucuccggcccg

SEQ ID NO: 2891100 - RNA, 23 nt, Mycobacterium avium subsp. paratuberculosis
gcggcccagguucuccggcccgc

SEQ ID NO: 2891101 - RNA, 20 nt, Mycobacterium avium subsp. paratuberculosis
gcggccccacguugaucaug

SEQ ID NO: 2891102 - RNA, 18 nt, Mycobacterium avium subsp. paratuberculosis
gcggcccccacgcagcgg

SEQ ID NO: 2891103 - RNA, 20 nt, Mycobacterium avium subsp. paratuberculosis
gcggcccccacgcagcggug

SEQ ID NO: 2891104 - RNA, 21 nt, Mycobacterium avium subsp. paratuberculosis
gcggccccccgcacaccggcc

SEQ ID NO: 2891105 - RNA, 21 nt, Mycobacterium avium subsp. paratuberculosis
gcggcccccugaucggccgca

SEQ ID NO: 2891106 - RNA, 15 nt, Mycobacterium avium subsp. paratuberculosis
gcggccccgccagca

SEQ ID NO: 2891107 - RNA, 16 nt, Mycobacterium avium subsp. paratuberculosis
gcggccccggcucggg

SEQ ID NO: 2891108 - RNA, 17 nt, Mycobacterium avium subsp. paratuberculosis
gcggccccggcucgggc

SEQ ID NO: 2891109 - RNA, 20 nt, Mycobacterium avium subsp. paratuberculosis
gcggccccggcucgggccaa

SEQ ID NO: 2891110 - RNA, 18 nt, Mycobacterium avium subsp. paratuberculosis
gcggccccgguagccagc

SEQ ID NO: 2891111 - RNA, 16 nt, Mycobacterium avium subsp. paratuberculosis
gcggcccuugcggccg

SEQ ID NO: 2891112 - RNA, 20 nt, Mycobacterium avium subsp. paratuberculosis
gcggcccuugcggccgauca

SEQ ID NO: 2891113 - RNA, 21 nt, Mycobacterium avium subsp. paratuberculosis
gcggccgaaaucaacgcgccg

SEQ ID NO: 2891114 - RNA, 22 nt, Mycobacterium avium subsp. paratuberculosis
gcggccgaaaucaacgcgccga

SEQ ID NO: 2891115 - RNA, 14 nt, Mycobacterium avium subsp. paratuberculosis
gcggccgaaccgcu

SEQ ID NO: 2891116 - RNA, 22 nt, Mycobacterium avium subsp. paratuberculosis
gcggccgaaccgcugcaaccgg

SEQ ID NO: 2891117 - RNA, 14 nt, Mycobacterium avium subsp. paratuberculosis
gcggccgaagucca

SEQ ID NO: 2891118 - RNA, 16 nt, Mycobacterium avium subsp. paratuberculosis
gcggccgaauccggcc

SEQ ID NO: 2891119 - RNA, 18 nt, Mycobacterium avium subsp. paratuberculosis
gcggccgaauccggccgg

SEQ ID NO: 2891120 - RNA, 19 nt, Mycobacterium avium subsp. paratuberculosis
gcggccgaauccggccgga

SEQ ID NO: 2891121 - RNA, 20 nt, Mycobacterium avium subsp. paratuberculosis
gcggccgaauccggccggag

SEQ ID NO: 2891122 - RNA, 16 nt, Mycobacterium avium subsp. paratuberculosis
gcggccgacagcgcgu

SEQ ID NO: 2891123 - RNA, 17 nt, Mycobacterium avium subsp. paratuberculosis
gcggccgacagggugcc

SEQ ID NO: 2891124 - RNA, 17 nt, Mycobacterium avium subsp. paratuberculosis
gcggccgacccugcguc

SEQ ID NO: 2891125 - RNA, 20 nt, Mycobacterium avium subsp. paratuberculosis
gcggccgacgaacaagggcg

SEQ ID NO: 2891126 - RNA, 12 nt, Mycobacterium avium subsp. paratuberculosis
gcggccgacgcg

SEQ ID NO: 2891127 - RNA, 14 nt, Mycobacterium avium subsp. paratuberculosis
gcggccgacgcgcc

SEQ ID NO: 2891128 - RNA, 20 nt, Mycobacterium avium subsp. paratuberculosis
gcggccgacgcgccgucggc

SEQ ID NO: 2891129 - RNA, 22 nt, Mycobacterium avium subsp. paratuberculosis
gcggccgacuuggucagcccgc

SEQ ID NO: 2891130 - RNA, 18 nt, Mycobacterium avium subsp. paratuberculosis
gcggccgagcgcaccgcg

SEQ ID NO: 2891131 - RNA, 19 nt, Mycobacterium avium subsp. paratuberculosis
gcggccgagcgcaccgcgg

SEQ ID NO: 2891132 - RNA, 20 nt, Mycobacterium avium subsp. paratuberculosis
gcggccgagcgcaccgcgga

SEQ ID NO: 2891133 - RNA, 16 nt, Mycobacterium avium subsp. paratuberculosis
gcggccgaucaccucg

SEQ ID NO: 2891134 - RNA, 20 nt, Mycobacterium avium subsp. paratuberculosis
gcggccgaucaccucgaugg

SEQ ID NO: 2891135 - RNA, 21 nt, Mycobacterium avium subsp. paratuberculosis
gcggccgauucggcgccgcga

SEQ ID NO: 2891136 - RNA, 21 nt, Mycobacterium avium subsp. paratuberculosis
gcggccgcaaucggcgccggc

SEQ ID NO: 2891137 - RNA, 21 nt, Mycobacterium avium subsp. paratuberculosis
gcggccgcagcgcccggcagc

SEQ ID NO: 2891138 - RNA, 17 nt, Mycobacterium avium subsp. paratuberculosis
gcggccgcagcgugggc

SEQ ID NO: 2891139 - RNA, 16 nt, Mycobacterium avium subsp. paratuberculosis
gcggccgcaugucgac

SEQ ID NO: 2891140 - RNA, 23 nt, Mycobacterium avium subsp. paratuberculosis
gcggccgcaugucgaccucggcc

SEQ ID NO: 2891141 - RNA, 12 nt, Mycobacterium avium subsp. paratuberculosis
gcggccgccacg

SEQ ID NO: 2891142 - RNA, 13 nt, Mycobacterium avium subsp. paratuberculosis
gcggccgccagcg

SEQ ID NO: 2891143 - RNA, 16 nt, Mycobacterium avium subsp. paratuberculosis
gcggccgccagcgucc

SEQ ID NO: 2891144 - RNA, 13 nt, Mycobacterium avium subsp. paratuberculosis
gcggccgccaggu

SEQ ID NO: 2891145 - RNA, 15 nt, Mycobacterium avium subsp. paratuberculosis
gcggccgccaucauc

SEQ ID NO: 2891146 - RNA, 20 nt, Mycobacterium avium subsp. paratuberculosis
gcggccgcccagcccgcgcc

SEQ ID NO: 2891147 - RNA, 21 nt, Mycobacterium avium subsp. paratuberculosis
gcggccgcccagucgccgccg

SEQ ID NO: 2891148 - RNA, 20 nt, Mycobacterium avium subsp. paratuberculosis
gcggccgcccgggcggcccg

SEQ ID NO: 2891149 - RNA, 22 nt, Mycobacterium avium subsp. paratuberculosis
gcggccgcccgggcggcccgca

SEQ ID NO: 2891150 - RNA, 13 nt, Mycobacterium avium subsp. paratuberculosis
gcggccgcccggu

SEQ ID NO: 2891151 - RNA, 18 nt, Mycobacterium avium subsp. paratuberculosis
gcggccgcccgguccggg

SEQ ID NO: 2891152 - RNA, 21 nt, Mycobacterium avium subsp. paratuberculosis
gcggccgcccgguccgggucg

SEQ ID NO: 2891153 - RNA, 12 nt, Mycobacterium avium subsp. paratuberculosis
gcggccgcccgu

SEQ ID NO: 2891154 - RNA, 16 nt, Mycobacterium avium subsp. paratuberculosis
gcggccgcccgucggg

SEQ ID NO: 2891155 - RNA, 23 nt, Mycobacterium avium subsp. paratuberculosis
gcggccgcccgucggggcccggc

SEQ ID NO: 2891156 - RNA, 22 nt, Mycobacterium avium subsp. paratuberculosis
gcggccgccgcccgcgcggcgg

SEQ ID NO: 2891157 - RNA, 23 nt, Mycobacterium avium subsp. paratuberculosis
gcggccgccgcccgcgcggcggc

SEQ ID NO: 2891158 - RNA, 15 nt, Mycobacterium avium subsp. paratuberculosis
gcggccgccgccgcg

SEQ ID NO: 2891159 - RNA, 17 nt, Mycobacterium avium subsp. paratuberculosis
gcggccgccgccgcggc

SEQ ID NO: 2891160 - RNA, 18 nt, Mycobacterium avium subsp. paratuberculosis
gcggccgccgccgcggcc

SEQ ID NO: 2891161 - RNA, 19 nt, Mycobacterium avium subsp. paratuberculosis
gcggccgccgccgcggccg

SEQ ID NO: 2891162 - RNA, 21 nt, Mycobacterium avium subsp. paratuberculosis
gcggccgccgccgcggccgcg

SEQ ID NO: 2891163 - RNA, 13 nt, Mycobacterium avium subsp. paratuberculosis
gcggccgccgcga

SEQ ID NO: 2891164 - RNA, 14 nt, Mycobacterium avium subsp. paratuberculosis
gcggccgccgcgac

SEQ ID NO: 2891165 - RNA, 15 nt, Mycobacterium avium subsp. paratuberculosis
gcggccgccgcgacg

SEQ ID NO: 2891166 - RNA, 14 nt, Mycobacterium avium subsp. paratuberculosis
gcggccgccgcgau

SEQ ID NO: 2891167 - RNA, 18 nt, Mycobacterium avium subsp. paratuberculosis
gcggccgccgcgaucagg

SEQ ID NO: 2891168 - RNA, 11 nt, Mycobacterium avium subsp. paratuberculosis
gcggccgccgg

SEQ ID NO: 2891169 - RNA, 15 nt, Mycobacterium avium subsp. paratuberculosis
gcggccgccggcacc

SEQ ID NO: 2891170 - RNA, 17 nt, Mycobacterium avium subsp. paratuberculosis
gcggccgccggcaccgu

SEQ ID NO: 2891171 - RNA, 22 nt, Mycobacterium avium subsp. paratuberculosis
gcggccgccggcaccguccggc

SEQ ID NO: 2891172 - RNA, 13 nt, Mycobacterium avium subsp. paratuberculosis
gcggccgccggcc

SEQ ID NO: 2891173 - RNA, 18 nt, Mycobacterium avium subsp. paratuberculosis
gcggccgccggccagcuc

SEQ ID NO: 2891174 - RNA, 12 nt, Mycobacterium avium subsp. paratuberculosis
gcggccgccggg

SEQ ID NO: 2891175 - RNA, 18 nt, Mycobacterium avium subsp. paratuberculosis
gcggccgccgggccggcg

SEQ ID NO: 2891176 - RNA, 21 nt, Mycobacterium avium subsp. paratuberculosis
gcggccgccgggccggcggcc

SEQ ID NO: 2891177 - RNA, 13 nt, Mycobacterium avium subsp. paratuberculosis
gcggccgccgggg

SEQ ID NO: 2891178 - RNA, 14 nt, Mycobacterium avium subsp. paratuberculosis
gcggccgccggggc

SEQ ID NO: 2891179 - RNA, 18 nt, Mycobacterium avium subsp. paratuberculosis
gcggccgccggggcccca

SEQ ID NO: 2891180 - RNA, 19 nt, Mycobacterium avium subsp. paratuberculosis
gcggccgccggggccccaa

SEQ ID NO: 2891181 - RNA, 22 nt, Mycobacterium avium subsp. paratuberculosis
gcggccgccggggccccaaccc

SEQ ID NO: 2891182 - RNA, 20 nt, Mycobacterium avium subsp. paratuberculosis
gcggccgccuucacgaccgg

SEQ ID NO: 2891183 - RNA, 20 nt, Mycobacterium avium subsp. paratuberculosis
gcggccgcgaaggcggcguc

SEQ ID NO: 2891184 - RNA, 16 nt, Mycobacterium avium subsp. paratuberculosis
gcggccgcgacggacc

SEQ ID NO: 2891185 - RNA, 20 nt, Mycobacterium avium subsp. paratuberculosis
gcggccgcgacggaccagug

SEQ ID NO: 2891186 - RNA, 14 nt, Mycobacterium avium subsp. paratuberculosis
gcggccgcgagccc

SEQ ID NO: 2891187 - RNA, 18 nt, Mycobacterium avium subsp. paratuberculosis
gcggccgcgagcccggcg

SEQ ID NO: 2891188 - RNA, 16 nt, Mycobacterium avium subsp. paratuberculosis
gcggccgcgaucgcca

SEQ ID NO: 2891189 - RNA, 20 nt, Mycobacterium avium subsp. paratuberculosis
gcggccgcgaucgccaacgc

SEQ ID NO: 2891190 - RNA, 10 nt, Mycobacterium avium subsp. paratuberculosis
gcggccgcgc

SEQ ID NO: 2891191 - RNA, 12 nt, Mycobacterium avium subsp. paratuberculosis
gcggccgcgcag

SEQ ID NO: 2891192 - RNA, 14 nt, Mycobacterium avium subsp. paratuberculosis
gcggccgcgcagcu

SEQ ID NO: 2891193 - RNA, 22 nt, Mycobacterium avium subsp. paratuberculosis
gcggccgcgcagcucgacgacc

SEQ ID NO: 2891194 - RNA, 16 nt, Mycobacterium avium subsp. paratuberculosis
gcggccgcgccggccg

SEQ ID NO: 2891195 - RNA, 14 nt, Mycobacterium avium subsp. paratuberculosis
gcggccgcgcgccc

SEQ ID NO: 2891196 - RNA, 23 nt, Mycobacterium avium subsp. paratuberculosis
gcggccuuuuccggcgacaccgc

SEQ ID NO: 2891197 - RNA, 18 nt, Mycobacterium avium subsp. paratuberculosis
gcggccuuuuucugcgcc

SEQ ID NO: 2891198 - RNA, 17 nt, Mycobacterium avium subsp. paratuberculosis
gcggcgaaaacgccugc

SEQ ID NO: 2891199 - RNA, 23 nt, Mycobacterium avium subsp. paratuberculosis
gcggcgaaaacgccugcgccgcc

SEQ ID NO: 2891200 - RNA, 19 nt, Mycobacterium avium subsp. paratuberculosis
gcggcgaaaucgcuccucg

SEQ ID NO: 2891201 - RNA, 23 nt, Mycobacterium avium subsp. paratuberculosis
gcggcgaaaucgcuccucgauca

SEQ ID NO: 2891202 - RNA, 13 nt, Mycobacterium avium subsp. paratuberculosis
gcggcgaaaucgg

SEQ ID NO: 2891203 - RNA, 17 nt, Mycobacterium avium subsp. paratuberculosis
gcggcgaacaacgccac

SEQ ID NO: 2891204 - RNA, 14 nt, Mycobacterium avium subsp. paratuberculosis
gcggcgaacaccag

SEQ ID NO: 2891205 - RNA, 15 nt, Mycobacterium avium subsp. paratuberculosis
gcggcgaacaccagc

SEQ ID NO: 2891206 - RNA, 17 nt, Mycobacterium avium subsp. paratuberculosis
gcggcgaacaccagcac

SEQ ID NO: 2891207 - RNA, 18 nt, Mycobacterium avium subsp. paratuberculosis
gcggcgaacaccagcacc

SEQ ID NO: 2891208 - RNA, 19 nt, Mycobacterium avium subsp. paratuberculosis
gcggcgaacaccagcaccc

SEQ ID NO: 2891209 - RNA, 21 nt, Mycobacterium avium subsp. paratuberculosis
gcggcgaacaccagcacccag

SEQ ID NO: 2891210 - RNA, 18 nt, Mycobacterium avium subsp. paratuberculosis
gcggcgaacaccucggcg

SEQ ID NO: 2891211 - RNA, 20 nt, Mycobacterium avium subsp. paratuberculosis
gcggcgaacaccucggcgau

SEQ ID NO: 2891212 - RNA, 15 nt, Mycobacterium avium subsp. paratuberculosis
gcggcgaaccagcau

SEQ ID NO: 2891213 - RNA, 17 nt, Mycobacterium avium subsp. paratuberculosis
gcggcgaaccagcaugc

SEQ ID NO: 2891214 - RNA, 16 nt, Mycobacterium avium subsp. paratuberculosis
gcggcgaacccgagca

SEQ ID NO: 2891215 - RNA, 22 nt, Mycobacterium avium subsp. paratuberculosis
gcggcgaacccgagcaccccgg

SEQ ID NO: 2891216 - RNA, 14 nt, Mycobacterium avium subsp. paratuberculosis
gcggcgaaccgggc

SEQ ID NO: 2891217 - RNA, 18 nt, Mycobacterium avium subsp. paratuberculosis
gcggcgaaccgggcccgu

SEQ ID NO: 2891218 - RNA, 14 nt, Mycobacterium avium subsp. paratuberculosis
gcggcgaacgccgc

SEQ ID NO: 2891219 - RNA, 15 nt, Mycobacterium avium subsp. paratuberculosis
gcggcgaacgccgcc

SEQ ID NO: 2891220 - RNA, 17 nt, Mycobacterium avium subsp. paratuberculosis
gcggcgaacgccgccgu

SEQ ID NO: 2891221 - RNA, 18 nt, Mycobacterium avium subsp. paratuberculosis
gcggcgaacgccgccgug

SEQ ID NO: 2891222 - RNA, 15 nt, Mycobacterium avium subsp. paratuberculosis
gcggcgaacgcgcgg

SEQ ID NO: 2891223 - RNA, 16 nt, Mycobacterium avium subsp. paratuberculosis
gcggcgaacgcgcggu

SEQ ID NO: 2891224 - RNA, 17 nt, Mycobacterium avium subsp. paratuberculosis
gcggcgaacgcgcgguc

SEQ ID NO: 2891225 - RNA, 23 nt, Mycobacterium avium subsp. paratuberculosis
gcggcgaacgcgcggucgucgcc

SEQ ID NO: 2891226 - RNA, 19 nt, Mycobacterium avium subsp. paratuberculosis
gcggcgaagacgucggcgc

SEQ ID NO: 2891227 - RNA, 22 nt, Mycobacterium avium subsp. paratuberculosis
gcggcgaagacgucggcgcggu

SEQ ID NO: 2891228 - RNA, 14 nt, Mycobacterium avium subsp. paratuberculosis
gcggcgaagccggc

SEQ ID NO: 2891229 - RNA, 15 nt, Mycobacterium avium subsp. paratuberculosis
gcggcgaagccggcc

SEQ ID NO: 2891230 - RNA, 16 nt, Mycobacterium avium subsp. paratuberculosis
gcggcgaagccggccc

SEQ ID NO: 2891231 - RNA, 20 nt, Mycobacterium avium subsp. paratuberculosis
gcggcgaagccggccccgcc

SEQ ID NO: 2891232 - RNA, 18 nt, Mycobacterium avium subsp. paratuberculosis
gcggcgaaggccagcgau

SEQ ID NO: 2891233 - RNA, 15 nt, Mycobacterium avium subsp. paratuberculosis
gcggcgaaguugcgg

SEQ ID NO: 2891234 - RNA, 24 nt, Mycobacterium avium subsp. paratuberculosis
gcggcgaauaccagggcgaggaac

SEQ ID NO: 2891235 - RNA, 18 nt, Mycobacterium avium subsp. paratuberculosis
gcggcgaauccgagcauc

SEQ ID NO: 2891236 - RNA, 19 nt, Mycobacterium avium subsp. paratuberculosis
gcggcgaaucgguccggcg

SEQ ID NO: 2891237 - RNA, 17 nt, Mycobacterium avium subsp. paratuberculosis
gcggcgaaugccugacg

SEQ ID NO: 2891238 - RNA, 15 nt, Mycobacterium avium subsp. paratuberculosis
gcggcgacacccagc

SEQ ID NO: 2891239 - RNA, 22 nt, Mycobacterium avium subsp. paratuberculosis
gcggcgacacccagcggcgcgg

SEQ ID NO: 2891240 - RNA, 15 nt, Mycobacterium avium subsp. paratuberculosis
gcggcgacacgccga

SEQ ID NO: 2891241 - RNA, 16 nt, Mycobacterium avium subsp. paratuberculosis
gcggcgacacgccgac

SEQ ID NO: 2891242 - RNA, 22 nt, Mycobacterium avium subsp. paratuberculosis
gcggcgacauuggccgcgcgca

SEQ ID NO: 2891243 - RNA, 20 nt, Mycobacterium avium subsp. paratuberculosis
gcggcgaccaaugcccugac

SEQ ID NO: 2891244 - RNA, 15 nt, Mycobacterium avium subsp. paratuberculosis
gcggcgaccaccacc

SEQ ID NO: 2891245 - RNA, 17 nt, Mycobacterium avium subsp. paratuberculosis
gcggcgaccaccaccgc

SEQ ID NO: 2891246 - RNA, 18 nt, Mycobacterium avium subsp. paratuberculosis
gcggcgaccaccucggcg

SEQ ID NO: 2891247 - RNA, 20 nt, Mycobacterium avium subsp. paratuberculosis
gcggcgaccaccucggcgac

SEQ ID NO: 2891248 - RNA, 22 nt, Mycobacterium avium subsp. paratuberculosis
gcggcgaccaccucggcgacga

SEQ ID NO: 2891249 - RNA, 12 nt, Mycobacterium avium subsp. paratuberculosis
gcggcgacccgc

SEQ ID NO: 2891250 - RNA, 19 nt, Mycobacterium avium subsp. paratuberculosis
gcggcgacccgcuucgccc

SEQ ID NO: 2891251 - RNA, 21 nt, Mycobacterium avium subsp. paratuberculosis
gcggcgacccgcuucgcccgg

SEQ ID NO: 2891252 - RNA, 22 nt, Mycobacterium avium subsp. paratuberculosis
gcggcgacccgcuucgcccggc

SEQ ID NO: 2891253 - RNA, 13 nt, Mycobacterium avium subsp. paratuberculosis
gcggcgaccgcga

SEQ ID NO: 2891254 - RNA, 15 nt, Mycobacterium avium subsp. paratuberculosis
gcggcgaccgcgacg

SEQ ID NO: 2891255 - RNA, 19 nt, Mycobacterium avium subsp. paratuberculosis
gcggcgaccgcgacgauca

SEQ ID NO: 2891256 - RNA, 14 nt, Mycobacterium avium subsp. paratuberculosis
gcggcgaccggggc

SEQ ID NO: 2891257 - RNA, 17 nt, Mycobacterium avium subsp. paratuberculosis
gcggcgaccggggcggu

SEQ ID NO: 2891258 - RNA, 18 nt, Mycobacterium avium subsp. paratuberculosis
gcggcgaccggggcggug

SEQ ID NO: 2891259 - RNA, 19 nt, Mycobacterium avium subsp. paratuberculosis
gcggcgaccggggcgguga

SEQ ID NO: 2891260 - RNA, 21 nt, Mycobacterium avium subsp. paratuberculosis
gcggcgaccuugcggcgcgau

SEQ ID NO: 2891261 - RNA, 16 nt, Mycobacterium avium subsp. paratuberculosis
gcggcgacgaacgccg

SEQ ID NO: 2891262 - RNA, 15 nt, Mycobacterium avium subsp. paratuberculosis
gcggcgacgaucggc

SEQ ID NO: 2891263 - RNA, 15 nt, Mycobacterium avium subsp. paratuberculosis
gcggcgacggcaccg

SEQ ID NO: 2891264 - RNA, 13 nt, Mycobacterium avium subsp. paratuberculosis
gcggcgacggccg

SEQ ID NO: 2891265 - RNA, 16 nt, Mycobacterium avium subsp. paratuberculosis
gcggcgacggccgucc

SEQ ID NO: 2891266 - RNA, 17 nt, Mycobacterium avium subsp. paratuberculosis
gcggcgacggccguccg

SEQ ID NO: 2891267 - RNA, 12 nt, Mycobacterium avium subsp. paratuberculosis
gcggcgacggcg

SEQ ID NO: 2891268 - RNA, 19 nt, Mycobacterium avium subsp. paratuberculosis
gcggcgacggcgucggcgg

SEQ ID NO: 2891269 - RNA, 20 nt, Mycobacterium avium subsp. paratuberculosis
gcggcgacggcgucggcggc

SEQ ID NO: 2891270 - RNA, 23 nt, Mycobacterium avium subsp. paratuberculosis
gcggcgacggcgucggcggccug

SEQ ID NO: 2891271 - RNA, 14 nt, Mycobacterium avium subsp. paratuberculosis
gcggcgacgguguc

SEQ ID NO: 2891272 - RNA, 14 nt, Mycobacterium avium subsp. paratuberculosis
gcggcgacgucgac

SEQ ID NO: 2891273 - RNA, 21 nt, Mycobacterium avium subsp. paratuberculosis
gcggcgacgucguggcccgga

SEQ ID NO: 2891274 - RNA, 22 nt, Mycobacterium avium subsp. paratuberculosis
gcggcgacgugaucggcggccu

SEQ ID NO: 2891275 - RNA, 15 nt, Mycobacterium avium subsp. paratuberculosis
gcggcgacgugccgg

SEQ ID NO: 2891276 - RNA, 16 nt, Mycobacterium avium subsp. paratuberculosis
gcggcgacgugccggc

SEQ ID NO: 2891277 - RNA, 20 nt, Mycobacterium avium subsp. paratuberculosis
gcggcgacgugccggcggca

SEQ ID NO: 2891278 - RNA, 17 nt, Mycobacterium avium subsp. paratuberculosis
gcggcgacuccagcagc

SEQ ID NO: 2891279 - RNA, 18 nt, Mycobacterium avium subsp. paratuberculosis
gcggcgacuccagcagcg

SEQ ID NO: 2891280 - RNA, 19 nt, Mycobacterium avium subsp. paratuberculosis
gcggcgacuccagcagcgc

SEQ ID NO: 2891281 - RNA, 22 nt, Mycobacterium avium subsp. paratuberculosis
gcggcgacuccagcagcgccag

SEQ ID NO: 2891282 - RNA, 23 nt, Mycobacterium avium subsp. paratuberculosis
gcggcgacuccagcagcgccagc

SEQ ID NO: 2891283 - RNA, 20 nt, Mycobacterium avium subsp. paratuberculosis
gcggcgagauuggccucggc

SEQ ID NO: 2891284 - RNA, 22 nt, Mycobacterium avium subsp. paratuberculosis
gcggcgagauuggccucggcgc

SEQ ID NO: 2891285 - RNA, 16 nt, Mycobacterium avium subsp. paratuberculosis
gcggcgagcagcgcga

SEQ ID NO: 2891286 - RNA, 18 nt, Mycobacterium avium subsp. paratuberculosis
gcggcgagcagcgcgaug

SEQ ID NO: 2891287 - RNA, 14 nt, Mycobacterium avium subsp. paratuberculosis
gcggcgagccggcc

SEQ ID NO: 2891288 - RNA, 16 nt, Mycobacterium avium subsp. paratuberculosis
gcggcgagccggccgu

SEQ ID NO: 2891289 - RNA, 19 nt, Mycobacterium avium subsp. paratuberculosis
gcggcgagcugaucggcgu

SEQ ID NO: 2891290 - RNA, 20 nt, Mycobacterium avium subsp. paratuberculosis
gcggcgaggaacucagcgcc

SEQ ID NO: 2891291 - RNA, 19 nt, Mycobacterium avium subsp. paratuberculosis
gcggcgaggacgucgucga

SEQ ID NO: 2891292 - RNA, 21 nt, Mycobacterium avium subsp. paratuberculosis
gcggcgaggacgucgucgacg

SEQ ID NO: 2891293 - RNA, 23 nt, Mycobacterium avium subsp. paratuberculosis
gcggcgaggacgucgucgacguc

SEQ ID NO: 2891294 - RNA, 16 nt, Mycobacterium avium subsp. paratuberculosis
gcggcgagucccggcg

SEQ ID NO: 2891295 - RNA, 22 nt, Mycobacterium avium subsp. paratuberculosis
gcggcgagucccggcgcaccag

SEQ ID NO: 2891296 - RNA, 14 nt, Mycobacterium avium subsp. paratuberculosis
gcggcgaguccggc

SEQ ID NO: 2891297 - RNA, 23 nt, Mycobacterium avium subsp. paratuberculosis
gcggcgaguccggccaggucgcc

SEQ ID NO: 2891298 - RNA, 14 nt, Mycobacterium avium subsp. paratuberculosis
gcggcgaguucggc

SEQ ID NO: 2891299 - RNA, 16 nt, Mycobacterium avium subsp. paratuberculosis
gcggcgaguucggcgg

SEQ ID NO: 2891300 - RNA, 17 nt, Mycobacterium avium subsp. paratuberculosis
gcggcgaguucggcggc

SEQ ID NO: 2891301 - RNA, 19 nt, Mycobacterium avium subsp. paratuberculosis
gcggcgaguucggcggccc

SEQ ID NO: 2891302 - RNA, 23 nt, Mycobacterium avium subsp. paratuberculosis
gcggcgaguucugguaggcggcc

SEQ ID NO: 2891303 - RNA, 12 nt, Mycobacterium avium subsp. paratuberculosis
gcggcgaucacc

SEQ ID NO: 2891304 - RNA, 16 nt, Mycobacterium avium subsp. paratuberculosis
gcggcgaucaccgccg

SEQ ID NO: 2891305 - RNA, 19 nt, Mycobacterium avium subsp. paratuberculosis
gcggcgaucaccgccgcgg

SEQ ID NO: 2891306 - RNA, 21 nt, Mycobacterium avium subsp. paratuberculosis
gcggcgaucaccgccgcggcg

SEQ ID NO: 2891307 - RNA, 12 nt, Mycobacterium avium subsp. paratuberculosis
gcggcgaucagc

SEQ ID NO: 2891308 - RNA, 17 nt, Mycobacterium avium subsp. paratuberculosis
gcggcgaucagcagcac

SEQ ID NO: 2891309 - RNA, 18 nt, Mycobacterium avium subsp. paratuberculosis
gcggcgaucagcccggcc

SEQ ID NO: 2891310 - RNA, 22 nt, Mycobacterium avium subsp. paratuberculosis
gcggcgaucagcccggcccgca

SEQ ID NO: 2891311 - RNA, 18 nt, Mycobacterium avium subsp. paratuberculosis
gcggcgaucagcugcucg

SEQ ID NO: 2891312 - RNA, 13 nt, Mycobacterium avium subsp. paratuberculosis
gcggcgauccggc

SEQ ID NO: 2891313 - RNA, 15 nt, Mycobacterium avium subsp. paratuberculosis
gcggcgauccggccg

SEQ ID NO: 2891314 - RNA, 16 nt, Mycobacterium avium subsp. paratuberculosis
gcggcgauccggccgg

SEQ ID NO: 2891315 - RNA, 18 nt, Mycobacterium avium subsp. paratuberculosis
gcggcgauccggccggcg

SEQ ID NO: 2891316 - RNA, 21 nt, Mycobacterium avium subsp. paratuberculosis
gcggcgauccggccggcggcg

SEQ ID NO: 2891317 - RNA, 22 nt, Mycobacterium avium subsp. paratuberculosis
gcggcgauccggccggcggcgg

SEQ ID NO: 2891318 - RNA, 13 nt, Mycobacterium avium subsp. paratuberculosis
gcggcgaucgccg

SEQ ID NO: 2891319 - RNA, 14 nt, Mycobacterium avium subsp. paratuberculosis
gcggcgaucgccgc

SEQ ID NO: 2891320 - RNA, 15 nt, Mycobacterium avium subsp. paratuberculosis
gcggcgaucgccgug

SEQ ID NO: 2891321 - RNA, 16 nt, Mycobacterium avium subsp. paratuberculosis
gcggcgaucgcgagca

SEQ ID NO: 2891322 - RNA, 18 nt, Mycobacterium avium subsp. paratuberculosis
gcggcgaucgcgagcagg

SEQ ID NO: 2891323 - RNA, 11 nt, Mycobacterium avium subsp. paratuberculosis
gcggcgaucgg

SEQ ID NO: 2891324 - RNA, 15 nt, Mycobacterium avium subsp. paratuberculosis
gcggcgaucggcgcg

SEQ ID NO: 2891325 - RNA, 17 nt, Mycobacterium avium subsp. paratuberculosis
gcggcgaucggcgcggc

SEQ ID NO: 2891326 - RNA, 18 nt, Mycobacterium avium subsp. paratuberculosis
gcggcgaucggcgcggcg

SEQ ID NO: 2891327 - RNA, 14 nt, Mycobacterium avium subsp. paratuberculosis
gcggcgaucggcgg

SEQ ID NO: 2891328 - RNA, 15 nt, Mycobacterium avium subsp. paratuberculosis
gcggcgaucggcggu

SEQ ID NO: 2891329 - RNA, 12 nt, Mycobacterium avium subsp. paratuberculosis
gcggcgaucggg

SEQ ID NO: 2891330 - RNA, 17 nt, Mycobacterium avium subsp. paratuberculosis
gcggcgaucgggucacc

SEQ ID NO: 2891331 - RNA, 21 nt, Mycobacterium avium subsp. paratuberculosis
gcggcgaucgggucaccggcc

SEQ ID NO: 2891332 - RNA, 17 nt, Mycobacterium avium subsp. paratuberculosis
gcggcgaucucggcggc

SEQ ID NO: 2891333 - RNA, 21 nt, Mycobacterium avium subsp. paratuberculosis
gcggcgaucucggcggccgcg

SEQ ID NO: 2891334 - RNA, 18 nt, Mycobacterium avium subsp. paratuberculosis
gcggcgaucuugucccgc

SEQ ID NO: 2891335 - RNA, 24 nt, Mycobacterium avium subsp. paratuberculosis
gcggcgaucuuugcggccguggcg

SEQ ID NO: 2891336 - RNA, 19 nt, Mycobacterium avium subsp. paratuberculosis
gcggcgaugaagccccgga

SEQ ID NO: 2891337 - RNA, 20 nt, Mycobacterium avium subsp. paratuberculosis
gcggcgaugaagccccggac

SEQ ID NO: 2891338 - RNA, 15 nt, Mycobacterium avium subsp. paratuberculosis
gcggcgaugaccgga

SEQ ID NO: 2891339 - RNA, 16 nt, Mycobacterium avium subsp. paratuberculosis
gcggcgaugaccggac

SEQ ID NO: 2891340 - RNA, 21 nt, Mycobacterium avium subsp. paratuberculosis
gcggcgaugaucacgaaguug

SEQ ID NO: 2891341 - RNA, 18 nt, Mycobacterium avium subsp. paratuberculosis
gcggcgaugauccgcggc

SEQ ID NO: 2891342 - RNA, 20 nt, Mycobacterium avium subsp. paratuberculosis
gcggcgaugauccgcggcgc

SEQ ID NO: 2891343 - RNA, 21 nt, Mycobacterium avium subsp. paratuberculosis
gcggcgaugauccgcggcgcc

SEQ ID NO: 2891344 - RNA, 22 nt, Mycobacterium avium subsp. paratuberculosis
gcggcgaugauccgcggcgccg

SEQ ID NO: 2891345 - RNA, 17 nt, Mycobacterium avium subsp. paratuberculosis
gcggcgaugaucgggau

SEQ ID NO: 2891346 - RNA, 19 nt, Mycobacterium avium subsp. paratuberculosis
gcggcgaugcccacagcca

SEQ ID NO: 2891347 - RNA, 16 nt, Mycobacterium avium subsp. paratuberculosis
gcggcgaugcgcggcc

SEQ ID NO: 2891348 - RNA, 17 nt, Mycobacterium avium subsp. paratuberculosis
gcggcgaugcgcggccc

SEQ ID NO: 2891349 - RNA, 18 nt, Mycobacterium avium subsp. paratuberculosis
gcggcgaugcgcggcccg

SEQ ID NO: 2891350 - RNA, 21 nt, Mycobacterium avium subsp. paratuberculosis
gcggcgaugcgcuccagcagg

SEQ ID NO: 2891351 - RNA, 13 nt, Mycobacterium avium subsp. paratuberculosis
gcggcgauggacg

SEQ ID NO: 2891352 - RNA, 17 nt, Mycobacterium avium subsp. paratuberculosis
gcggcgauggacgucca

SEQ ID NO: 2891353 - RNA, 18 nt, Mycobacterium avium subsp. paratuberculosis
gcggcgauggacguccag

SEQ ID NO: 2891354 - RNA, 21 nt, Mycobacterium avium subsp. paratuberculosis
gcggcgauggacguccagcgg

SEQ ID NO: 2891355 - RNA, 15 nt, Mycobacterium avium subsp. paratuberculosis
gcggcgauggcccgc

SEQ ID NO: 2891356 - RNA, 16 nt, Mycobacterium avium subsp. paratuberculosis
gcggcgauggcccgcu

SEQ ID NO: 2891357 - RNA, 19 nt, Mycobacterium avium subsp. paratuberculosis
gcggcgauggcccgcugcg

SEQ ID NO: 2891358 - RNA, 13 nt, Mycobacterium avium subsp. paratuberculosis
gcggcgauggccg

SEQ ID NO: 2891359 - RNA, 21 nt, Mycobacterium avium subsp. paratuberculosis
gcggcgaugucgucgacgcug

SEQ ID NO: 2891360 - RNA, 20 nt, Mycobacterium avium subsp. paratuberculosis
gcggcgcaaccaacucgcga

SEQ ID NO: 2891361 - RNA, 15 nt, Mycobacterium avium subsp. paratuberculosis
gcggcgcaccccgaa

SEQ ID NO: 2891362 - RNA, 15 nt, Mycobacterium avium subsp. paratuberculosis
gcggcgcacccgggc

SEQ ID NO: 2891363 - RNA, 21 nt, Mycobacterium avium subsp. paratuberculosis
gcggcgcacccgggcagcuuc

SEQ ID NO: 2891364 - RNA, 15 nt, Mycobacterium avium subsp. paratuberculosis
gcggcgccuugccgg

SEQ ID NO: 2891365 - RNA, 16 nt, Mycobacterium avium subsp. paratuberculosis
gcggcgcgacaccgcg

SEQ ID NO: 2891366 - RNA, 22 nt, Mycobacterium avium subsp. paratuberculosis
gcggcgcgacaccgcggcgacg

SEQ ID NO: 2891367 - RNA, 17 nt, Mycobacterium avium subsp. paratuberculosis
gcggcgcgaggcgcggg

SEQ ID NO: 2891368 - RNA, 15 nt, Mycobacterium avium subsp. paratuberculosis
gcggcgcgaucgucg

SEQ ID NO: 2891369 - RNA, 17 nt, Mycobacterium avium subsp. paratuberculosis
gcggcgcgaucgucgac

SEQ ID NO: 2891370 - RNA, 19 nt, Mycobacterium avium subsp. paratuberculosis
gcggcgcgaucgucgacca

SEQ ID NO: 2891371 - RNA, 18 nt, Mycobacterium avium subsp. paratuberculosis
gcggcgcgaugaucgccg

SEQ ID NO: 2891372 - RNA, 22 nt, Mycobacterium avium subsp. paratuberculosis
gcggcgcgaugaucgccggcgc

SEQ ID NO: 2891373 - RNA, 14 nt, Mycobacterium avium subsp. paratuberculosis
gcggcgcgcagccg

SEQ ID NO: 2891374 - RNA, 12 nt, Mycobacterium avium subsp. paratuberculosis
gcggcgcgcagg

SEQ ID NO: 2891375 - RNA, 19 nt, Mycobacterium avium subsp. paratuberculosis
gcggcgcgcaggcgcgcgg

SEQ ID NO: 2891376 - RNA, 15 nt, Mycobacterium avium subsp. paratuberculosis
gcggcgcgcaucgcc

SEQ ID NO: 2891377 - RNA, 20 nt, Mycobacterium avium subsp. paratuberculosis
gcggcgcgcaucgccgucca

SEQ ID NO: 2891378 - RNA, 22 nt, Mycobacterium avium subsp. paratuberculosis
gcggcgcgcaucgccguccacg

SEQ ID NO: 2891379 - RNA, 15 nt, Mycobacterium avium subsp. paratuberculosis
gcggcgcgcaucguc

SEQ ID NO: 2891380 - RNA, 18 nt, Mycobacterium avium subsp. paratuberculosis
gcggcgcgcaucgucgcg

SEQ ID NO: 2891381 - RNA, 23 nt, Mycobacterium avium subsp. paratuberculosis
gcggcgcgcaucgucgcggcgcu

SEQ ID NO: 2891382 - RNA, 14 nt, Mycobacterium avium subsp. paratuberculosis
gcggcgcgccggcc

SEQ ID NO: 2891383 - RNA, 18 nt, Mycobacterium avium subsp. paratuberculosis
gcggcgcgccggccggag

SEQ ID NO: 2891384 - RNA, 20 nt, Mycobacterium avium subsp. paratuberculosis
gcggcgcgccggccggagcg

SEQ ID NO: 2891385 - RNA, 13 nt, Mycobacterium avium subsp. paratuberculosis
gcggcgcgccggg

SEQ ID NO: 2891386 - RNA, 23 nt, Mycobacterium avium subsp. paratuberculosis
gcggcgcgcgaaaaaacggcggc

SEQ ID NO: 2891387 - RNA, 13 nt, Mycobacterium avium subsp. paratuberculosis
gcggcgcgcgcca

SEQ ID NO: 2891388 - RNA, 14 nt, Mycobacterium avium subsp. paratuberculosis
gcggcgcgcgccag

SEQ ID NO: 2891389 - RNA, 13 nt, Mycobacterium avium subsp. paratuberculosis
gcggcgcgcgccg

SEQ ID NO: 2891390 - RNA, 14 nt, Mycobacterium avium subsp. paratuberculosis
gcggcgcgcgccgc

SEQ ID NO: 2891391 - RNA, 15 nt, Mycobacterium avium subsp. paratuberculosis
gcggcgcgcgccgca

SEQ ID NO: 2891392 - RNA, 13 nt, Mycobacterium avium subsp. paratuberculosis
gcggcgcgcggcc

SEQ ID NO: 2891393 - RNA, 14 nt, Mycobacterium avium subsp. paratuberculosis
gcggcgcgcggccg

SEQ ID NO: 2891394 - RNA, 15 nt, Mycobacterium avium subsp. paratuberculosis
gcggcgcgcggccgc

SEQ ID NO: 2891395 - RNA, 16 nt, Mycobacterium avium subsp. paratuberculosis
gcggcgcgcucgucgu

SEQ ID NO: 2891396 - RNA, 15 nt, Mycobacterium avium subsp. paratuberculosis
gcggcgcgcugcagg

SEQ ID NO: 2891397 - RNA, 20 nt, Mycobacterium avium subsp. paratuberculosis
gcggcgcgcugcggcgucgu

SEQ ID NO: 2891398 - RNA, 14 nt, Mycobacterium avium subsp. paratuberculosis
gcggcgcggacccc

SEQ ID NO: 2891399 - RNA, 14 nt, Mycobacterium avium subsp. paratuberculosis
gcggcgcggagccg

SEQ ID NO: 2891400 - RNA, 15 nt, Mycobacterium avium subsp. paratuberculosis
gcggcgcggagccgg

SEQ ID NO: 2891401 - RNA, 18 nt, Mycobacterium avium subsp. paratuberculosis
gcggcgcggccaccccgg

SEQ ID NO: 2891402 - RNA, 14 nt, Mycobacterium avium subsp. paratuberculosis
gcggcgcggcccag

SEQ ID NO: 2891403 - RNA, 15 nt, Mycobacterium avium subsp. paratuberculosis
gcggcgcggcccggc

SEQ ID NO: 2891404 - RNA, 19 nt, Mycobacterium avium subsp. paratuberculosis
gcggcgcggcccggcccgc

SEQ ID NO: 2891405 - RNA, 22 nt, Mycobacterium avium subsp. paratuberculosis
gcggcgcggcccggcccgcugg

SEQ ID NO: 2891406 - RNA, 14 nt, Mycobacterium avium subsp. paratuberculosis
gcggcgcggcgcag

SEQ ID NO: 2891407 - RNA, 14 nt, Mycobacterium avium subsp. paratuberculosis
gcggcgcggcgguc

SEQ ID NO: 2891408 - RNA, 16 nt, Mycobacterium avium subsp. paratuberculosis
gcggcgcgggcgcccu

SEQ ID NO: 2891409 - RNA, 17 nt, Mycobacterium avium subsp. paratuberculosis
gcggcgcgggcgcccuc

SEQ ID NO: 2891410 - RNA, 13 nt, Mycobacterium avium subsp. paratuberculosis
gcggcgcgggcgg

SEQ ID NO: 2891411 - RNA, 15 nt, Mycobacterium avium subsp. paratuberculosis
gcggcgcgggcggcg

SEQ ID NO: 2891412 - RNA, 16 nt, Mycobacterium avium subsp. paratuberculosis
gcggcgcgggucgcgg

SEQ ID NO: 2891413 - RNA, 14 nt, Mycobacterium avium subsp. paratuberculosis
gcggcgcggucgca

SEQ ID NO: 2891414 - RNA, 19 nt, Mycobacterium avium subsp. paratuberculosis
gcggcgcggucgcaggccg

SEQ ID NO: 2891415 - RNA, 13 nt, Mycobacterium avium subsp. paratuberculosis
gcggcgcgguuga

SEQ ID NO: 2891416 - RNA, 21 nt, Mycobacterium avium subsp. paratuberculosis
gcggcgcgguugaccgccgac

SEQ ID NO: 2891417 - RNA, 22 nt, Mycobacterium avium subsp. paratuberculosis
gcggcgcgguugaccgccgaca

SEQ ID NO: 2891418 - RNA, 14 nt, Mycobacterium avium subsp. paratuberculosis
gcggcgcgugcgcc

SEQ ID NO: 2891419 - RNA, 17 nt, Mycobacterium avium subsp. paratuberculosis
gcggcgcgugcgccgcg

SEQ ID NO: 2891420 - RNA, 18 nt, Mycobacterium avium subsp. paratuberculosis
gcggcgcgugcgccgcgg

SEQ ID NO: 2891421 - RNA, 18 nt, Mycobacterium avium subsp. paratuberculosis
gcggcgcuaaagccacca

SEQ ID NO: 2891422 - RNA, 20 nt, Mycobacterium avium subsp. paratuberculosis
gcggcgcuaaagccaccagc

SEQ ID NO: 2891423 - RNA, 16 nt, Mycobacterium avium subsp. paratuberculosis
gcggcgcucagcgcgg

SEQ ID NO: 2891424 - RNA, 18 nt, Mycobacterium avium subsp. paratuberculosis
gcggcgcucagcgcggcg

SEQ ID NO: 2891425 - RNA, 19 nt, Mycobacterium avium subsp. paratuberculosis
gcggcgcucagcgcggcgg

SEQ ID NO: 2891426 - RNA, 22 nt, Mycobacterium avium subsp. paratuberculosis
gcggcgcucagcgcggcgggcc

SEQ ID NO: 2891427 - RNA, 13 nt, Mycobacterium avium subsp. paratuberculosis
gcggcgcucggug

SEQ ID NO: 2891428 - RNA, 16 nt, Mycobacterium avium subsp. paratuberculosis
gcggcgcucggugugc

SEQ ID NO: 2891429 - RNA, 14 nt, Mycobacterium avium subsp. paratuberculosis
gcggcgcugaugcc

SEQ ID NO: 2891430 - RNA, 13 nt, Mycobacterium avium subsp. paratuberculosis
gcggcgcugcagc

SEQ ID NO: 2891431 - RNA, 14 nt, Mycobacterium avium subsp. paratuberculosis
gcggcgcugcagca

SEQ ID NO: 2891432 - RNA, 15 nt, Mycobacterium avium subsp. paratuberculosis
gcggcgcugcagcag

SEQ ID NO: 2891433 - RNA, 16 nt, Mycobacterium avium subsp. paratuberculosis
gcggcgcugcagcagc

SEQ ID NO: 2891434 - RNA, 17 nt, Mycobacterium avium subsp. paratuberculosis
gcggcgcugcagcagcc

SEQ ID NO: 2891435 - RNA, 17 nt, Mycobacterium avium subsp. paratuberculosis
gcggcgcugccccagcc

SEQ ID NO: 2891436 - RNA, 18 nt, Mycobacterium avium subsp. paratuberculosis
gcggcgcugccccagcca

SEQ ID NO: 2891437 - RNA, 16 nt, Mycobacterium avium subsp. paratuberculosis
gcggcgcugccgccgg

SEQ ID NO: 2891438 - RNA, 17 nt, Mycobacterium avium subsp. paratuberculosis
gcggcgcugccgccggc

SEQ ID NO: 2891439 - RNA, 18 nt, Mycobacterium avium subsp. paratuberculosis
gcggcgcugccgccggcc

SEQ ID NO: 2891440 - RNA, 20 nt, Mycobacterium avium subsp. paratuberculosis
gcggcgcugccgccggccuc

SEQ ID NO: 2891441 - RNA, 21 nt, Mycobacterium avium subsp. paratuberculosis
gcggcgcugccgccggccucg

SEQ ID NO: 2891442 - RNA, 13 nt, Mycobacterium avium subsp. paratuberculosis
gcggcgcugccgg

SEQ ID NO: 2891443 - RNA, 14 nt, Mycobacterium avium subsp. paratuberculosis
gcggcgcugccggc

SEQ ID NO: 2891444 - RNA, 14 nt, Mycobacterium avium subsp. paratuberculosis
gcggcgcugccggu

SEQ ID NO: 2891445 - RNA, 13 nt, Mycobacterium avium subsp. paratuberculosis
gcggcgcugcgcc

SEQ ID NO: 2891446 - RNA, 15 nt, Mycobacterium avium subsp. paratuberculosis
gcggcgcugcgccgu

SEQ ID NO: 2891447 - RNA, 16 nt, Mycobacterium avium subsp. paratuberculosis
gcggcgcuggucggcg

SEQ ID NO: 2891448 - RNA, 23 nt, Mycobacterium avium subsp. paratuberculosis
gcggcgcuggucggcgggcagcg

SEQ ID NO: 2891449 - RNA, 15 nt, Mycobacterium avium subsp. paratuberculosis
gcggcggcgcgccgg

SEQ ID NO: 2891450 - RNA, 17 nt, Mycobacterium avium subsp. paratuberculosis
gcggcggcgcgggcgcc

SEQ ID NO: 2891451 - RNA, 13 nt, Mycobacterium avium subsp. paratuberculosis
gcggcggcgcugg

SEQ ID NO: 2891452 - RNA, 12 nt, Mycobacterium avium subsp. paratuberculosis
gcggcggcggcc

SEQ ID NO: 2891453 - RNA, 13 nt, Mycobacterium avium subsp. paratuberculosis
gcggcggcggccc

SEQ ID NO: 2891454 - RNA, 15 nt, Mycobacterium avium subsp. paratuberculosis
gcggcggcggccgcg

SEQ ID NO: 2891455 - RNA, 14 nt, Mycobacterium avium subsp. paratuberculosis
gcggcggcgggaag

SEQ ID NO: 2891456 - RNA, 12 nt, Mycobacterium avium subsp. paratuberculosis
gcggcggcgggc

SEQ ID NO: 2891457 - RNA, 13 nt, Mycobacterium avium subsp. paratuberculosis
gcggcggcggucc

SEQ ID NO: 2891458 - RNA, 15 nt, Mycobacterium avium subsp. paratuberculosis
gcggcggcggugccu

SEQ ID NO: 2891459 - RNA, 14 nt, Mycobacterium avium subsp. paratuberculosis
gcggcggcggugcu

SEQ ID NO: 2891460 - RNA, 16 nt, Mycobacterium avium subsp. paratuberculosis
gcggcggcguccgcgg

SEQ ID NO: 2891461 - RNA, 12 nt, Mycobacterium avium subsp. paratuberculosis
gcggcggcgucg

SEQ ID NO: 2891462 - RNA, 14 nt, Mycobacterium avium subsp. paratuberculosis
gcggcggcgucgac

SEQ ID NO: 2891463 - RNA, 15 nt, Mycobacterium avium subsp. paratuberculosis
gcggcggcgucgacc

SEQ ID NO: 2891464 - RNA, 17 nt, Mycobacterium avium subsp. paratuberculosis
gcggcggcgucgaccgc

SEQ ID NO: 2891465 - RNA, 16 nt, Mycobacterium avium subsp. paratuberculosis
gcggcggcgugccgcc

SEQ ID NO: 2891466 - RNA, 16 nt, Mycobacterium avium subsp. paratuberculosis
gcggcggcguuggccg

SEQ ID NO: 2891467 - RNA, 15 nt, Mycobacterium avium subsp. paratuberculosis
gcggcggcucggcgg

SEQ ID NO: 2891468 - RNA, 21 nt, Mycobacterium avium subsp. paratuberculosis
gcggcggcucggcggcgucgu

SEQ ID NO: 2891469 - RNA, 14 nt, Mycobacterium avium subsp. paratuberculosis
gcggcggcucgucc

SEQ ID NO: 2891470 - RNA, 15 nt, Mycobacterium avium subsp. paratuberculosis
gcggcggcucgucca

SEQ ID NO: 2891471 - RNA, 17 nt, Mycobacterium avium subsp. paratuberculosis
gcggcggcugaagcgcu

SEQ ID NO: 2891472 - RNA, 20 nt, Mycobacterium avium subsp. paratuberculosis
gcggcggcugaagcgcuggg

SEQ ID NO: 2891473 - RNA, 17 nt, Mycobacterium avium subsp. paratuberculosis
gcggcggcugccucgac

SEQ ID NO: 2891474 - RNA, 21 nt, Mycobacterium avium subsp. paratuberculosis
gcggcggcugggccgcggcgc

SEQ ID NO: 2891475 - RNA, 20 nt, Mycobacterium avium subsp. paratuberculosis
gcggcgggaaaccaccugcc

SEQ ID NO: 2891476 - RNA, 21 nt, Mycobacterium avium subsp. paratuberculosis
gcggcgggacggaaucacgca

SEQ ID NO: 2891477 - RNA, 17 nt, Mycobacterium avium subsp. paratuberculosis
gcggcgggagcuaggcg

SEQ ID NO: 2891478 - RNA, 19 nt, Mycobacterium avium subsp. paratuberculosis
gcggcgggagcuaggcggc

SEQ ID NO: 2891479 - RNA, 20 nt, Mycobacterium avium subsp. paratuberculosis
gcggcgggagcuaggcggcc

SEQ ID NO: 2891480 - RNA, 14 nt, Mycobacterium avium subsp. paratuberculosis
gcggcgggccagcu

SEQ ID NO: 2891481 - RNA, 16 nt, Mycobacterium avium subsp. paratuberculosis
gcggcgggccagggcg

SEQ ID NO: 2891482 - RNA, 14 nt, Mycobacterium avium subsp. paratuberculosis
gcggcgggcccagc

SEQ ID NO: 2891483 - RNA, 16 nt, Mycobacterium avium subsp. paratuberculosis
gcggcgggcccagcag

SEQ ID NO: 2891484 - RNA, 17 nt, Mycobacterium avium subsp. paratuberculosis
gcggcgggcccagcaga

SEQ ID NO: 2891485 - RNA, 14 nt, Mycobacterium avium subsp. paratuberculosis
gcggcgggcccgca

SEQ ID NO: 2891486 - RNA, 19 nt, Mycobacterium avium subsp. paratuberculosis
gcggcgggcccgcagcucg

SEQ ID NO: 2891487 - RNA, 16 nt, Mycobacterium avium subsp. paratuberculosis
gcggcgggcccggcga

SEQ ID NO: 2891488 - RNA, 17 nt, Mycobacterium avium subsp. paratuberculosis
gcggcgggcccggcgau

SEQ ID NO: 2891489 - RNA, 19 nt, Mycobacterium avium subsp. paratuberculosis
gcggcgggcccggcgaugc

SEQ ID NO: 2891490 - RNA, 14 nt, Mycobacterium avium subsp. paratuberculosis
gcggcgggccgcaa

SEQ ID NO: 2891491 - RNA, 23 nt, Mycobacterium avium subsp. paratuberculosis
gcggcgggccuugagcaccgcgu

SEQ ID NO: 2891492 - RNA, 15 nt, Mycobacterium avium subsp. paratuberculosis
gcggcgggcgagccg

SEQ ID NO: 2891493 - RNA, 19 nt, Mycobacterium avium subsp. paratuberculosis
gcggcgggcgagccgaagc

SEQ ID NO: 2891494 - RNA, 14 nt, Mycobacterium avium subsp. paratuberculosis
gcggcgggcgcguc

SEQ ID NO: 2891495 - RNA, 15 nt, Mycobacterium avium subsp. paratuberculosis
gcggcgggcgugcga

SEQ ID NO: 2891496 - RNA, 14 nt, Mycobacterium avium subsp. paratuberculosis
gcggcgggcucgga

SEQ ID NO: 2891497 - RNA, 19 nt, Mycobacterium avium subsp. paratuberculosis
gcggcgggcucggacgacu

SEQ ID NO: 2891498 - RNA, 15 nt, Mycobacterium avium subsp. paratuberculosis
gcggcgggcucggag

SEQ ID NO: 2891499 - RNA, 20 nt, Mycobacterium avium subsp. paratuberculosis
gcggcggggcugcccagguc

SEQ ID NO: 2891500 - RNA, 17 nt, Mycobacterium avium subsp. paratuberculosis
gcggcgggggcgggccc

SEQ ID NO: 2891501 - RNA, 20 nt, Mycobacterium avium subsp. paratuberculosis
gcggcgggggcgggccccac

SEQ ID NO: 2891502 - RNA, 20 nt, Mycobacterium avium subsp. paratuberculosis
gcggcggggugacggucacg

SEQ ID NO: 2891503 - RNA, 19 nt, Mycobacterium avium subsp. paratuberculosis
gcggcgggguuccgucgaa

SEQ ID NO: 2891504 - RNA, 21 nt, Mycobacterium avium subsp. paratuberculosis
gcggcgggguuccgucgaaca

SEQ ID NO: 2891505 - RNA, 16 nt, Mycobacterium avium subsp. paratuberculosis
gcggcgggucagcacc

SEQ ID NO: 2891506 - RNA, 21 nt, Mycobacterium avium subsp. paratuberculosis
gcggcgguaucgguggauccg

SEQ ID NO: 2891507 - RNA, 21 nt, Mycobacterium avium subsp. paratuberculosis
gcggcgguauucgucacccca

SEQ ID NO: 2891508 - RNA, 19 nt, Mycobacterium avium subsp. paratuberculosis
gcggcggucacgcccgggu

SEQ ID NO: 2891509 - RNA, 21 nt, Mycobacterium avium subsp. paratuberculosis
gcggcggucagguucgccacg

SEQ ID NO: 2891510 - RNA, 17 nt, Mycobacterium avium subsp. paratuberculosis
gcggcgguccagcgagc

SEQ ID NO: 2891511 - RNA, 18 nt, Mycobacterium avium subsp. paratuberculosis
gcggcgguccccgaagcg

SEQ ID NO: 2891512 - RNA, 18 nt, Mycobacterium avium subsp. paratuberculosis
gcggcgguccgcccggac

SEQ ID NO: 2891513 - RNA, 21 nt, Mycobacterium avium subsp. paratuberculosis
gcggcgguccgcccggaccag

SEQ ID NO: 2891514 - RNA, 15 nt, Mycobacterium avium subsp. paratuberculosis
gcggcgguccguucg

SEQ ID NO: 2891515 - RNA, 17 nt, Mycobacterium avium subsp. paratuberculosis
gcggcgguccguucggc

SEQ ID NO: 2891516 - RNA, 14 nt, Mycobacterium avium subsp. paratuberculosis
gcggcggucgccac

SEQ ID NO: 2891517 - RNA, 13 nt, Mycobacterium avium subsp. paratuberculosis
gcggcggucgcgc

SEQ ID NO: 2891518 - RNA, 15 nt, Mycobacterium avium subsp. paratuberculosis
gcggcggucgcgcgc

SEQ ID NO: 2891519 - RNA, 16 nt, Mycobacterium avium subsp. paratuberculosis
gcggcggucgcgcgcc

SEQ ID NO: 2891520 - RNA, 19 nt, Mycobacterium avium subsp. paratuberculosis
gcggcggucgcgcgccggc

SEQ ID NO: 2891521 - RNA, 20 nt, Mycobacterium avium subsp. paratuberculosis
gcggcggucgcgcgccggcg

SEQ ID NO: 2891522 - RNA, 13 nt, Mycobacterium avium subsp. paratuberculosis
gcggcggucggca

SEQ ID NO: 2891523 - RNA, 17 nt, Mycobacterium avium subsp. paratuberculosis
gcggcggucggcauagc

SEQ ID NO: 2891524 - RNA, 22 nt, Mycobacterium avium subsp. paratuberculosis
gcggcggucggcauagcgccgc

SEQ ID NO: 2891525 - RNA, 14 nt, Mycobacterium avium subsp. paratuberculosis
gcggcggucggcgc

SEQ ID NO: 2891526 - RNA, 16 nt, Mycobacterium avium subsp. paratuberculosis
gcggcggucggcgccg

SEQ ID NO: 2891527 - RNA, 17 nt, Mycobacterium avium subsp. paratuberculosis
gcggcggucggcgccga

SEQ ID NO: 2891528 - RNA, 15 nt, Mycobacterium avium subsp. paratuberculosis
gcggcggucuucuug

SEQ ID NO: 2891529 - RNA, 23 nt, Mycobacterium avium subsp. paratuberculosis
gcggcggucuucuuggccgcgcc

SEQ ID NO: 2891530 - RNA, 22 nt, Mycobacterium avium subsp. paratuberculosis
gcggcggucuucuuggcgggcg

SEQ ID NO: 2891531 - RNA, 21 nt, Mycobacterium avium subsp. paratuberculosis
gcggcggugaccggaucggcc

SEQ ID NO: 2891532 - RNA, 21 nt, Mycobacterium avium subsp. paratuberculosis
gcggcggugacgaugucgaug

SEQ ID NO: 2891533 - RNA, 16 nt, Mycobacterium avium subsp. paratuberculosis
gcggcggugagcgcgu

SEQ ID NO: 2891534 - RNA, 12 nt, Mycobacterium avium subsp. paratuberculosis
gcggcgugcagu

SEQ ID NO: 2891535 - RNA, 20 nt, Mycobacterium avium subsp. paratuberculosis
gcggcgugcagucccagauc

SEQ ID NO: 2891536 - RNA, 15 nt, Mycobacterium avium subsp. paratuberculosis
gcggcgugccagggc

SEQ ID NO: 2891537 - RNA, 19 nt, Mycobacterium avium subsp. paratuberculosis
gcggcgugccagggcagcg

SEQ ID NO: 2891538 - RNA, 12 nt, Mycobacterium avium subsp. paratuberculosis
gcggcgugcgcc

SEQ ID NO: 2891539 - RNA, 17 nt, Mycobacterium avium subsp. paratuberculosis
gcggcgugcggucgcgg

SEQ ID NO: 2891540 - RNA, 20 nt, Mycobacterium avium subsp. paratuberculosis
gcggcgugcugcgcagcagc

SEQ ID NO: 2891541 - RNA, 19 nt, Mycobacterium avium subsp. paratuberculosis
gcggcgugggguucccggc

SEQ ID NO: 2891542 - RNA, 21 nt, Mycobacterium avium subsp. paratuberculosis
gcggcgugggguucccggccg

SEQ ID NO: 2891543 - RNA, 15 nt, Mycobacterium avium subsp. paratuberculosis
gcggcgugguagccg

SEQ ID NO: 2891544 - RNA, 19 nt, Mycobacterium avium subsp. paratuberculosis
gcggcgugguagccgccgu

SEQ ID NO: 2891545 - RNA, 22 nt, Mycobacterium avium subsp. paratuberculosis
gcggcgugguagccgccguucu

SEQ ID NO: 2891546 - RNA, 19 nt, Mycobacterium avium subsp. paratuberculosis
gcggcguguuguagucaga

SEQ ID NO: 2891547 - RNA, 16 nt, Mycobacterium avium subsp. paratuberculosis
gcggcguucagccgga

SEQ ID NO: 2891548 - RNA, 20 nt, Mycobacterium avium subsp. paratuberculosis
gcggcguucagccggagccg

SEQ ID NO: 2891549 - RNA, 15 nt, Mycobacterium avium subsp. paratuberculosis
gcggcguucggugcc

SEQ ID NO: 2891550 - RNA, 16 nt, Mycobacterium avium subsp. paratuberculosis
gcggcguucggugccc

SEQ ID NO: 2891551 - RNA, 17 nt, Mycobacterium avium subsp. paratuberculosis
gcggcguucggugcccg

SEQ ID NO: 2891552 - RNA, 15 nt, Mycobacterium avium subsp. paratuberculosis
gcggcguucuccagc

SEQ ID NO: 2891553 - RNA, 17 nt, Mycobacterium avium subsp. paratuberculosis
gcggcguucuccagcac

SEQ ID NO: 2891554 - RNA, 21 nt, Mycobacterium avium subsp. paratuberculosis
gcggcguucuccagcacccgc

SEQ ID NO: 2891555 - RNA, 14 nt, Mycobacterium avium subsp. paratuberculosis
gcggcguugcccgc

SEQ ID NO: 2891556 - RNA, 15 nt, Mycobacterium avium subsp. paratuberculosis
gcggcguugcccggg

SEQ ID NO: 2891557 - RNA, 16 nt, Mycobacterium avium subsp. paratuberculosis
gcggcguugccgccgg

SEQ ID NO: 2891558 - RNA, 17 nt, Mycobacterium avium subsp. paratuberculosis
gcggcguugccgccggc

SEQ ID NO: 2891559 - RNA, 18 nt, Mycobacterium avium subsp. paratuberculosis
gcggcguugccgccggcg

SEQ ID NO: 2891560 - RNA, 19 nt, Mycobacterium avium subsp. paratuberculosis
gcggcguugccgccggcgc

SEQ ID NO: 2891561 - RNA, 21 nt, Mycobacterium avium subsp. paratuberculosis
gcggcguugccgccggcgcgg

SEQ ID NO: 2891562 - RNA, 24 nt, Mycobacterium avium subsp. paratuberculosis
gcggcguugccgccggcgcgguuc

SEQ ID NO: 2891563 - RNA, 12 nt, Mycobacterium avium subsp. paratuberculosis
gcggcguugcgg

SEQ ID NO: 2891564 - RNA, 14 nt, Mycobacterium avium subsp. paratuberculosis
gcggcguugcgggu

SEQ ID NO: 2891565 - RNA, 14 nt, Mycobacterium avium subsp. paratuberculosis
gcggcguuggccgc

SEQ ID NO: 2891566 - RNA, 15 nt, Mycobacterium avium subsp. paratuberculosis
gcggcguuggccgcc

SEQ ID NO: 2891567 - RNA, 17 nt, Mycobacterium avium subsp. paratuberculosis
gcggcguuggccgccgc

SEQ ID NO: 2891568 - RNA, 16 nt, Mycobacterium avium subsp. paratuberculosis
gcggcuaagccggcgu

SEQ ID NO: 2891569 - RNA, 15 nt, Mycobacterium avium subsp. paratuberculosis
gcggcuaguuggccg

SEQ ID NO: 2891570 - RNA, 23 nt, Mycobacterium avium subsp. paratuberculosis
gcggcucaacgauuuccgguucc

SEQ ID NO: 2891571 - RNA, 15 nt, Mycobacterium avium subsp. paratuberculosis
gcggcucacagcgcg

SEQ ID NO: 2891572 - RNA, 16 nt, Mycobacterium avium subsp. paratuberculosis
gcggcucacagcgcgg

SEQ ID NO: 2891573 - RNA, 20 nt, Mycobacterium avium subsp. paratuberculosis
gcggcucacagcgcggcggu

SEQ ID NO: 2891574 - RNA, 18 nt, Mycobacterium avium subsp. paratuberculosis
gcggcucacaugggcgcg

SEQ ID NO: 2891575 - RNA, 22 nt, Mycobacterium avium subsp. paratuberculosis
gcggcucacaugggcgcguugg

SEQ ID NO: 2891576 - RNA, 16 nt, Mycobacterium avium subsp. paratuberculosis
gcggcucagcaacccg

SEQ ID NO: 2891577 - RNA, 20 nt, Mycobacterium avium subsp. paratuberculosis
gcggcucagcaacccgccga

SEQ ID NO: 2891578 - RNA, 23 nt, Mycobacterium avium subsp. paratuberculosis
gcggcucagcaacccgccgagcg

SEQ ID NO: 2891579 - RNA, 16 nt, Mycobacterium avium subsp. paratuberculosis
gcggcuccagcagcgg

SEQ ID NO: 2891580 - RNA, 17 nt, Mycobacterium avium subsp. paratuberculosis
gcggcuccagcagcggc

SEQ ID NO: 2891581 - RNA, 23 nt, Mycobacterium avium subsp. paratuberculosis
gcggcuccagcagcggcucggcc

SEQ ID NO: 2891582 - RNA, 12 nt, Mycobacterium avium subsp. paratuberculosis
gcggcucccacc

SEQ ID NO: 2891583 - RNA, 15 nt, Mycobacterium avium subsp. paratuberculosis
gcggcuccgagcgga

SEQ ID NO: 2891584 - RNA, 22 nt, Mycobacterium avium subsp. paratuberculosis
gcggcuccgaucuccugguguc

SEQ ID NO: 2891585 - RNA, 13 nt, Mycobacterium avium subsp. paratuberculosis
gcggcuccggccg

SEQ ID NO: 2891586 - RNA, 14 nt, Mycobacterium avium subsp. paratuberculosis
gcggcuccggccgc

SEQ ID NO: 2891587 - RNA, 15 nt, Mycobacterium avium subsp. paratuberculosis
gcggcuccggccgcg

SEQ ID NO: 2891588 - RNA, 17 nt, Mycobacterium avium subsp. paratuberculosis
gcggcuccggccgcgcc

SEQ ID NO: 2891589 - RNA, 19 nt, Mycobacterium avium subsp. paratuberculosis
gcggcuccggccgcgccgg

SEQ ID NO: 2891590 - RNA, 20 nt, Mycobacterium avium subsp. paratuberculosis
gcggcuccggccgcgccggc

SEQ ID NO: 2891591 - RNA, 19 nt, Mycobacterium avium subsp. paratuberculosis
gcggcucgauggacgccag

SEQ ID NO: 2891592 - RNA, 13 nt, Mycobacterium avium subsp. paratuberculosis
gcggcucgccggc

SEQ ID NO: 2891593 - RNA, 14 nt, Mycobacterium avium subsp. paratuberculosis
gcggcucgccggcg

SEQ ID NO: 2891594 - RNA, 20 nt, Mycobacterium avium subsp. paratuberculosis
gcggcucgccggcgucuuga

SEQ ID NO: 2891595 - RNA, 13 nt, Mycobacterium avium subsp. paratuberculosis
gcggcucgcgacg

SEQ ID NO: 2891596 - RNA, 16 nt, Mycobacterium avium subsp. paratuberculosis
gcggcucgcgacgcgg

SEQ ID NO: 2891597 - RNA, 14 nt, Mycobacterium avium subsp. paratuberculosis
gcggcucgcgcggu

SEQ ID NO: 2891598 - RNA, 15 nt, Mycobacterium avium subsp. paratuberculosis
gcggcucgcgcggug

SEQ ID NO: 2891599 - RNA, 11 nt, Mycobacterium avium subsp. paratuberculosis
gcggcucgcgg

SEQ ID NO: 2891600 - RNA, 14 nt, Mycobacterium avium subsp. paratuberculosis
gcggcucgcgggcg

SEQ ID NO: 2891601 - RNA, 18 nt, Mycobacterium avium subsp. paratuberculosis
gcggcucgcgggcgaugc

SEQ ID NO: 2891602 - RNA, 19 nt, Mycobacterium avium subsp. paratuberculosis
gcggcucgcgggcgaugcg

SEQ ID NO: 2891603 - RNA, 16 nt, Mycobacterium avium subsp. paratuberculosis
gcggcucgcgggugcg

SEQ ID NO: 2891604 - RNA, 19 nt, Mycobacterium avium subsp. paratuberculosis
gcggcucgcgggugcggcg

SEQ ID NO: 2891605 - RNA, 21 nt, Mycobacterium avium subsp. paratuberculosis
gcggcucgcgggugcggcgcu

SEQ ID NO: 2891606 - RNA, 15 nt, Mycobacterium avium subsp. paratuberculosis
gcggcucggccuucg

SEQ ID NO: 2891607 - RNA, 14 nt, Mycobacterium avium subsp. paratuberculosis
gcggcucggcggcg

SEQ ID NO: 2891608 - RNA, 19 nt, Mycobacterium avium subsp. paratuberculosis
gcggcucggcggcgucgua

SEQ ID NO: 2891609 - RNA, 14 nt, Mycobacterium avium subsp. paratuberculosis
gcggcucgggggug

SEQ ID NO: 2891610 - RNA, 16 nt, Mycobacterium avium subsp. paratuberculosis
gcggcucggggguguc

SEQ ID NO: 2891611 - RNA, 23 nt, Mycobacterium avium subsp. paratuberculosis
gcggcucgggggugucguagcgg

SEQ ID NO: 2891612 - RNA, 20 nt, Mycobacterium avium subsp. paratuberculosis
gcggcucggucgcgaagacg

SEQ ID NO: 2891613 - RNA, 13 nt, Mycobacterium avium subsp. paratuberculosis
gcggcucgguguc

SEQ ID NO: 2891614 - RNA, 18 nt, Mycobacterium avium subsp. paratuberculosis
gcggcucguugagcacac

SEQ ID NO: 2891615 - RNA, 13 nt, Mycobacterium avium subsp. paratuberculosis
gcggcugacccgc

SEQ ID NO: 2891616 - RNA, 15 nt, Mycobacterium avium subsp. paratuberculosis
gcggcugacccgccc

SEQ ID NO: 2891617 - RNA, 19 nt, Mycobacterium avium subsp. paratuberculosis
gcggcugaccgagcggcgc

SEQ ID NO: 2891618 - RNA, 14 nt, Mycobacterium avium subsp. paratuberculosis
gcggcugaggcaag

SEQ ID NO: 2891619 - RNA, 15 nt, Mycobacterium avium subsp. paratuberculosis
gcgggacugcagcgc

SEQ ID NO: 2891620 - RNA, 15 nt, Mycobacterium avium subsp. paratuberculosis
gcgggacugggcgau

SEQ ID NO: 2891621 - RNA, 16 nt, Mycobacterium avium subsp. paratuberculosis
gcgggacugggcgauu

SEQ ID NO: 2891622 - RNA, 14 nt, Mycobacterium avium subsp. paratuberculosis
gcgggagagcgcgg

SEQ ID NO: 2891623 - RNA, 12 nt, Mycobacterium avium subsp. paratuberculosis
gcgggagccggc

SEQ ID NO: 2891624 - RNA, 17 nt, Mycobacterium avium subsp. paratuberculosis
gcgggagccggcggcgg

SEQ ID NO: 2891625 - RNA, 20 nt, Mycobacterium avium subsp. paratuberculosis
gcgggagcgcuggucggcga

SEQ ID NO: 2891626 - RNA, 16 nt, Mycobacterium avium subsp. paratuberculosis
gcgggaggacagcgcg

SEQ ID NO: 2891627 - RNA, 13 nt, Mycobacterium avium subsp. paratuberculosis
gcgggaggcccag

SEQ ID NO: 2891628 - RNA, 14 nt, Mycobacterium avium subsp. paratuberculosis
gcgggaggcccagu

SEQ ID NO: 2891629 - RNA, 17 nt, Mycobacterium avium subsp. paratuberculosis
gcgggaguccacgccgu

SEQ ID NO: 2891630 - RNA, 16 nt, Mycobacterium avium subsp. paratuberculosis
gcgggaguggccggcg

SEQ ID NO: 2891631 - RNA, 16 nt, Mycobacterium avium subsp. paratuberculosis
gcgggaucccagucgu

SEQ ID NO: 2891632 - RNA, 14 nt, Mycobacterium avium subsp. paratuberculosis
gcgggauccccacc

SEQ ID NO: 2891633 - RNA, 20 nt, Mycobacterium avium subsp. paratuberculosis
gcgggauccccaccgugacg

SEQ ID NO: 2891634 - RNA, 19 nt, Mycobacterium avium subsp. paratuberculosis
gcgggaucccgcagccgcg

SEQ ID NO: 2891635 - RNA, 23 nt, Mycobacterium avium subsp. paratuberculosis
gcgggaucccgcagccgcgacgg

SEQ ID NO: 2891636 - RNA, 16 nt, Mycobacterium avium subsp. paratuberculosis
gcgggaucgcggcggu

SEQ ID NO: 2891637 - RNA, 17 nt, Mycobacterium avium subsp. paratuberculosis
gcgggaucgcggcgguc

SEQ ID NO: 2891638 - RNA, 19 nt, Mycobacterium avium subsp. paratuberculosis
gcgggaucggaccgcacca

SEQ ID NO: 2891639 - RNA, 13 nt, Mycobacterium avium subsp. paratuberculosis
gcgggaucggccg

SEQ ID NO: 2891640 - RNA, 15 nt, Mycobacterium avium subsp. paratuberculosis
gcgggaucggccggc

SEQ ID NO: 2891641 - RNA, 16 nt, Mycobacterium avium subsp. paratuberculosis
gcgggaucggccggcg

SEQ ID NO: 2891642 - RNA, 14 nt, Mycobacterium avium subsp. paratuberculosis
gcgggaucggugcc

SEQ ID NO: 2891643 - RNA, 18 nt, Mycobacterium avium subsp. paratuberculosis
gcgggaugcuuggucgcg

SEQ ID NO: 2891644 - RNA, 14 nt, Mycobacterium avium subsp. paratuberculosis
gcgggauggguggu

SEQ ID NO: 2891645 - RNA, 16 nt, Mycobacterium avium subsp. paratuberculosis
gcgggauguagccggu

SEQ ID NO: 2891646 - RNA, 17 nt, Mycobacterium avium subsp. paratuberculosis
gcgggauguagccgguc

SEQ ID NO: 2891647 - RNA, 22 nt, Mycobacterium avium subsp. paratuberculosis
gcgggauuggcgccacugccgc

SEQ ID NO: 2891648 - RNA, 21 nt, Mycobacterium avium subsp. paratuberculosis
gcgggauuuggcuagcgggcg

SEQ ID NO: 2891649 - RNA, 15 nt, Mycobacterium avium subsp. paratuberculosis
gcgggcaaucgcugc

SEQ ID NO: 2891650 - RNA, 19 nt, Mycobacterium avium subsp. paratuberculosis
gcgggcaaucgcugcgccc

SEQ ID NO: 2891651 - RNA, 16 nt, Mycobacterium avium subsp. paratuberculosis
gcgggcaccgucgucg

SEQ ID NO: 2891652 - RNA, 24 nt, Mycobacterium avium subsp. paratuberculosis
gcgggcaccgucgucgcaccggca

SEQ ID NO: 2891653 - RNA, 18 nt, Mycobacterium avium subsp. paratuberculosis
gcgggcaccucgaugccg

SEQ ID NO: 2891654 - RNA, 14 nt, Mycobacterium avium subsp. paratuberculosis
gcgggcaccucggc

SEQ ID NO: 2891655 - RNA, 17 nt, Mycobacterium avium subsp. paratuberculosis
gcgggcaccucggccag

SEQ ID NO: 2891656 - RNA, 18 nt, Mycobacterium avium subsp. paratuberculosis
gcgggcaccucggccagg

SEQ ID NO: 2891657 - RNA, 19 nt, Mycobacterium avium subsp. paratuberculosis
gcgggcaccucggccaggu

SEQ ID NO: 2891658 - RNA, 19 nt, Mycobacterium avium subsp. paratuberculosis
gcgggcacgccgccgcgaa

SEQ ID NO: 2891659 - RNA, 13 nt, Mycobacterium avium subsp. paratuberculosis
gcgggcacggcga

SEQ ID NO: 2891660 - RNA, 16 nt, Mycobacterium avium subsp. paratuberculosis
gcgggcacggcgaugu

SEQ ID NO: 2891661 - RNA, 15 nt, Mycobacterium avium subsp. paratuberculosis
gcgggcacgucgcgc

SEQ ID NO: 2891662 - RNA, 18 nt, Mycobacterium avium subsp. paratuberculosis
gcgggcacgucgcgcggg

SEQ ID NO: 2891663 - RNA, 20 nt, Mycobacterium avium subsp. paratuberculosis
gcgggcacgucgcgcggggu

SEQ ID NO: 2891664 - RNA, 21 nt, Mycobacterium avium subsp. paratuberculosis
gcgggcacgucgcgcgggguc

SEQ ID NO: 2891665 - RNA, 22 nt, Mycobacterium avium subsp. paratuberculosis
gcgggcacgucgcgcggggucg

SEQ ID NO: 2891666 - RNA, 19 nt, Mycobacterium avium subsp. paratuberculosis
gcgggcacuuaacaccucg

SEQ ID NO: 2891667 - RNA, 23 nt, Mycobacterium avium subsp. paratuberculosis
gcgggcacuuaacaccucgccuc

SEQ ID NO: 2891668 - RNA, 14 nt, Mycobacterium avium subsp. paratuberculosis
gcgggcacuucguc

SEQ ID NO: 2891669 - RNA, 15 nt, Mycobacterium avium subsp. paratuberculosis
gcgggcagcaccagc

SEQ ID NO: 2891670 - RNA, 16 nt, Mycobacterium avium subsp. paratuberculosis
gcgggcagcaccagcg

SEQ ID NO: 2891671 - RNA, 12 nt, Mycobacterium avium subsp. paratuberculosis
gcgggcagcagc

SEQ ID NO: 2891672 - RNA, 13 nt, Mycobacterium avium subsp. paratuberculosis
gcgggcagcagcu

SEQ ID NO: 2891673 - RNA, 14 nt, Mycobacterium avium subsp. paratuberculosis
gcgggcagccgcuu

SEQ ID NO: 2891674 - RNA, 17 nt, Mycobacterium avium subsp. paratuberculosis
gcgggcagccgcuuggc

SEQ ID NO: 2891675 - RNA, 22 nt, Mycobacterium avium subsp. paratuberculosis
gcgggcagccgcuuggccgggc

SEQ ID NO: 2891676 - RNA, 13 nt, Mycobacterium avium subsp. paratuberculosis
gcgggcagccggc

SEQ ID NO: 2891677 - RNA, 14 nt, Mycobacterium avium subsp. paratuberculosis
gcgggcagccggcg

SEQ ID NO: 2891678 - RNA, 20 nt, Mycobacterium avium subsp. paratuberculosis
gcgggcagcgagucgaaggc

SEQ ID NO: 2891679 - RNA, 14 nt, Mycobacterium avium subsp. paratuberculosis
gcgggcaggcccga

SEQ ID NO: 2891680 - RNA, 13 nt, Mycobacterium avium subsp. paratuberculosis
gcgggcaggccga

SEQ ID NO: 2891681 - RNA, 21 nt, Mycobacterium avium subsp. paratuberculosis
gcgggcaucaucgcuacaccc

SEQ ID NO: 2891682 - RNA, 16 nt, Mycobacterium avium subsp. paratuberculosis
gcgggcaucgccguca

SEQ ID NO: 2891683 - RNA, 19 nt, Mycobacterium avium subsp. paratuberculosis
gcgggcaucgccgucaugg

SEQ ID NO: 2891684 - RNA, 15 nt, Mycobacterium avium subsp. paratuberculosis
gcgggcaucggcugg

SEQ ID NO: 2891685 - RNA, 22 nt, Mycobacterium avium subsp. paratuberculosis
gcgggcaugaaccaggccgcgc

SEQ ID NO: 2891686 - RNA, 19 nt, Mycobacterium avium subsp. paratuberculosis
gcgggccaaagagcuuggc

SEQ ID NO: 2891687 - RNA, 16 nt, Mycobacterium avium subsp. paratuberculosis
gcgggccacagcggcg

SEQ ID NO: 2891688 - RNA, 22 nt, Mycobacterium avium subsp. paratuberculosis
gcgggccaccacaguggccgcc

SEQ ID NO: 2891689 - RNA, 17 nt, Mycobacterium avium subsp. paratuberculosis
gcgggccaccgcggcgu

SEQ ID NO: 2891690 - RNA, 13 nt, Mycobacterium avium subsp. paratuberculosis
gcgggccaccggc

SEQ ID NO: 2891691 - RNA, 14 nt, Mycobacterium avium subsp. paratuberculosis
gcgggccaccggcg

SEQ ID NO: 2891692 - RNA, 18 nt, Mycobacterium avium subsp. paratuberculosis
gcgggccaccggcgccag

SEQ ID NO: 2891693 - RNA, 13 nt, Mycobacterium avium subsp. paratuberculosis
gcgggccacgcag

SEQ ID NO: 2891694 - RNA, 21 nt, Mycobacterium avium subsp. paratuberculosis
gcgggccagacugcgcaccgc

SEQ ID NO: 2891695 - RNA, 12 nt, Mycobacterium avium subsp. paratuberculosis
gcgggccagcag

SEQ ID NO: 2891696 - RNA, 14 nt, Mycobacterium avium subsp. paratuberculosis
gcgggccagcagca

SEQ ID NO: 2891697 - RNA, 14 nt, Mycobacterium avium subsp. paratuberculosis
gcgggccagcagcc

SEQ ID NO: 2891698 - RNA, 18 nt, Mycobacterium avium subsp. paratuberculosis
gcgggccagcagccgggu

SEQ ID NO: 2891699 - RNA, 19 nt, Mycobacterium avium subsp. paratuberculosis
gcgggccagcagccggguc

SEQ ID NO: 2891700 - RNA, 20 nt, Mycobacterium avium subsp. paratuberculosis
gcgggccagcagccggguca

SEQ ID NO: 2891701 - RNA, 22 nt, Mycobacterium avium subsp. paratuberculosis
gcgggccagcaguucguccacg

SEQ ID NO: 2891702 - RNA, 14 nt, Mycobacterium avium subsp. paratuberculosis
gcgggccagcgccu

SEQ ID NO: 2891703 - RNA, 17 nt, Mycobacterium avium subsp. paratuberculosis
gcgggccagcgccuucg

SEQ ID NO: 2891704 - RNA, 23 nt, Mycobacterium avium subsp. paratuberculosis
gcgagucgaagccguggcaggca

SEQ ID NO: 2891705 - RNA, 13 nt, Mycobacterium avium subsp. paratuberculosis
gcgagucgaaggc

SEQ ID NO: 2891706 - RNA, 18 nt, Mycobacterium avium subsp. paratuberculosis
gcgagucgaaggcgcggg

SEQ ID NO: 2891707 - RNA, 17 nt, Mycobacterium avium subsp. paratuberculosis
gcgagucgagcaccgcg

SEQ ID NO: 2891708 - RNA, 20 nt, Mycobacterium avium subsp. paratuberculosis
gcgagucgagcaccgcgacc

SEQ ID NO: 2891709 - RNA, 20 nt, Mycobacterium avium subsp. paratuberculosis
gcgagucgagguugaugccg

SEQ ID NO: 2891710 - RNA, 15 nt, Mycobacterium avium subsp. paratuberculosis
gcgagucgaugaccu

SEQ ID NO: 2891711 - RNA, 18 nt, Mycobacterium avium subsp. paratuberculosis
gcgagucgaugaccucgc

SEQ ID NO: 2891712 - RNA, 21 nt, Mycobacterium avium subsp. paratuberculosis
gcgagucgaugaccucgcgcc

SEQ ID NO: 2891713 - RNA, 22 nt, Mycobacterium avium subsp. paratuberculosis
gcgagucgaugaccucgcgccc

SEQ ID NO: 2891714 - RNA, 14 nt, Mycobacterium avium subsp. paratuberculosis
gcgagucgcggauc

SEQ ID NO: 2891715 - RNA, 16 nt, Mycobacterium avium subsp. paratuberculosis
gcgagucuuugguagu

SEQ ID NO: 2891716 - RNA, 13 nt, Mycobacterium avium subsp. paratuberculosis
gcgagugaggccg

SEQ ID NO: 2891717 - RNA, 18 nt, Mycobacterium avium subsp. paratuberculosis
gcgagugaggccgaggcg

SEQ ID NO: 2891718 - RNA, 19 nt, Mycobacterium avium subsp. paratuberculosis
gcgagugcaccuugaucuc

SEQ ID NO: 2891719 - RNA, 21 nt, Mycobacterium avium subsp. paratuberculosis
gcgagugccggccagcucgcc

SEQ ID NO: 2891720 - RNA, 20 nt, Mycobacterium avium subsp. paratuberculosis
gcgaguggaagucagcgcgu

SEQ ID NO: 2891721 - RNA, 20 nt, Mycobacterium avium subsp. paratuberculosis
gcgagugggugaaggccugg

SEQ ID NO: 2891722 - RNA, 21 nt, Mycobacterium avium subsp. paratuberculosis
gcgagugguaccggguggccg

SEQ ID NO: 2891723 - RNA, 19 nt, Mycobacterium avium subsp. paratuberculosis
gcgaguuaugccgucaccc

SEQ ID NO: 2891724 - RNA, 20 nt, Mycobacterium avium subsp. paratuberculosis
gcgaguuaugccgucaccca

SEQ ID NO: 2891725 - RNA, 19 nt, Mycobacterium avium subsp. paratuberculosis
gcgaguucagaagucgccc

SEQ ID NO: 2891726 - RNA, 16 nt, Mycobacterium avium subsp. paratuberculosis
gcgaguucgaccucca

SEQ ID NO: 2891727 - RNA, 20 nt, Mycobacterium avium subsp. paratuberculosis
gcgaguucgaccuccacccg

SEQ ID NO: 2891728 - RNA, 23 nt, Mycobacterium avium subsp. paratuberculosis
gcgaguucgaccuccacccgcuc

SEQ ID NO: 2891729 - RNA, 17 nt, Mycobacterium avium subsp. paratuberculosis
gcgaguucgcgcacgcu

SEQ ID NO: 2891730 - RNA, 23 nt, Mycobacterium avium subsp. paratuberculosis
gcgaguucgcgcacgcuggccgg

SEQ ID NO: 2891731 - RNA, 20 nt, Mycobacterium avium subsp. paratuberculosis
gcgaguucugguaggcggcc

SEQ ID NO: 2891732 - RNA, 22 nt, Mycobacterium avium subsp. paratuberculosis
gcgaguucugguaggcggccgg

SEQ ID NO: 2891733 - RNA, 16 nt, Mycobacterium avium subsp. paratuberculosis
gcgaguuggccaucgu

SEQ ID NO: 2891734 - RNA, 23 nt, Mycobacterium avium subsp. paratuberculosis
gcgaguuguacccuucggccgcu

SEQ ID NO: 2891735 - RNA, 22 nt, Mycobacterium avium subsp. paratuberculosis
gcgauaaccucggcggcggcgc

SEQ ID NO: 2891736 - RNA, 16 nt, Mycobacterium avium subsp. paratuberculosis
gcgauacccgggagca

SEQ ID NO: 2891737 - RNA, 22 nt, Mycobacterium avium subsp. paratuberculosis
gcgauagaccucacggucggcg

SEQ ID NO: 2891738 - RNA, 23 nt, Mycobacterium avium subsp. paratuberculosis
gcgauagaccucacggucggcgu

SEQ ID NO: 2891739 - RNA, 19 nt, Mycobacterium avium subsp. paratuberculosis
gcgauagccaucagaacgc

SEQ ID NO: 2891740 - RNA, 23 nt, Mycobacterium avium subsp. paratuberculosis
gcgauagccggugaucgcggcgc

SEQ ID NO: 2891741 - RNA, 15 nt, Mycobacterium avium subsp. paratuberculosis
gcgauaggcggccag

SEQ ID NO: 2891742 - RNA, 16 nt, Mycobacterium avium subsp. paratuberculosis
gcgauaggcggccagc

SEQ ID NO: 2891743 - RNA, 17 nt, Mycobacterium avium subsp. paratuberculosis
gcgauagggccggccgg

SEQ ID NO: 2891744 - RNA, 14 nt, Mycobacterium avium subsp. paratuberculosis
gcgaucaacaccgg

SEQ ID NO: 2891745 - RNA, 23 nt, Mycobacterium avium subsp. paratuberculosis
gcgaucaacaccgguccggccgu

SEQ ID NO: 2891746 - RNA, 24 nt, Mycobacterium avium subsp. paratuberculosis
gcgaucaacaccgguccggccgug

SEQ ID NO: 2891747 - RNA, 22 nt, Mycobacterium avium subsp. paratuberculosis
gcgaucaacgggucgagcacgu

SEQ ID NO: 2891748 - RNA, 18 nt, Mycobacterium avium subsp. paratuberculosis
gcgaucacaccaccacgc

SEQ ID NO: 2891749 - RNA, 14 nt, Mycobacterium avium subsp. paratuberculosis
gcgaucaccacccc

SEQ ID NO: 2891750 - RNA, 15 nt, Mycobacterium avium subsp. paratuberculosis
gcgaucaccccggcg

SEQ ID NO: 2891751 - RNA, 16 nt, Mycobacterium avium subsp. paratuberculosis
gcgaucaccccggcga

SEQ ID NO: 2891752 - RNA, 22 nt, Mycobacterium avium subsp. paratuberculosis
gcgaucaccccggcgacggcgg

SEQ ID NO: 2891753 - RNA, 22 nt, Mycobacterium avium subsp. paratuberculosis
gcgaucaccgagauggccacca

SEQ ID NO: 2891754 - RNA, 14 nt, Mycobacterium avium subsp. paratuberculosis
gcgaucaccgccgc

SEQ ID NO: 2891755 - RNA, 16 nt, Mycobacterium avium subsp. paratuberculosis
gcgaucaccgccgcgg

SEQ ID NO: 2891756 - RNA, 18 nt, Mycobacterium avium subsp. paratuberculosis
gcgaucaccgccgcggcg

SEQ ID NO: 2891757 - RNA, 22 nt, Mycobacterium avium subsp. paratuberculosis
gcgaucaccgccgcggcgacca

SEQ ID NO: 2891758 - RNA, 15 nt, Mycobacterium avium subsp. paratuberculosis
gcgaucaccgcggcc

SEQ ID NO: 2891759 - RNA, 16 nt, Mycobacterium avium subsp. paratuberculosis
gcgaucaccgcggcca

SEQ ID NO: 2891760 - RNA, 17 nt, Mycobacterium avium subsp. paratuberculosis
gcgaucaccgcggccac

SEQ ID NO: 2891761 - RNA, 12 nt, Mycobacterium avium subsp. paratuberculosis
gcgaucgccgug

SEQ ID NO: 2891762 - RNA, 13 nt, Mycobacterium avium subsp. paratuberculosis
gcgaucgccguga

SEQ ID NO: 2891763 - RNA, 16 nt, Mycobacterium avium subsp. paratuberculosis
gcgaucgcgagcaggg

SEQ ID NO: 2891764 - RNA, 18 nt, Mycobacterium avium subsp. paratuberculosis
gcgaucgcgagcagggcg

SEQ ID NO: 2891765 - RNA, 16 nt, Mycobacterium avium subsp. paratuberculosis
gcgaucggauggugcc

SEQ ID NO: 2891766 - RNA, 11 nt, Mycobacterium avium subsp. paratuberculosis
gcgaucggcag

SEQ ID NO: 2891767 - RNA, 16 nt, Mycobacterium avium subsp. paratuberculosis
gcgaucggccgcugcc

SEQ ID NO: 2891768 - RNA, 17 nt, Mycobacterium avium subsp. paratuberculosis
gcgaucggccgcugcgg

SEQ ID NO: 2891769 - RNA, 12 nt, Mycobacterium avium subsp. paratuberculosis
gcgaucggcgag

SEQ ID NO: 2891770 - RNA, 22 nt, Mycobacterium avium subsp. paratuberculosis
gcgaucggcgccacgaccagcg

SEQ ID NO: 2891771 - RNA, 17 nt, Mycobacterium avium subsp. paratuberculosis
gcgaucggcgcggcgaa

SEQ ID NO: 2891772 - RNA, 14 nt, Mycobacterium avium subsp. paratuberculosis
gcgaucggcggcuc

SEQ ID NO: 2891773 - RNA, 20 nt, Mycobacterium avium subsp. paratuberculosis
gcgaucggcggcucgccggc

SEQ ID NO: 2891774 - RNA, 21 nt, Mycobacterium avium subsp. paratuberculosis
gcgaucggcggcucgccggcg

SEQ ID NO: 2891775 - RNA, 17 nt, Mycobacterium avium subsp. paratuberculosis
gcgaucggcgguccgcc

SEQ ID NO: 2891776 - RNA, 23 nt, Mycobacterium avium subsp. paratuberculosis
gcgaucggcgguccgccgcagcg

SEQ ID NO: 2891777 - RNA, 24 nt, Mycobacterium avium subsp. paratuberculosis
gcgaucggcgguccgccgcagcgg

SEQ ID NO: 2891778 - RNA, 13 nt, Mycobacterium avium subsp. paratuberculosis
gcgaucgggaaca

SEQ ID NO: 2891779 - RNA, 15 nt, Mycobacterium avium subsp. paratuberculosis
gcgaucgggaacagc

SEQ ID NO: 2891780 - RNA, 19 nt, Mycobacterium avium subsp. paratuberculosis
gcgaucgggaacagcccgc

SEQ ID NO: 2891781 - RNA, 21 nt, Mycobacterium avium subsp. paratuberculosis
gcgaucgggaacagcccgccc

SEQ ID NO: 2891782 - RNA, 18 nt, Mycobacterium avium subsp. paratuberculosis
gcgaucgggucaccggcc

SEQ ID NO: 2891783 - RNA, 19 nt, Mycobacterium avium subsp. paratuberculosis
gcgaucgggucaccggccg

SEQ ID NO: 2891784 - RNA, 21 nt, Mycobacterium avium subsp. paratuberculosis
gcgaucggugaacccgccggc

SEQ ID NO: 2891785 - RNA, 22 nt, Mycobacterium avium subsp. paratuberculosis
gcgaucggugaacccgccggcg

SEQ ID NO: 2891786 - RNA, 13 nt, Mycobacterium avium subsp. paratuberculosis
gcgaucggugucc

SEQ ID NO: 2891787 - RNA, 22 nt, Mycobacterium avium subsp. paratuberculosis
gcgaucgucaggucuucggucg

SEQ ID NO: 2891788 - RNA, 14 nt, Mycobacterium avium subsp. paratuberculosis
gcgaucgucgacca

SEQ ID NO: 2891789 - RNA, 17 nt, Mycobacterium avium subsp. paratuberculosis
gcgaucgucgaccacca

SEQ ID NO: 2891790 - RNA, 19 nt, Mycobacterium avium subsp. paratuberculosis
gcgaucgucgaccaccacg

SEQ ID NO: 2891791 - RNA, 21 nt, Mycobacterium avium subsp. paratuberculosis
gcgaucgucgaccaccacgac

SEQ ID NO: 2891792 - RNA, 13 nt, Mycobacterium avium subsp. paratuberculosis
gcgaucgucgccg

SEQ ID NO: 2891793 - RNA, 16 nt, Mycobacterium avium subsp. paratuberculosis
gcgaucuccagcggcc

SEQ ID NO: 2891794 - RNA, 21 nt, Mycobacterium avium subsp. paratuberculosis
gcgaucuccagcggccgggcg

SEQ ID NO: 2891795 - RNA, 19 nt, Mycobacterium avium subsp. paratuberculosis
gcgaucuccgucaccgugg

SEQ ID NO: 2891796 - RNA, 19 nt, Mycobacterium avium subsp. paratuberculosis
gcgaucuccuuguugacga

SEQ ID NO: 2891797 - RNA, 14 nt, Mycobacterium avium subsp. paratuberculosis
gcgaucucgagcau

SEQ ID NO: 2891798 - RNA, 22 nt, Mycobacterium avium subsp. paratuberculosis
gcgaucucgauggacaggcacu

SEQ ID NO: 2891799 - RNA, 14 nt, Mycobacterium avium subsp. paratuberculosis
gcgaucucgauggc

SEQ ID NO: 2891800 - RNA, 15 nt, Mycobacterium avium subsp. paratuberculosis
gcgaucucgauggcc

SEQ ID NO: 2891801 - RNA, 22 nt, Mycobacterium avium subsp. paratuberculosis
gcgaucucgauggccucgucga

SEQ ID NO: 2891802 - RNA, 19 nt, Mycobacterium avium subsp. paratuberculosis
gcgaucucgccgaaggccg

SEQ ID NO: 2891803 - RNA, 22 nt, Mycobacterium avium subsp. paratuberculosis
gcgaucucgccgaaggccgggu

SEQ ID NO: 2891804 - RNA, 16 nt, Mycobacterium avium subsp. paratuberculosis
gcgaucucggcggacu

SEQ ID NO: 2891805 - RNA, 21 nt, Mycobacterium avium subsp. paratuberculosis
gcgaucucggcggacucggcg

SEQ ID NO: 2891806 - RNA, 22 nt, Mycobacterium avium subsp. paratuberculosis
gcgaucucggcggacucggcga

SEQ ID NO: 2891807 - RNA, 15 nt, Mycobacterium avium subsp. paratuberculosis
gcgaucucggcggcc

SEQ ID NO: 2891808 - RNA, 22 nt, Mycobacterium avium subsp. paratuberculosis
gcgaucucggcggccgcguccu

SEQ ID NO: 2891809 - RNA, 20 nt, Mycobacterium avium subsp. paratuberculosis
gcgaucucggucaccgagcg

SEQ ID NO: 2891810 - RNA, 21 nt, Mycobacterium avium subsp. paratuberculosis
gcgaucucggucaccgagcgg

SEQ ID NO: 2891811 - RNA, 23 nt, Mycobacterium avium subsp. paratuberculosis
gcgaucucggucaccgagcggcc

SEQ ID NO: 2891812 - RNA, 15 nt, Mycobacterium avium subsp. paratuberculosis
gcgaucucgguuucc

SEQ ID NO: 2891813 - RNA, 18 nt, Mycobacterium avium subsp. paratuberculosis
gcgaucucuucgaugccg

SEQ ID NO: 2891814 - RNA, 23 nt, Mycobacterium avium subsp. paratuberculosis
gcgaucuggguuugggucaucga

SEQ ID NO: 2891815 - RNA, 18 nt, Mycobacterium avium subsp. paratuberculosis
gcgaucuugccgccgcgg

SEQ ID NO: 2891816 - RNA, 19 nt, Mycobacterium avium subsp. paratuberculosis
gcgaucuugccgccgcgga

SEQ ID NO: 2891817 - RNA, 21 nt, Mycobacterium avium subsp. paratuberculosis
gcgaucuugucccgcauggcc

SEQ ID NO: 2891818 - RNA, 18 nt, Mycobacterium avium subsp. paratuberculosis
gcgaugaacgggauggag

SEQ ID NO: 2891819 - RNA, 14 nt, Mycobacterium avium subsp. paratuberculosis
gcgaugaagccccg

SEQ ID NO: 2891820 - RNA, 14 nt, Mycobacterium avium subsp. paratuberculosis
gcgaugaagccggc

SEQ ID NO: 2891821 - RNA, 16 nt, Mycobacterium avium subsp. paratuberculosis
gcgaugaagccggcga

SEQ ID NO: 2891822 - RNA, 15 nt, Mycobacterium avium subsp. paratuberculosis
gcgaugaccagcgcg

SEQ ID NO: 2891823 - RNA, 16 nt, Mycobacterium avium subsp. paratuberculosis
gcgaugaccagcgcga

SEQ ID NO: 2891824 - RNA, 18 nt, Mycobacterium avium subsp. paratuberculosis
gcgaugaccgccugcggc

SEQ ID NO: 2891825 - RNA, 21 nt, Mycobacterium avium subsp. paratuberculosis
gcgaugacgaauuccgcaccg

SEQ ID NO: 2891826 - RNA, 24 nt, Mycobacterium avium subsp. paratuberculosis
gcgaugacgaauuccgcaccgguc

SEQ ID NO: 2891827 - RNA, 16 nt, Mycobacterium avium subsp. paratuberculosis
gcgaugacgucgucgc

SEQ ID NO: 2891828 - RNA, 20 nt, Mycobacterium avium subsp. paratuberculosis
gcgaugaucaccucggugau

SEQ ID NO: 2891829 - RNA, 19 nt, Mycobacterium avium subsp. paratuberculosis
gcgaugaucacgaaguuga

SEQ ID NO: 2891830 - RNA, 19 nt, Mycobacterium avium subsp. paratuberculosis
gcgaugaucagcucgcgca

SEQ ID NO: 2891831 - RNA, 15 nt, Mycobacterium avium subsp. paratuberculosis
gcgaugauccgcggc

SEQ ID NO: 2891832 - RNA, 17 nt, Mycobacterium avium subsp. paratuberculosis
gcgaugauccgcggcgc

SEQ ID NO: 2891833 - RNA, 19 nt, Mycobacterium avium subsp. paratuberculosis
gcgaugauccgcggcgccg

SEQ ID NO: 2891834 - RNA, 22 nt, Mycobacterium avium subsp. paratuberculosis
gcgaugauccgcggcgccgggc

SEQ ID NO: 2891835 - RNA, 24 nt, Mycobacterium avium subsp. paratuberculosis
gcgaugauccgcggcgccgggcgg

SEQ ID NO: 2891836 - RNA, 15 nt, Mycobacterium avium subsp. paratuberculosis
gcgaugaucgccggc

SEQ ID NO: 2891837 - RNA, 16 nt, Mycobacterium avium subsp. paratuberculosis
gcgaugaucgccggcg

SEQ ID NO: 2891838 - RNA, 20 nt, Mycobacterium avium subsp. paratuberculosis
gcgaugaucgggaugucgug

SEQ ID NO: 2891839 - RNA, 21 nt, Mycobacterium avium subsp. paratuberculosis
gcgaugaucgggaugucgugg

SEQ ID NO: 2891840 - RNA, 20 nt, Mycobacterium avium subsp. paratuberculosis
gcgaugaugagcaagucggc

SEQ ID NO: 2891841 - RNA, 16 nt, Mycobacterium avium subsp. paratuberculosis
gcgaugauggcgucga

SEQ ID NO: 2891842 - RNA, 19 nt, Mycobacterium avium subsp. paratuberculosis
gcgaugauggcgucgacgu

SEQ ID NO: 2891843 - RNA, 21 nt, Mycobacterium avium subsp. paratuberculosis
gcgaugauggcgucgacgugc

SEQ ID NO: 2891844 - RNA, 19 nt, Mycobacterium avium subsp. paratuberculosis
gcgaugauggucaccgucg

SEQ ID NO: 2891845 - RNA, 13 nt, Mycobacterium avium subsp. paratuberculosis
gcgaugucggugc

SEQ ID NO: 2891846 - RNA, 22 nt, Mycobacterium avium subsp. paratuberculosis
gcgaugucggugggccgcaccu

SEQ ID NO: 2891847 - RNA, 13 nt, Mycobacterium avium subsp. paratuberculosis
gcgaugucgucga

SEQ ID NO: 2891848 - RNA, 15 nt, Mycobacterium avium subsp. paratuberculosis
gcgaugucgucgacg

SEQ ID NO: 2891849 - RNA, 15 nt, Mycobacterium avium subsp. paratuberculosis
gcgaugugaucgcgg

SEQ ID NO: 2891850 - RNA, 20 nt, Mycobacterium avium subsp. paratuberculosis
gcgaugugaucgcggcccac

SEQ ID NO: 2891851 - RNA, 21 nt, Mycobacterium avium subsp. paratuberculosis
gcgauguggcguucgaugccc

SEQ ID NO: 2891852 - RNA, 18 nt, Mycobacterium avium subsp. paratuberculosis
gcgauguggguggucagc

SEQ ID NO: 2891853 - RNA, 19 nt, Mycobacterium avium subsp. paratuberculosis
gcgauguggguggucagcg

SEQ ID NO: 2891854 - RNA, 13 nt, Mycobacterium avium subsp. paratuberculosis
gcgauucccgccg

SEQ ID NO: 2891855 - RNA, 14 nt, Mycobacterium avium subsp. paratuberculosis
gcgauucccgccgg

SEQ ID NO: 2891856 - RNA, 15 nt, Mycobacterium avium subsp. paratuberculosis
gcgauucccgccgga

SEQ ID NO: 2891857 - RNA, 19 nt, Mycobacterium avium subsp. paratuberculosis
gcgauucccggaugcugcg

SEQ ID NO: 2891858 - RNA, 18 nt, Mycobacterium avium subsp. paratuberculosis
gcgauucgguaccagggc

SEQ ID NO: 2891859 - RNA, 19 nt, Mycobacterium avium subsp. paratuberculosis
gcgauucgguaccagggca

SEQ ID NO: 2891860 - RNA, 13 nt, Mycobacterium avium subsp. paratuberculosis
gcgauucgucguc

SEQ ID NO: 2891861 - RNA, 15 nt, Mycobacterium avium subsp. paratuberculosis
gcgauucgucgucgu

SEQ ID NO: 2891862 - RNA, 14 nt, Mycobacterium avium subsp. paratuberculosis
gcgauugcacaccg

SEQ ID NO: 2891863 - RNA, 14 nt, Mycobacterium avium subsp. paratuberculosis
gcgauugcggccgc

SEQ ID NO: 2891864 - RNA, 16 nt, Mycobacterium avium subsp. paratuberculosis
gcgauugcggccgccg

SEQ ID NO: 2891865 - RNA, 17 nt, Mycobacterium avium subsp. paratuberculosis
gcgauugcggccgccgg

SEQ ID NO: 2891866 - RNA, 21 nt, Mycobacterium avium subsp. paratuberculosis
gcgauugcggccgccggccag

SEQ ID NO: 2891867 - RNA, 14 nt, Mycobacterium avium subsp. paratuberculosis
gcgauugguggccc

SEQ ID NO: 2891868 - RNA, 20 nt, Mycobacterium avium subsp. paratuberculosis
gcgauugguggcccggucgu

SEQ ID NO: 2891869 - RNA, 13 nt, Mycobacterium avium subsp. paratuberculosis
gcgauuucggccg

SEQ ID NO: 2891870 - RNA, 16 nt, Mycobacterium avium subsp. paratuberculosis
gcgauuucgucggcgg

SEQ ID NO: 2891871 - RNA, 14 nt, Mycobacterium avium subsp. paratuberculosis
gcgcaacaccggau

SEQ ID NO: 2891872 - RNA, 21 nt, Mycobacterium avium subsp. paratuberculosis
gcgcaacaccggauuucgcca

SEQ ID NO: 2891873 - RNA, 15 nt, Mycobacterium avium subsp. paratuberculosis
gcgcaacaccucggc

SEQ ID NO: 2891874 - RNA, 18 nt, Mycobacterium avium subsp. paratuberculosis
gcgcaacaccucggcgac

SEQ ID NO: 2891875 - RNA, 14 nt, Mycobacterium avium subsp. paratuberculosis
gcgcaacagcaccu

SEQ ID NO: 2891876 - RNA, 16 nt, Mycobacterium avium subsp. paratuberculosis
gcgcaacagcaccucg

SEQ ID NO: 2891877 - RNA, 17 nt, Mycobacterium avium subsp. paratuberculosis
gcgcaacagcaccucgu

SEQ ID NO: 2891878 - RNA, 14 nt, Mycobacterium avium subsp. paratuberculosis
gcgcaacagcgugc

SEQ ID NO: 2891879 - RNA, 15 nt, Mycobacterium avium subsp. paratuberculosis
gcgcaaccgcggcgg

SEQ ID NO: 2891880 - RNA, 21 nt, Mycobacterium avium subsp. paratuberculosis
gcgcaaccgcggcggcggccc

SEQ ID NO: 2891881 - RNA, 22 nt, Mycobacterium avium subsp. paratuberculosis
gcgcaaccgcggcggcggcccg

SEQ ID NO: 2891882 - RNA, 23 nt, Mycobacterium avium subsp. paratuberculosis
gcgcaaccgcggcggcggcccgu

SEQ ID NO: 2891883 - RNA, 20 nt, Mycobacterium avium subsp. paratuberculosis
gcgcaaccucuucgggggug

SEQ ID NO: 2891884 - RNA, 23 nt, Mycobacterium avium subsp. paratuberculosis
gcgcaacgcuuucgggucgacga

SEQ ID NO: 2891885 - RNA, 15 nt, Mycobacterium avium subsp. paratuberculosis
gcgcaacggcgucga

SEQ ID NO: 2891886 - RNA, 19 nt, Mycobacterium avium subsp. paratuberculosis
gcgcaacguguacucggcg

SEQ ID NO: 2891887 - RNA, 20 nt, Mycobacterium avium subsp. paratuberculosis
gcgcaacguguacucggcgu

SEQ ID NO: 2891888 - RNA, 16 nt, Mycobacterium avium subsp. paratuberculosis
gcgcaacucguccacc

SEQ ID NO: 2891889 - RNA, 17 nt, Mycobacterium avium subsp. paratuberculosis
gcgcaacucguccacca

SEQ ID NO: 2891890 - RNA, 20 nt, Mycobacterium avium subsp. paratuberculosis
gcgcaacucguccaccagcu

SEQ ID NO: 2891891 - RNA, 21 nt, Mycobacterium avium subsp. paratuberculosis
gcgcaacucguccaccagcuc

SEQ ID NO: 2891892 - RNA, 19 nt, Mycobacterium avium subsp. paratuberculosis
gcgcaacucguccagcguc

SEQ ID NO: 2891893 - RNA, 20 nt, Mycobacterium avium subsp. paratuberculosis
gcgcaacucguccagcgucg

SEQ ID NO: 2891894 - RNA, 19 nt, Mycobacterium avium subsp. paratuberculosis
gcgcaacuggguggucaca

SEQ ID NO: 2891895 - RNA, 14 nt, Mycobacterium avium subsp. paratuberculosis
gcgcaagcaccggc

SEQ ID NO: 2891896 - RNA, 16 nt, Mycobacterium avium subsp. paratuberculosis
gcgcaagcaccggcug

SEQ ID NO: 2891897 - RNA, 21 nt, Mycobacterium avium subsp. paratuberculosis
gcgcaagcaccggcuggccga

SEQ ID NO: 2891898 - RNA, 17 nt, Mycobacterium avium subsp. paratuberculosis
gcgcaagggccgacauc

SEQ ID NO: 2891899 - RNA, 20 nt, Mycobacterium avium subsp. paratuberculosis
gcgcaauacccgaccagcac

SEQ ID NO: 2891900 - RNA, 22 nt, Mycobacterium avium subsp. paratuberculosis
gcgcaauacccgaccagcaccg

SEQ ID NO: 2891901 - RNA, 23 nt, Mycobacterium avium subsp. paratuberculosis
gcgcaauacccgaccagcaccgc

SEQ ID NO: 2891902 - RNA, 16 nt, Mycobacterium avium subsp. paratuberculosis
gcgcaaucaaaaaccc

SEQ ID NO: 2891903 - RNA, 17 nt, Mycobacterium avium subsp. paratuberculosis
gcgcaauccugcccggu

SEQ ID NO: 2891904 - RNA, 21 nt, Mycobacterium avium subsp. paratuberculosis
gcgcaaucggggccgacccgc

SEQ ID NO: 2891905 - RNA, 22 nt, Mycobacterium avium subsp. paratuberculosis
gcgcaaucggggccgacccgca

SEQ ID NO: 2891906 - RNA, 14 nt, Mycobacterium avium subsp. paratuberculosis
gcgcaaugccgccg

SEQ ID NO: 2891907 - RNA, 17 nt, Mycobacterium avium subsp. paratuberculosis
gcgcaaugccgccgcga

SEQ ID NO: 2891908 - RNA, 19 nt, Mycobacterium avium subsp. paratuberculosis
gcgcaaugccgccgcgacg

SEQ ID NO: 2891909 - RNA, 16 nt, Mycobacterium avium subsp. paratuberculosis
gcgcacaacagccaug

SEQ ID NO: 2891910 - RNA, 22 nt, Mycobacterium avium subsp. paratuberculosis
gcgcacaacccggacagcgcga

SEQ ID NO: 2891911 - RNA, 22 nt, Mycobacterium avium subsp. paratuberculosis
gcgcacaauucggucagcgcgu

SEQ ID NO: 2891912 - RNA, 15 nt, Mycobacterium avium subsp. paratuberculosis
gcgcacacagcagca

SEQ ID NO: 2891913 - RNA, 22 nt, Mycobacterium avium subsp. paratuberculosis
gcgcacacggccucgcccagcg

SEQ ID NO: 2891914 - RNA, 17 nt, Mycobacterium avium subsp. paratuberculosis
gcgcacagcgccacacc

SEQ ID NO: 2891915 - RNA, 18 nt, Mycobacterium avium subsp. paratuberculosis
gcgcacagcgccacaccg

SEQ ID NO: 2891916 - RNA, 22 nt, Mycobacterium avium subsp. paratuberculosis
gcgcacagcuaggucguggcgc

SEQ ID NO: 2891917 - RNA, 13 nt, Mycobacterium avium subsp. paratuberculosis
gcgcacaucacgg

SEQ ID NO: 2891918 - RNA, 21 nt, Mycobacterium avium subsp. paratuberculosis
gcgcacaucacgguggccgcc

SEQ ID NO: 2891919 - RNA, 15 nt, Mycobacterium avium subsp. paratuberculosis
gcgcacaucguggcg

SEQ ID NO: 2891920 - RNA, 22 nt, Mycobacterium avium subsp. paratuberculosis
gcgcaccaaggcaaucaggcgg

SEQ ID NO: 2891921 - RNA, 23 nt, Mycobacterium avium subsp. paratuberculosis
gcgcaccaccagcucgucgccga

SEQ ID NO: 2891922 - RNA, 12 nt, Mycobacterium avium subsp. paratuberculosis
gcgcaccaccuc

SEQ ID NO: 2891923 - RNA, 14 nt, Mycobacterium avium subsp. paratuberculosis
gcgcaccaccucgg

SEQ ID NO: 2891924 - RNA, 16 nt, Mycobacterium avium subsp. paratuberculosis
gcgcaccaccucggcg

SEQ ID NO: 2891925 - RNA, 18 nt, Mycobacterium avium subsp. paratuberculosis
gcgcaccaccucggcgau

SEQ ID NO: 2891926 - RNA, 13 nt, Mycobacterium avium subsp. paratuberculosis
gcgcaccaccucu

SEQ ID NO: 2891927 - RNA, 15 nt, Mycobacterium avium subsp. paratuberculosis
gcgcaccacgguggc

SEQ ID NO: 2891928 - RNA, 23 nt, Mycobacterium avium subsp. paratuberculosis
gcgcaccacgguggcgccgcgca

SEQ ID NO: 2891929 - RNA, 12 nt, Mycobacterium avium subsp. paratuberculosis
gcgcaccacguc

SEQ ID NO: 2891930 - RNA, 13 nt, Mycobacterium avium subsp. paratuberculosis
gcgcaccacgucg

SEQ ID NO: 2891931 - RNA, 16 nt, Mycobacterium avium subsp. paratuberculosis
gcgcaccacgucgggu

SEQ ID NO: 2891932 - RNA, 17 nt, Mycobacterium avium subsp. paratuberculosis
gcgcaccacgucggguu

SEQ ID NO: 2891933 - RNA, 12 nt, Mycobacterium avium subsp. paratuberculosis
gcgcaccagcuc

SEQ ID NO: 2891934 - RNA, 22 nt, Mycobacterium avium subsp. paratuberculosis
gcgcaccagcucgaggccgcgg

SEQ ID NO: 2891935 - RNA, 14 nt, Mycobacterium avium subsp. paratuberculosis
gcgcaccagcucgg

SEQ ID NO: 2891936 - RNA, 15 nt, Mycobacterium avium subsp. paratuberculosis
gcgcaccagcucggc

SEQ ID NO: 2891937 - RNA, 16 nt, Mycobacterium avium subsp. paratuberculosis
gcgcaccagcucggcg

SEQ ID NO: 2891938 - RNA, 19 nt, Mycobacterium avium subsp. paratuberculosis
gcgcaccaggccgacgcug

SEQ ID NO: 2891939 - RNA, 14 nt, Mycobacterium avium subsp. paratuberculosis
gcgcaccaggcgcc

SEQ ID NO: 2891940 - RNA, 22 nt, Mycobacterium avium subsp. paratuberculosis
gcgcaccaggcgccacagcagc

SEQ ID NO: 2891941 - RNA, 12 nt, Mycobacterium avium subsp. paratuberculosis
gcgcaccagggc

SEQ ID NO: 2891942 - RNA, 17 nt, Mycobacterium avium subsp. paratuberculosis
gcgcaccagggccgcga

SEQ ID NO: 2891943 - RNA, 19 nt, Mycobacterium avium subsp. paratuberculosis
gcgcaccagggccgcgagc

SEQ ID NO: 2891944 - RNA, 20 nt, Mycobacterium avium subsp. paratuberculosis
gcgcaccagggccugcagca

SEQ ID NO: 2891945 - RNA, 16 nt, Mycobacterium avium subsp. paratuberculosis
gcgcaccagggugucg

SEQ ID NO: 2891946 - RNA, 23 nt, Mycobacterium avium subsp. paratuberculosis
gcgcaccagggugucgucgcgca

SEQ ID NO: 2891947 - RNA, 16 nt, Mycobacterium avium subsp. paratuberculosis
gcgcaccaucaccugu

SEQ ID NO: 2891948 - RNA, 17 nt, Mycobacterium avium subsp. paratuberculosis
gcgcaccauccgcgacg

SEQ ID NO: 2891949 - RNA, 20 nt, Mycobacterium avium subsp. paratuberculosis
gcgcaccauccgcgacgcca

SEQ ID NO: 2891950 - RNA, 23 nt, Mycobacterium avium subsp. paratuberculosis
gcgcaccauccgcgacgccagca

SEQ ID NO: 2891951 - RNA, 14 nt, Mycobacterium avium subsp. paratuberculosis
gcgcacccagacgu

SEQ ID NO: 2891952 - RNA, 12 nt, Mycobacterium avium subsp. paratuberculosis
gcgcacccccgg

SEQ ID NO: 2891953 - RNA, 14 nt, Mycobacterium avium subsp. paratuberculosis
gcgcacccccgggg

SEQ ID NO: 2891954 - RNA, 17 nt, Mycobacterium avium subsp. paratuberculosis
gcgcacccccggggccu

SEQ ID NO: 2891955 - RNA, 23 nt, Mycobacterium avium subsp. paratuberculosis
gcgcacccccggggccuccagcc

SEQ ID NO: 2891956 - RNA, 20 nt, Mycobacterium avium subsp. paratuberculosis
gcgcaccccgaaccgcccgc

SEQ ID NO: 2891957 - RNA, 22 nt, Mycobacterium avium subsp. paratuberculosis
gcgcaccccgaaccgcccgccc

SEQ ID NO: 2891958 - RNA, 13 nt, Mycobacterium avium subsp. paratuberculosis
gcgcaccccggca

SEQ ID NO: 2891959 - RNA, 18 nt, Mycobacterium avium subsp. paratuberculosis
gcgcaccccguugccgcc

SEQ ID NO: 2891960 - RNA, 19 nt, Mycobacterium avium subsp. paratuberculosis
gcgcaccccguugccgccg

SEQ ID NO: 2891961 - RNA, 22 nt, Mycobacterium avium subsp. paratuberculosis
gcgcaccccguugccgccggcg

SEQ ID NO: 2891962 - RNA, 14 nt, Mycobacterium avium subsp. paratuberculosis
gcgcacccgcacga

SEQ ID NO: 2891963 - RNA, 14 nt, Mycobacterium avium subsp. paratuberculosis
gcgcacccgcacgu

SEQ ID NO: 2891964 - RNA, 13 nt, Mycobacterium avium subsp. paratuberculosis
gcgcacccgcggg

SEQ ID NO: 2891965 - RNA, 12 nt, Mycobacterium avium subsp. paratuberculosis
gcgcacccggcc

SEQ ID NO: 2891966 - RNA, 12 nt, Mycobacterium avium subsp. paratuberculosis
gcgcacccgguc

SEQ ID NO: 2891967 - RNA, 18 nt, Mycobacterium avium subsp. paratuberculosis
gcgcacccgguccggcug

SEQ ID NO: 2891968 - RNA, 20 nt, Mycobacterium avium subsp. paratuberculosis
gcgcacccgguccggcuggu

SEQ ID NO: 2891969 - RNA, 13 nt, Mycobacterium avium subsp. paratuberculosis
gcgcaccgagccc

SEQ ID NO: 2891970 - RNA, 14 nt, Mycobacterium avium subsp. paratuberculosis
gcgcaccgagucgg

SEQ ID NO: 2891971 - RNA, 12 nt, Mycobacterium avium subsp. paratuberculosis
gcgcaccgccac

SEQ ID NO: 2891972 - RNA, 15 nt, Mycobacterium avium subsp. paratuberculosis
gcgcaccgccaccgc

SEQ ID NO: 2891973 - RNA, 16 nt, Mycobacterium avium subsp. paratuberculosis
gcgcaccgccaccgcc

SEQ ID NO: 2891974 - RNA, 17 nt, Mycobacterium avium subsp. paratuberculosis
gcgcaccgccaccgccc

SEQ ID NO: 2891975 - RNA, 18 nt, Mycobacterium avium subsp. paratuberculosis
gcgcaccgccaccgcccg

SEQ ID NO: 2891976 - RNA, 15 nt, Mycobacterium avium subsp. paratuberculosis
gcgcaccgccagcac

SEQ ID NO: 2891977 - RNA, 17 nt, Mycobacterium avium subsp. paratuberculosis
gcgcaccgccagcaccg

SEQ ID NO: 2891978 - RNA, 20 nt, Mycobacterium avium subsp. paratuberculosis
gcgcaccgccagcaccgacg

SEQ ID NO: 2891979 - RNA, 15 nt, Mycobacterium avium subsp. paratuberculosis
gcgcaccgccccgcc

SEQ ID NO: 2891980 - RNA, 15 nt, Mycobacterium avium subsp. paratuberculosis
gcgcaccgcccgcgg

SEQ ID NO: 2891981 - RNA, 17 nt, Mycobacterium avium subsp. paratuberculosis
gcgcaccgcccgcggug

SEQ ID NO: 2891982 - RNA, 12 nt, Mycobacterium avium subsp. paratuberculosis
gcgcaccgccgg

SEQ ID NO: 2891983 - RNA, 12 nt, Mycobacterium avium subsp. paratuberculosis
gcgcaccgccgu

SEQ ID NO: 2891984 - RNA, 19 nt, Mycobacterium avium subsp. paratuberculosis
gcgcaccgccgucggggcg

SEQ ID NO: 2891985 - RNA, 23 nt, Mycobacterium avium subsp. paratuberculosis
gcgcaccgccgucggggcgucgg

SEQ ID NO: 2891986 - RNA, 12 nt, Mycobacterium avium subsp. paratuberculosis
gcgcaccgccug

SEQ ID NO: 2891987 - RNA, 17 nt, Mycobacterium avium subsp. paratuberculosis
gcgcaccgccugugcga

SEQ ID NO: 2891988 - RNA, 21 nt, Mycobacterium avium subsp. paratuberculosis
gcgcaccgcgaaacgcaacag

SEQ ID NO: 2891989 - RNA, 14 nt, Mycobacterium avium subsp. paratuberculosis
gcgcaccgcgcgcc

SEQ ID NO: 2891990 - RNA, 21 nt, Mycobacterium avium subsp. paratuberculosis
gcgcaccgcgcgccaggucga

SEQ ID NO: 2891991 - RNA, 17 nt, Mycobacterium avium subsp. paratuberculosis
gcgcaccgcgcguucga

SEQ ID NO: 2891992 - RNA, 23 nt, Mycobacterium avium subsp. paratuberculosis
gcgcaccgcggauuccagcgcgu

SEQ ID NO: 2891993 - RNA, 16 nt, Mycobacterium avium subsp. paratuberculosis
gcgcaccgcggccucg

SEQ ID NO: 2891994 - RNA, 17 nt, Mycobacterium avium subsp. paratuberculosis
gcgcaccgcggccucgg

SEQ ID NO: 2891995 - RNA, 18 nt, Mycobacterium avium subsp. paratuberculosis
gcgcaccgcggccucggc

SEQ ID NO: 2891996 - RNA, 13 nt, Mycobacterium avium subsp. paratuberculosis
gcgcaccgcggcg

SEQ ID NO: 2891997 - RNA, 15 nt, Mycobacterium avium subsp. paratuberculosis
gcgcaccgcggcggg

SEQ ID NO: 2891998 - RNA, 14 nt, Mycobacterium avium subsp. paratuberculosis
gcgcaccgcggcgu

SEQ ID NO: 2891999 - RNA, 17 nt, Mycobacterium avium subsp. paratuberculosis
gcgcaccgcggcgugcg

SEQ ID NO: 2892000 - RNA, 22 nt, Mycobacterium avium subsp. paratuberculosis
gcgcaccgcggcgugcgccagu

SEQ ID NO: 2892001 - RNA, 14 nt, Mycobacterium avium subsp. paratuberculosis
gcgcaccgcgggcu

SEQ ID NO: 2892002 - RNA, 19 nt, Mycobacterium avium subsp. paratuberculosis
gcgcaccgcgggcucgaac

SEQ ID NO: 2892003 - RNA, 12 nt, Mycobacterium avium subsp. paratuberculosis
gcgcaccgcguc

SEQ ID NO: 2892004 - RNA, 14 nt, Mycobacterium avium subsp. paratuberculosis
gcgcaccgcgucga

SEQ ID NO: 2892005 - RNA, 17 nt, Mycobacterium avium subsp. paratuberculosis
gcgcaccgcgucgacca

SEQ ID NO: 2892006 - RNA, 20 nt, Mycobacterium avium subsp. paratuberculosis
gcgcaccgcgucgaccaccg

SEQ ID NO: 2892007 - RNA, 15 nt, Mycobacterium avium subsp. paratuberculosis
gcgcaccgcgucgau

SEQ ID NO: 2892008 - RNA, 15 nt, Mycobacterium avium subsp. paratuberculosis
gcgcaccggagccuu

SEQ ID NO: 2892009 - RNA, 16 nt, Mycobacterium avium subsp. paratuberculosis
gcgcaccggcgaugca

SEQ ID NO: 2892010 - RNA, 22 nt, Mycobacterium avium subsp. paratuberculosis
gcgcaccggcgaugcagaucac

SEQ ID NO: 2892011 - RNA, 13 nt, Mycobacterium avium subsp. paratuberculosis
gcgcaccggcgcu

SEQ ID NO: 2892012 - RNA, 14 nt, Mycobacterium avium subsp. paratuberculosis
gcgcaccggcgcug

SEQ ID NO: 2892013 - RNA, 12 nt, Mycobacterium avium subsp. paratuberculosis
gcgcaccggcug

SEQ ID NO: 2892014 - RNA, 18 nt, Mycobacterium avium subsp. paratuberculosis
gcgcaccggcugccccag

SEQ ID NO: 2892015 - RNA, 19 nt, Mycobacterium avium subsp. paratuberculosis
gccugagcaaccgguucgg

SEQ ID NO: 2892016 - RNA, 13 nt, Mycobacterium avium subsp. paratuberculosis
gccugagcccgcc

SEQ ID NO: 2892017 - RNA, 14 nt, Mycobacterium avium subsp. paratuberculosis
gccugagccgccgg

SEQ ID NO: 2892018 - RNA, 14 nt, Mycobacterium avium subsp. paratuberculosis
gccugaugccgguc

SEQ ID NO: 2892019 - RNA, 20 nt, Mycobacterium avium subsp. paratuberculosis
gccugcaacuggucgugcag

SEQ ID NO: 2892020 - RNA, 18 nt, Mycobacterium avium subsp. paratuberculosis
gccugcacaggggcgcgu

SEQ ID NO: 2892021 - RNA, 21 nt, Mycobacterium avium subsp. paratuberculosis
gccugcaccaccacacccagc

SEQ ID NO: 2892022 - RNA, 23 nt, Mycobacterium avium subsp. paratuberculosis
gccugcaccaccacacccagcgc

SEQ ID NO: 2892023 - RNA, 18 nt, Mycobacterium avium subsp. paratuberculosis
gccugcacccaggucaug

SEQ ID NO: 2892024 - RNA, 23 nt, Mycobacterium avium subsp. paratuberculosis
gccugcacccaggucaugguggc

SEQ ID NO: 2892025 - RNA, 16 nt, Mycobacterium avium subsp. paratuberculosis
gccugcaccggcgacg

SEQ ID NO: 2892026 - RNA, 22 nt, Mycobacterium avium subsp. paratuberculosis
gccugcaccggcgacggcgguu

SEQ ID NO: 2892027 - RNA, 16 nt, Mycobacterium avium subsp. paratuberculosis
gccugcaccucgggau

SEQ ID NO: 2892028 - RNA, 19 nt, Mycobacterium avium subsp. paratuberculosis
gccugcaccuugcccgucg

SEQ ID NO: 2892029 - RNA, 20 nt, Mycobacterium avium subsp. paratuberculosis
gccugcaccuugcccgucgc

SEQ ID NO: 2892030 - RNA, 23 nt, Mycobacterium avium subsp. paratuberculosis
gccugcaccuugcccgucgcguc

SEQ ID NO: 2892031 - RNA, 21 nt, Mycobacterium avium subsp. paratuberculosis
gccugcacgaaauaaccgcgc

SEQ ID NO: 2892032 - RNA, 23 nt, Mycobacterium avium subsp. paratuberculosis
gccugcacgaaauaaccgcgcgg

SEQ ID NO: 2892033 - RNA, 15 nt, Mycobacterium avium subsp. paratuberculosis
gccugcacgaagucg

SEQ ID NO: 2892034 - RNA, 21 nt, Mycobacterium avium subsp. paratuberculosis
gccugcacgaagucgaccgcg

SEQ ID NO: 2892035 - RNA, 15 nt, Mycobacterium avium subsp. paratuberculosis
gccugcacggugccg

SEQ ID NO: 2892036 - RNA, 14 nt, Mycobacterium avium subsp. paratuberculosis
gccugcacggugcg

SEQ ID NO: 2892037 - RNA, 17 nt, Mycobacterium avium subsp. paratuberculosis
gccugcacggugcgccg

SEQ ID NO: 2892038 - RNA, 19 nt, Mycobacterium avium subsp. paratuberculosis
gccugcagcaacucgcgcu

SEQ ID NO: 2892039 - RNA, 15 nt, Mycobacterium avium subsp. paratuberculosis
gccugcagcaccagg

SEQ ID NO: 2892040 - RNA, 16 nt, Mycobacterium avium subsp. paratuberculosis
gccugcagcaccaggc

SEQ ID NO: 2892041 - RNA, 20 nt, Mycobacterium avium subsp. paratuberculosis
gccugcagcaccaggcccuc

SEQ ID NO: 2892042 - RNA, 11 nt, Mycobacterium avium subsp. paratuberculosis
gccugcagccg

SEQ ID NO: 2892043 - RNA, 13 nt, Mycobacterium avium subsp. paratuberculosis
gccugcagccgcc

SEQ ID NO: 2892044 - RNA, 15 nt, Mycobacterium avium subsp. paratuberculosis
gccugcagccgccgc

SEQ ID NO: 2892045 - RNA, 16 nt, Mycobacterium avium subsp. paratuberculosis
gccugcagccgccgcg

SEQ ID NO: 2892046 - RNA, 21 nt, Mycobacterium avium subsp. paratuberculosis
gccugcaggaacgccuugacc

SEQ ID NO: 2892047 - RNA, 22 nt, Mycobacterium avium subsp. paratuberculosis
gccugcagggauucggccaugc

SEQ ID NO: 2892048 - RNA, 21 nt, Mycobacterium avium subsp. paratuberculosis
gccugcagugucggaaucggc

SEQ ID NO: 2892049 - RNA, 15 nt, Mycobacterium avium subsp. paratuberculosis
gccugccaccgcgaa

SEQ ID NO: 2892050 - RNA, 14 nt, Mycobacterium avium subsp. paratuberculosis
gccugcccagcggc

SEQ ID NO: 2892051 - RNA, 18 nt, Mycobacterium avium subsp. paratuberculosis
gccugcccagcggcacgg

SEQ ID NO: 2892052 - RNA, 21 nt, Mycobacterium avium subsp. paratuberculosis
gccugcccagcggcacgggca

SEQ ID NO: 2892053 - RNA, 14 nt, Mycobacterium avium subsp. paratuberculosis
gccugccccccuug

SEQ ID NO: 2892054 - RNA, 15 nt, Mycobacterium avium subsp. paratuberculosis
gccugcccgccgcgg

SEQ ID NO: 2892055 - RNA, 15 nt, Mycobacterium avium subsp. paratuberculosis
gccugcccgcgcagg

SEQ ID NO: 2892056 - RNA, 15 nt, Mycobacterium avium subsp. paratuberculosis
gccugcccgcgggug

SEQ ID NO: 2892057 - RNA, 14 nt, Mycobacterium avium subsp. paratuberculosis
gccugcccgggcgc

SEQ ID NO: 2892058 - RNA, 20 nt, Mycobacterium avium subsp. paratuberculosis
gccugcccuugaagcgcaga

SEQ ID NO: 2892059 - RNA, 18 nt, Mycobacterium avium subsp. paratuberculosis
gccugccggaugccgcgc

SEQ ID NO: 2892060 - RNA, 21 nt, Mycobacterium avium subsp. paratuberculosis
gccugccggaugccgcgcggc

SEQ ID NO: 2892061 - RNA, 22 nt, Mycobacterium avium subsp. paratuberculosis
gccugccggaugccgcgcggcg

SEQ ID NO: 2892062 - RNA, 24 nt, Mycobacterium avium subsp. paratuberculosis
gccugccggaugccgcgcggcgcc

SEQ ID NO: 2892063 - RNA, 13 nt, Mycobacterium avium subsp. paratuberculosis
gccugccggccgc

SEQ ID NO: 2892064 - RNA, 17 nt, Mycobacterium avium subsp. paratuberculosis
gccugccggccgccgcg

SEQ ID NO: 2892065 - RNA, 12 nt, Mycobacterium avium subsp. paratuberculosis
gccugccggcgc

SEQ ID NO: 2892066 - RNA, 15 nt, Mycobacterium avium subsp. paratuberculosis
gccugccggcgccgg

SEQ ID NO: 2892067 - RNA, 22 nt, Mycobacterium avium subsp. paratuberculosis
gccugccguuggggaucguguc

SEQ ID NO: 2892068 - RNA, 18 nt, Mycobacterium avium subsp. paratuberculosis
gccugcgagcacacccuc

SEQ ID NO: 2892069 - RNA, 17 nt, Mycobacterium avium subsp. paratuberculosis
gccugcgccaggauccg

SEQ ID NO: 2892070 - RNA, 22 nt, Mycobacterium avium subsp. paratuberculosis
gccugcgccaggauccgcccgc

SEQ ID NO: 2892071 - RNA, 11 nt, Mycobacterium avium subsp. paratuberculosis
gccugcgccgc

SEQ ID NO: 2892072 - RNA, 18 nt, Mycobacterium avium subsp. paratuberculosis
gccugcgccuuggccucg

SEQ ID NO: 2892073 - RNA, 14 nt, Mycobacterium avium subsp. paratuberculosis
gccugcgcgaccuc

SEQ ID NO: 2892074 - RNA, 19 nt, Mycobacterium avium subsp. paratuberculosis
gccugcgcgaccucuucgc

SEQ ID NO: 2892075 - RNA, 22 nt, Mycobacterium avium subsp. paratuberculosis
gccugcgcgccgauguggccgg

SEQ ID NO: 2892076 - RNA, 16 nt, Mycobacterium avium subsp. paratuberculosis
gccugcgcgccgucgg

SEQ ID NO: 2892077 - RNA, 14 nt, Mycobacterium avium subsp. paratuberculosis
gccugcgcggcggc

SEQ ID NO: 2892078 - RNA, 15 nt, Mycobacterium avium subsp. paratuberculosis
gccugcggcaacagc

SEQ ID NO: 2892079 - RNA, 16 nt, Mycobacterium avium subsp. paratuberculosis
gccugcggcaacagca

SEQ ID NO: 2892080 - RNA, 14 nt, Mycobacterium avium subsp. paratuberculosis
gccuggucggcgac

SEQ ID NO: 2892081 - RNA, 16 nt, Mycobacterium avium subsp. paratuberculosis
gccugguucgacguga

SEQ ID NO: 2892082 - RNA, 18 nt, Mycobacterium avium subsp. paratuberculosis
gccugguuggucaauccg

SEQ ID NO: 2892083 - RNA, 23 nt, Mycobacterium avium subsp. paratuberculosis
gccugguuggucaauccgggcac

SEQ ID NO: 2892084 - RNA, 21 nt, Mycobacterium avium subsp. paratuberculosis
gccugucaguuugcgcgacgg

SEQ ID NO: 2892085 - RNA, 23 nt, Mycobacterium avium subsp. paratuberculosis
gccugucaguuugcgcgacgggc

SEQ ID NO: 2892086 - RNA, 14 nt, Mycobacterium avium subsp. paratuberculosis
gccuguccagccgg

SEQ ID NO: 2892087 - RNA, 17 nt, Mycobacterium avium subsp. paratuberculosis
gccuguccgaccagcgg

SEQ ID NO: 2892088 - RNA, 18 nt, Mycobacterium avium subsp. paratuberculosis
gccuguccgaccagcggu

SEQ ID NO: 2892089 - RNA, 14 nt, Mycobacterium avium subsp. paratuberculosis
gccugugcgacggc

SEQ ID NO: 2892090 - RNA, 16 nt, Mycobacterium avium subsp. paratuberculosis
gccuuacaaagccggu

SEQ ID NO: 2892091 - RNA, 12 nt, Mycobacterium avium subsp. paratuberculosis
gccuuacgccgg

SEQ ID NO: 2892092 - RNA, 14 nt, Mycobacterium avium subsp. paratuberculosis
gccuuagcccggcc

SEQ ID NO: 2892093 - RNA, 14 nt, Mycobacterium avium subsp. paratuberculosis
gccuucaccagggu

SEQ ID NO: 2892094 - RNA, 17 nt, Mycobacterium avium subsp. paratuberculosis
gccuucacgcuggccuc

SEQ ID NO: 2892095 - RNA, 21 nt, Mycobacterium avium subsp. paratuberculosis
gccuucacgcuggccuccagc

SEQ ID NO: 2892096 - RNA, 23 nt, Mycobacterium avium subsp. paratuberculosis
gccuucacgcuggccuccagcuu

SEQ ID NO: 2892097 - RNA, 12 nt, Mycobacterium avium subsp. paratuberculosis
gccuucaucacc

SEQ ID NO: 2892098 - RNA, 17 nt, Mycobacterium avium subsp. paratuberculosis
gccuucaucaccgcccc

SEQ ID NO: 2892099 - RNA, 17 nt, Mycobacterium avium subsp. paratuberculosis
gccuuccacgaccuggc

SEQ ID NO: 2892100 - RNA, 22 nt, Mycobacterium avium subsp. paratuberculosis
gccuuccucggcgcucgccgcg

SEQ ID NO: 2892101 - RNA, 18 nt, Mycobacterium avium subsp. paratuberculosis
gccuucgacccgguggcc

SEQ ID NO: 2892102 - RNA, 19 nt, Mycobacterium avium subsp. paratuberculosis
gccuucgacccgguggccc

SEQ ID NO: 2892103 - RNA, 18 nt, Mycobacterium avium subsp. paratuberculosis
gccuucgacggccggccc

SEQ ID NO: 2892104 - RNA, 19 nt, Mycobacterium avium subsp. paratuberculosis
gccuucgacggccggcccu

SEQ ID NO: 2892105 - RNA, 18 nt, Mycobacterium avium subsp. paratuberculosis
gccuucgaguuuggccug

SEQ ID NO: 2892106 - RNA, 19 nt, Mycobacterium avium subsp. paratuberculosis
gccuucggcgccagcccgc

SEQ ID NO: 2892107 - RNA, 17 nt, Mycobacterium avium subsp. paratuberculosis
gccuucuccagcuccuc

SEQ ID NO: 2892108 - RNA, 20 nt, Mycobacterium avium subsp. paratuberculosis
gccuucuccagcuccucggu

SEQ ID NO: 2892109 - RNA, 22 nt, Mycobacterium avium subsp. paratuberculosis
gccuucucgccguuuugccgcc

SEQ ID NO: 2892110 - RNA, 16 nt, Mycobacterium avium subsp. paratuberculosis
gccuucucgcgcaccg

SEQ ID NO: 2892111 - RNA, 18 nt, Mycobacterium avium subsp. paratuberculosis
gccuucucgcgcaccgcg

SEQ ID NO: 2892112 - RNA, 18 nt, Mycobacterium avium subsp. paratuberculosis
gccuucuggaagccuggc

SEQ ID NO: 2892113 - RNA, 17 nt, Mycobacterium avium subsp. paratuberculosis
gccuucuucgccgcagc

SEQ ID NO: 2892114 - RNA, 15 nt, Mycobacterium avium subsp. paratuberculosis
gccuucuucucgacg

SEQ ID NO: 2892115 - RNA, 16 nt, Mycobacterium avium subsp. paratuberculosis
gccuucuucucgacgu

SEQ ID NO: 2892116 - RNA, 15 nt, Mycobacterium avium subsp. paratuberculosis
gccuucuugaccgca

SEQ ID NO: 2892117 - RNA, 17 nt, Mycobacterium avium subsp. paratuberculosis
gccuucuugaccgcagc

SEQ ID NO: 2892118 - RNA, 14 nt, Mycobacterium avium subsp. paratuberculosis
gccuucuugcugcc

SEQ ID NO: 2892119 - RNA, 17 nt, Mycobacterium avium subsp. paratuberculosis
gccuucuugcugcccgc

SEQ ID NO: 2892120 - RNA, 13 nt, Mycobacterium avium subsp. paratuberculosis
gccuucuuggccg

SEQ ID NO: 2892121 - RNA, 17 nt, Mycobacterium avium subsp. paratuberculosis
gccuucuuggccgcgcc

SEQ ID NO: 2892122 - RNA, 14 nt, Mycobacterium avium subsp. paratuberculosis
gccuucuuggccgg

SEQ ID NO: 2892123 - RNA, 18 nt, Mycobacterium avium subsp. paratuberculosis
gccuucuuggccggagcc

SEQ ID NO: 2892124 - RNA, 15 nt, Mycobacterium avium subsp. paratuberculosis
gccuucuuggcggcg

SEQ ID NO: 2892125 - RNA, 22 nt, Mycobacterium avium subsp. paratuberculosis
gccuucuuucguucgaugucgg

SEQ ID NO: 2892126 - RNA, 21 nt, Mycobacterium avium subsp. paratuberculosis
gccuugaacgcguccgacggc

SEQ ID NO: 2892127 - RNA, 18 nt, Mycobacterium avium subsp. paratuberculosis
gccuugaacucggccagg

SEQ ID NO: 2892128 - RNA, 13 nt, Mycobacterium avium subsp. paratuberculosis
gccuugaccacgg

SEQ ID NO: 2892129 - RNA, 22 nt, Mycobacterium avium subsp. paratuberculosis
gccuugaccacggugcgcucgu

SEQ ID NO: 2892130 - RNA, 15 nt, Mycobacterium avium subsp. paratuberculosis
gccuugacgacggcc

SEQ ID NO: 2892131 - RNA, 22 nt, Mycobacterium avium subsp. paratuberculosis
gccuugacgacggccaccgcga

SEQ ID NO: 2892132 - RNA, 21 nt, Mycobacterium avium subsp. paratuberculosis
gccuugacgaguuccaccucg

SEQ ID NO: 2892133 - RNA, 19 nt, Mycobacterium avium subsp. paratuberculosis
gccuugacguagaagucga

SEQ ID NO: 2892134 - RNA, 15 nt, Mycobacterium avium subsp. paratuberculosis
gccuugacgucgggu

SEQ ID NO: 2892135 - RNA, 22 nt, Mycobacterium avium subsp. paratuberculosis
gccuugagaacgucgcguccga

SEQ ID NO: 2892136 - RNA, 16 nt, Mycobacterium avium subsp. paratuberculosis
gccuugagcaccgcgu

SEQ ID NO: 2892137 - RNA, 17 nt, Mycobacterium avium subsp. paratuberculosis
gccuugaucuuggccug

SEQ ID NO: 2892138 - RNA, 20 nt, Mycobacterium avium subsp. paratuberculosis
gccuugaucuuggccugggc

SEQ ID NO: 2892139 - RNA, 15 nt, Mycobacterium avium subsp. paratuberculosis
gccuugcagccgcug

SEQ ID NO: 2892140 - RNA, 21 nt, Mycobacterium avium subsp. paratuberculosis
gccuugcagccgcugccgcac

SEQ ID NO: 2892141 - RNA, 17 nt, Mycobacterium avium subsp. paratuberculosis
gccuugccgacgacguc

SEQ ID NO: 2892142 - RNA, 19 nt, Mycobacterium avium subsp. paratuberculosis
gccuugccgaucagcuggc

SEQ ID NO: 2892143 - RNA, 16 nt, Mycobacterium avium subsp. paratuberculosis
gccuugcgcccacagu

SEQ ID NO: 2892144 - RNA, 15 nt, Mycobacterium avium subsp. paratuberculosis
gccuugcgggccgga

SEQ ID NO: 2892145 - RNA, 16 nt, Mycobacterium avium subsp. paratuberculosis
gccuugcgguuggccg

SEQ ID NO: 2892146 - RNA, 16 nt, Mycobacterium avium subsp. paratuberculosis
gccuugcugagccggc

SEQ ID NO: 2892147 - RNA, 18 nt, Mycobacterium avium subsp. paratuberculosis
gccuugcugagccggccc

SEQ ID NO: 2892148 - RNA, 19 nt, Mycobacterium avium subsp. paratuberculosis
gccuugcugauccccagcg

SEQ ID NO: 2892149 - RNA, 21 nt, Mycobacterium avium subsp. paratuberculosis
gccuugcugauccccagcggc

SEQ ID NO: 2892150 - RNA, 12 nt, Mycobacterium avium subsp. paratuberculosis
gccuuggccacc

SEQ ID NO: 2892151 - RNA, 13 nt, Mycobacterium avium subsp. paratuberculosis
gccuuggccacca

SEQ ID NO: 2892152 - RNA, 15 nt, Mycobacterium avium subsp. paratuberculosis
gccuuggccaccacg

SEQ ID NO: 2892153 - RNA, 15 nt, Mycobacterium avium subsp. paratuberculosis
gccuuggccaccgcc

SEQ ID NO: 2892154 - RNA, 16 nt, Mycobacterium avium subsp. paratuberculosis
gccuuggccaccgccu

SEQ ID NO: 2892155 - RNA, 20 nt, Mycobacterium avium subsp. paratuberculosis
gccuuggccaccgccugcgc

SEQ ID NO: 2892156 - RNA, 16 nt, Mycobacterium avium subsp. paratuberculosis
gccuuggccacgucga

SEQ ID NO: 2892157 - RNA, 14 nt, Mycobacterium avium subsp. paratuberculosis
gccuuggcccgcgc

SEQ ID NO: 2892158 - RNA, 17 nt, Mycobacterium avium subsp. paratuberculosis
gccuuggcccgcgcggc

SEQ ID NO: 2892159 - RNA, 15 nt, Mycobacterium avium subsp. paratuberculosis
gccuuggccgcaggc

SEQ ID NO: 2892160 - RNA, 17 nt, Mycobacterium avium subsp. paratuberculosis
gccuuggccguaggucg

SEQ ID NO: 2892161 - RNA, 14 nt, Mycobacterium avium subsp. paratuberculosis
gccuuggcucgggc

SEQ ID NO: 2892162 - RNA, 16 nt, Mycobacterium avium subsp. paratuberculosis
gccuugguccgcaacg

SEQ ID NO: 2892163 - RNA, 17 nt, Mycobacterium avium subsp. paratuberculosis
gccuuggugauccgggg

SEQ ID NO: 2892164 - RNA, 22 nt, Mycobacterium avium subsp. paratuberculosis
gccuuggugaugggcagcgccc

SEQ ID NO: 2892165 - RNA, 21 nt, Mycobacterium avium subsp. paratuberculosis
gcgaacgacgaccucccccga

SEQ ID NO: 2892166 - RNA, 14 nt, Mycobacterium avium subsp. paratuberculosis
gcgaacgacgucga

SEQ ID NO: 2892167 - RNA, 23 nt, Mycobacterium avium subsp. paratuberculosis
gcgaacgagacgaaguccgagcc

SEQ ID NO: 2892168 - RNA, 19 nt, Mycobacterium avium subsp. paratuberculosis
gcgaacgaggccgacgugg

SEQ ID NO: 2892169 - RNA, 13 nt, Mycobacterium avium subsp. paratuberculosis
gcgaacgcccggu

SEQ ID NO: 2892170 - RNA, 19 nt, Mycobacterium avium subsp. paratuberculosis
gcgaacgcccggucgauga

SEQ ID NO: 2892171 - RNA, 14 nt, Mycobacterium avium subsp. paratuberculosis
gcgaacgccgccgu

SEQ ID NO: 2892172 - RNA, 14 nt, Mycobacterium avium subsp. paratuberculosis
gcgaacgccucggu

SEQ ID NO: 2892173 - RNA, 17 nt, Mycobacterium avium subsp. paratuberculosis
gcgaacgccucgguggu

SEQ ID NO: 2892174 - RNA, 23 nt, Mycobacterium avium subsp. paratuberculosis
gcgaacgccucgguggucgacga

SEQ ID NO: 2892175 - RNA, 21 nt, Mycobacterium avium subsp. paratuberculosis
gcgaacgccucguuggccagc

SEQ ID NO: 2892176 - RNA, 13 nt, Mycobacterium avium subsp. paratuberculosis
gcgaacgcgaccu

SEQ ID NO: 2892177 - RNA, 13 nt, Mycobacterium avium subsp. paratuberculosis
gcgaacgcgcccc

SEQ ID NO: 2892178 - RNA, 19 nt, Mycobacterium avium subsp. paratuberculosis
gcgaacgcgccccgccggg

SEQ ID NO: 2892179 - RNA, 14 nt, Mycobacterium avium subsp. paratuberculosis
gcgaacgcgccggu

SEQ ID NO: 2892180 - RNA, 15 nt, Mycobacterium avium subsp. paratuberculosis
gcgaacgcgccggug

SEQ ID NO: 2892181 - RNA, 16 nt, Mycobacterium avium subsp. paratuberculosis
gcgaacgcgccgguga

SEQ ID NO: 2892182 - RNA, 19 nt, Mycobacterium avium subsp. paratuberculosis
gcgaacgcgcggucgucgc

SEQ ID NO: 2892183 - RNA, 22 nt, Mycobacterium avium subsp. paratuberculosis
gcgaacgcggcugaucagccgg

SEQ ID NO: 2892184 - RNA, 16 nt, Mycobacterium avium subsp. paratuberculosis
gcgaacgcgucccggg

SEQ ID NO: 2892185 - RNA, 15 nt, Mycobacterium avium subsp. paratuberculosis
gcgaacggcaacggc

SEQ ID NO: 2892186 - RNA, 19 nt, Mycobacterium avium subsp. paratuberculosis
gcgaacggcaacggcggcg

SEQ ID NO: 2892187 - RNA, 13 nt, Mycobacterium avium subsp. paratuberculosis
gcgaacggccagu

SEQ ID NO: 2892188 - RNA, 22 nt, Mycobacterium avium subsp. paratuberculosis
gcgaacggccaguccaggccgc

SEQ ID NO: 2892189 - RNA, 14 nt, Mycobacterium avium subsp. paratuberculosis
gcgaacggccgcga

SEQ ID NO: 2892190 - RNA, 15 nt, Mycobacterium avium subsp. paratuberculosis
gcgaacgggucgggg

SEQ ID NO: 2892191 - RNA, 17 nt, Mycobacterium avium subsp. paratuberculosis
gcgaacgggugaccggc

SEQ ID NO: 2892192 - RNA, 20 nt, Mycobacterium avium subsp. paratuberculosis
gcgaacgggugaccggcggc

SEQ ID NO: 2892193 - RNA, 21 nt, Mycobacterium avium subsp. paratuberculosis
gcgaacgggugaccggcggcc

SEQ ID NO: 2892194 - RNA, 23 nt, Mycobacterium avium subsp. paratuberculosis
gcgaacgggugaccggcggccag

SEQ ID NO: 2892195 - RNA, 15 nt, Mycobacterium avium subsp. paratuberculosis
gcgaacgggugcggc

SEQ ID NO: 2892196 - RNA, 16 nt, Mycobacterium avium subsp. paratuberculosis
gcgaacgggugcggcg

SEQ ID NO: 2892197 - RNA, 17 nt, Mycobacterium avium subsp. paratuberculosis
gcgaacgggugcggcgc

SEQ ID NO: 2892198 - RNA, 19 nt, Mycobacterium avium subsp. paratuberculosis
gcgaacgggugcggcgcuc

SEQ ID NO: 2892199 - RNA, 22 nt, Mycobacterium avium subsp. paratuberculosis
gcgaacgggugcggcgcucggu

SEQ ID NO: 2892200 - RNA, 23 nt, Mycobacterium avium subsp. paratuberculosis
gcgaacgguucgggaaccuggcc

SEQ ID NO: 2892201 - RNA, 16 nt, Mycobacterium avium subsp. paratuberculosis
gcgaacgucucgcggg

SEQ ID NO: 2892202 - RNA, 21 nt, Mycobacterium avium subsp. paratuberculosis
gcgaacuacuucgucagcagc

SEQ ID NO: 2892203 - RNA, 18 nt, Mycobacterium avium subsp. paratuberculosis
gcgaacucaggcgcgcac

SEQ ID NO: 2892204 - RNA, 16 nt, Mycobacterium avium subsp. paratuberculosis
gcgaacuccagaucgc

SEQ ID NO: 2892205 - RNA, 16 nt, Mycobacterium avium subsp. paratuberculosis
gcgaacucgcggcggg

SEQ ID NO: 2892206 - RNA, 13 nt, Mycobacterium avium subsp. paratuberculosis
gcgaacucgucga

SEQ ID NO: 2892207 - RNA, 15 nt, Mycobacterium avium subsp. paratuberculosis
gcgaacucgucgacg

SEQ ID NO: 2892208 - RNA, 17 nt, Mycobacterium avium subsp. paratuberculosis
gcgaacucgucgacgcc

SEQ ID NO: 2892209 - RNA, 19 nt, Mycobacterium avium subsp. paratuberculosis
gcgaacugcaccagcacga

SEQ ID NO: 2892210 - RNA, 22 nt, Mycobacterium avium subsp. paratuberculosis
gcgaacugcaccagcacgacac

SEQ ID NO: 2892211 - RNA, 13 nt, Mycobacterium avium subsp. paratuberculosis
gcgaacugccggc

SEQ ID NO: 2892212 - RNA, 19 nt, Mycobacterium avium subsp. paratuberculosis
gcgaacugcuugaucaggu

SEQ ID NO: 2892213 - RNA, 18 nt, Mycobacterium avium subsp. paratuberculosis
gcgaacuucaggcccuca

SEQ ID NO: 2892214 - RNA, 17 nt, Mycobacterium avium subsp. paratuberculosis
gcgaacuugcuggccga

SEQ ID NO: 2892215 - RNA, 17 nt, Mycobacterium avium subsp. paratuberculosis
gcgaacuuggccgacac

SEQ ID NO: 2892216 - RNA, 19 nt, Mycobacterium avium subsp. paratuberculosis
gcgaagaacgacgccaccg

SEQ ID NO: 2892217 - RNA, 19 nt, Mycobacterium avium subsp. paratuberculosis
gcgaagaacggugucacgu

SEQ ID NO: 2892218 - RNA, 14 nt, Mycobacterium avium subsp. paratuberculosis
gcgaagaccagcgu

SEQ ID NO: 2892219 - RNA, 16 nt, Mycobacterium avium subsp. paratuberculosis
gcgaagaccagcgugu

SEQ ID NO: 2892220 - RNA, 22 nt, Mycobacterium avium subsp. paratuberculosis
gcgaagaccagcgugucgccgg

SEQ ID NO: 2892221 - RNA, 15 nt, Mycobacterium avium subsp. paratuberculosis
gcgaagacgcuggcc

SEQ ID NO: 2892222 - RNA, 18 nt, Mycobacterium avium subsp. paratuberculosis
gcgaagacgucggcgcgg

SEQ ID NO: 2892223 - RNA, 19 nt, Mycobacterium avium subsp. paratuberculosis
gcgaagacgucggcgcggu

SEQ ID NO: 2892224 - RNA, 19 nt, Mycobacterium avium subsp. paratuberculosis
gcgaagagcggcacgaucg

SEQ ID NO: 2892225 - RNA, 16 nt, Mycobacterium avium subsp. paratuberculosis
gcgaagaugucgccgu

SEQ ID NO: 2892226 - RNA, 19 nt, Mycobacterium avium subsp. paratuberculosis
gcgaagcacgaccacaccc

SEQ ID NO: 2892227 - RNA, 13 nt, Mycobacterium avium subsp. paratuberculosis
gcgaagcaggcca

SEQ ID NO: 2892228 - RNA, 22 nt, Mycobacterium avium subsp. paratuberculosis
gcgaagcaggggucguuguugu

SEQ ID NO: 2892229 - RNA, 18 nt, Mycobacterium avium subsp. paratuberculosis
gcgaagccggccccgccc

SEQ ID NO: 2892230 - RNA, 14 nt, Mycobacterium avium subsp. paratuberculosis
gcgaagccggcguc

SEQ ID NO: 2892231 - RNA, 19 nt, Mycobacterium avium subsp. paratuberculosis
gcgaagcgaaagacguuga

SEQ ID NO: 2892232 - RNA, 17 nt, Mycobacterium avium subsp. paratuberculosis
gcgaagcguaugccggu

SEQ ID NO: 2892233 - RNA, 19 nt, Mycobacterium avium subsp. paratuberculosis
gcgaagcguuucagcaacc

SEQ ID NO: 2892234 - RNA, 21 nt, Mycobacterium avium subsp. paratuberculosis
gcgaagcguuucagcaacccg

SEQ ID NO: 2892235 - RNA, 13 nt, Mycobacterium avium subsp. paratuberculosis
gcgaagcucgacg

SEQ ID NO: 2892236 - RNA, 17 nt, Mycobacterium avium subsp. paratuberculosis
gcgaagcucgacgauga

SEQ ID NO: 2892237 - RNA, 22 nt, Mycobacterium avium subsp. paratuberculosis
gcgaaggacaauucguuguagc

SEQ ID NO: 2892238 - RNA, 18 nt, Mycobacterium avium subsp. paratuberculosis
gcgaaggacagccggacg

SEQ ID NO: 2892239 - RNA, 22 nt, Mycobacterium avium subsp. paratuberculosis
gcgaaggagaaccgcugcuccg

SEQ ID NO: 2892240 - RNA, 23 nt, Mycobacterium avium subsp. paratuberculosis
gcgaaggcaugggcgugccggcc

SEQ ID NO: 2892241 - RNA, 16 nt, Mycobacterium avium subsp. paratuberculosis
gcgaaggcggcgucga

SEQ ID NO: 2892242 - RNA, 18 nt, Mycobacterium avium subsp. paratuberculosis
gcgaaggcggcgucgaug

SEQ ID NO: 2892243 - RNA, 22 nt, Mycobacterium avium subsp. paratuberculosis
gcgaaggucugaaaugccgggc

SEQ ID NO: 2892244 - RNA, 23 nt, Mycobacterium avium subsp. paratuberculosis
gcgaaggucugaaaugccgggcc

SEQ ID NO: 2892245 - RNA, 16 nt, Mycobacterium avium subsp. paratuberculosis
gcgaaggugccccgcu

SEQ ID NO: 2892246 - RNA, 18 nt, Mycobacterium avium subsp. paratuberculosis
gcgaaggugccgcgaugc

SEQ ID NO: 2892247 - RNA, 17 nt, Mycobacterium avium subsp. paratuberculosis
gcgaagguggcacgcca

SEQ ID NO: 2892248 - RNA, 18 nt, Mycobacterium avium subsp. paratuberculosis
gcgaagguggcacgccac

SEQ ID NO: 2892249 - RNA, 19 nt, Mycobacterium avium subsp. paratuberculosis
gcgacaucgccggcgaccg

SEQ ID NO: 2892250 - RNA, 16 nt, Mycobacterium avium subsp. paratuberculosis
gcgacaucggcacacg

SEQ ID NO: 2892251 - RNA, 12 nt, Mycobacterium avium subsp. paratuberculosis
gcgacaucggcg

SEQ ID NO: 2892252 - RNA, 13 nt, Mycobacterium avium subsp. paratuberculosis
gcgacaucggcgc

SEQ ID NO: 2892253 - RNA, 15 nt, Mycobacterium avium subsp. paratuberculosis
gcgacaucggcgccg

SEQ ID NO: 2892254 - RNA, 18 nt, Mycobacterium avium subsp. paratuberculosis
gcgacaucggugaccguc

SEQ ID NO: 2892255 - RNA, 23 nt, Mycobacterium avium subsp. paratuberculosis
gcgacaucucggugaggugggcg

SEQ ID NO: 2892256 - RNA, 15 nt, Mycobacterium avium subsp. paratuberculosis
gcgacaugaccaccg

SEQ ID NO: 2892257 - RNA, 17 nt, Mycobacterium avium subsp. paratuberculosis
gcgacaugaccaccgcg

SEQ ID NO: 2892258 - RNA, 21 nt, Mycobacterium avium subsp. paratuberculosis
gcgacaugaccaccgcgucgg

SEQ ID NO: 2892259 - RNA, 13 nt, Mycobacterium avium subsp. paratuberculosis
gcgacaugcccgc

SEQ ID NO: 2892260 - RNA, 15 nt, Mycobacterium avium subsp. paratuberculosis
gcgacaugcgcagcg

SEQ ID NO: 2892261 - RNA, 17 nt, Mycobacterium avium subsp. paratuberculosis
gcgacauuggccgcgcg

SEQ ID NO: 2892262 - RNA, 17 nt, Mycobacterium avium subsp. paratuberculosis
gcgaccacaccgccggc

SEQ ID NO: 2892263 - RNA, 18 nt, Mycobacterium avium subsp. paratuberculosis
gcgaccacaccgccggcc

SEQ ID NO: 2892264 - RNA, 21 nt, Mycobacterium avium subsp. paratuberculosis
gcgaccacaccgccggccacg

SEQ ID NO: 2892265 - RNA, 21 nt, Mycobacterium avium subsp. paratuberculosis
gcgaccacaccgucgacgacg

SEQ ID NO: 2892266 - RNA, 16 nt, Mycobacterium avium subsp. paratuberculosis
gcgaccacagcgccuc

SEQ ID NO: 2892267 - RNA, 16 nt, Mycobacterium avium subsp. paratuberculosis
gcgaccaccaccgccc

SEQ ID NO: 2892268 - RNA, 13 nt, Mycobacterium avium subsp. paratuberculosis
gcgaccaccacgg

SEQ ID NO: 2892269 - RNA, 21 nt, Mycobacterium avium subsp. paratuberculosis
gcgaccaccacggccgcagcg

SEQ ID NO: 2892270 - RNA, 22 nt, Mycobacterium avium subsp. paratuberculosis
gcgaccaccacggccgcagcgg

SEQ ID NO: 2892271 - RNA, 23 nt, Mycobacterium avium subsp. paratuberculosis
gcgaccaccacggccgcagcggc

SEQ ID NO: 2892272 - RNA, 16 nt, Mycobacterium avium subsp. paratuberculosis
gcgaccacccggacga

SEQ ID NO: 2892273 - RNA, 18 nt, Mycobacterium avium subsp. paratuberculosis
gcgaccacccucaccacg

SEQ ID NO: 2892274 - RNA, 10 nt, Mycobacterium avium subsp. paratuberculosis
gcgaccaccg

SEQ ID NO: 2892275 - RNA, 13 nt, Mycobacterium avium subsp. paratuberculosis
gcgaccaccgacc

SEQ ID NO: 2892276 - RNA, 20 nt, Mycobacterium avium subsp. paratuberculosis
gcgaccaccgaccccugcac

SEQ ID NO: 2892277 - RNA, 18 nt, Mycobacterium avium subsp. paratuberculosis
gcgaccaccggccgaccg

SEQ ID NO: 2892278 - RNA, 19 nt, Mycobacterium avium subsp. paratuberculosis
gcgaccaccucggcgacga

SEQ ID NO: 2892279 - RNA, 16 nt, Mycobacterium avium subsp. paratuberculosis
gcgaccacgaacaccg

SEQ ID NO: 2892280 - RNA, 17 nt, Mycobacterium avium subsp. paratuberculosis
gcgaccacgaacaccgg

SEQ ID NO: 2892281 - RNA, 18 nt, Mycobacterium avium subsp. paratuberculosis
gcgaccacgaacaccggc

SEQ ID NO: 2892282 - RNA, 19 nt, Mycobacterium avium subsp. paratuberculosis
gcgaccacgaacaccggcg

SEQ ID NO: 2892283 - RNA, 14 nt, Mycobacterium avium subsp. paratuberculosis
gcgaccacgaccgg

SEQ ID NO: 2892284 - RNA, 14 nt, Mycobacterium avium subsp. paratuberculosis
gcgaccacgccgcg

SEQ ID NO: 2892285 - RNA, 15 nt, Mycobacterium avium subsp. paratuberculosis
gcgaccacgccgcgg

SEQ ID NO: 2892286 - RNA, 16 nt, Mycobacterium avium subsp. paratuberculosis
gcgaccacgccgcggu

SEQ ID NO: 2892287 - RNA, 17 nt, Mycobacterium avium subsp. paratuberculosis
gcgaccacgccgcgguc

SEQ ID NO: 2892288 - RNA, 22 nt, Mycobacterium avium subsp. paratuberculosis
gcgaccacgccgcggucgcuga

SEQ ID NO: 2892289 - RNA, 20 nt, Mycobacterium avium subsp. paratuberculosis
gcgaccacguccagcugggc

SEQ ID NO: 2892290 - RNA, 18 nt, Mycobacterium avium subsp. paratuberculosis
gcgaccagauaggccagc

SEQ ID NO: 2892291 - RNA, 20 nt, Mycobacterium avium subsp. paratuberculosis
gcgaccagauaggccagcgc

SEQ ID NO: 2892292 - RNA, 19 nt, Mycobacterium avium subsp. paratuberculosis
gcgaccagccccucgacca

SEQ ID NO: 2892293 - RNA, 21 nt, Mycobacterium avium subsp. paratuberculosis
gcgaccagccccucgaccacc

SEQ ID NO: 2892294 - RNA, 15 nt, Mycobacterium avium subsp. paratuberculosis
gcgaccagcccggcc

SEQ ID NO: 2892295 - RNA, 19 nt, Mycobacterium avium subsp. paratuberculosis
gcgaccagcccggccgccg

SEQ ID NO: 2892296 - RNA, 14 nt, Mycobacterium avium subsp. paratuberculosis
gcgaccagcgcgcc

SEQ ID NO: 2892297 - RNA, 15 nt, Mycobacterium avium subsp. paratuberculosis
gcgaccagcgcgccg

SEQ ID NO: 2892298 - RNA, 17 nt, Mycobacterium avium subsp. paratuberculosis
gcgaccagcgcgccggc

SEQ ID NO: 2892299 - RNA, 19 nt, Mycobacterium avium subsp. paratuberculosis
gcgaccagcgcgccggcca

SEQ ID NO: 2892300 - RNA, 21 nt, Mycobacterium avium subsp. paratuberculosis
gcgaccagcgcgccggccagc

SEQ ID NO: 2892301 - RNA, 13 nt, Mycobacterium avium subsp. paratuberculosis
gcgaccagcggca

SEQ ID NO: 2892302 - RNA, 15 nt, Mycobacterium avium subsp. paratuberculosis
gcgaccagcggcagc

SEQ ID NO: 2892303 - RNA, 17 nt, Mycobacterium avium subsp. paratuberculosis
gcgaccagcggcagcag

SEQ ID NO: 2892304 - RNA, 14 nt, Mycobacterium avium subsp. paratuberculosis
gcgaccaggcccag

SEQ ID NO: 2892305 - RNA, 17 nt, Mycobacterium avium subsp. paratuberculosis
gcgaccaggcccagcgg

SEQ ID NO: 2892306 - RNA, 18 nt, Mycobacterium avium subsp. paratuberculosis
gcgaccaggcccagcgga

SEQ ID NO: 2892307 - RNA, 18 nt, Mycobacterium avium subsp. paratuberculosis
gcgaccagguucucggug

SEQ ID NO: 2892308 - RNA, 19 nt, Mycobacterium avium subsp. paratuberculosis
gcgaccagguucucggugg

SEQ ID NO: 2892309 - RNA, 18 nt, Mycobacterium avium subsp. paratuberculosis
gcgaccaguaccgggccu

SEQ ID NO: 2892310 - RNA, 15 nt, Mycobacterium avium subsp. paratuberculosis
gcgaccaguaggcca

SEQ ID NO: 2892311 - RNA, 13 nt, Mycobacterium avium subsp. paratuberculosis
gcgaccagugcac

SEQ ID NO: 2892312 - RNA, 17 nt, Mycobacterium avium subsp. paratuberculosis
gcgaccaucagcccggu

SEQ ID NO: 2892313 - RNA, 19 nt, Mycobacterium avium subsp. paratuberculosis
gcgaccaucagcccgguga

SEQ ID NO: 2892314 - RNA, 22 nt, Mycobacterium avium subsp. paratuberculosis
gcgaccaucagcccggugacga

SEQ ID NO: 2892315 - RNA, 20 nt, Mycobacterium avium subsp. paratuberculosis
gcgaccaucagccugcggug

SEQ ID NO: 2892316 - RNA, 22 nt, Mycobacterium avium subsp. paratuberculosis
gcgaccaucagccugcggugau

SEQ ID NO: 2892317 - RNA, 17 nt, Mycobacterium avium subsp. paratuberculosis
gcgaccauccacucggg

SEQ ID NO: 2892318 - RNA, 15 nt, Mycobacterium avium subsp. paratuberculosis
gcgaccaugcccagc

SEQ ID NO: 2892319 - RNA, 19 nt, Mycobacterium avium subsp. paratuberculosis
gcgaccaugcccagcaguc

SEQ ID NO: 2892320 - RNA, 16 nt, Mycobacterium avium subsp. paratuberculosis
gcgaccaugcccggcg

SEQ ID NO: 2892321 - RNA, 17 nt, Mycobacterium avium subsp. paratuberculosis
gcgaccaugccgcgggc

SEQ ID NO: 2892322 - RNA, 21 nt, Mycobacterium avium subsp. paratuberculosis
gcgaccaugccgcgggccagc

SEQ ID NO: 2892323 - RNA, 14 nt, Mycobacterium avium subsp. paratuberculosis
gcgacccaccgucg

SEQ ID NO: 2892324 - RNA, 16 nt, Mycobacterium avium subsp. paratuberculosis
gcgacccaccgucgaa

SEQ ID NO: 2892325 - RNA, 22 nt, Mycobacterium avium subsp. paratuberculosis
gcgacccagacuugggcagcag

SEQ ID NO: 2892326 - RNA, 13 nt, Mycobacterium avium subsp. paratuberculosis
gcgacccaggccg

SEQ ID NO: 2892327 - RNA, 14 nt, Mycobacterium avium subsp. paratuberculosis
gcgacccaggccgc

SEQ ID NO: 2892328 - RNA, 20 nt, Mycobacterium avium subsp. paratuberculosis
gcgacccaggccgccgccac

SEQ ID NO: 2892329 - RNA, 21 nt, Mycobacterium avium subsp. paratuberculosis
gcgacccaggccgccgccacc

SEQ ID NO: 2892330 - RNA, 22 nt, Mycobacterium avium subsp. paratuberculosis
gcgacccccggugucugaccuc

SEQ ID NO: 2892331 - RNA, 12 nt, Mycobacterium avium subsp. paratuberculosis
gcgaccccgccg

SEQ ID NO: 2892332 - RNA, 15 nt, Mycobacterium avium subsp. paratuberculosis
gcgaccccgccgucg

SEQ ID NO: 2892333 - RNA, 16 nt, Mycobacterium avium subsp. paratuberculosis
gcgaccccgccgucga

SEQ ID NO: 2892334 - RNA, 18 nt, Mycobacterium avium subsp. paratuberculosis
gcgaccccgccgucgacg

SEQ ID NO: 2892335 - RNA, 19 nt, Mycobacterium avium subsp. paratuberculosis
gcgaccccgccgucgacgc

SEQ ID NO: 2892336 - RNA, 20 nt, Mycobacterium avium subsp. paratuberculosis
gcgaccccgccgucgacgcg

SEQ ID NO: 2892337 - RNA, 15 nt, Mycobacterium avium subsp. paratuberculosis
gcgaccccggaccgc

SEQ ID NO: 2892338 - RNA, 18 nt, Mycobacterium avium subsp. paratuberculosis
gcgaccccguucgccgac

SEQ ID NO: 2892339 - RNA, 19 nt, Mycobacterium avium subsp. paratuberculosis
gcgaccccguucgccgaca

SEQ ID NO: 2892340 - RNA, 14 nt, Mycobacterium avium subsp. paratuberculosis
gcgaccccuccaac

SEQ ID NO: 2892341 - RNA, 23 nt, Mycobacterium avium subsp. paratuberculosis
gcgaccccuccaacggccgcacg

SEQ ID NO: 2892342 - RNA, 22 nt, Mycobacterium avium subsp. paratuberculosis
gcgacccgcuucgcccggcugc

SEQ ID NO: 2892343 - RNA, 12 nt, Mycobacterium avium subsp. paratuberculosis
gcgacccggccg

SEQ ID NO: 2892344 - RNA, 13 nt, Mycobacterium avium subsp. paratuberculosis
gcgacccggccga

SEQ ID NO: 2892345 - RNA, 20 nt, Mycobacterium avium subsp. paratuberculosis
gcgacccggccgagcgcgcc

SEQ ID NO: 2892346 - RNA, 23 nt, Mycobacterium avium subsp. paratuberculosis
gcgacccggccgagcgcgccgag

SEQ ID NO: 2892347 - RNA, 13 nt, Mycobacterium avium subsp. paratuberculosis
gcgacccgggccg

SEQ ID NO: 2892348 - RNA, 14 nt, Mycobacterium avium subsp. paratuberculosis
gcgacccgggccgc

SEQ ID NO: 2892349 - RNA, 17 nt, Mycobacterium avium subsp. paratuberculosis
gcgacccgggccgccac

SEQ ID NO: 2892350 - RNA, 18 nt, Mycobacterium avium subsp. paratuberculosis
gcgacccgggccgccacg

SEQ ID NO: 2892351 - RNA, 20 nt, Mycobacterium avium subsp. paratuberculosis
gcgacccgggccgccacggc

SEQ ID NO: 2892352 - RNA, 21 nt, Mycobacterium avium subsp. paratuberculosis
gcgacccgggccgccacggcg

SEQ ID NO: 2892353 - RNA, 17 nt, Mycobacterium avium subsp. paratuberculosis
gcgaccgaggucgacgc

SEQ ID NO: 2892354 - RNA, 18 nt, Mycobacterium avium subsp. paratuberculosis
gcgaccgaggucgacgcc

SEQ ID NO: 2892355 - RNA, 20 nt, Mycobacterium avium subsp. paratuberculosis
gcgaccgaggucgacgcccc

SEQ ID NO: 2892356 - RNA, 15 nt, Mycobacterium avium subsp. paratuberculosis
gcgaccgcagcaggc

SEQ ID NO: 2892357 - RNA, 21 nt, Mycobacterium avium subsp. paratuberculosis
gcgaccgcagcaggcggacgg

SEQ ID NO: 2892358 - RNA, 20 nt, Mycobacterium avium subsp. paratuberculosis
gcgaccgcaggucgauggcg

SEQ ID NO: 2892359 - RNA, 17 nt, Mycobacterium avium subsp. paratuberculosis
gcgaccgccaccucgag

SEQ ID NO: 2892360 - RNA, 13 nt, Mycobacterium avium subsp. paratuberculosis
gcgaccgcccggg

SEQ ID NO: 2892361 - RNA, 14 nt, Mycobacterium avium subsp. paratuberculosis
gcgaccgcccgggg

SEQ ID NO: 2892362 - RNA, 15 nt, Mycobacterium avium subsp. paratuberculosis
gcgaccgcccggggc

SEQ ID NO: 2892363 - RNA, 16 nt, Mycobacterium avium subsp. paratuberculosis
gcgaccgcccggggcg

SEQ ID NO: 2892364 - RNA, 22 nt, Mycobacterium avium subsp. paratuberculosis
gcgaccgcccggggcgcggacc

SEQ ID NO: 2892365 - RNA, 20 nt, Mycobacterium avium subsp. paratuberculosis
gcgaccgccgcguacagcca

SEQ ID NO: 2892366 - RNA, 13 nt, Mycobacterium avium subsp. paratuberculosis
gcgaccgccucgu

SEQ ID NO: 2892367 - RNA, 24 nt, Mycobacterium avium subsp. paratuberculosis
gcgaccgccucgucgggaacgcga

SEQ ID NO: 2892368 - RNA, 19 nt, Mycobacterium avium subsp. paratuberculosis
gcgaccgccuugucggcga

SEQ ID NO: 2892369 - RNA, 20 nt, Mycobacterium avium subsp. paratuberculosis
gcgaccgccuugucggcgau

SEQ ID NO: 2892370 - RNA, 13 nt, Mycobacterium avium subsp. paratuberculosis
gcgaccgcgacga

SEQ ID NO: 2892371 - RNA, 16 nt, Mycobacterium avium subsp. paratuberculosis
gcgaccgcgaucaggg

SEQ ID NO: 2892372 - RNA, 14 nt, Mycobacterium avium subsp. paratuberculosis
gcgaccgcgcaggc

SEQ ID NO: 2892373 - RNA, 17 nt, Mycobacterium avium subsp. paratuberculosis
gcgaccgcgcaggcggc

SEQ ID NO: 2892374 - RNA, 15 nt, Mycobacterium avium subsp. paratuberculosis
gcgaccgcgcgcggc

SEQ ID NO: 2892375 - RNA, 19 nt, Mycobacterium avium subsp. paratuberculosis
gcgaccgcgcgcggcgccg

SEQ ID NO: 2892376 - RNA, 13 nt, Mycobacterium avium subsp. paratuberculosis
gcgaccgcggaug

SEQ ID NO: 2892377 - RNA, 23 nt, Mycobacterium avium subsp. paratuberculosis
gcgaccgcggaugacgggugcuc

SEQ ID NO: 2892378 - RNA, 14 nt, Mycobacterium avium subsp. paratuberculosis
gcgaccgcggccgc

SEQ ID NO: 2892379 - RNA, 15 nt, Mycobacterium avium subsp. paratuberculosis
gcgaccgcggccgcg

SEQ ID NO: 2892380 - RNA, 19 nt, Mycobacterium avium subsp. paratuberculosis
gcgaccgcggccgcgacgg

SEQ ID NO: 2892381 - RNA, 18 nt, Mycobacterium avium subsp. paratuberculosis
gcgaccgcgucgacggcg

SEQ ID NO: 2892382 - RNA, 23 nt, Mycobacterium avium subsp. paratuberculosis
gcgaccggccaucuccugcacgc

SEQ ID NO: 2892383 - RNA, 13 nt, Mycobacterium avium subsp. paratuberculosis
gcgaccggcccca

SEQ ID NO: 2892384 - RNA, 19 nt, Mycobacterium avium subsp. paratuberculosis
gcgaccggccccaacggcg

SEQ ID NO: 2892385 - RNA, 16 nt, Mycobacterium avium subsp. paratuberculosis
gcgaccggggcgguga

SEQ ID NO: 2892386 - RNA, 12 nt, Mycobacterium avium subsp. paratuberculosis
gcgaccgguccg

SEQ ID NO: 2892387 - RNA, 13 nt, Mycobacterium avium subsp. paratuberculosis
gcgaccgguccgc

SEQ ID NO: 2892388 - RNA, 16 nt, Mycobacterium avium subsp. paratuberculosis
gcgaccgguccgugcc

SEQ ID NO: 2892389 - RNA, 19 nt, Mycobacterium avium subsp. paratuberculosis
gcgaccgguccgugccacg

SEQ ID NO: 2892390 - RNA, 21 nt, Mycobacterium avium subsp. paratuberculosis
gcgaccgguccgugccacggc

SEQ ID NO: 2892391 - RNA, 23 nt, Mycobacterium avium subsp. paratuberculosis
gcgaccgguccgugccacggccg

SEQ ID NO: 2892392 - RNA, 19 nt, Mycobacterium avium subsp. paratuberculosis
gcgaccgucagcagggccu

SEQ ID NO: 2892393 - RNA, 15 nt, Mycobacterium avium subsp. paratuberculosis
gcgaccgucgggacg

SEQ ID NO: 2892394 - RNA, 16 nt, Mycobacterium avium subsp. paratuberculosis
gcgaccgucgggacgg

SEQ ID NO: 2892395 - RNA, 19 nt, Mycobacterium avium subsp. paratuberculosis
gcgaccgucgggacggcca

SEQ ID NO: 2892396 - RNA, 21 nt, Mycobacterium avium subsp. paratuberculosis
gcgaccgucgggacggccagc

SEQ ID NO: 2892397 - RNA, 22 nt, Mycobacterium avium subsp. paratuberculosis
gcgaccgucgggacggccagca

SEQ ID NO: 2892398 - RNA, 19 nt, Mycobacterium avium subsp. paratuberculosis
gcgaccgugcccaccagcc

SEQ ID NO: 2892399 - RNA, 22 nt, Mycobacterium avium subsp. paratuberculosis
gcgaccgugcccaccagccggc

SEQ ID NO: 2892400 - RNA, 12 nt, Mycobacterium avium subsp. paratuberculosis
gcgaccucgggu

SEQ ID NO: 2892401 - RNA, 22 nt, Mycobacterium avium subsp. paratuberculosis
gcgaccucggguguaggcccga

SEQ ID NO: 2892402 - RNA, 14 nt, Mycobacterium avium subsp. paratuberculosis
gcgaccucgguggu

SEQ ID NO: 2892403 - RNA, 20 nt, Mycobacterium avium subsp. paratuberculosis
gcgaccucguggucccagga

SEQ ID NO: 2892404 - RNA, 22 nt, Mycobacterium avium subsp. paratuberculosis
gcgaccugauuucaucgcggcg

SEQ ID NO: 2892405 - RNA, 20 nt, Mycobacterium avium subsp. paratuberculosis
gcgaccugcaucucgacccg

SEQ ID NO: 2892406 - RNA, 12 nt, Mycobacterium avium subsp. paratuberculosis
gcgaccugcggc

SEQ ID NO: 2892407 - RNA, 16 nt, Mycobacterium avium subsp. paratuberculosis
gcgaccugcggcucgu

SEQ ID NO: 2892408 - RNA, 22 nt, Mycobacterium avium subsp. paratuberculosis
gcgaccugcggcucgucggcga

SEQ ID NO: 2892409 - RNA, 15 nt, Mycobacterium avium subsp. paratuberculosis
gcgaccugcgggccc

SEQ ID NO: 2892410 - RNA, 17 nt, Mycobacterium avium subsp. paratuberculosis
gcgaccugcgggcccac

SEQ ID NO: 2892411 - RNA, 19 nt, Mycobacterium avium subsp. paratuberculosis
gcgaccugcgggcccaccg

SEQ ID NO: 2892412 - RNA, 15 nt, Mycobacterium avium subsp. paratuberculosis
gcgaccuggacgccg

SEQ ID NO: 2892413 - RNA, 16 nt, Mycobacterium avium subsp. paratuberculosis
gcgaccuggacgccgc

SEQ ID NO: 2892414 - RNA, 18 nt, Mycobacterium avium subsp. paratuberculosis
gcgaccuggacgccgcac

SEQ ID NO: 2892415 - RNA, 20 nt, Mycobacterium avium subsp. paratuberculosis
gcgaccuggacgccgcacgc

SEQ ID NO: 2892416 - RNA, 18 nt, Mycobacterium avium subsp. paratuberculosis
gcgaccugguccaccgcg

SEQ ID NO: 2892417 - RNA, 20 nt, Mycobacterium avium subsp. paratuberculosis
gcgaccugguccaccgcggc

SEQ ID NO: 2892418 - RNA, 19 nt, Mycobacterium avium subsp. paratuberculosis
gcgaccuggugcucgaugc

SEQ ID NO: 2892419 - RNA, 22 nt, Mycobacterium avium subsp. paratuberculosis
gcgaccuggugcucgaugcgac

SEQ ID NO: 2892420 - RNA, 23 nt, Mycobacterium avium subsp. paratuberculosis
gcgaccuguuugaacaccucgaa

SEQ ID NO: 2892421 - RNA, 21 nt, Mycobacterium avium subsp. paratuberculosis
gcgaccuguuuggccagccag

SEQ ID NO: 2892422 - RNA, 22 nt, Mycobacterium avium subsp. paratuberculosis
gcgaccuguuuggccagccagu

SEQ ID NO: 2892423 - RNA, 16 nt, Mycobacterium avium subsp. paratuberculosis
gcgaccuugcgcagcc

SEQ ID NO: 2892424 - RNA, 21 nt, Mycobacterium avium subsp. paratuberculosis
gcgaccuugcgcagccggcag

SEQ ID NO: 2892425 - RNA, 17 nt, Mycobacterium avium subsp. paratuberculosis
gcgaccuugcggcgcga

SEQ ID NO: 2892426 - RNA, 18 nt, Mycobacterium avium subsp. paratuberculosis
gcgaccuugcggcgcgau

SEQ ID NO: 2892427 - RNA, 19 nt, Mycobacterium avium subsp. paratuberculosis
gcgacgaacagcaccgcca

SEQ ID NO: 2892428 - RNA, 17 nt, Mycobacterium avium subsp. paratuberculosis
gcgacgaaccgccacac

SEQ ID NO: 2892429 - RNA, 14 nt, Mycobacterium avium subsp. paratuberculosis
gcgacgaacgccgg

SEQ ID NO: 2892430 - RNA, 15 nt, Mycobacterium avium subsp. paratuberculosis
gcgacgaacgccggc

SEQ ID NO: 2892431 - RNA, 16 nt, Mycobacterium avium subsp. paratuberculosis
gcgacgaacgccggca

SEQ ID NO: 2892432 - RNA, 20 nt, Mycobacterium avium subsp. paratuberculosis
gcgacgaacgcuuccagcac

SEQ ID NO: 2892433 - RNA, 14 nt, Mycobacterium avium subsp. paratuberculosis
gcgacgaagcagcu

SEQ ID NO: 2892434 - RNA, 15 nt, Mycobacterium avium subsp. paratuberculosis
gcgacgaagccggug

SEQ ID NO: 2892435 - RNA, 17 nt, Mycobacterium avium subsp. paratuberculosis
gcgacgaagccggugcc

SEQ ID NO: 2892436 - RNA, 17 nt, Mycobacterium avium subsp. paratuberculosis
gcgacgaagcggucgcg

SEQ ID NO: 2892437 - RNA, 17 nt, Mycobacterium avium subsp. paratuberculosis
gcgacgaagucgacggc

SEQ ID NO: 2892438 - RNA, 19 nt, Mycobacterium avium subsp. paratuberculosis
gcgacgaagucgacggcgg

SEQ ID NO: 2892439 - RNA, 19 nt, Mycobacterium avium subsp. paratuberculosis
gcgacgaauaucccagcca

SEQ ID NO: 2892440 - RNA, 19 nt, Mycobacterium avium subsp. paratuberculosis
gcgacgaauccggugaccg

SEQ ID NO: 2892441 - RNA, 12 nt, Mycobacterium avium subsp. paratuberculosis
gcgacgacacca

SEQ ID NO: 2892442 - RNA, 15 nt, Mycobacterium avium subsp. paratuberculosis
gcgacgacaccgugu

SEQ ID NO: 2892443 - RNA, 14 nt, Mycobacterium avium subsp. paratuberculosis
gcgacgaccaccag

SEQ ID NO: 2892444 - RNA, 19 nt, Mycobacterium avium subsp. paratuberculosis
gcgacgaccaccaggagca

SEQ ID NO: 2892445 - RNA, 23 nt, Mycobacterium avium subsp. paratuberculosis
gcgacgaccaccaggagcaccug

SEQ ID NO: 2892446 - RNA, 13 nt, Mycobacterium avium subsp. paratuberculosis
gcgacgaccgcac

SEQ ID NO: 2892447 - RNA, 15 nt, Mycobacterium avium subsp. paratuberculosis
gcgacgaccgcaccg

SEQ ID NO: 2892448 - RNA, 19 nt, Mycobacterium avium subsp. paratuberculosis
gcgacgaccgcaccgacca

SEQ ID NO: 2892449 - RNA, 20 nt, Mycobacterium avium subsp. paratuberculosis
gcgacgaccgcaccgaccag

SEQ ID NO: 2892450 - RNA, 21 nt, Mycobacterium avium subsp. paratuberculosis
gcgacgaccgcaccgaccagc

SEQ ID NO: 2892451 - RNA, 22 nt, Mycobacterium avium subsp. paratuberculosis
gcgacgaccgcaccgaccagcg

SEQ ID NO: 2892452 - RNA, 23 nt, Mycobacterium avium subsp. paratuberculosis
gcgacgaccgcaccgaccagcgg

SEQ ID NO: 2892453 - RNA, 14 nt, Mycobacterium avium subsp. paratuberculosis
gcgacgaccgccug

SEQ ID NO: 2892454 - RNA, 13 nt, Mycobacterium avium subsp. paratuberculosis
gcgacgaccucgc

SEQ ID NO: 2892455 - RNA, 20 nt, Mycobacterium avium subsp. paratuberculosis
gcgacgaccucgcccgccgc

SEQ ID NO: 2892456 - RNA, 23 nt, Mycobacterium avium subsp. paratuberculosis
gcgacgaccucgcccgccgcgac

SEQ ID NO: 2892457 - RNA, 21 nt, Mycobacterium avium subsp. paratuberculosis
gcgacgagagcggaucggcgg

SEQ ID NO: 2892458 - RNA, 23 nt, Mycobacterium avium subsp. paratuberculosis
gcgacgagagcggaucggcggcg

SEQ ID NO: 2892459 - RNA, 22 nt, Mycobacterium avium subsp. paratuberculosis
gcgacgaggugaugccguccag

SEQ ID NO: 2892460 - RNA, 23 nt, Mycobacterium avium subsp. paratuberculosis
gcgacgaggugaugccguccagc

SEQ ID NO: 2892461 - RNA, 15 nt, Mycobacterium avium subsp. paratuberculosis
gcgacgauaucggcc

SEQ ID NO: 2892462 - RNA, 15 nt, Mycobacterium avium subsp. paratuberculosis
gcgacgaucagcagc

SEQ ID NO: 2892463 - RNA, 18 nt, Mycobacterium avium subsp. paratuberculosis
gcgacgaucagcagccgg

SEQ ID NO: 2892464 - RNA, 22 nt, Mycobacterium avium subsp. paratuberculosis
gcgacgaucagcagccgggccu

SEQ ID NO: 2892465 - RNA, 17 nt, Mycobacterium avium subsp. paratuberculosis
gcgacgaucgcgacggc

SEQ ID NO: 2892466 - RNA, 19 nt, Mycobacterium avium subsp. paratuberculosis
gcgacgaucgcgacggccg

SEQ ID NO: 2892467 - RNA, 20 nt, Mycobacterium avium subsp. paratuberculosis
gcgacgaucgcgacggccgg

SEQ ID NO: 2892468 - RNA, 16 nt, Mycobacterium avium subsp. paratuberculosis
gcgacgaucggcucga

SEQ ID NO: 2892469 - RNA, 12 nt, Mycobacterium avium subsp. paratuberculosis
gcgacgaugccg

SEQ ID NO: 2892470 - RNA, 16 nt, Mycobacterium avium subsp. paratuberculosis
gcgacgaugccggccg

SEQ ID NO: 2892471 - RNA, 17 nt, Mycobacterium avium subsp. paratuberculosis
gcgacgaugccggccgg

SEQ ID NO: 2892472 - RNA, 17 nt, Mycobacterium avium subsp. paratuberculosis
gcgacgaugccggcguc

SEQ ID NO: 2892473 - RNA, 18 nt, Mycobacterium avium subsp. paratuberculosis
gcgacgaugccggcgucg

SEQ ID NO: 2892474 - RNA, 16 nt, Mycobacterium avium subsp. paratuberculosis
gcgacgaugcggccgu

SEQ ID NO: 2892475 - RNA, 13 nt, Mycobacterium avium subsp. paratuberculosis
gcgacgauggcca

SEQ ID NO: 2892476 - RNA, 14 nt, Mycobacterium avium subsp. paratuberculosis
gcgacgauggccag

SEQ ID NO: 2892477 - RNA, 17 nt, Mycobacterium avium subsp. paratuberculosis
gcgacgauggccaggcc

SEQ ID NO: 2892478 - RNA, 17 nt, Mycobacterium avium subsp. paratuberculosis
gcgacgaugucgacccg

SEQ ID NO: 2892479 - RNA, 21 nt, Mycobacterium avium subsp. paratuberculosis
gcgacgaugucgacccgcggc

SEQ ID NO: 2892480 - RNA, 22 nt, Mycobacterium avium subsp. paratuberculosis
gcgacgaugucgacccgcggcg

SEQ ID NO: 2892481 - RNA, 23 nt, Mycobacterium avium subsp. paratuberculosis
gcgacgaugucgacccgcggcgc

SEQ ID NO: 2892482 - RNA, 12 nt, Mycobacterium avium subsp. paratuberculosis
gcgacgcaccuc

SEQ ID NO: 2892483 - RNA, 18 nt, Mycobacterium avium subsp. paratuberculosis
gcgacgcaccucggccgg

SEQ ID NO: 2892484 - RNA, 14 nt, Mycobacterium avium subsp. paratuberculosis
gcgacgcacgccgg

SEQ ID NO: 2892485 - RNA, 15 nt, Mycobacterium avium subsp. paratuberculosis
gcgacgcacgccggc

SEQ ID NO: 2892486 - RNA, 16 nt, Mycobacterium avium subsp. paratuberculosis
gcgacgcacgccggcg

SEQ ID NO: 2892487 - RNA, 17 nt, Mycobacterium avium subsp. paratuberculosis
gcgacgcacgccggcgg

SEQ ID NO: 2892488 - RNA, 18 nt, Mycobacterium avium subsp. paratuberculosis
gcgacgcacgccggcggg

SEQ ID NO: 2892489 - RNA, 12 nt, Mycobacterium avium subsp. paratuberculosis
gcgacgccagca

SEQ ID NO: 2892490 - RNA, 23 nt, Mycobacterium avium subsp. paratuberculosis
gcgacgccagcaccuucgggccg

SEQ ID NO: 2892491 - RNA, 20 nt, Mycobacterium avium subsp. paratuberculosis
gcgacgccagcggcagcgcc

SEQ ID NO: 2892492 - RNA, 21 nt, Mycobacterium avium subsp. paratuberculosis
gcgacgccagcggcagcgcca

SEQ ID NO: 2892493 - RNA, 22 nt, Mycobacterium avium subsp. paratuberculosis
gcgacgccagcggcagcgccag

SEQ ID NO: 2892494 - RNA, 23 nt, Mycobacterium avium subsp. paratuberculosis
gcgacgcccacugguaaccgccc

SEQ ID NO: 2892495 - RNA, 12 nt, Mycobacterium avium subsp. paratuberculosis
gcgacgcccaga

SEQ ID NO: 2892496 - RNA, 13 nt, Mycobacterium avium subsp. paratuberculosis
gcgacgcccaggu

SEQ ID NO: 2892497 - RNA, 17 nt, Mycobacterium avium subsp. paratuberculosis
gcgacgcccaggugcac

SEQ ID NO: 2892498 - RNA, 18 nt, Mycobacterium avium subsp. paratuberculosis
gcgacgccgacgcccagc

SEQ ID NO: 2892499 - RNA, 23 nt, Mycobacterium avium subsp. paratuberculosis
gcgacgccgacgcccagcgcggc

SEQ ID NO: 2892500 - RNA, 16 nt, Mycobacterium avium subsp. paratuberculosis
gcgacgccgccgccga

SEQ ID NO: 2892501 - RNA, 17 nt, Mycobacterium avium subsp. paratuberculosis
gcgacgccgccgccgag

SEQ ID NO: 2892502 - RNA, 14 nt, Mycobacterium avium subsp. paratuberculosis
gcgacgccgcgcag

SEQ ID NO: 2892503 - RNA, 17 nt, Mycobacterium avium subsp. paratuberculosis
gcgacgccgcgcuggcc

SEQ ID NO: 2892504 - RNA, 19 nt, Mycobacterium avium subsp. paratuberculosis
gcgacgccgcgcuggccgg

SEQ ID NO: 2892505 - RNA, 14 nt, Mycobacterium avium subsp. paratuberculosis
gcgacgccgcggaa

SEQ ID NO: 2892506 - RNA, 22 nt, Mycobacterium avium subsp. paratuberculosis
gcgacgccguagaucacgccgg

SEQ ID NO: 2892507 - RNA, 12 nt, Mycobacterium avium subsp. paratuberculosis
gcgacgccguca

SEQ ID NO: 2892508 - RNA, 19 nt, Mycobacterium avium subsp. paratuberculosis
gcgacgccgucauccccau

SEQ ID NO: 2892509 - RNA, 20 nt, Mycobacterium avium subsp. paratuberculosis
gcgacgccgucauccccauc

SEQ ID NO: 2892510 - RNA, 19 nt, Mycobacterium avium subsp. paratuberculosis
gcgacgccgugcuuccauu

SEQ ID NO: 2892511 - RNA, 14 nt, Mycobacterium avium subsp. paratuberculosis
gcgacgcgacgcgc

SEQ ID NO: 2892512 - RNA, 17 nt, Mycobacterium avium subsp. paratuberculosis
gcgacgcgaucgaggug

SEQ ID NO: 2892513 - RNA, 19 nt, Mycobacterium avium subsp. paratuberculosis
gcgacgcgaucgaggugau

SEQ ID NO: 2892514 - RNA, 21 nt, Mycobacterium avium subsp. paratuberculosis
gcgacgcgaucgaggugaugu

SEQ ID NO: 2892515 - RNA, 15 nt, Mycobacterium avium subsp. paratuberculosis
gcgacgcgcucggcg

SEQ ID NO: 2892516 - RNA, 20 nt, Mycobacterium avium subsp. paratuberculosis
gcgacgcgcucggcgaccgc

SEQ ID NO: 2892517 - RNA, 18 nt, Mycobacterium avium subsp. paratuberculosis
gcgacgcggcucgcgcgg

SEQ ID NO: 2892518 - RNA, 19 nt, Mycobacterium avium subsp. paratuberculosis
gcgacgcggcucgcgcggu

SEQ ID NO: 2892519 - RNA, 20 nt, Mycobacterium avium subsp. paratuberculosis
gcgacgcgggauugccgagc

SEQ ID NO: 2892520 - RNA, 20 nt, Mycobacterium avium subsp. paratuberculosis
gcgacgcggugagcgcgccg

SEQ ID NO: 2892521 - RNA, 22 nt, Mycobacterium avium subsp. paratuberculosis
gcgacgcggugagcgcgccggc

SEQ ID NO: 2892522 - RNA, 13 nt, Mycobacterium avium subsp. paratuberculosis
gcgacgcucaggc

SEQ ID NO: 2892523 - RNA, 23 nt, Mycobacterium avium subsp. paratuberculosis
gcgacgcucaggcguccagccag

SEQ ID NO: 2892524 - RNA, 15 nt, Mycobacterium avium subsp. paratuberculosis
gcgacgcugagcgcc

SEQ ID NO: 2892525 - RNA, 16 nt, Mycobacterium avium subsp. paratuberculosis
gcgacgcugagcgcca

SEQ ID NO: 2892526 - RNA, 19 nt, Mycobacterium avium subsp. paratuberculosis
gcgacgcugagcgccaggc

SEQ ID NO: 2892527 - RNA, 15 nt, Mycobacterium avium subsp. paratuberculosis
gcgacgcugauggcg

SEQ ID NO: 2892528 - RNA, 16 nt, Mycobacterium avium subsp. paratuberculosis
gcgacgcugccggugg

SEQ ID NO: 2892529 - RNA, 18 nt, Mycobacterium avium subsp. paratuberculosis
gcgacgcugguggccugc

SEQ ID NO: 2892530 - RNA, 16 nt, Mycobacterium avium subsp. paratuberculosis
gcgacggaccagugca

SEQ ID NO: 2892531 - RNA, 16 nt, Mycobacterium avium subsp. paratuberculosis
gcgacggaucggccgc

SEQ ID NO: 2892532 - RNA, 18 nt, Mycobacterium avium subsp. paratuberculosis
gcgacggaucggccgcgu

SEQ ID NO: 2892533 - RNA, 21 nt, Mycobacterium avium subsp. paratuberculosis
gcgacggaucggccgcgucgg

SEQ ID NO: 2892534 - RNA, 17 nt, Mycobacterium avium subsp. paratuberculosis
gcgacggaucugcucgu

SEQ ID NO: 2892535 - RNA, 19 nt, Mycobacterium avium subsp. paratuberculosis
gcgacggcaauccggcccc

SEQ ID NO: 2892536 - RNA, 20 nt, Mycobacterium avium subsp. paratuberculosis
gcgacggcaauccggccccg

SEQ ID NO: 2892537 - RNA, 17 nt, Mycobacterium avium subsp. paratuberculosis
gcgacggcaccgccggc

SEQ ID NO: 2892538 - RNA, 18 nt, Mycobacterium avium subsp. paratuberculosis
gcgacggcaccgccggcg

SEQ ID NO: 2892539 - RNA, 22 nt, Mycobacterium avium subsp. paratuberculosis
gcgacggcaccgccggcggccu

SEQ ID NO: 2892540 - RNA, 23 nt, Mycobacterium avium subsp. paratuberculosis
gcgacggcagcaccucgcgcagc

SEQ ID NO: 2892541 - RNA, 15 nt, Mycobacterium avium subsp. paratuberculosis
gcgacggcagcgcga

SEQ ID NO: 2892542 - RNA, 19 nt, Mycobacterium avium subsp. paratuberculosis
gcgacggcagcgcgauccg

SEQ ID NO: 2892543 - RNA, 21 nt, Mycobacterium avium subsp. paratuberculosis
gcgacggcauugcagcggaug

SEQ ID NO: 2892544 - RNA, 18 nt, Mycobacterium avium subsp. paratuberculosis
gcgacggccagaccgcac

SEQ ID NO: 2892545 - RNA, 15 nt, Mycobacterium avium subsp. paratuberculosis
gcgacggccagcgcg

SEQ ID NO: 2892546 - RNA, 16 nt, Mycobacterium avium subsp. paratuberculosis
gcgacggccagcgcgg

SEQ ID NO: 2892547 - RNA, 17 nt, Mycobacterium avium subsp. paratuberculosis
gcgacggccagcgcggc

SEQ ID NO: 2892548 - RNA, 14 nt, Mycobacterium avium subsp. paratuberculosis
gcgacggcccgccg

SEQ ID NO: 2892549 - RNA, 15 nt, Mycobacterium avium subsp. paratuberculosis
gcgacggcccgccgg

SEQ ID NO: 2892550 - RNA, 14 nt, Mycobacterium avium subsp. paratuberculosis
gcgacggccgccga

SEQ ID NO: 2892551 - RNA, 15 nt, Mycobacterium avium subsp. paratuberculosis
gcgacggccggggcc

SEQ ID NO: 2892552 - RNA, 19 nt, Mycobacterium avium subsp. paratuberculosis
gcgacggccggggccagca

SEQ ID NO: 2892553 - RNA, 13 nt, Mycobacterium avium subsp. paratuberculosis
gcgacggccgggu

SEQ ID NO: 2892554 - RNA, 14 nt, Mycobacterium avium subsp. paratuberculosis
gcgacggccguccg

SEQ ID NO: 2892555 - RNA, 22 nt, Mycobacterium avium subsp. paratuberculosis
gcgacggccguccggucgcugg

SEQ ID NO: 2892556 - RNA, 19 nt, Mycobacterium avium subsp. paratuberculosis
gcgacggccucgccgucgc

SEQ ID NO: 2892557 - RNA, 21 nt, Mycobacterium avium subsp. paratuberculosis
gcgacggccucgccgucgcga

SEQ ID NO: 2892558 - RNA, 13 nt, Mycobacterium avium subsp. paratuberculosis
gcgacggcgacca

SEQ ID NO: 2892559 - RNA, 13 nt, Mycobacterium avium subsp. paratuberculosis
gcgacggcgacga

SEQ ID NO: 2892560 - RNA, 15 nt, Mycobacterium avium subsp. paratuberculosis
gcgacggcgacgacc

SEQ ID NO: 2892561 - RNA, 13 nt, Mycobacterium avium subsp. paratuberculosis
gcgacggcgacgg

SEQ ID NO: 2892562 - RNA, 17 nt, Mycobacterium avium subsp. paratuberculosis
gcgacggcgacggccag

SEQ ID NO: 2892563 - RNA, 18 nt, Mycobacterium avium subsp. paratuberculosis
gcgacggcgacggccaga

SEQ ID NO: 2892564 - RNA, 14 nt, Mycobacterium avium subsp. paratuberculosis
gcgacgucgucgau

SEQ ID NO: 2892565 - RNA, 15 nt, Mycobacterium avium subsp. paratuberculosis
gcgacgucgucgccc

SEQ ID NO: 2892566 - RNA, 22 nt, Mycobacterium avium subsp. paratuberculosis
gcgacgucgucgcccacccgcc

SEQ ID NO: 2892567 - RNA, 21 nt, Mycobacterium avium subsp. paratuberculosis
gcgacgucgugcacgccgugg

SEQ ID NO: 2892568 - RNA, 23 nt, Mycobacterium avium subsp. paratuberculosis
gcgacgucgugcacgccguggcg

SEQ ID NO: 2892569 - RNA, 13 nt, Mycobacterium avium subsp. paratuberculosis
gcgacgucguggc

SEQ ID NO: 2892570 - RNA, 20 nt, Mycobacterium avium subsp. paratuberculosis
gcgacgucugcggcucggcg

SEQ ID NO: 2892571 - RNA, 18 nt, Mycobacterium avium subsp. paratuberculosis
gcgacgugaucggcggcc

SEQ ID NO: 2892572 - RNA, 21 nt, Mycobacterium avium subsp. paratuberculosis
gcgacgugaucggcggccugc

SEQ ID NO: 2892573 - RNA, 15 nt, Mycobacterium avium subsp. paratuberculosis
gcgacgugauggucg

SEQ ID NO: 2892574 - RNA, 23 nt, Mycobacterium avium subsp. paratuberculosis
gcgacgugauggucgucguggug

SEQ ID NO: 2892575 - RNA, 13 nt, Mycobacterium avium subsp. paratuberculosis
gcgacguggcgca

SEQ ID NO: 2892576 - RNA, 15 nt, Mycobacterium avium subsp. paratuberculosis
gcgacguggcgcagu

SEQ ID NO: 2892577 - RNA, 22 nt, Mycobacterium avium subsp. paratuberculosis
gcgacguucgauugcaccaccg

SEQ ID NO: 2892578 - RNA, 15 nt, Mycobacterium avium subsp. paratuberculosis
gcgacuccagcagcg

SEQ ID NO: 2892579 - RNA, 16 nt, Mycobacterium avium subsp. paratuberculosis
gcgacuccagcagcgc

SEQ ID NO: 2892580 - RNA, 18 nt, Mycobacterium avium subsp. paratuberculosis
gcgacuccagcagcgcca

SEQ ID NO: 2892581 - RNA, 14 nt, Mycobacterium avium subsp. paratuberculosis
gcgacuccagcgcg

SEQ ID NO: 2892582 - RNA, 15 nt, Mycobacterium avium subsp. paratuberculosis
gcgacuccagcgcga

SEQ ID NO: 2892583 - RNA, 19 nt, Mycobacterium avium subsp. paratuberculosis
gcgacuccagcgcgaucaa

SEQ ID NO: 2892584 - RNA, 20 nt, Mycobacterium avium subsp. paratuberculosis
gcgacuccagcgcgaucaac

SEQ ID NO: 2892585 - RNA, 16 nt, Mycobacterium avium subsp. paratuberculosis
gcgacuccggcgccgg

SEQ ID NO: 2892586 - RNA, 17 nt, Mycobacterium avium subsp. paratuberculosis
gcgacuccggcgccggu

SEQ ID NO: 2892587 - RNA, 18 nt, Mycobacterium avium subsp. paratuberculosis
gcgacuccggcgccgguc

SEQ ID NO: 2892588 - RNA, 18 nt, Mycobacterium avium subsp. paratuberculosis
gcgacuccugguccucga

SEQ ID NO: 2892589 - RNA, 21 nt, Mycobacterium avium subsp. paratuberculosis
gcgacuccugguccucgaucc

SEQ ID NO: 2892590 - RNA, 14 nt, Mycobacterium avium subsp. paratuberculosis
gcgacucgaccccg

SEQ ID NO: 2892591 - RNA, 16 nt, Mycobacterium avium subsp. paratuberculosis
gcgacucgaccccgcc

SEQ ID NO: 2892592 - RNA, 19 nt, Mycobacterium avium subsp. paratuberculosis
gcgacucgaccccgcccag

SEQ ID NO: 2892593 - RNA, 21 nt, Mycobacterium avium subsp. paratuberculosis
gcgacucgaccccgcccagcg

SEQ ID NO: 2892594 - RNA, 18 nt, Mycobacterium avium subsp. paratuberculosis
gcgacucguuggccggcu

SEQ ID NO: 2892595 - RNA, 15 nt, Mycobacterium avium subsp. paratuberculosis
gcgacuggcccucgg

SEQ ID NO: 2892596 - RNA, 14 nt, Mycobacterium avium subsp. paratuberculosis
gcgacugggcgccc

SEQ ID NO: 2892597 - RNA, 18 nt, Mycobacterium avium subsp. paratuberculosis
gcgacugggugcucccgc

SEQ ID NO: 2892598 - RNA, 21 nt, Mycobacterium avium subsp. paratuberculosis
gcgacugggugcucccgccaa

SEQ ID NO: 2892599 - RNA, 10 nt, Mycobacterium avium subsp. paratuberculosis
gcgacugucg

SEQ ID NO: 2892600 - RNA, 16 nt, Mycobacterium avium subsp. paratuberculosis
gcgacugucggcgccc

SEQ ID NO: 2892601 - RNA, 22 nt, Mycobacterium avium subsp. paratuberculosis
gcgacugucggcgccccgcccg

SEQ ID NO: 2892602 - RNA, 17 nt, Mycobacterium avium subsp. paratuberculosis
gcgacugucggcucgcc

SEQ ID NO: 2892603 - RNA, 18 nt, Mycobacterium avium subsp. paratuberculosis
gcgacugucggcucgccc

SEQ ID NO: 2892604 - RNA, 22 nt, Mycobacterium avium subsp. paratuberculosis
gcgacugucggcucgcccgcga

SEQ ID NO: 2892605 - RNA, 20 nt, Mycobacterium avium subsp. paratuberculosis
gcgacuucguugguggucga

SEQ ID NO: 2892606 - RNA, 17 nt, Mycobacterium avium subsp. paratuberculosis
gcgacuucuacggcggg

SEQ ID NO: 2892607 - RNA, 20 nt, Mycobacterium avium subsp. paratuberculosis
gcgacuucuacggcgggccg

SEQ ID NO: 2892608 - RNA, 21 nt, Mycobacterium avium subsp. paratuberculosis
gcgacuucuacggcgggccgg

SEQ ID NO: 2892609 - RNA, 15 nt, Mycobacterium avium subsp. paratuberculosis
gcgacuugaccagca

SEQ ID NO: 2892610 - RNA, 14 nt, Mycobacterium avium subsp. paratuberculosis
gcgacuugccgccg

SEQ ID NO: 2892611 - RNA, 16 nt, Mycobacterium avium subsp. paratuberculosis
gcgacuugccgccggc

SEQ ID NO: 2892612 - RNA, 17 nt, Mycobacterium avium subsp. paratuberculosis
gcgacuugccgccggcg

SEQ ID NO: 2892613 - RNA, 19 nt, Mycobacterium avium subsp. paratuberculosis
gcgacuugccgccggcgca

SEQ ID NO: 2892614 - RNA, 20 nt, Mycobacterium avium subsp. paratuberculosis
gcgacuugccgccggcgcag

SEQ ID NO: 2892615 - RNA, 22 nt, Mycobacterium avium subsp. paratuberculosis
gcgacuugccgccggcgcaguc

SEQ ID NO: 2892616 - RNA, 14 nt, Mycobacterium avium subsp. paratuberculosis
gcgacuugcgcgcc

SEQ ID NO: 2892617 - RNA, 15 nt, Mycobacterium avium subsp. paratuberculosis
gcgacuugcgcgccg

SEQ ID NO: 2892618 - RNA, 17 nt, Mycobacterium avium subsp. paratuberculosis
gcgacuugguggccagc

SEQ ID NO: 2892619 - RNA, 19 nt, Mycobacterium avium subsp. paratuberculosis
gcgagaaaaucgcccgcga

SEQ ID NO: 2892620 - RNA, 12 nt, Mycobacterium avium subsp. paratuberculosis
gcgagaaccggc

SEQ ID NO: 2892621 - RNA, 14 nt, Mycobacterium avium subsp. paratuberculosis
gcgagaaccggcgc

SEQ ID NO: 2892622 - RNA, 15 nt, Mycobacterium avium subsp. paratuberculosis
gcgagaaccggcgca

SEQ ID NO: 2892623 - RNA, 14 nt, Mycobacterium avium subsp. paratuberculosis
gcgagaagucgccg

SEQ ID NO: 2892624 - RNA, 16 nt, Mycobacterium avium subsp. paratuberculosis
gcgagaagucgccgac

SEQ ID NO: 2892625 - RNA, 18 nt, Mycobacterium avium subsp. paratuberculosis
gcgagaagucgccgacgc

SEQ ID NO: 2892626 - RNA, 19 nt, Mycobacterium avium subsp. paratuberculosis
gcgagaagucgccgacgcc

SEQ ID NO: 2892627 - RNA, 17 nt, Mycobacterium avium subsp. paratuberculosis
gcgagaagucgcucagc

SEQ ID NO: 2892628 - RNA, 13 nt, Mycobacterium avium subsp. paratuberculosis
gcgagaccggcac

SEQ ID NO: 2892629 - RNA, 14 nt, Mycobacterium avium subsp. paratuberculosis
gcgagaccggcacg

SEQ ID NO: 2892630 - RNA, 19 nt, Mycobacterium avium subsp. paratuberculosis
gcgagaccucccggcgcca

SEQ ID NO: 2892631 - RNA, 18 nt, Mycobacterium avium subsp. paratuberculosis
gcgagacguaagccaugg

SEQ ID NO: 2892632 - RNA, 22 nt, Mycobacterium avium subsp. paratuberculosis
gcgagaguaucgccacgccgac

SEQ ID NO: 2892633 - RNA, 23 nt, Mycobacterium avium subsp. paratuberculosis
gcgagaguaucgccacgccgacc

SEQ ID NO: 2892634 - RNA, 24 nt, Mycobacterium avium subsp. paratuberculosis
gcgagaguaucgccacgccgacca

SEQ ID NO: 2892635 - RNA, 22 nt, Mycobacterium avium subsp. paratuberculosis
gcgagagugcaacuagcgacgg

SEQ ID NO: 2892636 - RNA, 18 nt, Mycobacterium avium subsp. paratuberculosis
gcgagaucaacaccgcgc

SEQ ID NO: 2892637 - RNA, 14 nt, Mycobacterium avium subsp. paratuberculosis
gcgagaucagcgcc

SEQ ID NO: 2892638 - RNA, 15 nt, Mycobacterium avium subsp. paratuberculosis
gcgagaucagcgcca

SEQ ID NO: 2892639 - RNA, 16 nt, Mycobacterium avium subsp. paratuberculosis
gcgagaucagcgccau

SEQ ID NO: 2892640 - RNA, 18 nt, Mycobacterium avium subsp. paratuberculosis
gcgagaucagcgccaugc

SEQ ID NO: 2892641 - RNA, 14 nt, Mycobacterium avium subsp. paratuberculosis
gcgagaugaucagc

SEQ ID NO: 2892642 - RNA, 23 nt, Mycobacterium avium subsp. paratuberculosis
gcgagaugaucagccgcccgauc

SEQ ID NO: 2892643 - RNA, 15 nt, Mycobacterium avium subsp. paratuberculosis
gcgagaugcccaccc

SEQ ID NO: 2892644 - RNA, 17 nt, Mycobacterium avium subsp. paratuberculosis
gcgagaugcccacccgc

SEQ ID NO: 2892645 - RNA, 22 nt, Mycobacterium avium subsp. paratuberculosis
gcgagaugcccacccgcucggc

SEQ ID NO: 2892646 - RNA, 23 nt, Mycobacterium avium subsp. paratuberculosis
gcgagaugcccacccgcucggcg

SEQ ID NO: 2892647 - RNA, 20 nt, Mycobacterium avium subsp. paratuberculosis
gcgagauuggauuccagauc

SEQ ID NO: 2892648 - RNA, 18 nt, Mycobacterium avium subsp. paratuberculosis
gcgagcggcccugcgcgg

SEQ ID NO: 2892649 - RNA, 16 nt, Mycobacterium avium subsp. paratuberculosis
gcgagcgggcacgccg

SEQ ID NO: 2892650 - RNA, 20 nt, Mycobacterium avium subsp. paratuberculosis
gcgagcgggcacgccgccgc

SEQ ID NO: 2892651 - RNA, 21 nt, Mycobacterium avium subsp. paratuberculosis
gcgagcgggcacgccgccgcg

SEQ ID NO: 2892652 - RNA, 22 nt, Mycobacterium avium subsp. paratuberculosis
gcgagcgggugaaucgacaccg

SEQ ID NO: 2892653 - RNA, 22 nt, Mycobacterium avium subsp. paratuberculosis
gcgagcgguucgaucucgucgg

SEQ ID NO: 2892654 - RNA, 14 nt, Mycobacterium avium subsp. paratuberculosis
gcgagcgguuggcg

SEQ ID NO: 2892655 - RNA, 19 nt, Mycobacterium avium subsp. paratuberculosis
gcgagcgucacgcuggcgu

SEQ ID NO: 2892656 - RNA, 13 nt, Mycobacterium avium subsp. paratuberculosis
gcgagcgucgccg

SEQ ID NO: 2892657 - RNA, 14 nt, Mycobacterium avium subsp. paratuberculosis
gcgagcgucgccgc

SEQ ID NO: 2892658 - RNA, 16 nt, Mycobacterium avium subsp. paratuberculosis
gcgagcgucgccgcgu

SEQ ID NO: 2892659 - RNA, 17 nt, Mycobacterium avium subsp. paratuberculosis
gcgagcgucgccgcgug

SEQ ID NO: 2892660 - RNA, 15 nt, Mycobacterium avium subsp. paratuberculosis
gcgagcucaggccgg

SEQ ID NO: 2892661 - RNA, 16 nt, Mycobacterium avium subsp. paratuberculosis
gcgagcucaggccggc

SEQ ID NO: 2892662 - RNA, 17 nt, Mycobacterium avium subsp. paratuberculosis
gcgagcucaggccggcc

SEQ ID NO: 2892663 - RNA, 14 nt, Mycobacterium avium subsp. paratuberculosis
gcgagcucgcggcc

SEQ ID NO: 2892664 - RNA, 17 nt, Mycobacterium avium subsp. paratuberculosis
gcgagcucgcggccgua

SEQ ID NO: 2892665 - RNA, 21 nt, Mycobacterium avium subsp. paratuberculosis
gcgagcucguucucggcgaac

SEQ ID NO: 2892666 - RNA, 17 nt, Mycobacterium avium subsp. paratuberculosis
gcgagcugaccggccac

SEQ ID NO: 2892667 - RNA, 21 nt, Mycobacterium avium subsp. paratuberculosis
gcgagcugaccggccaccucg

SEQ ID NO: 2892668 - RNA, 15 nt, Mycobacterium avium subsp. paratuberculosis
gcgagcugaucggcg

SEQ ID NO: 2892669 - RNA, 20 nt, Mycobacterium avium subsp. paratuberculosis
gcgagcugaucggcguuggc

SEQ ID NO: 2892670 - RNA, 15 nt, Mycobacterium avium subsp. paratuberculosis
gcgagcugccccuuc

SEQ ID NO: 2892671 - RNA, 14 nt, Mycobacterium avium subsp. paratuberculosis
gcgagcugccggcg

SEQ ID NO: 2892672 - RNA, 16 nt, Mycobacterium avium subsp. paratuberculosis
gcgagcugccggcggc

SEQ ID NO: 2892673 - RNA, 21 nt, Mycobacterium avium subsp. paratuberculosis
gcgagcugcgggugcucagcc

SEQ ID NO: 2892674 - RNA, 19 nt, Mycobacterium avium subsp. paratuberculosis
gcgagcugcuucgucgccg

SEQ ID NO: 2892675 - RNA, 20 nt, Mycobacterium avium subsp. paratuberculosis
gcgagcugcuucgucgccgg

SEQ ID NO: 2892676 - RNA, 22 nt, Mycobacterium avium subsp. paratuberculosis
gcgagcugcuucgucgccgggc

SEQ ID NO: 2892677 - RNA, 23 nt, Mycobacterium avium subsp. paratuberculosis
gcgagcugcuucgucgccgggcu

SEQ ID NO: 2892678 - RNA, 13 nt, Mycobacterium avium subsp. paratuberculosis
gcgagcuggccgc

SEQ ID NO: 2892679 - RNA, 15 nt, Mycobacterium avium subsp. paratuberculosis
gcgagcuggccgccc

SEQ ID NO: 2892680 - RNA, 16 nt, Mycobacterium avium subsp. paratuberculosis
gcgagcuggccgccca

SEQ ID NO: 2892681 - RNA, 20 nt, Mycobacterium avium subsp. paratuberculosis
gcgagcuggccgcccaccac

SEQ ID NO: 2892682 - RNA, 16 nt, Mycobacterium avium subsp. paratuberculosis
gcgagcuuggcgggcg

SEQ ID NO: 2892683 - RNA, 15 nt, Mycobacterium avium subsp. paratuberculosis
gcgagcuuggcggug

SEQ ID NO: 2892684 - RNA, 22 nt, Mycobacterium avium subsp. paratuberculosis
gcgagcuuggcgguguucuugc

SEQ ID NO: 2892685 - RNA, 20 nt, Mycobacterium avium subsp. paratuberculosis
gcgagcuuguccugcaccga

SEQ ID NO: 2892686 - RNA, 21 nt, Mycobacterium avium subsp. paratuberculosis
gcgagcuuguccugcaccgac

SEQ ID NO: 2892687 - RNA, 14 nt, Mycobacterium avium subsp. paratuberculosis
gcgaggaacccgac

SEQ ID NO: 2892688 - RNA, 16 nt, Mycobacterium avium subsp. paratuberculosis
gcgaggaacccgaccg

SEQ ID NO: 2892689 - RNA, 17 nt, Mycobacterium avium subsp. paratuberculosis
gcgaggaacccgaccgc

SEQ ID NO: 2892690 - RNA, 18 nt, Mycobacterium avium subsp. paratuberculosis
gcgaggaacccgaccgcg

SEQ ID NO: 2892691 - RNA, 18 nt, Mycobacterium avium subsp. paratuberculosis
gcgaggaaguccggcgcg

SEQ ID NO: 2892692 - RNA, 20 nt, Mycobacterium avium subsp. paratuberculosis
gcgaggaaguccggcgcgcc

SEQ ID NO: 2892693 - RNA, 21 nt, Mycobacterium avium subsp. paratuberculosis
gcgaggaaguccggcgcgccc

SEQ ID NO: 2892694 - RNA, 19 nt, Mycobacterium avium subsp. paratuberculosis
gcgaggaauugcgcuacgg

SEQ ID NO: 2892695 - RNA, 14 nt, Mycobacterium avium subsp. paratuberculosis
gcgaggaccgagau

SEQ ID NO: 2892696 - RNA, 20 nt, Mycobacterium avium subsp. paratuberculosis
gcgaggaccgagaugaagac

SEQ ID NO: 2892697 - RNA, 16 nt, Mycobacterium avium subsp. paratuberculosis
gcgaggacgauggacg

SEQ ID NO: 2892698 - RNA, 16 nt, Mycobacterium avium subsp. paratuberculosis
gcgaggacgucgagcg

SEQ ID NO: 2892699 - RNA, 16 nt, Mycobacterium avium subsp. paratuberculosis
gcgaggacgucgucga

SEQ ID NO: 2892700 - RNA, 18 nt, Mycobacterium avium subsp. paratuberculosis
gcgaggacgucgucgacg

SEQ ID NO: 2892701 - RNA, 19 nt, Mycobacterium avium subsp. paratuberculosis
gcgaggacgucgucgacgu

SEQ ID NO: 2892702 - RNA, 14 nt, Mycobacterium avium subsp. paratuberculosis
gcgaggaucgcgau

SEQ ID NO: 2892703 - RNA, 20 nt, Mycobacterium avium subsp. paratuberculosis
gcgaggauuucgcucagccg

SEQ ID NO: 2892704 - RNA, 21 nt, Mycobacterium avium subsp. paratuberculosis
gcgaggauuucgcucagccgu

SEQ ID NO: 2892705 - RNA, 14 nt, Mycobacterium avium subsp. paratuberculosis
gcgaggccucgccg

SEQ ID NO: 2892706 - RNA, 21 nt, Mycobacterium avium subsp. paratuberculosis
gcgaggcgaucgcggugcggg

SEQ ID NO: 2892707 - RNA, 12 nt, Mycobacterium avium subsp. paratuberculosis
gcgaggcgaugg

SEQ ID NO: 2892708 - RNA, 18 nt, Mycobacterium avium subsp. paratuberculosis
gcgaggcgccacaacugg

SEQ ID NO: 2892709 - RNA, 19 nt, Mycobacterium avium subsp. paratuberculosis
gcgaggcgcgaaagcgcga

SEQ ID NO: 2892710 - RNA, 15 nt, Mycobacterium avium subsp. paratuberculosis
gcgaggcgcggggcg

SEQ ID NO: 2892711 - RNA, 13 nt, Mycobacterium avium subsp. paratuberculosis
gcgaggcggccag

SEQ ID NO: 2892712 - RNA, 15 nt, Mycobacterium avium subsp. paratuberculosis
gcgaggcggccagcg

SEQ ID NO: 2892713 - RNA, 12 nt, Mycobacterium avium subsp. paratuberculosis
gcgaggcgggca

SEQ ID NO: 2892714 - RNA, 16 nt, Mycobacterium avium subsp. paratuberculosis
gcgaggcgggcacacg

SEQ ID NO: 2892715 - RNA, 20 nt, Mycobacterium avium subsp. paratuberculosis
gcgaggcggguaggcgucgc

SEQ ID NO: 2892716 - RNA, 14 nt, Mycobacterium avium subsp. paratuberculosis
gcgaggcggucggc

SEQ ID NO: 2892717 - RNA, 16 nt, Mycobacterium avium subsp. paratuberculosis
gcgaggcggucggcgg

SEQ ID NO: 2892718 - RNA, 21 nt, Mycobacterium avium subsp. paratuberculosis
gcgagggcucaacaggcgagu

SEQ ID NO: 2892719 - RNA, 22 nt, Mycobacterium avium subsp. paratuberculosis
gcgaggggguggguccggucag

SEQ ID NO: 2892720 - RNA, 18 nt, Mycobacterium avium subsp. paratuberculosis
gcgagguaauggugggcg

SEQ ID NO: 2892721 - RNA, 19 nt, Mycobacterium avium subsp. paratuberculosis
gcgaggucaccaacgcgaa

SEQ ID NO: 2892722 - RNA, 21 nt, Mycobacterium avium subsp. paratuberculosis
gcgaggucgggauacucgucc

SEQ ID NO: 2892723 - RNA, 19 nt, Mycobacterium avium subsp. paratuberculosis
gcgaggucgucgagggcca

SEQ ID NO: 2892724 - RNA, 22 nt, Mycobacterium avium subsp. paratuberculosis
gcgaggucgucgagggccaccg

SEQ ID NO: 2892725 - RNA, 16 nt, Mycobacterium avium subsp. paratuberculosis
gcgaggucguucgaca

SEQ ID NO: 2892726 - RNA, 22 nt, Mycobacterium avium subsp. paratuberculosis
gcgaggugcgccaguugcucgg

SEQ ID NO: 2892727 - RNA, 18 nt, Mycobacterium avium subsp. paratuberculosis
gcgaggugggcaccagcu

SEQ ID NO: 2892728 - RNA, 13 nt, Mycobacterium avium subsp. paratuberculosis
gcgaggugucgac

SEQ ID NO: 2892729 - RNA, 15 nt, Mycobacterium avium subsp. paratuberculosis
gcgaggugucgacgc

SEQ ID NO: 2892730 - RNA, 22 nt, Mycobacterium avium subsp. paratuberculosis
gcgaggugucgacgcugagcac

SEQ ID NO: 2892731 - RNA, 16 nt, Mycobacterium avium subsp. paratuberculosis
gcgaggugugaggagu

SEQ ID NO: 2892732 - RNA, 16 nt, Mycobacterium avium subsp. paratuberculosis
gccgucgcgcaccacc

SEQ ID NO: 2892733 - RNA, 23 nt, Mycobacterium avium subsp. paratuberculosis
gccgucgcgcaccaccucgaucg

SEQ ID NO: 2892734 - RNA, 13 nt, Mycobacterium avium subsp. paratuberculosis
gccgucgcgcagc

SEQ ID NO: 2892735 - RNA, 15 nt, Mycobacterium avium subsp. paratuberculosis
gccgucgcgcagccu

SEQ ID NO: 2892736 - RNA, 20 nt, Mycobacterium avium subsp. paratuberculosis
gccgucgcgccaggaccagc

SEQ ID NO: 2892737 - RNA, 20 nt, Mycobacterium avium subsp. paratuberculosis
gccgucgcgcucgacgaugu

SEQ ID NO: 2892738 - RNA, 15 nt, Mycobacterium avium subsp. paratuberculosis
gccgucgcggcgcgg

SEQ ID NO: 2892739 - RNA, 18 nt, Mycobacterium avium subsp. paratuberculosis
gccgucgcggcgcggguc

SEQ ID NO: 2892740 - RNA, 22 nt, Mycobacterium avium subsp. paratuberculosis
gccgucgcgggagagcgcgggc

SEQ ID NO: 2892741 - RNA, 16 nt, Mycobacterium avium subsp. paratuberculosis
gccgucgcgggcgucg

SEQ ID NO: 2892742 - RNA, 17 nt, Mycobacterium avium subsp. paratuberculosis
gccgucgcgggcgucgg

SEQ ID NO: 2892743 - RNA, 21 nt, Mycobacterium avium subsp. paratuberculosis
gccgucgcgggcgucgggcag

SEQ ID NO: 2892744 - RNA, 22 nt, Mycobacterium avium subsp. paratuberculosis
gccgucgcgggcgucgggcagc

SEQ ID NO: 2892745 - RNA, 23 nt, Mycobacterium avium subsp. paratuberculosis
gccgucgcgggcgucgggcagca

SEQ ID NO: 2892746 - RNA, 13 nt, Mycobacterium avium subsp. paratuberculosis
gccgucgcgggug

SEQ ID NO: 2892747 - RNA, 21 nt, Mycobacterium avium subsp. paratuberculosis
gccgucgcuguuggcgacggc

SEQ ID NO: 2892748 - RNA, 15 nt, Mycobacterium avium subsp. paratuberculosis
gccgucggcauccac

SEQ ID NO: 2892749 - RNA, 12 nt, Mycobacterium avium subsp. paratuberculosis
gccgucggccag

SEQ ID NO: 2892750 - RNA, 13 nt, Mycobacterium avium subsp. paratuberculosis
gccgucggccagc

SEQ ID NO: 2892751 - RNA, 18 nt, Mycobacterium avium subsp. paratuberculosis
gccgucggccagcagcgc

SEQ ID NO: 2892752 - RNA, 15 nt, Mycobacterium avium subsp. paratuberculosis
gccgucggcccacgg

SEQ ID NO: 2892753 - RNA, 12 nt, Mycobacterium avium subsp. paratuberculosis
gccgucggccgc

SEQ ID NO: 2892754 - RNA, 13 nt, Mycobacterium avium subsp. paratuberculosis
gccgucggccgcc

SEQ ID NO: 2892755 - RNA, 15 nt, Mycobacterium avium subsp. paratuberculosis
gccgucggccgccga

SEQ ID NO: 2892756 - RNA, 13 nt, Mycobacterium avium subsp. paratuberculosis
gccgucggccugc

SEQ ID NO: 2892757 - RNA, 15 nt, Mycobacterium avium subsp. paratuberculosis
gccgucggccugcgc

SEQ ID NO: 2892758 - RNA, 13 nt, Mycobacterium avium subsp. paratuberculosis
gccgucggcgaug

SEQ ID NO: 2892759 - RNA, 22 nt, Mycobacterium avium subsp. paratuberculosis
gccgucggcgauggugaacucc

SEQ ID NO: 2892760 - RNA, 15 nt, Mycobacterium avium subsp. paratuberculosis
gccgucggcgccgcc

SEQ ID NO: 2892761 - RNA, 16 nt, Mycobacterium avium subsp. paratuberculosis
gccgucggcgccgccg

SEQ ID NO: 2892762 - RNA, 18 nt, Mycobacterium avium subsp. paratuberculosis
gccgucggcgccgccgag

SEQ ID NO: 2892763 - RNA, 20 nt, Mycobacterium avium subsp. paratuberculosis
gccgucggcgccgccgagcc

SEQ ID NO: 2892764 - RNA, 15 nt, Mycobacterium avium subsp. paratuberculosis
gccgucggcgcggcc

SEQ ID NO: 2892765 - RNA, 16 nt, Mycobacterium avium subsp. paratuberculosis
gccgucggcgcggccg

SEQ ID NO: 2892766 - RNA, 20 nt, Mycobacterium avium subsp. paratuberculosis
gccgucggcgcggccggauc

SEQ ID NO: 2892767 - RNA, 11 nt, Mycobacterium avium subsp. paratuberculosis
gccgucggcgg

SEQ ID NO: 2892768 - RNA, 12 nt, Mycobacterium avium subsp. paratuberculosis
gccgucggcgga

SEQ ID NO: 2892769 - RNA, 14 nt, Mycobacterium avium subsp. paratuberculosis
gccgucggcggccu

SEQ ID NO: 2892770 - RNA, 15 nt, Mycobacterium avium subsp. paratuberculosis
gccgucggcggccuu

SEQ ID NO: 2892771 - RNA, 15 nt, Mycobacterium avium subsp. paratuberculosis
gccgucggcgggaug

SEQ ID NO: 2892772 - RNA, 13 nt, Mycobacterium avium subsp. paratuberculosis
gccgucggcgucg

SEQ ID NO: 2892773 - RNA, 14 nt, Mycobacterium avium subsp. paratuberculosis
gccgucggcgucga

SEQ ID NO: 2892774 - RNA, 16 nt, Mycobacterium avium subsp. paratuberculosis
gccgucggcgucgacg

SEQ ID NO: 2892775 - RNA, 14 nt, Mycobacterium avium subsp. paratuberculosis
gccgucggcgucgg

SEQ ID NO: 2892776 - RNA, 14 nt, Mycobacterium avium subsp. paratuberculosis
gccgucggcguuca

SEQ ID NO: 2892777 - RNA, 13 nt, Mycobacterium avium subsp. paratuberculosis
gccgucggggaug

SEQ ID NO: 2892778 - RNA, 22 nt, Mycobacterium avium subsp. paratuberculosis
gccgucggggaugccgaaccgc

SEQ ID NO: 2892779 - RNA, 16 nt, Mycobacterium avium subsp. paratuberculosis
gccgucggggcgucgg

SEQ ID NO: 2892780 - RNA, 19 nt, Mycobacterium avium subsp. paratuberculosis
gccgucggggcgucggcgg

SEQ ID NO: 2892781 - RNA, 20 nt, Mycobacterium avium subsp. paratuberculosis
gccgucggggcgucggcggc

SEQ ID NO: 2892782 - RNA, 21 nt, Mycobacterium avium subsp. paratuberculosis
gccgucggggcgucggcggcc

SEQ ID NO: 2892783 - RNA, 22 nt, Mycobacterium avium subsp. paratuberculosis
gccgucgggguaguccgacuuc

SEQ ID NO: 2892784 - RNA, 18 nt, Mycobacterium avium subsp. paratuberculosis
gccgucggggucgcgccg

SEQ ID NO: 2892785 - RNA, 20 nt, Mycobacterium avium subsp. paratuberculosis
gccgucggggucgcgccggu

SEQ ID NO: 2892786 - RNA, 20 nt, Mycobacterium avium subsp. paratuberculosis
gccgucggggugcggucggc

SEQ ID NO: 2892787 - RNA, 15 nt, Mycobacterium avium subsp. paratuberculosis
gccgucgggucggcg

SEQ ID NO: 2892788 - RNA, 17 nt, Mycobacterium avium subsp. paratuberculosis
gccgucgggucggcgag

SEQ ID NO: 2892789 - RNA, 21 nt, Mycobacterium avium subsp. paratuberculosis
gccgucgggucggcgagcagc

SEQ ID NO: 2892790 - RNA, 23 nt, Mycobacterium avium subsp. paratuberculosis
gccgucgguaucgagguccaugu

SEQ ID NO: 2892791 - RNA, 12 nt, Mycobacterium avium subsp. paratuberculosis
gccgucggugcg

SEQ ID NO: 2892792 - RNA, 22 nt, Mycobacterium avium subsp. paratuberculosis
gccgucggugcgcuccucgacg

SEQ ID NO: 2892793 - RNA, 22 nt, Mycobacterium avium subsp. paratuberculosis
gccgucggugcgguaggugccg

SEQ ID NO: 2892794 - RNA, 11 nt, Mycobacterium avium subsp. paratuberculosis
gccgucggugg

SEQ ID NO: 2892795 - RNA, 14 nt, Mycobacterium avium subsp. paratuberculosis
gccgucgguggccg

SEQ ID NO: 2892796 - RNA, 17 nt, Mycobacterium avium subsp. paratuberculosis
gccgucgguggccggua

SEQ ID NO: 2892797 - RNA, 20 nt, Mycobacterium avium subsp. paratuberculosis
gccgucggugggggccaggc

SEQ ID NO: 2892798 - RNA, 14 nt, Mycobacterium avium subsp. paratuberculosis
gccgucgguguagc

SEQ ID NO: 2892799 - RNA, 22 nt, Mycobacterium avium subsp. paratuberculosis
gccgucgguguagcgagugccg

SEQ ID NO: 2892800 - RNA, 17 nt, Mycobacterium avium subsp. paratuberculosis
gccgugcagcacgccgc

SEQ ID NO: 2892801 - RNA, 18 nt, Mycobacterium avium subsp. paratuberculosis
gccgugcagcgcccagcc

SEQ ID NO: 2892802 - RNA, 20 nt, Mycobacterium avium subsp. paratuberculosis
gccgugcagcgcccagccga

SEQ ID NO: 2892803 - RNA, 17 nt, Mycobacterium avium subsp. paratuberculosis
gccgugcaggaugaccg

SEQ ID NO: 2892804 - RNA, 17 nt, Mycobacterium avium subsp. paratuberculosis
gccgugcagggggcgca

SEQ ID NO: 2892805 - RNA, 19 nt, Mycobacterium avium subsp. paratuberculosis
gccgugcagggggcgcagc

SEQ ID NO: 2892806 - RNA, 20 nt, Mycobacterium avium subsp. paratuberculosis
gccgugcagggggcgcagcc

SEQ ID NO: 2892807 - RNA, 21 nt, Mycobacterium avium subsp. paratuberculosis
gccgugcagggggcgcagccg

SEQ ID NO: 2892808 - RNA, 16 nt, Mycobacterium avium subsp. paratuberculosis
gccgugcaucgggcgc

SEQ ID NO: 2892809 - RNA, 22 nt, Mycobacterium avium subsp. paratuberculosis
gccgugcccaauagcacccgcu

SEQ ID NO: 2892810 - RNA, 12 nt, Mycobacterium avium subsp. paratuberculosis
gccgugccccag

SEQ ID NO: 2892811 - RNA, 20 nt, Mycobacterium avium subsp. paratuberculosis
gccgugccccaggucggggu

SEQ ID NO: 2892812 - RNA, 22 nt, Mycobacterium avium subsp. paratuberculosis
gccgugccccaggucggggugg

SEQ ID NO: 2892813 - RNA, 13 nt, Mycobacterium avium subsp. paratuberculosis
gccgugcccgagg

SEQ ID NO: 2892814 - RNA, 13 nt, Mycobacterium avium subsp. paratuberculosis
gccgugcccgcgg

SEQ ID NO: 2892815 - RNA, 17 nt, Mycobacterium avium subsp. paratuberculosis
gccgugcccgcgggaca

SEQ ID NO: 2892816 - RNA, 13 nt, Mycobacterium avium subsp. paratuberculosis
gccgugcccggcg

SEQ ID NO: 2892817 - RNA, 14 nt, Mycobacterium avium subsp. paratuberculosis
gccgugcccggcgc

SEQ ID NO: 2892818 - RNA, 14 nt, Mycobacterium avium subsp. paratuberculosis
gccgugccgcgcgg

SEQ ID NO: 2892819 - RNA, 16 nt, Mycobacterium avium subsp. paratuberculosis
gccgugccgcgcggcg

SEQ ID NO: 2892820 - RNA, 13 nt, Mycobacterium avium subsp. paratuberculosis
gccgugccggacc

SEQ ID NO: 2892821 - RNA, 15 nt, Mycobacterium avium subsp. paratuberculosis
gccgugccggaccgc

SEQ ID NO: 2892822 - RNA, 17 nt, Mycobacterium avium subsp. paratuberculosis
gccgugccggaccgcgc

SEQ ID NO: 2892823 - RNA, 16 nt, Mycobacterium avium subsp. paratuberculosis
gccgugccggcucggc

SEQ ID NO: 2892824 - RNA, 20 nt, Mycobacterium avium subsp. paratuberculosis
gccgugccggcucggcggcu

SEQ ID NO: 2892825 - RNA, 17 nt, Mycobacterium avium subsp. paratuberculosis
gccgugcgccagcgacc

SEQ ID NO: 2892826 - RNA, 20 nt, Mycobacterium avium subsp. paratuberculosis
gccgugcgccagcgaccgca

SEQ ID NO: 2892827 - RNA, 22 nt, Mycobacterium avium subsp. paratuberculosis
gccgugcgccagcgaccgcagg

SEQ ID NO: 2892828 - RNA, 14 nt, Mycobacterium avium subsp. paratuberculosis
gccgugcgccccgc

SEQ ID NO: 2892829 - RNA, 16 nt, Mycobacterium avium subsp. paratuberculosis
gccgugcgccccgccc

SEQ ID NO: 2892830 - RNA, 16 nt, Mycobacterium avium subsp. paratuberculosis
gccgugcgcggcgacc

SEQ ID NO: 2892831 - RNA, 22 nt, Mycobacterium avium subsp. paratuberculosis
gccgugcgcgucgacaccccgc

SEQ ID NO: 2892832 - RNA, 13 nt, Mycobacterium avium subsp. paratuberculosis
gccgugcggcggc

SEQ ID NO: 2892833 - RNA, 19 nt, Mycobacterium avium subsp. paratuberculosis
gccgugcggcggcggcggu

SEQ ID NO: 2892834 - RNA, 21 nt, Mycobacterium avium subsp. paratuberculosis
gccgugcggcggcggcggucc

SEQ ID NO: 2892835 - RNA, 16 nt, Mycobacterium avium subsp. paratuberculosis
gccgugcggcguucgg

SEQ ID NO: 2892836 - RNA, 20 nt, Mycobacterium avium subsp. paratuberculosis
gccgugcggcguucggugcc

SEQ ID NO: 2892837 - RNA, 19 nt, Mycobacterium avium subsp. paratuberculosis
gccgugcggcuugcccguu

SEQ ID NO: 2892838 - RNA, 14 nt, Mycobacterium avium subsp. paratuberculosis
gccgugcucggcgg

SEQ ID NO: 2892839 - RNA, 16 nt, Mycobacterium avium subsp. paratuberculosis
gccgugcucggcggcg

SEQ ID NO: 2892840 - RNA, 16 nt, Mycobacterium avium subsp. paratuberculosis
gccgugcugccggaac

SEQ ID NO: 2892841 - RNA, 15 nt, Mycobacterium avium subsp. paratuberculosis
gccguggacccgccc

SEQ ID NO: 2892842 - RNA, 16 nt, Mycobacterium avium subsp. paratuberculosis
gccguggacccgcccc

SEQ ID NO: 2892843 - RNA, 14 nt, Mycobacterium avium subsp. paratuberculosis
gccguggcaccggg

SEQ ID NO: 2892844 - RNA, 16 nt, Mycobacterium avium subsp. paratuberculosis
gccguggcaccgggug

SEQ ID NO: 2892845 - RNA, 19 nt, Mycobacterium avium subsp. paratuberculosis
gccguggcaggcacgagcg

SEQ ID NO: 2892846 - RNA, 21 nt, Mycobacterium avium subsp. paratuberculosis
gccguggcaggcacgagcgaa

SEQ ID NO: 2892847 - RNA, 16 nt, Mycobacterium avium subsp. paratuberculosis
gccguggcagggccag

SEQ ID NO: 2892848 - RNA, 20 nt, Mycobacterium avium subsp. paratuberculosis
gccguggcccauguggccug

SEQ ID NO: 2892849 - RNA, 21 nt, Mycobacterium avium subsp. paratuberculosis
gccguggcccauguggccuga

SEQ ID NO: 2892850 - RNA, 14 nt, Mycobacterium avium subsp. paratuberculosis
gccguggcccgccc

SEQ ID NO: 2892851 - RNA, 19 nt, Mycobacterium avium subsp. paratuberculosis
gccguggcccgcccagcgc

SEQ ID NO: 2892852 - RNA, 18 nt, Mycobacterium avium subsp. paratuberculosis
gccguggcccggucggag

SEQ ID NO: 2892853 - RNA, 20 nt, Mycobacterium avium subsp. paratuberculosis
gccguggccgucacgcuggc

SEQ ID NO: 2892854 - RNA, 12 nt, Mycobacterium avium subsp. paratuberculosis
gccguggcggcc

SEQ ID NO: 2892855 - RNA, 14 nt, Mycobacterium avium subsp. paratuberculosis
gccguggcggcccg

SEQ ID NO: 2892856 - RNA, 17 nt, Mycobacterium avium subsp. paratuberculosis
gccguggcggcccgacc

SEQ ID NO: 2892857 - RNA, 21 nt, Mycobacterium avium subsp. paratuberculosis
gccguggcggcccgaccagcg

SEQ ID NO: 2892858 - RNA, 14 nt, Mycobacterium avium subsp. paratuberculosis
gccguggcggcggg

SEQ ID NO: 2892859 - RNA, 21 nt, Mycobacterium avium subsp. paratuberculosis
gccguggcggcgggccagcuc

SEQ ID NO: 2892860 - RNA, 23 nt, Mycobacterium avium subsp. paratuberculosis
gccguggcggcgggccagcucgu

SEQ ID NO: 2892861 - RNA, 15 nt, Mycobacterium avium subsp. paratuberculosis
gccguggcggcggug

SEQ ID NO: 2892862 - RNA, 21 nt, Mycobacterium avium subsp. paratuberculosis
gccguggcguuacacccgcgg

SEQ ID NO: 2892863 - RNA, 14 nt, Mycobacterium avium subsp. paratuberculosis
gccgugggggucga

SEQ ID NO: 2892864 - RNA, 21 nt, Mycobacterium avium subsp. paratuberculosis
gccgugggggucgacccgccg

SEQ ID NO: 2892865 - RNA, 22 nt, Mycobacterium avium subsp. paratuberculosis
gccgugggggucgacccgccgc

SEQ ID NO: 2892866 - RNA, 20 nt, Mycobacterium avium subsp. paratuberculosis
gccgugggugccgacgagcu

SEQ ID NO: 2892867 - RNA, 21 nt, Mycobacterium avium subsp. paratuberculosis
gccgugggugccgacgagcuc

SEQ ID NO: 2892868 - RNA, 15 nt, Mycobacterium avium subsp. paratuberculosis
gccguggucaacggc

SEQ ID NO: 2892869 - RNA, 13 nt, Mycobacterium avium subsp. paratuberculosis
gccgugguccagc

SEQ ID NO: 2892870 - RNA, 17 nt, Mycobacterium avium subsp. paratuberculosis
gccgugguccagccggu

SEQ ID NO: 2892871 - RNA, 15 nt, Mycobacterium avium subsp. paratuberculosis
gccguggucggcgaa

SEQ ID NO: 2892872 - RNA, 16 nt, Mycobacterium avium subsp. paratuberculosis
gccguggucggcgaac

SEQ ID NO: 2892873 - RNA, 22 nt, Mycobacterium avium subsp. paratuberculosis
gccguggucggcgaacgcccgg

SEQ ID NO: 2892874 - RNA, 23 nt, Mycobacterium avium subsp. paratuberculosis
gccguggucggcgaacgcccggu

SEQ ID NO: 2892875 - RNA, 13 nt, Mycobacterium avium subsp. paratuberculosis
gccguggucggug

SEQ ID NO: 2892876 - RNA, 15 nt, Mycobacterium avium subsp. paratuberculosis
gccguggucggugcc

SEQ ID NO: 2892877 - RNA, 17 nt, Mycobacterium avium subsp. paratuberculosis
gccguggucggugcccu

SEQ ID NO: 2892878 - RNA, 14 nt, Mycobacterium avium subsp. paratuberculosis
gccgugguuggcga

SEQ ID NO: 2892879 - RNA, 16 nt, Mycobacterium avium subsp. paratuberculosis
gccguguacagcaggg

SEQ ID NO: 2892880 - RNA, 16 nt, Mycobacterium avium subsp. paratuberculosis
gccguguaggccgcgc

SEQ ID NO: 2892881 - RNA, 19 nt, Mycobacterium avium subsp. paratuberculosis
gccguguaggccgcgcugg

SEQ ID NO: 2892882 - RNA, 14 nt, Mycobacterium avium subsp. paratuberculosis
gccguucagcgcgg

SEQ ID NO: 2892883 - RNA, 15 nt, Mycobacterium avium subsp. paratuberculosis
gccguucagcgcggc

SEQ ID NO: 2892884 - RNA, 17 nt, Mycobacterium avium subsp. paratuberculosis
gccguucagcgcggcca

SEQ ID NO: 2892885 - RNA, 18 nt, Mycobacterium avium subsp. paratuberculosis
gccuaccggguggccagc

SEQ ID NO: 2892886 - RNA, 23 nt, Mycobacterium avium subsp. paratuberculosis
gccuacgacauccugcgcaucga

SEQ ID NO: 2892887 - RNA, 15 nt, Mycobacterium avium subsp. paratuberculosis
gccuacggcgccggu

SEQ ID NO: 2892888 - RNA, 16 nt, Mycobacterium avium subsp. paratuberculosis
gccuacuugcggccgc

SEQ ID NO: 2892889 - RNA, 17 nt, Mycobacterium avium subsp. paratuberculosis
gccuacuugcggccgcg

SEQ ID NO: 2892890 - RNA, 18 nt, Mycobacterium avium subsp. paratuberculosis
gccuacuugcggccgcga

SEQ ID NO: 2892891 - RNA, 19 nt, Mycobacterium avium subsp. paratuberculosis
gccuacuugcggccgcgac

SEQ ID NO: 2892892 - RNA, 19 nt, Mycobacterium avium subsp. paratuberculosis
gccuagccuuggccgcagg

SEQ ID NO: 2892893 - RNA, 21 nt, Mycobacterium avium subsp. paratuberculosis
gccuagccuuggccgcaggcg

SEQ ID NO: 2892894 - RNA, 15 nt, Mycobacterium avium subsp. paratuberculosis
gccuaggaccccggc

SEQ ID NO: 2892895 - RNA, 18 nt, Mycobacterium avium subsp. paratuberculosis
gccuaggaccccggcugc

SEQ ID NO: 2892896 - RNA, 20 nt, Mycobacterium avium subsp. paratuberculosis
gccuaugaggcgacccccgg

SEQ ID NO: 2892897 - RNA, 15 nt, Mycobacterium avium subsp. paratuberculosis
gccuaugccgcguga

SEQ ID NO: 2892898 - RNA, 14 nt, Mycobacterium avium subsp. paratuberculosis
gccuaugcgcccgg

SEQ ID NO: 2892899 - RNA, 15 nt, Mycobacterium avium subsp. paratuberculosis
gccuaugcgcccggg

SEQ ID NO: 2892900 - RNA, 12 nt, Mycobacterium avium subsp. paratuberculosis
gccucaccgcgg

SEQ ID NO: 2892901 - RNA, 15 nt, Mycobacterium avium subsp. paratuberculosis
gccucaccgcgggcc

SEQ ID NO: 2892902 - RNA, 16 nt, Mycobacterium avium subsp. paratuberculosis
gccucaccgcgggcca

SEQ ID NO: 2892903 - RNA, 19 nt, Mycobacterium avium subsp. paratuberculosis
gccucaccgcgggccaggc

SEQ ID NO: 2892904 - RNA, 15 nt, Mycobacterium avium subsp. paratuberculosis
gccucagcgcgcaac

SEQ ID NO: 2892905 - RNA, 15 nt, Mycobacterium avium subsp. paratuberculosis
gccucaggcgagcac

SEQ ID NO: 2892906 - RNA, 14 nt, Mycobacterium avium subsp. paratuberculosis
gccucaggcgucgg

SEQ ID NO: 2892907 - RNA, 15 nt, Mycobacterium avium subsp. paratuberculosis
gccucaggcgucggu

SEQ ID NO: 2892908 - RNA, 18 nt, Mycobacterium avium subsp. paratuberculosis
gccucaggcgucggucag

SEQ ID NO: 2892909 - RNA, 23 nt, Mycobacterium avium subsp. paratuberculosis
gccucaggcgucggucagcaggc

SEQ ID NO: 2892910 - RNA, 20 nt, Mycobacterium avium subsp. paratuberculosis
gccucaggcugacgccacgc

SEQ ID NO: 2892911 - RNA, 15 nt, Mycobacterium avium subsp. paratuberculosis
gccucagggcgcgcu

SEQ ID NO: 2892912 - RNA, 19 nt, Mycobacterium avium subsp. paratuberculosis
gccucagggcgcgcugucg

SEQ ID NO: 2892913 - RNA, 22 nt, Mycobacterium avium subsp. paratuberculosis
gccucagggcgcgcugucgacg

SEQ ID NO: 2892914 - RNA, 19 nt, Mycobacterium avium subsp. paratuberculosis
gccucaguccgacgcgacg

SEQ ID NO: 2892915 - RNA, 20 nt, Mycobacterium avium subsp. paratuberculosis
gccucaugccagacgcgcac

SEQ ID NO: 2892916 - RNA, 22 nt, Mycobacterium avium subsp. paratuberculosis
gccucaugccagacgcgcaccg

SEQ ID NO: 2892917 - RNA, 18 nt, Mycobacterium avium subsp. paratuberculosis
gccuccacauacgcggcg

SEQ ID NO: 2892918 - RNA, 21 nt, Mycobacterium avium subsp. paratuberculosis
gccuccacauacgcggcggcc

SEQ ID NO: 2892919 - RNA, 17 nt, Mycobacterium avium subsp. paratuberculosis
gccuccaccaccauguc

SEQ ID NO: 2892920 - RNA, 22 nt, Mycobacterium avium subsp. paratuberculosis
gccuccaccaccaugucguuga

SEQ ID NO: 2892921 - RNA, 12 nt, Mycobacterium avium subsp. paratuberculosis
gccuccaccagc

SEQ ID NO: 2892922 - RNA, 14 nt, Mycobacterium avium subsp. paratuberculosis
gccuccaccagcgg

SEQ ID NO: 2892923 - RNA, 22 nt, Mycobacterium avium subsp. paratuberculosis
gccuccaccagcggcgcgucgc

SEQ ID NO: 2892924 - RNA, 21 nt, Mycobacterium avium subsp. paratuberculosis
gccuccaccggcaaucgggac

SEQ ID NO: 2892925 - RNA, 13 nt, Mycobacterium avium subsp. paratuberculosis
gccuccagcacgu

SEQ ID NO: 2892926 - RNA, 16 nt, Mycobacterium avium subsp. paratuberculosis
gccuccagcacgucgg

SEQ ID NO: 2892927 - RNA, 20 nt, Mycobacterium avium subsp. paratuberculosis
gccuccagcacgucggggug

SEQ ID NO: 2892928 - RNA, 16 nt, Mycobacterium avium subsp. paratuberculosis
gccuccagccagcgcg

SEQ ID NO: 2892929 - RNA, 12 nt, Mycobacterium avium subsp. paratuberculosis
gccuccagccgc

SEQ ID NO: 2892930 - RNA, 13 nt, Mycobacterium avium subsp. paratuberculosis
gccuccagccgcg

SEQ ID NO: 2892931 - RNA, 14 nt, Mycobacterium avium subsp. paratuberculosis
gccuccagccgcgc

SEQ ID NO: 2892932 - RNA, 17 nt, Mycobacterium avium subsp. paratuberculosis
gccuccagccgcgcggc

SEQ ID NO: 2892933 - RNA, 14 nt, Mycobacterium avium subsp. paratuberculosis
gccuccagccgcuc

SEQ ID NO: 2892934 - RNA, 16 nt, Mycobacterium avium subsp. paratuberculosis
gccuccagccgcuccg

SEQ ID NO: 2892935 - RNA, 23 nt, Mycobacterium avium subsp. paratuberculosis
gccuccagccgcuccgcggcggg

SEQ ID NO: 2892936 - RNA, 18 nt, Mycobacterium avium subsp. paratuberculosis
gccuccagccgcuccucg

SEQ ID NO: 2892937 - RNA, 18 nt, Mycobacterium avium subsp. paratuberculosis
gccuccagcuuugccagc

SEQ ID NO: 2892938 - RNA, 20 nt, Mycobacterium avium subsp. paratuberculosis
gccuccagguucgccgccca

SEQ ID NO: 2892939 - RNA, 19 nt, Mycobacterium avium subsp. paratuberculosis
gccuccauucgggccagcg

SEQ ID NO: 2892940 - RNA, 21 nt, Mycobacterium avium subsp. paratuberculosis
gccuccauucgggccagcgcc

SEQ ID NO: 2892941 - RNA, 15 nt, Mycobacterium avium subsp. paratuberculosis
gccucccacagcgga

SEQ ID NO: 2892942 - RNA, 16 nt, Mycobacterium avium subsp. paratuberculosis
gccucccacucgucga

SEQ ID NO: 2892943 - RNA, 21 nt, Mycobacterium avium subsp. paratuberculosis
gccuccccauccgcggccacc

SEQ ID NO: 2892944 - RNA, 15 nt, Mycobacterium avium subsp. paratuberculosis
gccucccccacccgc

SEQ ID NO: 2892945 - RNA, 13 nt, Mycobacterium avium subsp. paratuberculosis
gccucccgcagcg

SEQ ID NO: 2892946 - RNA, 18 nt, Mycobacterium avium subsp. paratuberculosis
gccucccgcagcgccagc

SEQ ID NO: 2892947 - RNA, 19 nt, Mycobacterium avium subsp. paratuberculosis
gccucccgcagcgccagcg

SEQ ID NO: 2892948 - RNA, 13 nt, Mycobacterium avium subsp. paratuberculosis
gccucccggacca

SEQ ID NO: 2892949 - RNA, 18 nt, Mycobacterium avium subsp. paratuberculosis
gccuccgaauccagcgcg

SEQ ID NO: 2892950 - RNA, 19 nt, Mycobacterium avium subsp. paratuberculosis
gccuccgaauccagcgcgc

SEQ ID NO: 2892951 - RNA, 22 nt, Mycobacterium avium subsp. paratuberculosis
gccuccgaauccagcgcgccgc

SEQ ID NO: 2892952 - RNA, 18 nt, Mycobacterium avium subsp. paratuberculosis
gccuccgacagccgcacc

SEQ ID NO: 2892953 - RNA, 14 nt, Mycobacterium avium subsp. paratuberculosis
gccuccgaccagcc

SEQ ID NO: 2892954 - RNA, 17 nt, Mycobacterium avium subsp. paratuberculosis
gccuccgaccagccggu

SEQ ID NO: 2892955 - RNA, 18 nt, Mycobacterium avium subsp. paratuberculosis
gccuccgaccagccgguc

SEQ ID NO: 2892956 - RNA, 20 nt, Mycobacterium avium subsp. paratuberculosis
gccuccgacccguccagcgu

SEQ ID NO: 2892957 - RNA, 13 nt, Mycobacterium avium subsp. paratuberculosis
gccuccgagcggc

SEQ ID NO: 2892958 - RNA, 16 nt, Mycobacterium avium subsp. paratuberculosis
gccuccgagcggcgca

SEQ ID NO: 2892959 - RNA, 20 nt, Mycobacterium avium subsp. paratuberculosis
gccuccgagcggcgcaggcc

SEQ ID NO: 2892960 - RNA, 17 nt, Mycobacterium avium subsp. paratuberculosis
gccuccgccaccuccuc

SEQ ID NO: 2892961 - RNA, 19 nt, Mycobacterium avium subsp. paratuberculosis
gccuccgccaccuccuccg

SEQ ID NO: 2892962 - RNA, 19 nt, Mycobacterium avium subsp. paratuberculosis
gccuccgcccgggugcagg

SEQ ID NO: 2892963 - RNA, 21 nt, Mycobacterium avium subsp. paratuberculosis
gccuccgcccgggugcaggcc

SEQ ID NO: 2892964 - RNA, 16 nt, Mycobacterium avium subsp. paratuberculosis
gccuccgcgaucagcu

SEQ ID NO: 2892965 - RNA, 18 nt, Mycobacterium avium subsp. paratuberculosis
gccuccgcgaucagcucg

SEQ ID NO: 2892966 - RNA, 18 nt, Mycobacterium avium subsp. paratuberculosis
gccuccgcgcgcggcccg

SEQ ID NO: 2892967 - RNA, 12 nt, Mycobacterium avium subsp. paratuberculosis
gccuccggagug

SEQ ID NO: 2892968 - RNA, 22 nt, Mycobacterium avium subsp. paratuberculosis
gccuccggagugacgucgcgcg

SEQ ID NO: 2892969 - RNA, 23 nt, Mycobacterium avium subsp. paratuberculosis
gccuccggagugacgucgcgcgg

SEQ ID NO: 2892970 - RNA, 22 nt, Mycobacterium avium subsp. paratuberculosis
gccucggauuccgcggaacccg

SEQ ID NO: 2892971 - RNA, 16 nt, Mycobacterium avium subsp. paratuberculosis
gccucggcaccgugcc

SEQ ID NO: 2892972 - RNA, 20 nt, Mycobacterium avium subsp. paratuberculosis
gccucggcaccgugccgcgc

SEQ ID NO: 2892973 - RNA, 21 nt, Mycobacterium avium subsp. paratuberculosis
gccucggcaccgugccgcgcg

SEQ ID NO: 2892974 - RNA, 13 nt, Mycobacterium avium subsp. paratuberculosis
gccucggccacca

SEQ ID NO: 2892975 - RNA, 23 nt, Mycobacterium avium subsp. paratuberculosis
gccucggccaccagaugccgggc

SEQ ID NO: 2892976 - RNA, 15 nt, Mycobacterium avium subsp. paratuberculosis
gccucggccagcacc

SEQ ID NO: 2892977 - RNA, 18 nt, Mycobacterium avium subsp. paratuberculosis
gccucggcccucaggugg

SEQ ID NO: 2892978 - RNA, 13 nt, Mycobacterium avium subsp. paratuberculosis
gccucggccgcgg

SEQ ID NO: 2892979 - RNA, 14 nt, Mycobacterium avium subsp. paratuberculosis
gccucggccgcggu

SEQ ID NO: 2892980 - RNA, 18 nt, Mycobacterium avium subsp. paratuberculosis
gccucggccucgucgacg

SEQ ID NO: 2892981 - RNA, 21 nt, Mycobacterium avium subsp. paratuberculosis
gccucggccucgucgacgucg

SEQ ID NO: 2892982 - RNA, 12 nt, Mycobacterium avium subsp. paratuberculosis
gccucggccugc

SEQ ID NO: 2892983 - RNA, 14 nt, Mycobacterium avium subsp. paratuberculosis
gccucggccuuggc

SEQ ID NO: 2892984 - RNA, 21 nt, Mycobacterium avium subsp. paratuberculosis
gccucggccuuggccaccgcc

SEQ ID NO: 2892985 - RNA, 18 nt, Mycobacterium avium subsp. paratuberculosis
gccucggcgaccgcccgg

SEQ ID NO: 2892986 - RNA, 16 nt, Mycobacterium avium subsp. paratuberculosis
gccucggcgagccgcu

SEQ ID NO: 2892987 - RNA, 19 nt, Mycobacterium avium subsp. paratuberculosis
gccucggcgaggucgucga

SEQ ID NO: 2892988 - RNA, 15 nt, Mycobacterium avium subsp. paratuberculosis
gccucggcgaucggc

SEQ ID NO: 2892989 - RNA, 21 nt, Mycobacterium avium subsp. paratuberculosis
gccucggcgaucggccgcugc

SEQ ID NO: 2892990 - RNA, 13 nt, Mycobacterium avium subsp. paratuberculosis
gccucggcgaugc

SEQ ID NO: 2892991 - RNA, 17 nt, Mycobacterium avium subsp. paratuberculosis
gccucggcgaugccgag

SEQ ID NO: 2892992 - RNA, 22 nt, Mycobacterium avium subsp. paratuberculosis
gccucggcgaugccgaggauuu

SEQ ID NO: 2892993 - RNA, 16 nt, Mycobacterium avium subsp. paratuberculosis
gccucggcgccucggc

SEQ ID NO: 2892994 - RNA, 14 nt, Mycobacterium avium subsp. paratuberculosis
gccucggcgcgggc

SEQ ID NO: 2892995 - RNA, 20 nt, Mycobacterium avium subsp. paratuberculosis
gccucggcgcugcccgccgc

SEQ ID NO: 2892996 - RNA, 22 nt, Mycobacterium avium subsp. paratuberculosis
gccucggcgcugcccgccgcgg

SEQ ID NO: 2892997 - RNA, 21 nt, Mycobacterium avium subsp. paratuberculosis
gccucggcggagucguagucg

SEQ ID NO: 2892998 - RNA, 13 nt, Mycobacterium avium subsp. paratuberculosis
gccucggcggccc

SEQ ID NO: 2892999 - RNA, 15 nt, Mycobacterium avium subsp. paratuberculosis
gccucggcggccgcc

SEQ ID NO: 2893000 - RNA, 16 nt, Mycobacterium avium subsp. paratuberculosis
gccucggcggccggga

SEQ ID NO: 2893001 - RNA, 16 nt, Mycobacterium avium subsp. paratuberculosis
gccucggcgggccgcc

SEQ ID NO: 2893002 - RNA, 17 nt, Mycobacterium avium subsp. paratuberculosis
gccucggcgggccgccc

SEQ ID NO: 2893003 - RNA, 15 nt, Mycobacterium avium subsp. paratuberculosis
gccucggcgguggcc

SEQ ID NO: 2893004 - RNA, 21 nt, Mycobacterium avium subsp. paratuberculosis
gccucggcgucaccgcgggug

SEQ ID NO: 2893005 - RNA, 21 nt, Mycobacterium avium subsp. paratuberculosis
gccucggcgucccggcgucuc

SEQ ID NO: 2893006 - RNA, 24 nt, Mycobacterium avium subsp. paratuberculosis
gccucggcgucccggcgucucggc

SEQ ID NO: 2893007 - RNA, 14 nt, Mycobacterium avium subsp. paratuberculosis
gccucggcguccgc

SEQ ID NO: 2893008 - RNA, 18 nt, Mycobacterium avium subsp. paratuberculosis
gccucggcguccgcggcg

SEQ ID NO: 2893009 - RNA, 19 nt, Mycobacterium avium subsp. paratuberculosis
gccucggcguccgcggcgg

SEQ ID NO: 2893010 - RNA, 20 nt, Mycobacterium avium subsp. paratuberculosis
gccucggcguccgcggcgga

SEQ ID NO: 2893011 - RNA, 21 nt, Mycobacterium avium subsp. paratuberculosis
gccucggcguccgcggcggag

SEQ ID NO: 2893012 - RNA, 12 nt, Mycobacterium avium subsp. paratuberculosis
gccucgggccgg

SEQ ID NO: 2893013 - RNA, 15 nt, Mycobacterium avium subsp. paratuberculosis
gccucgggccggcag

SEQ ID NO: 2893014 - RNA, 16 nt, Mycobacterium avium subsp. paratuberculosis
gccucgggccggcagc

SEQ ID NO: 2893015 - RNA, 20 nt, Mycobacterium avium subsp. paratuberculosis
gccucgggccggcagccggc

SEQ ID NO: 2893016 - RNA, 21 nt, Mycobacterium avium subsp. paratuberculosis
gccucgggccggcagccggcc

SEQ ID NO: 2893017 - RNA, 19 nt, Mycobacterium avium subsp. paratuberculosis
gccucgggcgacgacgcgg

SEQ ID NO: 2893018 - RNA, 22 nt, Mycobacterium avium subsp. paratuberculosis
gccucgggguugcuguacuggg

SEQ ID NO: 2893019 - RNA, 12 nt, Mycobacterium avium subsp. paratuberculosis
gccucggucgcg

SEQ ID NO: 2893020 - RNA, 13 nt, Mycobacterium avium subsp. paratuberculosis
gccucggucgcgu

SEQ ID NO: 2893021 - RNA, 15 nt, Mycobacterium avium subsp. paratuberculosis
gccucggucgcguga

SEQ ID NO: 2893022 - RNA, 22 nt, Mycobacterium avium subsp. paratuberculosis
gccucggucgcgugaccggcgg

SEQ ID NO: 2893023 - RNA, 18 nt, Mycobacterium avium subsp. paratuberculosis
gccucggugagcagcucg

SEQ ID NO: 2893024 - RNA, 19 nt, Mycobacterium avium subsp. paratuberculosis
gccucggugagcagcucgg

SEQ ID NO: 2893025 - RNA, 15 nt, Mycobacterium avium subsp. paratuberculosis
gccucgguggcggug

SEQ ID NO: 2893026 - RNA, 19 nt, Mycobacterium avium subsp. paratuberculosis
gccucgguggcgguggcca

SEQ ID NO: 2893027 - RNA, 23 nt, Mycobacterium avium subsp. paratuberculosis
gccucgguggucgacgagcccgc

SEQ ID NO: 2893028 - RNA, 14 nt, Mycobacterium avium subsp. paratuberculosis
gccucgguggucgc

SEQ ID NO: 2893029 - RNA, 18 nt, Mycobacterium avium subsp. paratuberculosis
gccucgguucugcagcga

SEQ ID NO: 2893030 - RNA, 18 nt, Mycobacterium avium subsp. paratuberculosis
gccucgucgaccgcggcc

SEQ ID NO: 2893031 - RNA, 19 nt, Mycobacterium avium subsp. paratuberculosis
gccucgucgaccgcggccu

SEQ ID NO: 2893032 - RNA, 20 nt, Mycobacterium avium subsp. paratuberculosis
gccucgucgaccgcggccug

SEQ ID NO: 2893033 - RNA, 22 nt, Mycobacterium avium subsp. paratuberculosis
gccucgucgaccgcggccuggg

SEQ ID NO: 2893034 - RNA, 16 nt, Mycobacterium avium subsp. paratuberculosis
gccucgucgacgucgg

SEQ ID NO: 2893035 - RNA, 13 nt, Mycobacterium avium subsp. paratuberculosis
gccucgucgagca

SEQ ID NO: 2893036 - RNA, 19 nt, Mycobacterium avium subsp. paratuberculosis
gccucgucgagcagcgccc

SEQ ID NO: 2893037 - RNA, 14 nt, Mycobacterium avium subsp. paratuberculosis
gccucgucgagcuc

SEQ ID NO: 2893038 - RNA, 21 nt, Mycobacterium avium subsp. paratuberculosis
gccucgucgagguacugcagc

SEQ ID NO: 2893039 - RNA, 16 nt, Mycobacterium avium subsp. paratuberculosis
gccucgucgaugucgg

SEQ ID NO: 2893040 - RNA, 23 nt, Mycobacterium avium subsp. paratuberculosis
gccucgucgaugucggcggcccg

SEQ ID NO: 2893041 - RNA, 14 nt, Mycobacterium avium subsp. paratuberculosis
gccucgucgcggaa

SEQ ID NO: 2893042 - RNA, 13 nt, Mycobacterium avium subsp. paratuberculosis
gccucgucggcga

SEQ ID NO: 2893043 - RNA, 14 nt, Mycobacterium avium subsp. paratuberculosis
gccucgucggcgag

SEQ ID NO: 2893044 - RNA, 15 nt, Mycobacterium avium subsp. paratuberculosis
gccucgucggcgagc

SEQ ID NO: 2893045 - RNA, 14 nt, Mycobacterium avium subsp. paratuberculosis
gccucgucggcgcc

SEQ ID NO: 2893046 - RNA, 18 nt, Mycobacterium avium subsp. paratuberculosis
gccucgucggcgccgucg

SEQ ID NO: 2893047 - RNA, 18 nt, Mycobacterium avium subsp. paratuberculosis
gccucgucgggaacgcga

SEQ ID NO: 2893048 - RNA, 13 nt, Mycobacterium avium subsp. paratuberculosis
gccucgucgucgu

SEQ ID NO: 2893049 - RNA, 18 nt, Mycobacterium avium subsp. paratuberculosis
gccucgugcaaggccugc

SEQ ID NO: 2893050 - RNA, 20 nt, Mycobacterium avium subsp. paratuberculosis
gccucgugcaaggccugcgc

SEQ ID NO: 2893051 - RNA, 19 nt, Mycobacterium avium subsp. paratuberculosis
gccucgugcaugugcucgg

SEQ ID NO: 2893052 - RNA, 20 nt, Mycobacterium avium subsp. paratuberculosis
gccucgugcaugugcucggc

SEQ ID NO: 2893053 - RNA, 22 nt, Mycobacterium avium subsp. paratuberculosis
gccucgugcaugugcucggcga

SEQ ID NO: 2893054 - RNA, 14 nt, Mycobacterium avium subsp. paratuberculosis
gccgguguucggcg

SEQ ID NO: 2893055 - RNA, 16 nt, Mycobacterium avium subsp. paratuberculosis
gccgguguugccgacg

SEQ ID NO: 2893056 - RNA, 19 nt, Mycobacterium avium subsp. paratuberculosis
gccgguguugccgacggcg

SEQ ID NO: 2893057 - RNA, 22 nt, Mycobacterium avium subsp. paratuberculosis
gccgguguugccgacggcgccg

SEQ ID NO: 2893058 - RNA, 14 nt, Mycobacterium avium subsp. paratuberculosis
gccgguuccuccga

SEQ ID NO: 2893059 - RNA, 15 nt, Mycobacterium avium subsp. paratuberculosis
gccgguucgcuggcg

SEQ ID NO: 2893060 - RNA, 18 nt, Mycobacterium avium subsp. paratuberculosis
gccgguucgucccgcgcg

SEQ ID NO: 2893061 - RNA, 19 nt, Mycobacterium avium subsp. paratuberculosis
gccgguucgucccgcgcgg

SEQ ID NO: 2893062 - RNA, 18 nt, Mycobacterium avium subsp. paratuberculosis
gccgguugacccucagca

SEQ ID NO: 2893063 - RNA, 21 nt, Mycobacterium avium subsp. paratuberculosis
gccgguugacccucagcaggg

SEQ ID NO: 2893064 - RNA, 22 nt, Mycobacterium avium subsp. paratuberculosis
gccgguugacccucagcagggc

SEQ ID NO: 2893065 - RNA, 16 nt, Mycobacterium avium subsp. paratuberculosis
gccgguugaucacccg

SEQ ID NO: 2893066 - RNA, 20 nt, Mycobacterium avium subsp. paratuberculosis
gccgguugccuuuccgcgcg

SEQ ID NO: 2893067 - RNA, 21 nt, Mycobacterium avium subsp. paratuberculosis
gccgguugccuuuccgcgcgg

SEQ ID NO: 2893068 - RNA, 22 nt, Mycobacterium avium subsp. paratuberculosis
gccgguugccuuuccgcgcggc

SEQ ID NO: 2893069 - RNA, 23 nt, Mycobacterium avium subsp. paratuberculosis
gccgguugccuuuccgcgcggcg

SEQ ID NO: 2893070 - RNA, 22 nt, Mycobacterium avium subsp. paratuberculosis
gccgguugcgguugccccaccc

SEQ ID NO: 2893071 - RNA, 14 nt, Mycobacterium avium subsp. paratuberculosis
gccgguuggcggcc

SEQ ID NO: 2893072 - RNA, 17 nt, Mycobacterium avium subsp. paratuberculosis
gccgguuggcggccggg

SEQ ID NO: 2893073 - RNA, 24 nt, Mycobacterium avium subsp. paratuberculosis
gccgguuggcggccgggucgagcg

SEQ ID NO: 2893074 - RNA, 15 nt, Mycobacterium avium subsp. paratuberculosis
gccgguuggugcgcc

SEQ ID NO: 2893075 - RNA, 18 nt, Mycobacterium avium subsp. paratuberculosis
gccgguuggugcgccguc

SEQ ID NO: 2893076 - RNA, 18 nt, Mycobacterium avium subsp. paratuberculosis
gccgguuguugcggucca

SEQ ID NO: 2893077 - RNA, 24 nt, Mycobacterium avium subsp. paratuberculosis
gccgguuuccaggacgaugcgcgc

SEQ ID NO: 2893078 - RNA, 15 nt, Mycobacterium avium subsp. paratuberculosis
gccgguuucgucggu

SEQ ID NO: 2893079 - RNA, 13 nt, Mycobacterium avium subsp. paratuberculosis
gccguaaccgccg

SEQ ID NO: 2893080 - RNA, 18 nt, Mycobacterium avium subsp. paratuberculosis
gccguaaguggcgccgcg

SEQ ID NO: 2893081 - RNA, 15 nt, Mycobacterium avium subsp. paratuberculosis
gccguacacggcggc

SEQ ID NO: 2893082 - RNA, 16 nt, Mycobacterium avium subsp. paratuberculosis
gccguacacggcggcg

SEQ ID NO: 2893083 - RNA, 19 nt, Mycobacterium avium subsp. paratuberculosis
gccguacacggcggcgaag

SEQ ID NO: 2893084 - RNA, 15 nt, Mycobacterium avium subsp. paratuberculosis
gccguacagcugguc

SEQ ID NO: 2893085 - RNA, 21 nt, Mycobacterium avium subsp. paratuberculosis
gccguacagcugguccggccg

SEQ ID NO: 2893086 - RNA, 23 nt, Mycobacterium avium subsp. paratuberculosis
gccguacagcugguccggccggc

SEQ ID NO: 2893087 - RNA, 21 nt, Mycobacterium avium subsp. paratuberculosis
gccguacauggugaccagcgu

SEQ ID NO: 2893088 - RNA, 16 nt, Mycobacterium avium subsp. paratuberculosis
gccguaccgauccgcg

SEQ ID NO: 2893089 - RNA, 19 nt, Mycobacterium avium subsp. paratuberculosis
gccguaccgauccgcgggc

SEQ ID NO: 2893090 - RNA, 17 nt, Mycobacterium avium subsp. paratuberculosis
gccguaccgcaacaccg

SEQ ID NO: 2893091 - RNA, 12 nt, Mycobacterium avium subsp. paratuberculosis
gccguaccggcg

SEQ ID NO: 2893092 - RNA, 16 nt, Mycobacterium avium subsp. paratuberculosis
gccguacgcgccggcc

SEQ ID NO: 2893093 - RNA, 13 nt, Mycobacterium avium subsp. paratuberculosis
gccguacgcgguu

SEQ ID NO: 2893094 - RNA, 20 nt, Mycobacterium avium subsp. paratuberculosis
gccguacgcgguucgugcgc

SEQ ID NO: 2893095 - RNA, 17 nt, Mycobacterium avium subsp. paratuberculosis
gccguagaauccgccgu

SEQ ID NO: 2893096 - RNA, 20 nt, Mycobacterium avium subsp. paratuberculosis
gccguagaauccgccguuga

SEQ ID NO: 2893097 - RNA, 18 nt, Mycobacterium avium subsp. paratuberculosis
gccguagagccguuuggc

SEQ ID NO: 2893098 - RNA, 22 nt, Mycobacterium avium subsp. paratuberculosis
gccguagagccguuuggcgccg

SEQ ID NO: 2893099 - RNA, 15 nt, Mycobacterium avium subsp. paratuberculosis
gccguagaucacgcc

SEQ ID NO: 2893100 - RNA, 17 nt, Mycobacterium avium subsp. paratuberculosis
gccguagaucacgccgg

SEQ ID NO: 2893101 - RNA, 19 nt, Mycobacterium avium subsp. paratuberculosis
gccguagaucacgccggug

SEQ ID NO: 2893102 - RNA, 23 nt, Mycobacterium avium subsp. paratuberculosis
gccguagaucacgccggugagca

SEQ ID NO: 2893103 - RNA, 15 nt, Mycobacterium avium subsp. paratuberculosis
gccguagaucgucga

SEQ ID NO: 2893104 - RNA, 16 nt, Mycobacterium avium subsp. paratuberculosis
gccguagaucgucgag

SEQ ID NO: 2893105 - RNA, 17 nt, Mycobacterium avium subsp. paratuberculosis
gccguagaucucgcgcc

SEQ ID NO: 2893106 - RNA, 19 nt, Mycobacterium avium subsp. paratuberculosis
gccguagaucucgcgccgc

SEQ ID NO: 2893107 - RNA, 20 nt, Mycobacterium avium subsp. paratuberculosis
gccguagaucucgcgccgcg

SEQ ID NO: 2893108 - RNA, 16 nt, Mycobacterium avium subsp. paratuberculosis
gccguagccggaccgc

SEQ ID NO: 2893109 - RNA, 16 nt, Mycobacterium avium subsp. paratuberculosis
gccguagccggcggug

SEQ ID NO: 2893110 - RNA, 15 nt, Mycobacterium avium subsp. paratuberculosis
gccguagcgagcgcu

SEQ ID NO: 2893111 - RNA, 16 nt, Mycobacterium avium subsp. paratuberculosis
gccguagcgcaacacc

SEQ ID NO: 2893112 - RNA, 21 nt, Mycobacterium avium subsp. paratuberculosis
gccguagcgcugggugaacac

SEQ ID NO: 2893113 - RNA, 15 nt, Mycobacterium avium subsp. paratuberculosis
gccguagcggacgac

SEQ ID NO: 2893114 - RNA, 21 nt, Mycobacterium avium subsp. paratuberculosis
gccguagcggacgacggccag

SEQ ID NO: 2893115 - RNA, 16 nt, Mycobacterium avium subsp. paratuberculosis
gccguagcggcucgcc

SEQ ID NO: 2893116 - RNA, 19 nt, Mycobacterium avium subsp. paratuberculosis
gccguagcggcucgccacc

SEQ ID NO: 2893117 - RNA, 22 nt, Mycobacterium avium subsp. paratuberculosis
gccguagcggcucgccaccucg

SEQ ID NO: 2893118 - RNA, 16 nt, Mycobacterium avium subsp. paratuberculosis
gccguagcggucgccc

SEQ ID NO: 2893119 - RNA, 17 nt, Mycobacterium avium subsp. paratuberculosis
gccguagcggucgcccc

SEQ ID NO: 2893120 - RNA, 18 nt, Mycobacterium avium subsp. paratuberculosis
gccguagcggucgcccca

SEQ ID NO: 2893121 - RNA, 21 nt, Mycobacterium avium subsp. paratuberculosis
gccguagcggucgccccagaa

SEQ ID NO: 2893122 - RNA, 22 nt, Mycobacterium avium subsp. paratuberculosis
gccguagcggucgccccagaac

SEQ ID NO: 2893123 - RNA, 19 nt, Mycobacterium avium subsp. paratuberculosis
gccguaggacaggaacggg

SEQ ID NO: 2893124 - RNA, 22 nt, Mycobacterium avium subsp. paratuberculosis
gccguaggccagguucaggcug

SEQ ID NO: 2893125 - RNA, 15 nt, Mycobacterium avium subsp. paratuberculosis
gccguaggccgcgcu

SEQ ID NO: 2893126 - RNA, 17 nt, Mycobacterium avium subsp. paratuberculosis
gccguaggucgggucga

SEQ ID NO: 2893127 - RNA, 17 nt, Mycobacterium avium subsp. paratuberculosis
gccguaucccaccacga

SEQ ID NO: 2893128 - RNA, 17 nt, Mycobacterium avium subsp. paratuberculosis
gccguaucggccccggc

SEQ ID NO: 2893129 - RNA, 21 nt, Mycobacterium avium subsp. paratuberculosis
gccguaucggccccggccgag

SEQ ID NO: 2893130 - RNA, 15 nt, Mycobacterium avium subsp. paratuberculosis
gccguauucgccgac

SEQ ID NO: 2893131 - RNA, 16 nt, Mycobacterium avium subsp. paratuberculosis
gccguauucgccgacg

SEQ ID NO: 2893132 - RNA, 17 nt, Mycobacterium avium subsp. paratuberculosis
gccguauucgccgacgg

SEQ ID NO: 2893133 - RNA, 16 nt, Mycobacterium avium subsp. paratuberculosis
gccgucacaccgcggc

SEQ ID NO: 2893134 - RNA, 19 nt, Mycobacterium avium subsp. paratuberculosis
gccgucacaccgcggccag

SEQ ID NO: 2893135 - RNA, 20 nt, Mycobacterium avium subsp. paratuberculosis
gccgucacaccgcggccagc

SEQ ID NO: 2893136 - RNA, 14 nt, Mycobacterium avium subsp. paratuberculosis
gccgucacaggccg

SEQ ID NO: 2893137 - RNA, 14 nt, Mycobacterium avium subsp. paratuberculosis
gccgucacccagau

SEQ ID NO: 2893138 - RNA, 14 nt, Mycobacterium avium subsp. paratuberculosis
gccguccggccacg

SEQ ID NO: 2893139 - RNA, 21 nt, Mycobacterium avium subsp. paratuberculosis
gccguccggccacgaccucgg

SEQ ID NO: 2893140 - RNA, 14 nt, Mycobacterium avium subsp. paratuberculosis
gccguccggccggu

SEQ ID NO: 2893141 - RNA, 14 nt, Mycobacterium avium subsp. paratuberculosis
gccguccggcggca

SEQ ID NO: 2893142 - RNA, 16 nt, Mycobacterium avium subsp. paratuberculosis
gccguccgggaacacg

SEQ ID NO: 2893143 - RNA, 19 nt, Mycobacterium avium subsp. paratuberculosis
gccguccgggcacccgacg

SEQ ID NO: 2893144 - RNA, 22 nt, Mycobacterium avium subsp. paratuberculosis
gccguccgggcacccgacgucg

SEQ ID NO: 2893145 - RNA, 13 nt, Mycobacterium avium subsp. paratuberculosis
gccguccggggcc

SEQ ID NO: 2893146 - RNA, 22 nt, Mycobacterium avium subsp. paratuberculosis
gccguccgggguguaggcgucg

SEQ ID NO: 2893147 - RNA, 14 nt, Mycobacterium avium subsp. paratuberculosis
gccguccggguccg

SEQ ID NO: 2893148 - RNA, 15 nt, Mycobacterium avium subsp. paratuberculosis
gccguccggguccgg

SEQ ID NO: 2893149 - RNA, 20 nt, Mycobacterium avium subsp. paratuberculosis
gccguccggguccggcuuca

SEQ ID NO: 2893150 - RNA, 16 nt, Mycobacterium avium subsp. paratuberculosis
gccguccgggugcggg

SEQ ID NO: 2893151 - RNA, 18 nt, Mycobacterium avium subsp. paratuberculosis
gccguccgggugcgggcu

SEQ ID NO: 2893152 - RNA, 23 nt, Mycobacterium avium subsp. paratuberculosis
gccguccggguucgacgccucgg

SEQ ID NO: 2893153 - RNA, 15 nt, Mycobacterium avium subsp. paratuberculosis
gccguccucgcgucg

SEQ ID NO: 2893154 - RNA, 18 nt, Mycobacterium avium subsp. paratuberculosis
gccguccucgcgucgcgc

SEQ ID NO: 2893155 - RNA, 19 nt, Mycobacterium avium subsp. paratuberculosis
gccguccucggccgccacc

SEQ ID NO: 2893156 - RNA, 21 nt, Mycobacterium avium subsp. paratuberculosis
gccguccucggccgccaccgc

SEQ ID NO: 2893157 - RNA, 14 nt, Mycobacterium avium subsp. paratuberculosis
gccguccuggucgu

SEQ ID NO: 2893158 - RNA, 17 nt, Mycobacterium avium subsp. paratuberculosis
gccguccuucucgaacc

SEQ ID NO: 2893159 - RNA, 22 nt, Mycobacterium avium subsp. paratuberculosis
gccguccuucucgaaccggggc

SEQ ID NO: 2893160 - RNA, 13 nt, Mycobacterium avium subsp. paratuberculosis
gccguccuugacg

SEQ ID NO: 2893161 - RNA, 19 nt, Mycobacterium avium subsp. paratuberculosis
gccguccuugacgaacgac

SEQ ID NO: 2893162 - RNA, 22 nt, Mycobacterium avium subsp. paratuberculosis
gccguccuugacgaacgacgug

SEQ ID NO: 2893163 - RNA, 19 nt, Mycobacterium avium subsp. paratuberculosis
gccguccuuggccgccagc

SEQ ID NO: 2893164 - RNA, 20 nt, Mycobacterium avium subsp. paratuberculosis
gccguccuuggccgccagca

SEQ ID NO: 2893165 - RNA, 22 nt, Mycobacterium avium subsp. paratuberculosis
gccguccuuggccgccagcacc

SEQ ID NO: 2893166 - RNA, 16 nt, Mycobacterium avium subsp. paratuberculosis
gccguccuuggucaca

SEQ ID NO: 2893167 - RNA, 20 nt, Mycobacterium avium subsp. paratuberculosis
gccguccuuggucacaaagc

SEQ ID NO: 2893168 - RNA, 23 nt, Mycobacterium avium subsp. paratuberculosis
gccguccuuggucacaaagcccg

SEQ ID NO: 2893169 - RNA, 18 nt, Mycobacterium avium subsp. paratuberculosis
gccguccuugucgcgcac

SEQ ID NO: 2893170 - RNA, 21 nt, Mycobacterium avium subsp. paratuberculosis
gccgucgaaacggcugcugcg

SEQ ID NO: 2893171 - RNA, 22 nt, Mycobacterium avium subsp. paratuberculosis
gccgucgaaacggcugcugcgc

SEQ ID NO: 2893172 - RNA, 16 nt, Mycobacterium avium subsp. paratuberculosis
gccgucgaacugcagc

SEQ ID NO: 2893173 - RNA, 17 nt, Mycobacterium avium subsp. paratuberculosis
gccgucgaaggccgggc

SEQ ID NO: 2893174 - RNA, 18 nt, Mycobacterium avium subsp. paratuberculosis
gccgucgaaggccgggcu

SEQ ID NO: 2893175 - RNA, 14 nt, Mycobacterium avium subsp. paratuberculosis
gccgucgaccacga

SEQ ID NO: 2893176 - RNA, 15 nt, Mycobacterium avium subsp. paratuberculosis
gccgucgaccacgaa

SEQ ID NO: 2893177 - RNA, 16 nt, Mycobacterium avium subsp. paratuberculosis
gccgucgaccacgaag

SEQ ID NO: 2893178 - RNA, 13 nt, Mycobacterium avium subsp. paratuberculosis
gccgucgaccagc

SEQ ID NO: 2893179 - RNA, 14 nt, Mycobacterium avium subsp. paratuberculosis
gccgucgaccagcu

SEQ ID NO: 2893180 - RNA, 14 nt, Mycobacterium avium subsp. paratuberculosis
gccgucgaccccgc

SEQ ID NO: 2893181 - RNA, 16 nt, Mycobacterium avium subsp. paratuberculosis
gccgucgaccccgccg

SEQ ID NO: 2893182 - RNA, 17 nt, Mycobacterium avium subsp. paratuberculosis
gccgucgaccccgccgg

SEQ ID NO: 2893183 - RNA, 19 nt, Mycobacterium avium subsp. paratuberculosis
gccgucgaccccgccggcc

SEQ ID NO: 2893184 - RNA, 23 nt, Mycobacterium avium subsp. paratuberculosis
gccgucgaccccgccggcccggu

SEQ ID NO: 2893185 - RNA, 23 nt, Mycobacterium avium subsp. paratuberculosis
gccgucgacccguuccccggccg

SEQ ID NO: 2893186 - RNA, 12 nt, Mycobacterium avium subsp. paratuberculosis
gccgucgaccgg

SEQ ID NO: 2893187 - RNA, 13 nt, Mycobacterium avium subsp. paratuberculosis
gccgucgaccggg

SEQ ID NO: 2893188 - RNA, 12 nt, Mycobacterium avium subsp. paratuberculosis
gccgucgacgaa

SEQ ID NO: 2893189 - RNA, 14 nt, Mycobacterium avium subsp. paratuberculosis
gccgucgacgaacu

SEQ ID NO: 2893190 - RNA, 16 nt, Mycobacterium avium subsp. paratuberculosis
gccgucgacgaccacc

SEQ ID NO: 2893191 - RNA, 20 nt, Mycobacterium avium subsp. paratuberculosis
gccgucgacgaccaccacca

SEQ ID NO: 2893192 - RNA, 12 nt, Mycobacterium avium subsp. paratuberculosis
gccgucgacgcg

SEQ ID NO: 2893193 - RNA, 22 nt, Mycobacterium avium subsp. paratuberculosis
gccgucgagcagggugacgcga

SEQ ID NO: 2893194 - RNA, 15 nt, Mycobacterium avium subsp. paratuberculosis
gccgucgagccuggu

SEQ ID NO: 2893195 - RNA, 17 nt, Mycobacterium avium subsp. paratuberculosis
gccgucgaggcgcugca

SEQ ID NO: 2893196 - RNA, 19 nt, Mycobacterium avium subsp. paratuberculosis
gccgucgaggcgcugcagc

SEQ ID NO: 2893197 - RNA, 20 nt, Mycobacterium avium subsp. paratuberculosis
gccgucgaggcgcugcagca

SEQ ID NO: 2893198 - RNA, 21 nt, Mycobacterium avium subsp. paratuberculosis
gccgucgagggggagcaggac

SEQ ID NO: 2893199 - RNA, 22 nt, Mycobacterium avium subsp. paratuberculosis
gccgucgagggggagcaggacg

SEQ ID NO: 2893200 - RNA, 18 nt, Mycobacterium avium subsp. paratuberculosis
gccgucgaucaccugcgg

SEQ ID NO: 2893201 - RNA, 20 nt, Mycobacterium avium subsp. paratuberculosis
gccgucgaucaccugcgggc

SEQ ID NO: 2893202 - RNA, 17 nt, Mycobacterium avium subsp. paratuberculosis
gccgucgauccacccac

SEQ ID NO: 2893203 - RNA, 16 nt, Mycobacterium avium subsp. paratuberculosis
gccgucgaucgcccgc

SEQ ID NO: 2893204 - RNA, 17 nt, Mycobacterium avium subsp. paratuberculosis
gccgucgaucgcccgcu

SEQ ID NO: 2893205 - RNA, 16 nt, Mycobacterium avium subsp. paratuberculosis
gccgucgaugccggcg

SEQ ID NO: 2893206 - RNA, 20 nt, Mycobacterium avium subsp. paratuberculosis
gccgucgauggcgcggccca

SEQ ID NO: 2893207 - RNA, 13 nt, Mycobacterium avium subsp. paratuberculosis
gccgucgcaccgc

SEQ ID NO: 2893208 - RNA, 15 nt, Mycobacterium avium subsp. paratuberculosis
gccgucgcaccgccu

SEQ ID NO: 2893209 - RNA, 22 nt, Mycobacterium avium subsp. paratuberculosis
gccgucgcacuagguccggcgc

SEQ ID NO: 2893210 - RNA, 23 nt, Mycobacterium avium subsp. paratuberculosis
gccgucgcacuagguccggcgcg

SEQ ID NO: 2893211 - RNA, 24 nt, Mycobacterium avium subsp. paratuberculosis
gccgucgcacuagguccggcgcga

SEQ ID NO: 2893212 - RNA, 19 nt, Mycobacterium avium subsp. paratuberculosis
gccgucgcaucagcucggc

SEQ ID NO: 2893213 - RNA, 15 nt, Mycobacterium avium subsp. paratuberculosis
gccgucgccaccacc

SEQ ID NO: 2893214 - RNA, 18 nt, Mycobacterium avium subsp. paratuberculosis
gccgucgccaccaccgcg

SEQ ID NO: 2893215 - RNA, 20 nt, Mycobacterium avium subsp. paratuberculosis
gccgucgccaccaccgcgcc

SEQ ID NO: 2893216 - RNA, 15 nt, Mycobacterium avium subsp. paratuberculosis
gccgucgccaccgag

SEQ ID NO: 2893217 - RNA, 18 nt, Mycobacterium avium subsp. paratuberculosis
gccgucgccaccgagucg

SEQ ID NO: 2893218 - RNA, 13 nt, Mycobacterium avium subsp. paratuberculosis
gccgucgcccgga

SEQ ID NO: 2893219 - RNA, 14 nt, Mycobacterium avium subsp. paratuberculosis
gccgucgccgaagu

SEQ ID NO: 2893220 - RNA, 12 nt, Mycobacterium avium subsp. paratuberculosis
gccgucgccgac

SEQ ID NO: 2893221 - RNA, 17 nt, Mycobacterium avium subsp. paratuberculosis
gccgucgccgacguugu

SEQ ID NO: 2893222 - RNA, 18 nt, Mycobacterium avium subsp. paratuberculosis
gccgucgccgaucaccug

SEQ ID NO: 2893223 - RNA, 18 nt, Mycobacterium avium subsp. paratuberculosis
gccggcgcuggcgcgccg

SEQ ID NO: 2893224 - RNA, 17 nt, Mycobacterium avium subsp. paratuberculosis
gccggcgcuggcgugcu

SEQ ID NO: 2893225 - RNA, 14 nt, Mycobacterium avium subsp. paratuberculosis
gccggcgcuucugc

SEQ ID NO: 2893226 - RNA, 20 nt, Mycobacterium avium subsp. paratuberculosis
gccggcgcuucugcgccggu

SEQ ID NO: 2893227 - RNA, 23 nt, Mycobacterium avium subsp. paratuberculosis
gccggcgcuucugcgccgguucg

SEQ ID NO: 2893228 - RNA, 18 nt, Mycobacterium avium subsp. paratuberculosis
gccggcggacagccccga

SEQ ID NO: 2893229 - RNA, 19 nt, Mycobacterium avium subsp. paratuberculosis
gccggcggacgcggccagc

SEQ ID NO: 2893230 - RNA, 22 nt, Mycobacterium avium subsp. paratuberculosis
gccggcggacgcggccagcgcc

SEQ ID NO: 2893231 - RNA, 14 nt, Mycobacterium avium subsp. paratuberculosis
gccggcggaucgcg

SEQ ID NO: 2893232 - RNA, 21 nt, Mycobacterium avium subsp. paratuberculosis
gccggcggaucgcgugcguca

SEQ ID NO: 2893233 - RNA, 15 nt, Mycobacterium avium subsp. paratuberculosis
gccggcggcagguga

SEQ ID NO: 2893234 - RNA, 19 nt, Mycobacterium avium subsp. paratuberculosis
gccggcggcaguccggcga

SEQ ID NO: 2893235 - RNA, 20 nt, Mycobacterium avium subsp. paratuberculosis
gccggcggcaguccggcgag

SEQ ID NO: 2893236 - RNA, 13 nt, Mycobacterium avium subsp. paratuberculosis
gccggcggcagug

SEQ ID NO: 2893237 - RNA, 16 nt, Mycobacterium avium subsp. paratuberculosis
gccggcggcagugcgc

SEQ ID NO: 2893238 - RNA, 17 nt, Mycobacterium avium subsp. paratuberculosis
gccggcggcagugcgcc

SEQ ID NO: 2893239 - RNA, 21 nt, Mycobacterium avium subsp. paratuberculosis
gccggcggccacgaucgcggc

SEQ ID NO: 2893240 - RNA, 23 nt, Mycobacterium avium subsp. paratuberculosis
gccggcggccacgaucgcggcca

SEQ ID NO: 2893241 - RNA, 13 nt, Mycobacterium avium subsp. paratuberculosis
gccggcggccagc

SEQ ID NO: 2893242 - RNA, 16 nt, Mycobacterium avium subsp. paratuberculosis
gccggcggccagcauc

SEQ ID NO: 2893243 - RNA, 19 nt, Mycobacterium avium subsp. paratuberculosis
gccggcggccagcaucgga

SEQ ID NO: 2893244 - RNA, 22 nt, Mycobacterium avium subsp. paratuberculosis
gccggcggccauggucgcggcc

SEQ ID NO: 2893245 - RNA, 12 nt, Mycobacterium avium subsp. paratuberculosis
gccggcggccga

SEQ ID NO: 2893246 - RNA, 13 nt, Mycobacterium avium subsp. paratuberculosis
gccggcggccgac

SEQ ID NO: 2893247 - RNA, 20 nt, Mycobacterium avium subsp. paratuberculosis
gccggcggccgacagggugc

SEQ ID NO: 2893248 - RNA, 16 nt, Mycobacterium avium subsp. paratuberculosis
gccggcggccgccacg

SEQ ID NO: 2893249 - RNA, 14 nt, Mycobacterium avium subsp. paratuberculosis
gccggcggccgccg

SEQ ID NO: 2893250 - RNA, 16 nt, Mycobacterium avium subsp. paratuberculosis
gccggcggccgccgcc

SEQ ID NO: 2893251 - RNA, 17 nt, Mycobacterium avium subsp. paratuberculosis
gccggcggccgccgccc

SEQ ID NO: 2893252 - RNA, 22 nt, Mycobacterium avium subsp. paratuberculosis
gccggcggccgccgcccgcgcg

SEQ ID NO: 2893253 - RNA, 23 nt, Mycobacterium avium subsp. paratuberculosis
gccggcggccgccgcccgcgcgg

SEQ ID NO: 2893254 - RNA, 15 nt, Mycobacterium avium subsp. paratuberculosis
gccggcggccgccgg

SEQ ID NO: 2893255 - RNA, 16 nt, Mycobacterium avium subsp. paratuberculosis
gccggcggccgccggc

SEQ ID NO: 2893256 - RNA, 17 nt, Mycobacterium avium subsp. paratuberculosis
gccggcggccgccggca

SEQ ID NO: 2893257 - RNA, 18 nt, Mycobacterium avium subsp. paratuberculosis
gccggcggccgccggcac

SEQ ID NO: 2893258 - RNA, 13 nt, Mycobacterium avium subsp. paratuberculosis
gccggcggccgcg

SEQ ID NO: 2893259 - RNA, 14 nt, Mycobacterium avium subsp. paratuberculosis
gccggcggccgcga

SEQ ID NO: 2893260 - RNA, 16 nt, Mycobacterium avium subsp. paratuberculosis
gccggcggccgcgacg

SEQ ID NO: 2893261 - RNA, 15 nt, Mycobacterium avium subsp. paratuberculosis
gccggcggccuccgc

SEQ ID NO: 2893262 - RNA, 17 nt, Mycobacterium avium subsp. paratuberculosis
gccggcggccuccgcca

SEQ ID NO: 2893263 - RNA, 19 nt, Mycobacterium avium subsp. paratuberculosis
gccggcggcgaagccggcc

SEQ ID NO: 2893264 - RNA, 20 nt, Mycobacterium avium subsp. paratuberculosis
gccggcggcgcccgcggccu

SEQ ID NO: 2893265 - RNA, 15 nt, Mycobacterium avium subsp. paratuberculosis
gccggcggcgccgga

SEQ ID NO: 2893266 - RNA, 14 nt, Mycobacterium avium subsp. paratuberculosis
gccggcggcgcggc

SEQ ID NO: 2893267 - RNA, 12 nt, Mycobacterium avium subsp. paratuberculosis
gccggcggcgga

SEQ ID NO: 2893268 - RNA, 17 nt, Mycobacterium avium subsp. paratuberculosis
gccggcggcggccagcg

SEQ ID NO: 2893269 - RNA, 18 nt, Mycobacterium avium subsp. paratuberculosis
gccggcggcggccagcga

SEQ ID NO: 2893270 - RNA, 19 nt, Mycobacterium avium subsp. paratuberculosis
gccggcggcggccagcgag

SEQ ID NO: 2893271 - RNA, 23 nt, Mycobacterium avium subsp. paratuberculosis
gccggcggcggccagcgagucga

SEQ ID NO: 2893272 - RNA, 18 nt, Mycobacterium avium subsp. paratuberculosis
gccggcggcggcgguccg

SEQ ID NO: 2893273 - RNA, 19 nt, Mycobacterium avium subsp. paratuberculosis
gccggcggcggcggucggc

SEQ ID NO: 2893274 - RNA, 21 nt, Mycobacterium avium subsp. paratuberculosis
gccggcggcggcggucggcau

SEQ ID NO: 2893275 - RNA, 12 nt, Mycobacterium avium subsp. paratuberculosis
gccggcggcggg

SEQ ID NO: 2893276 - RNA, 17 nt, Mycobacterium avium subsp. paratuberculosis
gccggcggcgggcucgg

SEQ ID NO: 2893277 - RNA, 14 nt, Mycobacterium avium subsp. paratuberculosis
gccggcggcggugc

SEQ ID NO: 2893278 - RNA, 20 nt, Mycobacterium avium subsp. paratuberculosis
gccggcggcgucccacgugg

SEQ ID NO: 2893279 - RNA, 16 nt, Mycobacterium avium subsp. paratuberculosis
gccggcggcgucguga

SEQ ID NO: 2893280 - RNA, 21 nt, Mycobacterium avium subsp. paratuberculosis
gccggcggcgucgugaccgac

SEQ ID NO: 2893281 - RNA, 19 nt, Mycobacterium avium subsp. paratuberculosis
gccggcggcguugaggcgu

SEQ ID NO: 2893282 - RNA, 12 nt, Mycobacterium avium subsp. paratuberculosis
gccggcgggcgc

SEQ ID NO: 2893283 - RNA, 15 nt, Mycobacterium avium subsp. paratuberculosis
gccggcgggcgcucg

SEQ ID NO: 2893284 - RNA, 17 nt, Mycobacterium avium subsp. paratuberculosis
gccggcggggcgggggc

SEQ ID NO: 2893285 - RNA, 13 nt, Mycobacterium avium subsp. paratuberculosis
gccggcggggcgu

SEQ ID NO: 2893286 - RNA, 15 nt, Mycobacterium avium subsp. paratuberculosis
gccggcggggcgucg

SEQ ID NO: 2893287 - RNA, 18 nt, Mycobacterium avium subsp. paratuberculosis
gccggcggggcgucgccc

SEQ ID NO: 2893288 - RNA, 22 nt, Mycobacterium avium subsp. paratuberculosis
gccggcggggcgucgcccgccg

SEQ ID NO: 2893289 - RNA, 23 nt, Mycobacterium avium subsp. paratuberculosis
gccggcggggcgucgcccgccga

SEQ ID NO: 2893290 - RNA, 19 nt, Mycobacterium avium subsp. paratuberculosis
gccggcgggggcgcguccg

SEQ ID NO: 2893291 - RNA, 20 nt, Mycobacterium avium subsp. paratuberculosis
gccggcggggguucgacguc

SEQ ID NO: 2893292 - RNA, 23 nt, Mycobacterium avium subsp. paratuberculosis
gccggcggggugggcaccuggcc

SEQ ID NO: 2893293 - RNA, 15 nt, Mycobacterium avium subsp. paratuberculosis
gccggcgggucagca

SEQ ID NO: 2893294 - RNA, 18 nt, Mycobacterium avium subsp. paratuberculosis
gccggcgggucagcagcg

SEQ ID NO: 2893295 - RNA, 19 nt, Mycobacterium avium subsp. paratuberculosis
gccggcgggugagccgguc

SEQ ID NO: 2893296 - RNA, 20 nt, Mycobacterium avium subsp. paratuberculosis
gccggcgggugagccggucg

SEQ ID NO: 2893297 - RNA, 21 nt, Mycobacterium avium subsp. paratuberculosis
gccggcgggugagccggucga

SEQ ID NO: 2893298 - RNA, 20 nt, Mycobacterium avium subsp. paratuberculosis
gccggcggguuggccgucga

SEQ ID NO: 2893299 - RNA, 14 nt, Mycobacterium avium subsp. paratuberculosis
gccggcgguaccgc

SEQ ID NO: 2893300 - RNA, 16 nt, Mycobacterium avium subsp. paratuberculosis
gccggcgguaccgccg

SEQ ID NO: 2893301 - RNA, 20 nt, Mycobacterium avium subsp. paratuberculosis
gccggcgguaccgccgaucg

SEQ ID NO: 2893302 - RNA, 13 nt, Mycobacterium avium subsp. paratuberculosis
gccggcggucagg

SEQ ID NO: 2893303 - RNA, 14 nt, Mycobacterium avium subsp. paratuberculosis
gccggcggucgaca

SEQ ID NO: 2893304 - RNA, 22 nt, Mycobacterium avium subsp. paratuberculosis
gccggcggucgacacgaucggc

SEQ ID NO: 2893305 - RNA, 14 nt, Mycobacterium avium subsp. paratuberculosis
gccggcggugcggg

SEQ ID NO: 2893306 - RNA, 16 nt, Mycobacterium avium subsp. paratuberculosis
gccggcggugcgggug

SEQ ID NO: 2893307 - RNA, 16 nt, Mycobacterium avium subsp. paratuberculosis
gccggcggugcgucga

SEQ ID NO: 2893308 - RNA, 16 nt, Mycobacterium avium subsp. paratuberculosis
gccggcugcagccggg

SEQ ID NO: 2893309 - RNA, 17 nt, Mycobacterium avium subsp. paratuberculosis
gccggcugcagccgggc

SEQ ID NO: 2893310 - RNA, 19 nt, Mycobacterium avium subsp. paratuberculosis
gccggcugcagccgggcgg

SEQ ID NO: 2893311 - RNA, 15 nt, Mycobacterium avium subsp. paratuberculosis
gccggcugcccgcga

SEQ ID NO: 2893312 - RNA, 16 nt, Mycobacterium avium subsp. paratuberculosis
gccggcugcccgcgac

SEQ ID NO: 2893313 - RNA, 17 nt, Mycobacterium avium subsp. paratuberculosis
gccggcugcccgcgacu

SEQ ID NO: 2893314 - RNA, 14 nt, Mycobacterium avium subsp. paratuberculosis
gccggcuggcgggc

SEQ ID NO: 2893315 - RNA, 16 nt, Mycobacterium avium subsp. paratuberculosis
gccggcuggcgggcga

SEQ ID NO: 2893316 - RNA, 19 nt, Mycobacterium avium subsp. paratuberculosis
gccggcuuaccgaccucga

SEQ ID NO: 2893317 - RNA, 21 nt, Mycobacterium avium subsp. paratuberculosis
gccggcuuccucgcggaaccg

SEQ ID NO: 2893318 - RNA, 12 nt, Mycobacterium avium subsp. paratuberculosis
gccggcuucggc

SEQ ID NO: 2893319 - RNA, 15 nt, Mycobacterium avium subsp. paratuberculosis
gccggcuucggccaa

SEQ ID NO: 2893320 - RNA, 15 nt, Mycobacterium avium subsp. paratuberculosis
gccggcuucucggcg

SEQ ID NO: 2893321 - RNA, 22 nt, Mycobacterium avium subsp. paratuberculosis
gccggcuucucggcgugcccgc

SEQ ID NO: 2893322 - RNA, 18 nt, Mycobacterium avium subsp. paratuberculosis
gccggcuugaucucgacc

SEQ ID NO: 2893323 - RNA, 16 nt, Mycobacterium avium subsp. paratuberculosis
gccggcuugccccggu

SEQ ID NO: 2893324 - RNA, 17 nt, Mycobacterium avium subsp. paratuberculosis
gccggcuugggcgaauc

SEQ ID NO: 2893325 - RNA, 21 nt, Mycobacterium avium subsp. paratuberculosis
gccggcuuucgaagagccggc

SEQ ID NO: 2893326 - RNA, 22 nt, Mycobacterium avium subsp. paratuberculosis
gccggcuuucgaagagccggcg

SEQ ID NO: 2893327 - RNA, 22 nt, Mycobacterium avium subsp. paratuberculosis
gccgggaaaguuguagcgcagc

SEQ ID NO: 2893328 - RNA, 20 nt, Mycobacterium avium subsp. paratuberculosis
gccgggaacagcgacgccca

SEQ ID NO: 2893329 - RNA, 21 nt, Mycobacterium avium subsp. paratuberculosis
gccgggaacagcgacgcccag

SEQ ID NO: 2893330 - RNA, 18 nt, Mycobacterium avium subsp. paratuberculosis
gccgggaagcgaagcggg

SEQ ID NO: 2893331 - RNA, 14 nt, Mycobacterium avium subsp. paratuberculosis
gccgggaaguuggc

SEQ ID NO: 2893332 - RNA, 20 nt, Mycobacterium avium subsp. paratuberculosis
gccgggaaguuggccuccca

SEQ ID NO: 2893333 - RNA, 16 nt, Mycobacterium avium subsp. paratuberculosis
gccgggaaucgagggc

SEQ ID NO: 2893334 - RNA, 21 nt, Mycobacterium avium subsp. paratuberculosis
gccgggaaucgagggcgcgca

SEQ ID NO: 2893335 - RNA, 22 nt, Mycobacterium avium subsp. paratuberculosis
gccgggaaucgagggcgcgcag

SEQ ID NO: 2893336 - RNA, 16 nt, Mycobacterium avium subsp. paratuberculosis
gccgggaaugucgcgc

SEQ ID NO: 2893337 - RNA, 22 nt, Mycobacterium avium subsp. paratuberculosis
gccgggaaugucgcgcagcauc

SEQ ID NO: 2893338 - RNA, 19 nt, Mycobacterium avium subsp. paratuberculosis
gccgggacagguagcgcag

SEQ ID NO: 2893339 - RNA, 21 nt, Mycobacterium avium subsp. paratuberculosis
gccgggacagguagcgcagcc

SEQ ID NO: 2893340 - RNA, 12 nt, Mycobacterium avium subsp. paratuberculosis
gccgggacgcgg

SEQ ID NO: 2893341 - RNA, 19 nt, Mycobacterium avium subsp. paratuberculosis
gccgggacgggcauccggc

SEQ ID NO: 2893342 - RNA, 21 nt, Mycobacterium avium subsp. paratuberculosis
gccgggagauacggucgcacc

SEQ ID NO: 2893343 - RNA, 22 nt, Mycobacterium avium subsp. paratuberculosis
gccgggagugcuggacggcccg

SEQ ID NO: 2893344 - RNA, 17 nt, Mycobacterium avium subsp. paratuberculosis
gccgggauauucgccca

SEQ ID NO: 2893345 - RNA, 21 nt, Mycobacterium avium subsp. paratuberculosis
gccgggauauucgcccagcgg

SEQ ID NO: 2893346 - RNA, 23 nt, Mycobacterium avium subsp. paratuberculosis
gccgggauauucgcccagcggca

SEQ ID NO: 2893347 - RNA, 13 nt, Mycobacterium avium subsp. paratuberculosis
gccgggaucacac

SEQ ID NO: 2893348 - RNA, 18 nt, Mycobacterium avium subsp. paratuberculosis
gccgggaucacacgcgcg

SEQ ID NO: 2893349 - RNA, 17 nt, Mycobacterium avium subsp. paratuberculosis
gccgggaucggcagcgc

SEQ ID NO: 2893350 - RNA, 14 nt, Mycobacterium avium subsp. paratuberculosis
gccgggaucggcgg

SEQ ID NO: 2893351 - RNA, 15 nt, Mycobacterium avium subsp. paratuberculosis
gccgggaucggcggg

SEQ ID NO: 2893352 - RNA, 20 nt, Mycobacterium avium subsp. paratuberculosis
gccgggaucggcggggcgcg

SEQ ID NO: 2893353 - RNA, 17 nt, Mycobacterium avium subsp. paratuberculosis
gccgggaugcgccaccg

SEQ ID NO: 2893354 - RNA, 18 nt, Mycobacterium avium subsp. paratuberculosis
gccgggaugcgccaccga

SEQ ID NO: 2893355 - RNA, 18 nt, Mycobacterium avium subsp. paratuberculosis
gccgggauggugagcccg

SEQ ID NO: 2893356 - RNA, 23 nt, Mycobacterium avium subsp. paratuberculosis
gccgggauggugagcccgaugcu

SEQ ID NO: 2893357 - RNA, 21 nt, Mycobacterium avium subsp. paratuberculosis
gccgggauuucccgggcgauc

SEQ ID NO: 2893358 - RNA, 17 nt, Mycobacterium avium subsp. paratuberculosis
gccgggcaacagcgcgc

SEQ ID NO: 2893359 - RNA, 20 nt, Mycobacterium avium subsp. paratuberculosis
gccgggcaacagcgcgccgg

SEQ ID NO: 2893360 - RNA, 23 nt, Mycobacterium avium subsp. paratuberculosis
gccgggcaacagcgcgccggccg

SEQ ID NO: 2893361 - RNA, 19 nt, Mycobacterium avium subsp. paratuberculosis
gccgggcaaccacagcggc

SEQ ID NO: 2893362 - RNA, 20 nt, Mycobacterium avium subsp. paratuberculosis
gccgggcaaccacagcggcg

SEQ ID NO: 2893363 - RNA, 21 nt, Mycobacterium avium subsp. paratuberculosis
gccgggcaaccacagcggcgc

SEQ ID NO: 2893364 - RNA, 13 nt, Mycobacterium avium subsp. paratuberculosis
gccgggcaccacc

SEQ ID NO: 2893365 - RNA, 15 nt, Mycobacterium avium subsp. paratuberculosis
gccgggcaccagcga

SEQ ID NO: 2893366 - RNA, 16 nt, Mycobacterium avium subsp. paratuberculosis
gccgggcaccagcgac

SEQ ID NO: 2893367 - RNA, 18 nt, Mycobacterium avium subsp. paratuberculosis
gccgggcaccagcgacag

SEQ ID NO: 2893368 - RNA, 13 nt, Mycobacterium avium subsp. paratuberculosis
gccgggcacccgg

SEQ ID NO: 2893369 - RNA, 15 nt, Mycobacterium avium subsp. paratuberculosis
gccgggcacccgggu

SEQ ID NO: 2893370 - RNA, 13 nt, Mycobacterium avium subsp. paratuberculosis
gccgggcaccgcg

SEQ ID NO: 2893371 - RNA, 14 nt, Mycobacterium avium subsp. paratuberculosis
gccgggcaccgcgc

SEQ ID NO: 2893372 - RNA, 23 nt, Mycobacterium avium subsp. paratuberculosis
gccgggcaccgcgcccgccccgu

SEQ ID NO: 2893373 - RNA, 21 nt, Mycobacterium avium subsp. paratuberculosis
gccgggcaccucggcgucggc

SEQ ID NO: 2893374 - RNA, 18 nt, Mycobacterium avium subsp. paratuberculosis
gccgggcacgaauucggu

SEQ ID NO: 2893375 - RNA, 22 nt, Mycobacterium avium subsp. paratuberculosis
gccgggcacgaauucgguggcg

SEQ ID NO: 2893376 - RNA, 14 nt, Mycobacterium avium subsp. paratuberculosis
gccgggcacgucga

SEQ ID NO: 2893377 - RNA, 19 nt, Mycobacterium avium subsp. paratuberculosis
gccgggcacgucgacgccc

SEQ ID NO: 2893378 - RNA, 22 nt, Mycobacterium avium subsp. paratuberculosis
gccgggcacgucgacgcccugc

SEQ ID NO: 2893379 - RNA, 15 nt, Mycobacterium avium subsp. paratuberculosis
gccgggcacucccuu

SEQ ID NO: 2893380 - RNA, 16 nt, Mycobacterium avium subsp. paratuberculosis
gccgggcagcccgccg

SEQ ID NO: 2893381 - RNA, 13 nt, Mycobacterium avium subsp. paratuberculosis
gccgggcagcgcg

SEQ ID NO: 2893382 - RNA, 15 nt, Mycobacterium avium subsp. paratuberculosis
gccgggcagcgcgcg

SEQ ID NO: 2893383 - RNA, 16 nt, Mycobacterium avium subsp. paratuberculosis
gccgggcagcggcccc

SEQ ID NO: 2893384 - RNA, 19 nt, Mycobacterium avium subsp. paratuberculosis
gccgggcagguggucggcg

SEQ ID NO: 2893385 - RNA, 14 nt, Mycobacterium avium subsp. paratuberculosis
gccgggcagugcgc

SEQ ID NO: 2893386 - RNA, 15 nt, Mycobacterium avium subsp. paratuberculosis
gccgggcauccgggc

SEQ ID NO: 2893387 - RNA, 20 nt, Mycobacterium avium subsp. paratuberculosis
gccgggcauccgggccgccg

SEQ ID NO: 2893388 - RNA, 23 nt, Mycobacterium avium subsp. paratuberculosis
gccgggcauccgggccgccgcgg

SEQ ID NO: 2893389 - RNA, 19 nt, Mycobacterium avium subsp. paratuberculosis
gccgggcaucucguugucg

SEQ ID NO: 2893390 - RNA, 17 nt, Mycobacterium avium subsp. paratuberculosis
gccgggcaugccguuca

SEQ ID NO: 2893391 - RNA, 19 nt, Mycobacterium avium subsp. paratuberculosis
gccgggcaugccguucagc

SEQ ID NO: 2893392 - RNA, 12 nt, Mycobacterium avium subsp. paratuberculosis
gccgggcgucga

SEQ ID NO: 2893393 - RNA, 14 nt, Mycobacterium avium subsp. paratuberculosis
gccgggcgucgacg

SEQ ID NO: 2893394 - RNA, 16 nt, Mycobacterium avium subsp. paratuberculosis
gccgggcgucgcgcuc

SEQ ID NO: 2893395 - RNA, 16 nt, Mycobacterium avium subsp. paratuberculosis
gccgggcgugcccggc

SEQ ID NO: 2893396 - RNA, 19 nt, Mycobacterium avium subsp. paratuberculosis
gccgggcgugcccggcgca

SEQ ID NO: 2893397 - RNA, 22 nt, Mycobacterium avium subsp. paratuberculosis
gccgggcgugcccggcgcacag

SEQ ID NO: 2893398 - RNA, 19 nt, Mycobacterium avium subsp. paratuberculosis
gccgggcguugcccgccgc

SEQ ID NO: 2893399 - RNA, 13 nt, Mycobacterium avium subsp. paratuberculosis
gccgggcucccgc

SEQ ID NO: 2893400 - RNA, 17 nt, Mycobacterium avium subsp. paratuberculosis
gccgggcuccgcguucg

SEQ ID NO: 2893401 - RNA, 13 nt, Mycobacterium avium subsp. paratuberculosis
gccgggcucgagg

SEQ ID NO: 2893402 - RNA, 16 nt, Mycobacterium avium subsp. paratuberculosis
gccgggcucgagggcg

SEQ ID NO: 2893403 - RNA, 19 nt, Mycobacterium avium subsp. paratuberculosis
gccgggcucgagggcggcg

SEQ ID NO: 2893404 - RNA, 22 nt, Mycobacterium avium subsp. paratuberculosis
gccgggcucgaguuuggccagc

SEQ ID NO: 2893405 - RNA, 12 nt, Mycobacterium avium subsp. paratuberculosis
gccgggcugacc

SEQ ID NO: 2893406 - RNA, 17 nt, Mycobacterium avium subsp. paratuberculosis
gccgggcugaccgucga

SEQ ID NO: 2893407 - RNA, 20 nt, Mycobacterium avium subsp. paratuberculosis
gccgggcugaccgucgacca

SEQ ID NO: 2893408 - RNA, 22 nt, Mycobacterium avium subsp. paratuberculosis
gccgggcugaccgucgaccaac

SEQ ID NO: 2893409 - RNA, 18 nt, Mycobacterium avium subsp. paratuberculosis
gccgggcugagcugugcc

SEQ ID NO: 2893410 - RNA, 18 nt, Mycobacterium avium subsp. paratuberculosis
gccgggcugcccaccacc

SEQ ID NO: 2893411 - RNA, 19 nt, Mycobacterium avium subsp. paratuberculosis
gccgggcugcccaccacca

SEQ ID NO: 2893412 - RNA, 18 nt, Mycobacterium avium subsp. paratuberculosis
gccgggcugcgcagcacc

SEQ ID NO: 2893413 - RNA, 22 nt, Mycobacterium avium subsp. paratuberculosis
gccgggcuggccgucggcgaug

SEQ ID NO: 2893414 - RNA, 19 nt, Mycobacterium avium subsp. paratuberculosis
gccgggcugguccggaacc

SEQ ID NO: 2893415 - RNA, 20 nt, Mycobacterium avium subsp. paratuberculosis
gccgggcugguccggaaccg

SEQ ID NO: 2893416 - RNA, 23 nt, Mycobacterium avium subsp. paratuberculosis
gccgggcuuccccaaccuggacg

SEQ ID NO: 2893417 - RNA, 18 nt, Mycobacterium avium subsp. paratuberculosis
gccggggaacaccggcga

SEQ ID NO: 2893418 - RNA, 21 nt, Mycobacterium avium subsp. paratuberculosis
gccggggaacaccggcgaggu

SEQ ID NO: 2893419 - RNA, 15 nt, Mycobacterium avium subsp. paratuberculosis
gccggggacccgcac

SEQ ID NO: 2893420 - RNA, 16 nt, Mycobacterium avium subsp. paratuberculosis
gccggggacgacggcg

SEQ ID NO: 2893421 - RNA, 23 nt, Mycobacterium avium subsp. paratuberculosis
gccggggacgacggcggggaugc

SEQ ID NO: 2893422 - RNA, 16 nt, Mycobacterium avium subsp. paratuberculosis
gccggggacggugcag

SEQ ID NO: 2893423 - RNA, 17 nt, Mycobacterium avium subsp. paratuberculosis
gccggggacggugcagc

SEQ ID NO: 2893424 - RNA, 18 nt, Mycobacterium avium subsp. paratuberculosis
gccggggacggugcagcc

SEQ ID NO: 2893425 - RNA, 22 nt, Mycobacterium avium subsp. paratuberculosis
gccggggacggugcagccgggg

SEQ ID NO: 2893426 - RNA, 13 nt, Mycobacterium avium subsp. paratuberculosis
gccggggaucgcg

SEQ ID NO: 2893427 - RNA, 17 nt, Mycobacterium avium subsp. paratuberculosis
gccggggaucgcgcagc

SEQ ID NO: 2893428 - RNA, 11 nt, Mycobacterium avium subsp. paratuberculosis
gccggggcacc

SEQ ID NO: 2893429 - RNA, 13 nt, Mycobacterium avium subsp. paratuberculosis
gccggggcaccau

SEQ ID NO: 2893430 - RNA, 15 nt, Mycobacterium avium subsp. paratuberculosis
gccggggcagacccg

SEQ ID NO: 2893431 - RNA, 20 nt, Mycobacterium avium subsp. paratuberculosis
gccggggcagacccgcgucg

SEQ ID NO: 2893432 - RNA, 22 nt, Mycobacterium avium subsp. paratuberculosis
gccggggcagacccgcgucgau

SEQ ID NO: 2893433 - RNA, 13 nt, Mycobacterium avium subsp. paratuberculosis
gccggggcagcac

SEQ ID NO: 2893434 - RNA, 18 nt, Mycobacterium avium subsp. paratuberculosis
gccggggcagcacccgca

SEQ ID NO: 2893435 - RNA, 19 nt, Mycobacterium avium subsp. paratuberculosis
gccggggcagcacccgcac

SEQ ID NO: 2893436 - RNA, 13 nt, Mycobacterium avium subsp. paratuberculosis
gccggggccagca

SEQ ID NO: 2893437 - RNA, 16 nt, Mycobacterium avium subsp. paratuberculosis
gccggggccagcaccc

SEQ ID NO: 2893438 - RNA, 22 nt, Mycobacterium avium subsp. paratuberculosis
gccggggcccucgcucaacccg

SEQ ID NO: 2893439 - RNA, 13 nt, Mycobacterium avium subsp. paratuberculosis
gccggggccgcgg

SEQ ID NO: 2893440 - RNA, 15 nt, Mycobacterium avium subsp. paratuberculosis
gccggggccgcggcu

SEQ ID NO: 2893441 - RNA, 12 nt, Mycobacterium avium subsp. paratuberculosis
gccggggccggc

SEQ ID NO: 2893442 - RNA, 13 nt, Mycobacterium avium subsp. paratuberculosis
gccggggccggcg

SEQ ID NO: 2893443 - RNA, 14 nt, Mycobacterium avium subsp. paratuberculosis
gccggggccggcga

SEQ ID NO: 2893444 - RNA, 19 nt, Mycobacterium avium subsp. paratuberculosis
gccggggccuucuuggcgg

SEQ ID NO: 2893445 - RNA, 22 nt, Mycobacterium avium subsp. paratuberculosis
gccggggccuucuuggcggcgg

SEQ ID NO: 2893446 - RNA, 15 nt, Mycobacterium avium subsp. paratuberculosis
gccggggcgaccagu

SEQ ID NO: 2893447 - RNA, 19 nt, Mycobacterium avium subsp. paratuberculosis
gccggggcgcagcugcagc

SEQ ID NO: 2893448 - RNA, 21 nt, Mycobacterium avium subsp. paratuberculosis
gccggggcgcagcugcagcuc

SEQ ID NO: 2893449 - RNA, 13 nt, Mycobacterium avium subsp. paratuberculosis
gccggggcgccac

SEQ ID NO: 2893450 - RNA, 16 nt, Mycobacterium avium subsp. paratuberculosis
gccggggcgccgccga

SEQ ID NO: 2893451 - RNA, 13 nt, Mycobacterium avium subsp. paratuberculosis
gccggggcggcgg

SEQ ID NO: 2893452 - RNA, 14 nt, Mycobacterium avium subsp. paratuberculosis
gccggggcggcggu

SEQ ID NO: 2893453 - RNA, 15 nt, Mycobacterium avium subsp. paratuberculosis
gccggggcggcggua

SEQ ID NO: 2893454 - RNA, 20 nt, Mycobacterium avium subsp. paratuberculosis
gccggggcgucggacgccag

SEQ ID NO: 2893455 - RNA, 21 nt, Mycobacterium avium subsp. paratuberculosis
gccggggcuucgaacgcccgc

SEQ ID NO: 2893456 - RNA, 23 nt, Mycobacterium avium subsp. paratuberculosis
gccggggcuucgaacgcccgcac

SEQ ID NO: 2893457 - RNA, 18 nt, Mycobacterium avium subsp. paratuberculosis
gccgggggagucggggug

SEQ ID NO: 2893458 - RNA, 15 nt, Mycobacterium avium subsp. paratuberculosis
gccgggggccgagca

SEQ ID NO: 2893459 - RNA, 14 nt, Mycobacterium avium subsp. paratuberculosis
gccgggggcgcggg

SEQ ID NO: 2893460 - RNA, 17 nt, Mycobacterium avium subsp. paratuberculosis
gccgggggcgcgggcgg

SEQ ID NO: 2893461 - RNA, 13 nt, Mycobacterium avium subsp. paratuberculosis
gccgggggcggcg

SEQ ID NO: 2893462 - RNA, 14 nt, Mycobacterium avium subsp. paratuberculosis
gccgggggcggcgg

SEQ ID NO: 2893463 - RNA, 16 nt, Mycobacterium avium subsp. paratuberculosis
gccgggggcggcggcg

SEQ ID NO: 2893464 - RNA, 18 nt, Mycobacterium avium subsp. paratuberculosis
gccgggggcggcggcgcg

SEQ ID NO: 2893465 - RNA, 13 nt, Mycobacterium avium subsp. paratuberculosis
gccgggggcggug

SEQ ID NO: 2893466 - RNA, 17 nt, Mycobacterium avium subsp. paratuberculosis
gccgggggcggugcagc

SEQ ID NO: 2893467 - RNA, 21 nt, Mycobacterium avium subsp. paratuberculosis
gccgggggcggugcagccggg

SEQ ID NO: 2893468 - RNA, 22 nt, Mycobacterium avium subsp. paratuberculosis
gccgggggcggugcagccgggu

SEQ ID NO: 2893469 - RNA, 16 nt, Mycobacterium avium subsp. paratuberculosis
gccggggggaggucgc

SEQ ID NO: 2893470 - RNA, 20 nt, Mycobacterium avium subsp. paratuberculosis
gccgggguagaggccgcgga

SEQ ID NO: 2893471 - RNA, 22 nt, Mycobacterium avium subsp. paratuberculosis
gccgggguagaggccgcggauc

SEQ ID NO: 2893472 - RNA, 19 nt, Mycobacterium avium subsp. paratuberculosis
gccgggguagggcggcggg

SEQ ID NO: 2893473 - RNA, 23 nt, Mycobacterium avium subsp. paratuberculosis
gccgggguagggcggcgggguuc

SEQ ID NO: 2893474 - RNA, 16 nt, Mycobacterium avium subsp. paratuberculosis
gccgggguccgcaacg

SEQ ID NO: 2893475 - RNA, 21 nt, Mycobacterium avium subsp. paratuberculosis
gccgggguccgcaacgccggc

SEQ ID NO: 2893476 - RNA, 21 nt, Mycobacterium avium subsp. paratuberculosis
gccgggguccucucggcgccg

SEQ ID NO: 2893477 - RNA, 22 nt, Mycobacterium avium subsp. paratuberculosis
gccgguagccgcucgcccagcg

SEQ ID NO: 2893478 - RNA, 16 nt, Mycobacterium avium subsp. paratuberculosis
gccgguaggccgcgcc

SEQ ID NO: 2893479 - RNA, 17 nt, Mycobacterium avium subsp. paratuberculosis
gccgguaggccgcgccg

SEQ ID NO: 2893480 - RNA, 17 nt, Mycobacterium avium subsp. paratuberculosis
gccgguaggccugcguc

SEQ ID NO: 2893481 - RNA, 14 nt, Mycobacterium avium subsp. paratuberculosis
gccgguaggcgcgg

SEQ ID NO: 2893482 - RNA, 17 nt, Mycobacterium avium subsp. paratuberculosis
gccgguaggcgcgggug

SEQ ID NO: 2893483 - RNA, 15 nt, Mycobacterium avium subsp. paratuberculosis
gccgguaggcggcca

SEQ ID NO: 2893484 - RNA, 16 nt, Mycobacterium avium subsp. paratuberculosis
gccgguaggcggccag

SEQ ID NO: 2893485 - RNA, 17 nt, Mycobacterium avium subsp. paratuberculosis
gccgguaggcggccagc

SEQ ID NO: 2893486 - RNA, 18 nt, Mycobacterium avium subsp. paratuberculosis
gccgguaggcggccagcg

SEQ ID NO: 2893487 - RNA, 21 nt, Mycobacterium avium subsp. paratuberculosis
gccgguaggcggccagcgccc

SEQ ID NO: 2893488 - RNA, 18 nt, Mycobacterium avium subsp. paratuberculosis
gccggcaacaacgccagc

SEQ ID NO: 2893489 - RNA, 20 nt, Mycobacterium avium subsp. paratuberculosis
gccggcaacaacgccagcgu

SEQ ID NO: 2893490 - RNA, 22 nt, Mycobacterium avium subsp. paratuberculosis
gccggcaacaacgccagcguga

SEQ ID NO: 2893491 - RNA, 12 nt, Mycobacterium avium subsp. paratuberculosis
gccggcaaccgc

SEQ ID NO: 2893492 - RNA, 15 nt, Mycobacterium avium subsp. paratuberculosis
gccggcaacgacccg

SEQ ID NO: 2893493 - RNA, 16 nt, Mycobacterium avium subsp. paratuberculosis
gccggcaacgacccgu

SEQ ID NO: 2893494 - RNA, 17 nt, Mycobacterium avium subsp. paratuberculosis
gccggcaacucccgauc

SEQ ID NO: 2893495 - RNA, 17 nt, Mycobacterium avium subsp. paratuberculosis
gccggcacaccgagcga

SEQ ID NO: 2893496 - RNA, 19 nt, Mycobacterium avium subsp. paratuberculosis
gccggcacaccgagcgagc

SEQ ID NO: 2893497 - RNA, 13 nt, Mycobacterium avium subsp. paratuberculosis
gccggcaccagca

SEQ ID NO: 2893498 - RNA, 14 nt, Mycobacterium avium subsp. paratuberculosis
gccggcaccagcag

SEQ ID NO: 2893499 - RNA, 16 nt, Mycobacterium avium subsp. paratuberculosis
gccggcaccagcagcc

SEQ ID NO: 2893500 - RNA, 17 nt, Mycobacterium avium subsp. paratuberculosis
gccggcaccagcagccg

SEQ ID NO: 2893501 - RNA, 21 nt, Mycobacterium avium subsp. paratuberculosis
gccggcaccagcagccgcagc

SEQ ID NO: 2893502 - RNA, 22 nt, Mycobacterium avium subsp. paratuberculosis
gccggcaccagcagccgcagcg

SEQ ID NO: 2893503 - RNA, 12 nt, Mycobacterium avium subsp. paratuberculosis
gccggcacccgg

SEQ ID NO: 2893504 - RNA, 15 nt, Mycobacterium avium subsp. paratuberculosis
gccggcacccgggcc

SEQ ID NO: 2893505 - RNA, 21 nt, Mycobacterium avium subsp. paratuberculosis
gccggcacccgggccuugacg

SEQ ID NO: 2893506 - RNA, 14 nt, Mycobacterium avium subsp. paratuberculosis
gccggcaccguccg

SEQ ID NO: 2893507 - RNA, 14 nt, Mycobacterium avium subsp. paratuberculosis
gccggcaccucgaa

SEQ ID NO: 2893508 - RNA, 20 nt, Mycobacterium avium subsp. paratuberculosis
gccggcaccucgaagggcgc

SEQ ID NO: 2893509 - RNA, 22 nt, Mycobacterium avium subsp. paratuberculosis
gccggcaccucgaagggcgcca

SEQ ID NO: 2893510 - RNA, 23 nt, Mycobacterium avium subsp. paratuberculosis
gccggcaccucgaagggcgccag

SEQ ID NO: 2893511 - RNA, 24 nt, Mycobacterium avium subsp. paratuberculosis
gccggcaccucgaagggcgccagc

SEQ ID NO: 2893512 - RNA, 19 nt, Mycobacterium avium subsp. paratuberculosis
gccggcacgaaaccgugga

SEQ ID NO: 2893513 - RNA, 16 nt, Mycobacterium avium subsp. paratuberculosis
gccggcacgauggcgc

SEQ ID NO: 2893514 - RNA, 22 nt, Mycobacterium avium subsp. paratuberculosis
gccggcacgauggcgcggcgca

SEQ ID NO: 2893515 - RNA, 20 nt, Mycobacterium avium subsp. paratuberculosis
gccggcacgcaccuuggacg

SEQ ID NO: 2893516 - RNA, 21 nt, Mycobacterium avium subsp. paratuberculosis
gccggcacgcaccuuggacga

SEQ ID NO: 2893517 - RNA, 15 nt, Mycobacterium avium subsp. paratuberculosis
gccggcacgcgcgcc

SEQ ID NO: 2893518 - RNA, 16 nt, Mycobacterium avium subsp. paratuberculosis
gccggcacgcgcgccg

SEQ ID NO: 2893519 - RNA, 19 nt, Mycobacterium avium subsp. paratuberculosis
gccggcacuaccgccucgc

SEQ ID NO: 2893520 - RNA, 19 nt, Mycobacterium avium subsp. paratuberculosis
gccggcacucgccucggag

SEQ ID NO: 2893521 - RNA, 20 nt, Mycobacterium avium subsp. paratuberculosis
gccggcacucgccucggagg

SEQ ID NO: 2893522 - RNA, 14 nt, Mycobacterium avium subsp. paratuberculosis
gccggcacucgucg

SEQ ID NO: 2893523 - RNA, 22 nt, Mycobacterium avium subsp. paratuberculosis
gccggcacucgucguggcggug

SEQ ID NO: 2893524 - RNA, 15 nt, Mycobacterium avium subsp. paratuberculosis
gccggcacugcugcc

SEQ ID NO: 2893525 - RNA, 19 nt, Mycobacterium avium subsp. paratuberculosis
gccggcacugcugcccgcg

SEQ ID NO: 2893526 - RNA, 22 nt, Mycobacterium avium subsp. paratuberculosis
gccggcacugcugcccgcgacg

SEQ ID NO: 2893527 - RNA, 19 nt, Mycobacterium avium subsp. paratuberculosis
gccggcagauugguucggc

SEQ ID NO: 2893528 - RNA, 20 nt, Mycobacterium avium subsp. paratuberculosis
gccggcagauugguucggcc

SEQ ID NO: 2893529 - RNA, 21 nt, Mycobacterium avium subsp. paratuberculosis
gccggcagauugguucggccg

SEQ ID NO: 2893530 - RNA, 19 nt, Mycobacterium avium subsp. paratuberculosis
gccggcagcaaccggcggc

SEQ ID NO: 2893531 - RNA, 20 nt, Mycobacterium avium subsp. paratuberculosis
gccggcagcaaccggcggcu

SEQ ID NO: 2893532 - RNA, 14 nt, Mycobacterium avium subsp. paratuberculosis
gccggcagcaucgg

SEQ ID NO: 2893533 - RNA, 21 nt, Mycobacterium avium subsp. paratuberculosis
gccggcagcauucgccggggu

SEQ ID NO: 2893534 - RNA, 15 nt, Mycobacterium avium subsp. paratuberculosis
gccggcagcccggag

SEQ ID NO: 2893535 - RNA, 13 nt, Mycobacterium avium subsp. paratuberculosis
gccggcagccgcu

SEQ ID NO: 2893536 - RNA, 12 nt, Mycobacterium avium subsp. paratuberculosis
gccggcagccgg

SEQ ID NO: 2893537 - RNA, 13 nt, Mycobacterium avium subsp. paratuberculosis
gccggcagccggc

SEQ ID NO: 2893538 - RNA, 15 nt, Mycobacterium avium subsp. paratuberculosis
gccggcagccggcca

SEQ ID NO: 2893539 - RNA, 17 nt, Mycobacterium avium subsp. paratuberculosis
gccggcagccggccacc

SEQ ID NO: 2893540 - RNA, 20 nt, Mycobacterium avium subsp. paratuberculosis
gccggcagccggccaccucg

SEQ ID NO: 2893541 - RNA, 16 nt, Mycobacterium avium subsp. paratuberculosis
gccggcagccggcgcg

SEQ ID NO: 2893542 - RNA, 14 nt, Mycobacterium avium subsp. paratuberculosis
gccggcagcggccg

SEQ ID NO: 2893543 - RNA, 15 nt, Mycobacterium avium subsp. paratuberculosis
gccggcagcggccgc

SEQ ID NO: 2893544 - RNA, 21 nt, Mycobacterium avium subsp. paratuberculosis
gccggcagcggccgcaaucgg

SEQ ID NO: 2893545 - RNA, 17 nt, Mycobacterium avium subsp. paratuberculosis
gccggcagcggcugcug

SEQ ID NO: 2893546 - RNA, 15 nt, Mycobacterium avium subsp. paratuberculosis
gccggcagcggugcc

SEQ ID NO: 2893547 - RNA, 16 nt, Mycobacterium avium subsp. paratuberculosis
gccggcagcggugccg

SEQ ID NO: 2893548 - RNA, 17 nt, Mycobacterium avium subsp. paratuberculosis
gccggcagcggugccgc

SEQ ID NO: 2893549 - RNA, 17 nt, Mycobacterium avium subsp. paratuberculosis
gccggcagcugcccguc

SEQ ID NO: 2893550 - RNA, 18 nt, Mycobacterium avium subsp. paratuberculosis
gccggcagcugcccgucg

SEQ ID NO: 2893551 - RNA, 21 nt, Mycobacterium avium subsp. paratuberculosis
gccggcagcugcccgucggag

SEQ ID NO: 2893552 - RNA, 16 nt, Mycobacterium avium subsp. paratuberculosis
gccggcaggucgaggc

SEQ ID NO: 2893553 - RNA, 20 nt, Mycobacterium avium subsp. paratuberculosis
gccggcaggucgaggccggc

SEQ ID NO: 2893554 - RNA, 22 nt, Mycobacterium avium subsp. paratuberculosis
gccggcaggucgaggccggcca

SEQ ID NO: 2893555 - RNA, 20 nt, Mycobacterium avium subsp. paratuberculosis
gccggcagguuguugacgac

SEQ ID NO: 2893556 - RNA, 19 nt, Mycobacterium avium subsp. paratuberculosis
gccggcauaggccagcacc

SEQ ID NO: 2893557 - RNA, 16 nt, Mycobacterium avium subsp. paratuberculosis
gccggcaucagcgaga

SEQ ID NO: 2893558 - RNA, 21 nt, Mycobacterium avium subsp. paratuberculosis
gccggcauccagcacggccgc

SEQ ID NO: 2893559 - RNA, 22 nt, Mycobacterium avium subsp. paratuberculosis
gccggcauccagcacggccgcc

SEQ ID NO: 2893560 - RNA, 17 nt, Mycobacterium avium subsp. paratuberculosis
gccggcauccucggcgc

SEQ ID NO: 2893561 - RNA, 18 nt, Mycobacterium avium subsp. paratuberculosis
gccggcauccucggcgcg

SEQ ID NO: 2893562 - RNA, 18 nt, Mycobacterium avium subsp. paratuberculosis
gccggcaucgaccgcccg

SEQ ID NO: 2893563 - RNA, 19 nt, Mycobacterium avium subsp. paratuberculosis
gccggcaugguucccccca

SEQ ID NO: 2893564 - RNA, 13 nt, Mycobacterium avium subsp. paratuberculosis
gccggccaacagc

SEQ ID NO: 2893565 - RNA, 16 nt, Mycobacterium avium subsp. paratuberculosis
gccggccaacagcagc

SEQ ID NO: 2893566 - RNA, 24 nt, Mycobacterium avium subsp. paratuberculosis
gccggccaacagcagcgccgcggc

SEQ ID NO: 2893567 - RNA, 18 nt, Mycobacterium avium subsp. paratuberculosis
gccggccaaggcaagucg

SEQ ID NO: 2893568 - RNA, 17 nt, Mycobacterium avium subsp. paratuberculosis
gccggccaccaacaggu

SEQ ID NO: 2893569 - RNA, 13 nt, Mycobacterium avium subsp. paratuberculosis
gccggccaccagc

SEQ ID NO: 2893570 - RNA, 14 nt, Mycobacterium avium subsp. paratuberculosis
gccggccaccagcg

SEQ ID NO: 2893571 - RNA, 15 nt, Mycobacterium avium subsp. paratuberculosis
gccggccaccagcgg

SEQ ID NO: 2893572 - RNA, 16 nt, Mycobacterium avium subsp. paratuberculosis
gccggccaccagcggc

SEQ ID NO: 2893573 - RNA, 17 nt, Mycobacterium avium subsp. paratuberculosis
gccggccaccagcggcc

SEQ ID NO: 2893574 - RNA, 16 nt, Mycobacterium avium subsp. paratuberculosis
gccggccaccaggucg

SEQ ID NO: 2893575 - RNA, 23 nt, Mycobacterium avium subsp. paratuberculosis
gccggccaccaggucgcacacca

SEQ ID NO: 2893576 - RNA, 13 nt, Mycobacterium avium subsp. paratuberculosis
gccggccaccgcc

SEQ ID NO: 2893577 - RNA, 16 nt, Mycobacterium avium subsp. paratuberculosis
gccggccaccggcgcg

SEQ ID NO: 2893578 - RNA, 21 nt, Mycobacterium avium subsp. paratuberculosis
gccggccaccggcgcgacggc

SEQ ID NO: 2893579 - RNA, 22 nt, Mycobacterium avium subsp. paratuberculosis
gccggccaccggcgcgacggcg

SEQ ID NO: 2893580 - RNA, 13 nt, Mycobacterium avium subsp. paratuberculosis
gccggccaccucg

SEQ ID NO: 2893581 - RNA, 16 nt, Mycobacterium avium subsp. paratuberculosis
gccggccaccucgucc

SEQ ID NO: 2893582 - RNA, 15 nt, Mycobacterium avium subsp. paratuberculosis
gccggccacgcucgg

SEQ ID NO: 2893583 - RNA, 21 nt, Mycobacterium avium subsp. paratuberculosis
gccggccacguaguccgacga

SEQ ID NO: 2893584 - RNA, 23 nt, Mycobacterium avium subsp. paratuberculosis
gccggccacguaguccgacgauc

SEQ ID NO: 2893585 - RNA, 13 nt, Mycobacterium avium subsp. paratuberculosis
gccggccagaccg

SEQ ID NO: 2893586 - RNA, 16 nt, Mycobacterium avium subsp. paratuberculosis
gccggccagaucgacg

SEQ ID NO: 2893587 - RNA, 19 nt, Mycobacterium avium subsp. paratuberculosis
gccggccagaucgacgccg

SEQ ID NO: 2893588 - RNA, 20 nt, Mycobacterium avium subsp. paratuberculosis
gccggccagaucgacgccgc

SEQ ID NO: 2893589 - RNA, 22 nt, Mycobacterium avium subsp. paratuberculosis
gccggccagaucgacgccgcgg

SEQ ID NO: 2893590 - RNA, 14 nt, Mycobacterium avium subsp. paratuberculosis
gccggccagcacac

SEQ ID NO: 2893591 - RNA, 18 nt, Mycobacterium avium subsp. paratuberculosis
gccggccagcacacccuc

SEQ ID NO: 2893592 - RNA, 14 nt, Mycobacterium avium subsp. paratuberculosis
gccggccagcacca

SEQ ID NO: 2893593 - RNA, 16 nt, Mycobacterium avium subsp. paratuberculosis
gccggccagcaccacg

SEQ ID NO: 2893594 - RNA, 19 nt, Mycobacterium avium subsp. paratuberculosis
gccggccagcacgccgucc

SEQ ID NO: 2893595 - RNA, 14 nt, Mycobacterium avium subsp. paratuberculosis
gccggccagcacgg

SEQ ID NO: 2893596 - RNA, 20 nt, Mycobacterium avium subsp. paratuberculosis
gccggccagcacggccagcc

SEQ ID NO: 2893597 - RNA, 21 nt, Mycobacterium avium subsp. paratuberculosis
gccggccagcacggccagcca

SEQ ID NO: 2893598 - RNA, 17 nt, Mycobacterium avium subsp. paratuberculosis
gccggccagcacggcgg

SEQ ID NO: 2893599 - RNA, 19 nt, Mycobacterium avium subsp. paratuberculosis
gccggccagcacggcggcg

SEQ ID NO: 2893600 - RNA, 13 nt, Mycobacterium avium subsp. paratuberculosis
gccggccagcagc

SEQ ID NO: 2893601 - RNA, 15 nt, Mycobacterium avium subsp. paratuberculosis
gccggccagcagcag

SEQ ID NO: 2893602 - RNA, 15 nt, Mycobacterium avium subsp. paratuberculosis
gccggccagcagccg

SEQ ID NO: 2893603 - RNA, 17 nt, Mycobacterium avium subsp. paratuberculosis
gccggccagcagccggu

SEQ ID NO: 2893604 - RNA, 21 nt, Mycobacterium avium subsp. paratuberculosis
gccggccagcagccgguacag

SEQ ID NO: 2893605 - RNA, 14 nt, Mycobacterium avium subsp. paratuberculosis
gccggccagcagcg

SEQ ID NO: 2893606 - RNA, 16 nt, Mycobacterium avium subsp. paratuberculosis
gccggccagcagcggc

SEQ ID NO: 2893607 - RNA, 13 nt, Mycobacterium avium subsp. paratuberculosis
gccggccagccgc

SEQ ID NO: 2893608 - RNA, 14 nt, Mycobacterium avium subsp. paratuberculosis
gccggccagccgcg

SEQ ID NO: 2893609 - RNA, 15 nt, Mycobacterium avium subsp. paratuberculosis
gccggccagccgcgc

SEQ ID NO: 2893610 - RNA, 14 nt, Mycobacterium avium subsp. paratuberculosis
gccggccagccggc

SEQ ID NO: 2893611 - RNA, 14 nt, Mycobacterium avium subsp. paratuberculosis
gccggccagcgcgc

SEQ ID NO: 2893612 - RNA, 16 nt, Mycobacterium avium subsp. paratuberculosis
gccggccagcgcgcgg

SEQ ID NO: 2893613 - RNA, 17 nt, Mycobacterium avium subsp. paratuberculosis
gccggccagcgcgcggc

SEQ ID NO: 2893614 - RNA, 14 nt, Mycobacterium avium subsp. paratuberculosis
gccggccagcggcc

SEQ ID NO: 2893615 - RNA, 17 nt, Mycobacterium avium subsp. paratuberculosis
gccggccagcggccagc

SEQ ID NO: 2893616 - RNA, 15 nt, Mycobacterium avium subsp. paratuberculosis
gccggccagcggguc

SEQ ID NO: 2893617 - RNA, 17 nt, Mycobacterium avium subsp. paratuberculosis
gccggccagcgggucgu

SEQ ID NO: 2893618 - RNA, 12 nt, Mycobacterium avium subsp. paratuberculosis
gccggccagcgu

SEQ ID NO: 2893619 - RNA, 18 nt, Mycobacterium avium subsp. paratuberculosis
gccggccagcgucgcgcc

SEQ ID NO: 2893620 - RNA, 17 nt, Mycobacterium avium subsp. paratuberculosis
gccggccagcuccgcca

SEQ ID NO: 2893621 - RNA, 19 nt, Mycobacterium avium subsp. paratuberculosis
gccggccagcuccgccacc

SEQ ID NO: 2893622 - RNA, 17 nt, Mycobacterium avium subsp. paratuberculosis
gccggccagcucgagca

SEQ ID NO: 2893623 - RNA, 19 nt, Mycobacterium avium subsp. paratuberculosis
gccggccagcucgagcauc

SEQ ID NO: 2893624 - RNA, 15 nt, Mycobacterium avium subsp. paratuberculosis
gccggccagcucgcc

SEQ ID NO: 2893625 - RNA, 16 nt, Mycobacterium avium subsp. paratuberculosis
gccggccagcucgccg

SEQ ID NO: 2893626 - RNA, 19 nt, Mycobacterium avium subsp. paratuberculosis
gccggccagcucgccgccg

SEQ ID NO: 2893627 - RNA, 23 nt, Mycobacterium avium subsp. paratuberculosis
gccggccagcucgccgccgacga

SEQ ID NO: 2893628 - RNA, 22 nt, Mycobacterium avium subsp. paratuberculosis
gccggccagcuuuccggccgcc

SEQ ID NO: 2893629 - RNA, 23 nt, Mycobacterium avium subsp. paratuberculosis
gccggccagcuuuccggccgccu

SEQ ID NO: 2893630 - RNA, 16 nt, Mycobacterium avium subsp. paratuberculosis
gccggccaggcacagc

SEQ ID NO: 2893631 - RNA, 23 nt, Mycobacterium avium subsp. paratuberculosis
gccggccaggcacagcagggcac

SEQ ID NO: 2893632 - RNA, 14 nt, Mycobacterium avium subsp. paratuberculosis
gccggccaggccgg

SEQ ID NO: 2893633 - RNA, 15 nt, Mycobacterium avium subsp. paratuberculosis
gccggccaggccggc

SEQ ID NO: 2893634 - RNA, 16 nt, Mycobacterium avium subsp. paratuberculosis
gccggccaggccggcc

SEQ ID NO: 2893635 - RNA, 19 nt, Mycobacterium avium subsp. paratuberculosis
gccggccaggccggccugc

SEQ ID NO: 2893636 - RNA, 19 nt, Mycobacterium avium subsp. paratuberculosis
gccggccagguugaccacc

SEQ ID NO: 2893637 - RNA, 18 nt, Mycobacterium avium subsp. paratuberculosis
gccggccaguccugggcc

SEQ ID NO: 2893638 - RNA, 13 nt, Mycobacterium avium subsp. paratuberculosis
gccggccaguucc

SEQ ID NO: 2893639 - RNA, 19 nt, Mycobacterium avium subsp. paratuberculosis
gccggccaguucccgggcg

SEQ ID NO: 2893640 - RNA, 20 nt, Mycobacterium avium subsp. paratuberculosis
gccggccaguucccgggcga

SEQ ID NO: 2893641 - RNA, 22 nt, Mycobacterium avium subsp. paratuberculosis
gccggccaguucccgggcgaac

SEQ ID NO: 2893642 - RNA, 14 nt, Mycobacterium avium subsp. paratuberculosis
gccggccaucucgg

SEQ ID NO: 2893643 - RNA, 16 nt, Mycobacterium avium subsp. paratuberculosis
gccggccaucucggcg

SEQ ID NO: 2893644 - RNA, 16 nt, Mycobacterium avium subsp. paratuberculosis
gccggccaucugcugg

SEQ ID NO: 2893645 - RNA, 23 nt, Mycobacterium avium subsp. paratuberculosis
gccggccaucuucaguucggccg

SEQ ID NO: 2893646 - RNA, 20 nt, Mycobacterium avium subsp. paratuberculosis
gccggccaugcccucgaucg

SEQ ID NO: 2893647 - RNA, 18 nt, Mycobacterium avium subsp. paratuberculosis
gccggcccagcgcgcggc

SEQ ID NO: 2893648 - RNA, 11 nt, Mycobacterium avium subsp. paratuberculosis
gccggcccagu

SEQ ID NO: 2893649 - RNA, 20 nt, Mycobacterium avium subsp. paratuberculosis
gccggcccaguggaucggcc

SEQ ID NO: 2893650 - RNA, 13 nt, Mycobacterium avium subsp. paratuberculosis
gccggccccgccc

SEQ ID NO: 2893651 - RNA, 15 nt, Mycobacterium avium subsp. paratuberculosis
gccggccccgcccgg

SEQ ID NO: 2893652 - RNA, 16 nt, Mycobacterium avium subsp. paratuberculosis
gccggccccgcccggc

SEQ ID NO: 2893653 - RNA, 18 nt, Mycobacterium avium subsp. paratuberculosis
gccggccccgcccggggc

SEQ ID NO: 2893654 - RNA, 19 nt, Mycobacterium avium subsp. paratuberculosis
gccggccccgcccggggcg

SEQ ID NO: 2893655 - RNA, 20 nt, Mycobacterium avium subsp. paratuberculosis
gccggccccgcccggggcgg

SEQ ID NO: 2893656 - RNA, 14 nt, Mycobacterium avium subsp. paratuberculosis
gccggccccggccg

SEQ ID NO: 2893657 - RNA, 15 nt, Mycobacterium avium subsp. paratuberculosis
gccggccccggccgg

SEQ ID NO: 2893658 - RNA, 17 nt, Mycobacterium avium subsp. paratuberculosis
gccggccccggccgggc

SEQ ID NO: 2893659 - RNA, 20 nt, Mycobacterium avium subsp. paratuberculosis
gccggccccggccgggcgac

SEQ ID NO: 2893660 - RNA, 13 nt, Mycobacterium avium subsp. paratuberculosis
gccggccccggcg

SEQ ID NO: 2893661 - RNA, 19 nt, Mycobacterium avium subsp. paratuberculosis
gccggccccggcgacggcg

SEQ ID NO: 2893662 - RNA, 22 nt, Mycobacterium avium subsp. paratuberculosis
gccggccccggcgacggcggcc

SEQ ID NO: 2893663 - RNA, 23 nt, Mycobacterium avium subsp. paratuberculosis
gccggccccggcgacggcggccg

SEQ ID NO: 2893664 - RNA, 14 nt, Mycobacterium avium subsp. paratuberculosis
gccggccccggggg

SEQ ID NO: 2893665 - RNA, 17 nt, Mycobacterium avium subsp. paratuberculosis
gccggccccuaccgccg

SEQ ID NO: 2893666 - RNA, 20 nt, Mycobacterium avium subsp. paratuberculosis
gccggccccuaccgccgagc

SEQ ID NO: 2893667 - RNA, 19 nt, Mycobacterium avium subsp. paratuberculosis
gccggcccgaccggagccg

SEQ ID NO: 2893668 - RNA, 19 nt, Mycobacterium avium subsp. paratuberculosis
gccggcccgagcccugcgc

SEQ ID NO: 2893669 - RNA, 21 nt, Mycobacterium avium subsp. paratuberculosis
gccggcccgagcccugcgcca

SEQ ID NO: 2893670 - RNA, 17 nt, Mycobacterium avium subsp. paratuberculosis
gccggcccgauaggccg

SEQ ID NO: 2893671 - RNA, 24 nt, Mycobacterium avium subsp. paratuberculosis
gccggcccgauaggccgacuggug

SEQ ID NO: 2893672 - RNA, 14 nt, Mycobacterium avium subsp. paratuberculosis
gccggcccgcagcc

SEQ ID NO: 2893673 - RNA, 20 nt, Mycobacterium avium subsp. paratuberculosis
gccggcccgcagcgccucgg

SEQ ID NO: 2893674 - RNA, 18 nt, Mycobacterium avium subsp. paratuberculosis
gccggcccgcaucgcggc

SEQ ID NO: 2893675 - RNA, 14 nt, Mycobacterium avium subsp. paratuberculosis
gccggcccgcccgg

SEQ ID NO: 2893676 - RNA, 16 nt, Mycobacterium avium subsp. paratuberculosis
gccggcccgcccggcg

SEQ ID NO: 2893677 - RNA, 19 nt, Mycobacterium avium subsp. paratuberculosis
gccggcccgcccggcggcg

SEQ ID NO: 2893678 - RNA, 14 nt, Mycobacterium avium subsp. paratuberculosis
gccggcccgcggcg

SEQ ID NO: 2893679 - RNA, 15 nt, Mycobacterium avium subsp. paratuberculosis
gccggcccgcggcgg

SEQ ID NO: 2893680 - RNA, 23 nt, Mycobacterium avium subsp. paratuberculosis
gccggcccgcggcggauccagca

SEQ ID NO: 2893681 - RNA, 12 nt, Mycobacterium avium subsp. paratuberculosis
gccggcccggcc

SEQ ID NO: 2893682 - RNA, 15 nt, Mycobacterium avium subsp. paratuberculosis
gccggcccggcccga

SEQ ID NO: 2893683 - RNA, 17 nt, Mycobacterium avium subsp. paratuberculosis
gccggcccggcggguca

SEQ ID NO: 2893684 - RNA, 18 nt, Mycobacterium avium subsp. paratuberculosis
gccggcccggcgggucag

SEQ ID NO: 2893685 - RNA, 13 nt, Mycobacterium avium subsp. paratuberculosis
gccggcccggggu

SEQ ID NO: 2893686 - RNA, 14 nt, Mycobacterium avium subsp. paratuberculosis
gccggcccggggug

SEQ ID NO: 2893687 - RNA, 22 nt, Mycobacterium avium subsp. paratuberculosis
gccggcccggggugugcccgaa

SEQ ID NO: 2893688 - RNA, 15 nt, Mycobacterium avium subsp. paratuberculosis
gccggcccugcggcc

SEQ ID NO: 2893689 - RNA, 13 nt, Mycobacterium avium subsp. paratuberculosis
gccggccgaacac

SEQ ID NO: 2893690 - RNA, 18 nt, Mycobacterium avium subsp. paratuberculosis
gccggccgaacacggccg

SEQ ID NO: 2893691 - RNA, 22 nt, Mycobacterium avium subsp. paratuberculosis
gccggccgaacacggccgccuc

SEQ ID NO: 2893692 - RNA, 18 nt, Mycobacterium avium subsp. paratuberculosis
gccggccgaagaccgccg

SEQ ID NO: 2893693 - RNA, 22 nt, Mycobacterium avium subsp. paratuberculosis
gccggccgaagcguuccgccgu

SEQ ID NO: 2893694 - RNA, 23 nt, Mycobacterium avium subsp. paratuberculosis
gccggccgacaacgacagcaccc

SEQ ID NO: 2893695 - RNA, 20 nt, Mycobacterium avium subsp. paratuberculosis
gccggccgaccgccucgaug

SEQ ID NO: 2893696 - RNA, 15 nt, Mycobacterium avium subsp. paratuberculosis
gccggccgagccgag

SEQ ID NO: 2893697 - RNA, 12 nt, Mycobacterium avium subsp. paratuberculosis
gccggccgagcg

SEQ ID NO: 2893698 - RNA, 13 nt, Mycobacterium avium subsp. paratuberculosis
gccggccgagcga

SEQ ID NO: 2893699 - RNA, 12 nt, Mycobacterium avium subsp. paratuberculosis
gccggccgcagc

SEQ ID NO: 2893700 - RNA, 13 nt, Mycobacterium avium subsp. paratuberculosis
gccggccgcagcu

SEQ ID NO: 2893701 - RNA, 12 nt, Mycobacterium avium subsp. paratuberculosis
gccggccgccag

SEQ ID NO: 2893702 - RNA, 14 nt, Mycobacterium avium subsp. paratuberculosis
gccggccgccagcg

SEQ ID NO: 2893703 - RNA, 19 nt, Mycobacterium avium subsp. paratuberculosis
gccggccgccagcgcccgc

SEQ ID NO: 2893704 - RNA, 23 nt, Mycobacterium avium subsp. paratuberculosis
gccggccgccagcgcccgcgcgu

SEQ ID NO: 2893705 - RNA, 12 nt, Mycobacterium avium subsp. paratuberculosis
gccggccgccga

SEQ ID NO: 2893706 - RNA, 17 nt, Mycobacterium avium subsp. paratuberculosis
gccggccgccgaagccg

SEQ ID NO: 2893707 - RNA, 21 nt, Mycobacterium avium subsp. paratuberculosis
gccggccgccgaagccggcuc

SEQ ID NO: 2893708 - RNA, 12 nt, Mycobacterium avium subsp. paratuberculosis
gccggccgccgc

SEQ ID NO: 2893709 - RNA, 13 nt, Mycobacterium avium subsp. paratuberculosis
gccggccgccgcg

SEQ ID NO: 2893710 - RNA, 17 nt, Mycobacterium avium subsp. paratuberculosis
gccggccgccgcgcauc

SEQ ID NO: 2893711 - RNA, 13 nt, Mycobacterium avium subsp. paratuberculosis
gccggccgccggc

SEQ ID NO: 2893712 - RNA, 15 nt, Mycobacterium avium subsp. paratuberculosis
gccggccgccggcgg

SEQ ID NO: 2893713 - RNA, 16 nt, Mycobacterium avium subsp. paratuberculosis
gccggccgccggcggc

SEQ ID NO: 2893714 - RNA, 20 nt, Mycobacterium avium subsp. paratuberculosis
gccggccgccggcggccaau

SEQ ID NO: 2893715 - RNA, 12 nt, Mycobacterium avium subsp. paratuberculosis
gccggccgccgu

SEQ ID NO: 2893716 - RNA, 13 nt, Mycobacterium avium subsp. paratuberculosis
gccggccgccgug

SEQ ID NO: 2893717 - RNA, 14 nt, Mycobacterium avium subsp. paratuberculosis
gccggccgccgugg

SEQ ID NO: 2893718 - RNA, 16 nt, Mycobacterium avium subsp. paratuberculosis
gccggccgccguggcc

SEQ ID NO: 2893719 - RNA, 13 nt, Mycobacterium avium subsp. paratuberculosis
gccggccgccugg

SEQ ID NO: 2893720 - RNA, 16 nt, Mycobacterium avium subsp. paratuberculosis
gccggccgccuggacg

SEQ ID NO: 2893721 - RNA, 22 nt, Mycobacterium avium subsp. paratuberculosis
gccggccgccuggacgacgucg

SEQ ID NO: 2893722 - RNA, 14 nt, Mycobacterium avium subsp. paratuberculosis
gccggccgcgcaga

SEQ ID NO: 2893723 - RNA, 16 nt, Mycobacterium avium subsp. paratuberculosis
gccggccgcgcagauc

SEQ ID NO: 2893724 - RNA, 16 nt, Mycobacterium avium subsp. paratuberculosis
gccggccgcgcccauc

SEQ ID NO: 2893725 - RNA, 21 nt, Mycobacterium avium subsp. paratuberculosis
gccggccgcgcccaucgcggc

SEQ ID NO: 2893726 - RNA, 23 nt, Mycobacterium avium subsp. paratuberculosis
gccggccgcgcccaucgcggccg

SEQ ID NO: 2893727 - RNA, 13 nt, Mycobacterium avium subsp. paratuberculosis
gccggccgcggcg

SEQ ID NO: 2893728 - RNA, 14 nt, Mycobacterium avium subsp. paratuberculosis
gccggccgcggcgu

SEQ ID NO: 2893729 - RNA, 15 nt, Mycobacterium avium subsp. paratuberculosis
gccggccgcgggcga

SEQ ID NO: 2893730 - RNA, 16 nt, Mycobacterium avium subsp. paratuberculosis
gccggccgcgggcgau

SEQ ID NO: 2893731 - RNA, 16 nt, Mycobacterium avium subsp. paratuberculosis
gccggccgcggugugc

SEQ ID NO: 2893732 - RNA, 16 nt, Mycobacterium avium subsp. paratuberculosis
gccggccgcgucgccg

SEQ ID NO: 2893733 - RNA, 15 nt, Mycobacterium avium subsp. paratuberculosis
gccggccgcuacccg

SEQ ID NO: 2893734 - RNA, 16 nt, Mycobacterium avium subsp. paratuberculosis
gccggccgcuacccgg

SEQ ID NO: 2893735 - RNA, 18 nt, Mycobacterium avium subsp. paratuberculosis
gccggccgcuacccggcg

SEQ ID NO: 2893736 - RNA, 19 nt, Mycobacterium avium subsp. paratuberculosis
gccggccgcuacccggcga

SEQ ID NO: 2893737 - RNA, 15 nt, Mycobacterium avium subsp. paratuberculosis
gccggccggacaccg

SEQ ID NO: 2893738 - RNA, 21 nt, Mycobacterium avium subsp. paratuberculosis
gccggccggacaccgaaccgc

SEQ ID NO: 2893739 - RNA, 11 nt, Mycobacterium avium subsp. paratuberculosis
gccggccggca

SEQ ID NO: 2893740 - RNA, 14 nt, Mycobacterium avium subsp. paratuberculosis
gccggccggcacga

SEQ ID NO: 2893741 - RNA, 23 nt, Mycobacterium avium subsp. paratuberculosis
gccggccggcacgauggcgcggc

SEQ ID NO: 2893742 - RNA, 16 nt, Mycobacterium avium subsp. paratuberculosis
gccggccggcagcugc

SEQ ID NO: 2893743 - RNA, 14 nt, Mycobacterium avium subsp. paratuberculosis
gccggccggcaggu

SEQ ID NO: 2893744 - RNA, 14 nt, Mycobacterium avium subsp. paratuberculosis
gccggccggccgac

SEQ ID NO: 2893745 - RNA, 15 nt, Mycobacterium avium subsp. paratuberculosis
gccggccggccgaca

SEQ ID NO: 2893746 - RNA, 16 nt, Mycobacterium avium subsp. paratuberculosis
gccggccggccgacaa

SEQ ID NO: 2893747 - RNA, 17 nt, Mycobacterium avium subsp. paratuberculosis
gccggccggccgagccg

SEQ ID NO: 2893748 - RNA, 16 nt, Mycobacterium avium subsp. paratuberculosis
gccggccggccuggug

SEQ ID NO: 2893749 - RNA, 11 nt, Mycobacterium avium subsp. paratuberculosis
gccggccggcg

SEQ ID NO: 2893750 - RNA, 14 nt, Mycobacterium avium subsp. paratuberculosis
gccggccggcgcgu

SEQ ID NO: 2893751 - RNA, 15 nt, Mycobacterium avium subsp. paratuberculosis
gccggccggcgcgug

SEQ ID NO: 2893752 - RNA, 12 nt, Mycobacterium avium subsp. paratuberculosis
gccggccggcgg

SEQ ID NO: 2893753 - RNA, 15 nt, Mycobacterium avium subsp. paratuberculosis
gccggccggcggacg

SEQ ID NO: 2893754 - RNA, 23 nt, Mycobacterium avium subsp. paratuberculosis
gccggccggcggacgcggccagc

SEQ ID NO: 2893755 - RNA, 14 nt, Mycobacterium avium subsp. paratuberculosis
gccggccggcgguc

SEQ ID NO: 2893756 - RNA, 15 nt, Mycobacterium avium subsp. paratuberculosis
gccggccggcgguca

SEQ ID NO: 2893757 - RNA, 19 nt, Mycobacterium avium subsp. paratuberculosis
gccggccggcggucaggcc

SEQ ID NO: 2893758 - RNA, 13 nt, Mycobacterium avium subsp. paratuberculosis
gccggccggcgug

SEQ ID NO: 2893759 - RNA, 21 nt, Mycobacterium avium subsp. paratuberculosis
gccggccgggacgcgguccag

SEQ ID NO: 2893760 - RNA, 22 nt, Mycobacterium avium subsp. paratuberculosis
gccggccgggacgcgguccagc

SEQ ID NO: 2893761 - RNA, 22 nt, Mycobacterium avium subsp. paratuberculosis
gccggccgggcggacggcaccg

SEQ ID NO: 2893762 - RNA, 15 nt, Mycobacterium avium subsp. paratuberculosis
gccggccgggcugcg

SEQ ID NO: 2893763 - RNA, 13 nt, Mycobacterium avium subsp. paratuberculosis
gccggccggggcg

SEQ ID NO: 2893764 - RNA, 16 nt, Mycobacterium avium subsp. paratuberculosis
gccggccggggcggcg

SEQ ID NO: 2893765 - RNA, 18 nt, Mycobacterium avium subsp. paratuberculosis
gccggccggggcggcggu

SEQ ID NO: 2893766 - RNA, 13 nt, Mycobacterium avium subsp. paratuberculosis
gccggccggguca

SEQ ID NO: 2893767 - RNA, 13 nt, Mycobacterium avium subsp. paratuberculosis
gccggccggucga

SEQ ID NO: 2893768 - RNA, 14 nt, Mycobacterium avium subsp. paratuberculosis
gccggccguagcgg

SEQ ID NO: 2893769 - RNA, 18 nt, Mycobacterium avium subsp. paratuberculosis
gccggccguagcggacga

SEQ ID NO: 2893770 - RNA, 15 nt, Mycobacterium avium subsp. paratuberculosis
gccggccgucacgcu

SEQ ID NO: 2893771 - RNA, 17 nt, Mycobacterium avium subsp. paratuberculosis
gccggccgucacgcugg

SEQ ID NO: 2893772 - RNA, 22 nt, Mycobacterium avium subsp. paratuberculosis
gccggccgucacgcuggcguga

SEQ ID NO: 2893773 - RNA, 23 nt, Mycobacterium avium subsp. paratuberculosis
gccggccgucaggaacgccggcu

SEQ ID NO: 2893774 - RNA, 17 nt, Mycobacterium avium subsp. paratuberculosis
gccggccguccacggcg

SEQ ID NO: 2893775 - RNA, 21 nt, Mycobacterium avium subsp. paratuberculosis
gccggccguccacggcggugg

SEQ ID NO: 2893776 - RNA, 14 nt, Mycobacterium avium subsp. paratuberculosis
gccggccgugccgg

SEQ ID NO: 2893777 - RNA, 16 nt, Mycobacterium avium subsp. paratuberculosis
gccggccgugccggcu

SEQ ID NO: 2893778 - RNA, 18 nt, Mycobacterium avium subsp. paratuberculosis
gccggccgugccggcucg

SEQ ID NO: 2893779 - RNA, 15 nt, Mycobacterium avium subsp. paratuberculosis
gccggccguucgccg

SEQ ID NO: 2893780 - RNA, 18 nt, Mycobacterium avium subsp. paratuberculosis
gccggccguucgccggcc

SEQ ID NO: 2893781 - RNA, 21 nt, Mycobacterium avium subsp. paratuberculosis
gccggccguucgccggccagc

SEQ ID NO: 2893782 - RNA, 17 nt, Mycobacterium avium subsp. paratuberculosis
gccggccguugcgggug

SEQ ID NO: 2893783 - RNA, 19 nt, Mycobacterium avium subsp. paratuberculosis
gccggccguugcggguguc

SEQ ID NO: 2893784 - RNA, 16 nt, Mycobacterium avium subsp. paratuberculosis
gccggccuccagcugu

SEQ ID NO: 2893785 - RNA, 19 nt, Mycobacterium avium subsp. paratuberculosis
gccggccuccagcuguuga

SEQ ID NO: 2893786 - RNA, 21 nt, Mycobacterium avium subsp. paratuberculosis
gccggccucgaugucgucgau

SEQ ID NO: 2893787 - RNA, 14 nt, Mycobacterium avium subsp. paratuberculosis
gccggccucgccgg

SEQ ID NO: 2893788 - RNA, 19 nt, Mycobacterium avium subsp. paratuberculosis
gccggccucgccggcgccg

SEQ ID NO: 2893789 - RNA, 13 nt, Mycobacterium avium subsp. paratuberculosis
gccggccucgggg

SEQ ID NO: 2893790 - RNA, 17 nt, Mycobacterium avium subsp. paratuberculosis
gccggccucgggguugc

SEQ ID NO: 2893791 - RNA, 15 nt, Mycobacterium avium subsp. paratuberculosis
gccggccucgucggc

SEQ ID NO: 2893792 - RNA, 16 nt, Mycobacterium avium subsp. paratuberculosis
gccggccucgucggcg

SEQ ID NO: 2893793 - RNA, 19 nt, Mycobacterium avium subsp. paratuberculosis
gccggccucgucggcgagc

SEQ ID NO: 2893794 - RNA, 18 nt, Mycobacterium avium subsp. paratuberculosis
gccggccugacugaguca

SEQ ID NO: 2893795 - RNA, 16 nt, Mycobacterium avium subsp. paratuberculosis
gccggccugccaccgc

SEQ ID NO: 2893796 - RNA, 17 nt, Mycobacterium avium subsp. paratuberculosis
gccggccugccaccgcg

SEQ ID NO: 2893797 - RNA, 16 nt, Mycobacterium avium subsp. paratuberculosis
gccggccugcccgccg

SEQ ID NO: 2893798 - RNA, 18 nt, Mycobacterium avium subsp. paratuberculosis
gccggccugcccgccgcg

SEQ ID NO: 2893799 - RNA, 20 nt, Mycobacterium avium subsp. paratuberculosis
gccggccugcccgccgcggc

SEQ ID NO: 2893800 - RNA, 23 nt, Mycobacterium avium subsp. paratuberculosis
gccggccugcccgccgcggccgc

SEQ ID NO: 2893801 - RNA, 23 nt, Mycobacterium avium subsp. paratuberculosis
gccggccugccggaugccgcgcg

SEQ ID NO: 2893802 - RNA, 20 nt, Mycobacterium avium subsp. paratuberculosis
gccggccugcuuuucggccg

SEQ ID NO: 2893803 - RNA, 12 nt, Mycobacterium avium subsp. paratuberculosis
gccggccuggcc

SEQ ID NO: 2893804 - RNA, 17 nt, Mycobacterium avium subsp. paratuberculosis
gccggccuggcccagcc

SEQ ID NO: 2893805 - RNA, 20 nt, Mycobacterium avium subsp. paratuberculosis
gccggccuggcccagccgcg

SEQ ID NO: 2893806 - RNA, 23 nt, Mycobacterium avium subsp. paratuberculosis
gccggccuggcccagccgcguca

SEQ ID NO: 2893807 - RNA, 13 nt, Mycobacterium avium subsp. paratuberculosis
gccggccuggugc

SEQ ID NO: 2893808 - RNA, 14 nt, Mycobacterium avium subsp. paratuberculosis
gccggccuggugcg

SEQ ID NO: 2893809 - RNA, 16 nt, Mycobacterium avium subsp. paratuberculosis
gccggccuggugcgga

SEQ ID NO: 2893810 - RNA, 20 nt, Mycobacterium avium subsp. paratuberculosis
gccggccuucucgcgcaccg

SEQ ID NO: 2893811 - RNA, 16 nt, Mycobacterium avium subsp. paratuberculosis
gccggccuugcucgcc

SEQ ID NO: 2893812 - RNA, 19 nt, Mycobacterium avium subsp. paratuberculosis
gccggccuugcucgccgcg

SEQ ID NO: 2893813 - RNA, 20 nt, Mycobacterium avium subsp. paratuberculosis
gccggccuugcucgccgcgu

SEQ ID NO: 2893814 - RNA, 20 nt, Mycobacterium avium subsp. paratuberculosis
gccggccuuggcccgcgccc

SEQ ID NO: 2893815 - RNA, 23 nt, Mycobacterium avium subsp. paratuberculosis
gccggccuuggcccgcgcccgcu

SEQ ID NO: 2893816 - RNA, 18 nt, Mycobacterium avium subsp. paratuberculosis
gccggcgaaacacagcag

SEQ ID NO: 2893817 - RNA, 19 nt, Mycobacterium avium subsp. paratuberculosis
gccggcgaaacacagcagc

SEQ ID NO: 2893818 - RNA, 11 nt, Mycobacterium avium subsp. paratuberculosis
gccggcgcagc

SEQ ID NO: 2893819 - RNA, 15 nt, Mycobacterium avium subsp. paratuberculosis
gccggcgcagccggc

SEQ ID NO: 2893820 - RNA, 17 nt, Mycobacterium avium subsp. paratuberculosis
gccggcgcagccggcca

SEQ ID NO: 2893821 - RNA, 22 nt, Mycobacterium avium subsp. paratuberculosis
gccggcgcagccggccaccgcc

SEQ ID NO: 2893822 - RNA, 16 nt, Mycobacterium avium subsp. paratuberculosis
gccggcgcagcggccc

SEQ ID NO: 2893823 - RNA, 18 nt, Mycobacterium avium subsp. paratuberculosis
gccggcgcagcggcccga

SEQ ID NO: 2893824 - RNA, 15 nt, Mycobacterium avium subsp. paratuberculosis
gccggcgcagguguc

SEQ ID NO: 2893825 - RNA, 21 nt, Mycobacterium avium subsp. paratuberculosis
gccggcgcagguguccagccc

SEQ ID NO: 2893826 - RNA, 14 nt, Mycobacterium avium subsp. paratuberculosis
gccggcgcagucca

SEQ ID NO: 2893827 - RNA, 23 nt, Mycobacterium avium subsp. paratuberculosis
gccggcgcaguccaggguggugg

SEQ ID NO: 2893828 - RNA, 17 nt, Mycobacterium avium subsp. paratuberculosis
gccgcccguccagcgca

SEQ ID NO: 2893829 - RNA, 16 nt, Mycobacterium avium subsp. paratuberculosis
gccgcccguccgggcc

SEQ ID NO: 2893830 - RNA, 14 nt, Mycobacterium avium subsp. paratuberculosis
gccgcccgucgccu

SEQ ID NO: 2893831 - RNA, 16 nt, Mycobacterium avium subsp. paratuberculosis
gccgcccgucggggcc

SEQ ID NO: 2893832 - RNA, 18 nt, Mycobacterium avium subsp. paratuberculosis
gccgcccgucggggcccg

SEQ ID NO: 2893833 - RNA, 22 nt, Mycobacterium avium subsp. paratuberculosis
gccgcccgucggggcccggccc

SEQ ID NO: 2893834 - RNA, 22 nt, Mycobacterium avium subsp. paratuberculosis
gccgcccucgcccucgcugauc

SEQ ID NO: 2893835 - RNA, 13 nt, Mycobacterium avium subsp. paratuberculosis
gccgcccucgccg

SEQ ID NO: 2893836 - RNA, 14 nt, Mycobacterium avium subsp. paratuberculosis
gccgcccucgccga

SEQ ID NO: 2893837 - RNA, 15 nt, Mycobacterium avium subsp. paratuberculosis
gccgcccucgccgaa

SEQ ID NO: 2893838 - RNA, 16 nt, Mycobacterium avium subsp. paratuberculosis
gccgcccucgccgaac

SEQ ID NO: 2893839 - RNA, 17 nt, Mycobacterium avium subsp. paratuberculosis
gccgcccucgccgaacc

SEQ ID NO: 2893840 - RNA, 23 nt, Mycobacterium avium subsp. paratuberculosis
gccgcccucgccgaaccggggcc

SEQ ID NO: 2893841 - RNA, 15 nt, Mycobacterium avium subsp. paratuberculosis
gccgcccucgcugcc

SEQ ID NO: 2893842 - RNA, 17 nt, Mycobacterium avium subsp. paratuberculosis
gccgcccucgcugccgc

SEQ ID NO: 2893843 - RNA, 19 nt, Mycobacterium avium subsp. paratuberculosis
gccgcccucgcugccgccc

SEQ ID NO: 2893844 - RNA, 15 nt, Mycobacterium avium subsp. paratuberculosis
gccgcccucggccgu

SEQ ID NO: 2893845 - RNA, 16 nt, Mycobacterium avium subsp. paratuberculosis
gccgcccucggugacg

SEQ ID NO: 2893846 - RNA, 18 nt, Mycobacterium avium subsp. paratuberculosis
gccgcccucggugacgaa

SEQ ID NO: 2893847 - RNA, 17 nt, Mycobacterium avium subsp. paratuberculosis
gccgcccucucacggcg

SEQ ID NO: 2893848 - RNA, 20 nt, Mycobacterium avium subsp. paratuberculosis
gccgcccucucacggcggua

SEQ ID NO: 2893849 - RNA, 15 nt, Mycobacterium avium subsp. paratuberculosis
gccgcccugcccguc

SEQ ID NO: 2893850 - RNA, 22 nt, Mycobacterium avium subsp. paratuberculosis
gccgcccugcccgucgggcgcg

SEQ ID NO: 2893851 - RNA, 21 nt, Mycobacterium avium subsp. paratuberculosis
gccgcccugcgggaacagcgg

SEQ ID NO: 2893852 - RNA, 23 nt, Mycobacterium avium subsp. paratuberculosis
gccgcccugcgggaacagcggga

SEQ ID NO: 2893853 - RNA, 13 nt, Mycobacterium avium subsp. paratuberculosis
gccgcccuggccc

SEQ ID NO: 2893854 - RNA, 18 nt, Mycobacterium avium subsp. paratuberculosis
gccgcccuugcucgcggc

SEQ ID NO: 2893855 - RNA, 19 nt, Mycobacterium avium subsp. paratuberculosis
gccgcccuugcucgcggcg

SEQ ID NO: 2893856 - RNA, 16 nt, Mycobacterium avium subsp. paratuberculosis
gccgcccuuguugaug

SEQ ID NO: 2893857 - RNA, 17 nt, Mycobacterium avium subsp. paratuberculosis
gccgcccuuguugaugg

SEQ ID NO: 2893858 - RNA, 18 nt, Mycobacterium avium subsp. paratuberculosis
gccgccgaaagccuccgc

SEQ ID NO: 2893859 - RNA, 23 nt, Mycobacterium avium subsp. paratuberculosis
gccgccgaaagccuccgcgauca

SEQ ID NO: 2893860 - RNA, 15 nt, Mycobacterium avium subsp. paratuberculosis
gccgccgaacagccg

SEQ ID NO: 2893861 - RNA, 16 nt, Mycobacterium avium subsp. paratuberculosis
gccgccgaacagccgg

SEQ ID NO: 2893862 - RNA, 18 nt, Mycobacterium avium subsp. paratuberculosis
gccgccgaacagccgggu

SEQ ID NO: 2893863 - RNA, 19 nt, Mycobacterium avium subsp. paratuberculosis
gccgccgaacagccgggug

SEQ ID NO: 2893864 - RNA, 16 nt, Mycobacterium avium subsp. paratuberculosis
gccgccgaagcccgac

SEQ ID NO: 2893865 - RNA, 18 nt, Mycobacterium avium subsp. paratuberculosis
gccgccgaagcccgacau

SEQ ID NO: 2893866 - RNA, 15 nt, Mycobacterium avium subsp. paratuberculosis
gccgccgaagccggc

SEQ ID NO: 2893867 - RNA, 16 nt, Mycobacterium avium subsp. paratuberculosis
gccgccgaagccggcu

SEQ ID NO: 2893868 - RNA, 19 nt, Mycobacterium avium subsp. paratuberculosis
gccgccgaagccggcucga

SEQ ID NO: 2893869 - RNA, 14 nt, Mycobacterium avium subsp. paratuberculosis
gccgccgaagcggc

SEQ ID NO: 2893870 - RNA, 16 nt, Mycobacterium avium subsp. paratuberculosis
gccgccgaagcggcgc

SEQ ID NO: 2893871 - RNA, 19 nt, Mycobacterium avium subsp. paratuberculosis
gccgccgaagcggcgcacg

SEQ ID NO: 2893872 - RNA, 16 nt, Mycobacterium avium subsp. paratuberculosis
gccgccgacaccacca

SEQ ID NO: 2893873 - RNA, 15 nt, Mycobacterium avium subsp. paratuberculosis
gccgccgacagcacc

SEQ ID NO: 2893874 - RNA, 19 nt, Mycobacterium avium subsp. paratuberculosis
gccgccgacagcaccucgc

SEQ ID NO: 2893875 - RNA, 20 nt, Mycobacterium avium subsp. paratuberculosis
gccgccgacagcaccucgcc

SEQ ID NO: 2893876 - RNA, 23 nt, Mycobacterium avium subsp. paratuberculosis
gccgccgaccacaugccguugcc

SEQ ID NO: 2893877 - RNA, 12 nt, Mycobacterium avium subsp. paratuberculosis
gccgccgaccgc

SEQ ID NO: 2893878 - RNA, 18 nt, Mycobacterium avium subsp. paratuberculosis
gccgccgaccgccgagcg

SEQ ID NO: 2893879 - RNA, 20 nt, Mycobacterium avium subsp. paratuberculosis
gccgccgaccgccgagcggg

SEQ ID NO: 2893880 - RNA, 22 nt, Mycobacterium avium subsp. paratuberculosis
gccgccgaccgccgagcgggcg

SEQ ID NO: 2893881 - RNA, 24 nt, Mycobacterium avium subsp. paratuberculosis
gccgccgacgaagaugcgcccggu

SEQ ID NO: 2893882 - RNA, 15 nt, Mycobacterium avium subsp. paratuberculosis
gccgccgacgacggc

SEQ ID NO: 2893883 - RNA, 22 nt, Mycobacterium avium subsp. paratuberculosis
gccgccgacgacggcgaacguc

SEQ ID NO: 2893884 - RNA, 16 nt, Mycobacterium avium subsp. paratuberculosis
gccgccgacgguggcc

SEQ ID NO: 2893885 - RNA, 17 nt, Mycobacterium avium subsp. paratuberculosis
gccgccgacgguggccc

SEQ ID NO: 2893886 - RNA, 20 nt, Mycobacterium avium subsp. paratuberculosis
gccgccgacgguggccccca

SEQ ID NO: 2893887 - RNA, 23 nt, Mycobacterium avium subsp. paratuberculosis
gccgccgacgguggcccccacca

SEQ ID NO: 2893888 - RNA, 13 nt, Mycobacterium avium subsp. paratuberculosis
gccgccgacgucg

SEQ ID NO: 2893889 - RNA, 14 nt, Mycobacterium avium subsp. paratuberculosis
gccgccgacgucgu

SEQ ID NO: 2893890 - RNA, 16 nt, Mycobacterium avium subsp. paratuberculosis
gccgccgacgucgugg

SEQ ID NO: 2893891 - RNA, 17 nt, Mycobacterium avium subsp. paratuberculosis
gccgccgacgucguggg

SEQ ID NO: 2893892 - RNA, 15 nt, Mycobacterium avium subsp. paratuberculosis
gccgccgacuccccg

SEQ ID NO: 2893893 - RNA, 17 nt, Mycobacterium avium subsp. paratuberculosis
gccgccgacuccccgcc

SEQ ID NO: 2893894 - RNA, 16 nt, Mycobacterium avium subsp. paratuberculosis
gccgccgagcaacagc

SEQ ID NO: 2893895 - RNA, 20 nt, Mycobacterium avium subsp. paratuberculosis
gccgccgagcaacagcccga

SEQ ID NO: 2893896 - RNA, 15 nt, Mycobacterium avium subsp. paratuberculosis
gccgccgagcagauc

SEQ ID NO: 2893897 - RNA, 13 nt, Mycobacterium avium subsp. paratuberculosis
gccgccgagccgc

SEQ ID NO: 2893898 - RNA, 14 nt, Mycobacterium avium subsp. paratuberculosis
gccgccgagccggc

SEQ ID NO: 2893899 - RNA, 16 nt, Mycobacterium avium subsp. paratuberculosis
gccgccgagccggcac

SEQ ID NO: 2893900 - RNA, 21 nt, Mycobacterium avium subsp. paratuberculosis
gccgccgagccggcacggccg

SEQ ID NO: 2893901 - RNA, 13 nt, Mycobacterium avium subsp. paratuberculosis
gccgccgagcguc

SEQ ID NO: 2893902 - RNA, 15 nt, Mycobacterium avium subsp. paratuberculosis
gccgccgagcgucac

SEQ ID NO: 2893903 - RNA, 18 nt, Mycobacterium avium subsp. paratuberculosis
gccgccgagcgucacgcu

SEQ ID NO: 2893904 - RNA, 22 nt, Mycobacterium avium subsp. paratuberculosis
gccgccgagcgucacgcuagcg

SEQ ID NO: 2893905 - RNA, 15 nt, Mycobacterium avium subsp. paratuberculosis
gccgccgagcucggc

SEQ ID NO: 2893906 - RNA, 18 nt, Mycobacterium avium subsp. paratuberculosis
gccgccgagcucggccac

SEQ ID NO: 2893907 - RNA, 21 nt, Mycobacterium avium subsp. paratuberculosis
gccgccgagcucggccaccag

SEQ ID NO: 2893908 - RNA, 13 nt, Mycobacterium avium subsp. paratuberculosis
gccgccgaggaca

SEQ ID NO: 2893909 - RNA, 16 nt, Mycobacterium avium subsp. paratuberculosis
gccgccgaggacacgu

SEQ ID NO: 2893910 - RNA, 18 nt, Mycobacterium avium subsp. paratuberculosis
gccgccgaggcgaugccg

SEQ ID NO: 2893911 - RNA, 13 nt, Mycobacterium avium subsp. paratuberculosis
gccgccgagggcc

SEQ ID NO: 2893912 - RNA, 14 nt, Mycobacterium avium subsp. paratuberculosis
gccgccgagggcca

SEQ ID NO: 2893913 - RNA, 16 nt, Mycobacterium avium subsp. paratuberculosis
gccgccgcgcgcggcc

SEQ ID NO: 2893914 - RNA, 14 nt, Mycobacterium avium subsp. paratuberculosis
gccgccgcgcgggu

SEQ ID NO: 2893915 - RNA, 16 nt, Mycobacterium avium subsp. paratuberculosis
gccgccgcgcggguac

SEQ ID NO: 2893916 - RNA, 23 nt, Mycobacterium avium subsp. paratuberculosis
gccgccgcggacauucugcacga

SEQ ID NO: 2893917 - RNA, 14 nt, Mycobacterium avium subsp. paratuberculosis
gccgccgcggcacc

SEQ ID NO: 2893918 - RNA, 13 nt, Mycobacterium avium subsp. paratuberculosis
gccgccgcggcca

SEQ ID NO: 2893919 - RNA, 15 nt, Mycobacterium avium subsp. paratuberculosis
gccgccgcggccaca

SEQ ID NO: 2893920 - RNA, 16 nt, Mycobacterium avium subsp. paratuberculosis
gccgccgcggccgcgg

SEQ ID NO: 2893921 - RNA, 12 nt, Mycobacterium avium subsp. paratuberculosis
gccgccgcggcg

SEQ ID NO: 2893922 - RNA, 14 nt, Mycobacterium avium subsp. paratuberculosis
gccgccgcgggucg

SEQ ID NO: 2893923 - RNA, 19 nt, Mycobacterium avium subsp. paratuberculosis
gccgccgcgggucggcgac

SEQ ID NO: 2893924 - RNA, 23 nt, Mycobacterium avium subsp. paratuberculosis
gccgccgcgggucggcgacggcg

SEQ ID NO: 2893925 - RNA, 13 nt, Mycobacterium avium subsp. paratuberculosis
gccgccgcgggug

SEQ ID NO: 2893926 - RNA, 14 nt, Mycobacterium avium subsp. paratuberculosis
gccgccgcgggugg

SEQ ID NO: 2893927 - RNA, 16 nt, Mycobacterium avium subsp. paratuberculosis
gccgccgcggguggcc

SEQ ID NO: 2893928 - RNA, 17 nt, Mycobacterium avium subsp. paratuberculosis
gccgccgcggguggcca

SEQ ID NO: 2893929 - RNA, 19 nt, Mycobacterium avium subsp. paratuberculosis
gccgccgcggguggccagc

SEQ ID NO: 2893930 - RNA, 18 nt, Mycobacterium avium subsp. paratuberculosis
gccgccgcguaggccagg

SEQ ID NO: 2893931 - RNA, 19 nt, Mycobacterium avium subsp. paratuberculosis
gccgccgcguaggccagga

SEQ ID NO: 2893932 - RNA, 12 nt, Mycobacterium avium subsp. paratuberculosis
gccgccgcgucg

SEQ ID NO: 2893933 - RNA, 13 nt, Mycobacterium avium subsp. paratuberculosis
gccgccgcgucgc

SEQ ID NO: 2893934 - RNA, 16 nt, Mycobacterium avium subsp. paratuberculosis
gccgccgcgucgccgc

SEQ ID NO: 2893935 - RNA, 21 nt, Mycobacterium avium subsp. paratuberculosis
gccgccgcgucgccgccgggc

SEQ ID NO: 2893936 - RNA, 14 nt, Mycobacterium avium subsp. paratuberculosis
gccgccgcgucguc

SEQ ID NO: 2893937 - RNA, 17 nt, Mycobacterium avium subsp. paratuberculosis
gccgccgcgucgugccg

SEQ ID NO: 2893938 - RNA, 21 nt, Mycobacterium avium subsp. paratuberculosis
gccgccgcuagucgcccagca

SEQ ID NO: 2893939 - RNA, 24 nt, Mycobacterium avium subsp. paratuberculosis
gccgccggaucggcagcgcguuga

SEQ ID NO: 2893940 - RNA, 13 nt, Mycobacterium avium subsp. paratuberculosis
gccgccggaucgu

SEQ ID NO: 2893941 - RNA, 19 nt, Mycobacterium avium subsp. paratuberculosis
gccgccggauuacucgccg

SEQ ID NO: 2893942 - RNA, 21 nt, Mycobacterium avium subsp. paratuberculosis
gccgccggauuacucgccggc

SEQ ID NO: 2893943 - RNA, 22 nt, Mycobacterium avium subsp. paratuberculosis
gccgccggauuacucgccggcg

SEQ ID NO: 2893944 - RNA, 13 nt, Mycobacterium avium subsp. paratuberculosis
gccgccggcaccg

SEQ ID NO: 2893945 - RNA, 15 nt, Mycobacterium avium subsp. paratuberculosis
gccgccggcaccguc

SEQ ID NO: 2893946 - RNA, 12 nt, Mycobacterium avium subsp. paratuberculosis
gccgccggccac

SEQ ID NO: 2893947 - RNA, 14 nt, Mycobacterium avium subsp. paratuberculosis
gccgccggccagcu

SEQ ID NO: 2893948 - RNA, 15 nt, Mycobacterium avium subsp. paratuberculosis
gccgccggccagcuc

SEQ ID NO: 2893949 - RNA, 17 nt, Mycobacterium avium subsp. paratuberculosis
gccgccggccagcuccg

SEQ ID NO: 2893950 - RNA, 21 nt, Mycobacterium avium subsp. paratuberculosis
gccgccggccagcuccgccac

SEQ ID NO: 2893951 - RNA, 14 nt, Mycobacterium avium subsp. paratuberculosis
gccgccggccgcgg

SEQ ID NO: 2893952 - RNA, 18 nt, Mycobacterium avium subsp. paratuberculosis
gccgccggccgcggcgug

SEQ ID NO: 2893953 - RNA, 13 nt, Mycobacterium avium subsp. paratuberculosis
gccgccggccgcu

SEQ ID NO: 2893954 - RNA, 14 nt, Mycobacterium avium subsp. paratuberculosis
gccgccggccgcuc

SEQ ID NO: 2893955 - RNA, 21 nt, Mycobacterium avium subsp. paratuberculosis
gccgccggccgcucgcgggcc

SEQ ID NO: 2893956 - RNA, 13 nt, Mycobacterium avium subsp. paratuberculosis
gccgccggccucg

SEQ ID NO: 2893957 - RNA, 14 nt, Mycobacterium avium subsp. paratuberculosis
gccgccggccucgg

SEQ ID NO: 2893958 - RNA, 22 nt, Mycobacterium avium subsp. paratuberculosis
gccgccggcgaucucgucgcgc

SEQ ID NO: 2893959 - RNA, 12 nt, Mycobacterium avium subsp. paratuberculosis
gccgccggcgca

SEQ ID NO: 2893960 - RNA, 23 nt, Mycobacterium avium subsp. paratuberculosis
gccgccggcgcaucaucucggcg

SEQ ID NO: 2893961 - RNA, 13 nt, Mycobacterium avium subsp. paratuberculosis
gccgccggcgccc

SEQ ID NO: 2893962 - RNA, 15 nt, Mycobacterium avium subsp. paratuberculosis
gccgccggcgcccug

SEQ ID NO: 2893963 - RNA, 16 nt, Mycobacterium avium subsp. paratuberculosis
gccgccggcgcccugc

SEQ ID NO: 2893964 - RNA, 19 nt, Mycobacterium avium subsp. paratuberculosis
gccgccggcgcccugcgcg

SEQ ID NO: 2893965 - RNA, 15 nt, Mycobacterium avium subsp. paratuberculosis
gccgccggcgcgguu

SEQ ID NO: 2893966 - RNA, 23 nt, Mycobacterium avium subsp. paratuberculosis
gccgccggcgcgguucuugcgcc

SEQ ID NO: 2893967 - RNA, 15 nt, Mycobacterium avium subsp. paratuberculosis
gccgccggcgcuggc

SEQ ID NO: 2893968 - RNA, 21 nt, Mycobacterium avium subsp. paratuberculosis
gccgccggcgcuggcgcgccg

SEQ ID NO: 2893969 - RNA, 22 nt, Mycobacterium avium subsp. paratuberculosis
gccgccggcgcuggcgcgccgu

SEQ ID NO: 2893970 - RNA, 12 nt, Mycobacterium avium subsp. paratuberculosis
gccgccggcggc

SEQ ID NO: 2893971 - RNA, 14 nt, Mycobacterium avium subsp. paratuberculosis
gccgccggcggcca

SEQ ID NO: 2893972 - RNA, 13 nt, Mycobacterium avium subsp. paratuberculosis
gccgccggcggcg

SEQ ID NO: 2893973 - RNA, 15 nt, Mycobacterium avium subsp. paratuberculosis
gccgccggcgguggc

SEQ ID NO: 2893974 - RNA, 21 nt, Mycobacterium avium subsp. paratuberculosis
gccgccggcgguggcguagcg

SEQ ID NO: 2893975 - RNA, 16 nt, Mycobacterium avium subsp. paratuberculosis
gccgccggcgucgacg

SEQ ID NO: 2893976 - RNA, 16 nt, Mycobacterium avium subsp. paratuberculosis
gccgccggcgucgccg

SEQ ID NO: 2893977 - RNA, 17 nt, Mycobacterium avium subsp. paratuberculosis
gccgccggcgucgccgc

SEQ ID NO: 2893978 - RNA, 12 nt, Mycobacterium avium subsp. paratuberculosis
gccgccggcuca

SEQ ID NO: 2893979 - RNA, 22 nt, Mycobacterium avium subsp. paratuberculosis
gccgccgggaacagcgacgccc

SEQ ID NO: 2893980 - RNA, 22 nt, Mycobacterium avium subsp. paratuberculosis
gccgccgggacgggcauccggc

SEQ ID NO: 2893981 - RNA, 15 nt, Mycobacterium avium subsp. paratuberculosis
gccgccgggcaccuc

SEQ ID NO: 2893982 - RNA, 16 nt, Mycobacterium avium subsp. paratuberculosis
gccgccgggcaccucg

SEQ ID NO: 2893983 - RNA, 19 nt, Mycobacterium avium subsp. paratuberculosis
gccgccgggcaccucggcg

SEQ ID NO: 2893984 - RNA, 21 nt, Mycobacterium avium subsp. paratuberculosis
gccgccgggcaccucggcguc

SEQ ID NO: 2893985 - RNA, 23 nt, Mycobacterium avium subsp. paratuberculosis
gccgccgggcaccucggcgucgg

SEQ ID NO: 2893986 - RNA, 12 nt, Mycobacterium avium subsp. paratuberculosis
gccgccgggcca

SEQ ID NO: 2893987 - RNA, 14 nt, Mycobacterium avium subsp. paratuberculosis
gccgccgggccacg

SEQ ID NO: 2893988 - RNA, 18 nt, Mycobacterium avium subsp. paratuberculosis
gccgccgggccacgccga

SEQ ID NO: 2893989 - RNA, 15 nt, Mycobacterium avium subsp. paratuberculosis
gccgccgggccaggu

SEQ ID NO: 2893990 - RNA, 15 nt, Mycobacterium avium subsp. paratuberculosis
gccgccgggccggcg

SEQ ID NO: 2893991 - RNA, 16 nt, Mycobacterium avium subsp. paratuberculosis
gccgccgggccggcgg

SEQ ID NO: 2893992 - RNA, 17 nt, Mycobacterium avium subsp. paratuberculosis
gccgccgggccggcggc

SEQ ID NO: 2893993 - RNA, 13 nt, Mycobacterium avium subsp. paratuberculosis
gccgccgggccug

SEQ ID NO: 2893994 - RNA, 16 nt, Mycobacterium avium subsp. paratuberculosis
gccgccgggccugucc

SEQ ID NO: 2893995 - RNA, 14 nt, Mycobacterium avium subsp. paratuberculosis
gccgccgggcgcca

SEQ ID NO: 2893996 - RNA, 12 nt, Mycobacterium avium subsp. paratuberculosis
gccgccgggcgu

SEQ ID NO: 2893997 - RNA, 18 nt, Mycobacterium avium subsp. paratuberculosis
gccgccgggcguagucga

SEQ ID NO: 2893998 - RNA, 13 nt, Mycobacterium avium subsp. paratuberculosis
gccgccuccgaca

SEQ ID NO: 2893999 - RNA, 14 nt, Mycobacterium avium subsp. paratuberculosis
gccgccuccgacag

SEQ ID NO: 2894000 - RNA, 18 nt, Mycobacterium avium subsp. paratuberculosis
gccgccuccgggcugccg

SEQ ID NO: 2894001 - RNA, 22 nt, Mycobacterium avium subsp. paratuberculosis
gccgccuccgggcugccguaga

SEQ ID NO: 2894002 - RNA, 14 nt, Mycobacterium avium subsp. paratuberculosis
gccgccucgaaguc

SEQ ID NO: 2894003 - RNA, 19 nt, Mycobacterium avium subsp. paratuberculosis
gccgccucgaagucgccgg

SEQ ID NO: 2894004 - RNA, 20 nt, Mycobacterium avium subsp. paratuberculosis
gccgccucgaagucgccggc

SEQ ID NO: 2894005 - RNA, 21 nt, Mycobacterium avium subsp. paratuberculosis
gccgccucgaagucgccggcc

SEQ ID NO: 2894006 - RNA, 22 nt, Mycobacterium avium subsp. paratuberculosis
gccgccucgaagucgccggccu

SEQ ID NO: 2894007 - RNA, 13 nt, Mycobacterium avium subsp. paratuberculosis
gccgccucgucga

SEQ ID NO: 2894008 - RNA, 13 nt, Mycobacterium avium subsp. paratuberculosis
gccgccugcccgg

SEQ ID NO: 2894009 - RNA, 16 nt, Mycobacterium avium subsp. paratuberculosis
gccgccugcccgggcg

SEQ ID NO: 2894010 - RNA, 18 nt, Mycobacterium avium subsp. paratuberculosis
gccgccugcccgggcgcc

SEQ ID NO: 2894011 - RNA, 19 nt, Mycobacterium avium subsp. paratuberculosis
gccgccugcccgggcgccg

SEQ ID NO: 2894012 - RNA, 21 nt, Mycobacterium avium subsp. paratuberculosis
gccgccugcccgggcgccgag

SEQ ID NO: 2894013 - RNA, 12 nt, Mycobacterium avium subsp. paratuberculosis
gccgccugcgcg

SEQ ID NO: 2894014 - RNA, 14 nt, Mycobacterium avium subsp. paratuberculosis
gccgccugcgcgcc

SEQ ID NO: 2894015 - RNA, 15 nt, Mycobacterium avium subsp. paratuberculosis
gccgccugcgcgccg

SEQ ID NO: 2894016 - RNA, 14 nt, Mycobacterium avium subsp. paratuberculosis
gccgccugcggguu

SEQ ID NO: 2894017 - RNA, 18 nt, Mycobacterium avium subsp. paratuberculosis
gccgccuggacgacgucg

SEQ ID NO: 2894018 - RNA, 13 nt, Mycobacterium avium subsp. paratuberculosis
gccgccuggcgaa

SEQ ID NO: 2894019 - RNA, 18 nt, Mycobacterium avium subsp. paratuberculosis
gccgccuucacgaccggc

SEQ ID NO: 2894020 - RNA, 22 nt, Mycobacterium avium subsp. paratuberculosis
gccgccuucuugcgcggcgcga

SEQ ID NO: 2894021 - RNA, 16 nt, Mycobacterium avium subsp. paratuberculosis
gccgccuugacgccgg

SEQ ID NO: 2894022 - RNA, 17 nt, Mycobacterium avium subsp. paratuberculosis
gccgccuugacgccggg

SEQ ID NO: 2894023 - RNA, 18 nt, Mycobacterium avium subsp. paratuberculosis
gccgccuugacgccgggc

SEQ ID NO: 2894024 - RNA, 19 nt, Mycobacterium avium subsp. paratuberculosis
gccgccuugggccggucgg

SEQ ID NO: 2894025 - RNA, 22 nt, Mycobacterium avium subsp. paratuberculosis
gccgccuuggugauccggggca

SEQ ID NO: 2894026 - RNA, 19 nt, Mycobacterium avium subsp. paratuberculosis
gccgcgaaaauaccgccgg

SEQ ID NO: 2894027 - RNA, 20 nt, Mycobacterium avium subsp. paratuberculosis
gccgcgaaaauaccgccggc

SEQ ID NO: 2894028 - RNA, 22 nt, Mycobacterium avium subsp. paratuberculosis
gccgcgaaaauaccgccggccg

SEQ ID NO: 2894029 - RNA, 23 nt, Mycobacterium avium subsp. paratuberculosis
gccgcgaaaauaccgccggccgc

SEQ ID NO: 2894030 - RNA, 15 nt, Mycobacterium avium subsp. paratuberculosis
gccgcgaacgacgac

SEQ ID NO: 2894031 - RNA, 18 nt, Mycobacterium avium subsp. paratuberculosis
gccgcgaacgacgaccuc

SEQ ID NO: 2894032 - RNA, 21 nt, Mycobacterium avium subsp. paratuberculosis
gccgcgaacgacgaccucccc

SEQ ID NO: 2894033 - RNA, 16 nt, Mycobacterium avium subsp. paratuberculosis
gccgcgaacgccucgg

SEQ ID NO: 2894034 - RNA, 22 nt, Mycobacterium avium subsp. paratuberculosis
gccgcgaacggcccgccgccgg

SEQ ID NO: 2894035 - RNA, 21 nt, Mycobacterium avium subsp. paratuberculosis
gccgcgaacgggucgggggug

SEQ ID NO: 2894036 - RNA, 21 nt, Mycobacterium avium subsp. paratuberculosis
gccgcgaacgggugaccggcg

SEQ ID NO: 2894037 - RNA, 14 nt, Mycobacterium avium subsp. paratuberculosis
gccgcgaagauguc

SEQ ID NO: 2894038 - RNA, 16 nt, Mycobacterium avium subsp. paratuberculosis
gccgcgaagaugucgc

SEQ ID NO: 2894039 - RNA, 18 nt, Mycobacterium avium subsp. paratuberculosis
gccgcgaaggcggcgucg

SEQ ID NO: 2894040 - RNA, 19 nt, Mycobacterium avium subsp. paratuberculosis
gccgcgaaggcggcgucga

SEQ ID NO: 2894041 - RNA, 19 nt, Mycobacterium avium subsp. paratuberculosis
gccgcgaauucggcgauga

SEQ ID NO: 2894042 - RNA, 14 nt, Mycobacterium avium subsp. paratuberculosis
gccgcgacacccgc

SEQ ID NO: 2894043 - RNA, 17 nt, Mycobacterium avium subsp. paratuberculosis
gccgcgacacccgcgac

SEQ ID NO: 2894044 - RNA, 18 nt, Mycobacterium avium subsp. paratuberculosis
gccgcgacacccgcgacg

SEQ ID NO: 2894045 - RNA, 19 nt, Mycobacterium avium subsp. paratuberculosis
gccgcgacacccgcgacga

SEQ ID NO: 2894046 - RNA, 16 nt, Mycobacterium avium subsp. paratuberculosis
gccgcgacagccgccc

SEQ ID NO: 2894047 - RNA, 20 nt, Mycobacterium avium subsp. paratuberculosis
gccgcgacagccgcccggcg

SEQ ID NO: 2894048 - RNA, 17 nt, Mycobacterium avium subsp. paratuberculosis
gccgcgacagccgggaa

SEQ ID NO: 2894049 - RNA, 17 nt, Mycobacterium avium subsp. paratuberculosis
gccgcgaccacagcgcc

SEQ ID NO: 2894050 - RNA, 22 nt, Mycobacterium avium subsp. paratuberculosis
gccgcgaccacagcgccucguc

SEQ ID NO: 2894051 - RNA, 14 nt, Mycobacterium avium subsp. paratuberculosis
gccgcgaccccgga

SEQ ID NO: 2894052 - RNA, 14 nt, Mycobacterium avium subsp. paratuberculosis
gccgcgacccgggc

SEQ ID NO: 2894053 - RNA, 15 nt, Mycobacterium avium subsp. paratuberculosis
gccgcgacccgggcc

SEQ ID NO: 2894054 - RNA, 12 nt, Mycobacterium avium subsp. paratuberculosis
gccgcgaccgcg

SEQ ID NO: 2894055 - RNA, 16 nt, Mycobacterium avium subsp. paratuberculosis
gccgcgaccgucagca

SEQ ID NO: 2894056 - RNA, 21 nt, Mycobacterium avium subsp. paratuberculosis
gccgcgaccgucagcagggcc

SEQ ID NO: 2894057 - RNA, 14 nt, Mycobacterium avium subsp. paratuberculosis
gccgcgacgaccgc

SEQ ID NO: 2894058 - RNA, 19 nt, Mycobacterium avium subsp. paratuberculosis
gccgcgacgaccgccugcu

SEQ ID NO: 2894059 - RNA, 21 nt, Mycobacterium avium subsp. paratuberculosis
gccgcgacgaugucgacccgc

SEQ ID NO: 2894060 - RNA, 23 nt, Mycobacterium avium subsp. paratuberculosis
gccgcgacgaugucgacccgcgg

SEQ ID NO: 2894061 - RNA, 12 nt, Mycobacterium avium subsp. paratuberculosis
gccgcgacgccg

SEQ ID NO: 2894062 - RNA, 16 nt, Mycobacterium avium subsp. paratuberculosis
gccgcgacgccgccgc

SEQ ID NO: 2894063 - RNA, 21 nt, Mycobacterium avium subsp. paratuberculosis
gccgcgacgccgccgccgagc

SEQ ID NO: 2894064 - RNA, 16 nt, Mycobacterium avium subsp. paratuberculosis
gccgcgacgccgugcu

SEQ ID NO: 2894065 - RNA, 14 nt, Mycobacterium avium subsp. paratuberculosis
gccgcgacgcgcgg

SEQ ID NO: 2894066 - RNA, 15 nt, Mycobacterium avium subsp. paratuberculosis
gccgcgacggaccag

SEQ ID NO: 2894067 - RNA, 12 nt, Mycobacterium avium subsp. paratuberculosis
gccgcgacggcc

SEQ ID NO: 2894068 - RNA, 15 nt, Mycobacterium avium subsp. paratuberculosis
gccgcgacggccgcc

SEQ ID NO: 2894069 - RNA, 18 nt, Mycobacterium avium subsp. paratuberculosis
gccgcgacggccgccgau

SEQ ID NO: 2894070 - RNA, 14 nt, Mycobacterium avium subsp. paratuberculosis
gccgcgacggcggg

SEQ ID NO: 2894071 - RNA, 15 nt, Mycobacterium avium subsp. paratuberculosis
gccgcgacggguugc

SEQ ID NO: 2894072 - RNA, 20 nt, Mycobacterium avium subsp. paratuberculosis
gccgcgacgguuguucagcc

SEQ ID NO: 2894073 - RNA, 22 nt, Mycobacterium avium subsp. paratuberculosis
gccgcgacgguuguucagcccg

SEQ ID NO: 2894074 - RNA, 18 nt, Mycobacterium avium subsp. paratuberculosis
gccgcgacguagccggua

SEQ ID NO: 2894075 - RNA, 16 nt, Mycobacterium avium subsp. paratuberculosis
gccgcgacgucggugu

SEQ ID NO: 2894076 - RNA, 17 nt, Mycobacterium avium subsp. paratuberculosis
gccgcgacucggugucg

SEQ ID NO: 2894077 - RNA, 21 nt, Mycobacterium avium subsp. paratuberculosis
gccgcgacucggugucgcuca

SEQ ID NO: 2894078 - RNA, 15 nt, Mycobacterium avium subsp. paratuberculosis
gccgcgacugcaccc

SEQ ID NO: 2894079 - RNA, 16 nt, Mycobacterium avium subsp. paratuberculosis
gccgcgacugcacccg

SEQ ID NO: 2894080 - RNA, 21 nt, Mycobacterium avium subsp. paratuberculosis
gccgcgacugcaggugacgga

SEQ ID NO: 2894081 - RNA, 21 nt, Mycobacterium avium subsp. paratuberculosis
gccgcgagcacgacgucgacg

SEQ ID NO: 2894082 - RNA, 14 nt, Mycobacterium avium subsp. paratuberculosis
gccgcgagcccggc

SEQ ID NO: 2894083 - RNA, 14 nt, Mycobacterium avium subsp. paratuberculosis
gccgcgccagccgc

SEQ ID NO: 2894084 - RNA, 15 nt, Mycobacterium avium subsp. paratuberculosis
gccgcgccagccgcc

SEQ ID NO: 2894085 - RNA, 16 nt, Mycobacterium avium subsp. paratuberculosis
gccgcgccagccgccg

SEQ ID NO: 2894086 - RNA, 18 nt, Mycobacterium avium subsp. paratuberculosis
gccgcgccagccgccgcc

SEQ ID NO: 2894087 - RNA, 22 nt, Mycobacterium avium subsp. paratuberculosis
gccgcgccagccgccgccgacc

SEQ ID NO: 2894088 - RNA, 20 nt, Mycobacterium avium subsp. paratuberculosis
gccgcgcccacccgcgcacg

SEQ ID NO: 2894089 - RNA, 12 nt, Mycobacterium avium subsp. paratuberculosis
gccgcgcccagc

SEQ ID NO: 2894090 - RNA, 13 nt, Mycobacterium avium subsp. paratuberculosis
gccgcgcccagca

SEQ ID NO: 2894091 - RNA, 15 nt, Mycobacterium avium subsp. paratuberculosis
gccgcgcccagcacg

SEQ ID NO: 2894092 - RNA, 16 nt, Mycobacterium avium subsp. paratuberculosis
gccgcgcccagcacgu

SEQ ID NO: 2894093 - RNA, 17 nt, Mycobacterium avium subsp. paratuberculosis
gccgcgcccaguguggg

SEQ ID NO: 2894094 - RNA, 15 nt, Mycobacterium avium subsp. paratuberculosis
gccgcgcccaucgcg

SEQ ID NO: 2894095 - RNA, 17 nt, Mycobacterium avium subsp. paratuberculosis
gccgcgcccaucgcggc

SEQ ID NO: 2894096 - RNA, 18 nt, Mycobacterium avium subsp. paratuberculosis
gccgcgcccaucgcggcc

SEQ ID NO: 2894097 - RNA, 19 nt, Mycobacterium avium subsp. paratuberculosis
gccgcgcccaucgcggccg

SEQ ID NO: 2894098 - RNA, 13 nt, Mycobacterium avium subsp. paratuberculosis
gccgcgccccgag

SEQ ID NO: 2894099 - RNA, 16 nt, Mycobacterium avium subsp. paratuberculosis
gccgcgccccgagcag

SEQ ID NO: 2894100 - RNA, 18 nt, Mycobacterium avium subsp. paratuberculosis
gccgcgccccgagcagcg

SEQ ID NO: 2894101 - RNA, 22 nt, Mycobacterium avium subsp. paratuberculosis
gccgcgccccgagcagcggguc

SEQ ID NO: 2894102 - RNA, 15 nt, Mycobacterium avium subsp. paratuberculosis
gccgcgccccggcgc

SEQ ID NO: 2894103 - RNA, 18 nt, Mycobacterium avium subsp. paratuberculosis
gccgcgccccggcgcgcc

SEQ ID NO: 2894104 - RNA, 19 nt, Mycobacterium avium subsp. paratuberculosis
gccgcgccccggcgcgccu

SEQ ID NO: 2894105 - RNA, 12 nt, Mycobacterium avium subsp. paratuberculosis
gccgcgcccgau

SEQ ID NO: 2894106 - RNA, 16 nt, Mycobacterium avium subsp. paratuberculosis
gccgcgcccgauggag

SEQ ID NO: 2894107 - RNA, 14 nt, Mycobacterium avium subsp. paratuberculosis
gccgcgcccgccgg

SEQ ID NO: 2894108 - RNA, 15 nt, Mycobacterium avium subsp. paratuberculosis
gccgcgcccgccggc

SEQ ID NO: 2894109 - RNA, 16 nt, Mycobacterium avium subsp. paratuberculosis
gccgcgcccgccggcc

SEQ ID NO: 2894110 - RNA, 17 nt, Mycobacterium avium subsp. paratuberculosis
gccgcgcccgccggccc

SEQ ID NO: 2894111 - RNA, 19 nt, Mycobacterium avium subsp. paratuberculosis
gccgcgcccgccggcccag

SEQ ID NO: 2894112 - RNA, 19 nt, Mycobacterium avium subsp. paratuberculosis
gccgcgcccggcuucgccg

SEQ ID NO: 2894113 - RNA, 23 nt, Mycobacterium avium subsp. paratuberculosis
gccgcgcccggcuucgccgcgcu

SEQ ID NO: 2894114 - RNA, 11 nt, Mycobacterium avium subsp. paratuberculosis
gccgcgcccgu

SEQ ID NO: 2894115 - RNA, 12 nt, Mycobacterium avium subsp. paratuberculosis
gccgcgcccguc

SEQ ID NO: 2894116 - RNA, 17 nt, Mycobacterium avium subsp. paratuberculosis
gccgcgcccuucuucgc

SEQ ID NO: 2894117 - RNA, 23 nt, Mycobacterium avium subsp. paratuberculosis
gccgcgcccuucuucgcgggugc

SEQ ID NO: 2894118 - RNA, 24 nt, Mycobacterium avium subsp. paratuberculosis
gccgcgcccuucuucgcgggugcc

SEQ ID NO: 2894119 - RNA, 13 nt, Mycobacterium avium subsp. paratuberculosis
gccgcgccgaaca

SEQ ID NO: 2894120 - RNA, 19 nt, Mycobacterium avium subsp. paratuberculosis
gccgcgccgaacaccacgc

SEQ ID NO: 2894121 - RNA, 23 nt, Mycobacterium avium subsp. paratuberculosis
gccgcgccgaacaccacgccgag

SEQ ID NO: 2894122 - RNA, 16 nt, Mycobacterium avium subsp. paratuberculosis
gccgcgccgaccucgu

SEQ ID NO: 2894123 - RNA, 17 nt, Mycobacterium avium subsp. paratuberculosis
gccgcgccgaccucguc

SEQ ID NO: 2894124 - RNA, 19 nt, Mycobacterium avium subsp. paratuberculosis
gccgcgccgaccucgucgg

SEQ ID NO: 2894125 - RNA, 16 nt, Mycobacterium avium subsp. paratuberculosis
gccgcgccgacgccca

SEQ ID NO: 2894126 - RNA, 13 nt, Mycobacterium avium subsp. paratuberculosis
gccgcgccgagga

SEQ ID NO: 2894127 - RNA, 22 nt, Mycobacterium avium subsp. paratuberculosis
gccgcgccgaggaacugcagcg

SEQ ID NO: 2894128 - RNA, 20 nt, Mycobacterium avium subsp. paratuberculosis
gccgcgccgaggcgcucggc

SEQ ID NO: 2894129 - RNA, 10 nt, Mycobacterium avium subsp. paratuberculosis
gccgcgccgc

SEQ ID NO: 2894130 - RNA, 20 nt, Mycobacterium avium subsp. paratuberculosis
gccgcgccgccacaccucgg

SEQ ID NO: 2894131 - RNA, 17 nt, Mycobacterium avium subsp. paratuberculosis
gccgcgccgcccggcga

SEQ ID NO: 2894132 - RNA, 15 nt, Mycobacterium avium subsp. paratuberculosis
gccgcgccgccgacc

SEQ ID NO: 2894133 - RNA, 16 nt, Mycobacterium avium subsp. paratuberculosis
gccgcgccgccgcccu

SEQ ID NO: 2894134 - RNA, 14 nt, Mycobacterium avium subsp. paratuberculosis
gccgcgccgccgcg

SEQ ID NO: 2894135 - RNA, 13 nt, Mycobacterium avium subsp. paratuberculosis
gccgcgccgccgg

SEQ ID NO: 2894136 - RNA, 14 nt, Mycobacterium avium subsp. paratuberculosis
gccgcgccgccggu

SEQ ID NO: 2894137 - RNA, 15 nt, Mycobacterium avium subsp. paratuberculosis
gccgcgccgccggug

SEQ ID NO: 2894138 - RNA, 16 nt, Mycobacterium avium subsp. paratuberculosis
gccgcgccgccgguga

SEQ ID NO: 2894139 - RNA, 22 nt, Mycobacterium avium subsp. paratuberculosis
gccgcgccgccggugaccacgc

SEQ ID NO: 2894140 - RNA, 14 nt, Mycobacterium avium subsp. paratuberculosis
gccgcgccgcgccg

SEQ ID NO: 2894141 - RNA, 15 nt, Mycobacterium avium subsp. paratuberculosis
gccgcgccgcgccgc

SEQ ID NO: 2894142 - RNA, 16 nt, Mycobacterium avium subsp. paratuberculosis
gccgcgccgcgccgcc

SEQ ID NO: 2894143 - RNA, 13 nt, Mycobacterium avium subsp. paratuberculosis
gccgcgccgcggu

SEQ ID NO: 2894144 - RNA, 18 nt, Mycobacterium avium subsp. paratuberculosis
gccgcgccggaugguccg

SEQ ID NO: 2894145 - RNA, 13 nt, Mycobacterium avium subsp. paratuberculosis
gccgcgccggccu

SEQ ID NO: 2894146 - RNA, 11 nt, Mycobacterium avium subsp. paratuberculosis
gccgcgccggg

SEQ ID NO: 2894147 - RNA, 13 nt, Mycobacterium avium subsp. paratuberculosis
gccgcgccgggcg

SEQ ID NO: 2894148 - RNA, 14 nt, Mycobacterium avium subsp. paratuberculosis
gccgcgccgggcga

SEQ ID NO: 2894149 - RNA, 15 nt, Mycobacterium avium subsp. paratuberculosis
gccgcgccgggcgcc

SEQ ID NO: 2894150 - RNA, 16 nt, Mycobacterium avium subsp. paratuberculosis
gccgcgccgggcgccc

SEQ ID NO: 2894151 - RNA, 17 nt, Mycobacterium avium subsp. paratuberculosis
gccgcgccgggcgcccg

SEQ ID NO: 2894152 - RNA, 14 nt, Mycobacterium avium subsp. paratuberculosis
gccgcgccgggcgg

SEQ ID NO: 2894153 - RNA, 13 nt, Mycobacterium avium subsp. paratuberculosis
gccgcgccggggu

SEQ ID NO: 2894154 - RNA, 16 nt, Mycobacterium avium subsp. paratuberculosis
gccgcgccgggguguc

SEQ ID NO: 2894155 - RNA, 19 nt, Mycobacterium avium subsp. paratuberculosis
gccgcgccguagcggccca

SEQ ID NO: 2894156 - RNA, 20 nt, Mycobacterium avium subsp. paratuberculosis
gccgcgccguagcggcccag

SEQ ID NO: 2894157 - RNA, 22 nt, Mycobacterium avium subsp. paratuberculosis
gccgcgccguagcggcccaggu

SEQ ID NO: 2894158 - RNA, 14 nt, Mycobacterium avium subsp. paratuberculosis
gccgcgcgacgccg

SEQ ID NO: 2894159 - RNA, 14 nt, Mycobacterium avium subsp. paratuberculosis
gccgcgcgagcauc

SEQ ID NO: 2894160 - RNA, 12 nt, Mycobacterium avium subsp. paratuberculosis
gccgcgcgcagc

SEQ ID NO: 2894161 - RNA, 14 nt, Mycobacterium avium subsp. paratuberculosis
gccgcgcgcagcac

SEQ ID NO: 2894162 - RNA, 12 nt, Mycobacterium avium subsp. paratuberculosis
gccgcgcgcagg

SEQ ID NO: 2894163 - RNA, 12 nt, Mycobacterium avium subsp. paratuberculosis
gccgcgcgcauc

SEQ ID NO: 2894164 - RNA, 15 nt, Mycobacterium avium subsp. paratuberculosis
gccgcgcgcaucucg

SEQ ID NO: 2894165 - RNA, 22 nt, Mycobacterium avium subsp. paratuberculosis
gccgcgcgcaucucgaaugcgg

SEQ ID NO: 2894166 - RNA, 20 nt, Mycobacterium avium subsp. paratuberculosis
gccgcgcgccagcgcgugcg

SEQ ID NO: 2894167 - RNA, 15 nt, Mycobacterium avium subsp. paratuberculosis
gccgcgcgcccgcgg

SEQ ID NO: 2894168 - RNA, 16 nt, Mycobacterium avium subsp. paratuberculosis
gccgcgcgcccgcggc

SEQ ID NO: 2894169 - RNA, 20 nt, Mycobacterium avium subsp. paratuberculosis
gccgcggacggccagcccgu

SEQ ID NO: 2894170 - RNA, 17 nt, Mycobacterium avium subsp. paratuberculosis
gccgcggacggcgaacu

SEQ ID NO: 2894171 - RNA, 14 nt, Mycobacterium avium subsp. paratuberculosis
gccgcggagcggcg

SEQ ID NO: 2894172 - RNA, 15 nt, Mycobacterium avium subsp. paratuberculosis
gccgcggagcggcgg

SEQ ID NO: 2894173 - RNA, 16 nt, Mycobacterium avium subsp. paratuberculosis
gccgcggagcggcggu

SEQ ID NO: 2894174 - RNA, 17 nt, Mycobacterium avium subsp. paratuberculosis
gccgcggagcggcgguc

SEQ ID NO: 2894175 - RNA, 21 nt, Mycobacterium avium subsp. paratuberculosis
gccgcggagcggcggucacga

SEQ ID NO: 2894176 - RNA, 18 nt, Mycobacterium avium subsp. paratuberculosis
gccgcggaguaggcgccg

SEQ ID NO: 2894177 - RNA, 20 nt, Mycobacterium avium subsp. paratuberculosis
gccgcggaucagcaggaccg

SEQ ID NO: 2894178 - RNA, 22 nt, Mycobacterium avium subsp. paratuberculosis
gccgcggaucagcaggaccggg

SEQ ID NO: 2894179 - RNA, 20 nt, Mycobacterium avium subsp. paratuberculosis
gccgcggaucuucuccgcca

SEQ ID NO: 2894180 - RNA, 16 nt, Mycobacterium avium subsp. paratuberculosis
gccgcggauggccucg

SEQ ID NO: 2894181 - RNA, 22 nt, Mycobacterium avium subsp. paratuberculosis
gccgcggauggugacggccgug

SEQ ID NO: 2894182 - RNA, 21 nt, Mycobacterium avium subsp. paratuberculosis
gccgcggauguggaggcgagc

SEQ ID NO: 2894183 - RNA, 23 nt, Mycobacterium avium subsp. paratuberculosis
gccgcggauguggaggcgagcaa

SEQ ID NO: 2894184 - RNA, 23 nt, Mycobacterium avium subsp. paratuberculosis
gccgcggauuccggcaucggcuc

SEQ ID NO: 2894185 - RNA, 17 nt, Mycobacterium avium subsp. paratuberculosis
gccgcggcaacgccagc

SEQ ID NO: 2894186 - RNA, 18 nt, Mycobacterium avium subsp. paratuberculosis
gccgcggcaacgccagcc

SEQ ID NO: 2894187 - RNA, 19 nt, Mycobacterium avium subsp. paratuberculosis
gccgcggcaacgccagcca

SEQ ID NO: 2894188 - RNA, 21 nt, Mycobacterium avium subsp. paratuberculosis
gccgcggccacacuggcguga

SEQ ID NO: 2894189 - RNA, 17 nt, Mycobacterium avium subsp. paratuberculosis
gccgcggccaccggguc

SEQ ID NO: 2894190 - RNA, 18 nt, Mycobacterium avium subsp. paratuberculosis
gccgcggccaccgggucg

SEQ ID NO: 2894191 - RNA, 12 nt, Mycobacterium avium subsp. paratuberculosis
gccgcggccacg

SEQ ID NO: 2894192 - RNA, 15 nt, Mycobacterium avium subsp. paratuberculosis
gccgcggccacgcuc

SEQ ID NO: 2894193 - RNA, 21 nt, Mycobacterium avium subsp. paratuberculosis
gccgcggccacgcucgggccg

SEQ ID NO: 2894194 - RNA, 13 nt, Mycobacterium avium subsp. paratuberculosis
gccgcggccagcg

SEQ ID NO: 2894195 - RNA, 16 nt, Mycobacterium avium subsp. paratuberculosis
gccgcggccagcgagg

SEQ ID NO: 2894196 - RNA, 19 nt, Mycobacterium avium subsp. paratuberculosis
gccgcggccagcgaggugg

SEQ ID NO: 2894197 - RNA, 16 nt, Mycobacterium avium subsp. paratuberculosis
gccgcggccagcgccc

SEQ ID NO: 2894198 - RNA, 14 nt, Mycobacterium avium subsp. paratuberculosis
gccgcggccagcuc

SEQ ID NO: 2894199 - RNA, 22 nt, Mycobacterium avium subsp. paratuberculosis
gccgcggccagcuccgggucga

SEQ ID NO: 2894200 - RNA, 17 nt, Mycobacterium avium subsp. paratuberculosis
gccgcggccagcugccc

SEQ ID NO: 2894201 - RNA, 13 nt, Mycobacterium avium subsp. paratuberculosis
gccgcggccaggu

SEQ ID NO: 2894202 - RNA, 20 nt, Mycobacterium avium subsp. paratuberculosis
gccgcggcccaugggggaac

SEQ ID NO: 2894203 - RNA, 16 nt, Mycobacterium avium subsp. paratuberculosis
gccgcggcccgcuucc

SEQ ID NO: 2894204 - RNA, 18 nt, Mycobacterium avium subsp. paratuberculosis
gccgcggcccggccacca

SEQ ID NO: 2894205 - RNA, 14 nt, Mycobacterium avium subsp. paratuberculosis
gccgcggcccugca

SEQ ID NO: 2894206 - RNA, 15 nt, Mycobacterium avium subsp. paratuberculosis
gccgcggcccugcag

SEQ ID NO: 2894207 - RNA, 12 nt, Mycobacterium avium subsp. paratuberculosis
gccgcggccgcc

SEQ ID NO: 2894208 - RNA, 13 nt, Mycobacterium avium subsp. paratuberculosis
gccgcggccgccg

SEQ ID NO: 2894209 - RNA, 14 nt, Mycobacterium avium subsp. paratuberculosis
gccgcggccgccgc

SEQ ID NO: 2894210 - RNA, 16 nt, Mycobacterium avium subsp. paratuberculosis
gccgcggccgccgcga

SEQ ID NO: 2894211 - RNA, 21 nt, Mycobacterium avium subsp. paratuberculosis
gccgcggccgccgcgacggcc

SEQ ID NO: 2894212 - RNA, 14 nt, Mycobacterium avium subsp. paratuberculosis
gccgcggccgccuc

SEQ ID NO: 2894213 - RNA, 13 nt, Mycobacterium avium subsp. paratuberculosis
gccgcggccgcga

SEQ ID NO: 2894214 - RNA, 15 nt, Mycobacterium avium subsp. paratuberculosis
gccgcggccgcgaug

SEQ ID NO: 2894215 - RNA, 15 nt, Mycobacterium avium subsp. paratuberculosis
gccgcggccgcggcg

SEQ ID NO: 2894216 - RNA, 16 nt, Mycobacterium avium subsp. paratuberculosis
gccgcggccgcggcgg

SEQ ID NO: 2894217 - RNA, 17 nt, Mycobacterium avium subsp. paratuberculosis
gccgcggccgcggcggg

SEQ ID NO: 2894218 - RNA, 13 nt, Mycobacterium avium subsp. paratuberculosis
gccgcggccgcgu

SEQ ID NO: 2894219 - RNA, 17 nt, Mycobacterium avium subsp. paratuberculosis
gccgcggccgcguuguc

SEQ ID NO: 2894220 - RNA, 13 nt, Mycobacterium avium subsp. paratuberculosis
gccgcggccggca

SEQ ID NO: 2894221 - RNA, 14 nt, Mycobacterium avium subsp. paratuberculosis
gccgcggccggcac

SEQ ID NO: 2894222 - RNA, 15 nt, Mycobacterium avium subsp. paratuberculosis
gccgcggccggcacu

SEQ ID NO: 2894223 - RNA, 14 nt, Mycobacterium avium subsp. paratuberculosis
gccgcggccggcgg

SEQ ID NO: 2894224 - RNA, 17 nt, Mycobacterium avium subsp. paratuberculosis
gccgcggccggcggcag

SEQ ID NO: 2894225 - RNA, 16 nt, Mycobacterium avium subsp. paratuberculosis
gccgcggccggugcca

SEQ ID NO: 2894226 - RNA, 18 nt, Mycobacterium avium subsp. paratuberculosis
gccgcggccggugccacg

SEQ ID NO: 2894227 - RNA, 19 nt, Mycobacterium avium subsp. paratuberculosis
gccgcggccggugccacgg

SEQ ID NO: 2894228 - RNA, 13 nt, Mycobacterium avium subsp. paratuberculosis
gccgcggccgucg

SEQ ID NO: 2894229 - RNA, 15 nt, Mycobacterium avium subsp. paratuberculosis
gccgcggcgacaccc

SEQ ID NO: 2894230 - RNA, 18 nt, Mycobacterium avium subsp. paratuberculosis
gccgcggcgaccggggcg

SEQ ID NO: 2894231 - RNA, 16 nt, Mycobacterium avium subsp. paratuberculosis
gccgcggcgagccggc

SEQ ID NO: 2894232 - RNA, 18 nt, Mycobacterium avium subsp. paratuberculosis
gccgcggcgagccggccg

SEQ ID NO: 2894233 - RNA, 19 nt, Mycobacterium avium subsp. paratuberculosis
gccgcggcgagccggccgu

SEQ ID NO: 2894234 - RNA, 13 nt, Mycobacterium avium subsp. paratuberculosis
gccgcggcgaucg

SEQ ID NO: 2894235 - RNA, 14 nt, Mycobacterium avium subsp. paratuberculosis
gccgcggcgaucgg

SEQ ID NO: 2894236 - RNA, 18 nt, Mycobacterium avium subsp. paratuberculosis
gccgcggcgaucggcggu

SEQ ID NO: 2894237 - RNA, 19 nt, Mycobacterium avium subsp. paratuberculosis
gccgcggcgaucggcgguc

SEQ ID NO: 2894238 - RNA, 21 nt, Mycobacterium avium subsp. paratuberculosis
gccgcggcgaucggcgguccg

SEQ ID NO: 2894239 - RNA, 16 nt, Mycobacterium avium subsp. paratuberculosis
gccgcggcgcaccccg

SEQ ID NO: 2894240 - RNA, 17 nt, Mycobacterium avium subsp. paratuberculosis
gccgcggcgcaccccga

SEQ ID NO: 2894241 - RNA, 11 nt, Mycobacterium avium subsp. paratuberculosis
gccgcggcgcc

SEQ ID NO: 2894242 - RNA, 15 nt, Mycobacterium avium subsp. paratuberculosis
gccgcggcgcccggc

SEQ ID NO: 2894243 - RNA, 16 nt, Mycobacterium avium subsp. paratuberculosis
gccgcggcgcccggcg

SEQ ID NO: 2894244 - RNA, 13 nt, Mycobacterium avium subsp. paratuberculosis
gccgcggcgcccu

SEQ ID NO: 2894245 - RNA, 12 nt, Mycobacterium avium subsp. paratuberculosis
gccgcggcgccg

SEQ ID NO: 2894246 - RNA, 14 nt, Mycobacterium avium subsp. paratuberculosis
gccgcggcgccgcc

SEQ ID NO: 2894247 - RNA, 13 nt, Mycobacterium avium subsp. paratuberculosis
gccgcggcgcgca

SEQ ID NO: 2894248 - RNA, 19 nt, Mycobacterium avium subsp. paratuberculosis
gccgcggcgcgcaucccga

SEQ ID NO: 2894249 - RNA, 18 nt, Mycobacterium avium subsp. paratuberculosis
gccgcggcgcggcccggc

SEQ ID NO: 2894250 - RNA, 19 nt, Mycobacterium avium subsp. paratuberculosis
gccgcggcgcggcccggcc

SEQ ID NO: 2894251 - RNA, 12 nt, Mycobacterium avium subsp. paratuberculosis
gccgcggcggca

SEQ ID NO: 2894252 - RNA, 13 nt, Mycobacterium avium subsp. paratuberculosis
gccgcggcggcaa

SEQ ID NO: 2894253 - RNA, 14 nt, Mycobacterium avium subsp. paratuberculosis
gccgcggcggcagc

SEQ ID NO: 2894254 - RNA, 16 nt, Mycobacterium avium subsp. paratuberculosis
gccgcgguggcggugu

SEQ ID NO: 2894255 - RNA, 17 nt, Mycobacterium avium subsp. paratuberculosis
gccgcgguggcgguguu

SEQ ID NO: 2894256 - RNA, 18 nt, Mycobacterium avium subsp. paratuberculosis
gccgcgguggcgguguuc

SEQ ID NO: 2894257 - RNA, 13 nt, Mycobacterium avium subsp. paratuberculosis
gccgcgguggugg

SEQ ID NO: 2894258 - RNA, 20 nt, Mycobacterium avium subsp. paratuberculosis
gccgcgguggugggcgcggu

SEQ ID NO: 2894259 - RNA, 21 nt, Mycobacterium avium subsp. paratuberculosis
gccgcgguggugggcgcggug

SEQ ID NO: 2894260 - RNA, 14 nt, Mycobacterium avium subsp. paratuberculosis
gccgcgguucggcg

SEQ ID NO: 2894261 - RNA, 17 nt, Mycobacterium avium subsp. paratuberculosis
gccgcgguucggcgucg

SEQ ID NO: 2894262 - RNA, 18 nt, Mycobacterium avium subsp. paratuberculosis
gccgcgguucggcgucgg

SEQ ID NO: 2894263 - RNA, 14 nt, Mycobacterium avium subsp. paratuberculosis
gccgcgguugaaca

SEQ ID NO: 2894264 - RNA, 16 nt, Mycobacterium avium subsp. paratuberculosis
gccgcgguugaacagg

SEQ ID NO: 2894265 - RNA, 18 nt, Mycobacterium avium subsp. paratuberculosis
gccgcgguugaacaggcu

SEQ ID NO: 2894266 - RNA, 23 nt, Mycobacterium avium subsp. paratuberculosis
gccgcgguugaacaggcugcccu

SEQ ID NO: 2894267 - RNA, 20 nt, Mycobacterium avium subsp. paratuberculosis
gccgcgguuggucaccaggu

SEQ ID NO: 2894268 - RNA, 23 nt, Mycobacterium avium subsp. paratuberculosis
gccgcgguuggucaccaggucgc

SEQ ID NO: 2894269 - RNA, 15 nt, Mycobacterium avium subsp. paratuberculosis
gccgcguacaccggc

SEQ ID NO: 2894270 - RNA, 16 nt, Mycobacterium avium subsp. paratuberculosis
gccgcguacaccggcu

SEQ ID NO: 2894271 - RNA, 18 nt, Mycobacterium avium subsp. paratuberculosis
gccgcguacaccggcuga

SEQ ID NO: 2894272 - RNA, 19 nt, Mycobacterium avium subsp. paratuberculosis
gccgcguacaccggcugac

SEQ ID NO: 2894273 - RNA, 13 nt, Mycobacterium avium subsp. paratuberculosis
gccgcguacagca

SEQ ID NO: 2894274 - RNA, 17 nt, Mycobacterium avium subsp. paratuberculosis
gccgcguacagcagcug

SEQ ID NO: 2894275 - RNA, 17 nt, Mycobacterium avium subsp. paratuberculosis
gccgcguacagccagcc

SEQ ID NO: 2894276 - RNA, 15 nt, Mycobacterium avium subsp. paratuberculosis
gccgcguaccagcgc

SEQ ID NO: 2894277 - RNA, 16 nt, Mycobacterium avium subsp. paratuberculosis
gccgcguaccagcgcc

SEQ ID NO: 2894278 - RNA, 20 nt, Mycobacterium avium subsp. paratuberculosis
gccgcguacuucgcgcccug

SEQ ID NO: 2894279 - RNA, 21 nt, Mycobacterium avium subsp. paratuberculosis
gccgcguacuucgcgcccugg

SEQ ID NO: 2894280 - RNA, 16 nt, Mycobacterium avium subsp. paratuberculosis
gccgcguagcucgccg

SEQ ID NO: 2894281 - RNA, 18 nt, Mycobacterium avium subsp. paratuberculosis
gccgcguagcucgccgcg

SEQ ID NO: 2894282 - RNA, 19 nt, Mycobacterium avium subsp. paratuberculosis
gccgcguagcucgccgcgg

SEQ ID NO: 2894283 - RNA, 20 nt, Mycobacterium avium subsp. paratuberculosis
gccgcguagcucgccgcggc

SEQ ID NO: 2894284 - RNA, 16 nt, Mycobacterium avium subsp. paratuberculosis
gccgcguaggccagga

SEQ ID NO: 2894285 - RNA, 19 nt, Mycobacterium avium subsp. paratuberculosis
gccgcguaggccaggaccg

SEQ ID NO: 2894286 - RNA, 15 nt, Mycobacterium avium subsp. paratuberculosis
gccgcgucacgucgg

SEQ ID NO: 2894287 - RNA, 16 nt, Mycobacterium avium subsp. paratuberculosis
gccgcgucacgucggc

SEQ ID NO: 2894288 - RNA, 19 nt, Mycobacterium avium subsp. paratuberculosis
gccgcgucacgucggccug

SEQ ID NO: 2894289 - RNA, 14 nt, Mycobacterium avium subsp. paratuberculosis
gccgcgucagcggc

SEQ ID NO: 2894290 - RNA, 15 nt, Mycobacterium avium subsp. paratuberculosis
gccgcgucagcggcg

SEQ ID NO: 2894291 - RNA, 16 nt, Mycobacterium avium subsp. paratuberculosis
gccgcguccggggugc

SEQ ID NO: 2894292 - RNA, 23 nt, Mycobacterium avium subsp. paratuberculosis
gccgcguccucgccguacgcgcc

SEQ ID NO: 2894293 - RNA, 15 nt, Mycobacterium avium subsp. paratuberculosis
gccgcguccucgucg

SEQ ID NO: 2894294 - RNA, 16 nt, Mycobacterium avium subsp. paratuberculosis
gccgcguccucgucga

SEQ ID NO: 2894295 - RNA, 12 nt, Mycobacterium avium subsp. paratuberculosis
gccgcgucgacc

SEQ ID NO: 2894296 - RNA, 15 nt, Mycobacterium avium subsp. paratuberculosis
gccgcgucgaccagc

SEQ ID NO: 2894297 - RNA, 16 nt, Mycobacterium avium subsp. paratuberculosis
gccgcgucgaccagcc

SEQ ID NO: 2894298 - RNA, 19 nt, Mycobacterium avium subsp. paratuberculosis
gccgcgucgaccagccggu

SEQ ID NO: 2894299 - RNA, 13 nt, Mycobacterium avium subsp. paratuberculosis
gccgcgucgacgc

SEQ ID NO: 2894300 - RNA, 14 nt, Mycobacterium avium subsp. paratuberculosis
gccgcgucgacgcc

SEQ ID NO: 2894301 - RNA, 16 nt, Mycobacterium avium subsp. paratuberculosis
gccgcgucgacgccgc

SEQ ID NO: 2894302 - RNA, 13 nt, Mycobacterium avium subsp. paratuberculosis
gccgcgucgccga

SEQ ID NO: 2894303 - RNA, 15 nt, Mycobacterium avium subsp. paratuberculosis
gccgcgucgccgacc

SEQ ID NO: 2894304 - RNA, 17 nt, Mycobacterium avium subsp. paratuberculosis
gccgcgucgccgaccag

SEQ ID NO: 2894305 - RNA, 22 nt, Mycobacterium avium subsp. paratuberculosis
gccgcgucgccgaucgcccggu

SEQ ID NO: 2894306 - RNA, 13 nt, Mycobacterium avium subsp. paratuberculosis
gccgcgucgccgc

SEQ ID NO: 2894307 - RNA, 16 nt, Mycobacterium avium subsp. paratuberculosis
gccgcgucgccgccgg

SEQ ID NO: 2894308 - RNA, 22 nt, Mycobacterium avium subsp. paratuberculosis
gccgcgucgccgccgggcgcca

SEQ ID NO: 2894309 - RNA, 14 nt, Mycobacterium avium subsp. paratuberculosis
gccgcgucgcgccg

SEQ ID NO: 2894310 - RNA, 17 nt, Mycobacterium avium subsp. paratuberculosis
gccgcgucgcgccgccg

SEQ ID NO: 2894311 - RNA, 18 nt, Mycobacterium avium subsp. paratuberculosis
gccgcgucgcgccgccgc

SEQ ID NO: 2894312 - RNA, 17 nt, Mycobacterium avium subsp. paratuberculosis
gccgcgucggaccccga

SEQ ID NO: 2894313 - RNA, 18 nt, Mycobacterium avium subsp. paratuberculosis
gccgcgucggaccccgau

SEQ ID NO: 2894314 - RNA, 19 nt, Mycobacterium avium subsp. paratuberculosis
gccgcgucggaccccgaug

SEQ ID NO: 2894315 - RNA, 21 nt, Mycobacterium avium subsp. paratuberculosis
gccgcgucggaccccgaugcg

SEQ ID NO: 2894316 - RNA, 13 nt, Mycobacterium avium subsp. paratuberculosis
gccgcgucggcca

SEQ ID NO: 2894317 - RNA, 18 nt, Mycobacterium avium subsp. paratuberculosis
gccgcgucggccaacgga

SEQ ID NO: 2894318 - RNA, 12 nt, Mycobacterium avium subsp. paratuberculosis
gccgcgucggcg

SEQ ID NO: 2894319 - RNA, 13 nt, Mycobacterium avium subsp. paratuberculosis
gccgcgucggcgg

SEQ ID NO: 2894320 - RNA, 15 nt, Mycobacterium avium subsp. paratuberculosis
gccgcgucggcggcg

SEQ ID NO: 2894321 - RNA, 16 nt, Mycobacterium avium subsp. paratuberculosis
gccgcgucggcggcgg

SEQ ID NO: 2894322 - RNA, 22 nt, Mycobacterium avium subsp. paratuberculosis
gccgcgucggcggcggcggccg

SEQ ID NO: 2894323 - RNA, 23 nt, Mycobacterium avium subsp. paratuberculosis
gccgcgucggcggcggcggccgc

SEQ ID NO: 2894324 - RNA, 15 nt, Mycobacterium avium subsp. paratuberculosis
gccgcgucggcgguc

SEQ ID NO: 2894325 - RNA, 17 nt, Mycobacterium avium subsp. paratuberculosis
gccgcgucggcggucgc

SEQ ID NO: 2894326 - RNA, 19 nt, Mycobacterium avium subsp. paratuberculosis
gccgcgucggcggucgcca

SEQ ID NO: 2894327 - RNA, 23 nt, Mycobacterium avium subsp. paratuberculosis
gccgcgucggcggucgccagcgc

SEQ ID NO: 2894328 - RNA, 16 nt, Mycobacterium avium subsp. paratuberculosis
gccgcgucggucagcg

SEQ ID NO: 2894329 - RNA, 19 nt, Mycobacterium avium subsp. paratuberculosis
gccgcgucggucagcgcca

SEQ ID NO: 2894330 - RNA, 16 nt, Mycobacterium avium subsp. paratuberculosis
gccgcgucgucaucgu

SEQ ID NO: 2894331 - RNA, 17 nt, Mycobacterium avium subsp. paratuberculosis
gccgcgucgucgucgac

SEQ ID NO: 2894332 - RNA, 18 nt, Mycobacterium avium subsp. paratuberculosis
gccgcgucgucgucgacc

SEQ ID NO: 2894333 - RNA, 18 nt, Mycobacterium avium subsp. paratuberculosis
gccgcgucgugccgagcg

SEQ ID NO: 2894334 - RNA, 13 nt, Mycobacterium avium subsp. paratuberculosis
gccgcgucguuga

SEQ ID NO: 2894335 - RNA, 20 nt, Mycobacterium avium subsp. paratuberculosis
gccgcgucguugagugcgcu

SEQ ID NO: 2894336 - RNA, 22 nt, Mycobacterium avium subsp. paratuberculosis
gccgcgucguugagugcgcugu

SEQ ID NO: 2894337 - RNA, 23 nt, Mycobacterium avium subsp. paratuberculosis
gccgcgucguugagugcgcugug

SEQ ID NO: 2894338 - RNA, 23 nt, Mycobacterium avium subsp. paratuberculosis
gccgcgugacaggggcagcagca

SEQ ID NO: 2894339 - RNA, 15 nt, Mycobacterium avium subsp. paratuberculosis
gccgcuucgaggugc

SEQ ID NO: 2894340 - RNA, 14 nt, Mycobacterium avium subsp. paratuberculosis
gccgcuucggggug

SEQ ID NO: 2894341 - RNA, 15 nt, Mycobacterium avium subsp. paratuberculosis
gccgcuucggggugg

SEQ ID NO: 2894342 - RNA, 22 nt, Mycobacterium avium subsp. paratuberculosis
gccgcuucggggugguugauca

SEQ ID NO: 2894343 - RNA, 16 nt, Mycobacterium avium subsp. paratuberculosis
gccgcuucgucgccgg

SEQ ID NO: 2894344 - RNA, 20 nt, Mycobacterium avium subsp. paratuberculosis
gccgcuucgucgccggccgc

SEQ ID NO: 2894345 - RNA, 21 nt, Mycobacterium avium subsp. paratuberculosis
gccgcuucgucgccggccgcc

SEQ ID NO: 2894346 - RNA, 23 nt, Mycobacterium avium subsp. paratuberculosis
gccgcuugcagcuuggcgguggc

SEQ ID NO: 2894347 - RNA, 14 nt, Mycobacterium avium subsp. paratuberculosis
gccgcuugccaugu

SEQ ID NO: 2894348 - RNA, 15 nt, Mycobacterium avium subsp. paratuberculosis
gccgcuuggccgggc

SEQ ID NO: 2894349 - RNA, 15 nt, Mycobacterium avium subsp. paratuberculosis
gccgcuuggcgcgcc

SEQ ID NO: 2894350 - RNA, 17 nt, Mycobacterium avium subsp. paratuberculosis
gccgcuuggcgcgccgc

SEQ ID NO: 2894351 - RNA, 20 nt, Mycobacterium avium subsp. paratuberculosis
gccgcuuguucgggcccaca

SEQ ID NO: 2894352 - RNA, 16 nt, Mycobacterium avium subsp. paratuberculosis
gccgcuuuccaccccg

SEQ ID NO: 2894353 - RNA, 17 nt, Mycobacterium avium subsp. paratuberculosis
gccgcuuuccaccccgg

SEQ ID NO: 2894354 - RNA, 20 nt, Mycobacterium avium subsp. paratuberculosis
gccgcuuuccaccccggcgg

SEQ ID NO: 2894355 - RNA, 18 nt, Mycobacterium avium subsp. paratuberculosis
gccggaaaaguucggcgg

SEQ ID NO: 2894356 - RNA, 14 nt, Mycobacterium avium subsp. paratuberculosis
gccggaacaccucg

SEQ ID NO: 2894357 - RNA, 13 nt, Mycobacterium avium subsp. paratuberculosis
gccggaacagcug

SEQ ID NO: 2894358 - RNA, 16 nt, Mycobacterium avium subsp. paratuberculosis
gccggaacgcccgauc

SEQ ID NO: 2894359 - RNA, 21 nt, Mycobacterium avium subsp. paratuberculosis
gccggaacgggaagaucgucg

SEQ ID NO: 2894360 - RNA, 16 nt, Mycobacterium avium subsp. paratuberculosis
gccggaacucggccgg

SEQ ID NO: 2894361 - RNA, 18 nt, Mycobacterium avium subsp. paratuberculosis
gccggaacucggccggca

SEQ ID NO: 2894362 - RNA, 15 nt, Mycobacterium avium subsp. paratuberculosis
gccggaagcggcggu

SEQ ID NO: 2894363 - RNA, 16 nt, Mycobacterium avium subsp. paratuberculosis
gccggaagcggcggua

SEQ ID NO: 2894364 - RNA, 20 nt, Mycobacterium avium subsp. paratuberculosis
gccggaaggccaaggccagc

SEQ ID NO: 2894365 - RNA, 21 nt, Mycobacterium avium subsp. paratuberculosis
gccggaaggccaaggccagca

SEQ ID NO: 2894366 - RNA, 23 nt, Mycobacterium avium subsp. paratuberculosis
gccggaaggccaaggccagcaac

SEQ ID NO: 2894367 - RNA, 21 nt, Mycobacterium avium subsp. paratuberculosis
gccggaaguucucgccgugca

SEQ ID NO: 2894368 - RNA, 20 nt, Mycobacterium avium subsp. paratuberculosis
gccggaaucgauuggugcgc

SEQ ID NO: 2894369 - RNA, 21 nt, Mycobacterium avium subsp. paratuberculosis
gccggaaucgauuggugcgca

SEQ ID NO: 2894370 - RNA, 20 nt, Mycobacterium avium subsp. paratuberculosis
gccggaauggcaaggccagc

SEQ ID NO: 2894371 - RNA, 19 nt, Mycobacterium avium subsp. paratuberculosis
gccggaauugaagaagcgg

SEQ ID NO: 2894372 - RNA, 23 nt, Mycobacterium avium subsp. paratuberculosis
gccggaauugaagaagcgggcca

SEQ ID NO: 2894373 - RNA, 16 nt, Mycobacterium avium subsp. paratuberculosis
gccggacaccaccgcg

SEQ ID NO: 2894374 - RNA, 17 nt, Mycobacterium avium subsp. paratuberculosis
gccggacaccaccgcgg

SEQ ID NO: 2894375 - RNA, 19 nt, Mycobacterium avium subsp. paratuberculosis
gccggacaccaccgcggug

SEQ ID NO: 2894376 - RNA, 20 nt, Mycobacterium avium subsp. paratuberculosis
gccggacaccaccgcggugg

SEQ ID NO: 2894377 - RNA, 21 nt, Mycobacterium avium subsp. paratuberculosis
gccggacaccaccgcgguggg

SEQ ID NO: 2894378 - RNA, 15 nt, Mycobacterium avium subsp. paratuberculosis
gccggacaccccggc

SEQ ID NO: 2894379 - RNA, 16 nt, Mycobacterium avium subsp. paratuberculosis
gccggacaccccggcc

SEQ ID NO: 2894380 - RNA, 19 nt, Mycobacterium avium subsp. paratuberculosis
gccggacaccccggccagu

SEQ ID NO: 2894381 - RNA, 23 nt, Mycobacterium avium subsp. paratuberculosis
gccggacaccccggccaguccgc

SEQ ID NO: 2894382 - RNA, 24 nt, Mycobacterium avium subsp. paratuberculosis
gccggacaccccggccaguccgcg

SEQ ID NO: 2894383 - RNA, 22 nt, Mycobacterium avium subsp. paratuberculosis
gccggacaccgaaccgccccgc

SEQ ID NO: 2894384 - RNA, 23 nt, Mycobacterium avium subsp. paratuberculosis
gccggacaccgaaccgccccgcg

SEQ ID NO: 2894385 - RNA, 14 nt, Mycobacterium avium subsp. paratuberculosis
gccggacaccggca

SEQ ID NO: 2894386 - RNA, 17 nt, Mycobacterium avium subsp. paratuberculosis
gccggacaccggcacgu

SEQ ID NO: 2894387 - RNA, 20 nt, Mycobacterium avium subsp. paratuberculosis
gccggacaccggcacgucgg

SEQ ID NO: 2894388 - RNA, 21 nt, Mycobacterium avium subsp. paratuberculosis
gccggacaccggcacgucggc

SEQ ID NO: 2894389 - RNA, 23 nt, Mycobacterium avium subsp. paratuberculosis
gccggacaccggcacgucggcca

SEQ ID NO: 2894390 - RNA, 12 nt, Mycobacterium avium subsp. paratuberculosis
gccggacagccg

SEQ ID NO: 2894391 - RNA, 15 nt, Mycobacterium avium subsp. paratuberculosis
gccggacagccgggg

SEQ ID NO: 2894392 - RNA, 19 nt, Mycobacterium avium subsp. paratuberculosis
gccggacagccggggcagc

SEQ ID NO: 2894393 - RNA, 14 nt, Mycobacterium avium subsp. paratuberculosis
gccggacagcggcc

SEQ ID NO: 2894394 - RNA, 19 nt, Mycobacterium avium subsp. paratuberculosis
gccggacagcgggccgacc

SEQ ID NO: 2894395 - RNA, 12 nt, Mycobacterium avium subsp. paratuberculosis
gccggacagcug

SEQ ID NO: 2894396 - RNA, 14 nt, Mycobacterium avium subsp. paratuberculosis
gccggacagcuggc

SEQ ID NO: 2894397 - RNA, 15 nt, Mycobacterium avium subsp. paratuberculosis
gccggacagcuggcg

SEQ ID NO: 2894398 - RNA, 20 nt, Mycobacterium avium subsp. paratuberculosis
gccggacagcuggcggucgc

SEQ ID NO: 2894399 - RNA, 20 nt, Mycobacterium avium subsp. paratuberculosis
gccggacaucucccgcaccc

SEQ ID NO: 2894400 - RNA, 23 nt, Mycobacterium avium subsp. paratuberculosis
gccggaccagguauucaucgcgg

SEQ ID NO: 2894401 - RNA, 20 nt, Mycobacterium avium subsp. paratuberculosis
gccggacccauucgucggcg

SEQ ID NO: 2894402 - RNA, 21 nt, Mycobacterium avium subsp. paratuberculosis
gccggacccauucgucggcgg

SEQ ID NO: 2894403 - RNA, 22 nt, Mycobacterium avium subsp. paratuberculosis
gccggacccauucgucggcggu

SEQ ID NO: 2894404 - RNA, 16 nt, Mycobacterium avium subsp. paratuberculosis
gccggaccccacagcg

SEQ ID NO: 2894405 - RNA, 18 nt, Mycobacterium avium subsp. paratuberculosis
gccggaccccacagcgcg

SEQ ID NO: 2894406 - RNA, 19 nt, Mycobacterium avium subsp. paratuberculosis
gccggaccccacagcgcgc

SEQ ID NO: 2894407 - RNA, 20 nt, Mycobacterium avium subsp. paratuberculosis
gccggaccccacagcgcgcc

SEQ ID NO: 2894408 - RNA, 20 nt, Mycobacterium avium subsp. paratuberculosis
gccggacccccucggggcuc

SEQ ID NO: 2894409 - RNA, 20 nt, Mycobacterium avium subsp. paratuberculosis
gccggaccgauccggcgccc

SEQ ID NO: 2894410 - RNA, 22 nt, Mycobacterium avium subsp. paratuberculosis
gccggaccgauccggcgcccga

SEQ ID NO: 2894411 - RNA, 18 nt, Mycobacterium avium subsp. paratuberculosis
gccggaccgcgcgggcca

SEQ ID NO: 2894412 - RNA, 20 nt, Mycobacterium avium subsp. paratuberculosis
gccggaccgcgcgggccagc

SEQ ID NO: 2894413 - RNA, 21 nt, Mycobacterium avium subsp. paratuberculosis
gccggaccgcuugacgccgcc

SEQ ID NO: 2894414 - RNA, 14 nt, Mycobacterium avium subsp. paratuberculosis
gccggaccucgacc

SEQ ID NO: 2894415 - RNA, 18 nt, Mycobacterium avium subsp. paratuberculosis
gccggaccucgaccagcc

SEQ ID NO: 2894416 - RNA, 19 nt, Mycobacterium avium subsp. paratuberculosis
gccggaccucgaccagccg

SEQ ID NO: 2894417 - RNA, 20 nt, Mycobacterium avium subsp. paratuberculosis
gccggaccucgaccagccgg

SEQ ID NO: 2894418 - RNA, 22 nt, Mycobacterium avium subsp. paratuberculosis
gccggaccucgaccagccggug

SEQ ID NO: 2894419 - RNA, 14 nt, Mycobacterium avium subsp. paratuberculosis
gccggacggcccgc

SEQ ID NO: 2894420 - RNA, 17 nt, Mycobacterium avium subsp. paratuberculosis
gccggacgggaucggcg

SEQ ID NO: 2894421 - RNA, 20 nt, Mycobacterium avium subsp. paratuberculosis
gccggacgggaucggcgcgu

SEQ ID NO: 2894422 - RNA, 23 nt, Mycobacterium avium subsp. paratuberculosis
gccggacgggaucggcgcgucgg

SEQ ID NO: 2894423 - RNA, 19 nt, Mycobacterium avium subsp. paratuberculosis
gccggauuacucgccggcg

SEQ ID NO: 2894424 - RNA, 21 nt, Mycobacterium avium subsp. paratuberculosis
gccggauuacucgccggcggc

SEQ ID NO: 2894425 - RNA, 22 nt, Mycobacterium avium subsp. paratuberculosis
gccggauuacucgccggcggcg

SEQ ID NO: 2894426 - RNA, 23 nt, Mycobacterium avium subsp. paratuberculosis
gccggauuacucgccggcggcgc

SEQ ID NO: 2894427 - RNA, 18 nt, Mycobacterium avium subsp. paratuberculosis
gccggauucucgcccggc

SEQ ID NO: 2894428 - RNA, 17 nt, Mycobacterium avium subsp. paratuberculosis
gccggauuggcgucggu

SEQ ID NO: 2894429 - RNA, 20 nt, Mycobacterium avium subsp. paratuberculosis
gccggauuggcgucgguggc

SEQ ID NO: 2894430 - RNA, 18 nt, Mycobacterium avium subsp. paratuberculosis
cgugacuugucgggccgc

SEQ ID NO: 2894431 - RNA, 17 nt, Mycobacterium avium subsp. paratuberculosis
cgugagggaccuccagc

SEQ ID NO: 2894432 - RNA, 18 nt, Mycobacterium avium subsp. paratuberculosis
cgugaguguugaagccgc

SEQ ID NO: 2894433 - RNA, 14 nt, Mycobacterium avium subsp. paratuberculosis
cgugauacgccgac

SEQ ID NO: 2894434 - RNA, 19 nt, Mycobacterium avium subsp. paratuberculosis
cgugauaguggucgucguc

SEQ ID NO: 2894435 - RNA, 18 nt, Mycobacterium avium subsp. paratuberculosis
cgugauaucccuugccgc

SEQ ID NO: 2894436 - RNA, 16 nt, Mycobacterium avium subsp. paratuberculosis
cgugauccggaaugcg

SEQ ID NO: 2894437 - RNA, 20 nt, Mycobacterium avium subsp. paratuberculosis
cgugauccggaaugcggugc

SEQ ID NO: 2894438 - RNA, 12 nt, Mycobacterium avium subsp. paratuberculosis
cgugauccggca

SEQ ID NO: 2894439 - RNA, 21 nt, Mycobacterium avium subsp. paratuberculosis
cgugaucgaaacgccgcgcuc

SEQ ID NO: 2894440 - RNA, 12 nt, Mycobacterium avium subsp. paratuberculosis
cgugaucgccac

SEQ ID NO: 2894441 - RNA, 14 nt, Mycobacterium avium subsp. paratuberculosis
cgugaucgccacca

SEQ ID NO: 2894442 - RNA, 18 nt, Mycobacterium avium subsp. paratuberculosis
cgugaucgccaccaccag

SEQ ID NO: 2894443 - RNA, 20 nt, Mycobacterium avium subsp. paratuberculosis
cgugaucgccaccaccagcg

SEQ ID NO: 2894444 - RNA, 16 nt, Mycobacterium avium subsp. paratuberculosis
cgugaucggcggccug

SEQ ID NO: 2894445 - RNA, 21 nt, Mycobacterium avium subsp. paratuberculosis
cgugaucggcggccugcggcg

SEQ ID NO: 2894446 - RNA, 22 nt, Mycobacterium avium subsp. paratuberculosis
cgugaucggcggccugcggcgg

SEQ ID NO: 2894447 - RNA, 16 nt, Mycobacterium avium subsp. paratuberculosis
cgugaucucgugccgc

SEQ ID NO: 2894448 - RNA, 19 nt, Mycobacterium avium subsp. paratuberculosis
cgugaucucgugccgcacc

SEQ ID NO: 2894449 - RNA, 23 nt, Mycobacterium avium subsp. paratuberculosis
cgugaucuggucggccagcgcgc

SEQ ID NO: 2894450 - RNA, 14 nt, Mycobacterium avium subsp. paratuberculosis
cgugaucuguucgg

SEQ ID NO: 2894451 - RNA, 18 nt, Mycobacterium avium subsp. paratuberculosis
cgugaucuguucggcggc

SEQ ID NO: 2894452 - RNA, 19 nt, Mycobacterium avium subsp. paratuberculosis
cgugaucuguucggcggcg

SEQ ID NO: 2894453 - RNA, 20 nt, Mycobacterium avium subsp. paratuberculosis
cgugaucuguucggcggcga

SEQ ID NO: 2894454 - RNA, 16 nt, Mycobacterium avium subsp. paratuberculosis
cgugaugacggcggcg

SEQ ID NO: 2894455 - RNA, 20 nt, Mycobacterium avium subsp. paratuberculosis
cgugaugacggcggcggugc

SEQ ID NO: 2894456 - RNA, 23 nt, Mycobacterium avium subsp. paratuberculosis
cgugaugagcgaggacgucgagc

SEQ ID NO: 2894457 - RNA, 14 nt, Mycobacterium avium subsp. paratuberculosis
cgugaugagcgcgu

SEQ ID NO: 2894458 - RNA, 21 nt, Mycobacterium avium subsp. paratuberculosis
cgugaugccgggcaaccacag

SEQ ID NO: 2894459 - RNA, 24 nt, Mycobacterium avium subsp. paratuberculosis
cgugaugcgcaagcaccggcuggc

SEQ ID NO: 2894460 - RNA, 14 nt, Mycobacterium avium subsp. paratuberculosis
cgugaugcgccggc

SEQ ID NO: 2894461 - RNA, 15 nt, Mycobacterium avium subsp. paratuberculosis
cgugaugcgccggcg

SEQ ID NO: 2894462 - RNA, 17 nt, Mycobacterium avium subsp. paratuberculosis
cgugaugcgccggcggu

SEQ ID NO: 2894463 - RNA, 20 nt, Mycobacterium avium subsp. paratuberculosis
cgugauggcgaaccagcgcc

SEQ ID NO: 2894464 - RNA, 17 nt, Mycobacterium avium subsp. paratuberculosis
cgugaugguccagcacc

SEQ ID NO: 2894465 - RNA, 20 nt, Mycobacterium avium subsp. paratuberculosis
cgugaugguccagcaccggc

SEQ ID NO: 2894466 - RNA, 15 nt, Mycobacterium avium subsp. paratuberculosis
cgugauggucgucgu

SEQ ID NO: 2894467 - RNA, 19 nt, Mycobacterium avium subsp. paratuberculosis
cgugauguacagcgacagc

SEQ ID NO: 2894468 - RNA, 21 nt, Mycobacterium avium subsp. paratuberculosis
cgugauguacagcgacagcag

SEQ ID NO: 2894469 - RNA, 23 nt, Mycobacterium avium subsp. paratuberculosis
cgugauguacagcgacagcagcg

SEQ ID NO: 2894470 - RNA, 18 nt, Mycobacterium avium subsp. paratuberculosis
cgugcaaaccggaccgcc

SEQ ID NO: 2894471 - RNA, 19 nt, Mycobacterium avium subsp. paratuberculosis
cgugcaacucccgcgccgc

SEQ ID NO: 2894472 - RNA, 21 nt, Mycobacterium avium subsp. paratuberculosis
cgugcaacugcguggccgugu

SEQ ID NO: 2894473 - RNA, 13 nt, Mycobacterium avium subsp. paratuberculosis
cgugcaaggccug

SEQ ID NO: 2894474 - RNA, 17 nt, Mycobacterium avium subsp. paratuberculosis
cgugcacacccgcagcg

SEQ ID NO: 2894475 - RNA, 14 nt, Mycobacterium avium subsp. paratuberculosis
cgugcacaccggcc

SEQ ID NO: 2894476 - RNA, 17 nt, Mycobacterium avium subsp. paratuberculosis
cgugcacaccggccuuc

SEQ ID NO: 2894477 - RNA, 16 nt, Mycobacterium avium subsp. paratuberculosis
cgugcacaggccgccg

SEQ ID NO: 2894478 - RNA, 18 nt, Mycobacterium avium subsp. paratuberculosis
cgugcacaggccgccgca

SEQ ID NO: 2894479 - RNA, 19 nt, Mycobacterium avium subsp. paratuberculosis
cgugcacaggccgccgcau

SEQ ID NO: 2894480 - RNA, 22 nt, Mycobacterium avium subsp. paratuberculosis
cgugcacaugcccgucgggcgg

SEQ ID NO: 2894481 - RNA, 19 nt, Mycobacterium avium subsp. paratuberculosis
cgugcaccacgacgucgag

SEQ ID NO: 2894482 - RNA, 20 nt, Mycobacterium avium subsp. paratuberculosis
cgugcacccacgccagccgg

SEQ ID NO: 2894483 - RNA, 15 nt, Mycobacterium avium subsp. paratuberculosis
cgugcaccgcccgcg

SEQ ID NO: 2894484 - RNA, 16 nt, Mycobacterium avium subsp. paratuberculosis
cgugcaccgcccgcgc

SEQ ID NO: 2894485 - RNA, 17 nt, Mycobacterium avium subsp. paratuberculosis
cgugcaccgcccgcgcg

SEQ ID NO: 2894486 - RNA, 14 nt, Mycobacterium avium subsp. paratuberculosis
cgugcaccgcggcc

SEQ ID NO: 2894487 - RNA, 14 nt, Mycobacterium avium subsp. paratuberculosis
cgugcaccggcgag

SEQ ID NO: 2894488 - RNA, 15 nt, Mycobacterium avium subsp. paratuberculosis
cgugcaccgucgccg

SEQ ID NO: 2894489 - RNA, 16 nt, Mycobacterium avium subsp. paratuberculosis
cgugcaccgucgccgg

SEQ ID NO: 2894490 - RNA, 17 nt, Mycobacterium avium subsp. paratuberculosis
cgugcaccgucgccggc

SEQ ID NO: 2894491 - RNA, 19 nt, Mycobacterium avium subsp. paratuberculosis
cgugcaccgucgccggcgg

SEQ ID NO: 2894492 - RNA, 17 nt, Mycobacterium avium subsp. paratuberculosis
cgugcaccugcagccgg

SEQ ID NO: 2894493 - RNA, 22 nt, Mycobacterium avium subsp. paratuberculosis
cgugcaccugugaggcaccgaa

SEQ ID NO: 2894494 - RNA, 20 nt, Mycobacterium avium subsp. paratuberculosis
cgugcaccuuggucagcucc

SEQ ID NO: 2894495 - RNA, 22 nt, Mycobacterium avium subsp. paratuberculosis
cgugcacgaacgcggccagcgg

SEQ ID NO: 2894496 - RNA, 13 nt, Mycobacterium avium subsp. paratuberculosis
cgugcacgaucgc

SEQ ID NO: 2894497 - RNA, 16 nt, Mycobacterium avium subsp. paratuberculosis
cgugcacgaucgcggu

SEQ ID NO: 2894498 - RNA, 20 nt, Mycobacterium avium subsp. paratuberculosis
cgugcacgaucgcggugacg

SEQ ID NO: 2894499 - RNA, 15 nt, Mycobacterium avium subsp. paratuberculosis
cgugcacgccgucgu

SEQ ID NO: 2894500 - RNA, 15 nt, Mycobacterium avium subsp. paratuberculosis
cgugcacgugcaggu

SEQ ID NO: 2894501 - RNA, 20 nt, Mycobacterium avium subsp. paratuberculosis
cgugcacgugcaggugcggc

SEQ ID NO: 2894502 - RNA, 23 nt, Mycobacterium avium subsp. paratuberculosis
cgugcacgugcaggugcggcacc

SEQ ID NO: 2894503 - RNA, 12 nt, Mycobacterium avium subsp. paratuberculosis
cgugcagaacag

SEQ ID NO: 2894504 - RNA, 17 nt, Mycobacterium avium subsp. paratuberculosis
cgugcagaacagcacga

SEQ ID NO: 2894505 - RNA, 18 nt, Mycobacterium avium subsp. paratuberculosis
cgugcagaacagcacgag

SEQ ID NO: 2894506 - RNA, 13 nt, Mycobacterium avium subsp. paratuberculosis
cgugcagcaccgc

SEQ ID NO: 2894507 - RNA, 19 nt, Mycobacterium avium subsp. paratuberculosis
cgugcagcaccgccagcau

SEQ ID NO: 2894508 - RNA, 13 nt, Mycobacterium avium subsp. paratuberculosis
cgugcagcacgcc

SEQ ID NO: 2894509 - RNA, 19 nt, Mycobacterium avium subsp. paratuberculosis
cgugcagcacgcccucggc

SEQ ID NO: 2894510 - RNA, 15 nt, Mycobacterium avium subsp. paratuberculosis
cgugcagcacgccgc

SEQ ID NO: 2894511 - RNA, 18 nt, Mycobacterium avium subsp. paratuberculosis
cgugcagcacgccgcgga

SEQ ID NO: 2894512 - RNA, 19 nt, Mycobacterium avium subsp. paratuberculosis
cgugcagcaguuccggagc

SEQ ID NO: 2894513 - RNA, 21 nt, Mycobacterium avium subsp. paratuberculosis
cgugcagcaguuccggagcgc

SEQ ID NO: 2894514 - RNA, 13 nt, Mycobacterium avium subsp. paratuberculosis
cgugcagcccgca

SEQ ID NO: 2894515 - RNA, 16 nt, Mycobacterium avium subsp. paratuberculosis
cguccgggccggccag

SEQ ID NO: 2894516 - RNA, 21 nt, Mycobacterium avium subsp. paratuberculosis
cguccgggcgcugcgcggugg

SEQ ID NO: 2894517 - RNA, 19 nt, Mycobacterium avium subsp. paratuberculosis
cguccgggcguagugcagc

SEQ ID NO: 2894518 - RNA, 21 nt, Mycobacterium avium subsp. paratuberculosis
cguccgggcguagugcagcug

SEQ ID NO: 2894519 - RNA, 14 nt, Mycobacterium avium subsp. paratuberculosis
cguccggggccggu

SEQ ID NO: 2894520 - RNA, 21 nt, Mycobacterium avium subsp. paratuberculosis
cguccgggguguaggcgucgg

SEQ ID NO: 2894521 - RNA, 23 nt, Mycobacterium avium subsp. paratuberculosis
cguccgggguguaggcgucggcg

SEQ ID NO: 2894522 - RNA, 21 nt, Mycobacterium avium subsp. paratuberculosis
cguccggguccggcuucaccg

SEQ ID NO: 2894523 - RNA, 16 nt, Mycobacterium avium subsp. paratuberculosis
cguccgggucgcacag

SEQ ID NO: 2894524 - RNA, 19 nt, Mycobacterium avium subsp. paratuberculosis
cguccgggucgcacagccg

SEQ ID NO: 2894525 - RNA, 14 nt, Mycobacterium avium subsp. paratuberculosis
cguccgggugcggg

SEQ ID NO: 2894526 - RNA, 19 nt, Mycobacterium avium subsp. paratuberculosis
cguccggguucgacgccuc

SEQ ID NO: 2894527 - RNA, 21 nt, Mycobacterium avium subsp. paratuberculosis
cguccgguaggugaucgccuc

SEQ ID NO: 2894528 - RNA, 19 nt, Mycobacterium avium subsp. paratuberculosis
cguccggucgcugggcucg

SEQ ID NO: 2894529 - RNA, 24 nt, Mycobacterium avium subsp. paratuberculosis
cguccggucgcugggcucgagugc

SEQ ID NO: 2894530 - RNA, 17 nt, Mycobacterium avium subsp. paratuberculosis
cguccguagugcucggc

SEQ ID NO: 2894531 - RNA, 13 nt, Mycobacterium avium subsp. paratuberculosis
cguccgugccguc

SEQ ID NO: 2894532 - RNA, 16 nt, Mycobacterium avium subsp. paratuberculosis
cguccgugccguccgg

SEQ ID NO: 2894533 - RNA, 19 nt, Mycobacterium avium subsp. paratuberculosis
cguccgugccguccggccg

SEQ ID NO: 2894534 - RNA, 20 nt, Mycobacterium avium subsp. paratuberculosis
cguccgugccguccggccgg

SEQ ID NO: 2894535 - RNA, 17 nt, Mycobacterium avium subsp. paratuberculosis
cguccgugcugccggcc

SEQ ID NO: 2894536 - RNA, 20 nt, Mycobacterium avium subsp. paratuberculosis
cguccgugcugccggccggc

SEQ ID NO: 2894537 - RNA, 22 nt, Mycobacterium avium subsp. paratuberculosis
cguccgugcugccggccggcag

SEQ ID NO: 2894538 - RNA, 23 nt, Mycobacterium avium subsp. paratuberculosis
cguccgugcugccggccggcagc

SEQ ID NO: 2894539 - RNA, 12 nt, Mycobacterium avium subsp. paratuberculosis
cguccucccggc

SEQ ID NO: 2894540 - RNA, 14 nt, Mycobacterium avium subsp. paratuberculosis
cguccucccggccg

SEQ ID NO: 2894541 - RNA, 15 nt, Mycobacterium avium subsp. paratuberculosis
cguccucccggccga

SEQ ID NO: 2894542 - RNA, 16 nt, Mycobacterium avium subsp. paratuberculosis
cguccucccggccgac

SEQ ID NO: 2894543 - RNA, 21 nt, Mycobacterium avium subsp. paratuberculosis
cguccucccggccgacgauga

SEQ ID NO: 2894544 - RNA, 12 nt, Mycobacterium avium subsp. paratuberculosis
cguccucccggu

SEQ ID NO: 2894545 - RNA, 15 nt, Mycobacterium avium subsp. paratuberculosis
cguccuccucguccg

SEQ ID NO: 2894546 - RNA, 19 nt, Mycobacterium avium subsp. paratuberculosis
cguccuccucguccgcggc

SEQ ID NO: 2894547 - RNA, 16 nt, Mycobacterium avium subsp. paratuberculosis
cguccuccucgucggc

SEQ ID NO: 2894548 - RNA, 14 nt, Mycobacterium avium subsp. paratuberculosis
cguccucgaccacc

SEQ ID NO: 2894549 - RNA, 13 nt, Mycobacterium avium subsp. paratuberculosis
cguccucgacgau

SEQ ID NO: 2894550 - RNA, 13 nt, Mycobacterium avium subsp. paratuberculosis
cguccucgacggu

SEQ ID NO: 2894551 - RNA, 23 nt, Mycobacterium avium subsp. paratuberculosis
cguccucgaugacgccggacagc

SEQ ID NO: 2894552 - RNA, 22 nt, Mycobacterium avium subsp. paratuberculosis
cguccucgaugccgaccgacag

SEQ ID NO: 2894553 - RNA, 23 nt, Mycobacterium avium subsp. paratuberculosis
cguccucgaugccgaccgacagc

SEQ ID NO: 2894554 - RNA, 14 nt, Mycobacterium avium subsp. paratuberculosis
cguccucgcccggg

SEQ ID NO: 2894555 - RNA, 16 nt, Mycobacterium avium subsp. paratuberculosis
cguccucgcgccgugg

SEQ ID NO: 2894556 - RNA, 19 nt, Mycobacterium avium subsp. paratuberculosis
cguccucgcgccguggccc

SEQ ID NO: 2894557 - RNA, 16 nt, Mycobacterium avium subsp. paratuberculosis
cguccucgcgucgcgc

SEQ ID NO: 2894558 - RNA, 14 nt, Mycobacterium avium subsp. paratuberculosis
cguccucggucagg

SEQ ID NO: 2894559 - RNA, 14 nt, Mycobacterium avium subsp. paratuberculosis
cguccucgucgaug

SEQ ID NO: 2894560 - RNA, 15 nt, Mycobacterium avium subsp. paratuberculosis
cguccucgucggcga

SEQ ID NO: 2894561 - RNA, 17 nt, Mycobacterium avium subsp. paratuberculosis
cguccucgucggcgaag

SEQ ID NO: 2894562 - RNA, 17 nt, Mycobacterium avium subsp. paratuberculosis
cguccucguucuggccc

SEQ ID NO: 2894563 - RNA, 19 nt, Mycobacterium avium subsp. paratuberculosis
cguccucguucuggcccgc

SEQ ID NO: 2894564 - RNA, 21 nt, Mycobacterium avium subsp. paratuberculosis
cguccucguucuggcccgcca

SEQ ID NO: 2894565 - RNA, 13 nt, Mycobacterium avium subsp. paratuberculosis
cguccugcagcag

SEQ ID NO: 2894566 - RNA, 15 nt, Mycobacterium avium subsp. paratuberculosis
cguccugcagcagcc

SEQ ID NO: 2894567 - RNA, 16 nt, Mycobacterium avium subsp. paratuberculosis
cguccugcagcagccg

SEQ ID NO: 2894568 - RNA, 20 nt, Mycobacterium avium subsp. paratuberculosis
cguccugcagcagccggacc

SEQ ID NO: 2894569 - RNA, 15 nt, Mycobacterium avium subsp. paratuberculosis
cguccugcagcgccg

SEQ ID NO: 2894570 - RNA, 17 nt, Mycobacterium avium subsp. paratuberculosis
cguccugcagcgccguc

SEQ ID NO: 2894571 - RNA, 19 nt, Mycobacterium avium subsp. paratuberculosis
cguccugcagcgccguccg

SEQ ID NO: 2894572 - RNA, 20 nt, Mycobacterium avium subsp. paratuberculosis
cguccugccaguugucgauc

SEQ ID NO: 2894573 - RNA, 23 nt, Mycobacterium avium subsp. paratuberculosis
cguccugccaguugucgaucucc

SEQ ID NO: 2894574 - RNA, 12 nt, Mycobacterium avium subsp. paratuberculosis
cguccugcgggg

SEQ ID NO: 2894575 - RNA, 17 nt, Mycobacterium avium subsp. paratuberculosis
cguccuggacgucgucg

SEQ ID NO: 2894576 - RNA, 21 nt, Mycobacterium avium subsp. paratuberculosis
cguccuggaucgcgcagguga

SEQ ID NO: 2894577 - RNA, 20 nt, Mycobacterium avium subsp. paratuberculosis
cguccuggcgcuggugcagc

SEQ ID NO: 2894578 - RNA, 22 nt, Mycobacterium avium subsp. paratuberculosis
cguccuggcgcuggugcagcag

SEQ ID NO: 2894579 - RNA, 14 nt, Mycobacterium avium subsp. paratuberculosis
cguccugggccggg

SEQ ID NO: 2894580 - RNA, 20 nt, Mycobacterium avium subsp. paratuberculosis
cguccuucucgaaccggggc

SEQ ID NO: 2894581 - RNA, 16 nt, Mycobacterium avium subsp. paratuberculosis
cguccuugacccggcc

SEQ ID NO: 2894582 - RNA, 20 nt, Mycobacterium avium subsp. paratuberculosis
cguccuugacgaacgacgug

SEQ ID NO: 2894583 - RNA, 14 nt, Mycobacterium avium subsp. paratuberculosis
cguccuugagcccc

SEQ ID NO: 2894584 - RNA, 21 nt, Mycobacterium avium subsp. paratuberculosis
cguccuugccgaucagcguca

SEQ ID NO: 2894585 - RNA, 15 nt, Mycobacterium avium subsp. paratuberculosis
cguccuuggccgcca

SEQ ID NO: 2894586 - RNA, 17 nt, Mycobacterium avium subsp. paratuberculosis
cguccuuggccgccagc

SEQ ID NO: 2894587 - RNA, 21 nt, Mycobacterium avium subsp. paratuberculosis
cguccuugggcuccucgacca

SEQ ID NO: 2894588 - RNA, 22 nt, Mycobacterium avium subsp. paratuberculosis
cguccuuggugauuucgcgcac

SEQ ID NO: 2894589 - RNA, 16 nt, Mycobacterium avium subsp. paratuberculosis
cguccuugucgcgcac

SEQ ID NO: 2894590 - RNA, 19 nt, Mycobacterium avium subsp. paratuberculosis
cguccuugucgcgcaccgc

SEQ ID NO: 2894591 - RNA, 20 nt, Mycobacterium avium subsp. paratuberculosis
cgucgaaaaacccggugccg

SEQ ID NO: 2894592 - RNA, 19 nt, Mycobacterium avium subsp. paratuberculosis
cgucgaaaccgucuccggc

SEQ ID NO: 2894593 - RNA, 14 nt, Mycobacterium avium subsp. paratuberculosis
cgucgaaacggcug

SEQ ID NO: 2894594 - RNA, 18 nt, Mycobacterium avium subsp. paratuberculosis
cgucgaaacggcugcugc

SEQ ID NO: 2894595 - RNA, 19 nt, Mycobacterium avium subsp. paratuberculosis
cgucgaaacggcugcugcg

SEQ ID NO: 2894596 - RNA, 17 nt, Mycobacterium avium subsp. paratuberculosis
cgucgaaauagcggcgc

SEQ ID NO: 2894597 - RNA, 18 nt, Mycobacterium avium subsp. paratuberculosis
cgucgaaauagcggcgca

SEQ ID NO: 2894598 - RNA, 22 nt, Mycobacterium avium subsp. paratuberculosis
cgucgaaauccacgaugccggg

SEQ ID NO: 2894599 - RNA, 21 nt, Mycobacterium avium subsp. paratuberculosis
cguccacaccguugggggucg

SEQ ID NO: 2894600 - RNA, 22 nt, Mycobacterium avium subsp. paratuberculosis
cguccacaccguugggggucga

SEQ ID NO: 2894601 - RNA, 18 nt, Mycobacterium avium subsp. paratuberculosis
cguccacagccggcggcu

SEQ ID NO: 2894602 - RNA, 16 nt, Mycobacterium avium subsp. paratuberculosis
cguccaccaccaaccc

SEQ ID NO: 2894603 - RNA, 17 nt, Mycobacterium avium subsp. paratuberculosis
cguccaccaccaacccg

SEQ ID NO: 2894604 - RNA, 15 nt, Mycobacterium avium subsp. paratuberculosis
cguccaccagcacca

SEQ ID NO: 2894605 - RNA, 18 nt, Mycobacterium avium subsp. paratuberculosis
cguccaccagcaccaggc

SEQ ID NO: 2894606 - RNA, 17 nt, Mycobacterium avium subsp. paratuberculosis
cguccaccagcacgccg

SEQ ID NO: 2894607 - RNA, 13 nt, Mycobacterium avium subsp. paratuberculosis
cguccaccagggu

SEQ ID NO: 2894608 - RNA, 20 nt, Mycobacterium avium subsp. paratuberculosis
cguccaccaggguggccgcc

SEQ ID NO: 2894609 - RNA, 21 nt, Mycobacterium avium subsp. paratuberculosis
cguccaccaggguggccgcca

SEQ ID NO: 2894610 - RNA, 13 nt, Mycobacterium avium subsp. paratuberculosis
cguccacccggcc

SEQ ID NO: 2894611 - RNA, 15 nt, Mycobacterium avium subsp. paratuberculosis
cguccacccggccca

SEQ ID NO: 2894612 - RNA, 21 nt, Mycobacterium avium subsp. paratuberculosis
cguccacccggcccaccaccg

SEQ ID NO: 2894613 - RNA, 18 nt, Mycobacterium avium subsp. paratuberculosis
cguccaccgacaggucga

SEQ ID NO: 2894614 - RNA, 21 nt, Mycobacterium avium subsp. paratuberculosis
cguccaccgacaggucgaagg

SEQ ID NO: 2894615 - RNA, 20 nt, Mycobacterium avium subsp. paratuberculosis
cguccaccggauggcgcccg

SEQ ID NO: 2894616 - RNA, 22 nt, Mycobacterium avium subsp. paratuberculosis
cguccaccggauggcgcccggc

SEQ ID NO: 2894617 - RNA, 16 nt, Mycobacterium avium subsp. paratuberculosis
cguccaccggcacggc

SEQ ID NO: 2894618 - RNA, 16 nt, Mycobacterium avium subsp. paratuberculosis
cguccaccggucgacg

SEQ ID NO: 2894619 - RNA, 17 nt, Mycobacterium avium subsp. paratuberculosis
cguccaccggucgacga

SEQ ID NO: 2894620 - RNA, 17 nt, Mycobacterium avium subsp. paratuberculosis
cguccacgaaacccauc

SEQ ID NO: 2894621 - RNA, 16 nt, Mycobacterium avium subsp. paratuberculosis
cguccacgaccccggc

SEQ ID NO: 2894622 - RNA, 17 nt, Mycobacterium avium subsp. paratuberculosis
cguccacgaccccggcg

SEQ ID NO: 2894623 - RNA, 18 nt, Mycobacterium avium subsp. paratuberculosis
cguccacgcccagcgccc

SEQ ID NO: 2894624 - RNA, 23 nt, Mycobacterium avium subsp. paratuberculosis
cguccacgcccagcgccccgaag

SEQ ID NO: 2894625 - RNA, 14 nt, Mycobacterium avium subsp. paratuberculosis
cguccacgccgcgg

SEQ ID NO: 2894626 - RNA, 18 nt, Mycobacterium avium subsp. paratuberculosis
cguccacguugaugccgc

SEQ ID NO: 2894627 - RNA, 22 nt, Mycobacterium avium subsp. paratuberculosis
cguccacguugaugccgcccag

SEQ ID NO: 2894628 - RNA, 21 nt, Mycobacterium avium subsp. paratuberculosis
cguccacuccaauacggcccg

SEQ ID NO: 2894629 - RNA, 23 nt, Mycobacterium avium subsp. paratuberculosis
cguccacuccaauacggcccggc

SEQ ID NO: 2894630 - RNA, 21 nt, Mycobacterium avium subsp. paratuberculosis
cguccagaccggccggggcgg

SEQ ID NO: 2894631 - RNA, 14 nt, Mycobacterium avium subsp. paratuberculosis
cguccagcaacgcc

SEQ ID NO: 2894632 - RNA, 18 nt, Mycobacterium avium subsp. paratuberculosis
cguccagcaacgccgaca

SEQ ID NO: 2894633 - RNA, 19 nt, Mycobacterium avium subsp. paratuberculosis
cguccagcaacgccgacau

SEQ ID NO: 2894634 - RNA, 15 nt, Mycobacterium avium subsp. paratuberculosis
cguccagcaccugcu

SEQ ID NO: 2894635 - RNA, 16 nt, Mycobacterium avium subsp. paratuberculosis
cguccagcaccugcuc

SEQ ID NO: 2894636 - RNA, 18 nt, Mycobacterium avium subsp. paratuberculosis
cguccagcaccugcucga

SEQ ID NO: 2894637 - RNA, 21 nt, Mycobacterium avium subsp. paratuberculosis
cguccagcaccugcucgaugc

SEQ ID NO: 2894638 - RNA, 22 nt, Mycobacterium avium subsp. paratuberculosis
cguccagcaccugcucgaugcg

SEQ ID NO: 2894639 - RNA, 20 nt, Mycobacterium avium subsp. paratuberculosis
cguccagcagcagcgcgcgg

SEQ ID NO: 2894640 - RNA, 21 nt, Mycobacterium avium subsp. paratuberculosis
cguccagcagcagcgcgcggu

SEQ ID NO: 2894641 - RNA, 17 nt, Mycobacterium avium subsp. paratuberculosis
cguccagcagcaugucg

SEQ ID NO: 2894642 - RNA, 17 nt, Mycobacterium avium subsp. paratuberculosis
cguccagcccgcgccag

SEQ ID NO: 2894643 - RNA, 17 nt, Mycobacterium avium subsp. paratuberculosis
cguccagccgugcggca

SEQ ID NO: 2894644 - RNA, 14 nt, Mycobacterium avium subsp. paratuberculosis
cguccagcgccgcc

SEQ ID NO: 2894645 - RNA, 17 nt, Mycobacterium avium subsp. paratuberculosis
cguccagcgccgccacg

SEQ ID NO: 2894646 - RNA, 23 nt, Mycobacterium avium subsp. paratuberculosis
cguccagcgccgccacggccacc

SEQ ID NO: 2894647 - RNA, 14 nt, Mycobacterium avium subsp. paratuberculosis
cguccagcgcggug

SEQ ID NO: 2894648 - RNA, 15 nt, Mycobacterium avium subsp. paratuberculosis
cguccagcgcgguga

SEQ ID NO: 2894649 - RNA, 15 nt, Mycobacterium avium subsp. paratuberculosis
cguccagcgcgucgc

SEQ ID NO: 2894650 - RNA, 20 nt, Mycobacterium avium subsp. paratuberculosis
cguccagcggguugccgcug

SEQ ID NO: 2894651 - RNA, 22 nt, Mycobacterium avium subsp. paratuberculosis
cguccagcggguugccgcuggc

SEQ ID NO: 2894652 - RNA, 21 nt, Mycobacterium avium subsp. paratuberculosis
cguccagcgucgacugcaccg

SEQ ID NO: 2894653 - RNA, 17 nt, Mycobacterium avium subsp. paratuberculosis
cguccagcgucgcggcc

SEQ ID NO: 2894654 - RNA, 20 nt, Mycobacterium avium subsp. paratuberculosis
cguccagcgucgcggccggg

SEQ ID NO: 2894655 - RNA, 20 nt, Mycobacterium avium subsp. paratuberculosis
cguccagcgucuggcagccg

SEQ ID NO: 2894656 - RNA, 14 nt, Mycobacterium avium subsp. paratuberculosis
cguccagcgugccg

SEQ ID NO: 2894657 - RNA, 17 nt, Mycobacterium avium subsp. paratuberculosis
cguccagcgugccgcgc

SEQ ID NO: 2894658 - RNA, 23 nt, Mycobacterium avium subsp. paratuberculosis
cguccagcgugccgcgcaccacc

SEQ ID NO: 2894659 - RNA, 21 nt, Mycobacterium avium subsp. paratuberculosis
cguccagcgugugcguggugg

SEQ ID NO: 2894660 - RNA, 14 nt, Mycobacterium avium subsp. paratuberculosis
cguccagcucagcg

SEQ ID NO: 2894661 - RNA, 17 nt, Mycobacterium avium subsp. paratuberculosis
cguccagcucagcgcgc

SEQ ID NO: 2894662 - RNA, 19 nt, Mycobacterium avium subsp. paratuberculosis
cguccagcucagcgcgcac

SEQ ID NO: 2894663 - RNA, 18 nt, Mycobacterium avium subsp. paratuberculosis
cguccagcuccgccgaca

SEQ ID NO: 2894664 - RNA, 20 nt, Mycobacterium avium subsp. paratuberculosis
cguccagcuccgccgacacc

SEQ ID NO: 2894665 - RNA, 16 nt, Mycobacterium avium subsp. paratuberculosis
cguccagcugcgcgcc

SEQ ID NO: 2894666 - RNA, 21 nt, Mycobacterium avium subsp. paratuberculosis
cguccagcugcgcgccggcgg

SEQ ID NO: 2894667 - RNA, 22 nt, Mycobacterium avium subsp. paratuberculosis
cguccagcugcgcgccggcggc

SEQ ID NO: 2894668 - RNA, 16 nt, Mycobacterium avium subsp. paratuberculosis
cguccagcugggcugc

SEQ ID NO: 2894669 - RNA, 17 nt, Mycobacterium avium subsp. paratuberculosis
cguccagcuucucggcg

SEQ ID NO: 2894670 - RNA, 19 nt, Mycobacterium avium subsp. paratuberculosis
cguccaggaugagcugggc

SEQ ID NO: 2894671 - RNA, 23 nt, Mycobacterium avium subsp. paratuberculosis
cguccaggaugagcugggcggcg

SEQ ID NO: 2894672 - RNA, 13 nt, Mycobacterium avium subsp. paratuberculosis
cguccaggccggc

SEQ ID NO: 2894673 - RNA, 15 nt, Mycobacterium avium subsp. paratuberculosis
cguccaggccggcgc

SEQ ID NO: 2894674 - RNA, 16 nt, Mycobacterium avium subsp. paratuberculosis
cguccaggccggcgcc

SEQ ID NO: 2894675 - RNA, 17 nt, Mycobacterium avium subsp. paratuberculosis
cguccaggccggcgccg

SEQ ID NO: 2894676 - RNA, 20 nt, Mycobacterium avium subsp. paratuberculosis
cguccaggccggcgccgcgg

SEQ ID NO: 2894677 - RNA, 23 nt, Mycobacterium avium subsp. paratuberculosis
cguccaggccggcgccgcgggug

SEQ ID NO: 2894678 - RNA, 15 nt, Mycobacterium avium subsp. paratuberculosis
cguccaggcgcaccg

SEQ ID NO: 2894679 - RNA, 18 nt, Mycobacterium avium subsp. paratuberculosis
cguccaggcgcaccgcca

SEQ ID NO: 2894680 - RNA, 19 nt, Mycobacterium avium subsp. paratuberculosis
cguccaggcgcaccgccac

SEQ ID NO: 2894681 - RNA, 20 nt, Mycobacterium avium subsp. paratuberculosis
cguccaggcgcaccgccacc

SEQ ID NO: 2894682 - RNA, 19 nt, Mycobacterium avium subsp. paratuberculosis
cguccaggguggccagcac

SEQ ID NO: 2894683 - RNA, 22 nt, Mycobacterium avium subsp. paratuberculosis
cguccaggguggccagcacgcu

SEQ ID NO: 2894684 - RNA, 18 nt, Mycobacterium avium subsp. paratuberculosis
cguccaggugcacccgcg

SEQ ID NO: 2894685 - RNA, 22 nt, Mycobacterium avium subsp. paratuberculosis
cguccaggugcacccgcggcgc

SEQ ID NO: 2894686 - RNA, 14 nt, Mycobacterium avium subsp. paratuberculosis
cguccaggugcgcc

SEQ ID NO: 2894687 - RNA, 15 nt, Mycobacterium avium subsp. paratuberculosis
cguccaggugcgccg

SEQ ID NO: 2894688 - RNA, 16 nt, Mycobacterium avium subsp. paratuberculosis
cguccaggugcgccgc

SEQ ID NO: 2894689 - RNA, 17 nt, Mycobacterium avium subsp. paratuberculosis
cguccaggugcgccgcc

SEQ ID NO: 2894690 - RNA, 21 nt, Mycobacterium avium subsp. paratuberculosis
cguccaggugcgccgccgcgu

SEQ ID NO: 2894691 - RNA, 18 nt, Mycobacterium avium subsp. paratuberculosis
cguccaguagccgccggg

SEQ ID NO: 2894692 - RNA, 14 nt, Mycobacterium avium subsp. paratuberculosis
cguccagugacgcc

SEQ ID NO: 2894693 - RNA, 17 nt, Mycobacterium avium subsp. paratuberculosis
cguccagugacgccugc

SEQ ID NO: 2894694 - RNA, 22 nt, Mycobacterium avium subsp. paratuberculosis
cguccagugacgccugcggccc

SEQ ID NO: 2894695 - RNA, 15 nt, Mycobacterium avium subsp. paratuberculosis
cguccagugcaugcc

SEQ ID NO: 2894696 - RNA, 20 nt, Mycobacterium avium subsp. paratuberculosis
cguccagugcaugccggccu

SEQ ID NO: 2894697 - RNA, 17 nt, Mycobacterium avium subsp. paratuberculosis
cguccaguucggccagc

SEQ ID NO: 2894698 - RNA, 17 nt, Mycobacterium avium subsp. paratuberculosis
cguccaguugcggcacg

SEQ ID NO: 2894699 - RNA, 19 nt, Mycobacterium avium subsp. paratuberculosis
cguccaguugcggcacgcc

SEQ ID NO: 2894700 - RNA, 20 nt, Mycobacterium avium subsp. paratuberculosis
cguccaguugcggcacgccg

SEQ ID NO: 2894701 - RNA, 22 nt, Mycobacterium avium subsp. paratuberculosis
cguccaguugcggcacgccgac

SEQ ID NO: 2894702 - RNA, 18 nt, Mycobacterium avium subsp. paratuberculosis
cguccauaccccccacgc

SEQ ID NO: 2894703 - RNA, 20 nt, Mycobacterium avium subsp. paratuberculosis
cguccauaccccccacgcuc

SEQ ID NO: 2894704 - RNA, 20 nt, Mycobacterium avium subsp. paratuberculosis
cguccaucauggcgcugcgc

SEQ ID NO: 2894705 - RNA, 18 nt, Mycobacterium avium subsp. paratuberculosis
cguccauccgcuugccgc

SEQ ID NO: 2894706 - RNA, 13 nt, Mycobacterium avium subsp. paratuberculosis
cguccaucgccgc

SEQ ID NO: 2894707 - RNA, 15 nt, Mycobacterium avium subsp. paratuberculosis
cguccaucgccgcgc

SEQ ID NO: 2894708 - RNA, 17 nt, Mycobacterium avium subsp. paratuberculosis
cguccaucgccgcgcac

SEQ ID NO: 2894709 - RNA, 16 nt, Mycobacterium avium subsp. paratuberculosis
cguccaucgcgucguc

SEQ ID NO: 2894710 - RNA, 17 nt, Mycobacterium avium subsp. paratuberculosis
cguccaucgggaccgcg

SEQ ID NO: 2894711 - RNA, 12 nt, Mycobacterium avium subsp. paratuberculosis
cguccaucguca

SEQ ID NO: 2894712 - RNA, 20 nt, Mycobacterium avium subsp. paratuberculosis
cguccaucguccucgcgccg

SEQ ID NO: 2894713 - RNA, 21 nt, Mycobacterium avium subsp. paratuberculosis
cguccaucguccucgcgccgu

SEQ ID NO: 2894714 - RNA, 21 nt, Mycobacterium avium subsp. paratuberculosis
cguccaugaaccacugcggca

SEQ ID NO: 2894715 - RNA, 13 nt, Mycobacterium avium subsp. paratuberculosis
cguccaugcggug

SEQ ID NO: 2894716 - RNA, 21 nt, Mycobacterium avium subsp. paratuberculosis
cguccaugcuggugccgccga

SEQ ID NO: 2894717 - RNA, 14 nt, Mycobacterium avium subsp. paratuberculosis
cguccauggucgag

SEQ ID NO: 2894718 - RNA, 17 nt, Mycobacterium avium subsp. paratuberculosis
cguccauguaguucagc

SEQ ID NO: 2894719 - RNA, 14 nt, Mycobacterium avium subsp. paratuberculosis
cgucccaccggcga

SEQ ID NO: 2894720 - RNA, 16 nt, Mycobacterium avium subsp. paratuberculosis
cgucccaccggcgaug

SEQ ID NO: 2894721 - RNA, 14 nt, Mycobacterium avium subsp. paratuberculosis
cgucccacggcggg

SEQ ID NO: 2894722 - RNA, 17 nt, Mycobacterium avium subsp. paratuberculosis
cgucccacggcgggguc

SEQ ID NO: 2894723 - RNA, 12 nt, Mycobacterium avium subsp. paratuberculosis
cgucccagcaca

SEQ ID NO: 2894724 - RNA, 19 nt, Mycobacterium avium subsp. paratuberculosis
cgucccagcacaacgccuc

SEQ ID NO: 2894725 - RNA, 11 nt, Mycobacterium avium subsp. paratuberculosis
cgucccagccg

SEQ ID NO: 2894726 - RNA, 17 nt, Mycobacterium avium subsp. paratuberculosis
cgucccagccggacagc

SEQ ID NO: 2894727 - RNA, 12 nt, Mycobacterium avium subsp. paratuberculosis
cgucccagcgca

SEQ ID NO: 2894728 - RNA, 17 nt, Mycobacterium avium subsp. paratuberculosis
cgucccaggguugccgc

SEQ ID NO: 2894729 - RNA, 21 nt, Mycobacterium avium subsp. paratuberculosis
cgucccaggguugccgcacga

SEQ ID NO: 2894730 - RNA, 18 nt, Mycobacterium avium subsp. paratuberculosis
cgucccagugcucgacca

SEQ ID NO: 2894731 - RNA, 19 nt, Mycobacterium avium subsp. paratuberculosis
cguccccaccaccgacagc

SEQ ID NO: 2894732 - RNA, 23 nt, Mycobacterium avium subsp. paratuberculosis
cguccccaccaccgacagcaccc

SEQ ID NO: 2894733 - RNA, 16 nt, Mycobacterium avium subsp. paratuberculosis
cguccccgcgccgggc

SEQ ID NO: 2894734 - RNA, 14 nt, Mycobacterium avium subsp. paratuberculosis
cguccccgcgcggc

SEQ ID NO: 2894735 - RNA, 14 nt, Mycobacterium avium subsp. paratuberculosis
cguccccgugcagc

SEQ ID NO: 2894736 - RNA, 13 nt, Mycobacterium avium subsp. paratuberculosis
cguccccuccccg

SEQ ID NO: 2894737 - RNA, 20 nt, Mycobacterium avium subsp. paratuberculosis
cgucccgcccggcgccggcc

SEQ ID NO: 2894738 - RNA, 21 nt, Mycobacterium avium subsp. paratuberculosis
cgucccgcgccacguaucgcg

SEQ ID NO: 2894739 - RNA, 13 nt, Mycobacterium avium subsp. paratuberculosis
cgucccgcgccgg

SEQ ID NO: 2894740 - RNA, 12 nt, Mycobacterium avium subsp. paratuberculosis
cgucccgcgcgg

SEQ ID NO: 2894741 - RNA, 15 nt, Mycobacterium avium subsp. paratuberculosis
cgucccgcgcggggg

SEQ ID NO: 2894742 - RNA, 21 nt, Mycobacterium avium subsp. paratuberculosis
cgucccgcgcgggggccgccg

SEQ ID NO: 2894743 - RNA, 22 nt, Mycobacterium avium subsp. paratuberculosis
cgucccgcgcgggggccgccgc

SEQ ID NO: 2894744 - RNA, 15 nt, Mycobacterium avium subsp. paratuberculosis
cgucccggcccaugg

SEQ ID NO: 2894745 - RNA, 19 nt, Mycobacterium avium subsp. paratuberculosis
cgucccggcccauggcgaa

SEQ ID NO: 2894746 - RNA, 20 nt, Mycobacterium avium subsp. paratuberculosis
cgucccggcgccucggcgcc

SEQ ID NO: 2894747 - RNA, 19 nt, Mycobacterium avium subsp. paratuberculosis
cgucccggcgucucggcgu

SEQ ID NO: 2894748 - RNA, 21 nt, Mycobacterium avium subsp. paratuberculosis
cgucccgggccuuggccaacg

SEQ ID NO: 2894749 - RNA, 16 nt, Mycobacterium avium subsp. paratuberculosis
cgucccgguugacccc

SEQ ID NO: 2894750 - RNA, 21 nt, Mycobacterium avium subsp. paratuberculosis
cgucccgguugaccccggccc

SEQ ID NO: 2894751 - RNA, 16 nt, Mycobacterium avium subsp. paratuberculosis
cgucccgucacggcug

SEQ ID NO: 2894752 - RNA, 23 nt, Mycobacterium avium subsp. paratuberculosis
cgucccgucacggcugccgaccu

SEQ ID NO: 2894753 - RNA, 24 nt, Mycobacterium avium subsp. paratuberculosis
cgucccgucacggcugccgaccuc

SEQ ID NO: 2894754 - RNA, 16 nt, Mycobacterium avium subsp. paratuberculosis
cgucccguccugggcc

SEQ ID NO: 2894755 - RNA, 22 nt, Mycobacterium avium subsp. paratuberculosis
cgucccguccugggccuggcgc

SEQ ID NO: 2894756 - RNA, 19 nt, Mycobacterium avium subsp. paratuberculosis
cgucccgucgaccaaugcg

SEQ ID NO: 2894757 - RNA, 12 nt, Mycobacterium avium subsp. paratuberculosis
cgucccgucggc

SEQ ID NO: 2894758 - RNA, 13 nt, Mycobacterium avium subsp. paratuberculosis
cgucccgucggcc

SEQ ID NO: 2894759 - RNA, 15 nt, Mycobacterium avium subsp. paratuberculosis
cgucccgucggcgcg

SEQ ID NO: 2894760 - RNA, 16 nt, Mycobacterium avium subsp. paratuberculosis
cgucccgucggcgcga

SEQ ID NO: 2894761 - RNA, 14 nt, Mycobacterium avium subsp. paratuberculosis
cgucccugcgcgga

SEQ ID NO: 2894762 - RNA, 14 nt, Mycobacterium avium subsp. paratuberculosis
cguccgacaccacc

SEQ ID NO: 2894763 - RNA, 19 nt, Mycobacterium avium subsp. paratuberculosis
cguccgacagcgccugccc

SEQ ID NO: 2894764 - RNA, 20 nt, Mycobacterium avium subsp. paratuberculosis
cguccgacagcgccugcccg

SEQ ID NO: 2894765 - RNA, 19 nt, Mycobacterium avium subsp. paratuberculosis
cguccgacaggaugcuggg

SEQ ID NO: 2894766 - RNA, 19 nt, Mycobacterium avium subsp. paratuberculosis
cguccgaccguugaccgac

SEQ ID NO: 2894767 - RNA, 22 nt, Mycobacterium avium subsp. paratuberculosis
cguccgagaagggccgccgcug

SEQ ID NO: 2894768 - RNA, 14 nt, Mycobacterium avium subsp. paratuberculosis
cguccgagcagcag

SEQ ID NO: 2894769 - RNA, 16 nt, Mycobacterium avium subsp. paratuberculosis
cguccgagcagcagcc

SEQ ID NO: 2894770 - RNA, 17 nt, Mycobacterium avium subsp. paratuberculosis
cguccgagcagcagccg

SEQ ID NO: 2894771 - RNA, 18 nt, Mycobacterium avium subsp. paratuberculosis
cguccgagcagcagccgc

SEQ ID NO: 2894772 - RNA, 21 nt, Mycobacterium avium subsp. paratuberculosis
cguccgagcagcagccgcagc

SEQ ID NO: 2894773 - RNA, 17 nt, Mycobacterium avium subsp. paratuberculosis
cguccgaggccccgcca

SEQ ID NO: 2894774 - RNA, 18 nt, Mycobacterium avium subsp. paratuberculosis
cguccgaggccccgccag

SEQ ID NO: 2894775 - RNA, 20 nt, Mycobacterium avium subsp. paratuberculosis
cguccgaggccccgccagau

SEQ ID NO: 2894776 - RNA, 17 nt, Mycobacterium avium subsp. paratuberculosis
cguccgaggcgguuccg

SEQ ID NO: 2894777 - RNA, 23 nt, Mycobacterium avium subsp. paratuberculosis
cguccgaggcgguuccgguggcg

SEQ ID NO: 2894778 - RNA, 18 nt, Mycobacterium avium subsp. paratuberculosis
cguccgauaccagccgcg

SEQ ID NO: 2894779 - RNA, 21 nt, Mycobacterium avium subsp. paratuberculosis
cguccgauaccagccgcggac

SEQ ID NO: 2894780 - RNA, 15 nt, Mycobacterium avium subsp. paratuberculosis
cguccgcaaccgccg

SEQ ID NO: 2894781 - RNA, 17 nt, Mycobacterium avium subsp. paratuberculosis
cguccgcaaccgccggc

SEQ ID NO: 2894782 - RNA, 19 nt, Mycobacterium avium subsp. paratuberculosis
cguccgcaaccgccggcag

SEQ ID NO: 2894783 - RNA, 21 nt, Mycobacterium avium subsp. paratuberculosis
cguccgcaaccgccggcagcg

SEQ ID NO: 2894784 - RNA, 16 nt, Mycobacterium avium subsp. paratuberculosis
cguccgcaagcaccuc

SEQ ID NO: 2894785 - RNA, 14 nt, Mycobacterium avium subsp. paratuberculosis
cguccgcaccgcga

SEQ ID NO: 2894786 - RNA, 22 nt, Mycobacterium avium subsp. paratuberculosis
cguccgcagauagaucgacgcg

SEQ ID NO: 2894787 - RNA, 15 nt, Mycobacterium avium subsp. paratuberculosis
cguccgccccgcugc

SEQ ID NO: 2894788 - RNA, 14 nt, Mycobacterium avium subsp. paratuberculosis
cguccgccggcggu

SEQ ID NO: 2894789 - RNA, 16 nt, Mycobacterium avium subsp. paratuberculosis
cguccgccggcggugc

SEQ ID NO: 2894790 - RNA, 15 nt, Mycobacterium avium subsp. paratuberculosis
cguccgccggcuggc

SEQ ID NO: 2894791 - RNA, 15 nt, Mycobacterium avium subsp. paratuberculosis
cguccgccuccgacc

SEQ ID NO: 2894792 - RNA, 18 nt, Mycobacterium avium subsp. paratuberculosis
cguccgccuccgaccagc

SEQ ID NO: 2894793 - RNA, 22 nt, Mycobacterium avium subsp. paratuberculosis
cguccgccuccgaccagccggu

SEQ ID NO: 2894794 - RNA, 21 nt, Mycobacterium avium subsp. paratuberculosis
cguccgcgaacgggugcggcg

SEQ ID NO: 2894795 - RNA, 22 nt, Mycobacterium avium subsp. paratuberculosis
cguccgcgaacgggugcggcgc

SEQ ID NO: 2894796 - RNA, 14 nt, Mycobacterium avium subsp. paratuberculosis
cguccgcgacgcug

SEQ ID NO: 2894797 - RNA, 20 nt, Mycobacterium avium subsp. paratuberculosis
cguccgcgacgcugagcgcc

SEQ ID NO: 2894798 - RNA, 24 nt, Mycobacterium avium subsp. paratuberculosis
cguccgcgacgcugagcgccaggc

SEQ ID NO: 2894799 - RNA, 23 nt, Mycobacterium avium subsp. paratuberculosis
cguccgcgaucgucucgucgaga

SEQ ID NO: 2894800 - RNA, 13 nt, Mycobacterium avium subsp. paratuberculosis
cguccgcgcccac

SEQ ID NO: 2894801 - RNA, 14 nt, Mycobacterium avium subsp. paratuberculosis
cguccgcgcccacc

SEQ ID NO: 2894802 - RNA, 14 nt, Mycobacterium avium subsp. paratuberculosis
cguccgcgcuggcg

SEQ ID NO: 2894803 - RNA, 13 nt, Mycobacterium avium subsp. paratuberculosis
cguccgcggccgc

SEQ ID NO: 2894804 - RNA, 15 nt, Mycobacterium avium subsp. paratuberculosis
cguccgcggccgcgg

SEQ ID NO: 2894805 - RNA, 16 nt, Mycobacterium avium subsp. paratuberculosis
cguccgcggccgcggc

SEQ ID NO: 2894806 - RNA, 19 nt, Mycobacterium avium subsp. paratuberculosis
cguccgcggccgcggcgcg

SEQ ID NO: 2894807 - RNA, 22 nt, Mycobacterium avium subsp. paratuberculosis
cguccgcggccgcggcgcgcau

SEQ ID NO: 2894808 - RNA, 22 nt, Mycobacterium avium subsp. paratuberculosis
cguccgcggcggagggguacuc

SEQ ID NO: 2894809 - RNA, 15 nt, Mycobacterium avium subsp. paratuberculosis
cguccgcggcggcca

SEQ ID NO: 2894810 - RNA, 16 nt, Mycobacterium avium subsp. paratuberculosis
cguccgcggcggccag

SEQ ID NO: 2894811 - RNA, 14 nt, Mycobacterium avium subsp. paratuberculosis
cguccgcggcggcg

SEQ ID NO: 2894812 - RNA, 21 nt, Mycobacterium avium subsp. paratuberculosis
cguccgcgggaauuggcaccg

SEQ ID NO: 2894813 - RNA, 22 nt, Mycobacterium avium subsp. paratuberculosis
cguccgcgggaauuggcaccgg

SEQ ID NO: 2894814 - RNA, 14 nt, Mycobacterium avium subsp. paratuberculosis
cguccgcgggcggg

SEQ ID NO: 2894815 - RNA, 19 nt, Mycobacterium avium subsp. paratuberculosis
cguccgcgggcggggccug

SEQ ID NO: 2894816 - RNA, 12 nt, Mycobacterium avium subsp. paratuberculosis
cguccgcgguga

SEQ ID NO: 2894817 - RNA, 15 nt, Mycobacterium avium subsp. paratuberculosis
cguccgcggugagca

SEQ ID NO: 2894818 - RNA, 18 nt, Mycobacterium avium subsp. paratuberculosis
cguccgcggugagcaccg

SEQ ID NO: 2894819 - RNA, 13 nt, Mycobacterium avium subsp. paratuberculosis
cguccgcgucggc

SEQ ID NO: 2894820 - RNA, 17 nt, Mycobacterium avium subsp. paratuberculosis
cguccgcgucggcgccg

SEQ ID NO: 2894821 - RNA, 19 nt, Mycobacterium avium subsp. paratuberculosis
cguccgcgucggcgccggc

SEQ ID NO: 2894822 - RNA, 13 nt, Mycobacterium avium subsp. paratuberculosis
cguccgcgucguc

SEQ ID NO: 2894823 - RNA, 14 nt, Mycobacterium avium subsp. paratuberculosis
cguccgcgucgucg

SEQ ID NO: 2894824 - RNA, 15 nt, Mycobacterium avium subsp. paratuberculosis
cguccgcgucgucga

SEQ ID NO: 2894825 - RNA, 18 nt, Mycobacterium avium subsp. paratuberculosis
cguccgcgucgucgaggc

SEQ ID NO: 2894826 - RNA, 19 nt, Mycobacterium avium subsp. paratuberculosis
cguccggaggugccggccg

SEQ ID NO: 2894827 - RNA, 20 nt, Mycobacterium avium subsp. paratuberculosis
cguccggaggugccggccgg

SEQ ID NO: 2894828 - RNA, 23 nt, Mycobacterium avium subsp. paratuberculosis
cguccggaggugccggccggucg

SEQ ID NO: 2894829 - RNA, 17 nt, Mycobacterium avium subsp. paratuberculosis
cguccggauagccgucg

SEQ ID NO: 2894830 - RNA, 20 nt, Mycobacterium avium subsp. paratuberculosis
cguccggauagccgucggcg

SEQ ID NO: 2894831 - RNA, 22 nt, Mycobacterium avium subsp. paratuberculosis
cguccggauagccgucggcgga

SEQ ID NO: 2894832 - RNA, 14 nt, Mycobacterium avium subsp. paratuberculosis
cguccggaugcggc

SEQ ID NO: 2894833 - RNA, 15 nt, Mycobacterium avium subsp. paratuberculosis
cguccggaugcggcg

SEQ ID NO: 2894834 - RNA, 16 nt, Mycobacterium avium subsp. paratuberculosis
cguccggaugcggcgc

SEQ ID NO: 2894835 - RNA, 18 nt, Mycobacterium avium subsp. paratuberculosis
cguccggaugcggcgccc

SEQ ID NO: 2894836 - RNA, 21 nt, Mycobacterium avium subsp. paratuberculosis
cguccggaugcggcgcccaca

SEQ ID NO: 2894837 - RNA, 13 nt, Mycobacterium avium subsp. paratuberculosis
cguccggcccggc

SEQ ID NO: 2894838 - RNA, 15 nt, Mycobacterium avium subsp. paratuberculosis
cguccggcccggcgu

SEQ ID NO: 2894839 - RNA, 16 nt, Mycobacterium avium subsp. paratuberculosis
cguccggcccggcguc

SEQ ID NO: 2894840 - RNA, 12 nt, Mycobacterium avium subsp. paratuberculosis
cguccggccggu

SEQ ID NO: 2894841 - RNA, 12 nt, Mycobacterium avium subsp. paratuberculosis
cguccggcgcca

SEQ ID NO: 2894842 - RNA, 13 nt, Mycobacterium avium subsp. paratuberculosis
cguccggcgccac

SEQ ID NO: 2894843 - RNA, 11 nt, Mycobacterium avium subsp. paratuberculosis
cguccggcggc

SEQ ID NO: 2894844 - RNA, 13 nt, Mycobacterium avium subsp. paratuberculosis
cguccggcggcaa

SEQ ID NO: 2894845 - RNA, 19 nt, Mycobacterium avium subsp. paratuberculosis
cguccgggauaguucgccg

SEQ ID NO: 2894846 - RNA, 22 nt, Mycobacterium avium subsp. paratuberculosis
cguccgggauaguucgccgccg

SEQ ID NO: 2894847 - RNA, 15 nt, Mycobacterium avium subsp. paratuberculosis
cguccgggcacccga

SEQ ID NO: 2894848 - RNA, 22 nt, Mycobacterium avium subsp. paratuberculosis
cguccgggcacccgacgucgac

SEQ ID NO: 2894849 - RNA, 14 nt, Mycobacterium avium subsp. paratuberculosis
cguccgggccgccu

SEQ ID NO: 2894850 - RNA, 15 nt, Mycobacterium avium subsp. paratuberculosis
cguccgggccgccuc

SEQ ID NO: 2894851 - RNA, 12 nt, Mycobacterium avium subsp. paratuberculosis
cguccgggccgg

SEQ ID NO: 2894852 - RNA, 14 nt, Mycobacterium avium subsp. paratuberculosis
cguccgggccggcc

SEQ ID NO: 2894853 - RNA, 22 nt, Mycobacterium avium subsp. paratuberculosis
gacgcccacagcgccagcacgg

SEQ ID NO: 2894854 - RNA, 21 nt, Mycobacterium avium subsp. paratuberculosis
gacgcccaccugguuggcccg

SEQ ID NO: 2894855 - RNA, 23 nt, Mycobacterium avium subsp. paratuberculosis
gacgcccaccugguuggcccgca

SEQ ID NO: 2894856 - RNA, 19 nt, Mycobacterium avium subsp. paratuberculosis
gacgcccagaacgacgcgc

SEQ ID NO: 2894857 - RNA, 20 nt, Mycobacterium avium subsp. paratuberculosis
gacgcccagaacgacgcgcu

SEQ ID NO: 2894858 - RNA, 24 nt, Mycobacterium avium subsp. paratuberculosis
gacgcccagaacgacgcgcucagc

SEQ ID NO: 2894859 - RNA, 16 nt, Mycobacterium avium subsp. paratuberculosis
gacgcccagaacuggg

SEQ ID NO: 2894860 - RNA, 17 nt, Mycobacterium avium subsp. paratuberculosis
gacgcccagaacugggc

SEQ ID NO: 2894861 - RNA, 21 nt, Mycobacterium avium subsp. paratuberculosis
gacgcccagaacugggccgcc

SEQ ID NO: 2894862 - RNA, 22 nt, Mycobacterium avium subsp. paratuberculosis
gacgcccagaacugggccgccg

SEQ ID NO: 2894863 - RNA, 13 nt, Mycobacterium avium subsp. paratuberculosis
gacgcccagcacc

SEQ ID NO: 2894864 - RNA, 14 nt, Mycobacterium avium subsp. paratuberculosis
gacgcccagcaccg

SEQ ID NO: 2894865 - RNA, 13 nt, Mycobacterium avium subsp. paratuberculosis
gacgcccagcgcg

SEQ ID NO: 2894866 - RNA, 15 nt, Mycobacterium avium subsp. paratuberculosis
gacgcccagcgcggc

SEQ ID NO: 2894867 - RNA, 16 nt, Mycobacterium avium subsp. paratuberculosis
gacgcccagcgcggcg

SEQ ID NO: 2894868 - RNA, 11 nt, Mycobacterium avium subsp. paratuberculosis
gacgccccagu

SEQ ID NO: 2894869 - RNA, 13 nt, Mycobacterium avium subsp. paratuberculosis
gacgcccgcgacc

SEQ ID NO: 2894870 - RNA, 19 nt, Mycobacterium avium subsp. paratuberculosis
gacgcccgcgacccgaacu

SEQ ID NO: 2894871 - RNA, 17 nt, Mycobacterium avium subsp. paratuberculosis
gccagcuccagcagccc

SEQ ID NO: 2894872 - RNA, 18 nt, Mycobacterium avium subsp. paratuberculosis
gccagcuccagcagcccg

SEQ ID NO: 2894873 - RNA, 14 nt, Mycobacterium avium subsp. paratuberculosis
gccagcucccgggc

SEQ ID NO: 2894874 - RNA, 15 nt, Mycobacterium avium subsp. paratuberculosis
gccagcucccgggcg

SEQ ID NO: 2894875 - RNA, 18 nt, Mycobacterium avium subsp. paratuberculosis
gccagcucccgggcggcg

SEQ ID NO: 2894876 - RNA, 21 nt, Mycobacterium avium subsp. paratuberculosis
gccagcucccgggcggcgccg

SEQ ID NO: 2894877 - RNA, 22 nt, Mycobacterium avium subsp. paratuberculosis
gccagcucccgggcggcgccga

SEQ ID NO: 2894878 - RNA, 15 nt, Mycobacterium avium subsp. paratuberculosis
gccagcuccgggucg

SEQ ID NO: 2894879 - RNA, 20 nt, Mycobacterium avium subsp. paratuberculosis
gccagcuccucggggaugac

SEQ ID NO: 2894880 - RNA, 15 nt, Mycobacterium avium subsp. paratuberculosis
gccagcucgaacacc

SEQ ID NO: 2894881 - RNA, 15 nt, Mycobacterium avium subsp. paratuberculosis
gccagcucgaccgcg

SEQ ID NO: 2894882 - RNA, 16 nt, Mycobacterium avium subsp. paratuberculosis
gccagcucgaccgcgg

SEQ ID NO: 2894883 - RNA, 17 nt, Mycobacterium avium subsp. paratuberculosis
gccagcucgaccgcggc

SEQ ID NO: 2894884 - RNA, 18 nt, Mycobacterium avium subsp. paratuberculosis
gccagcucgaccgcggcg

SEQ ID NO: 2894885 - RNA, 21 nt, Mycobacterium avium subsp. paratuberculosis
gccagcucgaccgcggcgaug

SEQ ID NO: 2894886 - RNA, 19 nt, Mycobacterium avium subsp. paratuberculosis
gccagcucgagcaucacga

SEQ ID NO: 2894887 - RNA, 20 nt, Mycobacterium avium subsp. paratuberculosis
gccagcucgagcaucacgaa

SEQ ID NO: 2894888 - RNA, 21 nt, Mycobacterium avium subsp. paratuberculosis
gccagcucgagcaucacgaac

SEQ ID NO: 2894889 - RNA, 14 nt, Mycobacterium avium subsp. paratuberculosis
gccagcucgccgcc

SEQ ID NO: 2894890 - RNA, 15 nt, Mycobacterium avium subsp. paratuberculosis
gccagcucgccgccg

SEQ ID NO: 2894891 - RNA, 16 nt, Mycobacterium avium subsp. paratuberculosis
gccagcucgccgccga

SEQ ID NO: 2894892 - RNA, 19 nt, Mycobacterium avium subsp. paratuberculosis
gccagcucgccgccgacga

SEQ ID NO: 2894893 - RNA, 14 nt, Mycobacterium avium subsp. paratuberculosis
gccagcucggcccg

SEQ ID NO: 2894894 - RNA, 16 nt, Mycobacterium avium subsp. paratuberculosis
gccagcucggcccgcu

SEQ ID NO: 2894895 - RNA, 21 nt, Mycobacterium avium subsp. paratuberculosis
gccagcucggcccgcugcgcg

SEQ ID NO: 2894896 - RNA, 15 nt, Mycobacterium avium subsp. paratuberculosis
gccagcucggcggcc

SEQ ID NO: 2894897 - RNA, 17 nt, Mycobacterium avium subsp. paratuberculosis
gccagcucggcggccau

SEQ ID NO: 2894898 - RNA, 13 nt, Mycobacterium avium subsp. paratuberculosis
gccagcucggcgu

SEQ ID NO: 2894899 - RNA, 14 nt, Mycobacterium avium subsp. paratuberculosis
gccagcucggcgug

SEQ ID NO: 2894900 - RNA, 15 nt, Mycobacterium avium subsp. paratuberculosis
gccagcucggcgugg

SEQ ID NO: 2894901 - RNA, 23 nt, Mycobacterium avium subsp. paratuberculosis
gccagcucggucagccgggcggc

SEQ ID NO: 2894902 - RNA, 22 nt, Mycobacterium avium subsp. paratuberculosis
gccagcucggucgcggucggcg

SEQ ID NO: 2894903 - RNA, 23 nt, Mycobacterium avium subsp. paratuberculosis
gccagcucggucgcggucggcgc

SEQ ID NO: 2894904 - RNA, 13 nt, Mycobacterium avium subsp. paratuberculosis
gccagcucgucga

SEQ ID NO: 2894905 - RNA, 16 nt, Mycobacterium avium subsp. paratuberculosis
gccagcucgucgagcc

SEQ ID NO: 2894906 - RNA, 19 nt, Mycobacterium avium subsp. paratuberculosis
gccagcucgucgagccggc

SEQ ID NO: 2894907 - RNA, 21 nt, Mycobacterium avium subsp. paratuberculosis
gccagcucgucgagccggccg

SEQ ID NO: 2894908 - RNA, 14 nt, Mycobacterium avium subsp. paratuberculosis
gccagcucgucgcg

SEQ ID NO: 2894909 - RNA, 15 nt, Mycobacterium avium subsp. paratuberculosis
gccagcucgucgcgg

SEQ ID NO: 2894910 - RNA, 22 nt, Mycobacterium avium subsp. paratuberculosis
gccagcugaacacgaacccggc

SEQ ID NO: 2894911 - RNA, 13 nt, Mycobacterium avium subsp. paratuberculosis
gccagcugcaccg

SEQ ID NO: 2894912 - RNA, 18 nt, Mycobacterium avium subsp. paratuberculosis
gccagcugcaccggggcc

SEQ ID NO: 2894913 - RNA, 19 nt, Mycobacterium avium subsp. paratuberculosis
gccagcugcaccggggccg

SEQ ID NO: 2894914 - RNA, 21 nt, Mycobacterium avium subsp. paratuberculosis
gccagcugcaccggggccggc

SEQ ID NO: 2894915 - RNA, 22 nt, Mycobacterium avium subsp. paratuberculosis
gccagcugcaccggggccggcg

SEQ ID NO: 2894916 - RNA, 15 nt, Mycobacterium avium subsp. paratuberculosis
gccagcugcccgccg

SEQ ID NO: 2894917 - RNA, 16 nt, Mycobacterium avium subsp. paratuberculosis
gccagcugcccgccga

SEQ ID NO: 2894918 - RNA, 17 nt, Mycobacterium avium subsp. paratuberculosis
gccagcugcccgccgac

SEQ ID NO: 2894919 - RNA, 18 nt, Mycobacterium avium subsp. paratuberculosis
gccagcugcccgccgacg

SEQ ID NO: 2894920 - RNA, 13 nt, Mycobacterium avium subsp. paratuberculosis
gccagcugccgcg

SEQ ID NO: 2894921 - RNA, 14 nt, Mycobacterium avium subsp. paratuberculosis
gccagcugccgcga

SEQ ID NO: 2894922 - RNA, 19 nt, Mycobacterium avium subsp. paratuberculosis
gccagcugccgcgacucgg

SEQ ID NO: 2894923 - RNA, 23 nt, Mycobacterium avium subsp. paratuberculosis
gccagcugcgacagcacgggcgg

SEQ ID NO: 2894924 - RNA, 15 nt, Mycobacterium avium subsp. paratuberculosis
gccagcugcgcgucg

SEQ ID NO: 2894925 - RNA, 18 nt, Mycobacterium avium subsp. paratuberculosis
gccagcugcgcgucggcc

SEQ ID NO: 2894926 - RNA, 19 nt, Mycobacterium avium subsp. paratuberculosis
gccagcugcgcgucggccg

SEQ ID NO: 2894927 - RNA, 20 nt, Mycobacterium avium subsp. paratuberculosis
gccagcugcgcgucggccgc

SEQ ID NO: 2894928 - RNA, 12 nt, Mycobacterium avium subsp. paratuberculosis
gccagcugcgga

SEQ ID NO: 2894929 - RNA, 17 nt, Mycobacterium avium subsp. paratuberculosis
gccagcugcggaucggg

SEQ ID NO: 2894930 - RNA, 21 nt, Mycobacterium avium subsp. paratuberculosis
gccagcugcggaucgggcgug

SEQ ID NO: 2894931 - RNA, 23 nt, Mycobacterium avium subsp. paratuberculosis
gccagcugcggguugcgggccag

SEQ ID NO: 2894932 - RNA, 13 nt, Mycobacterium avium subsp. paratuberculosis
gccagcugcguga

SEQ ID NO: 2894933 - RNA, 17 nt, Mycobacterium avium subsp. paratuberculosis
gccagcugggcagccag

SEQ ID NO: 2894934 - RNA, 18 nt, Mycobacterium avium subsp. paratuberculosis
gccagcugggcagccaga

SEQ ID NO: 2894935 - RNA, 15 nt, Mycobacterium avium subsp. paratuberculosis
gccagcugggugguc

SEQ ID NO: 2894936 - RNA, 21 nt, Mycobacterium avium subsp. paratuberculosis
gccagcuucaccggucgggcc

SEQ ID NO: 2894937 - RNA, 19 nt, Mycobacterium avium subsp. paratuberculosis
gccagcuucgggcgcgcgc

SEQ ID NO: 2894938 - RNA, 21 nt, Mycobacterium avium subsp. paratuberculosis
gccagcuugcagcuguccugc

SEQ ID NO: 2894939 - RNA, 19 nt, Mycobacterium avium subsp. paratuberculosis
gccaggaaccacaccccgg

SEQ ID NO: 2894940 - RNA, 23 nt, Mycobacterium avium subsp. paratuberculosis
gccaggaaccacaccccggccac

SEQ ID NO: 2894941 - RNA, 19 nt, Mycobacterium avium subsp. paratuberculosis
gccaggaacggcgccaucg

SEQ ID NO: 2894942 - RNA, 19 nt, Mycobacterium avium subsp. paratuberculosis
gccaggaagaacuccgcga

SEQ ID NO: 2894943 - RNA, 23 nt, Mycobacterium avium subsp. paratuberculosis
gccaggaagaacuccgcgauggc

SEQ ID NO: 2894944 - RNA, 22 nt, Mycobacterium avium subsp. paratuberculosis
gccaggaagacguaggcggcca

SEQ ID NO: 2894945 - RNA, 23 nt, Mycobacterium avium subsp. paratuberculosis
gccaggaagacguaggcggccag

SEQ ID NO: 2894946 - RNA, 14 nt, Mycobacterium avium subsp. paratuberculosis
gccaggaagccggc

SEQ ID NO: 2894947 - RNA, 16 nt, Mycobacterium avium subsp. paratuberculosis
gccaggaagccggcga

SEQ ID NO: 2894948 - RNA, 18 nt, Mycobacterium avium subsp. paratuberculosis
gccaggaagccggcgacg

SEQ ID NO: 2894949 - RNA, 19 nt, Mycobacterium avium subsp. paratuberculosis
gccaggaagccggcgacga

SEQ ID NO: 2894950 - RNA, 23 nt, Mycobacterium avium subsp. paratuberculosis
gccaggaaggccaguucgacgau

SEQ ID NO: 2894951 - RNA, 20 nt, Mycobacterium avium subsp. paratuberculosis
gccaggaauaacgccggccc

SEQ ID NO: 2894952 - RNA, 22 nt, Mycobacterium avium subsp. paratuberculosis
gccaggaauaacgccggccccg

SEQ ID NO: 2894953 - RNA, 13 nt, Mycobacterium avium subsp. paratuberculosis
gccaggacagcgu

SEQ ID NO: 2894954 - RNA, 15 nt, Mycobacterium avium subsp. paratuberculosis
gccaggacagcguca

SEQ ID NO: 2894955 - RNA, 17 nt, Mycobacterium avium subsp. paratuberculosis
gccaggcuggccaggcu

SEQ ID NO: 2894956 - RNA, 16 nt, Mycobacterium avium subsp. paratuberculosis
gccaggcuggcgucga

SEQ ID NO: 2894957 - RNA, 19 nt, Mycobacterium avium subsp. paratuberculosis
gccaggcuggcgucgaacg

SEQ ID NO: 2894958 - RNA, 17 nt, Mycobacterium avium subsp. paratuberculosis
gccagggcagcgcgacc

SEQ ID NO: 2894959 - RNA, 19 nt, Mycobacterium avium subsp. paratuberculosis
gccagggccccguuggugc

SEQ ID NO: 2894960 - RNA, 15 nt, Mycobacterium avium subsp. paratuberculosis
gccagggcccgcagc

SEQ ID NO: 2894961 - RNA, 17 nt, Mycobacterium avium subsp. paratuberculosis
gccagggcccgcagccg

SEQ ID NO: 2894962 - RNA, 13 nt, Mycobacterium avium subsp. paratuberculosis
gccagggccgccg

SEQ ID NO: 2894963 - RNA, 16 nt, Mycobacterium avium subsp. paratuberculosis
gccagggccgccgcau

SEQ ID NO: 2894964 - RNA, 17 nt, Mycobacterium avium subsp. paratuberculosis
gccagggccgccgcaua

SEQ ID NO: 2894965 - RNA, 19 nt, Mycobacterium avium subsp. paratuberculosis
gccagggccgccgcauacc

SEQ ID NO: 2894966 - RNA, 24 nt, Mycobacterium avium subsp. paratuberculosis
gccagggccgccuugaucuuggcc

SEQ ID NO: 2894967 - RNA, 14 nt, Mycobacterium avium subsp. paratuberculosis
gccagggccgggcg

SEQ ID NO: 2894968 - RNA, 16 nt, Mycobacterium avium subsp. paratuberculosis
gccagggccgggcgug

SEQ ID NO: 2894969 - RNA, 22 nt, Mycobacterium avium subsp. paratuberculosis
gccagggccgggcgugcccggc

SEQ ID NO: 2894970 - RNA, 19 nt, Mycobacterium avium subsp. paratuberculosis
gccagggcgacgccgcgga

SEQ ID NO: 2894971 - RNA, 16 nt, Mycobacterium avium subsp. paratuberculosis
gccagggcgaggacgg

SEQ ID NO: 2894972 - RNA, 17 nt, Mycobacterium avium subsp. paratuberculosis
gccagggcgcggcgcac

SEQ ID NO: 2894973 - RNA, 13 nt, Mycobacterium avium subsp. paratuberculosis
gccagggcggcgc

SEQ ID NO: 2894974 - RNA, 15 nt, Mycobacterium avium subsp. paratuberculosis
gccagggcggcgccg

SEQ ID NO: 2894975 - RNA, 17 nt, Mycobacterium avium subsp. paratuberculosis
gccagggcggcgccggc

SEQ ID NO: 2894976 - RNA, 19 nt, Mycobacterium avium subsp. paratuberculosis
gccagggcggcgccggcac

SEQ ID NO: 2894977 - RNA, 18 nt, Mycobacterium avium subsp. paratuberculosis
gccagggcucgugcagcc

SEQ ID NO: 2894978 - RNA, 20 nt, Mycobacterium avium subsp. paratuberculosis
gccagggcucgugcagccgg

SEQ ID NO: 2894979 - RNA, 21 nt, Mycobacterium avium subsp. paratuberculosis
gccagggggaguagucggcga

SEQ ID NO: 2894980 - RNA, 22 nt, Mycobacterium avium subsp. paratuberculosis
gccagggggaguagucggcgau

SEQ ID NO: 2894981 - RNA, 18 nt, Mycobacterium avium subsp. paratuberculosis
gccaggguagaggcggcg

SEQ ID NO: 2894982 - RNA, 19 nt, Mycobacterium avium subsp. paratuberculosis
gccaggguagaggcggcga

SEQ ID NO: 2894983 - RNA, 16 nt, Mycobacterium avium subsp. paratuberculosis
gccagggucucgggca

SEQ ID NO: 2894984 - RNA, 19 nt, Mycobacterium avium subsp. paratuberculosis
gccagggucucgggcagca

SEQ ID NO: 2894985 - RNA, 21 nt, Mycobacterium avium subsp. paratuberculosis
gccagggucucgggcagcagc

SEQ ID NO: 2894986 - RNA, 18 nt, Mycobacterium avium subsp. paratuberculosis
gccagggucuggcccggu

SEQ ID NO: 2894987 - RNA, 22 nt, Mycobacterium avium subsp. paratuberculosis
gccagggugacggucaugccga

SEQ ID NO: 2894988 - RNA, 14 nt, Mycobacterium avium subsp. paratuberculosis
gccagggugccccg

SEQ ID NO: 2894989 - RNA, 17 nt, Mycobacterium avium subsp. paratuberculosis
gccagggugccccgcac

SEQ ID NO: 2894990 - RNA, 20 nt, Mycobacterium avium subsp. paratuberculosis
gccagggugccccgcaccgc

SEQ ID NO: 2894991 - RNA, 16 nt, Mycobacterium avium subsp. paratuberculosis
gccagggugccgacga

SEQ ID NO: 2894992 - RNA, 20 nt, Mycobacterium avium subsp. paratuberculosis
gccagggugccgcugcccgc

SEQ ID NO: 2894993 - RNA, 21 nt, Mycobacterium avium subsp. paratuberculosis
gccaggguggggaucacgucg

SEQ ID NO: 2894994 - RNA, 22 nt, Mycobacterium avium subsp. paratuberculosis
gccaggguggggaucacgucgg

SEQ ID NO: 2894995 - RNA, 18 nt, Mycobacterium avium subsp. paratuberculosis
gccagggugucccagcgc

SEQ ID NO: 2894996 - RNA, 19 nt, Mycobacterium avium subsp. paratuberculosis
gccagggugucccagcgcc

SEQ ID NO: 2894997 - RNA, 20 nt, Mycobacterium avium subsp. paratuberculosis
gccagggugucccagcgcca

SEQ ID NO: 2894998 - RNA, 16 nt, Mycobacterium avium subsp. paratuberculosis
gccagguacaccacca

SEQ ID NO: 2894999 - RNA, 19 nt, Mycobacterium avium subsp. paratuberculosis
gccagguacaccaccaggu

SEQ ID NO: 2895000 - RNA, 22 nt, Mycobacterium avium subsp. paratuberculosis
gccagguacuccgguaccacgc

SEQ ID NO: 2895001 - RNA, 22 nt, Mycobacterium avium subsp. paratuberculosis
gccagguacugaucaccgcgcu

SEQ ID NO: 2895002 - RNA, 15 nt, Mycobacterium avium subsp. paratuberculosis
gccagguaguggugg

SEQ ID NO: 2895003 - RNA, 21 nt, Mycobacterium avium subsp. paratuberculosis
gccagguaguuguucgacugc

SEQ ID NO: 2895004 - RNA, 22 nt, Mycobacterium avium subsp. paratuberculosis
gccagguauucgcgggaggaca

SEQ ID NO: 2895005 - RNA, 16 nt, Mycobacterium avium subsp. paratuberculosis
gccagguccgggcacu

SEQ ID NO: 2895006 - RNA, 19 nt, Mycobacterium avium subsp. paratuberculosis
gccagguccucgcuggcga

SEQ ID NO: 2895007 - RNA, 14 nt, Mycobacterium avium subsp. paratuberculosis
gccaggucgccgcg

SEQ ID NO: 2895008 - RNA, 18 nt, Mycobacterium avium subsp. paratuberculosis
gccaggucgccgcgcagc

SEQ ID NO: 2895009 - RNA, 21 nt, Mycobacterium avium subsp. paratuberculosis
gccaggucgccgcgcagcacc

SEQ ID NO: 2895010 - RNA, 19 nt, Mycobacterium avium subsp. paratuberculosis
gccaggucgggguccaggc

SEQ ID NO: 2895011 - RNA, 22 nt, Mycobacterium avium subsp. paratuberculosis
gccaggucgggguccaggccgc

SEQ ID NO: 2895012 - RNA, 23 nt, Mycobacterium avium subsp. paratuberculosis
gccaggucgggguccaggccgcg

SEQ ID NO: 2895013 - RNA, 16 nt, Mycobacterium avium subsp. paratuberculosis
gccaggugaacagguc

SEQ ID NO: 2895014 - RNA, 19 nt, Mycobacterium avium subsp. paratuberculosis
gccaggugcacgccgagca

SEQ ID NO: 2895015 - RNA, 12 nt, Mycobacterium avium subsp. paratuberculosis
gccaggugcagc

SEQ ID NO: 2895016 - RNA, 14 nt, Mycobacterium avium subsp. paratuberculosis
gccaggugcagcug

SEQ ID NO: 2895017 - RNA, 13 nt, Mycobacterium avium subsp. paratuberculosis
gccagguggguga

SEQ ID NO: 2895018 - RNA, 13 nt, Mycobacterium avium subsp. paratuberculosis
gccagguggugaa

SEQ ID NO: 2895019 - RNA, 18 nt, Mycobacterium avium subsp. paratuberculosis
gccagguguaggcggcca

SEQ ID NO: 2895020 - RNA, 19 nt, Mycobacterium avium subsp. paratuberculosis
gccagguguaggcggccac

SEQ ID NO: 2895021 - RNA, 17 nt, Mycobacterium avium subsp. paratuberculosis
gccaggugugcccgccc

SEQ ID NO: 2895022 - RNA, 15 nt, Mycobacterium avium subsp. paratuberculosis
gccaggugugcggca

SEQ ID NO: 2895023 - RNA, 17 nt, Mycobacterium avium subsp. paratuberculosis
gccaggugugcggcacg

SEQ ID NO: 2895024 - RNA, 19 nt, Mycobacterium avium subsp. paratuberculosis
gccagguucaggcccgcgc

SEQ ID NO: 2895025 - RNA, 22 nt, Mycobacterium avium subsp. paratuberculosis
gccagguucaggcccgcgccga

SEQ ID NO: 2895026 - RNA, 15 nt, Mycobacterium avium subsp. paratuberculosis
gccagguuccaccgg

SEQ ID NO: 2895027 - RNA, 17 nt, Mycobacterium avium subsp. paratuberculosis
gccagguuccaccgggc

SEQ ID NO: 2895028 - RNA, 12 nt, Mycobacterium avium subsp. paratuberculosis
gccagguucgcg

SEQ ID NO: 2895029 - RNA, 16 nt, Mycobacterium avium subsp. paratuberculosis
gccagguucgcgccga

SEQ ID NO: 2895030 - RNA, 16 nt, Mycobacterium avium subsp. paratuberculosis
gccagguugaccacca

SEQ ID NO: 2895031 - RNA, 19 nt, Mycobacterium avium subsp. paratuberculosis
gccagguugaccaccagcg

SEQ ID NO: 2895032 - RNA, 18 nt, Mycobacterium avium subsp. paratuberculosis
gccagguugcgccguccg

SEQ ID NO: 2895033 - RNA, 17 nt, Mycobacterium avium subsp. paratuberculosis
gccagguuggcggcggc

SEQ ID NO: 2895034 - RNA, 19 nt, Mycobacterium avium subsp. paratuberculosis
gccagguuggcggcggccc

SEQ ID NO: 2895035 - RNA, 20 nt, Mycobacterium avium subsp. paratuberculosis
gccagguuggucagcagcag

SEQ ID NO: 2895036 - RNA, 22 nt, Mycobacterium avium subsp. paratuberculosis
gccagguuggucagcagcagcg

SEQ ID NO: 2895037 - RNA, 22 nt, Mycobacterium avium subsp. paratuberculosis
gccagguuguaggugcccgauu

SEQ ID NO: 2895038 - RNA, 16 nt, Mycobacterium avium subsp. paratuberculosis
gccagguugucgucgg

SEQ ID NO: 2895039 - RNA, 22 nt, Mycobacterium avium subsp. paratuberculosis
gcccaaaaacgagaugccccag

SEQ ID NO: 2895040 - RNA, 23 nt, Mycobacterium avium subsp. paratuberculosis
gcccaaaacgugauagcggccgc

SEQ ID NO: 2895041 - RNA, 20 nt, Mycobacterium avium subsp. paratuberculosis
gcccaacaacucgacguucg

SEQ ID NO: 2895042 - RNA, 16 nt, Mycobacterium avium subsp. paratuberculosis
gcccaacacgcccugc

SEQ ID NO: 2895043 - RNA, 19 nt, Mycobacterium avium subsp. paratuberculosis
gcccaacacgcccugcagg

SEQ ID NO: 2895044 - RNA, 23 nt, Mycobacterium avium subsp. paratuberculosis
gcccaacagcucgcgggccugcu

SEQ ID NO: 2895045 - RNA, 16 nt, Mycobacterium avium subsp. paratuberculosis
gcccaaccgcauucgg

SEQ ID NO: 2895046 - RNA, 17 nt, Mycobacterium avium subsp. paratuberculosis
gcccaaccgcauucggc

SEQ ID NO: 2895047 - RNA, 20 nt, Mycobacterium avium subsp. paratuberculosis
gcccaaccgcauucggccgc

SEQ ID NO: 2895048 - RNA, 23 nt, Mycobacterium avium subsp. paratuberculosis
gcccaaccggaucggcuagcagc

SEQ ID NO: 2895049 - RNA, 14 nt, Mycobacterium avium subsp. paratuberculosis
gcccaacgacgucg

SEQ ID NO: 2895050 - RNA, 17 nt, Mycobacterium avium subsp. paratuberculosis
gcccaacgacgucggcg

SEQ ID NO: 2895051 - RNA, 18 nt, Mycobacterium avium subsp. paratuberculosis
gcccaacgacgucggcgu

SEQ ID NO: 2895052 - RNA, 14 nt, Mycobacterium avium subsp. paratuberculosis
gcccaacgucgacu

SEQ ID NO: 2895053 - RNA, 17 nt, Mycobacterium avium subsp. paratuberculosis
gcccaacuacccgccga

SEQ ID NO: 2895054 - RNA, 19 nt, Mycobacterium avium subsp. paratuberculosis
gcccaacuacccgccgacg

SEQ ID NO: 2895055 - RNA, 18 nt, Mycobacterium avium subsp. paratuberculosis
gcccaacuggcgaccggu

SEQ ID NO: 2895056 - RNA, 21 nt, Mycobacterium avium subsp. paratuberculosis
gcccaagacccgcgucaucgg

SEQ ID NO: 2895057 - RNA, 14 nt, Mycobacterium avium subsp. paratuberculosis
gcccaagccggcca

SEQ ID NO: 2895058 - RNA, 15 nt, Mycobacterium avium subsp. paratuberculosis
gcccaagccggccag

SEQ ID NO: 2895059 - RNA, 17 nt, Mycobacterium avium subsp. paratuberculosis
gcccaagugcccgcggg

SEQ ID NO: 2895060 - RNA, 16 nt, Mycobacterium avium subsp. paratuberculosis
gcccaauagcacccgc

SEQ ID NO: 2895061 - RNA, 20 nt, Mycobacterium avium subsp. paratuberculosis
gcccaaugaucugggccgcc

SEQ ID NO: 2895062 - RNA, 21 nt, Mycobacterium avium subsp. paratuberculosis
gcccaaugaucugggccgcca

SEQ ID NO: 2895063 - RNA, 17 nt, Mycobacterium avium subsp. paratuberculosis
gcccaauucgacugcga

SEQ ID NO: 2895064 - RNA, 21 nt, Mycobacterium avium subsp. paratuberculosis
gcccaauucgacugcgaugcu

SEQ ID NO: 2895065 - RNA, 18 nt, Mycobacterium avium subsp. paratuberculosis
gcccaauucguaggcgag

SEQ ID NO: 2895066 - RNA, 18 nt, Mycobacterium avium subsp. paratuberculosis
gcccacaccgacaccggc

SEQ ID NO: 2895067 - RNA, 13 nt, Mycobacterium avium subsp. paratuberculosis
gcccacagcaacg

SEQ ID NO: 2895068 - RNA, 12 nt, Mycobacterium avium subsp. paratuberculosis
gcccacagcagc

SEQ ID NO: 2895069 - RNA, 13 nt, Mycobacterium avium subsp. paratuberculosis
gcccacagcagcc

SEQ ID NO: 2895070 - RNA, 15 nt, Mycobacterium avium subsp. paratuberculosis
gcccacagcagccgc

SEQ ID NO: 2895071 - RNA, 20 nt, Mycobacterium avium subsp. paratuberculosis
gcccacagcagccgcaccuc

SEQ ID NO: 2895072 - RNA, 14 nt, Mycobacterium avium subsp. paratuberculosis
gcccacagccaggu

SEQ ID NO: 2895073 - RNA, 13 nt, Mycobacterium avium subsp. paratuberculosis
gcccacagcgcca

SEQ ID NO: 2895074 - RNA, 14 nt, Mycobacterium avium subsp. paratuberculosis
gcccacagcgccag

SEQ ID NO: 2895075 - RNA, 16 nt, Mycobacterium avium subsp. paratuberculosis
gcccacagcgccagca

SEQ ID NO: 2895076 - RNA, 18 nt, Mycobacterium avium subsp. paratuberculosis
gcccacagcgccagcacg

SEQ ID NO: 2895077 - RNA, 20 nt, Mycobacterium avium subsp. paratuberculosis
gcccacagcgccagcacggc

SEQ ID NO: 2895078 - RNA, 15 nt, Mycobacterium avium subsp. paratuberculosis
gcccacagcugacgg

SEQ ID NO: 2895079 - RNA, 20 nt, Mycobacterium avium subsp. paratuberculosis
gcccacagcugacgggccgg

SEQ ID NO: 2895080 - RNA, 23 nt, Mycobacterium avium subsp. paratuberculosis
gcccacagcuugccggagcccag

SEQ ID NO: 2895081 - RNA, 23 nt, Mycobacterium avium subsp. paratuberculosis
gcccacaggacguugaggcggcg

SEQ ID NO: 2895082 - RNA, 18 nt, Mycobacterium avium subsp. paratuberculosis
gcccacaguccgcccagc

SEQ ID NO: 2895083 - RNA, 20 nt, Mycobacterium avium subsp. paratuberculosis
gcccacaguccgcccagcga

SEQ ID NO: 2895084 - RNA, 22 nt, Mycobacterium avium subsp. paratuberculosis
gcccacaguccgcccagcgagu

SEQ ID NO: 2895085 - RNA, 16 nt, Mycobacterium avium subsp. paratuberculosis
gcccacauacaccggg

SEQ ID NO: 2895086 - RNA, 23 nt, Mycobacterium avium subsp. paratuberculosis
gcccacauacaccgggaucggcg

SEQ ID NO: 2895087 - RNA, 20 nt, Mycobacterium avium subsp. paratuberculosis
gcccaccaccaggggcagcu

SEQ ID NO: 2895088 - RNA, 21 nt, Mycobacterium avium subsp. paratuberculosis
gcccaccaccgccucgacggu

SEQ ID NO: 2895089 - RNA, 12 nt, Mycobacterium avium subsp. paratuberculosis
gcccaccaccgg

SEQ ID NO: 2895090 - RNA, 13 nt, Mycobacterium avium subsp. paratuberculosis
gcccaccaccugc

SEQ ID NO: 2895091 - RNA, 22 nt, Mycobacterium avium subsp. paratuberculosis
gcccaccacgaaccaggcgccg

SEQ ID NO: 2895092 - RNA, 23 nt, Mycobacterium avium subsp. paratuberculosis
gcccaccacgaacgcgccgccga

SEQ ID NO: 2895093 - RNA, 17 nt, Mycobacterium avium subsp. paratuberculosis
gcccaccagcacaccgg

SEQ ID NO: 2895094 - RNA, 15 nt, Mycobacterium avium subsp. paratuberculosis
gcccaccagccggcc

SEQ ID NO: 2895095 - RNA, 20 nt, Mycobacterium avium subsp. paratuberculosis
gcccaccagccggccggcga

SEQ ID NO: 2895096 - RNA, 18 nt, Mycobacterium avium subsp. paratuberculosis
gcccaccaucccgccgcc

SEQ ID NO: 2895097 - RNA, 19 nt, Mycobacterium avium subsp. paratuberculosis
gcccaccaucccgccgccg

SEQ ID NO: 2895098 - RNA, 20 nt, Mycobacterium avium subsp. paratuberculosis
gcccaccaucccgccgccga

SEQ ID NO: 2895099 - RNA, 12 nt, Mycobacterium avium subsp. paratuberculosis
gcccaccccggc

SEQ ID NO: 2895100 - RNA, 14 nt, Mycobacterium avium subsp. paratuberculosis
gcccaccccggcgu

SEQ ID NO: 2895101 - RNA, 15 nt, Mycobacterium avium subsp. paratuberculosis
gcccaccccggcguc

SEQ ID NO: 2895102 - RNA, 16 nt, Mycobacterium avium subsp. paratuberculosis
gcccaccccggcgucc

SEQ ID NO: 2895103 - RNA, 19 nt, Mycobacterium avium subsp. paratuberculosis
gcccaccccggcguccacg

SEQ ID NO: 2895104 - RNA, 20 nt, Mycobacterium avium subsp. paratuberculosis
gcccacccgaugaccggccc

SEQ ID NO: 2895105 - RNA, 12 nt, Mycobacterium avium subsp. paratuberculosis
gcccacccgcac

SEQ ID NO: 2895106 - RNA, 20 nt, Mycobacterium avium subsp. paratuberculosis
gcccacccgcacgcccgggc

SEQ ID NO: 2895107 - RNA, 18 nt, Mycobacterium avium subsp. paratuberculosis
gcccacccgcagggcgcc

SEQ ID NO: 2895108 - RNA, 15 nt, Mycobacterium avium subsp. paratuberculosis
gcccacccgccagcc

SEQ ID NO: 2895109 - RNA, 16 nt, Mycobacterium avium subsp. paratuberculosis
gcccacccgccagccc

SEQ ID NO: 2895110 - RNA, 18 nt, Mycobacterium avium subsp. paratuberculosis
gcccacccgccagcccgc

SEQ ID NO: 2895111 - RNA, 15 nt, Mycobacterium avium subsp. paratuberculosis
gcccacccgcucggc

SEQ ID NO: 2895112 - RNA, 18 nt, Mycobacterium avium subsp. paratuberculosis
gcccacccggaugucgug

SEQ ID NO: 2895113 - RNA, 19 nt, Mycobacterium avium subsp. paratuberculosis
gcccacccggggccguccg

SEQ ID NO: 2895114 - RNA, 19 nt, Mycobacterium avium subsp. paratuberculosis
gcccacccguuggcaggcc

SEQ ID NO: 2895115 - RNA, 19 nt, Mycobacterium avium subsp. paratuberculosis
gcccaccgacgcggcggcc

SEQ ID NO: 2895116 - RNA, 21 nt, Mycobacterium avium subsp. paratuberculosis
gcccaccgacgcggcggccga

SEQ ID NO: 2895117 - RNA, 18 nt, Mycobacterium avium subsp. paratuberculosis
gcccaccgccaccaggcc

SEQ ID NO: 2895118 - RNA, 14 nt, Mycobacterium avium subsp. paratuberculosis
gcccaccgcgaccc

SEQ ID NO: 2895119 - RNA, 17 nt, Mycobacterium avium subsp. paratuberculosis
gcccaccgcgacccggc

SEQ ID NO: 2895120 - RNA, 19 nt, Mycobacterium avium subsp. paratuberculosis
gcccaccgcgacccggccg

SEQ ID NO: 2895121 - RNA, 22 nt, Mycobacterium avium subsp. paratuberculosis
gcccaccgcgacccggccgagc

SEQ ID NO: 2895122 - RNA, 15 nt, Mycobacterium avium subsp. paratuberculosis
gcccaccgcgcccag

SEQ ID NO: 2895123 - RNA, 19 nt, Mycobacterium avium subsp. paratuberculosis
gcccagauacgccgcgacg

SEQ ID NO: 2895124 - RNA, 17 nt, Mycobacterium avium subsp. paratuberculosis
gcccagaucgacgccga

SEQ ID NO: 2895125 - RNA, 22 nt, Mycobacterium avium subsp. paratuberculosis
gcccagaucgacgccgaccgcg

SEQ ID NO: 2895126 - RNA, 13 nt, Mycobacterium avium subsp. paratuberculosis
gcccagaucgccg

SEQ ID NO: 2895127 - RNA, 18 nt, Mycobacterium avium subsp. paratuberculosis
gcccagaucgccgacccg

SEQ ID NO: 2895128 - RNA, 20 nt, Mycobacterium avium subsp. paratuberculosis
gcccagaucgccgacccggu

SEQ ID NO: 2895129 - RNA, 15 nt, Mycobacterium avium subsp. paratuberculosis
gcccagaucgcgguc

SEQ ID NO: 2895130 - RNA, 17 nt, Mycobacterium avium subsp. paratuberculosis
gcccagaucggccagcc

SEQ ID NO: 2895131 - RNA, 14 nt, Mycobacterium avium subsp. paratuberculosis
gcccagaugccgcc

SEQ ID NO: 2895132 - RNA, 15 nt, Mycobacterium avium subsp. paratuberculosis
gcccagaugccgccg

SEQ ID NO: 2895133 - RNA, 22 nt, Mycobacterium avium subsp. paratuberculosis
gcccagaugccgccgccagcgc

SEQ ID NO: 2895134 - RNA, 18 nt, Mycobacterium avium subsp. paratuberculosis
gcccagaugccggcguag

SEQ ID NO: 2895135 - RNA, 16 nt, Mycobacterium avium subsp. paratuberculosis
gcccagauugcggccc

SEQ ID NO: 2895136 - RNA, 17 nt, Mycobacterium avium subsp. paratuberculosis
gcccagcaaacccagca

SEQ ID NO: 2895137 - RNA, 18 nt, Mycobacterium avium subsp. paratuberculosis
gcccagcaccaccacguu

SEQ ID NO: 2895138 - RNA, 14 nt, Mycobacterium avium subsp. paratuberculosis
gcccagcaccaccu

SEQ ID NO: 2895139 - RNA, 16 nt, Mycobacterium avium subsp. paratuberculosis
gcccagcaccacuucc

SEQ ID NO: 2895140 - RNA, 22 nt, Mycobacterium avium subsp. paratuberculosis
gcccagcacccgcucgccgaug

SEQ ID NO: 2895141 - RNA, 13 nt, Mycobacterium avium subsp. paratuberculosis
gcccagcacccgg

SEQ ID NO: 2895142 - RNA, 14 nt, Mycobacterium avium subsp. paratuberculosis
gcccagcacccggu

SEQ ID NO: 2895143 - RNA, 23 nt, Mycobacterium avium subsp. paratuberculosis
gcccagcacccgguuccaccggg

SEQ ID NO: 2895144 - RNA, 13 nt, Mycobacterium avium subsp. paratuberculosis
gcccagcaccgcc

SEQ ID NO: 2895145 - RNA, 15 nt, Mycobacterium avium subsp. paratuberculosis
gcccagcaccgccgg

SEQ ID NO: 2895146 - RNA, 16 nt, Mycobacterium avium subsp. paratuberculosis
gcccagcaccgccggc

SEQ ID NO: 2895147 - RNA, 19 nt, Mycobacterium avium subsp. paratuberculosis
gcccagcaccgccggcgcc

SEQ ID NO: 2895148 - RNA, 16 nt, Mycobacterium avium subsp. paratuberculosis
gcccagcaccgcgacg

SEQ ID NO: 2895149 - RNA, 23 nt, Mycobacterium avium subsp. paratuberculosis
gcccagcaccgucugcgccguca

SEQ ID NO: 2895150 - RNA, 19 nt, Mycobacterium avium subsp. paratuberculosis
gcccagcacgacgccgcug

SEQ ID NO: 2895151 - RNA, 22 nt, Mycobacterium avium subsp. paratuberculosis
gcccagcacgacgccgcugggc

SEQ ID NO: 2895152 - RNA, 20 nt, Mycobacterium avium subsp. paratuberculosis
gcccagcagauagcccagcc

SEQ ID NO: 2895153 - RNA, 21 nt, Mycobacterium avium subsp. paratuberculosis
gcccagcagauagcccagcca

SEQ ID NO: 2895154 - RNA, 24 nt, Mycobacterium avium subsp. paratuberculosis
gcccagcagauagcccagccagcc

SEQ ID NO: 2895155 - RNA, 14 nt, Mycobacterium avium subsp. paratuberculosis
gcccagcagcaccg

SEQ ID NO: 2895156 - RNA, 15 nt, Mycobacterium avium subsp. paratuberculosis
gcccagcagcaccgc

SEQ ID NO: 2895157 - RNA, 13 nt, Mycobacterium avium subsp. paratuberculosis
gcccagcagcccg

SEQ ID NO: 2895158 - RNA, 19 nt, Mycobacterium avium subsp. paratuberculosis
gcccagcagcccggccagc

SEQ ID NO: 2895159 - RNA, 20 nt, Mycobacterium avium subsp. paratuberculosis
gcccagcagcccggccagcc

SEQ ID NO: 2895160 - RNA, 20 nt, Mycobacterium avium subsp. paratuberculosis
gcccagcagccgcgccgacg

SEQ ID NO: 2895161 - RNA, 13 nt, Mycobacterium avium subsp. paratuberculosis
gcccagcagccug

SEQ ID NO: 2895162 - RNA, 16 nt, Mycobacterium avium subsp. paratuberculosis
gcccagcagccugccc

SEQ ID NO: 2895163 - RNA, 18 nt, Mycobacterium avium subsp. paratuberculosis
gcccagcagcgcaccggc

SEQ ID NO: 2895164 - RNA, 20 nt, Mycobacterium avium subsp. paratuberculosis
gcccagcagcgcaccggcga

SEQ ID NO: 2895165 - RNA, 23 nt, Mycobacterium avium subsp. paratuberculosis
gcccagcagcgcaccggcgaugc

SEQ ID NO: 2895166 - RNA, 16 nt, Mycobacterium avium subsp. paratuberculosis
gcccagcagcgggccc

SEQ ID NO: 2895167 - RNA, 18 nt, Mycobacterium avium subsp. paratuberculosis
gcccagcagcgggcccgg

SEQ ID NO: 2895168 - RNA, 16 nt, Mycobacterium avium subsp. paratuberculosis
gcccagcagcggggcg

SEQ ID NO: 2895169 - RNA, 17 nt, Mycobacterium avium subsp. paratuberculosis
gcccagcagcggggcga

SEQ ID NO: 2895170 - RNA, 12 nt, Mycobacterium avium subsp. paratuberculosis
gcccagcagcgu

SEQ ID NO: 2895171 - RNA, 13 nt, Mycobacterium avium subsp. paratuberculosis
gcccagcagcguc

SEQ ID NO: 2895172 - RNA, 16 nt, Mycobacterium avium subsp. paratuberculosis
gcccagcagcgucacg

SEQ ID NO: 2895173 - RNA, 20 nt, Mycobacterium avium subsp. paratuberculosis
gcccagcagcugcgcgucga

SEQ ID NO: 2895174 - RNA, 22 nt, Mycobacterium avium subsp. paratuberculosis
gcccagcagcugcgcgucgaag

SEQ ID NO: 2895175 - RNA, 23 nt, Mycobacterium avium subsp. paratuberculosis
gcccagcagcugcgcgucgaaga

SEQ ID NO: 2895176 - RNA, 20 nt, Mycobacterium avium subsp. paratuberculosis
gcccagcagggcggcgaucg

SEQ ID NO: 2895177 - RNA, 15 nt, Mycobacterium avium subsp. paratuberculosis
gcccagcaguccggc

SEQ ID NO: 2895178 - RNA, 18 nt, Mycobacterium avium subsp. paratuberculosis
gcccagcaguccggcggu

SEQ ID NO: 2895179 - RNA, 23 nt, Mycobacterium avium subsp. paratuberculosis
gcccagcaguccggcggucagca

SEQ ID NO: 2895180 - RNA, 18 nt, Mycobacterium avium subsp. paratuberculosis
gcccagcauaggugcgcc

SEQ ID NO: 2895181 - RNA, 16 nt, Mycobacterium avium subsp. paratuberculosis
gcccagcaucgccgcg

SEQ ID NO: 2895182 - RNA, 17 nt, Mycobacterium avium subsp. paratuberculosis
gcccagcaucgccgcga

SEQ ID NO: 2895183 - RNA, 17 nt, Mycobacterium avium subsp. paratuberculosis
gcccagccagccggugg

SEQ ID NO: 2895184 - RNA, 18 nt, Mycobacterium avium subsp. paratuberculosis
gcccagccagccgguggc

SEQ ID NO: 2895185 - RNA, 19 nt, Mycobacterium avium subsp. paratuberculosis
gcccagccagccgguggcg

SEQ ID NO: 2895186 - RNA, 13 nt, Mycobacterium avium subsp. paratuberculosis
gcccagccagcga

SEQ ID NO: 2895187 - RNA, 16 nt, Mycobacterium avium subsp. paratuberculosis
gcccagccagcgacaa

SEQ ID NO: 2895188 - RNA, 15 nt, Mycobacterium avium subsp. paratuberculosis
gcccagccaggccgc

SEQ ID NO: 2895189 - RNA, 20 nt, Mycobacterium avium subsp. paratuberculosis
gcccagccaggccgccgggc

SEQ ID NO: 2895190 - RNA, 16 nt, Mycobacterium avium subsp. paratuberculosis
gcccagccaguccgcc

SEQ ID NO: 2895191 - RNA, 19 nt, Mycobacterium avium subsp. paratuberculosis
gcccagccaguccgccgcc

SEQ ID NO: 2895192 - RNA, 21 nt, Mycobacterium avium subsp. paratuberculosis
gcccagccaguccgccgccgu

SEQ ID NO: 2895193 - RNA, 23 nt, Mycobacterium avium subsp. paratuberculosis
gcccagccauaccuugucggcgu

SEQ ID NO: 2895194 - RNA, 13 nt, Mycobacterium avium subsp. paratuberculosis
gcccagccaucug

SEQ ID NO: 2895195 - RNA, 16 nt, Mycobacterium avium subsp. paratuberculosis
gcccagccaucugcug

SEQ ID NO: 2895196 - RNA, 14 nt, Mycobacterium avium subsp. paratuberculosis
gcccagccccagca

SEQ ID NO: 2895197 - RNA, 15 nt, Mycobacterium avium subsp. paratuberculosis
gcccagccccagcac

SEQ ID NO: 2895198 - RNA, 16 nt, Mycobacterium avium subsp. paratuberculosis
gcccagccccagcacg

SEQ ID NO: 2895199 - RNA, 17 nt, Mycobacterium avium subsp. paratuberculosis
gcccagccccagcacga

SEQ ID NO: 2895200 - RNA, 17 nt, Mycobacterium avium subsp. paratuberculosis
gcccagccccucgacgu

SEQ ID NO: 2895201 - RNA, 23 nt, Mycobacterium avium subsp. paratuberculosis
gcccagccccucgacguccaggc

SEQ ID NO: 2895202 - RNA, 15 nt, Mycobacterium avium subsp. paratuberculosis
gcccagcccgagcac

SEQ ID NO: 2895203 - RNA, 19 nt, Mycobacterium avium subsp. paratuberculosis
gcccagcccgagcaccagc

SEQ ID NO: 2895204 - RNA, 21 nt, Mycobacterium avium subsp. paratuberculosis
gcccagcccgagcaccagcgg

SEQ ID NO: 2895205 - RNA, 14 nt, Mycobacterium avium subsp. paratuberculosis
gcccagcccgccgc

SEQ ID NO: 2895206 - RNA, 16 nt, Mycobacterium avium subsp. paratuberculosis
gcccagcccgccgcgu

SEQ ID NO: 2895207 - RNA, 17 nt, Mycobacterium avium subsp. paratuberculosis
gcccagcccgccgcguc

SEQ ID NO: 2895208 - RNA, 13 nt, Mycobacterium avium subsp. paratuberculosis
gcccagcgcggug

SEQ ID NO: 2895209 - RNA, 23 nt, Mycobacterium avium subsp. paratuberculosis
gcccagcgcgguguacagcgcgc

SEQ ID NO: 2895210 - RNA, 13 nt, Mycobacterium avium subsp. paratuberculosis
gcccagcgcguug

SEQ ID NO: 2895211 - RNA, 17 nt, Mycobacterium avium subsp. paratuberculosis
gcccagcgcguugcggc

SEQ ID NO: 2895212 - RNA, 22 nt, Mycobacterium avium subsp. paratuberculosis
gcccagcgcguugcggccgucc

SEQ ID NO: 2895213 - RNA, 21 nt, Mycobacterium avium subsp. paratuberculosis
gcccagcggcacgggcaccga

SEQ ID NO: 2895214 - RNA, 21 nt, Mycobacterium avium subsp. paratuberculosis
gcccagcggcauggcgaugac

SEQ ID NO: 2895215 - RNA, 20 nt, Mycobacterium avium subsp. paratuberculosis
gcccagcggccccggcucgg

SEQ ID NO: 2895216 - RNA, 15 nt, Mycobacterium avium subsp. paratuberculosis
gcccagcggcgaugc

SEQ ID NO: 2895217 - RNA, 22 nt, Mycobacterium avium subsp. paratuberculosis
gcccagcggcgaugcccacagc

SEQ ID NO: 2895218 - RNA, 22 nt, Mycobacterium avium subsp. paratuberculosis
gcccagcggcuguagcacccgg

SEQ ID NO: 2895219 - RNA, 20 nt, Mycobacterium avium subsp. paratuberculosis
gcccagcggggcgaccuugc

SEQ ID NO: 2895220 - RNA, 20 nt, Mycobacterium avium subsp. paratuberculosis
gcccagcguagaacauccac

SEQ ID NO: 2895221 - RNA, 20 nt, Mycobacterium avium subsp. paratuberculosis
gcccagcgucaacucgucgg

SEQ ID NO: 2895222 - RNA, 23 nt, Mycobacterium avium subsp. paratuberculosis
gcccagcgucaacucgucggcga

SEQ ID NO: 2895223 - RNA, 17 nt, Mycobacterium avium subsp. paratuberculosis
gcccagcgucucggcgg

SEQ ID NO: 2895224 - RNA, 18 nt, Mycobacterium avium subsp. paratuberculosis
gcccagcgucucggcggc

SEQ ID NO: 2895225 - RNA, 19 nt, Mycobacterium avium subsp. paratuberculosis
gcccagcgucucggcggcc

SEQ ID NO: 2895226 - RNA, 14 nt, Mycobacterium avium subsp. paratuberculosis
gcccagcgugguca

SEQ ID NO: 2895227 - RNA, 22 nt, Mycobacterium avium subsp. paratuberculosis
gcccagcguggucacccgcagc

SEQ ID NO: 2895228 - RNA, 15 nt, Mycobacterium avium subsp. paratuberculosis
gcccagcgugucggc

SEQ ID NO: 2895229 - RNA, 17 nt, Mycobacterium avium subsp. paratuberculosis
gcccagcgugucggcga

SEQ ID NO: 2895230 - RNA, 20 nt, Mycobacterium avium subsp. paratuberculosis
gcccagcgugucggcgaucg

SEQ ID NO: 2895231 - RNA, 20 nt, Mycobacterium avium subsp. paratuberculosis
gcccagcuccaaugcggccg

SEQ ID NO: 2895232 - RNA, 15 nt, Mycobacterium avium subsp. paratuberculosis
gcccagcuccacgcg

SEQ ID NO: 2895233 - RNA, 16 nt, Mycobacterium avium subsp. paratuberculosis
gcccagcuccacgcgu

SEQ ID NO: 2895234 - RNA, 21 nt, Mycobacterium avium subsp. paratuberculosis
gcccagcucggugaugaucgc

SEQ ID NO: 2895235 - RNA, 16 nt, Mycobacterium avium subsp. paratuberculosis
gcccagcucggugcgc

SEQ ID NO: 2895236 - RNA, 17 nt, Mycobacterium avium subsp. paratuberculosis
gcccagcucggugcgca

SEQ ID NO: 2895237 - RNA, 21 nt, Mycobacterium avium subsp. paratuberculosis
gcccagcucggugcgcauggc

SEQ ID NO: 2895238 - RNA, 18 nt, Mycobacterium avium subsp. paratuberculosis
gcccagcucguugccggc

SEQ ID NO: 2895239 - RNA, 19 nt, Mycobacterium avium subsp. paratuberculosis
gcccagcucguugccggcg

SEQ ID NO: 2895240 - RNA, 22 nt, Mycobacterium avium subsp. paratuberculosis
gcccagcucguugccggcggcc

SEQ ID NO: 2895241 - RNA, 16 nt, Mycobacterium avium subsp. paratuberculosis
gcccagcugcacccac

SEQ ID NO: 2895242 - RNA, 20 nt, Mycobacterium avium subsp. paratuberculosis
gcccagcugcacccaccggc

SEQ ID NO: 2895243 - RNA, 22 nt, Mycobacterium avium subsp. paratuberculosis
gcccagcugcacccaccggccc

SEQ ID NO: 2895244 - RNA, 21 nt, Mycobacterium avium subsp. paratuberculosis
gcccagcugcauggacagcga

SEQ ID NO: 2895245 - RNA, 13 nt, Mycobacterium avium subsp. paratuberculosis
gcccagcugggcc

SEQ ID NO: 2895246 - RNA, 18 nt, Mycobacterium avium subsp. paratuberculosis
gcccagcugggccagcgc

SEQ ID NO: 2895247 - RNA, 21 nt, Mycobacterium avium subsp. paratuberculosis
gcccagcugggccagcgcggu

SEQ ID NO: 2895248 - RNA, 16 nt, Mycobacterium avium subsp. paratuberculosis
gcccagcuuggcgccc

SEQ ID NO: 2895249 - RNA, 14 nt, Mycobacterium avium subsp. paratuberculosis
gcccaggaacgcgc

SEQ ID NO: 2895250 - RNA, 18 nt, Mycobacterium avium subsp. paratuberculosis
gcccaggaacgcgccggc

SEQ ID NO: 2895251 - RNA, 20 nt, Mycobacterium avium subsp. paratuberculosis
gcccaggaacgcgccggcgc

SEQ ID NO: 2895252 - RNA, 19 nt, Mycobacterium avium subsp. paratuberculosis
gcccaggaaguagccggcc

SEQ ID NO: 2895253 - RNA, 20 nt, Mycobacterium avium subsp. paratuberculosis
gcccaggaaguagccggcca

SEQ ID NO: 2895254 - RNA, 22 nt, Mycobacterium avium subsp. paratuberculosis
gcccaggaaguagccggccagc

SEQ ID NO: 2895255 - RNA, 23 nt, Mycobacterium avium subsp. paratuberculosis
gcccaggaaguagccggccagcg

SEQ ID NO: 2895256 - RNA, 13 nt, Mycobacterium avium subsp. paratuberculosis
gcccaggacccgu

SEQ ID NO: 2895257 - RNA, 20 nt, Mycobacterium avium subsp. paratuberculosis
gcccaggauucucagcagcg

SEQ ID NO: 2895258 - RNA, 21 nt, Mycobacterium avium subsp. paratuberculosis
gcccaggcagacccccagcag

SEQ ID NO: 2895259 - RNA, 22 nt, Mycobacterium avium subsp. paratuberculosis
gcccaggcagacccccagcagc

SEQ ID NO: 2895260 - RNA, 23 nt, Mycobacterium avium subsp. paratuberculosis
gcccaggcagacccccagcagcg

SEQ ID NO: 2895261 - RNA, 15 nt, Mycobacterium avium subsp. paratuberculosis
gcccaggcaguagcc

SEQ ID NO: 2895262 - RNA, 17 nt, Mycobacterium avium subsp. paratuberculosis
gcccaggccaacagcag

SEQ ID NO: 2895263 - RNA, 18 nt, Mycobacterium avium subsp. paratuberculosis
gcccaggccaacagcagc

SEQ ID NO: 2895264 - RNA, 17 nt, Mycobacterium avium subsp. paratuberculosis
gcccaggcccagcagca

SEQ ID NO: 2895265 - RNA, 18 nt, Mycobacterium avium subsp. paratuberculosis
gcccaggcccagcagcac

SEQ ID NO: 2895266 - RNA, 19 nt, Mycobacterium avium subsp. paratuberculosis
gcccaggcccagcagcacc

SEQ ID NO: 2895267 - RNA, 16 nt, Mycobacterium avium subsp. paratuberculosis
gcccaggccccggccg

SEQ ID NO: 2895268 - RNA, 20 nt, Mycobacterium avium subsp. paratuberculosis
gcccaggccccggccgagcg

SEQ ID NO: 2895269 - RNA, 14 nt, Mycobacterium avium subsp. paratuberculosis
gcccaggcccggca

SEQ ID NO: 2895270 - RNA, 19 nt, Mycobacterium avium subsp. paratuberculosis
gcccaggccgacgccggcc

SEQ ID NO: 2895271 - RNA, 14 nt, Mycobacterium avium subsp. paratuberculosis
gcccaggccgagcg

SEQ ID NO: 2895272 - RNA, 15 nt, Mycobacterium avium subsp. paratuberculosis
gcccaggccgagcgc

SEQ ID NO: 2895273 - RNA, 16 nt, Mycobacterium avium subsp. paratuberculosis
gcccaggccgagcgca

SEQ ID NO: 2895274 - RNA, 14 nt, Mycobacterium avium subsp. paratuberculosis
gcccaggccgaugg

SEQ ID NO: 2895275 - RNA, 16 nt, Mycobacterium avium subsp. paratuberculosis
gcccaggccgauggug

SEQ ID NO: 2895276 - RNA, 23 nt, Mycobacterium avium subsp. paratuberculosis
gcccaggccgauggugguaccga

SEQ ID NO: 2895277 - RNA, 13 nt, Mycobacterium avium subsp. paratuberculosis
gcccaggccgcca

SEQ ID NO: 2895278 - RNA, 15 nt, Mycobacterium avium subsp. paratuberculosis
gcccaggccgccagc

SEQ ID NO: 2895279 - RNA, 17 nt, Mycobacterium avium subsp. paratuberculosis
gcccaggccgccagcuc

SEQ ID NO: 2895280 - RNA, 18 nt, Mycobacterium avium subsp. paratuberculosis
gcccaggccgccagcucg

SEQ ID NO: 2895281 - RNA, 19 nt, Mycobacterium avium subsp. paratuberculosis
gcccaggccgccagcucgu

SEQ ID NO: 2895282 - RNA, 16 nt, Mycobacterium avium subsp. paratuberculosis
gcccaggccgcggucg

SEQ ID NO: 2895283 - RNA, 23 nt, Mycobacterium avium subsp. paratuberculosis
gcccaggccgcggucgccccggc

SEQ ID NO: 2895284 - RNA, 14 nt, Mycobacterium avium subsp. paratuberculosis
gcccaggccggcga

SEQ ID NO: 2895285 - RNA, 15 nt, Mycobacterium avium subsp. paratuberculosis
gcccaggccggcgag

SEQ ID NO: 2895286 - RNA, 16 nt, Mycobacterium avium subsp. paratuberculosis
gcccaggccggcgagc

SEQ ID NO: 2895287 - RNA, 22 nt, Mycobacterium avium subsp. paratuberculosis
gcccaggccggcgagcucgcgg

SEQ ID NO: 2895288 - RNA, 19 nt, Mycobacterium avium subsp. paratuberculosis
gcccaggcgggccagcucg

SEQ ID NO: 2895289 - RNA, 20 nt, Mycobacterium avium subsp. paratuberculosis
gcccaggcgggccagcucga

SEQ ID NO: 2895290 - RNA, 21 nt, Mycobacterium avium subsp. paratuberculosis
gcccaggcucaggaucagcag

SEQ ID NO: 2895291 - RNA, 22 nt, Mycobacterium avium subsp. paratuberculosis
gcccaggcucaggaucagcagc

SEQ ID NO: 2895292 - RNA, 12 nt, Mycobacterium avium subsp. paratuberculosis
gccccaccccgg

SEQ ID NO: 2895293 - RNA, 16 nt, Mycobacterium avium subsp. paratuberculosis
gccccaccccggacgg

SEQ ID NO: 2895294 - RNA, 15 nt, Mycobacterium avium subsp. paratuberculosis
gccccacccgcagug

SEQ ID NO: 2895295 - RNA, 13 nt, Mycobacterium avium subsp. paratuberculosis
gccccaccgccgc

SEQ ID NO: 2895296 - RNA, 14 nt, Mycobacterium avium subsp. paratuberculosis
gccccaccgccgcu

SEQ ID NO: 2895297 - RNA, 17 nt, Mycobacterium avium subsp. paratuberculosis
gccccaccgccgcugcg

SEQ ID NO: 2895298 - RNA, 15 nt, Mycobacterium avium subsp. paratuberculosis
gccccaccggccacu

SEQ ID NO: 2895299 - RNA, 20 nt, Mycobacterium avium subsp. paratuberculosis
gccccacgccaugugccggc

SEQ ID NO: 2895300 - RNA, 22 nt, Mycobacterium avium subsp. paratuberculosis
gccccacgccaugugccggcgc

SEQ ID NO: 2895301 - RNA, 14 nt, Mycobacterium avium subsp. paratuberculosis
gccccacgccuggc

SEQ ID NO: 2895302 - RNA, 15 nt, Mycobacterium avium subsp. paratuberculosis
gccccacgcgcucag

SEQ ID NO: 2895303 - RNA, 16 nt, Mycobacterium avium subsp. paratuberculosis
gccccacgcgcucagc

SEQ ID NO: 2895304 - RNA, 20 nt, Mycobacterium avium subsp. paratuberculosis
gccccacgcgcucagcgcgg

SEQ ID NO: 2895305 - RNA, 18 nt, Mycobacterium avium subsp. paratuberculosis
gccccacggcgcgugcug

SEQ ID NO: 2895306 - RNA, 22 nt, Mycobacterium avium subsp. paratuberculosis
gccccacggucuuugccggcca

SEQ ID NO: 2895307 - RNA, 18 nt, Mycobacterium avium subsp. paratuberculosis
gccccagaaccgcucggc

SEQ ID NO: 2895308 - RNA, 19 nt, Mycobacterium avium subsp. paratuberculosis
gccccagaaccgcucggcg

SEQ ID NO: 2895309 - RNA, 20 nt, Mycobacterium avium subsp. paratuberculosis
gccccagaaccgcucggcgg

SEQ ID NO: 2895310 - RNA, 21 nt, Mycobacterium avium subsp. paratuberculosis
gccccagaaccgcucggcggc

SEQ ID NO: 2895311 - RNA, 20 nt, Mycobacterium avium subsp. paratuberculosis
gccccagaacugguccucca

SEQ ID NO: 2895312 - RNA, 23 nt, Mycobacterium avium subsp. paratuberculosis
gccccagcacgaucccgccgccc

SEQ ID NO: 2895313 - RNA, 16 nt, Mycobacterium avium subsp. paratuberculosis
gccccagccacagccg

SEQ ID NO: 2895314 - RNA, 17 nt, Mycobacterium avium subsp. paratuberculosis
gccccagccacagccgc

SEQ ID NO: 2895315 - RNA, 18 nt, Mycobacterium avium subsp. paratuberculosis
gccccagccccucgccgg

SEQ ID NO: 2895316 - RNA, 13 nt, Mycobacterium avium subsp. paratuberculosis
gccccagcccggc

SEQ ID NO: 2895317 - RNA, 14 nt, Mycobacterium avium subsp. paratuberculosis
gccccagcccggcu

SEQ ID NO: 2895318 - RNA, 19 nt, Mycobacterium avium subsp. paratuberculosis
gccccagcccggcuggcag

SEQ ID NO: 2895319 - RNA, 17 nt, Mycobacterium avium subsp. paratuberculosis
gccccagcccgggggug

SEQ ID NO: 2895320 - RNA, 15 nt, Mycobacterium avium subsp. paratuberculosis
gccccagccgaccag

SEQ ID NO: 2895321 - RNA, 13 nt, Mycobacterium avium subsp. paratuberculosis
gccccagccgccg

SEQ ID NO: 2895322 - RNA, 14 nt, Mycobacterium avium subsp. paratuberculosis
gccccagccgccgc

SEQ ID NO: 2895323 - RNA, 12 nt, Mycobacterium avium subsp. paratuberculosis
gccccagcuccu

SEQ ID NO: 2895324 - RNA, 14 nt, Mycobacterium avium subsp. paratuberculosis
gccccagcuccucg

SEQ ID NO: 2895325 - RNA, 16 nt, Mycobacterium avium subsp. paratuberculosis
gccccagcugucgggu

SEQ ID NO: 2895326 - RNA, 19 nt, Mycobacterium avium subsp. paratuberculosis
gccccagcugucggguggc

SEQ ID NO: 2895327 - RNA, 22 nt, Mycobacterium avium subsp. paratuberculosis
gccccaggaggcacuggcgcug

SEQ ID NO: 2895328 - RNA, 12 nt, Mycobacterium avium subsp. paratuberculosis
gccccaggcgaa

SEQ ID NO: 2895329 - RNA, 14 nt, Mycobacterium avium subsp. paratuberculosis
gccccaggcgaaca

SEQ ID NO: 2895330 - RNA, 20 nt, Mycobacterium avium subsp. paratuberculosis
gccccaggcgcccugcacga

SEQ ID NO: 2895331 - RNA, 17 nt, Mycobacterium avium subsp. paratuberculosis
gccccaggcggaaugca

SEQ ID NO: 2895332 - RNA, 13 nt, Mycobacterium avium subsp. paratuberculosis
gccccagggacca

SEQ ID NO: 2895333 - RNA, 20 nt, Mycobacterium avium subsp. paratuberculosis
gccccagggaccaguggugg

SEQ ID NO: 2895334 - RNA, 17 nt, Mycobacterium avium subsp. paratuberculosis
gccccagggccucggcg

SEQ ID NO: 2895335 - RNA, 19 nt, Mycobacterium avium subsp. paratuberculosis
gccccagggccucggcgac

SEQ ID NO: 2895336 - RNA, 22 nt, Mycobacterium avium subsp. paratuberculosis
gccccagggccucggcgaccgc

SEQ ID NO: 2895337 - RNA, 19 nt, Mycobacterium avium subsp. paratuberculosis
gccccaggucggggugggc

SEQ ID NO: 2895338 - RNA, 20 nt, Mycobacterium avium subsp. paratuberculosis
gccccaggucggggugggcg

SEQ ID NO: 2895339 - RNA, 14 nt, Mycobacterium avium subsp. paratuberculosis
gccccagguuccgg

SEQ ID NO: 2895340 - RNA, 15 nt, Mycobacterium avium subsp. paratuberculosis
gccccagguuccggu

SEQ ID NO: 2895341 - RNA, 19 nt, Mycobacterium avium subsp. paratuberculosis
gccccagguuccggugucg

SEQ ID NO: 2895342 - RNA, 20 nt, Mycobacterium avium subsp. paratuberculosis
gccccagguuccggugucga

SEQ ID NO: 2895343 - RNA, 18 nt, Mycobacterium avium subsp. paratuberculosis
gccccagugcaggcaggc

SEQ ID NO: 2895344 - RNA, 19 nt, Mycobacterium avium subsp. paratuberculosis
gccccagugcaggcaggcc

SEQ ID NO: 2895345 - RNA, 19 nt, Mycobacterium avium subsp. paratuberculosis
gccccaguucgaucagcag

SEQ ID NO: 2895346 - RNA, 20 nt, Mycobacterium avium subsp. paratuberculosis
gccccaguuggcgucgucgg

SEQ ID NO: 2895347 - RNA, 23 nt, Mycobacterium avium subsp. paratuberculosis
gccccaguuggcgucgucggcgg

SEQ ID NO: 2895348 - RNA, 14 nt, Mycobacterium avium subsp. paratuberculosis
gccccauugccgcg

SEQ ID NO: 2895349 - RNA, 15 nt, Mycobacterium avium subsp. paratuberculosis
gccccauugccgcgc

SEQ ID NO: 2895350 - RNA, 17 nt, Mycobacterium avium subsp. paratuberculosis
gccccauugccgcgccg

SEQ ID NO: 2895351 - RNA, 15 nt, Mycobacterium avium subsp. paratuberculosis
gcccccaaugucacg

SEQ ID NO: 2895352 - RNA, 18 nt, Mycobacterium avium subsp. paratuberculosis
gcccccaccugaucgcgg

SEQ ID NO: 2895353 - RNA, 15 nt, Mycobacterium avium subsp. paratuberculosis
gcccccacgcucggc

SEQ ID NO: 2895354 - RNA, 23 nt, Mycobacterium avium subsp. paratuberculosis
gcccccagcggggcaagcagcgg

SEQ ID NO: 2895355 - RNA, 17 nt, Mycobacterium avium subsp. paratuberculosis
gccccccgcacaccggc

SEQ ID NO: 2895356 - RNA, 16 nt, Mycobacterium avium subsp. paratuberculosis
gccccccgggcaccag

SEQ ID NO: 2895357 - RNA, 21 nt, Mycobacterium avium subsp. paratuberculosis
gccccccgggcaccagcgcga

SEQ ID NO: 2895358 - RNA, 19 nt, Mycobacterium avium subsp. paratuberculosis
gcccccgacaggcccaccc

SEQ ID NO: 2895359 - RNA, 22 nt, Mycobacterium avium subsp. paratuberculosis
gcccccgaggagacgucggccg

SEQ ID NO: 2895360 - RNA, 17 nt, Mycobacterium avium subsp. paratuberculosis
gcccccgauagccccgc

SEQ ID NO: 2895361 - RNA, 23 nt, Mycobacterium avium subsp. paratuberculosis
gcccccgauagccccgccaggcg

SEQ ID NO: 2895362 - RNA, 17 nt, Mycobacterium avium subsp. paratuberculosis
gcccccgaugaacuugc

SEQ ID NO: 2895363 - RNA, 14 nt, Mycobacterium avium subsp. paratuberculosis
gcccccgcagcccg

SEQ ID NO: 2895364 - RNA, 12 nt, Mycobacterium avium subsp. paratuberculosis
gcccccgcccca

SEQ ID NO: 2895365 - RNA, 15 nt, Mycobacterium avium subsp. paratuberculosis
gcccccgccccagcc

SEQ ID NO: 2895366 - RNA, 13 nt, Mycobacterium avium subsp. paratuberculosis
gcccccgcccggc

SEQ ID NO: 2895367 - RNA, 17 nt, Mycobacterium avium subsp. paratuberculosis
gcccccgcccggccggu

SEQ ID NO: 2895368 - RNA, 23 nt, Mycobacterium avium subsp. paratuberculosis
gcccccgcccggccggucgccga

SEQ ID NO: 2895369 - RNA, 12 nt, Mycobacterium avium subsp. paratuberculosis
gcccccgccgcg

SEQ ID NO: 2895370 - RNA, 15 nt, Mycobacterium avium subsp. paratuberculosis
gcccccgccucgccg

SEQ ID NO: 2895371 - RNA, 16 nt, Mycobacterium avium subsp. paratuberculosis
gcccccgccucgccgg

SEQ ID NO: 2895372 - RNA, 14 nt, Mycobacterium avium subsp. paratuberculosis
gcccccgcgacguc

SEQ ID NO: 2895373 - RNA, 15 nt, Mycobacterium avium subsp. paratuberculosis
gcccccgcggcggcc

SEQ ID NO: 2895374 - RNA, 14 nt, Mycobacterium avium subsp. paratuberculosis
gcccccgcggcguc

SEQ ID NO: 2895375 - RNA, 18 nt, Mycobacterium avium subsp. paratuberculosis
gcccccgcgggucgucga

SEQ ID NO: 2895376 - RNA, 20 nt, Mycobacterium avium subsp. paratuberculosis
gcccccgcgggucgucgacg

SEQ ID NO: 2895377 - RNA, 20 nt, Mycobacterium avium subsp. paratuberculosis
gccccggaguagaccuuguc

SEQ ID NO: 2895378 - RNA, 19 nt, Mycobacterium avium subsp. paratuberculosis
gccccggauccgucgcccc

SEQ ID NO: 2895379 - RNA, 22 nt, Mycobacterium avium subsp. paratuberculosis
gccccggaugaccagggugguc

SEQ ID NO: 2895380 - RNA, 19 nt, Mycobacterium avium subsp. paratuberculosis
gccccggcccguccagauc

SEQ ID NO: 2895381 - RNA, 15 nt, Mycobacterium avium subsp. paratuberculosis
gccccggccgagcgc

SEQ ID NO: 2895382 - RNA, 18 nt, Mycobacterium avium subsp. paratuberculosis
gccccggccgagcgcagc

SEQ ID NO: 2895383 - RNA, 19 nt, Mycobacterium avium subsp. paratuberculosis
gccccggccgagcgcagcg

SEQ ID NO: 2895384 - RNA, 14 nt, Mycobacterium avium subsp. paratuberculosis
gccccggccgcgca

SEQ ID NO: 2895385 - RNA, 12 nt, Mycobacterium avium subsp. paratuberculosis
gccccggccggc

SEQ ID NO: 2895386 - RNA, 13 nt, Mycobacterium avium subsp. paratuberculosis
gccccggccggcg

SEQ ID NO: 2895387 - RNA, 16 nt, Mycobacterium avium subsp. paratuberculosis
gccccggccggcgggu

SEQ ID NO: 2895388 - RNA, 19 nt, Mycobacterium avium subsp. paratuberculosis
gccccggccgggcgacugc

SEQ ID NO: 2895389 - RNA, 21 nt, Mycobacterium avium subsp. paratuberculosis
gccccggccgggcgacugcgu

SEQ ID NO: 2895390 - RNA, 23 nt, Mycobacterium avium subsp. paratuberculosis
gccccggccguucuugcggguga

SEQ ID NO: 2895391 - RNA, 20 nt, Mycobacterium avium subsp. paratuberculosis
gccccggccugauacgucuu

SEQ ID NO: 2895392 - RNA, 15 nt, Mycobacterium avium subsp. paratuberculosis
gccccggcgaacgcc

SEQ ID NO: 2895393 - RNA, 14 nt, Mycobacterium avium subsp. paratuberculosis
gccccggcgacggc

SEQ ID NO: 2895394 - RNA, 15 nt, Mycobacterium avium subsp. paratuberculosis
gccccggcgacggcg

SEQ ID NO: 2895395 - RNA, 19 nt, Mycobacterium avium subsp. paratuberculosis
gccccggcgacggcggccg

SEQ ID NO: 2895396 - RNA, 15 nt, Mycobacterium avium subsp. paratuberculosis
gccccggcgacgucg

SEQ ID NO: 2895397 - RNA, 16 nt, Mycobacterium avium subsp. paratuberculosis
gccccggcgacgucgc

SEQ ID NO: 2895398 - RNA, 18 nt, Mycobacterium avium subsp. paratuberculosis
gccccggcgacgucgccg

SEQ ID NO: 2895399 - RNA, 13 nt, Mycobacterium avium subsp. paratuberculosis
gccccggcgcagc

SEQ ID NO: 2895400 - RNA, 21 nt, Mycobacterium avium subsp. paratuberculosis
gccccggcgcagcgccgcgcc

SEQ ID NO: 2895401 - RNA, 13 nt, Mycobacterium avium subsp. paratuberculosis
gccccggcgccgu

SEQ ID NO: 2895402 - RNA, 17 nt, Mycobacterium avium subsp. paratuberculosis
gccccggcgccgucguu

SEQ ID NO: 2895403 - RNA, 12 nt, Mycobacterium avium subsp. paratuberculosis
gccccggcgcgc

SEQ ID NO: 2895404 - RNA, 14 nt, Mycobacterium avium subsp. paratuberculosis
gccccggcggccac

SEQ ID NO: 2895405 - RNA, 15 nt, Mycobacterium avium subsp. paratuberculosis
gccccggcggccacg

SEQ ID NO: 2895406 - RNA, 14 nt, Mycobacterium avium subsp. paratuberculosis
gccccggcgggcgg

SEQ ID NO: 2895407 - RNA, 17 nt, Mycobacterium avium subsp. paratuberculosis
gccccggcgggcggccg

SEQ ID NO: 2895408 - RNA, 16 nt, Mycobacterium avium subsp. paratuberculosis
gccccggcgucgauga

SEQ ID NO: 2895409 - RNA, 20 nt, Mycobacterium avium subsp. paratuberculosis
gccccggcgucgaugaccuc

SEQ ID NO: 2895410 - RNA, 18 nt, Mycobacterium avium subsp. paratuberculosis
gccccgggaaaugcugca

SEQ ID NO: 2895411 - RNA, 22 nt, Mycobacterium avium subsp. paratuberculosis
gccccgggaaccagcccagguc

SEQ ID NO: 2895412 - RNA, 22 nt, Mycobacterium avium subsp. paratuberculosis
gccccgggauccgaggcgucag

SEQ ID NO: 2895413 - RNA, 16 nt, Mycobacterium avium subsp. paratuberculosis
gccccgggcgcuggcg

SEQ ID NO: 2895414 - RNA, 21 nt, Mycobacterium avium subsp. paratuberculosis
gccccgggcgcuggcgauggu

SEQ ID NO: 2895415 - RNA, 19 nt, Mycobacterium avium subsp. paratuberculosis
gccccgggggaccagcgca

SEQ ID NO: 2895416 - RNA, 22 nt, Mycobacterium avium subsp. paratuberculosis
gccccgggggaccagcgcaacc

SEQ ID NO: 2895417 - RNA, 16 nt, Mycobacterium avium subsp. paratuberculosis
gccccgguagccagca

SEQ ID NO: 2895418 - RNA, 20 nt, Mycobacterium avium subsp. paratuberculosis
gccccgguagccagcaccgc

SEQ ID NO: 2895419 - RNA, 23 nt, Mycobacterium avium subsp. paratuberculosis
gccccgguagccagcaccgcccc

SEQ ID NO: 2895420 - RNA, 15 nt, Mycobacterium avium subsp. paratuberculosis
gccccggucaccccg

SEQ ID NO: 2895421 - RNA, 15 nt, Mycobacterium avium subsp. paratuberculosis
gccccggucccgccg

SEQ ID NO: 2895422 - RNA, 16 nt, Mycobacterium avium subsp. paratuberculosis
gccccggucccgccgg

SEQ ID NO: 2895423 - RNA, 17 nt, Mycobacterium avium subsp. paratuberculosis
gccccggucccgccggu

SEQ ID NO: 2895424 - RNA, 20 nt, Mycobacterium avium subsp. paratuberculosis
gccccggucccggggcucga

SEQ ID NO: 2895425 - RNA, 14 nt, Mycobacterium avium subsp. paratuberculosis
gccccgguccggcu

SEQ ID NO: 2895426 - RNA, 23 nt, Mycobacterium avium subsp. paratuberculosis
gccccgguccggcugaacgccag

SEQ ID NO: 2895427 - RNA, 20 nt, Mycobacterium avium subsp. paratuberculosis
gccccgguuccaaccaccgu

SEQ ID NO: 2895428 - RNA, 22 nt, Mycobacterium avium subsp. paratuberculosis
gccccgguuccaaccaccgugg

SEQ ID NO: 2895429 - RNA, 23 nt, Mycobacterium avium subsp. paratuberculosis
gccccgguuuucgccucggucug

SEQ ID NO: 2895430 - RNA, 16 nt, Mycobacterium avium subsp. paratuberculosis
gccccguacggguugc

SEQ ID NO: 2895431 - RNA, 18 nt, Mycobacterium avium subsp. paratuberculosis
gccccguacggguugccg

SEQ ID NO: 2895432 - RNA, 22 nt, Mycobacterium avium subsp. paratuberculosis
gccccguacggguugccgucga

SEQ ID NO: 2895433 - RNA, 20 nt, Mycobacterium avium subsp. paratuberculosis
gccccguauugccgucggcg

SEQ ID NO: 2895434 - RNA, 21 nt, Mycobacterium avium subsp. paratuberculosis
gccccguauugccgucggcgu

SEQ ID NO: 2895435 - RNA, 15 nt, Mycobacterium avium subsp. paratuberculosis
gccccguccggcgcc

SEQ ID NO: 2895436 - RNA, 16 nt, Mycobacterium avium subsp. paratuberculosis
gccccguccggcgcca

SEQ ID NO: 2895437 - RNA, 20 nt, Mycobacterium avium subsp. paratuberculosis
gccccguccggcgccagccc

SEQ ID NO: 2895438 - RNA, 15 nt, Mycobacterium avium subsp. paratuberculosis
gccccgucggucccg

SEQ ID NO: 2895439 - RNA, 16 nt, Mycobacterium avium subsp. paratuberculosis
gccccgucggucccga

SEQ ID NO: 2895440 - RNA, 19 nt, Mycobacterium avium subsp. paratuberculosis
gccccgucggucccgacgc

SEQ ID NO: 2895441 - RNA, 23 nt, Mycobacterium avium subsp. paratuberculosis
gccccgucggucccgacgcggcg

SEQ ID NO: 2895442 - RNA, 20 nt, Mycobacterium avium subsp. paratuberculosis
gccccguggaucaucccgac

SEQ ID NO: 2895443 - RNA, 13 nt, Mycobacterium avium subsp. paratuberculosis
gccccguguggug

SEQ ID NO: 2895444 - RNA, 15 nt, Mycobacterium avium subsp. paratuberculosis
gccccgugugguguc

SEQ ID NO: 2895445 - RNA, 12 nt, Mycobacterium avium subsp. paratuberculosis
gccccguucggu

SEQ ID NO: 2895446 - RNA, 23 nt, Mycobacterium avium subsp. paratuberculosis
gccccguuggugcggugcaucgu

SEQ ID NO: 2895447 - RNA, 16 nt, Mycobacterium avium subsp. paratuberculosis
gccccuaccgccgagc

SEQ ID NO: 2895448 - RNA, 17 nt, Mycobacterium avium subsp. paratuberculosis
gccccuaccgccgagcg

SEQ ID NO: 2895449 - RNA, 12 nt, Mycobacterium avium subsp. paratuberculosis
gccccuccagcc

SEQ ID NO: 2895450 - RNA, 14 nt, Mycobacterium avium subsp. paratuberculosis
gccccuccagccgc

SEQ ID NO: 2895451 - RNA, 17 nt, Mycobacterium avium subsp. paratuberculosis
gccccuccagccgccgg

SEQ ID NO: 2895452 - RNA, 20 nt, Mycobacterium avium subsp. paratuberculosis
gccccuccagccgccggucc

SEQ ID NO: 2895453 - RNA, 13 nt, Mycobacterium avium subsp. paratuberculosis
gccccuccagcug

SEQ ID NO: 2895454 - RNA, 14 nt, Mycobacterium avium subsp. paratuberculosis
gccccuccaggcau

SEQ ID NO: 2895455 - RNA, 15 nt, Mycobacterium avium subsp. paratuberculosis
gccccucccaccacg

SEQ ID NO: 2895456 - RNA, 16 nt, Mycobacterium avium subsp. paratuberculosis
gccccucccaccacgg

SEQ ID NO: 2895457 - RNA, 19 nt, Mycobacterium avium subsp. paratuberculosis
gccccucccaccacggccg

SEQ ID NO: 2895458 - RNA, 20 nt, Mycobacterium avium subsp. paratuberculosis
gccccucccaccacggccga

SEQ ID NO: 2895459 - RNA, 13 nt, Mycobacterium avium subsp. paratuberculosis
gccccuccucggu

SEQ ID NO: 2895460 - RNA, 16 nt, Mycobacterium avium subsp. paratuberculosis
gccccucgaccaccuc

SEQ ID NO: 2895461 - RNA, 14 nt, Mycobacterium avium subsp. paratuberculosis
gccccucgacccga

SEQ ID NO: 2895462 - RNA, 14 nt, Mycobacterium avium subsp. paratuberculosis
gcccgacggcagca

SEQ ID NO: 2895463 - RNA, 15 nt, Mycobacterium avium subsp. paratuberculosis
gcccgacggcagcac

SEQ ID NO: 2895464 - RNA, 18 nt, Mycobacterium avium subsp. paratuberculosis
gcccgacggcagcaccgc

SEQ ID NO: 2895465 - RNA, 20 nt, Mycobacterium avium subsp. paratuberculosis
gcccgacggcagcaccgccg

SEQ ID NO: 2895466 - RNA, 14 nt, Mycobacterium avium subsp. paratuberculosis
gcccgacggcgcgc

SEQ ID NO: 2895467 - RNA, 15 nt, Mycobacterium avium subsp. paratuberculosis
gcccgacggcgcgcc

SEQ ID NO: 2895468 - RNA, 13 nt, Mycobacterium avium subsp. paratuberculosis
gcccgacggcguc

SEQ ID NO: 2895469 - RNA, 14 nt, Mycobacterium avium subsp. paratuberculosis
gcccgacgggcgug

SEQ ID NO: 2895470 - RNA, 18 nt, Mycobacterium avium subsp. paratuberculosis
gcccgacggguucgcgca

SEQ ID NO: 2895471 - RNA, 21 nt, Mycobacterium avium subsp. paratuberculosis
gcccgacggguucgcgcagcc

SEQ ID NO: 2895472 - RNA, 14 nt, Mycobacterium avium subsp. paratuberculosis
gcccgacggucgcc

SEQ ID NO: 2895473 - RNA, 20 nt, Mycobacterium avium subsp. paratuberculosis
gcccgacggucgccaccacc

SEQ ID NO: 2895474 - RNA, 15 nt, Mycobacterium avium subsp. paratuberculosis
gcccgacuccucaca

SEQ ID NO: 2895475 - RNA, 20 nt, Mycobacterium avium subsp. paratuberculosis
gcccgacuccucacaccucg

SEQ ID NO: 2895476 - RNA, 22 nt, Mycobacterium avium subsp. paratuberculosis
gcccgacuccucacaccucgcu

SEQ ID NO: 2895477 - RNA, 20 nt, Mycobacterium avium subsp. paratuberculosis
gcccgagaguccgccgccgg

SEQ ID NO: 2895478 - RNA, 21 nt, Mycobacterium avium subsp. paratuberculosis
gcccgagcaacugggugagca

SEQ ID NO: 2895479 - RNA, 14 nt, Mycobacterium avium subsp. paratuberculosis
gcccgagcaccacc

SEQ ID NO: 2895480 - RNA, 21 nt, Mycobacterium avium subsp. paratuberculosis
gcccgagcaccagcggacccu

SEQ ID NO: 2895481 - RNA, 19 nt, Mycobacterium avium subsp. paratuberculosis
gcccgagcauuucgcgcac

SEQ ID NO: 2895482 - RNA, 22 nt, Mycobacterium avium subsp. paratuberculosis
gcccgagcauuucgcgcacguc

SEQ ID NO: 2895483 - RNA, 20 nt, Mycobacterium avium subsp. paratuberculosis
gcccgagcccgacggcagca

SEQ ID NO: 2895484 - RNA, 22 nt, Mycobacterium avium subsp. paratuberculosis
gcccgagcccgacggcagcacc

SEQ ID NO: 2895485 - RNA, 16 nt, Mycobacterium avium subsp. paratuberculosis
gcccgagcccugcgcc

SEQ ID NO: 2895486 - RNA, 17 nt, Mycobacterium avium subsp. paratuberculosis
gcccgagcccugcgcca

SEQ ID NO: 2895487 - RNA, 18 nt, Mycobacterium avium subsp. paratuberculosis
gcccgagcccugcgccag

SEQ ID NO: 2895488 - RNA, 22 nt, Mycobacterium avium subsp. paratuberculosis
gcccgagcccugcgccagcagc

SEQ ID NO: 2895489 - RNA, 23 nt, Mycobacterium avium subsp. paratuberculosis
gcccgagcccugcgccagcagca

SEQ ID NO: 2895490 - RNA, 14 nt, Mycobacterium avium subsp. paratuberculosis
gcccgagcggcauc

SEQ ID NO: 2895491 - RNA, 14 nt, Mycobacterium avium subsp. paratuberculosis
gcccgagcggcgac

SEQ ID NO: 2895492 - RNA, 13 nt, Mycobacterium avium subsp. paratuberculosis
gcccgagcgucac

SEQ ID NO: 2895493 - RNA, 14 nt, Mycobacterium avium subsp. paratuberculosis
gcccgagcgucacg

SEQ ID NO: 2895494 - RNA, 17 nt, Mycobacterium avium subsp. paratuberculosis
gcccgagcgucacgcca

SEQ ID NO: 2895495 - RNA, 22 nt, Mycobacterium avium subsp. paratuberculosis
gcccgagcgucacgccagcgug

SEQ ID NO: 2895496 - RNA, 23 nt, Mycobacterium avium subsp. paratuberculosis
gcccgagcgucauuccgccgcgc

SEQ ID NO: 2895497 - RNA, 16 nt, Mycobacterium avium subsp. paratuberculosis
gcccgagcugaucgcg

SEQ ID NO: 2895498 - RNA, 17 nt, Mycobacterium avium subsp. paratuberculosis
gcccgagcugaucgcgg

SEQ ID NO: 2895499 - RNA, 18 nt, Mycobacterium avium subsp. paratuberculosis
gcccgagguccucgcgca

SEQ ID NO: 2895500 - RNA, 12 nt, Mycobacterium avium subsp. paratuberculosis
gcccgagucacc

SEQ ID NO: 2895501 - RNA, 16 nt, Mycobacterium avium subsp. paratuberculosis
gcccgagucacccggc

SEQ ID NO: 2895502 - RNA, 17 nt, Mycobacterium avium subsp. paratuberculosis
gcccgagucacccggcu

SEQ ID NO: 2895503 - RNA, 21 nt, Mycobacterium avium subsp. paratuberculosis
gcccgauagcuugagccccgc

SEQ ID NO: 2895504 - RNA, 15 nt, Mycobacterium avium subsp. paratuberculosis
gcccgauaggccgac

SEQ ID NO: 2895505 - RNA, 18 nt, Mycobacterium avium subsp. paratuberculosis
gcccgauaggccgacugg

SEQ ID NO: 2895506 - RNA, 15 nt, Mycobacterium avium subsp. paratuberculosis
gcccgaucaccaggc

SEQ ID NO: 2895507 - RNA, 17 nt, Mycobacterium avium subsp. paratuberculosis
gcccgaucaccaggccc

SEQ ID NO: 2895508 - RNA, 18 nt, Mycobacterium avium subsp. paratuberculosis
gcccgaucaccaggccca

SEQ ID NO: 2895509 - RNA, 19 nt, Mycobacterium avium subsp. paratuberculosis
gcccgaucaccaggcccag

SEQ ID NO: 2895510 - RNA, 15 nt, Mycobacterium avium subsp. paratuberculosis
gcccgaucacccccg

SEQ ID NO: 2895511 - RNA, 16 nt, Mycobacterium avium subsp. paratuberculosis
gcccgaucacccccga

SEQ ID NO: 2895512 - RNA, 15 nt, Mycobacterium avium subsp. paratuberculosis
gcccgaucaccgccg

SEQ ID NO: 2895513 - RNA, 13 nt, Mycobacterium avium subsp. paratuberculosis
gcccgaucagccg

SEQ ID NO: 2895514 - RNA, 15 nt, Mycobacterium avium subsp. paratuberculosis
gcccgaucagccggg

SEQ ID NO: 2895515 - RNA, 13 nt, Mycobacterium avium subsp. paratuberculosis
gcccgaucaucuc

SEQ ID NO: 2895516 - RNA, 18 nt, Mycobacterium avium subsp. paratuberculosis
gcccgaucaucucaccga

SEQ ID NO: 2895517 - RNA, 14 nt, Mycobacterium avium subsp. paratuberculosis
gcccgaucccgggc

SEQ ID NO: 2895518 - RNA, 16 nt, Mycobacterium avium subsp. paratuberculosis
gcccgaucccgucguc

SEQ ID NO: 2895519 - RNA, 19 nt, Mycobacterium avium subsp. paratuberculosis
gcccgaucccgucgucggc

SEQ ID NO: 2895520 - RNA, 20 nt, Mycobacterium avium subsp. paratuberculosis
gcccgaucgccagcgcccga

SEQ ID NO: 2895521 - RNA, 12 nt, Mycobacterium avium subsp. paratuberculosis
gcccgaucgcgg

SEQ ID NO: 2895522 - RNA, 13 nt, Mycobacterium avium subsp. paratuberculosis
gcccgaucgcggc

SEQ ID NO: 2895523 - RNA, 17 nt, Mycobacterium avium subsp. paratuberculosis
gcccgaucgcggcgagc

SEQ ID NO: 2895524 - RNA, 18 nt, Mycobacterium avium subsp. paratuberculosis
gcccgaucgcgucgacga

SEQ ID NO: 2895525 - RNA, 19 nt, Mycobacterium avium subsp. paratuberculosis
gcccgaucgcgucgacgau

SEQ ID NO: 2895526 - RNA, 23 nt, Mycobacterium avium subsp. paratuberculosis
gcccgaucggcacccgcaacacc

SEQ ID NO: 2895527 - RNA, 19 nt, Mycobacterium avium subsp. paratuberculosis
gcccgaucgugcgcccauc

SEQ ID NO: 2895528 - RNA, 16 nt, Mycobacterium avium subsp. paratuberculosis
gcccgaucucgcgcgg

SEQ ID NO: 2895529 - RNA, 21 nt, Mycobacterium avium subsp. paratuberculosis
gcccgaucucgcgcgggucga

SEQ ID NO: 2895530 - RNA, 24 nt, Mycobacterium avium subsp. paratuberculosis
gcccgaucucgcgcgggucgagca

SEQ ID NO: 2895531 - RNA, 16 nt, Mycobacterium avium subsp. paratuberculosis
gcccgaucucgcgguc

SEQ ID NO: 2895532 - RNA, 16 nt, Mycobacterium avium subsp. paratuberculosis
gcccgaucucgucggu

SEQ ID NO: 2895533 - RNA, 18 nt, Mycobacterium avium subsp. paratuberculosis
gcccgaucucgucgguga

SEQ ID NO: 2895534 - RNA, 23 nt, Mycobacterium avium subsp. paratuberculosis
gcccgaucugauaggucagcucg

SEQ ID NO: 2895535 - RNA, 19 nt, Mycobacterium avium subsp. paratuberculosis
gcccgaugaaguacccggu

SEQ ID NO: 2895536 - RNA, 15 nt, Mycobacterium avium subsp. paratuberculosis
gcccgaugccgccga

SEQ ID NO: 2895537 - RNA, 19 nt, Mycobacterium avium subsp. paratuberculosis
gcccgaugccgccgagggc

SEQ ID NO: 2895538 - RNA, 21 nt, Mycobacterium avium subsp. paratuberculosis
gcccgaugcuggccaucgccg

SEQ ID NO: 2895539 - RNA, 16 nt, Mycobacterium avium subsp. paratuberculosis
gcccgauggaggugcc

SEQ ID NO: 2895540 - RNA, 15 nt, Mycobacterium avium subsp. paratuberculosis
gcccgauggcggccu

SEQ ID NO: 2895541 - RNA, 16 nt, Mycobacterium avium subsp. paratuberculosis
gcccgauggcggccug

SEQ ID NO: 2895542 - RNA, 20 nt, Mycobacterium avium subsp. paratuberculosis
gcccgauggugaagccgugc

SEQ ID NO: 2895543 - RNA, 21 nt, Mycobacterium avium subsp. paratuberculosis
gcccgauggugaagccgugca

SEQ ID NO: 2895544 - RNA, 15 nt, Mycobacterium avium subsp. paratuberculosis
gcccgauuccccggc

SEQ ID NO: 2895545 - RNA, 18 nt, Mycobacterium avium subsp. paratuberculosis
gcccgauuccccggcgug

SEQ ID NO: 2895546 - RNA, 20 nt, Mycobacterium avium subsp. paratuberculosis
gcccgauucgcuuacugcga

SEQ ID NO: 2895547 - RNA, 18 nt, Mycobacterium avium subsp. paratuberculosis
gcccgcccggacaccccg

SEQ ID NO: 2895548 - RNA, 11 nt, Mycobacterium avium subsp. paratuberculosis
gcccgcccggc

SEQ ID NO: 2895549 - RNA, 14 nt, Mycobacterium avium subsp. paratuberculosis
gcccgcccggcacg

SEQ ID NO: 2895550 - RNA, 14 nt, Mycobacterium avium subsp. paratuberculosis
gcccgcccggcccg

SEQ ID NO: 2895551 - RNA, 15 nt, Mycobacterium avium subsp. paratuberculosis
gcccgcccggcccgg

SEQ ID NO: 2895552 - RNA, 23 nt, Mycobacterium avium subsp. paratuberculosis
gcccgcccggcccggcgcggccg

SEQ ID NO: 2895553 - RNA, 17 nt, Mycobacterium avium subsp. paratuberculosis
gcccgcccggcggcgcu

SEQ ID NO: 2895554 - RNA, 15 nt, Mycobacterium avium subsp. paratuberculosis
gcccgcccgggcacg

SEQ ID NO: 2895555 - RNA, 14 nt, Mycobacterium avium subsp. paratuberculosis
gcccgcccuggcug

SEQ ID NO: 2895556 - RNA, 16 nt, Mycobacterium avium subsp. paratuberculosis
gcccgcccuuggccgc

SEQ ID NO: 2895557 - RNA, 20 nt, Mycobacterium avium subsp. paratuberculosis
gcccgccgaacaccggcagc

SEQ ID NO: 2895558 - RNA, 17 nt, Mycobacterium avium subsp. paratuberculosis
gcccgccgaaccagauc

SEQ ID NO: 2895559 - RNA, 21 nt, Mycobacterium avium subsp. paratuberculosis
gcccgccgaaccagaucggcg

SEQ ID NO: 2895560 - RNA, 13 nt, Mycobacterium avium subsp. paratuberculosis
gcccgccgaccag

SEQ ID NO: 2895561 - RNA, 14 nt, Mycobacterium avium subsp. paratuberculosis
gcccgccgacgccc

SEQ ID NO: 2895562 - RNA, 15 nt, Mycobacterium avium subsp. paratuberculosis
gcccgccgacgccca

SEQ ID NO: 2895563 - RNA, 17 nt, Mycobacterium avium subsp. paratuberculosis
gcccgccgacggcugcc

SEQ ID NO: 2895564 - RNA, 18 nt, Mycobacterium avium subsp. paratuberculosis
gcccgccgacggcugccc

SEQ ID NO: 2895565 - RNA, 20 nt, Mycobacterium avium subsp. paratuberculosis
gcccgccgaucgaucagccg

SEQ ID NO: 2895566 - RNA, 18 nt, Mycobacterium avium subsp. paratuberculosis
gcccgccgauggacacgc

SEQ ID NO: 2895567 - RNA, 20 nt, Mycobacterium avium subsp. paratuberculosis
gcccgccgauggacacgcug

SEQ ID NO: 2895568 - RNA, 23 nt, Mycobacterium avium subsp. paratuberculosis
gcccgccgauggacacgcugccg

SEQ ID NO: 2895569 - RNA, 17 nt, Mycobacterium avium subsp. paratuberculosis
gcccgccgcaacgcgua

SEQ ID NO: 2895570 - RNA, 14 nt, Mycobacterium avium subsp. paratuberculosis
gcccgccgccacca

SEQ ID NO: 2895571 - RNA, 17 nt, Mycobacterium avium subsp. paratuberculosis
gcccgccgccaccacgg

SEQ ID NO: 2895572 - RNA, 15 nt, Mycobacterium avium subsp. paratuberculosis
gcccgccgccgaugc

SEQ ID NO: 2895573 - RNA, 12 nt, Mycobacterium avium subsp. paratuberculosis
gcccgccgccgg

SEQ ID NO: 2895574 - RNA, 15 nt, Mycobacterium avium subsp. paratuberculosis
gcccgccgccggcgc

SEQ ID NO: 2895575 - RNA, 11 nt, Mycobacterium avium subsp. paratuberculosis
gcccgccgcga

SEQ ID NO: 2895576 - RNA, 21 nt, Mycobacterium avium subsp. paratuberculosis
gcccgccgcgaccgcgaucag

SEQ ID NO: 2895577 - RNA, 13 nt, Mycobacterium avium subsp. paratuberculosis
gcccgccgcgacg

SEQ ID NO: 2895578 - RNA, 14 nt, Mycobacterium avium subsp. paratuberculosis
gcccgccgcgacgg

SEQ ID NO: 2895579 - RNA, 16 nt, Mycobacterium avium subsp. paratuberculosis
gcccgccgcgacgggu

SEQ ID NO: 2895580 - RNA, 12 nt, Mycobacterium avium subsp. paratuberculosis
gcccgccgcgag

SEQ ID NO: 2895581 - RNA, 13 nt, Mycobacterium avium subsp. paratuberculosis
gcccgccgcgagc

SEQ ID NO: 2895582 - RNA, 15 nt, Mycobacterium avium subsp. paratuberculosis
gcccgccgcgagccg

SEQ ID NO: 2895583 - RNA, 16 nt, Mycobacterium avium subsp. paratuberculosis
gcccgccgcgagccgc

SEQ ID NO: 2895584 - RNA, 17 nt, Mycobacterium avium subsp. paratuberculosis
gcccgccgcgcccggcu

SEQ ID NO: 2895585 - RNA, 16 nt, Mycobacterium avium subsp. paratuberculosis
gcccgccgcggccgcu

SEQ ID NO: 2895586 - RNA, 13 nt, Mycobacterium avium subsp. paratuberculosis
gcccgccgcggcg

SEQ ID NO: 2895587 - RNA, 14 nt, Mycobacterium avium subsp. paratuberculosis
gcccgccgcggcga

SEQ ID NO: 2895588 - RNA, 23 nt, Mycobacterium avium subsp. paratuberculosis
gcccgccgcggcgaccggggcgg

SEQ ID NO: 2895589 - RNA, 16 nt, Mycobacterium avium subsp. paratuberculosis
gcccgccgcggcgagc

SEQ ID NO: 2895590 - RNA, 18 nt, Mycobacterium avium subsp. paratuberculosis
gcccgccgcggcgagccg

SEQ ID NO: 2895591 - RNA, 21 nt, Mycobacterium avium subsp. paratuberculosis
gcccgccgcggcgagccggcc

SEQ ID NO: 2895592 - RNA, 14 nt, Mycobacterium avium subsp. paratuberculosis
gcccgccgcggcuc

SEQ ID NO: 2895593 - RNA, 22 nt, Mycobacterium avium subsp. paratuberculosis
gcccgccgcggcuccagcagcg

SEQ ID NO: 2895594 - RNA, 12 nt, Mycobacterium avium subsp. paratuberculosis
gcccgccgcggu

SEQ ID NO: 2895595 - RNA, 13 nt, Mycobacterium avium subsp. paratuberculosis
gcccgccgcggug

SEQ ID NO: 2895596 - RNA, 11 nt, Mycobacterium avium subsp. paratuberculosis
gcccgccgcgu

SEQ ID NO: 2895597 - RNA, 14 nt, Mycobacterium avium subsp. paratuberculosis
gcccgccgcguaca

SEQ ID NO: 2895598 - RNA, 16 nt, Mycobacterium avium subsp. paratuberculosis
gcccgccgcguacagc

SEQ ID NO: 2895599 - RNA, 20 nt, Mycobacterium avium subsp. paratuberculosis
gcccgccgcguacagcagcu

SEQ ID NO: 2895600 - RNA, 15 nt, Mycobacterium avium subsp. paratuberculosis
gcccgccgcgucagc

SEQ ID NO: 2895601 - RNA, 18 nt, Mycobacterium avium subsp. paratuberculosis
gcccgccgcgucagcggc

SEQ ID NO: 2895602 - RNA, 14 nt, Mycobacterium avium subsp. paratuberculosis
gcccgccgcguccg

SEQ ID NO: 2895603 - RNA, 15 nt, Mycobacterium avium subsp. paratuberculosis
gcccgccgcucaccg

SEQ ID NO: 2895604 - RNA, 19 nt, Mycobacterium avium subsp. paratuberculosis
gcccgccgcucaccgccga

SEQ ID NO: 2895605 - RNA, 17 nt, Mycobacterium avium subsp. paratuberculosis
gcccgccgcugacgcgg

SEQ ID NO: 2895606 - RNA, 19 nt, Mycobacterium avium subsp. paratuberculosis
gcccgccgcugacgcggcg

SEQ ID NO: 2895607 - RNA, 15 nt, Mycobacterium avium subsp. paratuberculosis
gcccgccgcugcagc

SEQ ID NO: 2895608 - RNA, 15 nt, Mycobacterium avium subsp. paratuberculosis
gcccgccggcccagc

SEQ ID NO: 2895609 - RNA, 16 nt, Mycobacterium avium subsp. paratuberculosis
gcccgccggcccagcu

SEQ ID NO: 2895610 - RNA, 20 nt, Mycobacterium avium subsp. paratuberculosis
gcccgccggcccagcuccac

SEQ ID NO: 2895611 - RNA, 14 nt, Mycobacterium avium subsp. paratuberculosis
gcccgccggcggcg

SEQ ID NO: 2895612 - RNA, 19 nt, Mycobacterium avium subsp. paratuberculosis
gcccgccggcggcgaugau

SEQ ID NO: 2895613 - RNA, 21 nt, Mycobacterium avium subsp. paratuberculosis
gcccgccggcggcgaugaucg

SEQ ID NO: 2895614 - RNA, 13 nt, Mycobacterium avium subsp. paratuberculosis
gcccgccggcggg

SEQ ID NO: 2895615 - RNA, 12 nt, Mycobacterium avium subsp. paratuberculosis
gcccgccggcgu

SEQ ID NO: 2895616 - RNA, 13 nt, Mycobacterium avium subsp. paratuberculosis
gcccgccggcguc

SEQ ID NO: 2895617 - RNA, 17 nt, Mycobacterium avium subsp. paratuberculosis
gcccgccgggaugcgcc

SEQ ID NO: 2895618 - RNA, 22 nt, Mycobacterium avium subsp. paratuberculosis
gcccgccgggaugcgccaccga

SEQ ID NO: 2895619 - RNA, 15 nt, Mycobacterium avium subsp. paratuberculosis
gcccgccgggcaccc

SEQ ID NO: 2895620 - RNA, 17 nt, Mycobacterium avium subsp. paratuberculosis
gcccgccgggcacccgg

SEQ ID NO: 2895621 - RNA, 14 nt, Mycobacterium avium subsp. paratuberculosis
gcccgccgggccgg

SEQ ID NO: 2895622 - RNA, 15 nt, Mycobacterium avium subsp. paratuberculosis
gcccgccgggccgga

SEQ ID NO: 2895623 - RNA, 23 nt, Mycobacterium avium subsp. paratuberculosis
gcccgccgggccggaucgcgcag

SEQ ID NO: 2895624 - RNA, 12 nt, Mycobacterium avium subsp. paratuberculosis
gcccgccgggcg

SEQ ID NO: 2895625 - RNA, 16 nt, Mycobacterium avium subsp. paratuberculosis
gcccgccgggcgccac

SEQ ID NO: 2895626 - RNA, 14 nt, Mycobacterium avium subsp. paratuberculosis
gcccgccgggcguc

SEQ ID NO: 2895627 - RNA, 16 nt, Mycobacterium avium subsp. paratuberculosis
gcccgccgggcugacc

SEQ ID NO: 2895628 - RNA, 17 nt, Mycobacterium avium subsp. paratuberculosis
gcccgccgggcugaccg

SEQ ID NO: 2895629 - RNA, 22 nt, Mycobacterium avium subsp. paratuberculosis
gcccgccgggcugaccgucgac

SEQ ID NO: 2895630 - RNA, 23 nt, Mycobacterium avium subsp. paratuberculosis
gcccgccgggcugaccgucgacc

SEQ ID NO: 2895631 - RNA, 15 nt, Mycobacterium avium subsp. paratuberculosis
gcccgccgguggccg

SEQ ID NO: 2895632 - RNA, 17 nt, Mycobacterium avium subsp. paratuberculosis
gcccgccgguggccgcg

SEQ ID NO: 2895633 - RNA, 17 nt, Mycobacterium avium subsp. paratuberculosis
gcccgcggcagccagcc

SEQ ID NO: 2895634 - RNA, 15 nt, Mycobacterium avium subsp. paratuberculosis
gcccgcggccgccgc

SEQ ID NO: 2895635 - RNA, 16 nt, Mycobacterium avium subsp. paratuberculosis
gcccgcggccgccgcc

SEQ ID NO: 2895636 - RNA, 14 nt, Mycobacterium avium subsp. paratuberculosis
gcccgcggccucca

SEQ ID NO: 2895637 - RNA, 18 nt, Mycobacterium avium subsp. paratuberculosis
gcccgcggccuccagccg

SEQ ID NO: 2895638 - RNA, 19 nt, Mycobacterium avium subsp. paratuberculosis
gcccgcggccuccagccgc

SEQ ID NO: 2895639 - RNA, 21 nt, Mycobacterium avium subsp. paratuberculosis
gcccgcggccuccagccgcuc

SEQ ID NO: 2895640 - RNA, 14 nt, Mycobacterium avium subsp. paratuberculosis
gcccgcggcgcccg

SEQ ID NO: 2895641 - RNA, 14 nt, Mycobacterium avium subsp. paratuberculosis
gcccgcggcgcgca

SEQ ID NO: 2895642 - RNA, 16 nt, Mycobacterium avium subsp. paratuberculosis
gcccgcggcgcgcagg

SEQ ID NO: 2895643 - RNA, 12 nt, Mycobacterium avium subsp. paratuberculosis
gcccgcggcguc

SEQ ID NO: 2895644 - RNA, 13 nt, Mycobacterium avium subsp. paratuberculosis
gcccgcggcguca

SEQ ID NO: 2895645 - RNA, 15 nt, Mycobacterium avium subsp. paratuberculosis
gcccgcggcgucauc

SEQ ID NO: 2895646 - RNA, 17 nt, Mycobacterium avium subsp. paratuberculosis
gcccgcgggacacggcg

SEQ ID NO: 2895647 - RNA, 13 nt, Mycobacterium avium subsp. paratuberculosis
gcccgcgggccag

SEQ ID NO: 2895648 - RNA, 16 nt, Mycobacterium avium subsp. paratuberculosis
gcccgcgggccagacu

SEQ ID NO: 2895649 - RNA, 22 nt, Mycobacterium avium subsp. paratuberculosis
gcccgcggggcguacgcgcugc

SEQ ID NO: 2895650 - RNA, 19 nt, Mycobacterium avium subsp. paratuberculosis
gcccgcggguagcccgucg

SEQ ID NO: 2895651 - RNA, 16 nt, Mycobacterium avium subsp. paratuberculosis
gcccgcgggugcagcc

SEQ ID NO: 2895652 - RNA, 19 nt, Mycobacterium avium subsp. paratuberculosis
gcccgcgggugcagccgga

SEQ ID NO: 2895653 - RNA, 20 nt, Mycobacterium avium subsp. paratuberculosis
gcccgcggucaugcgcgggc

SEQ ID NO: 2895654 - RNA, 18 nt, Mycobacterium avium subsp. paratuberculosis
gcccgcggugcagucggu

SEQ ID NO: 2895655 - RNA, 21 nt, Mycobacterium avium subsp. paratuberculosis
gcccgcgguggaacccagcac

SEQ ID NO: 2895656 - RNA, 22 nt, Mycobacterium avium subsp. paratuberculosis
gcccgcgguggaacccagcacc

SEQ ID NO: 2895657 - RNA, 18 nt, Mycobacterium avium subsp. paratuberculosis
gcccgcguaaccggcggc

SEQ ID NO: 2895658 - RNA, 18 nt, Mycobacterium avium subsp. paratuberculosis
gcccgcguacagcaguuc

SEQ ID NO: 2895659 - RNA, 18 nt, Mycobacterium avium subsp. paratuberculosis
gcccgcguacagcggguc

SEQ ID NO: 2895660 - RNA, 23 nt, Mycobacterium avium subsp. paratuberculosis
gcccgcguacagcgggucguugg

SEQ ID NO: 2895661 - RNA, 15 nt, Mycobacterium avium subsp. paratuberculosis
gcccgcguccagcag

SEQ ID NO: 2895662 - RNA, 17 nt, Mycobacterium avium subsp. paratuberculosis
gcccgcguccagcagca

SEQ ID NO: 2895663 - RNA, 16 nt, Mycobacterium avium subsp. paratuberculosis
gcccgcguccugcagc

SEQ ID NO: 2895664 - RNA, 17 nt, Mycobacterium avium subsp. paratuberculosis
gcccgcguccugcagcg

SEQ ID NO: 2895665 - RNA, 13 nt, Mycobacterium avium subsp. paratuberculosis
gcccgcgucgugg

SEQ ID NO: 2895666 - RNA, 20 nt, Mycobacterium avium subsp. paratuberculosis
gcccgcgucguggcccugcu

SEQ ID NO: 2895667 - RNA, 20 nt, Mycobacterium avium subsp. paratuberculosis
gcccgcgucguguccgggcc

SEQ ID NO: 2895668 - RNA, 21 nt, Mycobacterium avium subsp. paratuberculosis
gcccgcgucguguccgggccc

SEQ ID NO: 2895669 - RNA, 22 nt, Mycobacterium avium subsp. paratuberculosis
gcccgcgucguguccgggcccg

SEQ ID NO: 2895670 - RNA, 13 nt, Mycobacterium avium subsp. paratuberculosis
gcccgcgugcaca

SEQ ID NO: 2895671 - RNA, 17 nt, Mycobacterium avium subsp. paratuberculosis
gcccgcucaccugcggc

SEQ ID NO: 2895672 - RNA, 18 nt, Mycobacterium avium subsp. paratuberculosis
gcccgcucaccugcggcc

SEQ ID NO: 2895673 - RNA, 21 nt, Mycobacterium avium subsp. paratuberculosis
gcccgcucaccugcggcccgu

SEQ ID NO: 2895674 - RNA, 15 nt, Mycobacterium avium subsp. paratuberculosis
gcccgcucagagcug

SEQ ID NO: 2895675 - RNA, 13 nt, Mycobacterium avium subsp. paratuberculosis
gcccgcuccgcgg

SEQ ID NO: 2895676 - RNA, 22 nt, Mycobacterium avium subsp. paratuberculosis
gcccgcuccgcgggcagcgagc

SEQ ID NO: 2895677 - RNA, 15 nt, Mycobacterium avium subsp. paratuberculosis
gcccgcuccgcggug

SEQ ID NO: 2895678 - RNA, 16 nt, Mycobacterium avium subsp. paratuberculosis
gcccgcuccgcggugc

SEQ ID NO: 2895679 - RNA, 14 nt, Mycobacterium avium subsp. paratuberculosis
gcccgcuccggcgg

SEQ ID NO: 2895680 - RNA, 23 nt, Mycobacterium avium subsp. paratuberculosis
gcccgcuccggcggacccagcuc

SEQ ID NO: 2895681 - RNA, 14 nt, Mycobacterium avium subsp. paratuberculosis
gcccgcucgacggc

SEQ ID NO: 2895682 - RNA, 17 nt, Mycobacterium avium subsp. paratuberculosis
gcccgcucgacggccgg

SEQ ID NO: 2895683 - RNA, 18 nt, Mycobacterium avium subsp. paratuberculosis
gcccgcucgacggccggu

SEQ ID NO: 2895684 - RNA, 19 nt, Mycobacterium avium subsp. paratuberculosis
gcccgcucgacggccggug

SEQ ID NO: 2895685 - RNA, 16 nt, Mycobacterium avium subsp. paratuberculosis
gcccgcucgaugucgg

SEQ ID NO: 2895686 - RNA, 12 nt, Mycobacterium avium subsp. paratuberculosis
gcccgcucggcg

SEQ ID NO: 2895687 - RNA, 11 nt, Mycobacterium avium subsp. paratuberculosis
gcccgcugacc

SEQ ID NO: 2895688 - RNA, 14 nt, Mycobacterium avium subsp. paratuberculosis
gcccgcugaccagg

SEQ ID NO: 2895689 - RNA, 16 nt, Mycobacterium avium subsp. paratuberculosis
gcccgcugaccaggcc

SEQ ID NO: 2895690 - RNA, 17 nt, Mycobacterium avium subsp. paratuberculosis
gcccgcugaccgccgcg

SEQ ID NO: 2895691 - RNA, 19 nt, Mycobacterium avium subsp. paratuberculosis
gcccgcugaccgccgcgcu

SEQ ID NO: 2895692 - RNA, 20 nt, Mycobacterium avium subsp. paratuberculosis
gcccgcugaccgccgcgcuc

SEQ ID NO: 2895693 - RNA, 16 nt, Mycobacterium avium subsp. paratuberculosis
gcccgcugcagcgccg

SEQ ID NO: 2895694 - RNA, 17 nt, Mycobacterium avium subsp. paratuberculosis
gcccgcugcagcgccga

SEQ ID NO: 2895695 - RNA, 15 nt, Mycobacterium avium subsp. paratuberculosis
gcccgcugcgccgac

SEQ ID NO: 2895696 - RNA, 13 nt, Mycobacterium avium subsp. paratuberculosis
gcccgcugcgcgg

SEQ ID NO: 2895697 - RNA, 15 nt, Mycobacterium avium subsp. paratuberculosis
gcccgcugcgcggcc

SEQ ID NO: 2895698 - RNA, 19 nt, Mycobacterium avium subsp. paratuberculosis
gcccgcugcgcggccgaac

SEQ ID NO: 2895699 - RNA, 14 nt, Mycobacterium avium subsp. paratuberculosis
gcccgcugcgcggg

SEQ ID NO: 2895700 - RNA, 18 nt, Mycobacterium avium subsp. paratuberculosis
gcccgcugcgcgggucgg

SEQ ID NO: 2895701 - RNA, 20 nt, Mycobacterium avium subsp. paratuberculosis
gcccgcugcgcgggucggcg

SEQ ID NO: 2895702 - RNA, 22 nt, Mycobacterium avium subsp. paratuberculosis
gcccgcugcgcgggucggcgcc

SEQ ID NO: 2895703 - RNA, 14 nt, Mycobacterium avium subsp. paratuberculosis
gcccgcugcggcaa

SEQ ID NO: 2895704 - RNA, 14 nt, Mycobacterium avium subsp. paratuberculosis
gcccgcugcggcgc

SEQ ID NO: 2895705 - RNA, 17 nt, Mycobacterium avium subsp. paratuberculosis
gcccgcugcggcgcagg

SEQ ID NO: 2895706 - RNA, 18 nt, Mycobacterium avium subsp. paratuberculosis
gcccgcugcggcgcaggu

SEQ ID NO: 2895707 - RNA, 15 nt, Mycobacterium avium subsp. paratuberculosis
gcccgcugcggcugg

SEQ ID NO: 2895708 - RNA, 16 nt, Mycobacterium avium subsp. paratuberculosis
gcccgcuggccgccgc

SEQ ID NO: 2895709 - RNA, 16 nt, Mycobacterium avium subsp. paratuberculosis
gcccgcuggggcgcac

SEQ ID NO: 2895710 - RNA, 21 nt, Mycobacterium avium subsp. paratuberculosis
gcccgcuggggcgcaccgccu

SEQ ID NO: 2895711 - RNA, 22 nt, Mycobacterium avium subsp. paratuberculosis
gcccgcuggggcgcaccgccug

SEQ ID NO: 2895712 - RNA, 14 nt, Mycobacterium avium subsp. paratuberculosis
gcccgcuguggucc

SEQ ID NO: 2895713 - RNA, 21 nt, Mycobacterium avium subsp. paratuberculosis
gcccgcugugguccucgucac

SEQ ID NO: 2895714 - RNA, 19 nt, Mycobacterium avium subsp. paratuberculosis
gcccgcuucaggcagcgca

SEQ ID NO: 2895715 - RNA, 15 nt, Mycobacterium avium subsp. paratuberculosis
gcccgcuugauggcg

SEQ ID NO: 2895716 - RNA, 18 nt, Mycobacterium avium subsp. paratuberculosis
gcccgcuugauggcggcg

SEQ ID NO: 2895717 - RNA, 19 nt, Mycobacterium avium subsp. paratuberculosis
gcccgcuugauggcggcgc

SEQ ID NO: 2895718 - RNA, 20 nt, Mycobacterium avium subsp. paratuberculosis
gcccggcccgcaucgaaucc

SEQ ID NO: 2895719 - RNA, 16 nt, Mycobacterium avium subsp. paratuberculosis
gcccggcccgcaugca

SEQ ID NO: 2895720 - RNA, 16 nt, Mycobacterium avium subsp. paratuberculosis
gcccggcccgccgcug

SEQ ID NO: 2895721 - RNA, 12 nt, Mycobacterium avium subsp. paratuberculosis
gcccggcccgcu

SEQ ID NO: 2895722 - RNA, 17 nt, Mycobacterium avium subsp. paratuberculosis
gcccggcccgcuggccg

SEQ ID NO: 2895723 - RNA, 14 nt, Mycobacterium avium subsp. paratuberculosis
gcccggcccggcga

SEQ ID NO: 2895724 - RNA, 15 nt, Mycobacterium avium subsp. paratuberculosis
gcccggcccggcgau

SEQ ID NO: 2895725 - RNA, 14 nt, Mycobacterium avium subsp. paratuberculosis
gcccggcccggcgc

SEQ ID NO: 2895726 - RNA, 15 nt, Mycobacterium avium subsp. paratuberculosis
gcccggcccggcgcg

SEQ ID NO: 2895727 - RNA, 19 nt, Mycobacterium avium subsp. paratuberculosis
gcccggcccggcgcggccg

SEQ ID NO: 2895728 - RNA, 12 nt, Mycobacterium avium subsp. paratuberculosis
gcccggcccguc

SEQ ID NO: 2895729 - RNA, 15 nt, Mycobacterium avium subsp. paratuberculosis
gcccggcccgucgag

SEQ ID NO: 2895730 - RNA, 20 nt, Mycobacterium avium subsp. paratuberculosis
gcccggccgaggucaccacc

SEQ ID NO: 2895731 - RNA, 23 nt, Mycobacterium avium subsp. paratuberculosis
gcccggccgaggucaccaccgag

SEQ ID NO: 2895732 - RNA, 15 nt, Mycobacterium avium subsp. paratuberculosis
gcccggccgcggccc

SEQ ID NO: 2895733 - RNA, 12 nt, Mycobacterium avium subsp. paratuberculosis
gcccggccggcc

SEQ ID NO: 2895734 - RNA, 14 nt, Mycobacterium avium subsp. paratuberculosis
gcccggccggcccc

SEQ ID NO: 2895735 - RNA, 23 nt, Mycobacterium avium subsp. paratuberculosis
gcccggccggccccuaccgccga

SEQ ID NO: 2895736 - RNA, 15 nt, Mycobacterium avium subsp. paratuberculosis
gcccggccggcgcga

SEQ ID NO: 2895737 - RNA, 23 nt, Mycobacterium avium subsp. paratuberculosis
gcccggccggugcuuggcguuga

SEQ ID NO: 2895738 - RNA, 15 nt, Mycobacterium avium subsp. paratuberculosis
gcccggccgugagug

SEQ ID NO: 2895739 - RNA, 17 nt, Mycobacterium avium subsp. paratuberculosis
gcccggcgaacaccacg

SEQ ID NO: 2895740 - RNA, 19 nt, Mycobacterium avium subsp. paratuberculosis
gcccggcgaaucagcagcu

SEQ ID NO: 2895741 - RNA, 20 nt, Mycobacterium avium subsp. paratuberculosis
gcccggcgaaucagcagcuu

SEQ ID NO: 2895742 - RNA, 14 nt, Mycobacterium avium subsp. paratuberculosis
gcccggcgaccacc

SEQ ID NO: 2895743 - RNA, 19 nt, Mycobacterium avium subsp. paratuberculosis
gcccggcgaccaccagccg

SEQ ID NO: 2895744 - RNA, 21 nt, Mycobacterium avium subsp. paratuberculosis
gcccggcgaccaccagccgca

SEQ ID NO: 2895745 - RNA, 21 nt, Mycobacterium avium subsp. paratuberculosis
gcccggcgacgaagcagcucg

SEQ ID NO: 2895746 - RNA, 15 nt, Mycobacterium avium subsp. paratuberculosis
gcccggcgacgcggc

SEQ ID NO: 2895747 - RNA, 18 nt, Mycobacterium avium subsp. paratuberculosis
gcccggcgacgcggcggg

SEQ ID NO: 2895748 - RNA, 21 nt, Mycobacterium avium subsp. paratuberculosis
gcccggcgacgcggcgggaaa

SEQ ID NO: 2895749 - RNA, 13 nt, Mycobacterium avium subsp. paratuberculosis
gcccggcgacggc

SEQ ID NO: 2895750 - RNA, 15 nt, Mycobacterium avium subsp. paratuberculosis
gcccggcgacggcgc

SEQ ID NO: 2895751 - RNA, 14 nt, Mycobacterium avium subsp. paratuberculosis
gcccggcgacgucg

SEQ ID NO: 2895752 - RNA, 18 nt, Mycobacterium avium subsp. paratuberculosis
gcccggcgacgucgucga

SEQ ID NO: 2895753 - RNA, 14 nt, Mycobacterium avium subsp. paratuberculosis
gcccggcgagcagc

SEQ ID NO: 2895754 - RNA, 13 nt, Mycobacterium avium subsp. paratuberculosis
gcccggcgagcga

SEQ ID NO: 2895755 - RNA, 14 nt, Mycobacterium avium subsp. paratuberculosis
gcccggcgagcgac

SEQ ID NO: 2895756 - RNA, 15 nt, Mycobacterium avium subsp. paratuberculosis
gcccggcgagcgacg

SEQ ID NO: 2895757 - RNA, 20 nt, Mycobacterium avium subsp. paratuberculosis
gcccggcgaugaucaggccg

SEQ ID NO: 2895758 - RNA, 15 nt, Mycobacterium avium subsp. paratuberculosis
gcccggcgaugccga

SEQ ID NO: 2895759 - RNA, 18 nt, Mycobacterium avium subsp. paratuberculosis
gcccggcgaugccgagcc

SEQ ID NO: 2895760 - RNA, 21 nt, Mycobacterium avium subsp. paratuberculosis
gcccggcgaugccgagcccuu

SEQ ID NO: 2895761 - RNA, 14 nt, Mycobacterium avium subsp. paratuberculosis
gcccggcgaugucg

SEQ ID NO: 2895762 - RNA, 15 nt, Mycobacterium avium subsp. paratuberculosis
gcccggcgaugucgg

SEQ ID NO: 2895763 - RNA, 17 nt, Mycobacterium avium subsp. paratuberculosis
gcccggcgaugucgggc

SEQ ID NO: 2895764 - RNA, 20 nt, Mycobacterium avium subsp. paratuberculosis
gcccggcgaugucgggcacc

SEQ ID NO: 2895765 - RNA, 21 nt, Mycobacterium avium subsp. paratuberculosis
gcccggcgcacaggaacgcgu

SEQ ID NO: 2895766 - RNA, 14 nt, Mycobacterium avium subsp. paratuberculosis
gcccggcgccacgc

SEQ ID NO: 2895767 - RNA, 17 nt, Mycobacterium avium subsp. paratuberculosis
gcccggcgccacgcaca

SEQ ID NO: 2895768 - RNA, 14 nt, Mycobacterium avium subsp. paratuberculosis
gcccggcgccccgc

SEQ ID NO: 2895769 - RNA, 13 nt, Mycobacterium avium subsp. paratuberculosis
gcccggcgcccgg

SEQ ID NO: 2895770 - RNA, 16 nt, Mycobacterium avium subsp. paratuberculosis
gcccggcgcccggccg

SEQ ID NO: 2895771 - RNA, 21 nt, Mycobacterium avium subsp. paratuberculosis
gcccggcgcccugcacccagc

SEQ ID NO: 2895772 - RNA, 13 nt, Mycobacterium avium subsp. paratuberculosis
gcccggcgccggc

SEQ ID NO: 2895773 - RNA, 15 nt, Mycobacterium avium subsp. paratuberculosis
gcccggcgccggccc

SEQ ID NO: 2895774 - RNA, 20 nt, Mycobacterium avium subsp. paratuberculosis
gcccggcgccggcccgcggc

SEQ ID NO: 2895775 - RNA, 14 nt, Mycobacterium avium subsp. paratuberculosis
gcccggcgccggcg

SEQ ID NO: 2895776 - RNA, 15 nt, Mycobacterium avium subsp. paratuberculosis
gcccggcgccggcgg

SEQ ID NO: 2895777 - RNA, 17 nt, Mycobacterium avium subsp. paratuberculosis
gcccggcgccggcggcc

SEQ ID NO: 2895778 - RNA, 15 nt, Mycobacterium avium subsp. paratuberculosis
gcccggcgccggucg

SEQ ID NO: 2895779 - RNA, 15 nt, Mycobacterium avium subsp. paratuberculosis
gcccggcgcgcagcc

SEQ ID NO: 2895780 - RNA, 19 nt, Mycobacterium avium subsp. paratuberculosis
gcccggcgcgcagcccagc

SEQ ID NO: 2895781 - RNA, 23 nt, Mycobacterium avium subsp. paratuberculosis
gcccggcgcgcagcccagccagc

SEQ ID NO: 2895782 - RNA, 15 nt, Mycobacterium avium subsp. paratuberculosis
gcccggcgcgccacg

SEQ ID NO: 2895783 - RNA, 16 nt, Mycobacterium avium subsp. paratuberculosis
gcccggcgcgccacga

SEQ ID NO: 2895784 - RNA, 13 nt, Mycobacterium avium subsp. paratuberculosis
gcccggcgcgccg

SEQ ID NO: 2895785 - RNA, 17 nt, Mycobacterium avium subsp. paratuberculosis
gcccggcgcgccgcagg

SEQ ID NO: 2895786 - RNA, 20 nt, Mycobacterium avium subsp. paratuberculosis
gcccggcgcggacagcgcgg

SEQ ID NO: 2895787 - RNA, 13 nt, Mycobacterium avium subsp. paratuberculosis
gcccggcgcggca

SEQ ID NO: 2895788 - RNA, 14 nt, Mycobacterium avium subsp. paratuberculosis
gcccggcgcggcau

SEQ ID NO: 2895789 - RNA, 22 nt, Mycobacterium avium subsp. paratuberculosis
gcccggcgcggcaucggcgacg

SEQ ID NO: 2895790 - RNA, 13 nt, Mycobacterium avium subsp. paratuberculosis
gcccggcgcggcc

SEQ ID NO: 2895791 - RNA, 14 nt, Mycobacterium avium subsp. paratuberculosis
gcccggcgcggccg

SEQ ID NO: 2895792 - RNA, 17 nt, Mycobacterium avium subsp. paratuberculosis
gcccggcgcggccggug

SEQ ID NO: 2895793 - RNA, 14 nt, Mycobacterium avium subsp. paratuberculosis
gcccggcgcggcgg

SEQ ID NO: 2895794 - RNA, 15 nt, Mycobacterium avium subsp. paratuberculosis
gcccggcgcggcggc

SEQ ID NO: 2895795 - RNA, 16 nt, Mycobacterium avium subsp. paratuberculosis
gcccggcgcggcggcg

SEQ ID NO: 2895796 - RNA, 21 nt, Mycobacterium avium subsp. paratuberculosis
gcccggcgcggcggcgccgcg

SEQ ID NO: 2895797 - RNA, 16 nt, Mycobacterium avium subsp. paratuberculosis
gcccggcgcuaaagcc

SEQ ID NO: 2895798 - RNA, 22 nt, Mycobacterium avium subsp. paratuberculosis
gcccggcgcuaaagccgaccgc

SEQ ID NO: 2895799 - RNA, 14 nt, Mycobacterium avium subsp. paratuberculosis
gcccggcgcucacc

SEQ ID NO: 2895800 - RNA, 16 nt, Mycobacterium avium subsp. paratuberculosis
gcccggcgcucaccgc

SEQ ID NO: 2895801 - RNA, 23 nt, Mycobacterium avium subsp. paratuberculosis
gcccggcgcucaccgcgaugaug

SEQ ID NO: 2895802 - RNA, 14 nt, Mycobacterium avium subsp. paratuberculosis
gcccggcgcugcgc

SEQ ID NO: 2895803 - RNA, 14 nt, Mycobacterium avium subsp. paratuberculosis
gcccggggcggcga

SEQ ID NO: 2895804 - RNA, 17 nt, Mycobacterium avium subsp. paratuberculosis
gcccggggcggcgaugc

SEQ ID NO: 2895805 - RNA, 14 nt, Mycobacterium avium subsp. paratuberculosis
gcccggggguggcg

SEQ ID NO: 2895806 - RNA, 20 nt, Mycobacterium avium subsp. paratuberculosis
gcccggggguggcggucccg

SEQ ID NO: 2895807 - RNA, 19 nt, Mycobacterium avium subsp. paratuberculosis
gcccgggguccaccggccg

SEQ ID NO: 2895808 - RNA, 20 nt, Mycobacterium avium subsp. paratuberculosis
gcccgggguccaccggccga

SEQ ID NO: 2895809 - RNA, 23 nt, Mycobacterium avium subsp. paratuberculosis
gcccggggucugacccaugcccc

SEQ ID NO: 2895810 - RNA, 18 nt, Mycobacterium avium subsp. paratuberculosis
gcccggggugaugccggc

SEQ ID NO: 2895811 - RNA, 20 nt, Mycobacterium avium subsp. paratuberculosis
gcccggggugaugccggcgg

SEQ ID NO: 2895812 - RNA, 21 nt, Mycobacterium avium subsp. paratuberculosis
gcccggggugaugccggcggu

SEQ ID NO: 2895813 - RNA, 22 nt, Mycobacterium avium subsp. paratuberculosis
gcccggggugaugccggcggua

SEQ ID NO: 2895814 - RNA, 11 nt, Mycobacterium avium subsp. paratuberculosis
gcccggggugc

SEQ ID NO: 2895815 - RNA, 18 nt, Mycobacterium avium subsp. paratuberculosis
gcccggggugcuggcgua

SEQ ID NO: 2895816 - RNA, 20 nt, Mycobacterium avium subsp. paratuberculosis
gcccgggguggauccgucgc

SEQ ID NO: 2895817 - RNA, 16 nt, Mycobacterium avium subsp. paratuberculosis
gcccggguagcgcagc

SEQ ID NO: 2895818 - RNA, 20 nt, Mycobacterium avium subsp. paratuberculosis
gcccggguccuggcccccgc

SEQ ID NO: 2895819 - RNA, 14 nt, Mycobacterium avium subsp. paratuberculosis
gcccgggucgucgg

SEQ ID NO: 2895820 - RNA, 16 nt, Mycobacterium avium subsp. paratuberculosis
gcccgggucgucggug

SEQ ID NO: 2895821 - RNA, 19 nt, Mycobacterium avium subsp. paratuberculosis
gcccgggucgucggugccg

SEQ ID NO: 2895822 - RNA, 23 nt, Mycobacterium avium subsp. paratuberculosis
gcccgggucgucggugccgaagc

SEQ ID NO: 2895823 - RNA, 14 nt, Mycobacterium avium subsp. paratuberculosis
gcccgggucgugcg

SEQ ID NO: 2895824 - RNA, 16 nt, Mycobacterium avium subsp. paratuberculosis
gcccgggucgugcggc

SEQ ID NO: 2895825 - RNA, 17 nt, Mycobacterium avium subsp. paratuberculosis
gcccgggucgugcggcg

SEQ ID NO: 2895826 - RNA, 20 nt, Mycobacterium avium subsp. paratuberculosis
gcccgggucgugcggcggcg

SEQ ID NO: 2895827 - RNA, 21 nt, Mycobacterium avium subsp. paratuberculosis
gcccgggugacaacgguggug

SEQ ID NO: 2895828 - RNA, 22 nt, Mycobacterium avium subsp. paratuberculosis
gcccgggugacaacgguggugg

SEQ ID NO: 2895829 - RNA, 17 nt, Mycobacterium avium subsp. paratuberculosis
gcccgggugauggucuc

SEQ ID NO: 2895830 - RNA, 16 nt, Mycobacterium avium subsp. paratuberculosis
gcccgggugcaggccc

SEQ ID NO: 2895831 - RNA, 18 nt, Mycobacterium avium subsp. paratuberculosis
gcccgggugcaggcccag

SEQ ID NO: 2895832 - RNA, 19 nt, Mycobacterium avium subsp. paratuberculosis
gcccgggugcaggcccagc

SEQ ID NO: 2895833 - RNA, 15 nt, Mycobacterium avium subsp. paratuberculosis
gcccgggugcgaaca

SEQ ID NO: 2895834 - RNA, 13 nt, Mycobacterium avium subsp. paratuberculosis
gcccgggugcgcu

SEQ ID NO: 2895835 - RNA, 22 nt, Mycobacterium avium subsp. paratuberculosis
gcccgggugcgcuugucggcgu

SEQ ID NO: 2895836 - RNA, 20 nt, Mycobacterium avium subsp. paratuberculosis
gcccggguggacgcccgcga

SEQ ID NO: 2895837 - RNA, 14 nt, Mycobacterium avium subsp. paratuberculosis
gcccggguggcguc

SEQ ID NO: 2895838 - RNA, 13 nt, Mycobacterium avium subsp. paratuberculosis
gcccgggugggcg

SEQ ID NO: 2895839 - RNA, 16 nt, Mycobacterium avium subsp. paratuberculosis
gcccgggugugggcgc

SEQ ID NO: 2895840 - RNA, 21 nt, Mycobacterium avium subsp. paratuberculosis
gcccgggugugggcgccguca

SEQ ID NO: 2895841 - RNA, 16 nt, Mycobacterium avium subsp. paratuberculosis
gcccggguugcacagg

SEQ ID NO: 2895842 - RNA, 21 nt, Mycobacterium avium subsp. paratuberculosis
gcccggguugcacaggucgau

SEQ ID NO: 2895843 - RNA, 18 nt, Mycobacterium avium subsp. paratuberculosis
gcccggguugucgacgug

SEQ ID NO: 2895844 - RNA, 21 nt, Mycobacterium avium subsp. paratuberculosis
gcccggguugucgacguggug

SEQ ID NO: 2895845 - RNA, 22 nt, Mycobacterium avium subsp. paratuberculosis
gcccggguugucgacguggugc

SEQ ID NO: 2895846 - RNA, 19 nt, Mycobacterium avium subsp. paratuberculosis
gcccgguacagcgccgcgg

SEQ ID NO: 2895847 - RNA, 20 nt, Mycobacterium avium subsp. paratuberculosis
gcccgguacagcgccgcggc

SEQ ID NO: 2895848 - RNA, 22 nt, Mycobacterium avium subsp. paratuberculosis
gcccgguacagcgccgcggcca

SEQ ID NO: 2895849 - RNA, 16 nt, Mycobacterium avium subsp. paratuberculosis
gcccgguacaucgacg

SEQ ID NO: 2895850 - RNA, 18 nt, Mycobacterium avium subsp. paratuberculosis
gcccgguacaucgacgcg

SEQ ID NO: 2895851 - RNA, 14 nt, Mycobacterium avium subsp. paratuberculosis
gcccgguaggccgc

SEQ ID NO: 2895852 - RNA, 15 nt, Mycobacterium avium subsp. paratuberculosis
gcccgguaggccgcc

SEQ ID NO: 2895853 - RNA, 17 nt, Mycobacterium avium subsp. paratuberculosis
gcccgguaggccgccgc

SEQ ID NO: 2895854 - RNA, 22 nt, Mycobacterium avium subsp. paratuberculosis
gcccgguaggccgccgcgaccg

SEQ ID NO: 2895855 - RNA, 17 nt, Mycobacterium avium subsp. paratuberculosis
gcccggucaccaucagc

SEQ ID NO: 2895856 - RNA, 13 nt, Mycobacterium avium subsp. paratuberculosis
gcccggucacccg

SEQ ID NO: 2895857 - RNA, 23 nt, Mycobacterium avium subsp. paratuberculosis
gcccggucacccgugggccgacc

SEQ ID NO: 2895858 - RNA, 19 nt, Mycobacterium avium subsp. paratuberculosis
gcccggucaguucgucggu

SEQ ID NO: 2895859 - RNA, 21 nt, Mycobacterium avium subsp. paratuberculosis
gcccggucaguucgucgguca

SEQ ID NO: 2895860 - RNA, 22 nt, Mycobacterium avium subsp. paratuberculosis
gcccgguccaucccguugcgca

SEQ ID NO: 2895861 - RNA, 19 nt, Mycobacterium avium subsp. paratuberculosis
gcccgguccgggucgcuga

SEQ ID NO: 2895862 - RNA, 17 nt, Mycobacterium avium subsp. paratuberculosis
gcccggucgaccagggu

SEQ ID NO: 2895863 - RNA, 21 nt, Mycobacterium avium subsp. paratuberculosis
gcccggucgaggucggccagc

SEQ ID NO: 2895864 - RNA, 22 nt, Mycobacterium avium subsp. paratuberculosis
gcccggucgaggucggccagca

SEQ ID NO: 2895865 - RNA, 12 nt, Mycobacterium avium subsp. paratuberculosis
gcccggucgaug

SEQ ID NO: 2895866 - RNA, 15 nt, Mycobacterium avium subsp. paratuberculosis
gcccggucgaugauc

SEQ ID NO: 2895867 - RNA, 20 nt, Mycobacterium avium subsp. paratuberculosis
gcccggucggaguccagcac

SEQ ID NO: 2895868 - RNA, 14 nt, Mycobacterium avium subsp. paratuberculosis
gcccggucgucgag

SEQ ID NO: 2895869 - RNA, 15 nt, Mycobacterium avium subsp. paratuberculosis
gcccggucgucgccg

SEQ ID NO: 2895870 - RNA, 16 nt, Mycobacterium avium subsp. paratuberculosis
gcccggucugcggccg

SEQ ID NO: 2895871 - RNA, 12 nt, Mycobacterium avium subsp. paratuberculosis
gcccggugacga

SEQ ID NO: 2895872 - RNA, 15 nt, Mycobacterium avium subsp. paratuberculosis
gcccggugacgaaca

SEQ ID NO: 2895873 - RNA, 17 nt, Mycobacterium avium subsp. paratuberculosis
gcccggugacgaacauc

SEQ ID NO: 2895874 - RNA, 21 nt, Mycobacterium avium subsp. paratuberculosis
gcccggugacgaacaucgacg

SEQ ID NO: 2895875 - RNA, 17 nt, Mycobacterium avium subsp. paratuberculosis
gcccggugagccucagg

SEQ ID NO: 2895876 - RNA, 15 nt, Mycobacterium avium subsp. paratuberculosis
gcccggugaucgccg

SEQ ID NO: 2895877 - RNA, 15 nt, Mycobacterium avium subsp. paratuberculosis
gcccggugccacgau

SEQ ID NO: 2895878 - RNA, 18 nt, Mycobacterium avium subsp. paratuberculosis
gcccggugcgacgccgcg

SEQ ID NO: 2895879 - RNA, 22 nt, Mycobacterium avium subsp. paratuberculosis
gcccggugcgacgccgcgcagc

SEQ ID NO: 2895880 - RNA, 15 nt, Mycobacterium avium subsp. paratuberculosis
gcccggugcgccagc

SEQ ID NO: 2895881 - RNA, 17 nt, Mycobacterium avium subsp. paratuberculosis
gcccggugcgccagcgu

SEQ ID NO: 2895882 - RNA, 18 nt, Mycobacterium avium subsp. paratuberculosis
gcccgguguccacgucgc

SEQ ID NO: 2895883 - RNA, 23 nt, Mycobacterium avium subsp. paratuberculosis
gcccgguguccacgucgcccagc

SEQ ID NO: 2895884 - RNA, 16 nt, Mycobacterium avium subsp. paratuberculosis
gcccgguuccagcggc

SEQ ID NO: 2895885 - RNA, 19 nt, Mycobacterium avium subsp. paratuberculosis
gcccgguugagugcgccgu

SEQ ID NO: 2895886 - RNA, 15 nt, Mycobacterium avium subsp. paratuberculosis
gcccguacucgggug

SEQ ID NO: 2895887 - RNA, 15 nt, Mycobacterium avium subsp. paratuberculosis
gcccgucucggcgug

SEQ ID NO: 2895888 - RNA, 16 nt, Mycobacterium avium subsp. paratuberculosis
gcccgucucggcgugc

SEQ ID NO: 2895889 - RNA, 17 nt, Mycobacterium avium subsp. paratuberculosis
gcccgucucggcgugcu

SEQ ID NO: 2895890 - RNA, 20 nt, Mycobacterium avium subsp. paratuberculosis
gcccgucucggcgugcucgg

SEQ ID NO: 2895891 - RNA, 14 nt, Mycobacterium avium subsp. paratuberculosis
gcccgugaucgcca

SEQ ID NO: 2895892 - RNA, 15 nt, Mycobacterium avium subsp. paratuberculosis
gcccgugaucgccac

SEQ ID NO: 2895893 - RNA, 16 nt, Mycobacterium avium subsp. paratuberculosis
gcccgugaucgccacg

SEQ ID NO: 2895894 - RNA, 18 nt, Mycobacterium avium subsp. paratuberculosis
gcccgugaucgccacggc

SEQ ID NO: 2895895 - RNA, 19 nt, Mycobacterium avium subsp. paratuberculosis
gcccgugaucgccacggcg

SEQ ID NO: 2895896 - RNA, 20 nt, Mycobacterium avium subsp. paratuberculosis
gcccgugaucgccacggcgg

SEQ ID NO: 2895897 - RNA, 21 nt, Mycobacterium avium subsp. paratuberculosis
gcccgugaucgccacggcggu

SEQ ID NO: 2895898 - RNA, 23 nt, Mycobacterium avium subsp. paratuberculosis
gcccgugcauguagguggcgacc

SEQ ID NO: 2895899 - RNA, 14 nt, Mycobacterium avium subsp. paratuberculosis
gcccgugccgaugc

SEQ ID NO: 2895900 - RNA, 19 nt, Mycobacterium avium subsp. paratuberculosis
gcccgugccgaugccggcc

SEQ ID NO: 2895901 - RNA, 20 nt, Mycobacterium avium subsp. paratuberculosis
gcccgugccgaugccggccu

SEQ ID NO: 2895902 - RNA, 16 nt, Mycobacterium avium subsp. paratuberculosis
gcccgugccgcaccug

SEQ ID NO: 2895903 - RNA, 14 nt, Mycobacterium avium subsp. paratuberculosis
gcccgugcgacggc

SEQ ID NO: 2895904 - RNA, 20 nt, Mycobacterium avium subsp. paratuberculosis
gcccgugcggcggggccucg

SEQ ID NO: 2895905 - RNA, 23 nt, Mycobacterium avium subsp. paratuberculosis
gcccgugcggcggggccucgaug

SEQ ID NO: 2895906 - RNA, 20 nt, Mycobacterium avium subsp. paratuberculosis
gcccgugcgggugguccacc

SEQ ID NO: 2895907 - RNA, 16 nt, Mycobacterium avium subsp. paratuberculosis
gcccguggccagcgcc

SEQ ID NO: 2895908 - RNA, 17 nt, Mycobacterium avium subsp. paratuberculosis
gcccguggccagcgcca

SEQ ID NO: 2895909 - RNA, 14 nt, Mycobacterium avium subsp. paratuberculosis
gcccgugucgcggc

SEQ ID NO: 2895910 - RNA, 16 nt, Mycobacterium avium subsp. paratuberculosis
gcccgugucgcggccu

SEQ ID NO: 2895911 - RNA, 19 nt, Mycobacterium avium subsp. paratuberculosis
gcccgugucgcggccuccg

SEQ ID NO: 2895912 - RNA, 14 nt, Mycobacterium avium subsp. paratuberculosis
gcccguucgagcgc

SEQ ID NO: 2895913 - RNA, 17 nt, Mycobacterium avium subsp. paratuberculosis
gcccguucgagcgccgg

SEQ ID NO: 2895914 - RNA, 21 nt, Mycobacterium avium subsp. paratuberculosis
gcccguucgaugaugggcgau

SEQ ID NO: 2895915 - RNA, 23 nt, Mycobacterium avium subsp. paratuberculosis
gcccguucgaugaugggcgaucg

SEQ ID NO: 2895916 - RNA, 13 nt, Mycobacterium avium subsp. paratuberculosis
gcccguugacgcc

SEQ ID NO: 2895917 - RNA, 17 nt, Mycobacterium avium subsp. paratuberculosis
gcccguuguggcggcca

SEQ ID NO: 2895918 - RNA, 20 nt, Mycobacterium avium subsp. paratuberculosis
gcccguuguggcggccagcg

SEQ ID NO: 2895919 - RNA, 20 nt, Mycobacterium avium subsp. paratuberculosis
gcccuacccguccagcgcga

SEQ ID NO: 2895920 - RNA, 23 nt, Mycobacterium avium subsp. paratuberculosis
gcccuagcgguggcguucacagu

SEQ ID NO: 2895921 - RNA, 14 nt, Mycobacterium avium subsp. paratuberculosis
gcccuagucgacgc

SEQ ID NO: 2895922 - RNA, 22 nt, Mycobacterium avium subsp. paratuberculosis
gcccuagucgacgccgauggug

SEQ ID NO: 2895923 - RNA, 15 nt, Mycobacterium avium subsp. paratuberculosis
gcccuauggcaucgc

SEQ ID NO: 2895924 - RNA, 16 nt, Mycobacterium avium subsp. paratuberculosis
gcccuauggcaucgcc

SEQ ID NO: 2895925 - RNA, 15 nt, Mycobacterium avium subsp. paratuberculosis
gcccucaauagcggg

SEQ ID NO: 2895926 - RNA, 17 nt, Mycobacterium avium subsp. paratuberculosis
gcccucaggcguccagc

SEQ ID NO: 2895927 - RNA, 19 nt, Mycobacterium avium subsp. paratuberculosis
gcccucaggcguccagcac

SEQ ID NO: 2895928 - RNA, 22 nt, Mycobacterium avium subsp. paratuberculosis
gcccucaggcguccagcaccug

SEQ ID NO: 2895929 - RNA, 16 nt, Mycobacterium avium subsp. paratuberculosis
gcccucagugcgggua

SEQ ID NO: 2895930 - RNA, 20 nt, Mycobacterium avium subsp. paratuberculosis
gcccucaucgucgacccggc

SEQ ID NO: 2895931 - RNA, 17 nt, Mycobacterium avium subsp. paratuberculosis
gcccuccacggugcgca

SEQ ID NO: 2895932 - RNA, 23 nt, Mycobacterium avium subsp. paratuberculosis
gcccuccacggugcgcaccgaca

SEQ ID NO: 2895933 - RNA, 22 nt, Mycobacterium avium subsp. paratuberculosis
gcccuccacgucgucggacagc

SEQ ID NO: 2895934 - RNA, 22 nt, Mycobacterium avium subsp. paratuberculosis
gcccuccaggaagaacccggcg

SEQ ID NO: 2895935 - RNA, 16 nt, Mycobacterium avium subsp. paratuberculosis
gcccucccccgagucg

SEQ ID NO: 2895936 - RNA, 17 nt, Mycobacterium avium subsp. paratuberculosis
gcccucccccgagucgg

SEQ ID NO: 2895937 - RNA, 18 nt, Mycobacterium avium subsp. paratuberculosis
gcccuccccggccagcac

SEQ ID NO: 2895938 - RNA, 19 nt, Mycobacterium avium subsp. paratuberculosis
gcccuccccggccagcacg

SEQ ID NO: 2895939 - RNA, 13 nt, Mycobacterium avium subsp. paratuberculosis
gcccuccgcggcg

SEQ ID NO: 2895940 - RNA, 14 nt, Mycobacterium avium subsp. paratuberculosis
gcccuccgcggcgc

SEQ ID NO: 2895941 - RNA, 16 nt, Mycobacterium avium subsp. paratuberculosis
gcccuccgcggcgccg

SEQ ID NO: 2895942 - RNA, 21 nt, Mycobacterium avium subsp. paratuberculosis
gcccuccgcggcgccguaggu

SEQ ID NO: 2895943 - RNA, 13 nt, Mycobacterium avium subsp. paratuberculosis
gcccuccucgccg

SEQ ID NO: 2895944 - RNA, 13 nt, Mycobacterium avium subsp. paratuberculosis
gcccuccuggcgg

SEQ ID NO: 2895945 - RNA, 16 nt, Mycobacterium avium subsp. paratuberculosis
gcccuccuggcgggug

SEQ ID NO: 2895946 - RNA, 14 nt, Mycobacterium avium subsp. paratuberculosis
gcccuccuggguga

SEQ ID NO: 2895947 - RNA, 16 nt, Mycobacterium avium subsp. paratuberculosis
gcccuccugggugagu

SEQ ID NO: 2895948 - RNA, 17 nt, Mycobacterium avium subsp. paratuberculosis
gcccucgaagcagaacu

SEQ ID NO: 2895949 - RNA, 20 nt, Mycobacterium avium subsp. paratuberculosis
gcccucgaaguagagccgcu

SEQ ID NO: 2895950 - RNA, 13 nt, Mycobacterium avium subsp. paratuberculosis
gcccucgacaccg

SEQ ID NO: 2895951 - RNA, 18 nt, Mycobacterium avium subsp. paratuberculosis
gcccucgacaccgguggc

SEQ ID NO: 2895952 - RNA, 24 nt, Mycobacterium avium subsp. paratuberculosis
gcccucgagccauaaaccggccgg

SEQ ID NO: 2895953 - RNA, 19 nt, Mycobacterium avium subsp. paratuberculosis
gcccucgauaauggcggcc

SEQ ID NO: 2895954 - RNA, 21 nt, Mycobacterium avium subsp. paratuberculosis
gcccucgauaauggcggccgc

SEQ ID NO: 2895955 - RNA, 22 nt, Mycobacterium avium subsp. paratuberculosis
gcccucgauaauggcggccgcc

SEQ ID NO: 2895956 - RNA, 14 nt, Mycobacterium avium subsp. paratuberculosis
gcccucgaucgcga

SEQ ID NO: 2895957 - RNA, 16 nt, Mycobacterium avium subsp. paratuberculosis
gcccucgaucgcgacc

SEQ ID NO: 2895958 - RNA, 20 nt, Mycobacterium avium subsp. paratuberculosis
gcccucgaucgcgaccaccg

SEQ ID NO: 2895959 - RNA, 21 nt, Mycobacterium avium subsp. paratuberculosis
gcccucgaucgcgaccaccgg

SEQ ID NO: 2895960 - RNA, 22 nt, Mycobacterium avium subsp. paratuberculosis
gcccucgaucgcgaccaccggc

SEQ ID NO: 2895961 - RNA, 23 nt, Mycobacterium avium subsp. paratuberculosis
gcccucgaucgcgaccaccggcc

SEQ ID NO: 2895962 - RNA, 14 nt, Mycobacterium avium subsp. paratuberculosis
gcccucgccccgga

SEQ ID NO: 2895963 - RNA, 21 nt, Mycobacterium avium subsp. paratuberculosis
gcccucgccgaaccggggccg

SEQ ID NO: 2895964 - RNA, 20 nt, Mycobacterium avium subsp. paratuberculosis
gcccucgccgcggucaucga

SEQ ID NO: 2895965 - RNA, 12 nt, Mycobacterium avium subsp. paratuberculosis
gcccucgccggc

SEQ ID NO: 2895966 - RNA, 14 nt, Mycobacterium avium subsp. paratuberculosis
gcccucgccggcgg

SEQ ID NO: 2895967 - RNA, 17 nt, Mycobacterium avium subsp. paratuberculosis
gcccucgccggcggcgc

SEQ ID NO: 2895968 - RNA, 15 nt, Mycobacterium avium subsp. paratuberculosis
gcccucgccggucag

SEQ ID NO: 2895969 - RNA, 17 nt, Mycobacterium avium subsp. paratuberculosis
gcccucgccggucagcg

SEQ ID NO: 2895970 - RNA, 15 nt, Mycobacterium avium subsp. paratuberculosis
gcccucgcgcagggc

SEQ ID NO: 2895971 - RNA, 16 nt, Mycobacterium avium subsp. paratuberculosis
gcccuggugcaacacc

SEQ ID NO: 2895972 - RNA, 20 nt, Mycobacterium avium subsp. paratuberculosis
gcccugguugagcaccgcga

SEQ ID NO: 2895973 - RNA, 19 nt, Mycobacterium avium subsp. paratuberculosis
gcccugguugauccagcgg

SEQ ID NO: 2895974 - RNA, 20 nt, Mycobacterium avium subsp. paratuberculosis
gcccugguugauccagcggc

SEQ ID NO: 2895975 - RNA, 21 nt, Mycobacterium avium subsp. paratuberculosis
gcccugguugauccagcggcg

SEQ ID NO: 2895976 - RNA, 17 nt, Mycobacterium avium subsp. paratuberculosis
gcccugugaggcguugg

SEQ ID NO: 2895977 - RNA, 16 nt, Mycobacterium avium subsp. paratuberculosis
gcccuguucgccgucg

SEQ ID NO: 2895978 - RNA, 17 nt, Mycobacterium avium subsp. paratuberculosis
gcccuguucgccgucgc

SEQ ID NO: 2895979 - RNA, 23 nt, Mycobacterium avium subsp. paratuberculosis
gcccuguucgccgucgcgggugg

SEQ ID NO: 2895980 - RNA, 14 nt, Mycobacterium avium subsp. paratuberculosis
gcccuucaccucgg

SEQ ID NO: 2895981 - RNA, 15 nt, Mycobacterium avium subsp. paratuberculosis
gcccuucaccucggc

SEQ ID NO: 2895982 - RNA, 12 nt, Mycobacterium avium subsp. paratuberculosis
gcccuuccagca

SEQ ID NO: 2895983 - RNA, 16 nt, Mycobacterium avium subsp. paratuberculosis
gcccuuccccggcggc

SEQ ID NO: 2895984 - RNA, 18 nt, Mycobacterium avium subsp. paratuberculosis
gcccuuccccggcggccg

SEQ ID NO: 2895985 - RNA, 20 nt, Mycobacterium avium subsp. paratuberculosis
gcccuuccccggcggccggc

SEQ ID NO: 2895986 - RNA, 18 nt, Mycobacterium avium subsp. paratuberculosis
gcccuugaacggcaccag

SEQ ID NO: 2895987 - RNA, 20 nt, Mycobacterium avium subsp. paratuberculosis
gcccuugaacggcaccagcg

SEQ ID NO: 2895988 - RNA, 21 nt, Mycobacterium avium subsp. paratuberculosis
gcccuugaacggcaccagcgg

SEQ ID NO: 2895989 - RNA, 22 nt, Mycobacterium avium subsp. paratuberculosis
gcccuugaagcgcagaucgcgc

SEQ ID NO: 2895990 - RNA, 15 nt, Mycobacterium avium subsp. paratuberculosis
gcccuugaccgccug

SEQ ID NO: 2895991 - RNA, 23 nt, Mycobacterium avium subsp. paratuberculosis
gcccuugaucgucuugccgaaga

SEQ ID NO: 2895992 - RNA, 19 nt, Mycobacterium avium subsp. paratuberculosis
gcccuugcagcacaccggc

SEQ ID NO: 2895993 - RNA, 21 nt, Mycobacterium avium subsp. paratuberculosis
gcccuugcagcacaccggcau

SEQ ID NO: 2895994 - RNA, 16 nt, Mycobacterium avium subsp. paratuberculosis
gcccuugccccaccac

SEQ ID NO: 2895995 - RNA, 22 nt, Mycobacterium avium subsp. paratuberculosis
gcccuugccccaccaccgccgg

SEQ ID NO: 2895996 - RNA, 23 nt, Mycobacterium avium subsp. paratuberculosis
gcccuugccccaccaccgccggc

SEQ ID NO: 2895997 - RNA, 12 nt, Mycobacterium avium subsp. paratuberculosis
gcccuugccgau

SEQ ID NO: 2895998 - RNA, 17 nt, Mycobacterium avium subsp. paratuberculosis
gcccuuggacaccugca

SEQ ID NO: 2895999 - RNA, 16 nt, Mycobacterium avium subsp. paratuberculosis
gcccuuggccagcagu

SEQ ID NO: 2896000 - RNA, 17 nt, Mycobacterium avium subsp. paratuberculosis
gcccuuggcccgggcgu

SEQ ID NO: 2896001 - RNA, 15 nt, Mycobacterium avium subsp. paratuberculosis
gcccuuggcgcccag

SEQ ID NO: 2896002 - RNA, 23 nt, Mycobacterium avium subsp. paratuberculosis
gcccuuggcgcccagcgugguca

SEQ ID NO: 2896003 - RNA, 16 nt, Mycobacterium avium subsp. paratuberculosis
gcccuuggcggccacg

SEQ ID NO: 2896004 - RNA, 21 nt, Mycobacterium avium subsp. paratuberculosis
gcccuugguguaggcgaucgg

SEQ ID NO: 2896005 - RNA, 16 nt, Mycobacterium avium subsp. paratuberculosis
gcccuugucgcuggcg

SEQ ID NO: 2896006 - RNA, 22 nt, Mycobacterium avium subsp. paratuberculosis
gcccuugugguugcgugacuug

SEQ ID NO: 2896007 - RNA, 18 nt, Mycobacterium avium subsp. paratuberculosis
gcccuuguugacguaccg

SEQ ID NO: 2896008 - RNA, 16 nt, Mycobacterium avium subsp. paratuberculosis
gcccuuuacccggacg

SEQ ID NO: 2896009 - RNA, 18 nt, Mycobacterium avium subsp. paratuberculosis
gccgaaaaaccugcggug

SEQ ID NO: 2896010 - RNA, 21 nt, Mycobacterium avium subsp. paratuberculosis
gccgaaaaaccugcggugcca

SEQ ID NO: 2896011 - RNA, 22 nt, Mycobacterium avium subsp. paratuberculosis
gccgaaaaacgcgacggcccgg

SEQ ID NO: 2896012 - RNA, 15 nt, Mycobacterium avium subsp. paratuberculosis
gccgaaacgcccggc

SEQ ID NO: 2896013 - RNA, 19 nt, Mycobacterium avium subsp. paratuberculosis
gccgaaacgcccggcucaa

SEQ ID NO: 2896014 - RNA, 16 nt, Mycobacterium avium subsp. paratuberculosis
gccgaaagccuccgcg

SEQ ID NO: 2896015 - RNA, 19 nt, Mycobacterium avium subsp. paratuberculosis
gccgaaagccuccgcgauc

SEQ ID NO: 2896016 - RNA, 15 nt, Mycobacterium avium subsp. paratuberculosis
gccgaaagguuuucc

SEQ ID NO: 2896017 - RNA, 20 nt, Mycobacterium avium subsp. paratuberculosis
gccgaaagguuuucccggcc

SEQ ID NO: 2896018 - RNA, 14 nt, Mycobacterium avium subsp. paratuberculosis
gccgaaaucaacgc

SEQ ID NO: 2896019 - RNA, 18 nt, Mycobacterium avium subsp. paratuberculosis
gccgaaaucaacgcgccg

SEQ ID NO: 2896020 - RNA, 19 nt, Mycobacterium avium subsp. paratuberculosis
gccgaaaucaacgcgccga

SEQ ID NO: 2896021 - RNA, 15 nt, Mycobacterium avium subsp. paratuberculosis
gccgaaaugccgugc

SEQ ID NO: 2896022 - RNA, 23 nt, Mycobacterium avium subsp. paratuberculosis
gccgaaaugccgugccagccggc

SEQ ID NO: 2896023 - RNA, 15 nt, Mycobacterium avium subsp. paratuberculosis
gccgaacaacagggc

SEQ ID NO: 2896024 - RNA, 23 nt, Mycobacterium avium subsp. paratuberculosis
gccgaacaacggcggaccggcgg

SEQ ID NO: 2896025 - RNA, 13 nt, Mycobacterium avium subsp. paratuberculosis
gccgaacaccggc

SEQ ID NO: 2896026 - RNA, 16 nt, Mycobacterium avium subsp. paratuberculosis
gccgaacaccggcagc

SEQ ID NO: 2896027 - RNA, 20 nt, Mycobacterium avium subsp. paratuberculosis
gccgaacaccggcagcgcca

SEQ ID NO: 2896028 - RNA, 22 nt, Mycobacterium avium subsp. paratuberculosis
gccgaacaccggcagcgccacc

SEQ ID NO: 2896029 - RNA, 22 nt, Mycobacterium avium subsp. paratuberculosis
gccgaacaccgucaucgugugg

SEQ ID NO: 2896030 - RNA, 16 nt, Mycobacterium avium subsp. paratuberculosis
gccgaacaccugcggc

SEQ ID NO: 2896031 - RNA, 17 nt, Mycobacterium avium subsp. paratuberculosis
gccgaacaccugcggcg

SEQ ID NO: 2896032 - RNA, 22 nt, Mycobacterium avium subsp. paratuberculosis
gccgaacaccugcggcggcagu

SEQ ID NO: 2896033 - RNA, 19 nt, Mycobacterium avium subsp. paratuberculosis
gccgaacacguacagcggc

SEQ ID NO: 2896034 - RNA, 20 nt, Mycobacterium avium subsp. paratuberculosis
gccgaacacguacagcggcg

SEQ ID NO: 2896035 - RNA, 21 nt, Mycobacterium avium subsp. paratuberculosis
gccgaacacguacagcggcgg

SEQ ID NO: 2896036 - RNA, 18 nt, Mycobacterium avium subsp. paratuberculosis
gccgaacagaugccugcc

SEQ ID NO: 2896037 - RNA, 23 nt, Mycobacterium avium subsp. paratuberculosis
gccgaacagcagcgaacccgcca

SEQ ID NO: 2896038 - RNA, 16 nt, Mycobacterium avium subsp. paratuberculosis
gccgaacagcgacguc

SEQ ID NO: 2896039 - RNA, 22 nt, Mycobacterium avium subsp. paratuberculosis
gccgaacagcgacgucugcggc

SEQ ID NO: 2896040 - RNA, 12 nt, Mycobacterium avium subsp. paratuberculosis
gccgaacaggcg

SEQ ID NO: 2896041 - RNA, 14 nt, Mycobacterium avium subsp. paratuberculosis
gccgaacaggcgca

SEQ ID NO: 2896042 - RNA, 21 nt, Mycobacterium avium subsp. paratuberculosis
gccgaacaggcgcaacagcac

SEQ ID NO: 2896043 - RNA, 13 nt, Mycobacterium avium subsp. paratuberculosis
gccgaacaucagc

SEQ ID NO: 2896044 - RNA, 13 nt, Mycobacterium avium subsp. paratuberculosis
gccgaaccagauc

SEQ ID NO: 2896045 - RNA, 23 nt, Mycobacterium avium subsp. paratuberculosis
gccgaacccgcccucgccccgga

SEQ ID NO: 2896046 - RNA, 19 nt, Mycobacterium avium subsp. paratuberculosis
gccgaaccgaucaccggca

SEQ ID NO: 2896047 - RNA, 21 nt, Mycobacterium avium subsp. paratuberculosis
gccgaaccgaucaccggcagc

SEQ ID NO: 2896048 - RNA, 16 nt, Mycobacterium avium subsp. paratuberculosis
gccgaaccgcugcgga

SEQ ID NO: 2896049 - RNA, 18 nt, Mycobacterium avium subsp. paratuberculosis
gccgaaccggaucuggcc

SEQ ID NO: 2896050 - RNA, 16 nt, Mycobacterium avium subsp. paratuberculosis
gccgaaccgggcgcgc

SEQ ID NO: 2896051 - RNA, 15 nt, Mycobacterium avium subsp. paratuberculosis
gccgaaccggggccg

SEQ ID NO: 2896052 - RNA, 14 nt, Mycobacterium avium subsp. paratuberculosis
gccgaaccguccca

SEQ ID NO: 2896053 - RNA, 15 nt, Mycobacterium avium subsp. paratuberculosis
gccgaacgacagcag

SEQ ID NO: 2896054 - RNA, 13 nt, Mycobacterium avium subsp. paratuberculosis
gccgaacgcacca

SEQ ID NO: 2896055 - RNA, 15 nt, Mycobacterium avium subsp. paratuberculosis
gccgaauccggcggg

SEQ ID NO: 2896056 - RNA, 23 nt, Mycobacterium avium subsp. paratuberculosis
gccgaaucggcuguggcgcacag

SEQ ID NO: 2896057 - RNA, 12 nt, Mycobacterium avium subsp. paratuberculosis
gccgaauucggu

SEQ ID NO: 2896058 - RNA, 21 nt, Mycobacterium avium subsp. paratuberculosis
gccgaauugcuuacgcaucgc

SEQ ID NO: 2896059 - RNA, 15 nt, Mycobacterium avium subsp. paratuberculosis
gccgaauuguucggc

SEQ ID NO: 2896060 - RNA, 19 nt, Mycobacterium avium subsp. paratuberculosis
gccgaauuguucggccacc

SEQ ID NO: 2896061 - RNA, 20 nt, Mycobacterium avium subsp. paratuberculosis
gccgaauuguucggccaccg

SEQ ID NO: 2896062 - RNA, 22 nt, Mycobacterium avium subsp. paratuberculosis
gccgaauuguucggccaccgcg

SEQ ID NO: 2896063 - RNA, 23 nt, Mycobacterium avium subsp. paratuberculosis
gccgaauuguucggccaccgcgc

SEQ ID NO: 2896064 - RNA, 19 nt, Mycobacterium avium subsp. paratuberculosis
gccgacaacauccgcgacg

SEQ ID NO: 2896065 - RNA, 20 nt, Mycobacterium avium subsp. paratuberculosis
gccgacaacauccgcgacga

SEQ ID NO: 2896066 - RNA, 23 nt, Mycobacterium avium subsp. paratuberculosis
gccgacaacgacagcacccaggu

SEQ ID NO: 2896067 - RNA, 13 nt, Mycobacterium avium subsp. paratuberculosis
gccgacaccagcg

SEQ ID NO: 2896068 - RNA, 16 nt, Mycobacterium avium subsp. paratuberculosis
gccgacaccagcgcgc

SEQ ID NO: 2896069 - RNA, 18 nt, Mycobacterium avium subsp. paratuberculosis
gccgacaccagcgcgcac

SEQ ID NO: 2896070 - RNA, 22 nt, Mycobacterium avium subsp. paratuberculosis
gccgacaccagcgcgcacgcgg

SEQ ID NO: 2896071 - RNA, 18 nt, Mycobacterium avium subsp. paratuberculosis
gccgacaccccacaccgu

SEQ ID NO: 2896072 - RNA, 19 nt, Mycobacterium avium subsp. paratuberculosis
gccgacaccccacaccguc

SEQ ID NO: 2896073 - RNA, 22 nt, Mycobacterium avium subsp. paratuberculosis
gccgacaccccacaccguccga

SEQ ID NO: 2896074 - RNA, 24 nt, Mycobacterium avium subsp. paratuberculosis
gccgacaccccacaccguccgacc

SEQ ID NO: 2896075 - RNA, 20 nt, Mycobacterium avium subsp. paratuberculosis
gccgacaccccgaugccgaa

SEQ ID NO: 2896076 - RNA, 20 nt, Mycobacterium avium subsp. paratuberculosis
gccgacaccgggucccccgc

SEQ ID NO: 2896077 - RNA, 23 nt, Mycobacterium avium subsp. paratuberculosis
gccgacaccgggucccccgccga

SEQ ID NO: 2896078 - RNA, 17 nt, Mycobacterium avium subsp. paratuberculosis
gccgacacguaggccgc

SEQ ID NO: 2896079 - RNA, 16 nt, Mycobacterium avium subsp. paratuberculosis
gccgacagacccgaca

SEQ ID NO: 2896080 - RNA, 20 nt, Mycobacterium avium subsp. paratuberculosis
gccgacagacccgacagucc

SEQ ID NO: 2896081 - RNA, 20 nt, Mycobacterium avium subsp. paratuberculosis
gccgacagaugcggcaccag

SEQ ID NO: 2896082 - RNA, 18 nt, Mycobacterium avium subsp. paratuberculosis
gccgacagcaccucgccc

SEQ ID NO: 2896083 - RNA, 16 nt, Mycobacterium avium subsp. paratuberculosis
gccgacagcacgccgg

SEQ ID NO: 2896084 - RNA, 18 nt, Mycobacterium avium subsp. paratuberculosis
gccgacagcacgccgggc

SEQ ID NO: 2896085 - RNA, 21 nt, Mycobacterium avium subsp. paratuberculosis
gccgacagcagcucauacagc

SEQ ID NO: 2896086 - RNA, 16 nt, Mycobacterium avium subsp. paratuberculosis
gccgacagcgcgucgg

SEQ ID NO: 2896087 - RNA, 19 nt, Mycobacterium avium subsp. paratuberculosis
gccgacagcgcgucggcga

SEQ ID NO: 2896088 - RNA, 13 nt, Mycobacterium avium subsp. paratuberculosis
gccgacagcgucg

SEQ ID NO: 2896089 - RNA, 17 nt, Mycobacterium avium subsp. paratuberculosis
gccgacagcgucgucca

SEQ ID NO: 2896090 - RNA, 14 nt, Mycobacterium avium subsp. paratuberculosis
gccgacagcugagc

SEQ ID NO: 2896091 - RNA, 18 nt, Mycobacterium avium subsp. paratuberculosis
gccgacagcugagcagcc

SEQ ID NO: 2896092 - RNA, 21 nt, Mycobacterium avium subsp. paratuberculosis
gccgacagcugagcagcccga

SEQ ID NO: 2896093 - RNA, 23 nt, Mycobacterium avium subsp. paratuberculosis
gccgacagcugagcagcccgacc

SEQ ID NO: 2896094 - RNA, 16 nt, Mycobacterium avium subsp. paratuberculosis
gccgacagggugccaa

SEQ ID NO: 2896095 - RNA, 13 nt, Mycobacterium avium subsp. paratuberculosis
gccgacagguagc

SEQ ID NO: 2896096 - RNA, 19 nt, Mycobacterium avium subsp. paratuberculosis
gccgacagguagcaggcgc

SEQ ID NO: 2896097 - RNA, 23 nt, Mycobacterium avium subsp. paratuberculosis
gccgacagguagcaggcgcgcag

SEQ ID NO: 2896098 - RNA, 12 nt, Mycobacterium avium subsp. paratuberculosis
gccgacagucgc

SEQ ID NO: 2896099 - RNA, 19 nt, Mycobacterium avium subsp. paratuberculosis
gccgacagucgcgggcagc

SEQ ID NO: 2896100 - RNA, 23 nt, Mycobacterium avium subsp. paratuberculosis
gccgacagucgcgggcagccggc

SEQ ID NO: 2896101 - RNA, 18 nt, Mycobacterium avium subsp. paratuberculosis
gccgacagucgcgggcgg

SEQ ID NO: 2896102 - RNA, 21 nt, Mycobacterium avium subsp. paratuberculosis
gccgacagucgcgggcggggc

SEQ ID NO: 2896103 - RNA, 14 nt, Mycobacterium avium subsp. paratuberculosis
gccgacauccgggu

SEQ ID NO: 2896104 - RNA, 14 nt, Mycobacterium avium subsp. paratuberculosis
gccgacaucgcccg

SEQ ID NO: 2896105 - RNA, 17 nt, Mycobacterium avium subsp. paratuberculosis
gccgacaucgcccgguc

SEQ ID NO: 2896106 - RNA, 16 nt, Mycobacterium avium subsp. paratuberculosis
gccgacaucgcggcga

SEQ ID NO: 2896107 - RNA, 17 nt, Mycobacterium avium subsp. paratuberculosis
gccgacaucgcggcgau

SEQ ID NO: 2896108 - RNA, 15 nt, Mycobacterium avium subsp. paratuberculosis
gccgacaucgucggc

SEQ ID NO: 2896109 - RNA, 19 nt, Mycobacterium avium subsp. paratuberculosis
gccgacaucgucggcucgu

SEQ ID NO: 2896110 - RNA, 15 nt, Mycobacterium avium subsp. paratuberculosis
gccgacaucucccgg

SEQ ID NO: 2896111 - RNA, 13 nt, Mycobacterium avium subsp. paratuberculosis
gccgacaugcugg

SEQ ID NO: 2896112 - RNA, 18 nt, Mycobacterium avium subsp. paratuberculosis
gccgacauggacgcggcc

SEQ ID NO: 2896113 - RNA, 19 nt, Mycobacterium avium subsp. paratuberculosis
gccgacauggacgcggccu

SEQ ID NO: 2896114 - RNA, 21 nt, Mycobacterium avium subsp. paratuberculosis
gccgacauggacgcggccuca

SEQ ID NO: 2896115 - RNA, 20 nt, Mycobacterium avium subsp. paratuberculosis
gccgaccaacacccccgcgc

SEQ ID NO: 2896116 - RNA, 21 nt, Mycobacterium avium subsp. paratuberculosis
gccgaccaacacccccgcgcu

SEQ ID NO: 2896117 - RNA, 22 nt, Mycobacterium avium subsp. paratuberculosis
gccgaccaacacccccgcgcug

SEQ ID NO: 2896118 - RNA, 23 nt, Mycobacterium avium subsp. paratuberculosis
gccgaccaacacccccgcgcugc

SEQ ID NO: 2896119 - RNA, 15 nt, Mycobacterium avium subsp. paratuberculosis
gccgaccaacgggcg

SEQ ID NO: 2896120 - RNA, 19 nt, Mycobacterium avium subsp. paratuberculosis
gccgaccaacgggcggcgg

SEQ ID NO: 2896121 - RNA, 14 nt, Mycobacterium avium subsp. paratuberculosis
gccgaccaccccca

SEQ ID NO: 2896122 - RNA, 20 nt, Mycobacterium avium subsp. paratuberculosis
gccgaccacccccagcccgc

SEQ ID NO: 2896123 - RNA, 23 nt, Mycobacterium avium subsp. paratuberculosis
gccgaccacccccagcccgccgg

SEQ ID NO: 2896124 - RNA, 20 nt, Mycobacterium avium subsp. paratuberculosis
gccgaccaccuugcgcagca

SEQ ID NO: 2896125 - RNA, 23 nt, Mycobacterium avium subsp. paratuberculosis
gccgaccaccuugcgcagcagca

SEQ ID NO: 2896126 - RNA, 15 nt, Mycobacterium avium subsp. paratuberculosis
gccgaccacgccgcg

SEQ ID NO: 2896127 - RNA, 16 nt, Mycobacterium avium subsp. paratuberculosis
gccgaccacgccgcgc

SEQ ID NO: 2896128 - RNA, 17 nt, Mycobacterium avium subsp. paratuberculosis
gccgaccacgccgcgcu

SEQ ID NO: 2896129 - RNA, 13 nt, Mycobacterium avium subsp. paratuberculosis
gccgaccacggcc

SEQ ID NO: 2896130 - RNA, 18 nt, Mycobacterium avium subsp. paratuberculosis
gccgaccacggccccagc

SEQ ID NO: 2896131 - RNA, 19 nt, Mycobacterium avium subsp. paratuberculosis
gccgaccagcaggacgcgc

SEQ ID NO: 2896132 - RNA, 20 nt, Mycobacterium avium subsp. paratuberculosis
gccgaccagcaggacgcgcc

SEQ ID NO: 2896133 - RNA, 18 nt, Mycobacterium avium subsp. paratuberculosis
gccgaccagccgaggcgc

SEQ ID NO: 2896134 - RNA, 13 nt, Mycobacterium avium subsp. paratuberculosis
gccgaccagcgcg

SEQ ID NO: 2896135 - RNA, 14 nt, Mycobacterium avium subsp. paratuberculosis
gccgaccagcgcgu

SEQ ID NO: 2896136 - RNA, 15 nt, Mycobacterium avium subsp. paratuberculosis
gccgaccagcgcguu

SEQ ID NO: 2896137 - RNA, 16 nt, Mycobacterium avium subsp. paratuberculosis
gccgaccagcgcguug

SEQ ID NO: 2896138 - RNA, 19 nt, Mycobacterium avium subsp. paratuberculosis
gccgaccagcgcguugaug

SEQ ID NO: 2896139 - RNA, 15 nt, Mycobacterium avium subsp. paratuberculosis
gccgacgauccgggc

SEQ ID NO: 2896140 - RNA, 16 nt, Mycobacterium avium subsp. paratuberculosis
gccgacgauccgggcg

SEQ ID NO: 2896141 - RNA, 19 nt, Mycobacterium avium subsp. paratuberculosis
gccgacgauccgggcgccc

SEQ ID NO: 2896142 - RNA, 20 nt, Mycobacterium avium subsp. paratuberculosis
gccgacgauccgggcgcccu

SEQ ID NO: 2896143 - RNA, 21 nt, Mycobacterium avium subsp. paratuberculosis
gccgacgaugaacagucggcc

SEQ ID NO: 2896144 - RNA, 21 nt, Mycobacterium avium subsp. paratuberculosis
gccgacgaugucgaaacccag

SEQ ID NO: 2896145 - RNA, 15 nt, Mycobacterium avium subsp. paratuberculosis
gccgacgaugucggc

SEQ ID NO: 2896146 - RNA, 17 nt, Mycobacterium avium subsp. paratuberculosis
gccgacgcauguccgcc

SEQ ID NO: 2896147 - RNA, 21 nt, Mycobacterium avium subsp. paratuberculosis
gccgacgcauguccgccguca

SEQ ID NO: 2896148 - RNA, 22 nt, Mycobacterium avium subsp. paratuberculosis
gccgacgcccacagcgccagca

SEQ ID NO: 2896149 - RNA, 14 nt, Mycobacterium avium subsp. paratuberculosis
gccgacgcccagcg

SEQ ID NO: 2896150 - RNA, 15 nt, Mycobacterium avium subsp. paratuberculosis
gccgacgcccagcgc

SEQ ID NO: 2896151 - RNA, 18 nt, Mycobacterium avium subsp. paratuberculosis
gccgacgcccagcgcggc

SEQ ID NO: 2896152 - RNA, 20 nt, Mycobacterium avium subsp. paratuberculosis
gccgacgcccagcgcggcga

SEQ ID NO: 2896153 - RNA, 13 nt, Mycobacterium avium subsp. paratuberculosis
gccgacgcccagg

SEQ ID NO: 2896154 - RNA, 14 nt, Mycobacterium avium subsp. paratuberculosis
gccgacgcccaggc

SEQ ID NO: 2896155 - RNA, 15 nt, Mycobacterium avium subsp. paratuberculosis
gccgacgcccaggcu

SEQ ID NO: 2896156 - RNA, 16 nt, Mycobacterium avium subsp. paratuberculosis
gccgacgccgaagauc

SEQ ID NO: 2896157 - RNA, 15 nt, Mycobacterium avium subsp. paratuberculosis
gccgacgccggccac

SEQ ID NO: 2896158 - RNA, 22 nt, Mycobacterium avium subsp. paratuberculosis
gccgacgccggccaccaacagg

SEQ ID NO: 2896159 - RNA, 17 nt, Mycobacterium avium subsp. paratuberculosis
gccgacgccgucgauga

SEQ ID NO: 2896160 - RNA, 23 nt, Mycobacterium avium subsp. paratuberculosis
gccgacgccgucgaugacgcgcu

SEQ ID NO: 2896161 - RNA, 20 nt, Mycobacterium avium subsp. paratuberculosis
gccgacgccguuucggaucc

SEQ ID NO: 2896162 - RNA, 16 nt, Mycobacterium avium subsp. paratuberculosis
gccgacgccugcgcga

SEQ ID NO: 2896163 - RNA, 12 nt, Mycobacterium avium subsp. paratuberculosis
gccgacgcgccg

SEQ ID NO: 2896164 - RNA, 14 nt, Mycobacterium avium subsp. paratuberculosis
gccgacgcgccguc

SEQ ID NO: 2896165 - RNA, 15 nt, Mycobacterium avium subsp. paratuberculosis
gccgacgcgccgucg

SEQ ID NO: 2896166 - RNA, 16 nt, Mycobacterium avium subsp. paratuberculosis
gccgacgcgccgucgg

SEQ ID NO: 2896167 - RNA, 17 nt, Mycobacterium avium subsp. paratuberculosis
gccgacgcgcugcgcgc

SEQ ID NO: 2896168 - RNA, 20 nt, Mycobacterium avium subsp. paratuberculosis
gccgacgcgcugcgcgccgc

SEQ ID NO: 2896169 - RNA, 22 nt, Mycobacterium avium subsp. paratuberculosis
gccgacgcgcugcgcgccgccc

SEQ ID NO: 2896170 - RNA, 16 nt, Mycobacterium avium subsp. paratuberculosis
gccgacgcggccucga

SEQ ID NO: 2896171 - RNA, 17 nt, Mycobacterium avium subsp. paratuberculosis
gccgacgcuggccgaga

SEQ ID NO: 2896172 - RNA, 18 nt, Mycobacterium avium subsp. paratuberculosis
gccgacggagacgaccag

SEQ ID NO: 2896173 - RNA, 20 nt, Mycobacterium avium subsp. paratuberculosis
gccgacggagacgaccaggu

SEQ ID NO: 2896174 - RNA, 21 nt, Mycobacterium avium subsp. paratuberculosis
gccgacggagacgaccagguc

SEQ ID NO: 2896175 - RNA, 14 nt, Mycobacterium avium subsp. paratuberculosis
gccgacggccagca

SEQ ID NO: 2896176 - RNA, 16 nt, Mycobacterium avium subsp. paratuberculosis
gccgacggccagcagg

SEQ ID NO: 2896177 - RNA, 17 nt, Mycobacterium avium subsp. paratuberculosis
gccgacggccagcagga

SEQ ID NO: 2896178 - RNA, 18 nt, Mycobacterium avium subsp. paratuberculosis
gccgacggccagcaggau

SEQ ID NO: 2896179 - RNA, 13 nt, Mycobacterium avium subsp. paratuberculosis
gccgacggccgcg

SEQ ID NO: 2896180 - RNA, 15 nt, Mycobacterium avium subsp. paratuberculosis
gccgacggccgcgcc

SEQ ID NO: 2896181 - RNA, 16 nt, Mycobacterium avium subsp. paratuberculosis
gccgacggcgccggug

SEQ ID NO: 2896182 - RNA, 17 nt, Mycobacterium avium subsp. paratuberculosis
gccgacggcgccggugc

SEQ ID NO: 2896183 - RNA, 18 nt, Mycobacterium avium subsp. paratuberculosis
gccgacggcgccggugcc

SEQ ID NO: 2896184 - RNA, 19 nt, Mycobacterium avium subsp. paratuberculosis
gccgacggcgccggugccc

SEQ ID NO: 2896185 - RNA, 20 nt, Mycobacterium avium subsp. paratuberculosis
gccgacggcgccggugccca

SEQ ID NO: 2896186 - RNA, 19 nt, Mycobacterium avium subsp. paratuberculosis
gccgacggcugcccggccc

SEQ ID NO: 2896187 - RNA, 17 nt, Mycobacterium avium subsp. paratuberculosis
gccgacgggcccagcgc

SEQ ID NO: 2896188 - RNA, 19 nt, Mycobacterium avium subsp. paratuberculosis
gccgacgggcccagcgcga

SEQ ID NO: 2896189 - RNA, 15 nt, Mycobacterium avium subsp. paratuberculosis
gccgacgggcccgcg

SEQ ID NO: 2896190 - RNA, 18 nt, Mycobacterium avium subsp. paratuberculosis
gccgacgggcccgcgccu

SEQ ID NO: 2896191 - RNA, 18 nt, Mycobacterium avium subsp. paratuberculosis
gccgacggugagcaccgc

SEQ ID NO: 2896192 - RNA, 21 nt, Mycobacterium avium subsp. paratuberculosis
gccgacggugagcaccgccgu

SEQ ID NO: 2896193 - RNA, 13 nt, Mycobacterium avium subsp. paratuberculosis
gccgacgguggcc

SEQ ID NO: 2896194 - RNA, 19 nt, Mycobacterium avium subsp. paratuberculosis
gccgacgguggcccccacc

SEQ ID NO: 2896195 - RNA, 17 nt, Mycobacterium avium subsp. paratuberculosis
gccgacgguggcgaagc

SEQ ID NO: 2896196 - RNA, 21 nt, Mycobacterium avium subsp. paratuberculosis
gccgacgguggcgaagcacga

SEQ ID NO: 2896197 - RNA, 14 nt, Mycobacterium avium subsp. paratuberculosis
gccgacgguguccg

SEQ ID NO: 2896198 - RNA, 19 nt, Mycobacterium avium subsp. paratuberculosis
gccgacgguguccgcgggc

SEQ ID NO: 2896199 - RNA, 23 nt, Mycobacterium avium subsp. paratuberculosis
gccgacguaaccguacggcccga

SEQ ID NO: 2896200 - RNA, 22 nt, Mycobacterium avium subsp. paratuberculosis
gccgacguagacgagccgguug

SEQ ID NO: 2896201 - RNA, 18 nt, Mycobacterium avium subsp. paratuberculosis
gccgacguaggacagcac

SEQ ID NO: 2896202 - RNA, 20 nt, Mycobacterium avium subsp. paratuberculosis
gccgacguaggacagcacca

SEQ ID NO: 2896203 - RNA, 21 nt, Mycobacterium avium subsp. paratuberculosis
gccgacguaggacagcaccac

SEQ ID NO: 2896204 - RNA, 22 nt, Mycobacterium avium subsp. paratuberculosis
gccgacguaggacagcaccaca

SEQ ID NO: 2896205 - RNA, 19 nt, Mycobacterium avium subsp. paratuberculosis
gccgacgucaggggugccg

SEQ ID NO: 2896206 - RNA, 17 nt, Mycobacterium avium subsp. paratuberculosis
gccgacgucccagcaca

SEQ ID NO: 2896207 - RNA, 13 nt, Mycobacterium avium subsp. paratuberculosis
gccgacguccugg

SEQ ID NO: 2896208 - RNA, 19 nt, Mycobacterium avium subsp. paratuberculosis
gccgacguccuggaucgcg

SEQ ID NO: 2896209 - RNA, 22 nt, Mycobacterium avium subsp. paratuberculosis
gccgacguccuggaucgcgcag

SEQ ID NO: 2896210 - RNA, 14 nt, Mycobacterium avium subsp. paratuberculosis
gccgacgucgguga

SEQ ID NO: 2896211 - RNA, 22 nt, Mycobacterium avium subsp. paratuberculosis
gccgacgucucauaccagugcc

SEQ ID NO: 2896212 - RNA, 18 nt, Mycobacterium avium subsp. paratuberculosis
gccgacgucugguuggcc

SEQ ID NO: 2896213 - RNA, 23 nt, Mycobacterium avium subsp. paratuberculosis
gccgacgucugguuggccggcgg

SEQ ID NO: 2896214 - RNA, 20 nt, Mycobacterium avium subsp. paratuberculosis
gccgacgugaugcacccgga

SEQ ID NO: 2896215 - RNA, 16 nt, Mycobacterium avium subsp. paratuberculosis
gccgacgugcccgauc

SEQ ID NO: 2896216 - RNA, 23 nt, Mycobacterium avium subsp. paratuberculosis
gccgacgugcccgaucucgucgg

SEQ ID NO: 2896217 - RNA, 14 nt, Mycobacterium avium subsp. paratuberculosis
gccgacgugccggu

SEQ ID NO: 2896218 - RNA, 15 nt, Mycobacterium avium subsp. paratuberculosis
gccgacgugccggug

SEQ ID NO: 2896219 - RNA, 19 nt, Mycobacterium avium subsp. paratuberculosis
gccgacgugcuuggccagc

SEQ ID NO: 2896220 - RNA, 19 nt, Mycobacterium avium subsp. paratuberculosis
gccgacguuguugucgaug

SEQ ID NO: 2896221 - RNA, 16 nt, Mycobacterium avium subsp. paratuberculosis
gccgacuagcgcggcg

SEQ ID NO: 2896222 - RNA, 19 nt, Mycobacterium avium subsp. paratuberculosis
gccgacuagcgcggcggcc

SEQ ID NO: 2896223 - RNA, 23 nt, Mycobacterium avium subsp. paratuberculosis
gccgagcagcucagccgccuggc

SEQ ID NO: 2896224 - RNA, 14 nt, Mycobacterium avium subsp. paratuberculosis
gccgagcagcucgg

SEQ ID NO: 2896225 - RNA, 18 nt, Mycobacterium avium subsp. paratuberculosis
gccgagcagcucggcggc

SEQ ID NO: 2896226 - RNA, 14 nt, Mycobacterium avium subsp. paratuberculosis
gccgagcaucagcu

SEQ ID NO: 2896227 - RNA, 18 nt, Mycobacterium avium subsp. paratuberculosis
gccgagcaucagcugccg

SEQ ID NO: 2896228 - RNA, 22 nt, Mycobacterium avium subsp. paratuberculosis
gccgagcaucagcugccguccg

SEQ ID NO: 2896229 - RNA, 14 nt, Mycobacterium avium subsp. paratuberculosis
gccgagcccgccgg

SEQ ID NO: 2896230 - RNA, 15 nt, Mycobacterium avium subsp. paratuberculosis
gccgagcccgccggc

SEQ ID NO: 2896231 - RNA, 17 nt, Mycobacterium avium subsp. paratuberculosis
gccgagcccgccggcgg

SEQ ID NO: 2896232 - RNA, 21 nt, Mycobacterium avium subsp. paratuberculosis
gccgagcccgccggcggcgau

SEQ ID NO: 2896233 - RNA, 19 nt, Mycobacterium avium subsp. paratuberculosis
gccgagcccuuugcgcugc

SEQ ID NO: 2896234 - RNA, 12 nt, Mycobacterium avium subsp. paratuberculosis
gccgagccgacc

SEQ ID NO: 2896235 - RNA, 20 nt, Mycobacterium avium subsp. paratuberculosis
gccgagccgacccgggcuag

SEQ ID NO: 2896236 - RNA, 16 nt, Mycobacterium avium subsp. paratuberculosis
gccgagccgagccgac

SEQ ID NO: 2896237 - RNA, 22 nt, Mycobacterium avium subsp. paratuberculosis
gccgagccgaggccgauggcgc

SEQ ID NO: 2896238 - RNA, 18 nt, Mycobacterium avium subsp. paratuberculosis
gccgagccgaugcccagc

SEQ ID NO: 2896239 - RNA, 19 nt, Mycobacterium avium subsp. paratuberculosis
gccgagccgaugcccagca

SEQ ID NO: 2896240 - RNA, 22 nt, Mycobacterium avium subsp. paratuberculosis
gccgagccgaugcccagcagcg

SEQ ID NO: 2896241 - RNA, 13 nt, Mycobacterium avium subsp. paratuberculosis
gccgagccgcacc

SEQ ID NO: 2896242 - RNA, 15 nt, Mycobacterium avium subsp. paratuberculosis
gccgagccgcaccgc

SEQ ID NO: 2896243 - RNA, 11 nt, Mycobacterium avium subsp. paratuberculosis
gccgagccgcu

SEQ ID NO: 2896244 - RNA, 19 nt, Mycobacterium avium subsp. paratuberculosis
gccgagccggcacggccgg

SEQ ID NO: 2896245 - RNA, 23 nt, Mycobacterium avium subsp. paratuberculosis
gccgagccggcacggccggccgg

SEQ ID NO: 2896246 - RNA, 18 nt, Mycobacterium avium subsp. paratuberculosis
gccgagccggcguacccg

SEQ ID NO: 2896247 - RNA, 21 nt, Mycobacterium avium subsp. paratuberculosis
gccgagccggcguacccgccc

SEQ ID NO: 2896248 - RNA, 13 nt, Mycobacterium avium subsp. paratuberculosis
gccgagccgggcc

SEQ ID NO: 2896249 - RNA, 15 nt, Mycobacterium avium subsp. paratuberculosis
gccgagccgggccag

SEQ ID NO: 2896250 - RNA, 21 nt, Mycobacterium avium subsp. paratuberculosis
gccgagccgggccagguccca

SEQ ID NO: 2896251 - RNA, 23 nt, Mycobacterium avium subsp. paratuberculosis
gccgagccgggucauccagccgu

SEQ ID NO: 2896252 - RNA, 14 nt, Mycobacterium avium subsp. paratuberculosis
gccgagccgguccg

SEQ ID NO: 2896253 - RNA, 15 nt, Mycobacterium avium subsp. paratuberculosis
gccgagccgguccga

SEQ ID NO: 2896254 - RNA, 22 nt, Mycobacterium avium subsp. paratuberculosis
gccgagccgguccgaccagcgg

SEQ ID NO: 2896255 - RNA, 23 nt, Mycobacterium avium subsp. paratuberculosis
gccgagccgguccgaccagcggc

SEQ ID NO: 2896256 - RNA, 18 nt, Mycobacterium avium subsp. paratuberculosis
gccgagccguaggccagg

SEQ ID NO: 2896257 - RNA, 14 nt, Mycobacterium avium subsp. paratuberculosis
gccgagccgucguc

SEQ ID NO: 2896258 - RNA, 23 nt, Mycobacterium avium subsp. paratuberculosis
gccgagcgcaagggccgacaucg

SEQ ID NO: 2896259 - RNA, 14 nt, Mycobacterium avium subsp. paratuberculosis
gccgagcgcaccgc

SEQ ID NO: 2896260 - RNA, 16 nt, Mycobacterium avium subsp. paratuberculosis
gccgagcgcaccgcgg

SEQ ID NO: 2896261 - RNA, 17 nt, Mycobacterium avium subsp. paratuberculosis
gccgagcgcaccgcgga

SEQ ID NO: 2896262 - RNA, 22 nt, Mycobacterium avium subsp. paratuberculosis
gccgagcgcaccgcggagcgca

SEQ ID NO: 2896263 - RNA, 17 nt, Mycobacterium avium subsp. paratuberculosis
gccgagcgcagcgggga

SEQ ID NO: 2896264 - RNA, 14 nt, Mycobacterium avium subsp. paratuberculosis
gccgagcgcaucga

SEQ ID NO: 2896265 - RNA, 13 nt, Mycobacterium avium subsp. paratuberculosis
gccgagcgccgcg

SEQ ID NO: 2896266 - RNA, 17 nt, Mycobacterium avium subsp. paratuberculosis
gccgagcgccgcguuca

SEQ ID NO: 2896267 - RNA, 13 nt, Mycobacterium avium subsp. paratuberculosis
gccgagcgcgccg

SEQ ID NO: 2896268 - RNA, 14 nt, Mycobacterium avium subsp. paratuberculosis
gccgagcgcgccga

SEQ ID NO: 2896269 - RNA, 17 nt, Mycobacterium avium subsp. paratuberculosis
gccgagcgcgccgagca

SEQ ID NO: 2896270 - RNA, 21 nt, Mycobacterium avium subsp. paratuberculosis
gccgagcgcgccgagcagcug

SEQ ID NO: 2896271 - RNA, 15 nt, Mycobacterium avium subsp. paratuberculosis
gccgagcgcgccgcc

SEQ ID NO: 2896272 - RNA, 16 nt, Mycobacterium avium subsp. paratuberculosis
gccgagcgcgccgccg

SEQ ID NO: 2896273 - RNA, 13 nt, Mycobacterium avium subsp. paratuberculosis
gccgagcgcgcug

SEQ ID NO: 2896274 - RNA, 13 nt, Mycobacterium avium subsp. paratuberculosis
gccgagcgcuggu

SEQ ID NO: 2896275 - RNA, 19 nt, Mycobacterium avium subsp. paratuberculosis
gccgagcgcugguugucga

SEQ ID NO: 2896276 - RNA, 12 nt, Mycobacterium avium subsp. paratuberculosis
gccgagcggcgc

SEQ ID NO: 2896277 - RNA, 14 nt, Mycobacterium avium subsp. paratuberculosis
gccgagcggcgcca

SEQ ID NO: 2896278 - RNA, 15 nt, Mycobacterium avium subsp. paratuberculosis
gccgagcggcgccac

SEQ ID NO: 2896279 - RNA, 16 nt, Mycobacterium avium subsp. paratuberculosis
gccgagcggcgccacg

SEQ ID NO: 2896280 - RNA, 17 nt, Mycobacterium avium subsp. paratuberculosis
gccgagcggcgccacgu

SEQ ID NO: 2896281 - RNA, 17 nt, Mycobacterium avium subsp. paratuberculosis
gccgagcgggcgaucuc

SEQ ID NO: 2896282 - RNA, 13 nt, Mycobacterium avium subsp. paratuberculosis
gccgagcgucacg

SEQ ID NO: 2896283 - RNA, 22 nt, Mycobacterium avium subsp. paratuberculosis
gccgagcgugcauucagugcga

SEQ ID NO: 2896284 - RNA, 16 nt, Mycobacterium avium subsp. paratuberculosis
gccgagcgugugggaa

SEQ ID NO: 2896285 - RNA, 14 nt, Mycobacterium avium subsp. paratuberculosis
gccgagcguucggc

SEQ ID NO: 2896286 - RNA, 21 nt, Mycobacterium avium subsp. paratuberculosis
gccgagcguucggcgcggauc

SEQ ID NO: 2896287 - RNA, 16 nt, Mycobacterium avium subsp. paratuberculosis
gccgagcucggccacc

SEQ ID NO: 2896288 - RNA, 23 nt, Mycobacterium avium subsp. paratuberculosis
gccgagcucgugaugguccagca

SEQ ID NO: 2896289 - RNA, 18 nt, Mycobacterium avium subsp. paratuberculosis
gccgaggaaagcucgcga

SEQ ID NO: 2896290 - RNA, 14 nt, Mycobacterium avium subsp. paratuberculosis
gccgaggaaccggc

SEQ ID NO: 2896291 - RNA, 21 nt, Mycobacterium avium subsp. paratuberculosis
gccgaggaaccggcagccggc

SEQ ID NO: 2896292 - RNA, 18 nt, Mycobacterium avium subsp. paratuberculosis
gccgaggaacugcagcga

SEQ ID NO: 2896293 - RNA, 22 nt, Mycobacterium avium subsp. paratuberculosis
gccgaggaacugcagcgacugg

SEQ ID NO: 2896294 - RNA, 16 nt, Mycobacterium avium subsp. paratuberculosis
gccgaggaagacgucg

SEQ ID NO: 2896295 - RNA, 17 nt, Mycobacterium avium subsp. paratuberculosis
gccgaggaagacgucga

SEQ ID NO: 2896296 - RNA, 18 nt, Mycobacterium avium subsp. paratuberculosis
gccgaggacacguuggcc

SEQ ID NO: 2896297 - RNA, 20 nt, Mycobacterium avium subsp. paratuberculosis
gccgaggacacguuggccag

SEQ ID NO: 2896298 - RNA, 13 nt, Mycobacterium avium subsp. paratuberculosis
gccgaggaggccg

SEQ ID NO: 2896299 - RNA, 16 nt, Mycobacterium avium subsp. paratuberculosis
gccgaggaggccgcgg

SEQ ID NO: 2896300 - RNA, 17 nt, Mycobacterium avium subsp. paratuberculosis
gccgaggaggccgcggc

SEQ ID NO: 2896301 - RNA, 18 nt, Mycobacterium avium subsp. paratuberculosis
gccgaggaggccgcggcg

SEQ ID NO: 2896302 - RNA, 19 nt, Mycobacterium avium subsp. paratuberculosis
gccgaggaggccgcggcga

SEQ ID NO: 2896303 - RNA, 18 nt, Mycobacterium avium subsp. paratuberculosis
gccgaggauuucgcgauc

SEQ ID NO: 2896304 - RNA, 15 nt, Mycobacterium avium subsp. paratuberculosis
gccgaggcacagcag

SEQ ID NO: 2896305 - RNA, 18 nt, Mycobacterium avium subsp. paratuberculosis
gccgaggcaguuccaugu

SEQ ID NO: 2896306 - RNA, 14 nt, Mycobacterium avium subsp. paratuberculosis
gccgaggccaacuc

SEQ ID NO: 2896307 - RNA, 16 nt, Mycobacterium avium subsp. paratuberculosis
gccgaggccaacucgc

SEQ ID NO: 2896308 - RNA, 19 nt, Mycobacterium avium subsp. paratuberculosis
gccgaucaccucgauggcc

SEQ ID NO: 2896309 - RNA, 20 nt, Mycobacterium avium subsp. paratuberculosis
gccgaucaccucgauggccg

SEQ ID NO: 2896310 - RNA, 15 nt, Mycobacterium avium subsp. paratuberculosis
gccgaucaccucgcc

SEQ ID NO: 2896311 - RNA, 18 nt, Mycobacterium avium subsp. paratuberculosis
gccgaucaccucgccggc

SEQ ID NO: 2896312 - RNA, 18 nt, Mycobacterium avium subsp. paratuberculosis
gccgaucaccugacagac

SEQ ID NO: 2896313 - RNA, 21 nt, Mycobacterium avium subsp. paratuberculosis
gccgaucaccugacagacccg

SEQ ID NO: 2896314 - RNA, 23 nt, Mycobacterium avium subsp. paratuberculosis
gccgaucaccugacagacccgau

SEQ ID NO: 2896315 - RNA, 12 nt, Mycobacterium avium subsp. paratuberculosis
gccgaucacgaa

SEQ ID NO: 2896316 - RNA, 14 nt, Mycobacterium avium subsp. paratuberculosis
gccgaucacgccgg

SEQ ID NO: 2896317 - RNA, 15 nt, Mycobacterium avium subsp. paratuberculosis
gccgaucacgccggu

SEQ ID NO: 2896318 - RNA, 17 nt, Mycobacterium avium subsp. paratuberculosis
gccgaucacgccggugg

SEQ ID NO: 2896319 - RNA, 23 nt, Mycobacterium avium subsp. paratuberculosis
gccgaucacgccgguggacaggu

SEQ ID NO: 2896320 - RNA, 19 nt, Mycobacterium avium subsp. paratuberculosis
gccgaucacggugaucgcc

SEQ ID NO: 2896321 - RNA, 13 nt, Mycobacterium avium subsp. paratuberculosis
gccgaucagcacc

SEQ ID NO: 2896322 - RNA, 14 nt, Mycobacterium avium subsp. paratuberculosis
gccgaucagcacca

SEQ ID NO: 2896323 - RNA, 14 nt, Mycobacterium avium subsp. paratuberculosis
gccgaucagcggcg

SEQ ID NO: 2896324 - RNA, 20 nt, Mycobacterium avium subsp. paratuberculosis
gccgaucagcggcgggccca

SEQ ID NO: 2896325 - RNA, 22 nt, Mycobacterium avium subsp. paratuberculosis
gccgaucagcggcgggcccagc

SEQ ID NO: 2896326 - RNA, 22 nt, Mycobacterium avium subsp. paratuberculosis
gccgaucagcgucagcaccgcg

SEQ ID NO: 2896327 - RNA, 23 nt, Mycobacterium avium subsp. paratuberculosis
gccgaucagcgucagcaccgcga

SEQ ID NO: 2896328 - RNA, 20 nt, Mycobacterium avium subsp. paratuberculosis
gccgaucagcugcucggcca

SEQ ID NO: 2896329 - RNA, 22 nt, Mycobacterium avium subsp. paratuberculosis
gccgaucagcugcucggccacc

SEQ ID NO: 2896330 - RNA, 14 nt, Mycobacterium avium subsp. paratuberculosis
gccgaucaggcugg

SEQ ID NO: 2896331 - RNA, 13 nt, Mycobacterium avium subsp. paratuberculosis
gccgaucagugcc

SEQ ID NO: 2896332 - RNA, 18 nt, Mycobacterium avium subsp. paratuberculosis
gccgaucagugccgcgcc

SEQ ID NO: 2896333 - RNA, 20 nt, Mycobacterium avium subsp. paratuberculosis
gccgaucagugccgcgccaa

SEQ ID NO: 2896334 - RNA, 22 nt, Mycobacterium avium subsp. paratuberculosis
gccgaucagugccgcgccaacg

SEQ ID NO: 2896335 - RNA, 22 nt, Mycobacterium avium subsp. paratuberculosis
gccgaucauggucggcgacgcc

SEQ ID NO: 2896336 - RNA, 14 nt, Mycobacterium avium subsp. paratuberculosis
gccgauccagccgu

SEQ ID NO: 2896337 - RNA, 12 nt, Mycobacterium avium subsp. paratuberculosis
gccgaucccggc

SEQ ID NO: 2896338 - RNA, 13 nt, Mycobacterium avium subsp. paratuberculosis
gccgaucccggcc

SEQ ID NO: 2896339 - RNA, 15 nt, Mycobacterium avium subsp. paratuberculosis
gccgaucccggccac

SEQ ID NO: 2896340 - RNA, 18 nt, Mycobacterium avium subsp. paratuberculosis
gccgaucccggccacguc

SEQ ID NO: 2896341 - RNA, 16 nt, Mycobacterium avium subsp. paratuberculosis
gccgaucccggccagc

SEQ ID NO: 2896342 - RNA, 18 nt, Mycobacterium avium subsp. paratuberculosis
gccgaucccggccagcac

SEQ ID NO: 2896343 - RNA, 20 nt, Mycobacterium avium subsp. paratuberculosis
gccgaucccggccagcaccc

SEQ ID NO: 2896344 - RNA, 22 nt, Mycobacterium avium subsp. paratuberculosis
gccgaucccggccagcacccgc

SEQ ID NO: 2896345 - RNA, 18 nt, Mycobacterium avium subsp. paratuberculosis
gccgauccgcaccggacg

SEQ ID NO: 2896346 - RNA, 20 nt, Mycobacterium avium subsp. paratuberculosis
gccgauccgcaccggacgca

SEQ ID NO: 2896347 - RNA, 14 nt, Mycobacterium avium subsp. paratuberculosis
gccgauccgcagcc

SEQ ID NO: 2896348 - RNA, 20 nt, Mycobacterium avium subsp. paratuberculosis
gccgauccgcagccgcugcc

SEQ ID NO: 2896349 - RNA, 13 nt, Mycobacterium avium subsp. paratuberculosis
gccgauccgcggg

SEQ ID NO: 2896350 - RNA, 15 nt, Mycobacterium avium subsp. paratuberculosis
gccgauccggcgccg

SEQ ID NO: 2896351 - RNA, 19 nt, Mycobacterium avium subsp. paratuberculosis
gccgauccggcgccgcggg

SEQ ID NO: 2896352 - RNA, 20 nt, Mycobacterium avium subsp. paratuberculosis
gccgauccggcgccgcgggc

SEQ ID NO: 2896353 - RNA, 23 nt, Mycobacterium avium subsp. paratuberculosis
gccgauccggcgccgcgggcgcc

SEQ ID NO: 2896354 - RNA, 21 nt, Mycobacterium avium subsp. paratuberculosis
gccgauccggcuccacagcag

SEQ ID NO: 2896355 - RNA, 17 nt, Mycobacterium avium subsp. paratuberculosis
gccgauccgggcggcag

SEQ ID NO: 2896356 - RNA, 14 nt, Mycobacterium avium subsp. paratuberculosis
gccgaucgagacca

SEQ ID NO: 2896357 - RNA, 22 nt, Mycobacterium avium subsp. paratuberculosis
gccgaucgagacgaugcggucc

SEQ ID NO: 2896358 - RNA, 19 nt, Mycobacterium avium subsp. paratuberculosis
gccgaucgaucagccgcga

SEQ ID NO: 2896359 - RNA, 21 nt, Mycobacterium avium subsp. paratuberculosis
gccgaucgaucagccgcgaca

SEQ ID NO: 2896360 - RNA, 23 nt, Mycobacterium avium subsp. paratuberculosis
gccgaucgaucagccgcgacagc

SEQ ID NO: 2896361 - RNA, 16 nt, Mycobacterium avium subsp. paratuberculosis
gccgaucgcccagugc

SEQ ID NO: 2896362 - RNA, 18 nt, Mycobacterium avium subsp. paratuberculosis
gccgaucgcccagugcgc

SEQ ID NO: 2896363 - RNA, 22 nt, Mycobacterium avium subsp. paratuberculosis
gccgaucgcccagugcgcgccg

SEQ ID NO: 2896364 - RNA, 14 nt, Mycobacterium avium subsp. paratuberculosis
gccgaucgcccggu

SEQ ID NO: 2896365 - RNA, 13 nt, Mycobacterium avium subsp. paratuberculosis
gccgaucgccgcg

SEQ ID NO: 2896366 - RNA, 16 nt, Mycobacterium avium subsp. paratuberculosis
gccgaucgccgcggcg

SEQ ID NO: 2896367 - RNA, 19 nt, Mycobacterium avium subsp. paratuberculosis
gccgaucgccgcggcgauc

SEQ ID NO: 2896368 - RNA, 21 nt, Mycobacterium avium subsp. paratuberculosis
gccgaucgccgcggcgaucuc

SEQ ID NO: 2896369 - RNA, 23 nt, Mycobacterium avium subsp. paratuberculosis
gccgaucgccuccgucagcgccg

SEQ ID NO: 2896370 - RNA, 13 nt, Mycobacterium avium subsp. paratuberculosis
gccgaucgcgcgc

SEQ ID NO: 2896371 - RNA, 14 nt, Mycobacterium avium subsp. paratuberculosis
gccgaucgcgcgca

SEQ ID NO: 2896372 - RNA, 16 nt, Mycobacterium avium subsp. paratuberculosis
gccgaucgcgcgcagg

SEQ ID NO: 2896373 - RNA, 16 nt, Mycobacterium avium subsp. paratuberculosis
gccgaucgcggugcug

SEQ ID NO: 2896374 - RNA, 20 nt, Mycobacterium avium subsp. paratuberculosis
gccgaucgcggugcugcaga

SEQ ID NO: 2896375 - RNA, 16 nt, Mycobacterium avium subsp. paratuberculosis
gccgaucgggaccguc

SEQ ID NO: 2896376 - RNA, 12 nt, Mycobacterium avium subsp. paratuberculosis
gccgaucgggau

SEQ ID NO: 2896377 - RNA, 17 nt, Mycobacterium avium subsp. paratuberculosis
gccgaucggggcgcagc

SEQ ID NO: 2896378 - RNA, 22 nt, Mycobacterium avium subsp. paratuberculosis
gccgaucggggcgcagcccggc

SEQ ID NO: 2896379 - RNA, 22 nt, Mycobacterium avium subsp. paratuberculosis
gccgaucgugaauucggccggg

SEQ ID NO: 2896380 - RNA, 14 nt, Mycobacterium avium subsp. paratuberculosis
gccgaucuccaccg

SEQ ID NO: 2896381 - RNA, 16 nt, Mycobacterium avium subsp. paratuberculosis
gccgaucuccaccgag

SEQ ID NO: 2896382 - RNA, 22 nt, Mycobacterium avium subsp. paratuberculosis
gccgaucuccaccgagugcggc

SEQ ID NO: 2896383 - RNA, 17 nt, Mycobacterium avium subsp. paratuberculosis
gccgaucucgaccagcg

SEQ ID NO: 2896384 - RNA, 19 nt, Mycobacterium avium subsp. paratuberculosis
gccgaucucgaccagcgcc

SEQ ID NO: 2896385 - RNA, 23 nt, Mycobacterium avium subsp. paratuberculosis
gccgaucucguagcccaccucga

SEQ ID NO: 2896386 - RNA, 17 nt, Mycobacterium avium subsp. paratuberculosis
gccgaucugaccgagca

SEQ ID NO: 2896387 - RNA, 14 nt, Mycobacterium avium subsp. paratuberculosis
gccgaucugcucgg

SEQ ID NO: 2896388 - RNA, 20 nt, Mycobacterium avium subsp. paratuberculosis
gccgaucugcucggcugcag

SEQ ID NO: 2896389 - RNA, 16 nt, Mycobacterium avium subsp. paratuberculosis
gccgaucuggcgcagc

SEQ ID NO: 2896390 - RNA, 17 nt, Mycobacterium avium subsp. paratuberculosis
gccgaucuggcgcagcg

SEQ ID NO: 2896391 - RNA, 19 nt, Mycobacterium avium subsp. paratuberculosis
gccgaucuggcgcagcguc

SEQ ID NO: 2896392 - RNA, 18 nt, Mycobacterium avium subsp. paratuberculosis
gccgaugucugaucgcgu

SEQ ID NO: 2896393 - RNA, 19 nt, Mycobacterium avium subsp. paratuberculosis
gccgaugugaucggcggcc

SEQ ID NO: 2896394 - RNA, 23 nt, Mycobacterium avium subsp. paratuberculosis
gccgaugugaucggcggccacca

SEQ ID NO: 2896395 - RNA, 14 nt, Mycobacterium avium subsp. paratuberculosis
gccgaugugcucgg

SEQ ID NO: 2896396 - RNA, 16 nt, Mycobacterium avium subsp. paratuberculosis
gccgauguggccggcg

SEQ ID NO: 2896397 - RNA, 17 nt, Mycobacterium avium subsp. paratuberculosis
gccgauguggccggcga

SEQ ID NO: 2896398 - RNA, 13 nt, Mycobacterium avium subsp. paratuberculosis
gccgauguggcgg

SEQ ID NO: 2896399 - RNA, 15 nt, Mycobacterium avium subsp. paratuberculosis
gccgauguggcgggc

SEQ ID NO: 2896400 - RNA, 17 nt, Mycobacterium avium subsp. paratuberculosis
gccgauguggcgggcgu

SEQ ID NO: 2896401 - RNA, 22 nt, Mycobacterium avium subsp. paratuberculosis
gccgauguggcgggcguccugc

SEQ ID NO: 2896402 - RNA, 19 nt, Mycobacterium avium subsp. paratuberculosis
gccgauguucaccccgauc

SEQ ID NO: 2896403 - RNA, 15 nt, Mycobacterium avium subsp. paratuberculosis
gccgauucaaccccg

SEQ ID NO: 2896404 - RNA, 17 nt, Mycobacterium avium subsp. paratuberculosis
gccgauucaaccccgcg

SEQ ID NO: 2896405 - RNA, 22 nt, Mycobacterium avium subsp. paratuberculosis
gccgauucaaccccgcgcgcgg

SEQ ID NO: 2896406 - RNA, 15 nt, Mycobacterium avium subsp. paratuberculosis
gccgauuccagcaac

SEQ ID NO: 2896407 - RNA, 15 nt, Mycobacterium avium subsp. paratuberculosis
gccgauuccggccgg

SEQ ID NO: 2896408 - RNA, 18 nt, Mycobacterium avium subsp. paratuberculosis
gccgauuccgucgguggc

SEQ ID NO: 2896409 - RNA, 23 nt, Mycobacterium avium subsp. paratuberculosis
gccgauuccgucgguggcggugg

SEQ ID NO: 2896410 - RNA, 14 nt, Mycobacterium avium subsp. paratuberculosis
gccgauucggcgcc

SEQ ID NO: 2896411 - RNA, 20 nt, Mycobacterium avium subsp. paratuberculosis
gccgauucggcgccgcgacc

SEQ ID NO: 2896412 - RNA, 11 nt, Mycobacterium avium subsp. paratuberculosis
gccgcaacacg

SEQ ID NO: 2896413 - RNA, 21 nt, Mycobacterium avium subsp. paratuberculosis
gccgcaacacggccucgauca

SEQ ID NO: 2896414 - RNA, 14 nt, Mycobacterium avium subsp. paratuberculosis
gccgcaacagccgg

SEQ ID NO: 2896415 - RNA, 17 nt, Mycobacterium avium subsp. paratuberculosis
gccgcaacagccggccc

SEQ ID NO: 2896416 - RNA, 18 nt, Mycobacterium avium subsp. paratuberculosis
gccgcaacagccggcccg

SEQ ID NO: 2896417 - RNA, 19 nt, Mycobacterium avium subsp. paratuberculosis
gccgcaacagccggcccga

SEQ ID NO: 2896418 - RNA, 22 nt, Mycobacterium avium subsp. paratuberculosis
gccgcaacagguuucgcucguc

SEQ ID NO: 2896419 - RNA, 14 nt, Mycobacterium avium subsp. paratuberculosis
gccgcaacggcgca

SEQ ID NO: 2896420 - RNA, 14 nt, Mycobacterium avium subsp. paratuberculosis
gccgcaacggcggu

SEQ ID NO: 2896421 - RNA, 15 nt, Mycobacterium avium subsp. paratuberculosis
gccgcaacggcgguc

SEQ ID NO: 2896422 - RNA, 19 nt, Mycobacterium avium subsp. paratuberculosis
gccgcaacggcggucgugc

SEQ ID NO: 2896423 - RNA, 22 nt, Mycobacterium avium subsp. paratuberculosis
gccgcaacggcggucgugcggc

SEQ ID NO: 2896424 - RNA, 14 nt, Mycobacterium avium subsp. paratuberculosis
gccgcaacgggccg

SEQ ID NO: 2896425 - RNA, 16 nt, Mycobacterium avium subsp. paratuberculosis
gccgcaacgggccgca

SEQ ID NO: 2896426 - RNA, 18 nt, Mycobacterium avium subsp. paratuberculosis
gccgcaacgggccgcagc

SEQ ID NO: 2896427 - RNA, 19 nt, Mycobacterium avium subsp. paratuberculosis
gccgcaacgggccgcagcc

SEQ ID NO: 2896428 - RNA, 17 nt, Mycobacterium avium subsp. paratuberculosis
gccgcaacuugcccgac

SEQ ID NO: 2896429 - RNA, 22 nt, Mycobacterium avium subsp. paratuberculosis
gccgcaaggugauucgcgcggc

SEQ ID NO: 2896430 - RNA, 16 nt, Mycobacterium avium subsp. paratuberculosis
gccgcaauacaccgcg

SEQ ID NO: 2896431 - RNA, 18 nt, Mycobacterium avium subsp. paratuberculosis
gccgcaauacggugcccg

SEQ ID NO: 2896432 - RNA, 24 nt, Mycobacterium avium subsp. paratuberculosis
gccgcaauacggugcccgccgcga

SEQ ID NO: 2896433 - RNA, 18 nt, Mycobacterium avium subsp. paratuberculosis
gccgcaaucggcgccggc

SEQ ID NO: 2896434 - RNA, 14 nt, Mycobacterium avium subsp. paratuberculosis
gccgcacaacagac

SEQ ID NO: 2896435 - RNA, 17 nt, Mycobacterium avium subsp. paratuberculosis
gccgcacaccaccacgu

SEQ ID NO: 2896436 - RNA, 13 nt, Mycobacterium avium subsp. paratuberculosis
gccgcacaccgcg

SEQ ID NO: 2896437 - RNA, 15 nt, Mycobacterium avium subsp. paratuberculosis
gccgcacaccgcgca

SEQ ID NO: 2896438 - RNA, 17 nt, Mycobacterium avium subsp. paratuberculosis
gccgcacaccgcgcaga

SEQ ID NO: 2896439 - RNA, 14 nt, Mycobacterium avium subsp. paratuberculosis
gccgcacaccgcgg

SEQ ID NO: 2896440 - RNA, 16 nt, Mycobacterium avium subsp. paratuberculosis
gccgcacaccgcggcg

SEQ ID NO: 2896441 - RNA, 17 nt, Mycobacterium avium subsp. paratuberculosis
gccgcacaccgcggcgg

SEQ ID NO: 2896442 - RNA, 18 nt, Mycobacterium avium subsp. paratuberculosis
gccgcacaccgcggcggc

SEQ ID NO: 2896443 - RNA, 19 nt, Mycobacterium avium subsp. paratuberculosis
gccgcacaccgcggcggcg

SEQ ID NO: 2896444 - RNA, 21 nt, Mycobacterium avium subsp. paratuberculosis
gccgcacaccgucucccacga

SEQ ID NO: 2896445 - RNA, 20 nt, Mycobacterium avium subsp. paratuberculosis
gccgcacaccugcaucacga

SEQ ID NO: 2896446 - RNA, 15 nt, Mycobacterium avium subsp. paratuberculosis
gccgcacagccggcg

SEQ ID NO: 2896447 - RNA, 16 nt, Mycobacterium avium subsp. paratuberculosis
gccgcacagccggcgg

SEQ ID NO: 2896448 - RNA, 17 nt, Mycobacterium avium subsp. paratuberculosis
gccgcacagccggcggc

SEQ ID NO: 2896449 - RNA, 18 nt, Mycobacterium avium subsp. paratuberculosis
gccgcacagccggcggcg

SEQ ID NO: 2896450 - RNA, 15 nt, Mycobacterium avium subsp. paratuberculosis
gccgcaccagcaccc

SEQ ID NO: 2896451 - RNA, 21 nt, Mycobacterium avium subsp. paratuberculosis
gccgcaccagcaccccgccgc

SEQ ID NO: 2896452 - RNA, 22 nt, Mycobacterium avium subsp. paratuberculosis
gccgcaccaguuccugcaugcc

SEQ ID NO: 2896453 - RNA, 16 nt, Mycobacterium avium subsp. paratuberculosis
gccgcacccagcgggc

SEQ ID NO: 2896454 - RNA, 18 nt, Mycobacterium avium subsp. paratuberculosis
gccgcacccagcgggcga

SEQ ID NO: 2896455 - RNA, 20 nt, Mycobacterium avium subsp. paratuberculosis
gccgcacccagcgggcgacg

SEQ ID NO: 2896456 - RNA, 21 nt, Mycobacterium avium subsp. paratuberculosis
gccgcacccagcgggcgacgu

SEQ ID NO: 2896457 - RNA, 17 nt, Mycobacterium avium subsp. paratuberculosis
gccgcaccccacccgcg

SEQ ID NO: 2896458 - RNA, 18 nt, Mycobacterium avium subsp. paratuberculosis
gccgcaccccacccgcgc

SEQ ID NO: 2896459 - RNA, 19 nt, Mycobacterium avium subsp. paratuberculosis
gccgcaccccacccgcgcg

SEQ ID NO: 2896460 - RNA, 21 nt, Mycobacterium avium subsp. paratuberculosis
gccgcaccccacccgcgcgac

SEQ ID NO: 2896461 - RNA, 13 nt, Mycobacterium avium subsp. paratuberculosis
gccgcacccccuc

SEQ ID NO: 2896462 - RNA, 22 nt, Mycobacterium avium subsp. paratuberculosis
gccgcacccgauccacggcgac

SEQ ID NO: 2896463 - RNA, 20 nt, Mycobacterium avium subsp. paratuberculosis
gccgcaccgcaaagcaccgc

SEQ ID NO: 2896464 - RNA, 14 nt, Mycobacterium avium subsp. paratuberculosis
gccgcaccgcgacc

SEQ ID NO: 2896465 - RNA, 13 nt, Mycobacterium avium subsp. paratuberculosis
gccgcaccggccg

SEQ ID NO: 2896466 - RNA, 15 nt, Mycobacterium avium subsp. paratuberculosis
gccgcaccggccggc

SEQ ID NO: 2896467 - RNA, 13 nt, Mycobacterium avium subsp. paratuberculosis
gccgcaccggcgc

SEQ ID NO: 2896468 - RNA, 14 nt, Mycobacterium avium subsp. paratuberculosis
gccgcaccggcgcc

SEQ ID NO: 2896469 - RNA, 15 nt, Mycobacterium avium subsp. paratuberculosis
gccgcaccggcgccg

SEQ ID NO: 2896470 - RNA, 16 nt, Mycobacterium avium subsp. paratuberculosis
gccgcaccgucgugcc

SEQ ID NO: 2896471 - RNA, 14 nt, Mycobacterium avium subsp. paratuberculosis
gccgcaccucgccg

SEQ ID NO: 2896472 - RNA, 15 nt, Mycobacterium avium subsp. paratuberculosis
gccgcaccucgccga

SEQ ID NO: 2896473 - RNA, 16 nt, Mycobacterium avium subsp. paratuberculosis
gccgcaccucgccgau

SEQ ID NO: 2896474 - RNA, 17 nt, Mycobacterium avium subsp. paratuberculosis
gccgcaccucgccggcc

SEQ ID NO: 2896475 - RNA, 18 nt, Mycobacterium avium subsp. paratuberculosis
gccgcaccucgccggccg

SEQ ID NO: 2896476 - RNA, 19 nt, Mycobacterium avium subsp. paratuberculosis
gccgcaccucgccggccgc

SEQ ID NO: 2896477 - RNA, 20 nt, Mycobacterium avium subsp. paratuberculosis
gccgcagcucgaucacccag

SEQ ID NO: 2896478 - RNA, 21 nt, Mycobacterium avium subsp. paratuberculosis
gccgcagcucgcccagcaccg

SEQ ID NO: 2896479 - RNA, 22 nt, Mycobacterium avium subsp. paratuberculosis
gccgcagcucguugugaaucca

SEQ ID NO: 2896480 - RNA, 20 nt, Mycobacterium avium subsp. paratuberculosis
gccgcagcugcugcggccgg

SEQ ID NO: 2896481 - RNA, 21 nt, Mycobacterium avium subsp. paratuberculosis
gccgcagcugcugcggccgga

SEQ ID NO: 2896482 - RNA, 21 nt, Mycobacterium avium subsp. paratuberculosis
gccgcagcuguucgggcagau

SEQ ID NO: 2896483 - RNA, 19 nt, Mycobacterium avium subsp. paratuberculosis
gccgcaggagaucggcgcg

SEQ ID NO: 2896484 - RNA, 14 nt, Mycobacterium avium subsp. paratuberculosis
gccgcaggcggcca

SEQ ID NO: 2896485 - RNA, 15 nt, Mycobacterium avium subsp. paratuberculosis
gccgcaggcggccag

SEQ ID NO: 2896486 - RNA, 14 nt, Mycobacterium avium subsp. paratuberculosis
gccgcaggguggcc

SEQ ID NO: 2896487 - RNA, 15 nt, Mycobacterium avium subsp. paratuberculosis
gccgcaggguggcca

SEQ ID NO: 2896488 - RNA, 17 nt, Mycobacterium avium subsp. paratuberculosis
gccgcaggguggccagc

SEQ ID NO: 2896489 - RNA, 19 nt, Mycobacterium avium subsp. paratuberculosis
gccgcaggguggccagcac

SEQ ID NO: 2896490 - RNA, 20 nt, Mycobacterium avium subsp. paratuberculosis
gccgcaggguggccagcacc

SEQ ID NO: 2896491 - RNA, 23 nt, Mycobacterium avium subsp. paratuberculosis
gccgcaggguggccagcaccgcg

SEQ ID NO: 2896492 - RNA, 13 nt, Mycobacterium avium subsp. paratuberculosis
gccgcaggugcag

SEQ ID NO: 2896493 - RNA, 18 nt, Mycobacterium avium subsp. paratuberculosis
gccgcaggugcagcuccu

SEQ ID NO: 2896494 - RNA, 16 nt, Mycobacterium avium subsp. paratuberculosis
gccgcaggugcucgcc

SEQ ID NO: 2896495 - RNA, 19 nt, Mycobacterium avium subsp. paratuberculosis
gccgcaggugcucgccggc

SEQ ID NO: 2896496 - RNA, 20 nt, Mycobacterium avium subsp. paratuberculosis
gccgcaggugcucgccggcg

SEQ ID NO: 2896497 - RNA, 16 nt, Mycobacterium avium subsp. paratuberculosis
gccgcagguggugggc

SEQ ID NO: 2896498 - RNA, 17 nt, Mycobacterium avium subsp. paratuberculosis
gccgcagguggugggcg

SEQ ID NO: 2896499 - RNA, 19 nt, Mycobacterium avium subsp. paratuberculosis
gccgcagguggugggcgug

SEQ ID NO: 2896500 - RNA, 21 nt, Mycobacterium avium subsp. paratuberculosis
gccgcagguggugggcgugca

SEQ ID NO: 2896501 - RNA, 15 nt, Mycobacterium avium subsp. paratuberculosis
gccgcagucgaucac

SEQ ID NO: 2896502 - RNA, 16 nt, Mycobacterium avium subsp. paratuberculosis
gccgcagucgaucacc

SEQ ID NO: 2896503 - RNA, 14 nt, Mycobacterium avium subsp. paratuberculosis
gccgcagugccggc

SEQ ID NO: 2896504 - RNA, 20 nt, Mycobacterium avium subsp. paratuberculosis
gccgcagugccggcgcaccg

SEQ ID NO: 2896505 - RNA, 17 nt, Mycobacterium avium subsp. paratuberculosis
gccgcauacaccuuguc

SEQ ID NO: 2896506 - RNA, 22 nt, Mycobacterium avium subsp. paratuberculosis
gccgcauacaccuugucggcga

SEQ ID NO: 2896507 - RNA, 15 nt, Mycobacterium avium subsp. paratuberculosis
gccgcauaccgcccg

SEQ ID NO: 2896508 - RNA, 16 nt, Mycobacterium avium subsp. paratuberculosis
gccgcauaccgcccgc

SEQ ID NO: 2896509 - RNA, 17 nt, Mycobacterium avium subsp. paratuberculosis
gccgcauaccgcccgcg

SEQ ID NO: 2896510 - RNA, 19 nt, Mycobacterium avium subsp. paratuberculosis
gccgcauaccgcccgcgcu

SEQ ID NO: 2896511 - RNA, 21 nt, Mycobacterium avium subsp. paratuberculosis
gccgcauaccgcccgcgcugg

SEQ ID NO: 2896512 - RNA, 23 nt, Mycobacterium avium subsp. paratuberculosis
gccgcauaccgcccgcgcuggug

SEQ ID NO: 2896513 - RNA, 23 nt, Mycobacterium avium subsp. paratuberculosis
gccgcaucaccuucugcgcgccg

SEQ ID NO: 2896514 - RNA, 13 nt, Mycobacterium avium subsp. paratuberculosis
gccgcauccagcg

SEQ ID NO: 2896515 - RNA, 15 nt, Mycobacterium avium subsp. paratuberculosis
gccgcauccagcgcc

SEQ ID NO: 2896516 - RNA, 16 nt, Mycobacterium avium subsp. paratuberculosis
gccgcauccagcgccg

SEQ ID NO: 2896517 - RNA, 15 nt, Mycobacterium avium subsp. paratuberculosis
gccgcauccgcgagc

SEQ ID NO: 2896518 - RNA, 22 nt, Mycobacterium avium subsp. paratuberculosis
gccgcaucgcaagaaccuccau

SEQ ID NO: 2896519 - RNA, 19 nt, Mycobacterium avium subsp. paratuberculosis
gccgcaugaugcggccaug

SEQ ID NO: 2896520 - RNA, 22 nt, Mycobacterium avium subsp. paratuberculosis
gccgcaugcccuugucgcuggc

SEQ ID NO: 2896521 - RNA, 19 nt, Mycobacterium avium subsp. paratuberculosis
gccgcaugucgaccucggc

SEQ ID NO: 2896522 - RNA, 20 nt, Mycobacterium avium subsp. paratuberculosis
gccgcauguugugcccgacg

SEQ ID NO: 2896523 - RNA, 22 nt, Mycobacterium avium subsp. paratuberculosis
gccgcauguugugcccgacggc

SEQ ID NO: 2896524 - RNA, 16 nt, Mycobacterium avium subsp. paratuberculosis
gccgcauuccucggcc

SEQ ID NO: 2896525 - RNA, 19 nt, Mycobacterium avium subsp. paratuberculosis
gccgcauuccucggccagc

SEQ ID NO: 2896526 - RNA, 15 nt, Mycobacterium avium subsp. paratuberculosis
gccgcauucggugag

SEQ ID NO: 2896527 - RNA, 16 nt, Mycobacterium avium subsp. paratuberculosis
gccgcauucggugagc

SEQ ID NO: 2896528 - RNA, 15 nt, Mycobacterium avium subsp. paratuberculosis
gccgcauuggcaccg

SEQ ID NO: 2896529 - RNA, 24 nt, Mycobacterium avium subsp. paratuberculosis
gccgcauuggcaccgucgaccucg

SEQ ID NO: 2896530 - RNA, 16 nt, Mycobacterium avium subsp. paratuberculosis
gccgcauuggugccgg

SEQ ID NO: 2896531 - RNA, 18 nt, Mycobacterium avium subsp. paratuberculosis
gccgcauuggugccggcc

SEQ ID NO: 2896532 - RNA, 19 nt, Mycobacterium avium subsp. paratuberculosis
gccgcauuggugccggccu

SEQ ID NO: 2896533 - RNA, 22 nt, Mycobacterium avium subsp. paratuberculosis
gccgcauuggugccggccucgu

SEQ ID NO: 2896534 - RNA, 23 nt, Mycobacterium avium subsp. paratuberculosis
gccgcauuggugccggccucguc

SEQ ID NO: 2896535 - RNA, 16 nt, Mycobacterium avium subsp. paratuberculosis
gccgccaaaucgauca

SEQ ID NO: 2896536 - RNA, 15 nt, Mycobacterium avium subsp. paratuberculosis
gccgccaaccagguc

SEQ ID NO: 2896537 - RNA, 24 nt, Mycobacterium avium subsp. paratuberculosis
gccgccaaccaggucgcggcgcug

SEQ ID NO: 2896538 - RNA, 13 nt, Mycobacterium avium subsp. paratuberculosis
gccgccaacgcga

SEQ ID NO: 2896539 - RNA, 16 nt, Mycobacterium avium subsp. paratuberculosis
gccgccaacgcgaacg

SEQ ID NO: 2896540 - RNA, 22 nt, Mycobacterium avium subsp. paratuberculosis
gccgccaacggauucagcgucg

SEQ ID NO: 2896541 - RNA, 20 nt, Mycobacterium avium subsp. paratuberculosis
gccgccaaggggaacaacgc

SEQ ID NO: 2896542 - RNA, 22 nt, Mycobacterium avium subsp. paratuberculosis
gccgccaaggggaacaacgcgc

SEQ ID NO: 2896543 - RNA, 18 nt, Mycobacterium avium subsp. paratuberculosis
gccgccacaccucggcga

SEQ ID NO: 2896544 - RNA, 19 nt, Mycobacterium avium subsp. paratuberculosis
gccgccacaccucggcgac

SEQ ID NO: 2896545 - RNA, 13 nt, Mycobacterium avium subsp. paratuberculosis
gccgccacagcgc

SEQ ID NO: 2896546 - RNA, 15 nt, Mycobacterium avium subsp. paratuberculosis
gccgccacagcgccu

SEQ ID NO: 2896547 - RNA, 19 nt, Mycobacterium avium subsp. paratuberculosis
gccgccacagcgccucgcg

SEQ ID NO: 2896548 - RNA, 13 nt, Mycobacterium avium subsp. paratuberculosis
gccgccaccaaca

SEQ ID NO: 2896549 - RNA, 19 nt, Mycobacterium avium subsp. paratuberculosis
gccgccaccaacaucgacg

SEQ ID NO: 2896550 - RNA, 13 nt, Mycobacterium avium subsp. paratuberculosis
gccgccaccacgg

SEQ ID NO: 2896551 - RNA, 21 nt, Mycobacterium avium subsp. paratuberculosis
gccgccaccccaggcgaugcc

SEQ ID NO: 2896552 - RNA, 12 nt, Mycobacterium avium subsp. paratuberculosis
gccgccaccgcc

SEQ ID NO: 2896553 - RNA, 13 nt, Mycobacterium avium subsp. paratuberculosis
gccgccaccgcga

SEQ ID NO: 2896554 - RNA, 16 nt, Mycobacterium avium subsp. paratuberculosis
gccgccaccggccggu

SEQ ID NO: 2896555 - RNA, 17 nt, Mycobacterium avium subsp. paratuberculosis
gccgccaccggccgguc

SEQ ID NO: 2896556 - RNA, 23 nt, Mycobacterium avium subsp. paratuberculosis
gccgccaccggccgguccgccca

SEQ ID NO: 2896557 - RNA, 16 nt, Mycobacterium avium subsp. paratuberculosis
gccgccaccgucgccg

SEQ ID NO: 2896558 - RNA, 18 nt, Mycobacterium avium subsp. paratuberculosis
gccgccaccgucgccggc

SEQ ID NO: 2896559 - RNA, 20 nt, Mycobacterium avium subsp. paratuberculosis
gccgccaccgucgccggcug

SEQ ID NO: 2896560 - RNA, 17 nt, Mycobacterium avium subsp. paratuberculosis
gccgccacgcggcgcgc

SEQ ID NO: 2896561 - RNA, 14 nt, Mycobacterium avium subsp. paratuberculosis
gccgcccagcccgc

SEQ ID NO: 2896562 - RNA, 18 nt, Mycobacterium avium subsp. paratuberculosis
cucgccgaucuggcgcag

SEQ ID NO: 2896563 - RNA, 17 nt, Mycobacterium avium subsp. paratuberculosis
cucgccgaugacguugc

SEQ ID NO: 2896564 - RNA, 18 nt, Mycobacterium avium subsp. paratuberculosis
cucgccgauguggcgggc

SEQ ID NO: 2896565 - RNA, 15 nt, Mycobacterium avium subsp. paratuberculosis
cucgccgccgacgaa

SEQ ID NO: 2896566 - RNA, 13 nt, Mycobacterium avium subsp. paratuberculosis
cucgccgccgccg

SEQ ID NO: 2896567 - RNA, 17 nt, Mycobacterium avium subsp. paratuberculosis
cucgccgccgccgaucu

SEQ ID NO: 2896568 - RNA, 17 nt, Mycobacterium avium subsp. paratuberculosis
cucgccgcgaacgacga

SEQ ID NO: 2896569 - RNA, 20 nt, Mycobacterium avium subsp. paratuberculosis
cucgccgcgcaucaucgccc

SEQ ID NO: 2896570 - RNA, 12 nt, Mycobacterium avium subsp. paratuberculosis
cucgccgcgcca

SEQ ID NO: 2896571 - RNA, 14 nt, Mycobacterium avium subsp. paratuberculosis
cucgccgcgccagc

SEQ ID NO: 2896572 - RNA, 17 nt, Mycobacterium avium subsp. paratuberculosis
cucgccgcgccagcacc

SEQ ID NO: 2896573 - RNA, 20 nt, Mycobacterium avium subsp. paratuberculosis
cucgccgcgccagcaccucg

SEQ ID NO: 2896574 - RNA, 23 nt, Mycobacterium avium subsp. paratuberculosis
cucgccgcgcucaacccgggccg

SEQ ID NO: 2896575 - RNA, 13 nt, Mycobacterium avium subsp. paratuberculosis
cucgccgcgggcc

SEQ ID NO: 2896576 - RNA, 21 nt, Mycobacterium avium subsp. paratuberculosis
cucgccgcgggugucgcccuc

SEQ ID NO: 2896577 - RNA, 14 nt, Mycobacterium avium subsp. paratuberculosis
cucgccgcggucau

SEQ ID NO: 2896578 - RNA, 16 nt, Mycobacterium avium subsp. paratuberculosis
cucgccgcggucaucg

SEQ ID NO: 2896579 - RNA, 19 nt, Mycobacterium avium subsp. paratuberculosis
cucgccgcgguggugggcg

SEQ ID NO: 2896580 - RNA, 18 nt, Mycobacterium avium subsp. paratuberculosis
cucgccgcguacgccgcc

SEQ ID NO: 2896581 - RNA, 21 nt, Mycobacterium avium subsp. paratuberculosis
cucgccgcucguaacgccacg

SEQ ID NO: 2896582 - RNA, 17 nt, Mycobacterium avium subsp. paratuberculosis
cucgccgcugucgucga

SEQ ID NO: 2896583 - RNA, 19 nt, Mycobacterium avium subsp. paratuberculosis
cucgccggagagcccgucg

SEQ ID NO: 2896584 - RNA, 22 nt, Mycobacterium avium subsp. paratuberculosis
cucgccggagagcccgucgucg

SEQ ID NO: 2896585 - RNA, 23 nt, Mycobacterium avium subsp. paratuberculosis
cucgccggagagcccgucgucgg

SEQ ID NO: 2896586 - RNA, 13 nt, Mycobacterium avium subsp. paratuberculosis
cucgccggccgcc

SEQ ID NO: 2896587 - RNA, 15 nt, Mycobacterium avium subsp. paratuberculosis
cucgccggccgccgu

SEQ ID NO: 2896588 - RNA, 18 nt, Mycobacterium avium subsp. paratuberculosis
cucgccggccgccguggc

SEQ ID NO: 2896589 - RNA, 15 nt, Mycobacterium avium subsp. paratuberculosis
cucgccggccgcggg

SEQ ID NO: 2896590 - RNA, 16 nt, Mycobacterium avium subsp. paratuberculosis
cucgccggccgcgggc

SEQ ID NO: 2896591 - RNA, 14 nt, Mycobacterium avium subsp. paratuberculosis
cucgccggccgggc

SEQ ID NO: 2896592 - RNA, 16 nt, Mycobacterium avium subsp. paratuberculosis
cucgccggccgggcgg

SEQ ID NO: 2896593 - RNA, 14 nt, Mycobacterium avium subsp. paratuberculosis
cucgccggcgccgg

SEQ ID NO: 2896594 - RNA, 15 nt, Mycobacterium avium subsp. paratuberculosis
cucgccggcgccggg

SEQ ID NO: 2896595 - RNA, 13 nt, Mycobacterium avium subsp. paratuberculosis
cucgccggcgcgc

SEQ ID NO: 2896596 - RNA, 15 nt, Mycobacterium avium subsp. paratuberculosis
cucgccggcgcgcag

SEQ ID NO: 2896597 - RNA, 14 nt, Mycobacterium avium subsp. paratuberculosis
cucgccggcgcgga

SEQ ID NO: 2896598 - RNA, 13 nt, Mycobacterium avium subsp. paratuberculosis
cucgccggcggcc

SEQ ID NO: 2896599 - RNA, 14 nt, Mycobacterium avium subsp. paratuberculosis
cucgccggcggccg

SEQ ID NO: 2896600 - RNA, 15 nt, Mycobacterium avium subsp. paratuberculosis
cucgccggcggccgc

SEQ ID NO: 2896601 - RNA, 18 nt, Mycobacterium avium subsp. paratuberculosis
cucgccggcggccgccac

SEQ ID NO: 2896602 - RNA, 18 nt, Mycobacterium avium subsp. paratuberculosis
cucgccggcggcgcccgc

SEQ ID NO: 2896603 - RNA, 22 nt, Mycobacterium avium subsp. paratuberculosis
cucgccggcggcgcccgcggcc

SEQ ID NO: 2896604 - RNA, 16 nt, Mycobacterium avium subsp. paratuberculosis
cucgccggcggcgccg

SEQ ID NO: 2896605 - RNA, 20 nt, Mycobacterium avium subsp. paratuberculosis
cucgccggcuaccggcgcug

SEQ ID NO: 2896606 - RNA, 21 nt, Mycobacterium avium subsp. paratuberculosis
cucgccgggcugcacgcugcg

SEQ ID NO: 2896607 - RNA, 15 nt, Mycobacterium avium subsp. paratuberculosis
cucgccggggaacac

SEQ ID NO: 2896608 - RNA, 20 nt, Mycobacterium avium subsp. paratuberculosis
cucgccggggacgacggcgg

SEQ ID NO: 2896609 - RNA, 17 nt, Mycobacterium avium subsp. paratuberculosis
cucgccggucagcacgu

SEQ ID NO: 2896610 - RNA, 19 nt, Mycobacterium avium subsp. paratuberculosis
cucgccggucagcacgucg

SEQ ID NO: 2896611 - RNA, 17 nt, Mycobacterium avium subsp. paratuberculosis
cucgccgguggcggcga

SEQ ID NO: 2896612 - RNA, 18 nt, Mycobacterium avium subsp. paratuberculosis
cucgccgguggcggcgac

SEQ ID NO: 2896613 - RNA, 17 nt, Mycobacterium avium subsp. paratuberculosis
cucgccguacgcgccgg

SEQ ID NO: 2896614 - RNA, 19 nt, Mycobacterium avium subsp. paratuberculosis
cucgccguacgcgccggcc

SEQ ID NO: 2896615 - RNA, 20 nt, Mycobacterium avium subsp. paratuberculosis
cucgccguacgcgccggcca

SEQ ID NO: 2896616 - RNA, 22 nt, Mycobacterium avium subsp. paratuberculosis
cucgccguacgcgccggccagc

SEQ ID NO: 2896617 - RNA, 17 nt, Mycobacterium avium subsp. paratuberculosis
cucgccgucacaccgcg

SEQ ID NO: 2896618 - RNA, 19 nt, Mycobacterium avium subsp. paratuberculosis
cucgccgucacaccgcggc

SEQ ID NO: 2896619 - RNA, 22 nt, Mycobacterium avium subsp. paratuberculosis
cucgccgucacaccgcggccag

SEQ ID NO: 2896620 - RNA, 23 nt, Mycobacterium avium subsp. paratuberculosis
cucgccgucacaccgcggccagc

SEQ ID NO: 2896621 - RNA, 14 nt, Mycobacterium avium subsp. paratuberculosis
cucgccguccucgc

SEQ ID NO: 2896622 - RNA, 19 nt, Mycobacterium avium subsp. paratuberculosis
cucgccgucgaaggccggg

SEQ ID NO: 2896623 - RNA, 14 nt, Mycobacterium avium subsp. paratuberculosis
cucgccgucggcca

SEQ ID NO: 2896624 - RNA, 15 nt, Mycobacterium avium subsp. paratuberculosis
cucgccgucggccag

SEQ ID NO: 2896625 - RNA, 16 nt, Mycobacterium avium subsp. paratuberculosis
cucgccgucggccagc

SEQ ID NO: 2896626 - RNA, 17 nt, Mycobacterium avium subsp. paratuberculosis
cucgccgucggccagca

SEQ ID NO: 2896627 - RNA, 19 nt, Mycobacterium avium subsp. paratuberculosis
cucgccgucggccagcagc

SEQ ID NO: 2896628 - RNA, 19 nt, Mycobacterium avium subsp. paratuberculosis
cucgccgugcagcaccucg

SEQ ID NO: 2896629 - RNA, 20 nt, Mycobacterium avium subsp. paratuberculosis
cucgccgugcagcaccucga

SEQ ID NO: 2896630 - RNA, 16 nt, Mycobacterium avium subsp. paratuberculosis
cucgccguugccggcc

SEQ ID NO: 2896631 - RNA, 17 nt, Mycobacterium avium subsp. paratuberculosis
cucgccguugccggccc

SEQ ID NO: 2896632 - RNA, 19 nt, Mycobacterium avium subsp. paratuberculosis
cucgccguugccggcccgc

SEQ ID NO: 2896633 - RNA, 20 nt, Mycobacterium avium subsp. paratuberculosis
cucgccguugccggcccgca

SEQ ID NO: 2896634 - RNA, 19 nt, Mycobacterium avium subsp. paratuberculosis
cucgccguugcgggucggc

SEQ ID NO: 2896635 - RNA, 19 nt, Mycobacterium avium subsp. paratuberculosis
cucgccuccagcagggaca

SEQ ID NO: 2896636 - RNA, 19 nt, Mycobacterium avium subsp. paratuberculosis
cucgccucggaggccaccg

SEQ ID NO: 2896637 - RNA, 21 nt, Mycobacterium avium subsp. paratuberculosis
cucgccucggaggccaccgcg

SEQ ID NO: 2896638 - RNA, 14 nt, Mycobacterium avium subsp. paratuberculosis
cucgccugcgagcg

SEQ ID NO: 2896639 - RNA, 15 nt, Mycobacterium avium subsp. paratuberculosis
cucgccugucggucg

SEQ ID NO: 2896640 - RNA, 20 nt, Mycobacterium avium subsp. paratuberculosis
cucgccuuugaugacgacgu

SEQ ID NO: 2896641 - RNA, 17 nt, Mycobacterium avium subsp. paratuberculosis
cucgcgaagcgcgaugc

SEQ ID NO: 2896642 - RNA, 13 nt, Mycobacterium avium subsp. paratuberculosis
cucgcgacgcggc

SEQ ID NO: 2896643 - RNA, 14 nt, Mycobacterium avium subsp. paratuberculosis
cucgcgacgcggcu

SEQ ID NO: 2896644 - RNA, 19 nt, Mycobacterium avium subsp. paratuberculosis
cucgcgacgcggcucgcgc

SEQ ID NO: 2896645 - RNA, 16 nt, Mycobacterium avium subsp. paratuberculosis
cucgcgaggccgccau

SEQ ID NO: 2896646 - RNA, 15 nt, Mycobacterium avium subsp. paratuberculosis
cucgcgagggcgggc

SEQ ID NO: 2896647 - RNA, 14 nt, Mycobacterium avium subsp. paratuberculosis
cucgcgauggcggg

SEQ ID NO: 2896648 - RNA, 21 nt, Mycobacterium avium subsp. paratuberculosis
cucgcgcaauaacggagcggc

SEQ ID NO: 2896649 - RNA, 16 nt, Mycobacterium avium subsp. paratuberculosis
cucgcgcaaugccgcc

SEQ ID NO: 2896650 - RNA, 21 nt, Mycobacterium avium subsp. paratuberculosis
cucgcgcaaugccgccgcgac

SEQ ID NO: 2896651 - RNA, 22 nt, Mycobacterium avium subsp. paratuberculosis
cucgcgcaaugccgccgcgacg

SEQ ID NO: 2896652 - RNA, 13 nt, Mycobacterium avium subsp. paratuberculosis
cucgcgcaccgcg

SEQ ID NO: 2896653 - RNA, 14 nt, Mycobacterium avium subsp. paratuberculosis
cucgcgcaccgcgg

SEQ ID NO: 2896654 - RNA, 17 nt, Mycobacterium avium subsp. paratuberculosis
cucgcgcaccggcugcc

SEQ ID NO: 2896655 - RNA, 20 nt, Mycobacterium avium subsp. paratuberculosis
cucgcgcaccggcugcccca

SEQ ID NO: 2896656 - RNA, 14 nt, Mycobacterium avium subsp. paratuberculosis
cucgcgcaccggga

SEQ ID NO: 2896657 - RNA, 17 nt, Mycobacterium avium subsp. paratuberculosis
cucgcgcaccgggacca

SEQ ID NO: 2896658 - RNA, 21 nt, Mycobacterium avium subsp. paratuberculosis
cucgcgcacuucgcgggcggc

SEQ ID NO: 2896659 - RNA, 12 nt, Mycobacterium avium subsp. paratuberculosis
cucgcgcagcac

SEQ ID NO: 2896660 - RNA, 15 nt, Mycobacterium avium subsp. paratuberculosis
cucgcgcagcaccga

SEQ ID NO: 2896661 - RNA, 22 nt, Mycobacterium avium subsp. paratuberculosis
cucgcgcagcaccgaugccaga

SEQ ID NO: 2896662 - RNA, 14 nt, Mycobacterium avium subsp. paratuberculosis
cucgcgcagcacga

SEQ ID NO: 2896663 - RNA, 12 nt, Mycobacterium avium subsp. paratuberculosis
cucgcgcagccc

SEQ ID NO: 2896664 - RNA, 13 nt, Mycobacterium avium subsp. paratuberculosis
cucgcgcagcccc

SEQ ID NO: 2896665 - RNA, 14 nt, Mycobacterium avium subsp. paratuberculosis
cucgcgcagccggc

SEQ ID NO: 2896666 - RNA, 15 nt, Mycobacterium avium subsp. paratuberculosis
cucgcgcagccggcc

SEQ ID NO: 2896667 - RNA, 16 nt, Mycobacterium avium subsp. paratuberculosis
cucgcgcagccggccg

SEQ ID NO: 2896668 - RNA, 22 nt, Mycobacterium avium subsp. paratuberculosis
cucgcgcagccggccgaccgcc

SEQ ID NO: 2896669 - RNA, 19 nt, Mycobacterium avium subsp. paratuberculosis
cucgcgcagcgcgucgggc

SEQ ID NO: 2896670 - RNA, 15 nt, Mycobacterium avium subsp. paratuberculosis
cucgcgcagcuggcc

SEQ ID NO: 2896671 - RNA, 20 nt, Mycobacterium avium subsp. paratuberculosis
cucgcgcaggaacuccagca

SEQ ID NO: 2896672 - RNA, 18 nt, Mycobacterium avium subsp. paratuberculosis
cucgcgcagggccagcgc

SEQ ID NO: 2896673 - RNA, 19 nt, Mycobacterium avium subsp. paratuberculosis
cucgcgcagggccagcgcc

SEQ ID NO: 2896674 - RNA, 14 nt, Mycobacterium avium subsp. paratuberculosis
cucgcgcaggucac

SEQ ID NO: 2896675 - RNA, 23 nt, Mycobacterium avium subsp. paratuberculosis
cucgcgcaggucacccuccucgc

SEQ ID NO: 2896676 - RNA, 16 nt, Mycobacterium avium subsp. paratuberculosis
cucgcgcaucagcgga

SEQ ID NO: 2896677 - RNA, 12 nt, Mycobacterium avium subsp. paratuberculosis
cucgcgcccggc

SEQ ID NO: 2896678 - RNA, 20 nt, Mycobacterium avium subsp. paratuberculosis
cucgcgcccuaacgugcccg

SEQ ID NO: 2896679 - RNA, 19 nt, Mycobacterium avium subsp. paratuberculosis
cucgcgccgacccgcccgc

SEQ ID NO: 2896680 - RNA, 23 nt, Mycobacterium avium subsp. paratuberculosis
cucgcgccgcgaucucggcggac

SEQ ID NO: 2896681 - RNA, 14 nt, Mycobacterium avium subsp. paratuberculosis
cucgcgccgcgcau

SEQ ID NO: 2896682 - RNA, 16 nt, Mycobacterium avium subsp. paratuberculosis
cucgcgccgggcggcc

SEQ ID NO: 2896683 - RNA, 13 nt, Mycobacterium avium subsp. paratuberculosis
cucgcgccguggc

SEQ ID NO: 2896684 - RNA, 14 nt, Mycobacterium avium subsp. paratuberculosis
cucgcgccguggcc

SEQ ID NO: 2896685 - RNA, 13 nt, Mycobacterium avium subsp. paratuberculosis
cucgcgcgcgagc

SEQ ID NO: 2896686 - RNA, 15 nt, Mycobacterium avium subsp. paratuberculosis
cucgcgcggggcggc

SEQ ID NO: 2896687 - RNA, 23 nt, Mycobacterium avium subsp. paratuberculosis
cucgcgcgggucgagcagcagcc

SEQ ID NO: 2896688 - RNA, 15 nt, Mycobacterium avium subsp. paratuberculosis
cucgcgcgucacgcu

SEQ ID NO: 2896689 - RNA, 18 nt, Mycobacterium avium subsp. paratuberculosis
cucgcgcucccggcgccg

SEQ ID NO: 2896690 - RNA, 19 nt, Mycobacterium avium subsp. paratuberculosis
cucgcgcucccggcgccgc

SEQ ID NO: 2896691 - RNA, 20 nt, Mycobacterium avium subsp. paratuberculosis
cucgcgcucccggcgccgcc

SEQ ID NO: 2896692 - RNA, 21 nt, Mycobacterium avium subsp. paratuberculosis
cucgcgcucccggcgccgccg

SEQ ID NO: 2896693 - RNA, 15 nt, Mycobacterium avium subsp. paratuberculosis
cucgcgcugccgcgc

SEQ ID NO: 2896694 - RNA, 19 nt, Mycobacterium avium subsp. paratuberculosis
cucgcggaaccgcuugagc

SEQ ID NO: 2896695 - RNA, 19 nt, Mycobacterium avium subsp. paratuberculosis
cucgcggauccgggccggc

SEQ ID NO: 2896696 - RNA, 17 nt, Mycobacterium avium subsp. paratuberculosis
cucgcggcaaggcgcag

SEQ ID NO: 2896697 - RNA, 16 nt, Mycobacterium avium subsp. paratuberculosis
cucgcggccugcgggc

SEQ ID NO: 2896698 - RNA, 12 nt, Mycobacterium avium subsp. paratuberculosis
cucgcggcgcag

SEQ ID NO: 2896699 - RNA, 14 nt, Mycobacterium avium subsp. paratuberculosis
cucgcggcgcagcu

SEQ ID NO: 2896700 - RNA, 12 nt, Mycobacterium avium subsp. paratuberculosis
cucgcggcggcc

SEQ ID NO: 2896701 - RNA, 19 nt, Mycobacterium avium subsp. paratuberculosis
cucgcggcggccgacgcgc

SEQ ID NO: 2896702 - RNA, 12 nt, Mycobacterium avium subsp. paratuberculosis
cucgcggcgggu

SEQ ID NO: 2896703 - RNA, 16 nt, Mycobacterium avium subsp. paratuberculosis
cucgcggcgggucagc

SEQ ID NO: 2896704 - RNA, 22 nt, Mycobacterium avium subsp. paratuberculosis
cucgcggcgggucagcacccgc

SEQ ID NO: 2896705 - RNA, 20 nt, Mycobacterium avium subsp. paratuberculosis
cucgcggcguaggcggccau

SEQ ID NO: 2896706 - RNA, 14 nt, Mycobacterium avium subsp. paratuberculosis
cucgcgggacggcg

SEQ ID NO: 2896707 - RNA, 16 nt, Mycobacterium avium subsp. paratuberculosis
cucgcgggacggcggc

SEQ ID NO: 2896708 - RNA, 18 nt, Mycobacterium avium subsp. paratuberculosis
cucgcgggacggcggcga

SEQ ID NO: 2896709 - RNA, 19 nt, Mycobacterium avium subsp. paratuberculosis
cucgcgggacggcggcgag

SEQ ID NO: 2896710 - RNA, 17 nt, Mycobacterium avium subsp. paratuberculosis
cucgcgggaguggccgg

SEQ ID NO: 2896711 - RNA, 18 nt, Mycobacterium avium subsp. paratuberculosis
cucgcgggaguggccggc

SEQ ID NO: 2896712 - RNA, 15 nt, Mycobacterium avium subsp. paratuberculosis
cucgcgggccacagc

SEQ ID NO: 2896713 - RNA, 21 nt, Mycobacterium avium subsp. paratuberculosis
cucgcgggccacagcggcgac

SEQ ID NO: 2896714 - RNA, 13 nt, Mycobacterium avium subsp. paratuberculosis
cucgcgggccacc

SEQ ID NO: 2896715 - RNA, 21 nt, Mycobacterium avium subsp. paratuberculosis
cucgcgggcccgcgccgcguc

SEQ ID NO: 2896716 - RNA, 19 nt, Mycobacterium avium subsp. paratuberculosis
cucgcgggcccgcgcggcg

SEQ ID NO: 2896717 - RNA, 14 nt, Mycobacterium avium subsp. paratuberculosis
cucgcgggcgaccu

SEQ ID NO: 2896718 - RNA, 20 nt, Mycobacterium avium subsp. paratuberculosis
cucgcgggcgaucuccagcg

SEQ ID NO: 2896719 - RNA, 23 nt, Mycobacterium avium subsp. paratuberculosis
cucgcgggcgaucuccagcggcc

SEQ ID NO: 2896720 - RNA, 22 nt, Mycobacterium avium subsp. paratuberculosis
cucgcgggcgaugcggcccggc

SEQ ID NO: 2896721 - RNA, 17 nt, Mycobacterium avium subsp. paratuberculosis
cucgcggggugucgugc

SEQ ID NO: 2896722 - RNA, 19 nt, Mycobacterium avium subsp. paratuberculosis
cucgcgggugcggcgcugc

SEQ ID NO: 2896723 - RNA, 20 nt, Mycobacterium avium subsp. paratuberculosis
cucgcgggugcggcgcugcc

SEQ ID NO: 2896724 - RNA, 23 nt, Mycobacterium avium subsp. paratuberculosis
cucgcgggugcggcgcugccggc

SEQ ID NO: 2896725 - RNA, 21 nt, Mycobacterium avium subsp. paratuberculosis
cucgcgggugucgagccacca

SEQ ID NO: 2896726 - RNA, 14 nt, Mycobacterium avium subsp. paratuberculosis
cucgcggucgaagg

SEQ ID NO: 2896727 - RNA, 13 nt, Mycobacterium avium subsp. paratuberculosis
cucgcggucgacg

SEQ ID NO: 2896728 - RNA, 14 nt, Mycobacterium avium subsp. paratuberculosis
cucgcggucgacgg

SEQ ID NO: 2896729 - RNA, 14 nt, Mycobacterium avium subsp. paratuberculosis
cucgcggucgggga

SEQ ID NO: 2896730 - RNA, 17 nt, Mycobacterium avium subsp. paratuberculosis
cucgcggucuucgaaca

SEQ ID NO: 2896731 - RNA, 20 nt, Mycobacterium avium subsp. paratuberculosis
cucgcgguugggccgccggc

SEQ ID NO: 2896732 - RNA, 21 nt, Mycobacterium avium subsp. paratuberculosis
cucgcgguugggccgccggcc

SEQ ID NO: 2896733 - RNA, 22 nt, Mycobacterium avium subsp. paratuberculosis
cucgcgguugggccgccggccg

SEQ ID NO: 2896734 - RNA, 15 nt, Mycobacterium avium subsp. paratuberculosis
cucgcguagcgaggu

SEQ ID NO: 2896735 - RNA, 18 nt, Mycobacterium avium subsp. paratuberculosis
cucgcguagcgaggugug

SEQ ID NO: 2896736 - RNA, 16 nt, Mycobacterium avium subsp. paratuberculosis
cucgcguccccgcgcc

SEQ ID NO: 2896737 - RNA, 20 nt, Mycobacterium avium subsp. paratuberculosis
cucgcguccccgcgccgggc

SEQ ID NO: 2896738 - RNA, 12 nt, Mycobacterium avium subsp. paratuberculosis
cucgcgucgacg

SEQ ID NO: 2896739 - RNA, 15 nt, Mycobacterium avium subsp. paratuberculosis
cucgcgucgacgucg

SEQ ID NO: 2896740 - RNA, 18 nt, Mycobacterium avium subsp. paratuberculosis
cucgcguggccugggcga

SEQ ID NO: 2896741 - RNA, 20 nt, Mycobacterium avium subsp. paratuberculosis
cucgcguggccugggcgacc

SEQ ID NO: 2896742 - RNA, 23 nt, Mycobacterium avium subsp. paratuberculosis
cucgcguucgcuuucgccgggcg

SEQ ID NO: 2896743 - RNA, 18 nt, Mycobacterium avium subsp. paratuberculosis
cucgcguucgggcccggc

SEQ ID NO: 2896744 - RNA, 23 nt, Mycobacterium avium subsp. paratuberculosis
cucgcguucgggcccggccgcca

SEQ ID NO: 2896745 - RNA, 17 nt, Mycobacterium avium subsp. paratuberculosis
cucgcuaaucgccgcgc

SEQ ID NO: 2896746 - RNA, 15 nt, Mycobacterium avium subsp. paratuberculosis
cucgcuacgcgagcu

SEQ ID NO: 2896747 - RNA, 20 nt, Mycobacterium avium subsp. paratuberculosis
cucgcuauaucgcaccggcg

SEQ ID NO: 2896748 - RNA, 16 nt, Mycobacterium avium subsp. paratuberculosis
cucgcucaacccgucg

SEQ ID NO: 2896749 - RNA, 20 nt, Mycobacterium avium subsp. paratuberculosis
cucgcucaacccgucgcggg

SEQ ID NO: 2896750 - RNA, 14 nt, Mycobacterium avium subsp. paratuberculosis
cucgcucagcccgg

SEQ ID NO: 2896751 - RNA, 12 nt, Mycobacterium avium subsp. paratuberculosis
cucgcucugccg

SEQ ID NO: 2896752 - RNA, 16 nt, Mycobacterium avium subsp. paratuberculosis
cucgcugacgucgaug

SEQ ID NO: 2896753 - RNA, 22 nt, Mycobacterium avium subsp. paratuberculosis
cucgcugacgucgaugccggcc

SEQ ID NO: 2896754 - RNA, 16 nt, Mycobacterium avium subsp. paratuberculosis
cucgcugaucucgacg

SEQ ID NO: 2896755 - RNA, 12 nt, Mycobacterium avium subsp. paratuberculosis
cucgcugccgcc

SEQ ID NO: 2896756 - RNA, 15 nt, Mycobacterium avium subsp. paratuberculosis
cucgcugccgccccc

SEQ ID NO: 2896757 - RNA, 13 nt, Mycobacterium avium subsp. paratuberculosis
cucgcugccggcc

SEQ ID NO: 2896758 - RNA, 17 nt, Mycobacterium avium subsp. paratuberculosis
cucgcugccggccgggg

SEQ ID NO: 2896759 - RNA, 18 nt, Mycobacterium avium subsp. paratuberculosis
cucgcugccggccggggc

SEQ ID NO: 2896760 - RNA, 22 nt, Mycobacterium avium subsp. paratuberculosis
cucgcugccggccggggcggcg

SEQ ID NO: 2896761 - RNA, 15 nt, Mycobacterium avium subsp. paratuberculosis
cucgcugcggcgcag

SEQ ID NO: 2896762 - RNA, 15 nt, Mycobacterium avium subsp. paratuberculosis
cucgcugcucugcgc

SEQ ID NO: 2896763 - RNA, 14 nt, Mycobacterium avium subsp. paratuberculosis
cucgcuggcgauca

SEQ ID NO: 2896764 - RNA, 18 nt, Mycobacterium avium subsp. paratuberculosis
cucgcuggcgaucaccuu

SEQ ID NO: 2896765 - RNA, 22 nt, Mycobacterium avium subsp. paratuberculosis
cucgcuggcgaucaccuugcgg

SEQ ID NO: 2896766 - RNA, 23 nt, Mycobacterium avium subsp. paratuberculosis
cucgcuggcgaucaccuugcggc

SEQ ID NO: 2896767 - RNA, 13 nt, Mycobacterium avium subsp. paratuberculosis
cucgcuggcggcg

SEQ ID NO: 2896768 - RNA, 15 nt, Mycobacterium avium subsp. paratuberculosis
cucgcuggcggcgcg

SEQ ID NO: 2896769 - RNA, 16 nt, Mycobacterium avium subsp. paratuberculosis
cucgcuguccugccgg

SEQ ID NO: 2896770 - RNA, 18 nt, Mycobacterium avium subsp. paratuberculosis
cucgcuguccugccgggc

SEQ ID NO: 2896771 - RNA, 17 nt, Mycobacterium avium subsp. paratuberculosis
cucgcuugccagccggg

SEQ ID NO: 2896772 - RNA, 20 nt, Mycobacterium avium subsp. paratuberculosis
cucggaaugaacugccgcgg

SEQ ID NO: 2896773 - RNA, 21 nt, Mycobacterium avium subsp. paratuberculosis
cucggaaugaacugccgcggc

SEQ ID NO: 2896774 - RNA, 12 nt, Mycobacterium avium subsp. paratuberculosis
cucggaccgguu

SEQ ID NO: 2896775 - RNA, 12 nt, Mycobacterium avium subsp. paratuberculosis
cucggacgccgg

SEQ ID NO: 2896776 - RNA, 18 nt, Mycobacterium avium subsp. paratuberculosis
cucggacgccggcagccg

SEQ ID NO: 2896777 - RNA, 19 nt, Mycobacterium avium subsp. paratuberculosis
cucggagaccuuggcgcug

SEQ ID NO: 2896778 - RNA, 20 nt, Mycobacterium avium subsp. paratuberculosis
cucggagaugauggccgcgc

SEQ ID NO: 2896779 - RNA, 13 nt, Mycobacterium avium subsp. paratuberculosis
cucggaggccacc

SEQ ID NO: 2896780 - RNA, 19 nt, Mycobacterium avium subsp. paratuberculosis
cucggaggugccgcgcggc

SEQ ID NO: 2896781 - RNA, 20 nt, Mycobacterium avium subsp. paratuberculosis
cucggaggugccgcgcggca

SEQ ID NO: 2896782 - RNA, 24 nt, Mycobacterium avium subsp. paratuberculosis
cucggaguucgcccgcagcacgcc

SEQ ID NO: 2896783 - RNA, 17 nt, Mycobacterium avium subsp. paratuberculosis
cucggaguugcgcagcc

SEQ ID NO: 2896784 - RNA, 22 nt, Mycobacterium avium subsp. paratuberculosis
cucggaucccggggcgcgcugg

SEQ ID NO: 2896785 - RNA, 23 nt, Mycobacterium avium subsp. paratuberculosis
cucggaucccggggcgcgcuggg

SEQ ID NO: 2896786 - RNA, 15 nt, Mycobacterium avium subsp. paratuberculosis
cucggauuccgcgga

SEQ ID NO: 2896787 - RNA, 18 nt, Mycobacterium avium subsp. paratuberculosis
cucggcaccagagcgccg

SEQ ID NO: 2896788 - RNA, 21 nt, Mycobacterium avium subsp. paratuberculosis
cucggcaccagagcgccggac

SEQ ID NO: 2896789 - RNA, 12 nt, Mycobacterium avium subsp. paratuberculosis
cucggcaccgug

SEQ ID NO: 2896790 - RNA, 18 nt, Mycobacterium avium subsp. paratuberculosis
cucggcaccgugccgcgc

SEQ ID NO: 2896791 - RNA, 22 nt, Mycobacterium avium subsp. paratuberculosis
cucggcaccgugccgcgcggcg

SEQ ID NO: 2896792 - RNA, 14 nt, Mycobacterium avium subsp. paratuberculosis
cucggcagccccgu

SEQ ID NO: 2896793 - RNA, 14 nt, Mycobacterium avium subsp. paratuberculosis
cucggccaaccggg

SEQ ID NO: 2896794 - RNA, 17 nt, Mycobacterium avium subsp. paratuberculosis
cucggccaaccgggcag

SEQ ID NO: 2896795 - RNA, 22 nt, Mycobacterium avium subsp. paratuberculosis
cucggccaaccgggcaggcacg

SEQ ID NO: 2896796 - RNA, 14 nt, Mycobacterium avium subsp. paratuberculosis
cucggccaccaccu

SEQ ID NO: 2896797 - RNA, 15 nt, Mycobacterium avium subsp. paratuberculosis
cucggccaccaccuc

SEQ ID NO: 2896798 - RNA, 17 nt, Mycobacterium avium subsp. paratuberculosis
cucggccaccaccucgc

SEQ ID NO: 2896799 - RNA, 13 nt, Mycobacterium avium subsp. paratuberculosis
cucggccaccaga

SEQ ID NO: 2896800 - RNA, 23 nt, Mycobacterium avium subsp. paratuberculosis
cucggccaccagaugccgggcuc

SEQ ID NO: 2896801 - RNA, 13 nt, Mycobacterium avium subsp. paratuberculosis
cucggccaccagc

SEQ ID NO: 2896802 - RNA, 18 nt, Mycobacterium avium subsp. paratuberculosis
cucggccaccagcgcccg

SEQ ID NO: 2896803 - RNA, 21 nt, Mycobacterium avium subsp. paratuberculosis
cucggccaccagcgcccgccc

SEQ ID NO: 2896804 - RNA, 13 nt, Mycobacterium avium subsp. paratuberculosis
cucggccaccgcg

SEQ ID NO: 2896805 - RNA, 23 nt, Mycobacterium avium subsp. paratuberculosis
cucggccaccgcgcggugcacca

SEQ ID NO: 2896806 - RNA, 14 nt, Mycobacterium avium subsp. paratuberculosis
cucggccaccguca

SEQ ID NO: 2896807 - RNA, 21 nt, Mycobacterium avium subsp. paratuberculosis
cucggccaccgucagcgucag

SEQ ID NO: 2896808 - RNA, 13 nt, Mycobacterium avium subsp. paratuberculosis
cucggccacgacg

SEQ ID NO: 2896809 - RNA, 17 nt, Mycobacterium avium subsp. paratuberculosis
cucggccacgacgcgcc

SEQ ID NO: 2896810 - RNA, 22 nt, Mycobacterium avium subsp. paratuberculosis
cucggccacgacgcgccacgcc

SEQ ID NO: 2896811 - RNA, 16 nt, Mycobacterium avium subsp. paratuberculosis
cucggccagcagcacc

SEQ ID NO: 2896812 - RNA, 17 nt, Mycobacterium avium subsp. paratuberculosis
cucggccagcagcacca

SEQ ID NO: 2896813 - RNA, 13 nt, Mycobacterium avium subsp. paratuberculosis
cucggccagcagu

SEQ ID NO: 2896814 - RNA, 16 nt, Mycobacterium avium subsp. paratuberculosis
cucggccagccaggcc

SEQ ID NO: 2896815 - RNA, 12 nt, Mycobacterium avium subsp. paratuberculosis
cucggccagccc

SEQ ID NO: 2896816 - RNA, 13 nt, Mycobacterium avium subsp. paratuberculosis
cucggccagcccc

SEQ ID NO: 2896817 - RNA, 18 nt, Mycobacterium avium subsp. paratuberculosis
cucggccagccccaccac

SEQ ID NO: 2896818 - RNA, 14 nt, Mycobacterium avium subsp. paratuberculosis
cucggccagcgcag

SEQ ID NO: 2896819 - RNA, 16 nt, Mycobacterium avium subsp. paratuberculosis
cucggccagcgcagcg

SEQ ID NO: 2896820 - RNA, 20 nt, Mycobacterium avium subsp. paratuberculosis
cucggccagcgcagcgaccu

SEQ ID NO: 2896821 - RNA, 15 nt, Mycobacterium avium subsp. paratuberculosis
cucggccagcgccgc

SEQ ID NO: 2896822 - RNA, 19 nt, Mycobacterium avium subsp. paratuberculosis
cucggccagcgccgcgcgc

SEQ ID NO: 2896823 - RNA, 13 nt, Mycobacterium avium subsp. paratuberculosis
cucggccagcgcg

SEQ ID NO: 2896824 - RNA, 15 nt, Mycobacterium avium subsp. paratuberculosis
cucggccagcgcgcc

SEQ ID NO: 2896825 - RNA, 16 nt, Mycobacterium avium subsp. paratuberculosis
cucggccagcgcgccg

SEQ ID NO: 2896826 - RNA, 17 nt, Mycobacterium avium subsp. paratuberculosis
cucggccagcgcgccgc

SEQ ID NO: 2896827 - RNA, 21 nt, Mycobacterium avium subsp. paratuberculosis
cucggccagcgcgccgcacag

SEQ ID NO: 2896828 - RNA, 12 nt, Mycobacterium avium subsp. paratuberculosis
cucggccagcgg

SEQ ID NO: 2896829 - RNA, 14 nt, Mycobacterium avium subsp. paratuberculosis
cucggccagcgggc

SEQ ID NO: 2896830 - RNA, 18 nt, Mycobacterium avium subsp. paratuberculosis
cucggccagcgggcggcc

SEQ ID NO: 2896831 - RNA, 22 nt, Mycobacterium avium subsp. paratuberculosis
cucggccagggcucgugcagcc

SEQ ID NO: 2896832 - RNA, 15 nt, Mycobacterium avium subsp. paratuberculosis
cucggccaucccggu

SEQ ID NO: 2896833 - RNA, 17 nt, Mycobacterium avium subsp. paratuberculosis
cucggccaucccggugc

SEQ ID NO: 2896834 - RNA, 20 nt, Mycobacterium avium subsp. paratuberculosis
cucggccaucccggugccgc

SEQ ID NO: 2896835 - RNA, 18 nt, Mycobacterium avium subsp. paratuberculosis
cucggccauccgggcggc

SEQ ID NO: 2896836 - RNA, 19 nt, Mycobacterium avium subsp. paratuberculosis
cucggccauccgggcggca

SEQ ID NO: 2896837 - RNA, 20 nt, Mycobacterium avium subsp. paratuberculosis
cucggccauccgggcggcau

SEQ ID NO: 2896838 - RNA, 20 nt, Mycobacterium avium subsp. paratuberculosis
cucggcccgccgggcgccac

SEQ ID NO: 2896839 - RNA, 20 nt, Mycobacterium avium subsp. paratuberculosis
cucggcccgcuucaggcagc

SEQ ID NO: 2896840 - RNA, 14 nt, Mycobacterium avium subsp. paratuberculosis
cucggccgaugagc

SEQ ID NO: 2896841 - RNA, 15 nt, Mycobacterium avium subsp. paratuberculosis
cucggccgaugagcc

SEQ ID NO: 2896842 - RNA, 16 nt, Mycobacterium avium subsp. paratuberculosis
cucggccgccaccgcc

SEQ ID NO: 2896843 - RNA, 22 nt, Mycobacterium avium subsp. paratuberculosis
cucggccgccaccgccaucucg

SEQ ID NO: 2896844 - RNA, 14 nt, Mycobacterium avium subsp. paratuberculosis
cucggccgccgaca

SEQ ID NO: 2896845 - RNA, 20 nt, Mycobacterium avium subsp. paratuberculosis
cucggccgccgacaccacca

SEQ ID NO: 2896846 - RNA, 12 nt, Mycobacterium avium subsp. paratuberculosis
cucggccgcggu

SEQ ID NO: 2896847 - RNA, 14 nt, Mycobacterium avium subsp. paratuberculosis
cucggccggcaccu

SEQ ID NO: 2896848 - RNA, 19 nt, Mycobacterium avium subsp. paratuberculosis
cucggccggccggccgugc

SEQ ID NO: 2896849 - RNA, 17 nt, Mycobacterium avium subsp. paratuberculosis
cucggccggguccugga

SEQ ID NO: 2896850 - RNA, 22 nt, Mycobacterium avium subsp. paratuberculosis
cucggccggguuguccuggccc

SEQ ID NO: 2896851 - RNA, 17 nt, Mycobacterium avium subsp. paratuberculosis
cucggccguaccggcgu

SEQ ID NO: 2896852 - RNA, 22 nt, Mycobacterium avium subsp. paratuberculosis
cucggccucccgguaggcggcg

SEQ ID NO: 2896853 - RNA, 20 nt, Mycobacterium avium subsp. paratuberculosis
cucggccuccgcgcgcggcc

SEQ ID NO: 2896854 - RNA, 23 nt, Mycobacterium avium subsp. paratuberculosis
cucggccuccgcgcgcggcccgu

SEQ ID NO: 2896855 - RNA, 17 nt, Mycobacterium avium subsp. paratuberculosis
cucggccucgucgacgu

SEQ ID NO: 2896856 - RNA, 20 nt, Mycobacterium avium subsp. paratuberculosis
cucggccucgucgacgucgg

SEQ ID NO: 2896857 - RNA, 16 nt, Mycobacterium avium subsp. paratuberculosis
cucggccuucggggug

SEQ ID NO: 2896858 - RNA, 18 nt, Mycobacterium avium subsp. paratuberculosis
cucggccuugagccgguc

SEQ ID NO: 2896859 - RNA, 18 nt, Mycobacterium avium subsp. paratuberculosis
cucggccuugccgcugug

SEQ ID NO: 2896860 - RNA, 18 nt, Mycobacterium avium subsp. paratuberculosis
cucggcgaagucaucacc

SEQ ID NO: 2896861 - RNA, 20 nt, Mycobacterium avium subsp. paratuberculosis
cucggcgaagucaucaccgg

SEQ ID NO: 2896862 - RNA, 18 nt, Mycobacterium avium subsp. paratuberculosis
cucggcgacaacagcgcc

SEQ ID NO: 2896863 - RNA, 19 nt, Mycobacterium avium subsp. paratuberculosis
cucggcgacaacagcgccg

SEQ ID NO: 2896864 - RNA, 21 nt, Mycobacterium avium subsp. paratuberculosis
cucggcgacaacagcgccgag

SEQ ID NO: 2896865 - RNA, 20 nt, Mycobacterium avium subsp. paratuberculosis
cucggcgaccagcgacggca

SEQ ID NO: 2896866 - RNA, 17 nt, Mycobacterium avium subsp. paratuberculosis
cucggcgaccgcccggg

SEQ ID NO: 2896867 - RNA, 17 nt, Mycobacterium avium subsp. paratuberculosis
cucggcgaccgccggug

SEQ ID NO: 2896868 - RNA, 22 nt, Mycobacterium avium subsp. paratuberculosis
cucggcgaccgccgguggggug

SEQ ID NO: 2896869 - RNA, 13 nt, Mycobacterium avium subsp. paratuberculosis
cucggcgacgaug

SEQ ID NO: 2896870 - RNA, 22 nt, Mycobacterium avium subsp. paratuberculosis
cucggcgacgaugaagacccgc

SEQ ID NO: 2896871 - RNA, 15 nt, Mycobacterium avium subsp. paratuberculosis
cucggcgacgauggc

SEQ ID NO: 2896872 - RNA, 16 nt, Mycobacterium avium subsp. paratuberculosis
cucggcgagcaccgug

SEQ ID NO: 2896873 - RNA, 17 nt, Mycobacterium avium subsp. paratuberculosis
cucggcgagcaccgugc

SEQ ID NO: 2896874 - RNA, 18 nt, Mycobacterium avium subsp. paratuberculosis
cucggcgagcaccgugcc

SEQ ID NO: 2896875 - RNA, 19 nt, Mycobacterium avium subsp. paratuberculosis
cucggcgagcaccgugccg

SEQ ID NO: 2896876 - RNA, 24 nt, Mycobacterium avium subsp. paratuberculosis
cucggcgagcaccgugccgucggc

SEQ ID NO: 2896877 - RNA, 13 nt, Mycobacterium avium subsp. paratuberculosis
cucggcgagccgc

SEQ ID NO: 2896878 - RNA, 18 nt, Mycobacterium avium subsp. paratuberculosis
cucggcgagcugcgggug

SEQ ID NO: 2896879 - RNA, 16 nt, Mycobacterium avium subsp. paratuberculosis
cucggcgaggucgucg

SEQ ID NO: 2896880 - RNA, 17 nt, Mycobacterium avium subsp. paratuberculosis
cucggcgaggucgucga

SEQ ID NO: 2896881 - RNA, 19 nt, Mycobacterium avium subsp. paratuberculosis
cucggcgaggucgucgagg

SEQ ID NO: 2896882 - RNA, 16 nt, Mycobacterium avium subsp. paratuberculosis
cucggcgaucaccgcg

SEQ ID NO: 2896883 - RNA, 18 nt, Mycobacterium avium subsp. paratuberculosis
cucggcgaucaccgcguu

SEQ ID NO: 2896884 - RNA, 18 nt, Mycobacterium avium subsp. paratuberculosis
cucggcgaucagcugccc

SEQ ID NO: 2896885 - RNA, 17 nt, Mycobacterium avium subsp. paratuberculosis
cucggcgaucggccgcu

SEQ ID NO: 2896886 - RNA, 19 nt, Mycobacterium avium subsp. paratuberculosis
cucggcgaucggccgcugc

SEQ ID NO: 2896887 - RNA, 21 nt, Mycobacterium avium subsp. paratuberculosis
cucggcgaugccguugaucac

SEQ ID NO: 2896888 - RNA, 23 nt, Mycobacterium avium subsp. paratuberculosis
cucggcgauggugaugugcggcg

SEQ ID NO: 2896889 - RNA, 22 nt, Mycobacterium avium subsp. paratuberculosis
cucggcgauguugaccacccgc

SEQ ID NO: 2896890 - RNA, 13 nt, Mycobacterium avium subsp. paratuberculosis
cucggcgcaggug

SEQ ID NO: 2896891 - RNA, 16 nt, Mycobacterium avium subsp. paratuberculosis
cucggcgccccacgcc

SEQ ID NO: 2896892 - RNA, 17 nt, Mycobacterium avium subsp. paratuberculosis
cucggcgccccacgccu

SEQ ID NO: 2896893 - RNA, 18 nt, Mycobacterium avium subsp. paratuberculosis
cucggcgccccacgccug

SEQ ID NO: 2896894 - RNA, 17 nt, Mycobacterium avium subsp. paratuberculosis
cucggcgccgaccucgg

SEQ ID NO: 2896895 - RNA, 20 nt, Mycobacterium avium subsp. paratuberculosis
cucggcgccgaccucggcca

SEQ ID NO: 2896896 - RNA, 21 nt, Mycobacterium avium subsp. paratuberculosis
cucggcgccgaccucggccag

SEQ ID NO: 2896897 - RNA, 13 nt, Mycobacterium avium subsp. paratuberculosis
cucggcgccgagc

SEQ ID NO: 2896898 - RNA, 12 nt, Mycobacterium avium subsp. paratuberculosis
cucggcgccgcc

SEQ ID NO: 2896899 - RNA, 13 nt, Mycobacterium avium subsp. paratuberculosis
cucggcgccgcgg

SEQ ID NO: 2896900 - RNA, 14 nt, Mycobacterium avium subsp. paratuberculosis
cucggcgccggccg

SEQ ID NO: 2896901 - RNA, 12 nt, Mycobacterium avium subsp. paratuberculosis
cucggcgccggu

SEQ ID NO: 2896902 - RNA, 13 nt, Mycobacterium avium subsp. paratuberculosis
cucggcgccggug

SEQ ID NO: 2896903 - RNA, 16 nt, Mycobacterium avium subsp. paratuberculosis
cucggcgccgguggug

SEQ ID NO: 2896904 - RNA, 22 nt, Mycobacterium avium subsp. paratuberculosis
cucggcgccgguggugucgacg

SEQ ID NO: 2896905 - RNA, 14 nt, Mycobacterium avium subsp. paratuberculosis
cucggcgccgucca

SEQ ID NO: 2896906 - RNA, 21 nt, Mycobacterium avium subsp. paratuberculosis
cucggcgccguccagcucgcg

SEQ ID NO: 2896907 - RNA, 17 nt, Mycobacterium avium subsp. paratuberculosis
cucggcgccgucgccgg

SEQ ID NO: 2896908 - RNA, 20 nt, Mycobacterium avium subsp. paratuberculosis
cucggcgccgucgccggacu

SEQ ID NO: 2896909 - RNA, 16 nt, Mycobacterium avium subsp. paratuberculosis
cucggcgcgacguugu

SEQ ID NO: 2896910 - RNA, 13 nt, Mycobacterium avium subsp. paratuberculosis
cucggcgcgcggg

SEQ ID NO: 2896911 - RNA, 19 nt, Mycobacterium avium subsp. paratuberculosis
cucggcgcgcggggccggc

SEQ ID NO: 2896912 - RNA, 22 nt, Mycobacterium avium subsp. paratuberculosis
cucggcgcgcggggccggcgcg

SEQ ID NO: 2896913 - RNA, 22 nt, Mycobacterium avium subsp. paratuberculosis
cucggcgcggcuuuuggcgucg

SEQ ID NO: 2896914 - RNA, 15 nt, Mycobacterium avium subsp. paratuberculosis
cucggcgcgucgucc

SEQ ID NO: 2896915 - RNA, 18 nt, Mycobacterium avium subsp. paratuberculosis
cucggcgcuccagcgggc

SEQ ID NO: 2896916 - RNA, 22 nt, Mycobacterium avium subsp. paratuberculosis
cucggcgcuccagcgggcggcg

SEQ ID NO: 2896917 - RNA, 14 nt, Mycobacterium avium subsp. paratuberculosis
cucggcgcucgccg

SEQ ID NO: 2896918 - RNA, 17 nt, Mycobacterium avium subsp. paratuberculosis
cucggcgcucgccgcgc

SEQ ID NO: 2896919 - RNA, 16 nt, Mycobacterium avium subsp. paratuberculosis
cucggcgcugaacugc

SEQ ID NO: 2896920 - RNA, 21 nt, Mycobacterium avium subsp. paratuberculosis
cucggcgcugcccgccgcggu

SEQ ID NO: 2896921 - RNA, 19 nt, Mycobacterium avium subsp. paratuberculosis
cucggcgcugucggcgggg

SEQ ID NO: 2896922 - RNA, 22 nt, Mycobacterium avium subsp. paratuberculosis
cucggcggacaucgccucggcg

SEQ ID NO: 2896923 - RNA, 15 nt, Mycobacterium avium subsp. paratuberculosis
cucggcggacucggc

SEQ ID NO: 2896924 - RNA, 19 nt, Mycobacterium avium subsp. paratuberculosis
cucggcggcaccgcccggg

SEQ ID NO: 2896925 - RNA, 14 nt, Mycobacterium avium subsp. paratuberculosis
cucggcggccagcg

SEQ ID NO: 2896926 - RNA, 15 nt, Mycobacterium avium subsp. paratuberculosis
cucggcggccagcgc

SEQ ID NO: 2896927 - RNA, 17 nt, Mycobacterium avium subsp. paratuberculosis
cucggcggccagcgcga

SEQ ID NO: 2896928 - RNA, 14 nt, Mycobacterium avium subsp. paratuberculosis
cucggcggcccgca

SEQ ID NO: 2896929 - RNA, 15 nt, Mycobacterium avium subsp. paratuberculosis
cucggcggcccgcag

SEQ ID NO: 2896930 - RNA, 14 nt, Mycobacterium avium subsp. paratuberculosis
cucggcggcccgcc

SEQ ID NO: 2896931 - RNA, 12 nt, Mycobacterium avium subsp. paratuberculosis
cucggcggccga

SEQ ID NO: 2896932 - RNA, 15 nt, Mycobacterium avium subsp. paratuberculosis
cucggcggccgagcg

SEQ ID NO: 2896933 - RNA, 14 nt, Mycobacterium avium subsp. paratuberculosis
cucggcggccgcca

SEQ ID NO: 2896934 - RNA, 20 nt, Mycobacterium avium subsp. paratuberculosis
cucggcggccgccagcgucc

SEQ ID NO: 2896935 - RNA, 14 nt, Mycobacterium avium subsp. paratuberculosis
cucggcggccgccc

SEQ ID NO: 2896936 - RNA, 17 nt, Mycobacterium avium subsp. paratuberculosis
cucggcggccgcccggg

SEQ ID NO: 2896937 - RNA, 15 nt, Mycobacterium avium subsp. paratuberculosis
cucggcggccgccuu

SEQ ID NO: 2896938 - RNA, 20 nt, Mycobacterium avium subsp. paratuberculosis
cucggcggccgcguccucgc

SEQ ID NO: 2896939 - RNA, 14 nt, Mycobacterium avium subsp. paratuberculosis
cucggcggccggga

SEQ ID NO: 2896940 - RNA, 22 nt, Mycobacterium avium subsp. paratuberculosis
cucggcggccgggaugccgccg

SEQ ID NO: 2896941 - RNA, 17 nt, Mycobacterium avium subsp. paratuberculosis
cucggcggccgucggau

SEQ ID NO: 2896942 - RNA, 14 nt, Mycobacterium avium subsp. paratuberculosis
cucggcggccucgc

SEQ ID NO: 2896943 - RNA, 19 nt, Mycobacterium avium subsp. paratuberculosis
cucggcggccucgccgucg

SEQ ID NO: 2896944 - RNA, 23 nt, Mycobacterium avium subsp. paratuberculosis
cucggcggccucgccgucgaagg

SEQ ID NO: 2896945 - RNA, 13 nt, Mycobacterium avium subsp. paratuberculosis
cucggcggcgacg

SEQ ID NO: 2896946 - RNA, 14 nt, Mycobacterium avium subsp. paratuberculosis
cucggcggcgacgg

SEQ ID NO: 2896947 - RNA, 17 nt, Mycobacterium avium subsp. paratuberculosis
cucggcggcgacggugu

SEQ ID NO: 2896948 - RNA, 16 nt, Mycobacterium avium subsp. paratuberculosis
cucggcggcgcaggcg

SEQ ID NO: 2896949 - RNA, 23 nt, Mycobacterium avium subsp. paratuberculosis
cucggcggcgcaggcgcgcacca

SEQ ID NO: 2896950 - RNA, 15 nt, Mycobacterium avium subsp. paratuberculosis
cucggcggcgccguc

SEQ ID NO: 2896951 - RNA, 14 nt, Mycobacterium avium subsp. paratuberculosis
cucggcggcgcgca

SEQ ID NO: 2896952 - RNA, 20 nt, Mycobacterium avium subsp. paratuberculosis
cucggcggcgcgcaggcgcg

SEQ ID NO: 2896953 - RNA, 13 nt, Mycobacterium avium subsp. paratuberculosis
cucggcggcggcg

SEQ ID NO: 2896954 - RNA, 15 nt, Mycobacterium avium subsp. paratuberculosis
cucggcggcggcgcg

SEQ ID NO: 2896955 - RNA, 16 nt, Mycobacterium avium subsp. paratuberculosis
cucggcggcggcgcgc

SEQ ID NO: 2896956 - RNA, 21 nt, Mycobacterium avium subsp. paratuberculosis
cucggcggcggcgcgccggcc

SEQ ID NO: 2896957 - RNA, 13 nt, Mycobacterium avium subsp. paratuberculosis
cucggcggcgggg

SEQ ID NO: 2896958 - RNA, 20 nt, Mycobacterium avium subsp. paratuberculosis
cucggcggcggggucguugc

SEQ ID NO: 2896959 - RNA, 20 nt, Mycobacterium avium subsp. paratuberculosis
cucggcgggaucggaccgca

SEQ ID NO: 2896960 - RNA, 14 nt, Mycobacterium avium subsp. paratuberculosis
cucggcgggccgcc

SEQ ID NO: 2896961 - RNA, 19 nt, Mycobacterium avium subsp. paratuberculosis
cucggcgggccgcccggcg

SEQ ID NO: 2896962 - RNA, 21 nt, Mycobacterium avium subsp. paratuberculosis
cucggcgggcucccucgucgc

SEQ ID NO: 2896963 - RNA, 16 nt, Mycobacterium avium subsp. paratuberculosis
cucggcgggcucgcgc

SEQ ID NO: 2896964 - RNA, 23 nt, Mycobacterium avium subsp. paratuberculosis
cucggcggggggagaggcgcggc

SEQ ID NO: 2896965 - RNA, 23 nt, Mycobacterium avium subsp. paratuberculosis
cucggcggguugcugagccgccg

SEQ ID NO: 2896966 - RNA, 16 nt, Mycobacterium avium subsp. paratuberculosis
cucggcguacagcccg

SEQ ID NO: 2896967 - RNA, 17 nt, Mycobacterium avium subsp. paratuberculosis
cucggcguacagcccgc

SEQ ID NO: 2896968 - RNA, 16 nt, Mycobacterium avium subsp. paratuberculosis
cucggcguacaggccg

SEQ ID NO: 2896969 - RNA, 17 nt, Mycobacterium avium subsp. paratuberculosis
cucggcguacaggccgu

SEQ ID NO: 2896970 - RNA, 23 nt, Mycobacterium avium subsp. paratuberculosis
cucggcguagaggugcagcgggc

SEQ ID NO: 2896971 - RNA, 15 nt, Mycobacterium avium subsp. paratuberculosis
cucggcgucaccgcg

SEQ ID NO: 2896972 - RNA, 16 nt, Mycobacterium avium subsp. paratuberculosis
cucggcgucaccgcgg

SEQ ID NO: 2896973 - RNA, 13 nt, Mycobacterium avium subsp. paratuberculosis
cucggcguccagc

SEQ ID NO: 2896974 - RNA, 18 nt, Mycobacterium avium subsp. paratuberculosis
cucggcguccccggcggu

SEQ ID NO: 2896975 - RNA, 14 nt, Mycobacterium avium subsp. paratuberculosis
cucggcgucccgcg

SEQ ID NO: 2896976 - RNA, 18 nt, Mycobacterium avium subsp. paratuberculosis
cucggcgucccgcgccac

SEQ ID NO: 2896977 - RNA, 14 nt, Mycobacterium avium subsp. paratuberculosis
cucggcgucccggc

SEQ ID NO: 2896978 - RNA, 16 nt, Mycobacterium avium subsp. paratuberculosis
cucggcgucccguccu

SEQ ID NO: 2896979 - RNA, 13 nt, Mycobacterium avium subsp. paratuberculosis
cucggcguccgcg

SEQ ID NO: 2896980 - RNA, 15 nt, Mycobacterium avium subsp. paratuberculosis
cucggcguccgcggc

SEQ ID NO: 2896981 - RNA, 14 nt, Mycobacterium avium subsp. paratuberculosis
cucggcgucgcacg

SEQ ID NO: 2896982 - RNA, 14 nt, Mycobacterium avium subsp. paratuberculosis
cucggcgucggcgc

SEQ ID NO: 2896983 - RNA, 15 nt, Mycobacterium avium subsp. paratuberculosis
cucggcgucggcgcg

SEQ ID NO: 2896984 - RNA, 15 nt, Mycobacterium avium subsp. paratuberculosis
cucggcgucucggcg

SEQ ID NO: 2896985 - RNA, 15 nt, Mycobacterium avium subsp. paratuberculosis
cucggcgugcccgcc

SEQ ID NO: 2896986 - RNA, 16 nt, Mycobacterium avium subsp. paratuberculosis
cucggcgugcucggcc

SEQ ID NO: 2896987 - RNA, 20 nt, Mycobacterium avium subsp. paratuberculosis
cucggcgugcucggccacga

SEQ ID NO: 2896988 - RNA, 16 nt, Mycobacterium avium subsp. paratuberculosis
cucggcguggcaggcg

SEQ ID NO: 2896989 - RNA, 21 nt, Mycobacterium avium subsp. paratuberculosis
cucggcguggcaggcgauggc

SEQ ID NO: 2896990 - RNA, 22 nt, Mycobacterium avium subsp. paratuberculosis
cucggcguggcgcucagcggca

SEQ ID NO: 2896991 - RNA, 16 nt, Mycobacterium avium subsp. paratuberculosis
cucggcguggucgagg

SEQ ID NO: 2896992 - RNA, 19 nt, Mycobacterium avium subsp. paratuberculosis
cucggcguguuccuugcgg

SEQ ID NO: 2896993 - RNA, 18 nt, Mycobacterium avium subsp. paratuberculosis
cucggcguugagccggcg

SEQ ID NO: 2896994 - RNA, 19 nt, Mycobacterium avium subsp. paratuberculosis
cucggcguugagccggcgc

SEQ ID NO: 2896995 - RNA, 20 nt, Mycobacterium avium subsp. paratuberculosis
cucggcguugagccggcgca

SEQ ID NO: 2896996 - RNA, 12 nt, Mycobacterium avium subsp. paratuberculosis
cucggcucggcc

SEQ ID NO: 2896997 - RNA, 14 nt, Mycobacterium avium subsp. paratuberculosis
cucggcucggccgg

SEQ ID NO: 2896998 - RNA, 17 nt, Mycobacterium avium subsp. paratuberculosis
cucggcucggccggccg

SEQ ID NO: 2896999 - RNA, 16 nt, Mycobacterium avium subsp. paratuberculosis
cucgggaaaugcgucg

SEQ ID NO: 2897000 - RNA, 18 nt, Mycobacterium avium subsp. paratuberculosis
cucgggaaaugcgucggc

SEQ ID NO: 2897001 - RNA, 15 nt, Mycobacterium avium subsp. paratuberculosis
cucgggaacggucag

SEQ ID NO: 2897002 - RNA, 20 nt, Mycobacterium avium subsp. paratuberculosis
cucgggauagccgagcggcg

SEQ ID NO: 2897003 - RNA, 23 nt, Mycobacterium avium subsp. paratuberculosis
cucgggauagccgagcggcgcca

SEQ ID NO: 2897004 - RNA, 16 nt, Mycobacterium avium subsp. paratuberculosis
cucgggauuggacagc

SEQ ID NO: 2897005 - RNA, 20 nt, Mycobacterium avium subsp. paratuberculosis
cucgggauuggacagcggcg

SEQ ID NO: 2897006 - RNA, 23 nt, Mycobacterium avium subsp. paratuberculosis
cucgggcaccccugccgccaccg

SEQ ID NO: 2897007 - RNA, 22 nt, Mycobacterium avium subsp. paratuberculosis
cucgggcacguccagcccgcgc

SEQ ID NO: 2897008 - RNA, 20 nt, Mycobacterium avium subsp. paratuberculosis
cucgggcagcagcaccagcg

SEQ ID NO: 2897009 - RNA, 22 nt, Mycobacterium avium subsp. paratuberculosis
cucgggcagcagcaccagcgcc

SEQ ID NO: 2897010 - RNA, 21 nt, Mycobacterium avium subsp. paratuberculosis
cucgggcauuggcagcucggg

SEQ ID NO: 2897011 - RNA, 14 nt, Mycobacterium avium subsp. paratuberculosis
cucgggccagccca

SEQ ID NO: 2897012 - RNA, 22 nt, Mycobacterium avium subsp. paratuberculosis
cucgggccagcccauguccagg

SEQ ID NO: 2897013 - RNA, 20 nt, Mycobacterium avium subsp. paratuberculosis
cucgggcccgagguccucgc

SEQ ID NO: 2897014 - RNA, 17 nt, Mycobacterium avium subsp. paratuberculosis
cucgggcccgcgcaccg

SEQ ID NO: 2897015 - RNA, 16 nt, Mycobacterium avium subsp. paratuberculosis
cucgggccggcagccg

SEQ ID NO: 2897016 - RNA, 18 nt, Mycobacterium avium subsp. paratuberculosis
cucgggccggcagccggc

SEQ ID NO: 2897017 - RNA, 15 nt, Mycobacterium avium subsp. paratuberculosis
cucgggccggcgccg

SEQ ID NO: 2897018 - RNA, 19 nt, Mycobacterium avium subsp. paratuberculosis
cucgggccggcgccgacga

SEQ ID NO: 2897019 - RNA, 20 nt, Mycobacterium avium subsp. paratuberculosis
cucgggccggcgccgacgac

SEQ ID NO: 2897020 - RNA, 15 nt, Mycobacterium avium subsp. paratuberculosis
cucgggcgacgacgc

SEQ ID NO: 2897021 - RNA, 17 nt, Mycobacterium avium subsp. paratuberculosis
cucgggcgcgaacagcg

SEQ ID NO: 2897022 - RNA, 19 nt, Mycobacterium avium subsp. paratuberculosis
cucgggcgcgaacagcgcc

SEQ ID NO: 2897023 - RNA, 18 nt, Mycobacterium avium subsp. paratuberculosis
cucgggcgguggcgccgg

SEQ ID NO: 2897024 - RNA, 19 nt, Mycobacterium avium subsp. paratuberculosis
cucgggcgguggcgccggg

SEQ ID NO: 2897025 - RNA, 17 nt, Mycobacterium avium subsp. paratuberculosis
cucggggaucagcagau

SEQ ID NO: 2897026 - RNA, 14 nt, Mycobacterium avium subsp. paratuberculosis
cucggggaucgcca

SEQ ID NO: 2897027 - RNA, 18 nt, Mycobacterium avium subsp. paratuberculosis
cucggggaugucgaaauc

SEQ ID NO: 2897028 - RNA, 20 nt, Mycobacterium avium subsp. paratuberculosis
cucggggcguggcggaagcg

SEQ ID NO: 2897029 - RNA, 22 nt, Mycobacterium avium subsp. paratuberculosis
cucggggcguggcggaagcgcg

SEQ ID NO: 2897030 - RNA, 12 nt, Mycobacterium avium subsp. paratuberculosis
cucggggcucgc

SEQ ID NO: 2897031 - RNA, 17 nt, Mycobacterium avium subsp. paratuberculosis
cucggggcugcgcggcu

SEQ ID NO: 2897032 - RNA, 13 nt, Mycobacterium avium subsp. paratuberculosis
cucgggggccgcu

SEQ ID NO: 2897033 - RNA, 14 nt, Mycobacterium avium subsp. paratuberculosis
cucgggggcgggca

SEQ ID NO: 2897034 - RNA, 19 nt, Mycobacterium avium subsp. paratuberculosis
cucgggggcgggcaccucg

SEQ ID NO: 2897035 - RNA, 22 nt, Mycobacterium avium subsp. paratuberculosis
cucgggggugaaggcggccacc

SEQ ID NO: 2897036 - RNA, 16 nt, Mycobacterium avium subsp. paratuberculosis
cucgggguacucggcg

SEQ ID NO: 2897037 - RNA, 19 nt, Mycobacterium avium subsp. paratuberculosis
cucgggguacucggcggcg

SEQ ID NO: 2897038 - RNA, 18 nt, Mycobacterium avium subsp. paratuberculosis
cucgggguaguucagcgc

SEQ ID NO: 2897039 - RNA, 20 nt, Mycobacterium avium subsp. paratuberculosis
cucgggguaguucagcgcgc

SEQ ID NO: 2897040 - RNA, 23 nt, Mycobacterium avium subsp. paratuberculosis
cucgggguaguucagcgcgcggg

SEQ ID NO: 2897041 - RNA, 14 nt, Mycobacterium avium subsp. paratuberculosis
cucggggucggcgu

SEQ ID NO: 2897042 - RNA, 18 nt, Mycobacterium avium subsp. paratuberculosis
cucgggguugacccggcc

SEQ ID NO: 2897043 - RNA, 15 nt, Mycobacterium avium subsp. paratuberculosis
cucgggugacgccuc

SEQ ID NO: 2897044 - RNA, 20 nt, Mycobacterium avium subsp. paratuberculosis
cucgggugucgccgagccgc

SEQ ID NO: 2897045 - RNA, 16 nt, Mycobacterium avium subsp. paratuberculosis
cucgguacccccgccg

SEQ ID NO: 2897046 - RNA, 16 nt, Mycobacterium avium subsp. paratuberculosis
cucggucaagccggcc

SEQ ID NO: 2897047 - RNA, 17 nt, Mycobacterium avium subsp. paratuberculosis
cucggucaagccggcca

SEQ ID NO: 2897048 - RNA, 18 nt, Mycobacterium avium subsp. paratuberculosis
cucggucaagccggccag

SEQ ID NO: 2897049 - RNA, 20 nt, Mycobacterium avium subsp. paratuberculosis
cucggucaagccggccagca

SEQ ID NO: 2897050 - RNA, 20 nt, Mycobacterium avium subsp. paratuberculosis
cucggucaaguccgcgagga

SEQ ID NO: 2897051 - RNA, 14 nt, Mycobacterium avium subsp. paratuberculosis
cucggucaccagcg

SEQ ID NO: 2897052 - RNA, 17 nt, Mycobacterium avium subsp. paratuberculosis
cucggucaccagcggcc

SEQ ID NO: 2897053 - RNA, 13 nt, Mycobacterium avium subsp. paratuberculosis
cucggucaccccg

SEQ ID NO: 2897054 - RNA, 18 nt, Mycobacterium avium subsp. paratuberculosis
cucggucaccgagcggcc

SEQ ID NO: 2897055 - RNA, 22 nt, Mycobacterium avium subsp. paratuberculosis
cucggucaccgagcggccgucc

SEQ ID NO: 2897056 - RNA, 21 nt, Mycobacterium avium subsp. paratuberculosis
cucggucaccggugucacgcu

SEQ ID NO: 2897057 - RNA, 13 nt, Mycobacterium avium subsp. paratuberculosis
cucggucaccucg

SEQ ID NO: 2897058 - RNA, 20 nt, Mycobacterium avium subsp. paratuberculosis
cucggucaccucgucgaucc

SEQ ID NO: 2897059 - RNA, 18 nt, Mycobacterium avium subsp. paratuberculosis
cucggucacggucuggcu

SEQ ID NO: 2897060 - RNA, 12 nt, Mycobacterium avium subsp. paratuberculosis
cucggucagcac

SEQ ID NO: 2897061 - RNA, 18 nt, Mycobacterium avium subsp. paratuberculosis
cucggucagccgggcggc

SEQ ID NO: 2897062 - RNA, 17 nt, Mycobacterium avium subsp. paratuberculosis
cucggucagcggcgugc

SEQ ID NO: 2897063 - RNA, 13 nt, Mycobacterium avium subsp. paratuberculosis
cucggucagcucg

SEQ ID NO: 2897064 - RNA, 15 nt, Mycobacterium avium subsp. paratuberculosis
cucggucagcucggg

SEQ ID NO: 2897065 - RNA, 14 nt, Mycobacterium avium subsp. paratuberculosis
cucggucaggaucg

SEQ ID NO: 2897066 - RNA, 14 nt, Mycobacterium avium subsp. paratuberculosis
cucggucaggccca

SEQ ID NO: 2897067 - RNA, 17 nt, Mycobacterium avium subsp. paratuberculosis
cucggucaggcccaggu

SEQ ID NO: 2897068 - RNA, 13 nt, Mycobacterium avium subsp. paratuberculosis
cucggucaggccg

SEQ ID NO: 2897069 - RNA, 18 nt, Mycobacterium avium subsp. paratuberculosis
cucggucagguagccgag

SEQ ID NO: 2897070 - RNA, 14 nt, Mycobacterium avium subsp. paratuberculosis
cucggucgccacgg

SEQ ID NO: 2897071 - RNA, 15 nt, Mycobacterium avium subsp. paratuberculosis
cucggucgccacggc

SEQ ID NO: 2897072 - RNA, 19 nt, Mycobacterium avium subsp. paratuberculosis
cucggucgccacggccggc

SEQ ID NO: 2897073 - RNA, 17 nt, Mycobacterium avium subsp. paratuberculosis
cucggucgccagcaccg

SEQ ID NO: 2897074 - RNA, 20 nt, Mycobacterium avium subsp. paratuberculosis
cucggucgccgaauccggcg

SEQ ID NO: 2897075 - RNA, 23 nt, Mycobacterium avium subsp. paratuberculosis
cucggucgccgaauccggcgggg

SEQ ID NO: 2897076 - RNA, 17 nt, Mycobacterium avium subsp. paratuberculosis
cucggucgcggcgaucg

SEQ ID NO: 2897077 - RNA, 15 nt, Mycobacterium avium subsp. paratuberculosis
cucggucgcggucgg

SEQ ID NO: 2897078 - RNA, 17 nt, Mycobacterium avium subsp. paratuberculosis
cucggucgcggucggcg

SEQ ID NO: 2897079 - RNA, 13 nt, Mycobacterium avium subsp. paratuberculosis
cucggucuccucc

SEQ ID NO: 2897080 - RNA, 16 nt, Mycobacterium avium subsp. paratuberculosis
cucggucuccuccagg

SEQ ID NO: 2897081 - RNA, 23 nt, Mycobacterium avium subsp. paratuberculosis
cucggucugggcgaacggcaacg

SEQ ID NO: 2897082 - RNA, 17 nt, Mycobacterium avium subsp. paratuberculosis
cucggucuugaucaggu

SEQ ID NO: 2897083 - RNA, 16 nt, Mycobacterium avium subsp. paratuberculosis
cucggugaagccgcgg

SEQ ID NO: 2897084 - RNA, 18 nt, Mycobacterium avium subsp. paratuberculosis
cucggugaagccgcggac

SEQ ID NO: 2897085 - RNA, 14 nt, Mycobacterium avium subsp. paratuberculosis
cucggugagcagaa

SEQ ID NO: 2897086 - RNA, 14 nt, Mycobacterium avium subsp. paratuberculosis
cucggugagcagcu

SEQ ID NO: 2897087 - RNA, 14 nt, Mycobacterium avium subsp. paratuberculosis
cucggugagccgcu

SEQ ID NO: 2897088 - RNA, 18 nt, Mycobacterium avium subsp. paratuberculosis
cucggugagccgcuggau

SEQ ID NO: 2897089 - RNA, 19 nt, Mycobacterium avium subsp. paratuberculosis
cucggugagccgcuggaug

SEQ ID NO: 2897090 - RNA, 22 nt, Mycobacterium avium subsp. paratuberculosis
cucggugaucaccaugaucagc

SEQ ID NO: 2897091 - RNA, 15 nt, Mycobacterium avium subsp. paratuberculosis
cucggugaucacccg

SEQ ID NO: 2897092 - RNA, 21 nt, Mycobacterium avium subsp. paratuberculosis
cucggugaucacccgccgggu

SEQ ID NO: 2897093 - RNA, 22 nt, Mycobacterium avium subsp. paratuberculosis
cucggugaucucaccggcggcg

SEQ ID NO: 2897094 - RNA, 19 nt, Mycobacterium avium subsp. paratuberculosis
cucggugaucugcaccagc

SEQ ID NO: 2897095 - RNA, 16 nt, Mycobacterium avium subsp. paratuberculosis
cucggugaugaucgcc

SEQ ID NO: 2897096 - RNA, 17 nt, Mycobacterium avium subsp. paratuberculosis
cucggugaugccgagcg

SEQ ID NO: 2897097 - RNA, 21 nt, Mycobacterium avium subsp. paratuberculosis
cucggugaugccgagcgccgc

SEQ ID NO: 2897098 - RNA, 22 nt, Mycobacterium avium subsp. paratuberculosis
cucggugaugccgagcgccgcg

SEQ ID NO: 2897099 - RNA, 22 nt, Mycobacterium avium subsp. paratuberculosis
cucggugaugccggccagccgc

SEQ ID NO: 2897100 - RNA, 16 nt, Mycobacterium avium subsp. paratuberculosis
cucggugaugucgacg

SEQ ID NO: 2897101 - RNA, 17 nt, Mycobacterium avium subsp. paratuberculosis
cucggugaugucgacgu

SEQ ID NO: 2897102 - RNA, 12 nt, Mycobacterium avium subsp. paratuberculosis
cucggugccgcg

SEQ ID NO: 2897103 - RNA, 14 nt, Mycobacterium avium subsp. paratuberculosis
cucggugccgguga

SEQ ID NO: 2897104 - RNA, 23 nt, Mycobacterium avium subsp. paratuberculosis
cucggugcgcauggcgugcugau

SEQ ID NO: 2897105 - RNA, 23 nt, Mycobacterium avium subsp. paratuberculosis
cucggugcgccagaucagcgugg

SEQ ID NO: 2897106 - RNA, 15 nt, Mycobacterium avium subsp. paratuberculosis
cucggugcggaacac

SEQ ID NO: 2897107 - RNA, 19 nt, Mycobacterium avium subsp. paratuberculosis
cucggugcggaacaccgcc

SEQ ID NO: 2897108 - RNA, 19 nt, Mycobacterium avium subsp. paratuberculosis
cucggugcucuugacggcc

SEQ ID NO: 2897109 - RNA, 17 nt, Mycobacterium avium subsp. paratuberculosis
cucgguggacgccgcgc

SEQ ID NO: 2897110 - RNA, 14 nt, Mycobacterium avium subsp. paratuberculosis
cucgguggccaccu

SEQ ID NO: 2897111 - RNA, 16 nt, Mycobacterium avium subsp. paratuberculosis
cucgguggccaccuug

SEQ ID NO: 2897112 - RNA, 22 nt, Mycobacterium avium subsp. paratuberculosis
cucgguggccaccuuggacagg

SEQ ID NO: 2897113 - RNA, 13 nt, Mycobacterium avium subsp. paratuberculosis
cucgguggccggu

SEQ ID NO: 2897114 - RNA, 15 nt, Mycobacterium avium subsp. paratuberculosis
cucgguggccgguau

SEQ ID NO: 2897115 - RNA, 14 nt, Mycobacterium avium subsp. paratuberculosis
cucgguggccucgc

SEQ ID NO: 2897116 - RNA, 20 nt, Mycobacterium avium subsp. paratuberculosis
cucgguggcgguggccacgg

SEQ ID NO: 2897117 - RNA, 16 nt, Mycobacterium avium subsp. paratuberculosis
cucgguggcgucggcg

SEQ ID NO: 2897118 - RNA, 19 nt, Mycobacterium avium subsp. paratuberculosis
cucgguggcgucggcggcc

SEQ ID NO: 2897119 - RNA, 17 nt, Mycobacterium avium subsp. paratuberculosis
cucgguggucgacgagc

SEQ ID NO: 2897120 - RNA, 24 nt, Mycobacterium avium subsp. paratuberculosis
cucgguggucgacgagcccgcgcc

SEQ ID NO: 2897121 - RNA, 14 nt, Mycobacterium avium subsp. paratuberculosis
cucggugguggcca

SEQ ID NO: 2897122 - RNA, 22 nt, Mycobacterium avium subsp. paratuberculosis
cucgguggugucaaccaggucg

SEQ ID NO: 2897123 - RNA, 16 nt, Mycobacterium avium subsp. paratuberculosis
cucgguguacagcgcc

SEQ ID NO: 2897124 - RNA, 17 nt, Mycobacterium avium subsp. paratuberculosis
cucgguguacagcgcca

SEQ ID NO: 2897125 - RNA, 16 nt, Mycobacterium avium subsp. paratuberculosis
cucgguguagagcacc

SEQ ID NO: 2897126 - RNA, 15 nt, Mycobacterium avium subsp. paratuberculosis
cucggugucgagguc

SEQ ID NO: 2897127 - RNA, 14 nt, Mycobacterium avium subsp. paratuberculosis
cucggugucgaucg

SEQ ID NO: 2897128 - RNA, 15 nt, Mycobacterium avium subsp. paratuberculosis
cucguaacgccacgg

SEQ ID NO: 2897129 - RNA, 18 nt, Mycobacterium avium subsp. paratuberculosis
cucguaacgccacggcgg

SEQ ID NO: 2897130 - RNA, 14 nt, Mycobacterium avium subsp. paratuberculosis
cucguacaagguga

SEQ ID NO: 2897131 - RNA, 22 nt, Mycobacterium avium subsp. paratuberculosis
cucguacaaggugauggcccgc

SEQ ID NO: 2897132 - RNA, 17 nt, Mycobacterium avium subsp. paratuberculosis
cucguagaagcucagcu

SEQ ID NO: 2897133 - RNA, 16 nt, Mycobacterium avium subsp. paratuberculosis
cucguagcccaccucg

SEQ ID NO: 2897134 - RNA, 15 nt, Mycobacterium avium subsp. paratuberculosis
cucguagcggccgca

SEQ ID NO: 2897135 - RNA, 17 nt, Mycobacterium avium subsp. paratuberculosis
cucguagcuggugcgca

SEQ ID NO: 2897136 - RNA, 24 nt, Mycobacterium avium subsp. paratuberculosis
cucguagcuggugcgcagcccgcc

SEQ ID NO: 2897137 - RNA, 13 nt, Mycobacterium avium subsp. paratuberculosis
cucgucaccgugg

SEQ ID NO: 2897138 - RNA, 19 nt, Mycobacterium avium subsp. paratuberculosis
cucgucaccgugggcggcg

SEQ ID NO: 2897139 - RNA, 15 nt, Mycobacterium avium subsp. paratuberculosis
cucgucagcgcgggc

SEQ ID NO: 2897140 - RNA, 17 nt, Mycobacterium avium subsp. paratuberculosis
cucgucagcgcgggcca

SEQ ID NO: 2897141 - RNA, 18 nt, Mycobacterium avium subsp. paratuberculosis
cucgucagcgcgggccag

SEQ ID NO: 2897142 - RNA, 20 nt, Mycobacterium avium subsp. paratuberculosis
cucgucagcgcgggccagca

SEQ ID NO: 2897143 - RNA, 14 nt, Mycobacterium avium subsp. paratuberculosis
cucguccaccagcu

SEQ ID NO: 2897144 - RNA, 18 nt, Mycobacterium avium subsp. paratuberculosis
cucguccaccagcucgau

SEQ ID NO: 2897145 - RNA, 16 nt, Mycobacterium avium subsp. paratuberculosis
cucguccagcccgguc

SEQ ID NO: 2897146 - RNA, 15 nt, Mycobacterium avium subsp. paratuberculosis
cucguccagcgucgc

SEQ ID NO: 2897147 - RNA, 18 nt, Mycobacterium avium subsp. paratuberculosis
cucguccagcgucgcggc

SEQ ID NO: 2897148 - RNA, 19 nt, Mycobacterium avium subsp. paratuberculosis
cucguccagcgucgcggcc

SEQ ID NO: 2897149 - RNA, 17 nt, Mycobacterium avium subsp. paratuberculosis
cucguccagggacuccg

SEQ ID NO: 2897150 - RNA, 17 nt, Mycobacterium avium subsp. paratuberculosis
cucguccaggguggcca

SEQ ID NO: 2897151 - RNA, 20 nt, Mycobacterium avium subsp. paratuberculosis
cucguccaggguggccagca

SEQ ID NO: 2897152 - RNA, 21 nt, Mycobacterium avium subsp. paratuberculosis
cucguccaggguggccagcac

SEQ ID NO: 2897153 - RNA, 20 nt, Mycobacterium avium subsp. paratuberculosis
cucguccaggugcacccgcg

SEQ ID NO: 2897154 - RNA, 22 nt, Mycobacterium avium subsp. paratuberculosis
cucguccaggugcacccgcggc

SEQ ID NO: 2897155 - RNA, 17 nt, Mycobacterium avium subsp. paratuberculosis
cucguccaugcuggugc

SEQ ID NO: 2897156 - RNA, 15 nt, Mycobacterium avium subsp. paratuberculosis
cucgucccacggcgg

SEQ ID NO: 2897157 - RNA, 23 nt, Mycobacterium avium subsp. paratuberculosis
cucgucccagcgcaacggcgucg

SEQ ID NO: 2897158 - RNA, 20 nt, Mycobacterium avium subsp. paratuberculosis
cucguccgacagcgccugcc

SEQ ID NO: 2897159 - RNA, 13 nt, Mycobacterium avium subsp. paratuberculosis
cucguccgcggcg

SEQ ID NO: 2897160 - RNA, 15 nt, Mycobacterium avium subsp. paratuberculosis
cucguccgcggcggc

SEQ ID NO: 2897161 - RNA, 13 nt, Mycobacterium avium subsp. paratuberculosis
cucguccuggcgc

SEQ ID NO: 2897162 - RNA, 15 nt, Mycobacterium avium subsp. paratuberculosis
cucguccuggcgcug

SEQ ID NO: 2897163 - RNA, 19 nt, Mycobacterium avium subsp. paratuberculosis
cucguccuggcgcuggugc

SEQ ID NO: 2897164 - RNA, 14 nt, Mycobacterium avium subsp. paratuberculosis
cucguccugggccg

SEQ ID NO: 2897165 - RNA, 16 nt, Mycobacterium avium subsp. paratuberculosis
cucgucgaagccgauc

SEQ ID NO: 2897166 - RNA, 21 nt, Mycobacterium avium subsp. paratuberculosis
cucgucgaagccgaucaccgg

SEQ ID NO: 2897167 - RNA, 21 nt, Mycobacterium avium subsp. paratuberculosis
cucgucgaccagggcgaucac

SEQ ID NO: 2897168 - RNA, 23 nt, Mycobacterium avium subsp. paratuberculosis
cucgucgaccagggcgaucaccg

SEQ ID NO: 2897169 - RNA, 15 nt, Mycobacterium avium subsp. paratuberculosis
cucgucgaccgcggc

SEQ ID NO: 2897170 - RNA, 22 nt, Mycobacterium avium subsp. paratuberculosis
cucgucgacgauggcccggacc

SEQ ID NO: 2897171 - RNA, 14 nt, Mycobacterium avium subsp. paratuberculosis
cucgucgacgccca

SEQ ID NO: 2897172 - RNA, 17 nt, Mycobacterium avium subsp. paratuberculosis
cucgucgacgcccaccu

SEQ ID NO: 2897173 - RNA, 20 nt, Mycobacterium avium subsp. paratuberculosis
cucgucgacgcccaccuggu

SEQ ID NO: 2897174 - RNA, 17 nt, Mycobacterium avium subsp. paratuberculosis
cucgucgacgcugaccg

SEQ ID NO: 2897175 - RNA, 14 nt, Mycobacterium avium subsp. paratuberculosis
cucgucgacggcgg

SEQ ID NO: 2897176 - RNA, 18 nt, Mycobacterium avium subsp. paratuberculosis
cucgucgacggcggcguc

SEQ ID NO: 2897177 - RNA, 15 nt, Mycobacterium avium subsp. paratuberculosis
cucgucgacgucggg

SEQ ID NO: 2897178 - RNA, 16 nt, Mycobacterium avium subsp. paratuberculosis
cucgucgagcagcgcc

SEQ ID NO: 2897179 - RNA, 20 nt, Mycobacterium avium subsp. paratuberculosis
cucgucgagcagcgcccggc

SEQ ID NO: 2897180 - RNA, 15 nt, Mycobacterium avium subsp. paratuberculosis
cucgucgagccggcc

SEQ ID NO: 2897181 - RNA, 22 nt, Mycobacterium avium subsp. paratuberculosis
cucgucgagccggccggacacc

SEQ ID NO: 2897182 - RNA, 15 nt, Mycobacterium avium subsp. paratuberculosis
cucgucgagccgggc

SEQ ID NO: 2897183 - RNA, 18 nt, Mycobacterium avium subsp. paratuberculosis
cucgucgagccgggcccg

SEQ ID NO: 2897184 - RNA, 20 nt, Mycobacterium avium subsp. paratuberculosis
cucgucgauccccacgucgc

SEQ ID NO: 2897185 - RNA, 22 nt, Mycobacterium avium subsp. paratuberculosis
cucgucgauccccacgucgccg

SEQ ID NO: 2897186 - RNA, 17 nt, Mycobacterium avium subsp. paratuberculosis
cucgucgaucgacgccg

SEQ ID NO: 2897187 - RNA, 19 nt, Mycobacterium avium subsp. paratuberculosis
cucgucgaucgacgccgac

SEQ ID NO: 2897188 - RNA, 20 nt, Mycobacterium avium subsp. paratuberculosis
cucgucgaucgacgccgaca

SEQ ID NO: 2897189 - RNA, 13 nt, Mycobacterium avium subsp. paratuberculosis
cucgucgaucgcg

SEQ ID NO: 2897190 - RNA, 15 nt, Mycobacterium avium subsp. paratuberculosis
cucgucgaucgcggc

SEQ ID NO: 2897191 - RNA, 18 nt, Mycobacterium avium subsp. paratuberculosis
cucgucgaucgcggcgau

SEQ ID NO: 2897192 - RNA, 13 nt, Mycobacterium avium subsp. paratuberculosis
cucgucgaugacg

SEQ ID NO: 2897193 - RNA, 23 nt, Mycobacterium avium subsp. paratuberculosis
cucgucgaugccguagaccagca

SEQ ID NO: 2897194 - RNA, 17 nt, Mycobacterium avium subsp. paratuberculosis
cucgucgaugucggcgg

SEQ ID NO: 2897195 - RNA, 18 nt, Mycobacterium avium subsp. paratuberculosis
cucgucgaugucggcggc

SEQ ID NO: 2897196 - RNA, 19 nt, Mycobacterium avium subsp. paratuberculosis
cucgucgaugucggcggcc

SEQ ID NO: 2897197 - RNA, 13 nt, Mycobacterium avium subsp. paratuberculosis
cucgucgccaccg

SEQ ID NO: 2897198 - RNA, 13 nt, Mycobacterium avium subsp. paratuberculosis
cucgucgcccggc

SEQ ID NO: 2897199 - RNA, 18 nt, Mycobacterium avium subsp. paratuberculosis
cucgucgcccggcgucca

SEQ ID NO: 2897200 - RNA, 23 nt, Mycobacterium avium subsp. paratuberculosis
cucgucgcccggcguccagugca

SEQ ID NO: 2897201 - RNA, 22 nt, Mycobacterium avium subsp. paratuberculosis
cucgucgccgucggggucgcgc

SEQ ID NO: 2897202 - RNA, 18 nt, Mycobacterium avium subsp. paratuberculosis
cucgucgcgcagcuggga

SEQ ID NO: 2897203 - RNA, 20 nt, Mycobacterium avium subsp. paratuberculosis
cucgucgcggaacgggucga

SEQ ID NO: 2897204 - RNA, 24 nt, Mycobacterium avium subsp. paratuberculosis
cucgucgcggaggaugccggccag

SEQ ID NO: 2897205 - RNA, 15 nt, Mycobacterium avium subsp. paratuberculosis
cucgucgcggcugcc

SEQ ID NO: 2897206 - RNA, 12 nt, Mycobacterium avium subsp. paratuberculosis
cucgucgcgggc

SEQ ID NO: 2897207 - RNA, 17 nt, Mycobacterium avium subsp. paratuberculosis
cucgucgcgggcgccga

SEQ ID NO: 2897208 - RNA, 19 nt, Mycobacterium avium subsp. paratuberculosis
cucgucgcgguugaucaca

SEQ ID NO: 2897209 - RNA, 20 nt, Mycobacterium avium subsp. paratuberculosis
cucgucggaggcgucgacgc

SEQ ID NO: 2897210 - RNA, 21 nt, Mycobacterium avium subsp. paratuberculosis
cucgucggaggcgucgacgcg

SEQ ID NO: 2897211 - RNA, 22 nt, Mycobacterium avium subsp. paratuberculosis
cucgucggaggcgucgacgcgc

SEQ ID NO: 2897212 - RNA, 19 nt, Mycobacterium avium subsp. paratuberculosis
cucgucggccagcgagucc

SEQ ID NO: 2897213 - RNA, 14 nt, Mycobacterium avium subsp. paratuberculosis
cucgucggccgcga

SEQ ID NO: 2897214 - RNA, 15 nt, Mycobacterium avium subsp. paratuberculosis
cucgucggccgcgac

SEQ ID NO: 2897215 - RNA, 14 nt, Mycobacterium avium subsp. paratuberculosis
cucgucggcgagca

SEQ ID NO: 2897216 - RNA, 17 nt, Mycobacterium avium subsp. paratuberculosis
cucgucggcgagcagca

SEQ ID NO: 2897217 - RNA, 17 nt, Mycobacterium avium subsp. paratuberculosis
cucgucggcgccgucgc

SEQ ID NO: 2897218 - RNA, 13 nt, Mycobacterium avium subsp. paratuberculosis
cucgucggcgcgc

SEQ ID NO: 2897219 - RNA, 20 nt, Mycobacterium avium subsp. paratuberculosis
cucgucggcgcgccacccga

SEQ ID NO: 2897220 - RNA, 15 nt, Mycobacterium avium subsp. paratuberculosis
cucgucggcgcgggc

SEQ ID NO: 2897221 - RNA, 12 nt, Mycobacterium avium subsp. paratuberculosis
cucgucggcggc

SEQ ID NO: 2897222 - RNA, 22 nt, Mycobacterium avium subsp. paratuberculosis
cucgucggcggcgacggcgacc

SEQ ID NO: 2897223 - RNA, 14 nt, Mycobacterium avium subsp. paratuberculosis
cucgucggcggcgg

SEQ ID NO: 2897224 - RNA, 17 nt, Mycobacterium avium subsp. paratuberculosis
cucgucggcggcggccu

SEQ ID NO: 2897225 - RNA, 21 nt, Mycobacterium avium subsp. paratuberculosis
cucgucggcggcggccugcac

SEQ ID NO: 2897226 - RNA, 14 nt, Mycobacterium avium subsp. paratuberculosis
cucgucggcgggca

SEQ ID NO: 2897227 - RNA, 17 nt, Mycobacterium avium subsp. paratuberculosis
cucgucggcgggcaccu

SEQ ID NO: 2897228 - RNA, 13 nt, Mycobacterium avium subsp. paratuberculosis
cucgucggcgguc

SEQ ID NO: 2897229 - RNA, 14 nt, Mycobacterium avium subsp. paratuberculosis
cucgucggcggugc

SEQ ID NO: 2897230 - RNA, 23 nt, Mycobacterium avium subsp. paratuberculosis
cucgucggcggugccgagcccgc

SEQ ID NO: 2897231 - RNA, 20 nt, Mycobacterium avium subsp. paratuberculosis
cucgucgggaacgccgauca

SEQ ID NO: 2897232 - RNA, 14 nt, Mycobacterium avium subsp. paratuberculosis
cucgucgggcaccg

SEQ ID NO: 2897233 - RNA, 16 nt, Mycobacterium avium subsp. paratuberculosis
cucgucgggcaccgcc

SEQ ID NO: 2897234 - RNA, 14 nt, Mycobacterium avium subsp. paratuberculosis
cucgucgggcgcca

SEQ ID NO: 2897235 - RNA, 16 nt, Mycobacterium avium subsp. paratuberculosis
cucgucgggcgccagc

SEQ ID NO: 2897236 - RNA, 18 nt, Mycobacterium avium subsp. paratuberculosis
cucgucgggcgccagccc

SEQ ID NO: 2897237 - RNA, 21 nt, Mycobacterium avium subsp. paratuberculosis
cucgucgggcgccagcccgcc

SEQ ID NO: 2897238 - RNA, 17 nt, Mycobacterium avium subsp. paratuberculosis
cucgucggggcagccgu

SEQ ID NO: 2897239 - RNA, 18 nt, Mycobacterium avium subsp. paratuberculosis
cucgucggggcagccguc

SEQ ID NO: 2897240 - RNA, 19 nt, Mycobacterium avium subsp. paratuberculosis
cucgucggggcgccuaccg

SEQ ID NO: 2897241 - RNA, 23 nt, Mycobacterium avium subsp. paratuberculosis
cucgucgggugucaggucggcga

SEQ ID NO: 2897242 - RNA, 20 nt, Mycobacterium avium subsp. paratuberculosis
cucgucggguguggcgccgu

SEQ ID NO: 2897243 - RNA, 13 nt, Mycobacterium avium subsp. paratuberculosis
cucgucgucgaug

SEQ ID NO: 2897244 - RNA, 15 nt, Mycobacterium avium subsp. paratuberculosis
cucgucgucggcggg

SEQ ID NO: 2897245 - RNA, 14 nt, Mycobacterium avium subsp. paratuberculosis
cucgucgucgucga

SEQ ID NO: 2897246 - RNA, 15 nt, Mycobacterium avium subsp. paratuberculosis
cucgucuccggcggc

SEQ ID NO: 2897247 - RNA, 17 nt, Mycobacterium avium subsp. paratuberculosis
cucgucuccggcggcag

SEQ ID NO: 2897248 - RNA, 20 nt, Mycobacterium avium subsp. paratuberculosis
cucgucuuggugcgagccac

SEQ ID NO: 2897249 - RNA, 22 nt, Mycobacterium avium subsp. paratuberculosis
cucgucuuggugcgagccaccu

SEQ ID NO: 2897250 - RNA, 23 nt, Mycobacterium avium subsp. paratuberculosis
cucgucuuggugcgagccaccuc

SEQ ID NO: 2897251 - RNA, 23 nt, Mycobacterium avium subsp. paratuberculosis
cucgugaccggcggugucggugc

SEQ ID NO: 2897252 - RNA, 15 nt, Mycobacterium avium subsp. paratuberculosis
cucgugauccggcac

SEQ ID NO: 2897253 - RNA, 16 nt, Mycobacterium avium subsp. paratuberculosis
cucgugaugguccagc

SEQ ID NO: 2897254 - RNA, 18 nt, Mycobacterium avium subsp. paratuberculosis
cucgugaugguccagcac

SEQ ID NO: 2897255 - RNA, 15 nt, Mycobacterium avium subsp. paratuberculosis
cucgugcaaaccgga

SEQ ID NO: 2897256 - RNA, 12 nt, Mycobacterium avium subsp. paratuberculosis
cucgugcaaccu

SEQ ID NO: 2897257 - RNA, 18 nt, Mycobacterium avium subsp. paratuberculosis
cucgugcaaggccugcgc

SEQ ID NO: 2897258 - RNA, 21 nt, Mycobacterium avium subsp. paratuberculosis
cucgugcaaggccugcgccuu

SEQ ID NO: 2897259 - RNA, 14 nt, Mycobacterium avium subsp. paratuberculosis
cucgugcagccggc

SEQ ID NO: 2897260 - RNA, 17 nt, Mycobacterium avium subsp. paratuberculosis
cucgugcagccggcggc

SEQ ID NO: 2897261 - RNA, 19 nt, Mycobacterium avium subsp. paratuberculosis
cucgugcagccggcggcgc

SEQ ID NO: 2897262 - RNA, 19 nt, Mycobacterium avium subsp. paratuberculosis
cucgugcaugugcucggcg

SEQ ID NO: 2897263 - RNA, 16 nt, Mycobacterium avium subsp. paratuberculosis
cucgugcccgggcccg

SEQ ID NO: 2897264 - RNA, 15 nt, Mycobacterium avium subsp. paratuberculosis
cucgugccgcacccg

SEQ ID NO: 2897265 - RNA, 16 nt, Mycobacterium avium subsp. paratuberculosis
cucgugccgcacccga

SEQ ID NO: 2897266 - RNA, 14 nt, Mycobacterium avium subsp. paratuberculosis
cucgugcggcgccg

SEQ ID NO: 2897267 - RNA, 17 nt, Mycobacterium avium subsp. paratuberculosis
cucgugcggcgccgccc

SEQ ID NO: 2897268 - RNA, 18 nt, Mycobacterium avium subsp. paratuberculosis
cucgugcggcgccgcccg

SEQ ID NO: 2897269 - RNA, 20 nt, Mycobacterium avium subsp. paratuberculosis
cucgugcggcgccgcccggc

SEQ ID NO: 2897270 - RNA, 14 nt, Mycobacterium avium subsp. paratuberculosis
cucgugcugcugcu

SEQ ID NO: 2897271 - RNA, 23 nt, Mycobacterium avium subsp. paratuberculosis
cucguggaaaucgagcgcgcugu

SEQ ID NO: 2897272 - RNA, 20 nt, Mycobacterium avium subsp. paratuberculosis
cucguggaacaccgcgcuga

SEQ ID NO: 2897273 - RNA, 18 nt, Mycobacterium avium subsp. paratuberculosis
cucgugggaaugcggcug

SEQ ID NO: 2897274 - RNA, 19 nt, Mycobacterium avium subsp. paratuberculosis
cucgugggaaugcggcugg

SEQ ID NO: 2897275 - RNA, 15 nt, Mycobacterium avium subsp. paratuberculosis
cucgugggccaccac

SEQ ID NO: 2897276 - RNA, 17 nt, Mycobacterium avium subsp. paratuberculosis
cucgugggucagcuuca

SEQ ID NO: 2897277 - RNA, 16 nt, Mycobacterium avium subsp. paratuberculosis
cucguggucccaggac

SEQ ID NO: 2897278 - RNA, 22 nt, Mycobacterium avium subsp. paratuberculosis
cucguguccgaugacgagcagc

SEQ ID NO: 2897279 - RNA, 15 nt, Mycobacterium avium subsp. paratuberculosis
cucguucuggcccgc

SEQ ID NO: 2897280 - RNA, 13 nt, Mycobacterium avium subsp. paratuberculosis
cucguugagcaca

SEQ ID NO: 2897281 - RNA, 13 nt, Mycobacterium avium subsp. paratuberculosis
cucguugauccag

SEQ ID NO: 2897282 - RNA, 15 nt, Mycobacterium avium subsp. paratuberculosis
cucguugccggcggc

SEQ ID NO: 2897283 - RNA, 14 nt, Mycobacterium avium subsp. paratuberculosis
cucguuggccagcu

SEQ ID NO: 2897284 - RNA, 14 nt, Mycobacterium avium subsp. paratuberculosis
cucguuggccggcu

SEQ ID NO: 2897285 - RNA, 17 nt, Mycobacterium avium subsp. paratuberculosis
cucguuggccggcucca

SEQ ID NO: 2897286 - RNA, 16 nt, Mycobacterium avium subsp. paratuberculosis
cucguugugcaccggc

SEQ ID NO: 2897287 - RNA, 19 nt, Mycobacterium avium subsp. paratuberculosis
cucguugugcaccggcacg

SEQ ID NO: 2897288 - RNA, 21 nt, Mycobacterium avium subsp. paratuberculosis
cucguugugcaccggcacguc

SEQ ID NO: 2897289 - RNA, 20 nt, Mycobacterium avium subsp. paratuberculosis
cucuaacuguugucagccac

SEQ ID NO: 2897290 - RNA, 14 nt, Mycobacterium avium subsp. paratuberculosis
cucuacucagccga

SEQ ID NO: 2897291 - RNA, 14 nt, Mycobacterium avium subsp. paratuberculosis
cucucacggcggua

SEQ ID NO: 2897292 - RNA, 20 nt, Mycobacterium avium subsp. paratuberculosis
cucucagccggaacacaacg

SEQ ID NO: 2897293 - RNA, 14 nt, Mycobacterium avium subsp. paratuberculosis
cucucgccggucag

SEQ ID NO: 2897294 - RNA, 23 nt, Mycobacterium avium subsp. paratuberculosis
cucucgcguucgcuuucgccggg

SEQ ID NO: 2897295 - RNA, 18 nt, Mycobacterium avium subsp. paratuberculosis
cucucggcgccguccagc

SEQ ID NO: 2897296 - RNA, 20 nt, Mycobacterium avium subsp. paratuberculosis
cucucggcgccguccagcuc

SEQ ID NO: 2897297 - RNA, 18 nt, Mycobacterium avium subsp. paratuberculosis
cucucgucgacgauggcc

SEQ ID NO: 2897298 - RNA, 22 nt, Mycobacterium avium subsp. paratuberculosis
cucugacggcucuucggcgccg

SEQ ID NO: 2897299 - RNA, 23 nt, Mycobacterium avium subsp. paratuberculosis
cucugcacucagagcagcgccug

SEQ ID NO: 2897300 - RNA, 14 nt, Mycobacterium avium subsp. paratuberculosis
cucugccgggccgc

SEQ ID NO: 2897301 - RNA, 15 nt, Mycobacterium avium subsp. paratuberculosis
cucugccgggccgca

SEQ ID NO: 2897302 - RNA, 19 nt, Mycobacterium avium subsp. paratuberculosis
cucugccgggccgcaucca

SEQ ID NO: 2897303 - RNA, 22 nt, Mycobacterium avium subsp. paratuberculosis
cucugccuacuugcggccgcga

SEQ ID NO: 2897304 - RNA, 14 nt, Mycobacterium avium subsp. paratuberculosis
cucugccugcagga

SEQ ID NO: 2897305 - RNA, 17 nt, Mycobacterium avium subsp. paratuberculosis
cucugccugcaggaugg

SEQ ID NO: 2897306 - RNA, 10 nt, Mycobacterium avium subsp. paratuberculosis
cucuggccga

SEQ ID NO: 2897307 - RNA, 22 nt, Mycobacterium avium subsp. paratuberculosis
cucuggccugauugacggccca

SEQ ID NO: 2897308 - RNA, 22 nt, Mycobacterium avium subsp. paratuberculosis
cucuggcgugacgcucggcgcg

SEQ ID NO: 2897309 - RNA, 13 nt, Mycobacterium avium subsp. paratuberculosis
cucugucgucgac

SEQ ID NO: 2897310 - RNA, 19 nt, Mycobacterium avium subsp. paratuberculosis
cucuucgaaagccacccgc

SEQ ID NO: 2897311 - RNA, 13 nt, Mycobacterium avium subsp. paratuberculosis
cucuucgacccgc

SEQ ID NO: 2897312 - RNA, 15 nt, Mycobacterium avium subsp. paratuberculosis
cucuucgccggacag

SEQ ID NO: 2897313 - RNA, 17 nt, Mycobacterium avium subsp. paratuberculosis
cucuucgccggacagcc

SEQ ID NO: 2897314 - RNA, 20 nt, Mycobacterium avium subsp. paratuberculosis
cucuucgccggacagccggg

SEQ ID NO: 2897315 - RNA, 15 nt, Mycobacterium avium subsp. paratuberculosis
cucuucgcugccgcc

SEQ ID NO: 2897316 - RNA, 13 nt, Mycobacterium avium subsp. paratuberculosis
cucuucggcgccg

SEQ ID NO: 2897317 - RNA, 15 nt, Mycobacterium avium subsp. paratuberculosis
cucuucggcgccggc

SEQ ID NO: 2897318 - RNA, 12 nt, Mycobacterium avium subsp. paratuberculosis
cucuucgguggu

SEQ ID NO: 2897319 - RNA, 18 nt, Mycobacterium avium subsp. paratuberculosis
cucuugcgugcgggucgc

SEQ ID NO: 2897320 - RNA, 13 nt, Mycobacterium avium subsp. paratuberculosis
cucuugggacugg

SEQ ID NO: 2897321 - RNA, 20 nt, Mycobacterium avium subsp. paratuberculosis
cugaaagccgaggcgcaaca

SEQ ID NO: 2897322 - RNA, 17 nt, Mycobacterium avium subsp. paratuberculosis
cugaaagcucgcgucga

SEQ ID NO: 2897323 - RNA, 15 nt, Mycobacterium avium subsp. paratuberculosis
cugaaagugacgggu

SEQ ID NO: 2897324 - RNA, 17 nt, Mycobacterium avium subsp. paratuberculosis
cugaaaugccgggccgg

SEQ ID NO: 2897325 - RNA, 14 nt, Mycobacterium avium subsp. paratuberculosis
cugaacacgaaccc

SEQ ID NO: 2897326 - RNA, 16 nt, Mycobacterium avium subsp. paratuberculosis
cugaacacgaacccgg

SEQ ID NO: 2897327 - RNA, 19 nt, Mycobacterium avium subsp. paratuberculosis
cugaacagcagcagcagcg

SEQ ID NO: 2897328 - RNA, 16 nt, Mycobacterium avium subsp. paratuberculosis
cugaacagcccgagca

SEQ ID NO: 2897329 - RNA, 13 nt, Mycobacterium avium subsp. paratuberculosis
cugaacagcgcgc

SEQ ID NO: 2897330 - RNA, 18 nt, Mycobacterium avium subsp. paratuberculosis
cugaacagcgcgccgaac

SEQ ID NO: 2897331 - RNA, 22 nt, Mycobacterium avium subsp. paratuberculosis
cugaacagcgcgccgaacaccu

SEQ ID NO: 2897332 - RNA, 16 nt, Mycobacterium avium subsp. paratuberculosis
cugaacgccagcagcc

SEQ ID NO: 2897333 - RNA, 22 nt, Mycobacterium avium subsp. paratuberculosis
cugaacgccagcagccgcagca

SEQ ID NO: 2897334 - RNA, 21 nt, Mycobacterium avium subsp. paratuberculosis
cugaacgccugccggcgccgg

SEQ ID NO: 2897335 - RNA, 22 nt, Mycobacterium avium subsp. paratuberculosis
cugaacgccugccggcgccgga

SEQ ID NO: 2897336 - RNA, 15 nt, Mycobacterium avium subsp. paratuberculosis
cugaacgcggugggc

SEQ ID NO: 2897337 - RNA, 22 nt, Mycobacterium avium subsp. paratuberculosis
cugaacgcggugggcaccagca

SEQ ID NO: 2897338 - RNA, 14 nt, Mycobacterium avium subsp. paratuberculosis
cugaacggccgcgc

SEQ ID NO: 2897339 - RNA, 16 nt, Mycobacterium avium subsp. paratuberculosis
cugaacgggcagccac

SEQ ID NO: 2897340 - RNA, 17 nt, Mycobacterium avium subsp. paratuberculosis
cugaacggugcccgccg

SEQ ID NO: 2897341 - RNA, 20 nt, Mycobacterium avium subsp. paratuberculosis
cugaagaucgaaaugaccgc

SEQ ID NO: 2897342 - RNA, 21 nt, Mycobacterium avium subsp. paratuberculosis
cugaagcggcccuguucgccg

SEQ ID NO: 2897343 - RNA, 21 nt, Mycobacterium avium subsp. paratuberculosis
cugaagguuguucugcucgaa

SEQ ID NO: 2897344 - RNA, 22 nt, Mycobacterium avium subsp. paratuberculosis
cugaaguucaccaccgcgcugc

SEQ ID NO: 2897345 - RNA, 22 nt, Mycobacterium avium subsp. paratuberculosis
cugaaucccuccggcaggccgc

SEQ ID NO: 2897346 - RNA, 18 nt, Mycobacterium avium subsp. paratuberculosis
cugaaugaacgaccuggu

SEQ ID NO: 2897347 - RNA, 13 nt, Mycobacterium avium subsp. paratuberculosis
cugaauucggcca

SEQ ID NO: 2897348 - RNA, 14 nt, Mycobacterium avium subsp. paratuberculosis
cugaauucggccac

SEQ ID NO: 2897349 - RNA, 16 nt, Mycobacterium avium subsp. paratuberculosis
cugacacagcaccggc

SEQ ID NO: 2897350 - RNA, 20 nt, Mycobacterium avium subsp. paratuberculosis
cugacacagcaccggcgucg

SEQ ID NO: 2897351 - RNA, 21 nt, Mycobacterium avium subsp. paratuberculosis
cugacacagcaccggcgucga

SEQ ID NO: 2897352 - RNA, 22 nt, Mycobacterium avium subsp. paratuberculosis
cugacacagcaccggcgucgac

SEQ ID NO: 2897353 - RNA, 20 nt, Mycobacterium avium subsp. paratuberculosis
cugacacccgacgaagccgc

SEQ ID NO: 2897354 - RNA, 16 nt, Mycobacterium avium subsp. paratuberculosis
cugacacgaccgccug

SEQ ID NO: 2897355 - RNA, 16 nt, Mycobacterium avium subsp. paratuberculosis
cugaccaaggccgaca

SEQ ID NO: 2897356 - RNA, 16 nt, Mycobacterium avium subsp. paratuberculosis
cugaccaccgagguga

SEQ ID NO: 2897357 - RNA, 13 nt, Mycobacterium avium subsp. paratuberculosis
cugaccagcgccu

SEQ ID NO: 2897358 - RNA, 15 nt, Mycobacterium avium subsp. paratuberculosis
cugaccagcgccucg

SEQ ID NO: 2897359 - RNA, 17 nt, Mycobacterium avium subsp. paratuberculosis
cugaccagcgccucgcg

SEQ ID NO: 2897360 - RNA, 13 nt, Mycobacterium avium subsp. paratuberculosis
cugaccagcggcg

SEQ ID NO: 2897361 - RNA, 20 nt, Mycobacterium avium subsp. paratuberculosis
cugaccagcggcgcgccggg

SEQ ID NO: 2897362 - RNA, 19 nt, Mycobacterium avium subsp. paratuberculosis
cugaccagcgugaccucga

SEQ ID NO: 2897363 - RNA, 18 nt, Mycobacterium avium subsp. paratuberculosis
cugaccaugacccacggg

SEQ ID NO: 2897364 - RNA, 14 nt, Mycobacterium avium subsp. paratuberculosis
cugacccagcgcgg

SEQ ID NO: 2897365 - RNA, 17 nt, Mycobacterium avium subsp. paratuberculosis
cugaccccccgacgccg

SEQ ID NO: 2897366 - RNA, 19 nt, Mycobacterium avium subsp. paratuberculosis
cugaccccccgacgccgac

SEQ ID NO: 2897367 - RNA, 16 nt, Mycobacterium avium subsp. paratuberculosis
cugaccccgcucggcg

SEQ ID NO: 2897368 - RNA, 13 nt, Mycobacterium avium subsp. paratuberculosis
cugaccccgguuu

SEQ ID NO: 2897369 - RNA, 19 nt, Mycobacterium avium subsp. paratuberculosis
cugacccgcacgaaaugcg

SEQ ID NO: 2897370 - RNA, 16 nt, Mycobacterium avium subsp. paratuberculosis
cugacccgcccgggug

SEQ ID NO: 2897371 - RNA, 21 nt, Mycobacterium avium subsp. paratuberculosis
cugacccgccgcaacagccgg

SEQ ID NO: 2897372 - RNA, 22 nt, Mycobacterium avium subsp. paratuberculosis
cugacccgggcggccugcugca

SEQ ID NO: 2897373 - RNA, 16 nt, Mycobacterium avium subsp. paratuberculosis
cugacccggucgcggc

SEQ ID NO: 2897374 - RNA, 16 nt, Mycobacterium avium subsp. paratuberculosis
cugacccuucugggcg

SEQ ID NO: 2897375 - RNA, 16 nt, Mycobacterium avium subsp. paratuberculosis
cugaccgacggcgacc

SEQ ID NO: 2897376 - RNA, 18 nt, Mycobacterium avium subsp. paratuberculosis
cugaccgagcggcgcugc

SEQ ID NO: 2897377 - RNA, 16 nt, Mycobacterium avium subsp. paratuberculosis
cugaccgaucuggcga

SEQ ID NO: 2897378 - RNA, 17 nt, Mycobacterium avium subsp. paratuberculosis
cugaccgaucuggcgau

SEQ ID NO: 2897379 - RNA, 16 nt, Mycobacterium avium subsp. paratuberculosis
cugaccgauggccgcc

SEQ ID NO: 2897380 - RNA, 13 nt, Mycobacterium avium subsp. paratuberculosis
cugaccgcaggaa

SEQ ID NO: 2897381 - RNA, 13 nt, Mycobacterium avium subsp. paratuberculosis
cugaccgccgcgc

SEQ ID NO: 2897382 - RNA, 19 nt, Mycobacterium avium subsp. paratuberculosis
cugaccgccgcgcucggcc

SEQ ID NO: 2897383 - RNA, 24 nt, Mycobacterium avium subsp. paratuberculosis
cugaccgccgcgcucggccauccg

SEQ ID NO: 2897384 - RNA, 18 nt, Mycobacterium avium subsp. paratuberculosis
cugaccgcgggcccgccg

SEQ ID NO: 2897385 - RNA, 23 nt, Mycobacterium avium subsp. paratuberculosis
cugaccgcgggcccgccguagcg

SEQ ID NO: 2897386 - RNA, 23 nt, Mycobacterium avium subsp. paratuberculosis
cugaccgcgggugaggggcgcgc

SEQ ID NO: 2897387 - RNA, 12 nt, Mycobacterium avium subsp. paratuberculosis
cugaccggcgau

SEQ ID NO: 2897388 - RNA, 12 nt, Mycobacterium avium subsp. paratuberculosis
cugaccggcggu

SEQ ID NO: 2897389 - RNA, 13 nt, Mycobacterium avium subsp. paratuberculosis
cugaccggcggug

SEQ ID NO: 2897390 - RNA, 16 nt, Mycobacterium avium subsp. paratuberculosis
cugaccggcggugccg

SEQ ID NO: 2897391 - RNA, 19 nt, Mycobacterium avium subsp. paratuberculosis
cugaccggcggugccggcc

SEQ ID NO: 2897392 - RNA, 22 nt, Mycobacterium avium subsp. paratuberculosis
cugaccggcggugccggccaga

SEQ ID NO: 2897393 - RNA, 14 nt, Mycobacterium avium subsp. paratuberculosis
cugaccgucgacca

SEQ ID NO: 2897394 - RNA, 13 nt, Mycobacterium avium subsp. paratuberculosis
cugaccgucggcc

SEQ ID NO: 2897395 - RNA, 16 nt, Mycobacterium avium subsp. paratuberculosis
cugaccgucggccaga

SEQ ID NO: 2897396 - RNA, 17 nt, Mycobacterium avium subsp. paratuberculosis
cugaccgugcuuggcgg

SEQ ID NO: 2897397 - RNA, 24 nt, Mycobacterium avium subsp. paratuberculosis
cugaccgugcuuggcggcgcacuc

SEQ ID NO: 2897398 - RNA, 14 nt, Mycobacterium avium subsp. paratuberculosis
cugaccucgccgcc

SEQ ID NO: 2897399 - RNA, 15 nt, Mycobacterium avium subsp. paratuberculosis
cugaccucgccgccc

SEQ ID NO: 2897400 - RNA, 17 nt, Mycobacterium avium subsp. paratuberculosis
cugaccucgcgccgcga

SEQ ID NO: 2897401 - RNA, 19 nt, Mycobacterium avium subsp. paratuberculosis
cugaccuggcugacggcgu

SEQ ID NO: 2897402 - RNA, 21 nt, Mycobacterium avium subsp. paratuberculosis
cugaccuggcugacggcgucg

SEQ ID NO: 2897403 - RNA, 17 nt, Mycobacterium avium subsp. paratuberculosis
cugaccugugcgcccca

SEQ ID NO: 2897404 - RNA, 18 nt, Mycobacterium avium subsp. paratuberculosis
cugaccugugcgccccac

SEQ ID NO: 2897405 - RNA, 18 nt, Mycobacterium avium subsp. paratuberculosis
cugaccuucucccgcggc

SEQ ID NO: 2897406 - RNA, 21 nt, Mycobacterium avium subsp. paratuberculosis
cugaccuucuuggucagcggc

SEQ ID NO: 2897407 - RNA, 15 nt, Mycobacterium avium subsp. paratuberculosis
cugacgaacgcgccg

SEQ ID NO: 2897408 - RNA, 21 nt, Mycobacterium avium subsp. paratuberculosis
cugacgaacgcgccgcccacc

SEQ ID NO: 2897409 - RNA, 14 nt, Mycobacterium avium subsp. paratuberculosis
cugacgaucgucga

SEQ ID NO: 2897410 - RNA, 18 nt, Mycobacterium avium subsp. paratuberculosis
cugacgaucgucgacguc

SEQ ID NO: 2897411 - RNA, 17 nt, Mycobacterium avium subsp. paratuberculosis
cugacgaugauccuggc

SEQ ID NO: 2897412 - RNA, 19 nt, Mycobacterium avium subsp. paratuberculosis
cugacgaugauccuggccu

SEQ ID NO: 2897413 - RNA, 15 nt, Mycobacterium avium subsp. paratuberculosis
cugacgaugcggccg

SEQ ID NO: 2897414 - RNA, 21 nt, Mycobacterium avium subsp. paratuberculosis
cugacgauggcgaccgcgcag

SEQ ID NO: 2897415 - RNA, 20 nt, Mycobacterium avium subsp. paratuberculosis
cugacgauucuugaccaccu

SEQ ID NO: 2897416 - RNA, 19 nt, Mycobacterium avium subsp. paratuberculosis
cugacgcaccucgcucagc

SEQ ID NO: 2897417 - RNA, 14 nt, Mycobacterium avium subsp. paratuberculosis
cugacgcaucacca

SEQ ID NO: 2897418 - RNA, 17 nt, Mycobacterium avium subsp. paratuberculosis
cugacgcaucaccacgc

SEQ ID NO: 2897419 - RNA, 16 nt, Mycobacterium avium subsp. paratuberculosis
cugacgccacgcguca

SEQ ID NO: 2897420 - RNA, 14 nt, Mycobacterium avium subsp. paratuberculosis
cugacgccgagcag

SEQ ID NO: 2897421 - RNA, 17 nt, Mycobacterium avium subsp. paratuberculosis
cugacgccggucgcugc

SEQ ID NO: 2897422 - RNA, 22 nt, Mycobacterium avium subsp. paratuberculosis
cugacgccggucgcugcgauga

SEQ ID NO: 2897423 - RNA, 15 nt, Mycobacterium avium subsp. paratuberculosis
cugacgcgaccgcgc

SEQ ID NO: 2897424 - RNA, 18 nt, Mycobacterium avium subsp. paratuberculosis
cugacgcgaccgcgcggc

SEQ ID NO: 2897425 - RNA, 19 nt, Mycobacterium avium subsp. paratuberculosis
cugacgcgaccgcgcggcg

SEQ ID NO: 2897426 - RNA, 13 nt, Mycobacterium avium subsp. paratuberculosis
cugacgcggcggg

SEQ ID NO: 2897427 - RNA, 17 nt, Mycobacterium avium subsp. paratuberculosis
cugacgcucggucgcca

SEQ ID NO: 2897428 - RNA, 21 nt, Mycobacterium avium subsp. paratuberculosis
cugacgcucggucgccacggc

SEQ ID NO: 2897429 - RNA, 24 nt, Mycobacterium avium subsp. paratuberculosis
cugacgcucggucgccacggccgg

SEQ ID NO: 2897430 - RNA, 13 nt, Mycobacterium avium subsp. paratuberculosis
cugacggccauga

SEQ ID NO: 2897431 - RNA, 18 nt, Mycobacterium avium subsp. paratuberculosis
cugacggcgucguugagc

SEQ ID NO: 2897432 - RNA, 22 nt, Mycobacterium avium subsp. paratuberculosis
cugacggcgucguugagcaggc

SEQ ID NO: 2897433 - RNA, 21 nt, Mycobacterium avium subsp. paratuberculosis
cugacggcucuucggcgccga

SEQ ID NO: 2897434 - RNA, 22 nt, Mycobacterium avium subsp. paratuberculosis
cugacggcucuucggcgccgag

SEQ ID NO: 2897435 - RNA, 14 nt, Mycobacterium avium subsp. paratuberculosis
cugacgggaccgca

SEQ ID NO: 2897436 - RNA, 12 nt, Mycobacterium avium subsp. paratuberculosis
cugacgggccgg

SEQ ID NO: 2897437 - RNA, 13 nt, Mycobacterium avium subsp. paratuberculosis
cugacgggccggc

SEQ ID NO: 2897438 - RNA, 14 nt, Mycobacterium avium subsp. paratuberculosis
cugacgggccggcg

SEQ ID NO: 2897439 - RNA, 16 nt, Mycobacterium avium subsp. paratuberculosis
cugacgggccggcggg

SEQ ID NO: 2897440 - RNA, 20 nt, Mycobacterium avium subsp. paratuberculosis
cugacgggccggcggggugg

SEQ ID NO: 2897441 - RNA, 15 nt, Mycobacterium avium subsp. paratuberculosis
cugacggucgccgac

SEQ ID NO: 2897442 - RNA, 15 nt, Mycobacterium avium subsp. paratuberculosis
cugacgucgaugccg

SEQ ID NO: 2897443 - RNA, 13 nt, Mycobacterium avium subsp. paratuberculosis
cugacgucgucgc

SEQ ID NO: 2897444 - RNA, 14 nt, Mycobacterium avium subsp. paratuberculosis
cugacgucgucgcc

SEQ ID NO: 2897445 - RNA, 16 nt, Mycobacterium avium subsp. paratuberculosis
cugacugagucaagcc

SEQ ID NO: 2897446 - RNA, 12 nt, Mycobacterium avium subsp. paratuberculosis
cugacugcgauc

SEQ ID NO: 2897447 - RNA, 16 nt, Mycobacterium avium subsp. paratuberculosis
cugacugcgaucgccg

SEQ ID NO: 2897448 - RNA, 18 nt, Mycobacterium avium subsp. paratuberculosis
cugacugcgaucgccgac

SEQ ID NO: 2897449 - RNA, 18 nt, Mycobacterium avium subsp. paratuberculosis
cugagcaaccgguucgga

SEQ ID NO: 2897450 - RNA, 21 nt, Mycobacterium avium subsp. paratuberculosis
cugagcaauucggugacggcg

SEQ ID NO: 2897451 - RNA, 24 nt, Mycobacterium avium subsp. paratuberculosis
cugagcaauucggugacggcgucg

SEQ ID NO: 2897452 - RNA, 20 nt, Mycobacterium avium subsp. paratuberculosis
cugagcacccgcagcucgcc

SEQ ID NO: 2897453 - RNA, 17 nt, Mycobacterium avium subsp. paratuberculosis
cugagcacccgcccgga

SEQ ID NO: 2897454 - RNA, 13 nt, Mycobacterium avium subsp. paratuberculosis
cugagcaccgggg

SEQ ID NO: 2897455 - RNA, 16 nt, Mycobacterium avium subsp. paratuberculosis
cugagcaccggggucu

SEQ ID NO: 2897456 - RNA, 18 nt, Mycobacterium avium subsp. paratuberculosis
cugagcacggugggcgcc

SEQ ID NO: 2897457 - RNA, 16 nt, Mycobacterium avium subsp. paratuberculosis
cugagcagccagucgg

SEQ ID NO: 2897458 - RNA, 15 nt, Mycobacterium avium subsp. paratuberculosis
cugagcagcccgacc

SEQ ID NO: 2897459 - RNA, 18 nt, Mycobacterium avium subsp. paratuberculosis
cugagcagcccgaccacc

SEQ ID NO: 2897460 - RNA, 19 nt, Mycobacterium avium subsp. paratuberculosis
cugagcagcccgaccaccu

SEQ ID NO: 2897461 - RNA, 21 nt, Mycobacterium avium subsp. paratuberculosis
cugagcagcccgaccaccucc

SEQ ID NO: 2897462 - RNA, 16 nt, Mycobacterium avium subsp. paratuberculosis
cugagcagcucgcgga

SEQ ID NO: 2897463 - RNA, 12 nt, Mycobacterium avium subsp. paratuberculosis
cugagcaggucc

SEQ ID NO: 2897464 - RNA, 18 nt, Mycobacterium avium subsp. paratuberculosis
cugagcccggauuucguc

SEQ ID NO: 2897465 - RNA, 23 nt, Mycobacterium avium subsp. paratuberculosis
cugagcccggcgacgaagcagcu

SEQ ID NO: 2897466 - RNA, 11 nt, Mycobacterium avium subsp. paratuberculosis
cugagccgccg

SEQ ID NO: 2897467 - RNA, 14 nt, Mycobacterium avium subsp. paratuberculosis
cugagccgccgagc

SEQ ID NO: 2897468 - RNA, 20 nt, Mycobacterium avium subsp. paratuberculosis
cugagccgccgagccggcac

SEQ ID NO: 2897469 - RNA, 23 nt, Mycobacterium avium subsp. paratuberculosis
cugagccgccgagccggcacggc

SEQ ID NO: 2897470 - RNA, 20 nt, Mycobacterium avium subsp. paratuberculosis
cugagccgccggggcgccgc

SEQ ID NO: 2897471 - RNA, 16 nt, Mycobacterium avium subsp. paratuberculosis
cugagccgcucgucga

SEQ ID NO: 2897472 - RNA, 16 nt, Mycobacterium avium subsp. paratuberculosis
cugagcgccaggccau

SEQ ID NO: 2897473 - RNA, 13 nt, Mycobacterium avium subsp. paratuberculosis
cugagcgcccggu

SEQ ID NO: 2897474 - RNA, 16 nt, Mycobacterium avium subsp. paratuberculosis
cugagcgcccggucga

SEQ ID NO: 2897475 - RNA, 14 nt, Mycobacterium avium subsp. paratuberculosis
cugagcgcggcgag

SEQ ID NO: 2897476 - RNA, 13 nt, Mycobacterium avium subsp. paratuberculosis
cugagcggcagaa

SEQ ID NO: 2897477 - RNA, 19 nt, Mycobacterium avium subsp. paratuberculosis
cugagcggcagaaguugac

SEQ ID NO: 2897478 - RNA, 15 nt, Mycobacterium avium subsp. paratuberculosis
cugagcgggacgcgc

SEQ ID NO: 2897479 - RNA, 20 nt, Mycobacterium avium subsp. paratuberculosis
cugagcggguaaccgcagcc

SEQ ID NO: 2897480 - RNA, 18 nt, Mycobacterium avium subsp. paratuberculosis
cugagcgggucggccggc

SEQ ID NO: 2897481 - RNA, 19 nt, Mycobacterium avium subsp. paratuberculosis
cugagcgggucggccggcg

SEQ ID NO: 2897482 - RNA, 23 nt, Mycobacterium avium subsp. paratuberculosis
cugagcgggucggccggcggggc

SEQ ID NO: 2897483 - RNA, 21 nt, Mycobacterium avium subsp. paratuberculosis
cugagcgucggucucgacguu

SEQ ID NO: 2897484 - RNA, 17 nt, Mycobacterium avium subsp. paratuberculosis
cugagcguggugaagca

SEQ ID NO: 2897485 - RNA, 22 nt, Mycobacterium avium subsp. paratuberculosis
cugagcugugccgcggugcggc

SEQ ID NO: 2897486 - RNA, 17 nt, Mycobacterium avium subsp. paratuberculosis
cugagcuucugcccggc

SEQ ID NO: 2897487 - RNA, 16 nt, Mycobacterium avium subsp. paratuberculosis
cugagcuuuucgucgg

SEQ ID NO: 2897488 - RNA, 19 nt, Mycobacterium avium subsp. paratuberculosis
cugagcuuuucgucggugc

SEQ ID NO: 2897489 - RNA, 22 nt, Mycobacterium avium subsp. paratuberculosis
cugaggagacgaucucgccguc

SEQ ID NO: 2897490 - RNA, 22 nt, Mycobacterium avium subsp. paratuberculosis
cugaggaugguggugcaggcga

SEQ ID NO: 2897491 - RNA, 17 nt, Mycobacterium avium subsp. paratuberculosis
cugaggcccggugagcc

SEQ ID NO: 2897492 - RNA, 19 nt, Mycobacterium avium subsp. paratuberculosis
cugaggccgccccggccgc

SEQ ID NO: 2897493 - RNA, 16 nt, Mycobacterium avium subsp. paratuberculosis
cugagggugucggcga

SEQ ID NO: 2897494 - RNA, 20 nt, Mycobacterium avium subsp. paratuberculosis
cugauagcccgccgcggcga

SEQ ID NO: 2897495 - RNA, 21 nt, Mycobacterium avium subsp. paratuberculosis
cugauagcccgccgcggcgac

SEQ ID NO: 2897496 - RNA, 16 nt, Mycobacterium avium subsp. paratuberculosis
cugauaggggucggcg

SEQ ID NO: 2897497 - RNA, 17 nt, Mycobacterium avium subsp. paratuberculosis
cugauaggggucggcga

SEQ ID NO: 2897498 - RNA, 15 nt, Mycobacterium avium subsp. paratuberculosis
cugaucaccgcgcuc

SEQ ID NO: 2897499 - RNA, 19 nt, Mycobacterium avium subsp. paratuberculosis
cugaucaccgcgcucggcg

SEQ ID NO: 2897500 - RNA, 17 nt, Mycobacterium avium subsp. paratuberculosis
cugaucagccggcgagc

SEQ ID NO: 2897501 - RNA, 19 nt, Mycobacterium avium subsp. paratuberculosis
cugaucaugaagucgcgga

SEQ ID NO: 2897502 - RNA, 22 nt, Mycobacterium avium subsp. paratuberculosis
cugauccagcagcgccucggcg

SEQ ID NO: 2897503 - RNA, 20 nt, Mycobacterium avium subsp. paratuberculosis
cugaucgcccagcaccgcga

SEQ ID NO: 2897504 - RNA, 19 nt, Mycobacterium avium subsp. paratuberculosis
cugaucgcgauccgggcgc

SEQ ID NO: 2897505 - RNA, 21 nt, Mycobacterium avium subsp. paratuberculosis
cugaucgcgauccgggcgccg

SEQ ID NO: 2897506 - RNA, 23 nt, Mycobacterium avium subsp. paratuberculosis
cugaucgcgauccgggcgccggc

SEQ ID NO: 2897507 - RNA, 13 nt, Mycobacterium avium subsp. paratuberculosis
cugaucgcggccg

SEQ ID NO: 2897508 - RNA, 14 nt, Mycobacterium avium subsp. paratuberculosis
cugaucgcggccgg

SEQ ID NO: 2897509 - RNA, 17 nt, Mycobacterium avium subsp. paratuberculosis
cugaucgcggccggcga

SEQ ID NO: 2897510 - RNA, 16 nt, Mycobacterium avium subsp. paratuberculosis
cugaucgcggcgagca

SEQ ID NO: 2897511 - RNA, 17 nt, Mycobacterium avium subsp. paratuberculosis
cugaucgcggcgagcag

SEQ ID NO: 2897512 - RNA, 22 nt, Mycobacterium avium subsp. paratuberculosis
cugaucgcggcgagcagcgcga

SEQ ID NO: 2897513 - RNA, 16 nt, Mycobacterium avium subsp. paratuberculosis
cugaucgcgucgacgg

SEQ ID NO: 2897514 - RNA, 21 nt, Mycobacterium avium subsp. paratuberculosis
cugaucgcgucgacggcgccg

SEQ ID NO: 2897515 - RNA, 23 nt, Mycobacterium avium subsp. paratuberculosis
cugaucgcgucgacggcgccgga

SEQ ID NO: 2897516 - RNA, 14 nt, Mycobacterium avium subsp. paratuberculosis
cugaucggcguugg

SEQ ID NO: 2897517 - RNA, 21 nt, Mycobacterium avium subsp. paratuberculosis
cugaucggggcccaccccgga

SEQ ID NO: 2897518 - RNA, 14 nt, Mycobacterium avium subsp. paratuberculosis
cugaucgggugaga

SEQ ID NO: 2897519 - RNA, 20 nt, Mycobacterium avium subsp. paratuberculosis
cugaucgggugagacggcca

SEQ ID NO: 2897520 - RNA, 14 nt, Mycobacterium avium subsp. paratuberculosis
cugaucucgacggu

SEQ ID NO: 2897521 - RNA, 14 nt, Mycobacterium avium subsp. paratuberculosis
cugaucugcggcac

SEQ ID NO: 2897522 - RNA, 16 nt, Mycobacterium avium subsp. paratuberculosis
cugaucugcggcacca

SEQ ID NO: 2897523 - RNA, 13 nt, Mycobacterium avium subsp. paratuberculosis
cugaucuggaugc

SEQ ID NO: 2897524 - RNA, 19 nt, Mycobacterium avium subsp. paratuberculosis
cugaucuuggcacgggccc

SEQ ID NO: 2897525 - RNA, 15 nt, Mycobacterium avium subsp. paratuberculosis
cugaugaagccgccg

SEQ ID NO: 2897526 - RNA, 18 nt, Mycobacterium avium subsp. paratuberculosis
cugaugcccucgccgguc

SEQ ID NO: 2897527 - RNA, 17 nt, Mycobacterium avium subsp. paratuberculosis
cugaugccgccgaagcg

SEQ ID NO: 2897528 - RNA, 20 nt, Mycobacterium avium subsp. paratuberculosis
cugaugguggcgcgcaucgu

SEQ ID NO: 2897529 - RNA, 19 nt, Mycobacterium avium subsp. paratuberculosis
cugauguccuuguggucga

SEQ ID NO: 2897530 - RNA, 22 nt, Mycobacterium avium subsp. paratuberculosis
cugauugcccuuggacaccugc

SEQ ID NO: 2897531 - RNA, 15 nt, Mycobacterium avium subsp. paratuberculosis
cugauuguugacggu

SEQ ID NO: 2897532 - RNA, 20 nt, Mycobacterium avium subsp. paratuberculosis
cugcaacaacuucgggguga

SEQ ID NO: 2897533 - RNA, 21 nt, Mycobacterium avium subsp. paratuberculosis
cugcaaccgguccgccgucgg

SEQ ID NO: 2897534 - RNA, 19 nt, Mycobacterium avium subsp. paratuberculosis
cugcaacgcgucggcgccg

SEQ ID NO: 2897535 - RNA, 16 nt, Mycobacterium avium subsp. paratuberculosis
cugcaacggcuggcgc

SEQ ID NO: 2897536 - RNA, 23 nt, Mycobacterium avium subsp. paratuberculosis
cugcaacuggucgugcagcaccg

SEQ ID NO: 2897537 - RNA, 17 nt, Mycobacterium avium subsp. paratuberculosis
cugcaagggcuugggcg

SEQ ID NO: 2897538 - RNA, 19 nt, Mycobacterium avium subsp. paratuberculosis
cugcacacgggcccguccg

SEQ ID NO: 2897539 - RNA, 22 nt, Mycobacterium avium subsp. paratuberculosis
cugcacacgggcccguccgcga

SEQ ID NO: 2897540 - RNA, 23 nt, Mycobacterium avium subsp. paratuberculosis
cugcaccacgaagcgggcggcga

SEQ ID NO: 2897541 - RNA, 20 nt, Mycobacterium avium subsp. paratuberculosis
cugcaccagcacgacaccga

SEQ ID NO: 2897542 - RNA, 22 nt, Mycobacterium avium subsp. paratuberculosis
cugcaccagcacgacaccgacg

SEQ ID NO: 2897543 - RNA, 14 nt, Mycobacterium avium subsp. paratuberculosis
cugcaccagcccgu

SEQ ID NO: 2897544 - RNA, 17 nt, Mycobacterium avium subsp. paratuberculosis
cugcaccagcccgucgg

SEQ ID NO: 2897545 - RNA, 14 nt, Mycobacterium avium subsp. paratuberculosis
cugcaccagcgcgg

SEQ ID NO: 2897546 - RNA, 22 nt, Mycobacterium avium subsp. paratuberculosis
cugcaccagcgcggacaccagg

SEQ ID NO: 2897547 - RNA, 14 nt, Mycobacterium avium subsp. paratuberculosis
cugcaccagcggcg

SEQ ID NO: 2897548 - RNA, 16 nt, Mycobacterium avium subsp. paratuberculosis
cugcaccagcggcgcc

SEQ ID NO: 2897549 - RNA, 17 nt, Mycobacterium avium subsp. paratuberculosis
cugcaccagcguggugc

SEQ ID NO: 2897550 - RNA, 13 nt, Mycobacterium avium subsp. paratuberculosis
cugcaccagggcg

SEQ ID NO: 2897551 - RNA, 14 nt, Mycobacterium avium subsp. paratuberculosis
cugcacccaccggc

SEQ ID NO: 2897552 - RNA, 18 nt, Mycobacterium avium subsp. paratuberculosis
cugcacccaccggcgcag

SEQ ID NO: 2897553 - RNA, 16 nt, Mycobacterium avium subsp. paratuberculosis
cugcacccagccgugc

SEQ ID NO: 2897554 - RNA, 17 nt, Mycobacterium avium subsp. paratuberculosis
cugcacccaggucaugg

SEQ ID NO: 2897555 - RNA, 13 nt, Mycobacterium avium subsp. paratuberculosis
cugcacccgaacg

SEQ ID NO: 2897556 - RNA, 12 nt, Mycobacterium avium subsp. paratuberculosis
cugcacccgcuc

SEQ ID NO: 2897557 - RNA, 17 nt, Mycobacterium avium subsp. paratuberculosis
cugcacccgggucaggu

SEQ ID NO: 2897558 - RNA, 20 nt, Mycobacterium avium subsp. paratuberculosis
cugcacccucugccacggcg

SEQ ID NO: 2897559 - RNA, 21 nt, Mycobacterium avium subsp. paratuberculosis
cugcacccucugccacggcgg

SEQ ID NO: 2897560 - RNA, 22 nt, Mycobacterium avium subsp. paratuberculosis
cugcacccucugccacggcgga

SEQ ID NO: 2897561 - RNA, 20 nt, Mycobacterium avium subsp. paratuberculosis
cugcaccgacuccuugggca

SEQ ID NO: 2897562 - RNA, 18 nt, Mycobacterium avium subsp. paratuberculosis
cugcaccgacugcggcgc

SEQ ID NO: 2897563 - RNA, 15 nt, Mycobacterium avium subsp. paratuberculosis
cugcaccggcgacgg

SEQ ID NO: 2897564 - RNA, 18 nt, Mycobacterium avium subsp. paratuberculosis
cugcaccggcgacggcgg

SEQ ID NO: 2897565 - RNA, 16 nt, Mycobacterium avium subsp. paratuberculosis
cugcaccggggccggc

SEQ ID NO: 2897566 - RNA, 23 nt, Mycobacterium avium subsp. paratuberculosis
cugcaccggguacaccggcucgc

SEQ ID NO: 2897567 - RNA, 17 nt, Mycobacterium avium subsp. paratuberculosis
cugcaccguuuccggug

SEQ ID NO: 2897568 - RNA, 14 nt, Mycobacterium avium subsp. paratuberculosis
cugcaccugcggca

SEQ ID NO: 2897569 - RNA, 14 nt, Mycobacterium avium subsp. paratuberculosis
cugcaccuggguga

SEQ ID NO: 2897570 - RNA, 17 nt, Mycobacterium avium subsp. paratuberculosis
cugcaccuugcccgucg

SEQ ID NO: 2897571 - RNA, 20 nt, Mycobacterium avium subsp. paratuberculosis
cugcacgaaauaaccgcgcg

SEQ ID NO: 2897572 - RNA, 22 nt, Mycobacterium avium subsp. paratuberculosis
cugcacgaagucgaccgcggcu

SEQ ID NO: 2897573 - RNA, 15 nt, Mycobacterium avium subsp. paratuberculosis
cugcacgacgaccgc

SEQ ID NO: 2897574 - RNA, 17 nt, Mycobacterium avium subsp. paratuberculosis
cugcacgacgaccgcga

SEQ ID NO: 2897575 - RNA, 14 nt, Mycobacterium avium subsp. paratuberculosis
cugcacgaugccga

SEQ ID NO: 2897576 - RNA, 16 nt, Mycobacterium avium subsp. paratuberculosis
cugcacgaugccgacc

SEQ ID NO: 2897577 - RNA, 17 nt, Mycobacterium avium subsp. paratuberculosis
cugcacgaugccgacca

SEQ ID NO: 2897578 - RNA, 19 nt, Mycobacterium avium subsp. paratuberculosis
cugcacgaugccgaccaac

SEQ ID NO: 2897579 - RNA, 23 nt, Mycobacterium avium subsp. paratuberculosis
cugcacgaugccgaccaacaccc

SEQ ID NO: 2897580 - RNA, 16 nt, Mycobacterium avium subsp. paratuberculosis
cugcacgcaggccucu

SEQ ID NO: 2897581 - RNA, 19 nt, Mycobacterium avium subsp. paratuberculosis
cugcacgcguugcagcgcc

SEQ ID NO: 2897582 - RNA, 20 nt, Mycobacterium avium subsp. paratuberculosis
cugcacgcguugcagcgccg

SEQ ID NO: 2897583 - RNA, 22 nt, Mycobacterium avium subsp. paratuberculosis
cugcacgcugcgcacccggucc

SEQ ID NO: 2897584 - RNA, 13 nt, Mycobacterium avium subsp. paratuberculosis
cugcacgcuguug

SEQ ID NO: 2897585 - RNA, 15 nt, Mycobacterium avium subsp. paratuberculosis
cugcacggccucggu

SEQ ID NO: 2897586 - RNA, 19 nt, Mycobacterium avium subsp. paratuberculosis
cugcacggccucggucacg

SEQ ID NO: 2897587 - RNA, 15 nt, Mycobacterium avium subsp. paratuberculosis
cugcacggugcgccg

SEQ ID NO: 2897588 - RNA, 23 nt, Mycobacterium avium subsp. paratuberculosis
cugcacggugcgccggcagcggc

SEQ ID NO: 2897589 - RNA, 15 nt, Mycobacterium avium subsp. paratuberculosis
cugcacgucacgggc

SEQ ID NO: 2897590 - RNA, 13 nt, Mycobacterium avium subsp. paratuberculosis
cugcacguccgcc

SEQ ID NO: 2897591 - RNA, 20 nt, Mycobacterium avium subsp. paratuberculosis
cugcacguccucgucggucc

SEQ ID NO: 2897592 - RNA, 19 nt, Mycobacterium avium subsp. paratuberculosis
cugcacgucgccggcgacc

SEQ ID NO: 2897593 - RNA, 20 nt, Mycobacterium avium subsp. paratuberculosis
cugcacgucgccggcgaccg

SEQ ID NO: 2897594 - RNA, 13 nt, Mycobacterium avium subsp. paratuberculosis
cugcacgucggcg

SEQ ID NO: 2897595 - RNA, 23 nt, Mycobacterium avium subsp. paratuberculosis
cugcacgucggcgcgcaggcugg

SEQ ID NO: 2897596 - RNA, 14 nt, Mycobacterium avium subsp. paratuberculosis
cugcacgucggcgg

SEQ ID NO: 2897597 - RNA, 15 nt, Mycobacterium avium subsp. paratuberculosis
cugcacgucggcggc

SEQ ID NO: 2897598 - RNA, 16 nt, Mycobacterium avium subsp. paratuberculosis
cugcacgucggcggcc

SEQ ID NO: 2897599 - RNA, 19 nt, Mycobacterium avium subsp. paratuberculosis
cugcacucagagcagcgcc

SEQ ID NO: 2897600 - RNA, 14 nt, Mycobacterium avium subsp. paratuberculosis
cugcagaccgaacg

SEQ ID NO: 2897601 - RNA, 14 nt, Mycobacterium avium subsp. paratuberculosis
cugcagagcgguga

SEQ ID NO: 2897602 - RNA, 16 nt, Mycobacterium avium subsp. paratuberculosis
cugcagagcggugaca

SEQ ID NO: 2897603 - RNA, 17 nt, Mycobacterium avium subsp. paratuberculosis
cugcagauccgcucgcc

SEQ ID NO: 2897604 - RNA, 18 nt, Mycobacterium avium subsp. paratuberculosis
cugcagauccgcucgccg

SEQ ID NO: 2897605 - RNA, 18 nt, Mycobacterium avium subsp. paratuberculosis
cugcagcaacucgcgcuc

SEQ ID NO: 2897606 - RNA, 15 nt, Mycobacterium avium subsp. paratuberculosis
cugcagcaccaggcc

SEQ ID NO: 2897607 - RNA, 18 nt, Mycobacterium avium subsp. paratuberculosis
cugcagcaccaggcccuc

SEQ ID NO: 2897608 - RNA, 21 nt, Mycobacterium avium subsp. paratuberculosis
cugcagcaccgaaccggcggg

SEQ ID NO: 2897609 - RNA, 13 nt, Mycobacterium avium subsp. paratuberculosis
cugcagcagaugc

SEQ ID NO: 2897610 - RNA, 15 nt, Mycobacterium avium subsp. paratuberculosis
cugcagcagcccgau

SEQ ID NO: 2897611 - RNA, 12 nt, Mycobacterium avium subsp. paratuberculosis
cugcagcagccg

SEQ ID NO: 2897612 - RNA, 16 nt, Mycobacterium avium subsp. paratuberculosis
cugcagcagccgcugc

SEQ ID NO: 2897613 - RNA, 18 nt, Mycobacterium avium subsp. paratuberculosis
cugcagcagccggaccca

SEQ ID NO: 2897614 - RNA, 23 nt, Mycobacterium avium subsp. paratuberculosis
cugcagcagcgacuugaccagca

SEQ ID NO: 2897615 - RNA, 22 nt, Mycobacterium avium subsp. paratuberculosis
cugcagcagucccucgaucagc

SEQ ID NO: 2897616 - RNA, 20 nt, Mycobacterium avium subsp. paratuberculosis
cugcagcauccagguggcgc

SEQ ID NO: 2897617 - RNA, 23 nt, Mycobacterium avium subsp. paratuberculosis
cugcagcccgaucucgcggucga

SEQ ID NO: 2897618 - RNA, 15 nt, Mycobacterium avium subsp. paratuberculosis
cugcagccgccgcgc

SEQ ID NO: 2897619 - RNA, 15 nt, Mycobacterium avium subsp. paratuberculosis
cugcagccggccggc

SEQ ID NO: 2897620 - RNA, 16 nt, Mycobacterium avium subsp. paratuberculosis
cugcagccggccggcg

SEQ ID NO: 2897621 - RNA, 18 nt, Mycobacterium avium subsp. paratuberculosis
cugcagccggccggcgga

SEQ ID NO: 2897622 - RNA, 12 nt, Mycobacterium avium subsp. paratuberculosis
cugcagccgggc

SEQ ID NO: 2897623 - RNA, 14 nt, Mycobacterium avium subsp. paratuberculosis
cugcagccgggcgg

SEQ ID NO: 2897624 - RNA, 15 nt, Mycobacterium avium subsp. paratuberculosis
cugcagccgggcggc

SEQ ID NO: 2897625 - RNA, 19 nt, Mycobacterium avium subsp. paratuberculosis
cugcagccgggcggcggcc

SEQ ID NO: 2897626 - RNA, 20 nt, Mycobacterium avium subsp. paratuberculosis
cugcagccgggcggcggccu

SEQ ID NO: 2897627 - RNA, 20 nt, Mycobacterium avium subsp. paratuberculosis
cugcagccggguggcccgcc

SEQ ID NO: 2897628 - RNA, 13 nt, Mycobacterium avium subsp. paratuberculosis
cugcagccggucc

SEQ ID NO: 2897629 - RNA, 14 nt, Mycobacterium avium subsp. paratuberculosis
cugcagccgguccg

SEQ ID NO: 2897630 - RNA, 19 nt, Mycobacterium avium subsp. paratuberculosis
cugcagcgacggaucggcc

SEQ ID NO: 2897631 - RNA, 13 nt, Mycobacterium avium subsp. paratuberculosis
cugcagcgacugg

SEQ ID NO: 2897632 - RNA, 14 nt, Mycobacterium avium subsp. paratuberculosis
cugcagcgacugga

SEQ ID NO: 2897633 - RNA, 20 nt, Mycobacterium avium subsp. paratuberculosis
cugcagcgacuggaccacca

SEQ ID NO: 2897634 - RNA, 20 nt, Mycobacterium avium subsp. paratuberculosis
cugcagcgagaccucccggc

SEQ ID NO: 2897635 - RNA, 17 nt, Mycobacterium avium subsp. paratuberculosis
cugcagcgcccgggcca

SEQ ID NO: 2897636 - RNA, 20 nt, Mycobacterium avium subsp. paratuberculosis
cugcagcgcccgggccagga

SEQ ID NO: 2897637 - RNA, 15 nt, Mycobacterium avium subsp. paratuberculosis
cugcagcgccgaggc

SEQ ID NO: 2897638 - RNA, 19 nt, Mycobacterium avium subsp. paratuberculosis
cugcagcgccgaggccagc

SEQ ID NO: 2897639 - RNA, 20 nt, Mycobacterium avium subsp. paratuberculosis
cugcagcgccgaggccagca

SEQ ID NO: 2897640 - RNA, 15 nt, Mycobacterium avium subsp. paratuberculosis
cugcagcgcgaggcg

SEQ ID NO: 2897641 - RNA, 17 nt, Mycobacterium avium subsp. paratuberculosis
cugcagcgcgaggcgca

SEQ ID NO: 2897642 - RNA, 14 nt, Mycobacterium avium subsp. paratuberculosis
cugcagcgcggcga

SEQ ID NO: 2897643 - RNA, 23 nt, Mycobacterium avium subsp. paratuberculosis
cugcagcgcggcgaucagcugcu

SEQ ID NO: 2897644 - RNA, 20 nt, Mycobacterium avium subsp. paratuberculosis
cugcagcgcggucaucguca

SEQ ID NO: 2897645 - RNA, 13 nt, Mycobacterium avium subsp. paratuberculosis
cugcagcgcggug

SEQ ID NO: 2897646 - RNA, 14 nt, Mycobacterium avium subsp. paratuberculosis
cugcagcggcggcc

SEQ ID NO: 2897647 - RNA, 21 nt, Mycobacterium avium subsp. paratuberculosis
cugcagcggguuuggccgcgg

SEQ ID NO: 2897648 - RNA, 19 nt, Mycobacterium avium subsp. paratuberculosis
cugcagcuccucggcggcc

SEQ ID NO: 2897649 - RNA, 14 nt, Mycobacterium avium subsp. paratuberculosis
cugcagcucgccgg

SEQ ID NO: 2897650 - RNA, 22 nt, Mycobacterium avium subsp. paratuberculosis
cugcagcucgccggcgcgcagc

SEQ ID NO: 2897651 - RNA, 17 nt, Mycobacterium avium subsp. paratuberculosis
cugcagcucgcugagcg

SEQ ID NO: 2897652 - RNA, 22 nt, Mycobacterium avium subsp. paratuberculosis
cugcagcucgcugagcgggacg

SEQ ID NO: 2897653 - RNA, 20 nt, Mycobacterium avium subsp. paratuberculosis
cugcagcucggugcgcaccc

SEQ ID NO: 2897654 - RNA, 14 nt, Mycobacterium avium subsp. paratuberculosis
cugcagcugcucgu

SEQ ID NO: 2897655 - RNA, 18 nt, Mycobacterium avium subsp. paratuberculosis
cugcagcuucgugucacc

SEQ ID NO: 2897656 - RNA, 22 nt, Mycobacterium avium subsp. paratuberculosis
cugcaggaacgccuugaccgcc

SEQ ID NO: 2897657 - RNA, 17 nt, Mycobacterium avium subsp. paratuberculosis
cugcaggcaggccggca

SEQ ID NO: 2897658 - RNA, 19 nt, Mycobacterium avium subsp. paratuberculosis
cugcaggccccagugggug

SEQ ID NO: 2897659 - RNA, 22 nt, Mycobacterium avium subsp. paratuberculosis
cugcaggcccggguagcgcagc

SEQ ID NO: 2897660 - RNA, 16 nt, Mycobacterium avium subsp. paratuberculosis
cugcaggccgagccgc

SEQ ID NO: 2897661 - RNA, 18 nt, Mycobacterium avium subsp. paratuberculosis
cugcaggccgagccgccg

SEQ ID NO: 2897662 - RNA, 17 nt, Mycobacterium avium subsp. paratuberculosis
cugcaggcuggucuggu

SEQ ID NO: 2897663 - RNA, 17 nt, Mycobacterium avium subsp. paratuberculosis
cugcaggguuuccucga

SEQ ID NO: 2897664 - RNA, 21 nt, Mycobacterium avium subsp. paratuberculosis
cugcagguagguggccagccg

SEQ ID NO: 2897665 - RNA, 23 nt, Mycobacterium avium subsp. paratuberculosis
cugcagguagguggccagccggg

SEQ ID NO: 2897666 - RNA, 21 nt, Mycobacterium avium subsp. paratuberculosis
cugcaggucguaguaggcgcc

SEQ ID NO: 2897667 - RNA, 21 nt, Mycobacterium avium subsp. paratuberculosis
cugcagguggcccacacgcga

SEQ ID NO: 2897668 - RNA, 19 nt, Mycobacterium avium subsp. paratuberculosis
cugcagguugauccggauc

SEQ ID NO: 2897669 - RNA, 21 nt, Mycobacterium avium subsp. paratuberculosis
cugcagguugauccggauccg

SEQ ID NO: 2897670 - RNA, 15 nt, Mycobacterium avium subsp. paratuberculosis
cugcaguucgaucac

SEQ ID NO: 2897671 - RNA, 19 nt, Mycobacterium avium subsp. paratuberculosis
cugcaucaaaaacgauccc

SEQ ID NO: 2897672 - RNA, 22 nt, Mycobacterium avium subsp. paratuberculosis
cugcaucaugccgcccaucacc

SEQ ID NO: 2897673 - RNA, 23 nt, Mycobacterium avium subsp. paratuberculosis
cugcaucaugccgcccaucaccc

SEQ ID NO: 2897674 - RNA, 20 nt, Mycobacterium avium subsp. paratuberculosis
cugcauccgcagcaccaggg

SEQ ID NO: 2897675 - RNA, 14 nt, Mycobacterium avium subsp. paratuberculosis
cugcaucgccagca

SEQ ID NO: 2897676 - RNA, 16 nt, Mycobacterium avium subsp. paratuberculosis
cugcaucgccagcaca

SEQ ID NO: 2897677 - RNA, 14 nt, Mycobacterium avium subsp. paratuberculosis
cugcaucuccagcc

SEQ ID NO: 2897678 - RNA, 17 nt, Mycobacterium avium subsp. paratuberculosis
cugcaucuccagccgcg

SEQ ID NO: 2897679 - RNA, 21 nt, Mycobacterium avium subsp. paratuberculosis
cugcaucucgacccgggccag

SEQ ID NO: 2897680 - RNA, 19 nt, Mycobacterium avium subsp. paratuberculosis
cugcaucucgaccuggguc

SEQ ID NO: 2897681 - RNA, 14 nt, Mycobacterium avium subsp. paratuberculosis
cugcaugccgggca

SEQ ID NO: 2897682 - RNA, 22 nt, Mycobacterium avium subsp. paratuberculosis
cugcaugcgcugcuuagccccu

SEQ ID NO: 2897683 - RNA, 20 nt, Mycobacterium avium subsp. paratuberculosis
cugcauuucggacggcgacg

SEQ ID NO: 2897684 - RNA, 15 nt, Mycobacterium avium subsp. paratuberculosis
cugccaagacguccg

SEQ ID NO: 2897685 - RNA, 22 nt, Mycobacterium avium subsp. paratuberculosis
cugccaagacguccgcgucggc

SEQ ID NO: 2897686 - RNA, 21 nt, Mycobacterium avium subsp. paratuberculosis
cugccaagauugggccacaga

SEQ ID NO: 2897687 - RNA, 16 nt, Mycobacterium avium subsp. paratuberculosis
cugccaaggugcggug

SEQ ID NO: 2897688 - RNA, 17 nt, Mycobacterium avium subsp. paratuberculosis
cugccaaggugcgguga

SEQ ID NO: 2897689 - RNA, 14 nt, Mycobacterium avium subsp. paratuberculosis
cugccacagcgaca

SEQ ID NO: 2897690 - RNA, 13 nt, Mycobacterium avium subsp. paratuberculosis
cugccaccgcgaa

SEQ ID NO: 2897691 - RNA, 15 nt, Mycobacterium avium subsp. paratuberculosis
cugccacgcccaccg

SEQ ID NO: 2897692 - RNA, 18 nt, Mycobacterium avium subsp. paratuberculosis
cugccacgcccaccggug

SEQ ID NO: 2897693 - RNA, 15 nt, Mycobacterium avium subsp. paratuberculosis
cugccacguacaccg

SEQ ID NO: 2897694 - RNA, 18 nt, Mycobacterium avium subsp. paratuberculosis
cugccacguacaccggga

SEQ ID NO: 2897695 - RNA, 16 nt, Mycobacterium avium subsp. paratuberculosis
cugccagaacggcggc

SEQ ID NO: 2897696 - RNA, 18 nt, Mycobacterium avium subsp. paratuberculosis
cugccagaagaucugccg

SEQ ID NO: 2897697 - RNA, 15 nt, Mycobacterium avium subsp. paratuberculosis
cugccagaucuguau

SEQ ID NO: 2897698 - RNA, 21 nt, Mycobacterium avium subsp. paratuberculosis
cugccagcgaauuguucugcu

SEQ ID NO: 2897699 - RNA, 12 nt, Mycobacterium avium subsp. paratuberculosis
cugccagcggcg

SEQ ID NO: 2897700 - RNA, 23 nt, Mycobacterium avium subsp. paratuberculosis
cugccaggcgguggccgaaccgc

SEQ ID NO: 2897701 - RNA, 12 nt, Mycobacterium avium subsp. paratuberculosis
cugccagggccg

SEQ ID NO: 2897702 - RNA, 21 nt, Mycobacterium avium subsp. paratuberculosis
cugccagggccgggcgugccc

SEQ ID NO: 2897703 - RNA, 19 nt, Mycobacterium avium subsp. paratuberculosis
cugccagggggaguagucg

SEQ ID NO: 2897704 - RNA, 22 nt, Mycobacterium avium subsp. paratuberculosis
cugccagggggaguagucggcg

SEQ ID NO: 2897705 - RNA, 17 nt, Mycobacterium avium subsp. paratuberculosis
cugccaguugucgaucu

SEQ ID NO: 2897706 - RNA, 22 nt, Mycobacterium avium subsp. paratuberculosis
cugccaguugucgaucuccucg

SEQ ID NO: 2897707 - RNA, 16 nt, Mycobacterium avium subsp. paratuberculosis
cugcccaacgucgacu

SEQ ID NO: 2897708 - RNA, 23 nt, Mycobacterium avium subsp. paratuberculosis
cugcccaaugaucugggccgcca

SEQ ID NO: 2897709 - RNA, 13 nt, Mycobacterium avium subsp. paratuberculosis
cugcccaccacca

SEQ ID NO: 2897710 - RNA, 16 nt, Mycobacterium avium subsp. paratuberculosis
cugcccaccagcaggu

SEQ ID NO: 2897711 - RNA, 19 nt, Mycobacterium avium subsp. paratuberculosis
cugcccaccagcaggucga

SEQ ID NO: 2897712 - RNA, 16 nt, Mycobacterium avium subsp. paratuberculosis
cugcccagauacgccg

SEQ ID NO: 2897713 - RNA, 16 nt, Mycobacterium avium subsp. paratuberculosis
cugcccagccaucugc

SEQ ID NO: 2897714 - RNA, 13 nt, Mycobacterium avium subsp. paratuberculosis
cugcccagcgcgg

SEQ ID NO: 2897715 - RNA, 17 nt, Mycobacterium avium subsp. paratuberculosis
cugcccagcgcggucgc

SEQ ID NO: 2897716 - RNA, 22 nt, Mycobacterium avium subsp. paratuberculosis
cugcccagcgcggucgccacca

SEQ ID NO: 2897717 - RNA, 22 nt, Mycobacterium avium subsp. paratuberculosis
cugcccagcggcacgggcaccg

SEQ ID NO: 2897718 - RNA, 18 nt, Mycobacterium avium subsp. paratuberculosis
cugcccaggaucaccggg

SEQ ID NO: 2897719 - RNA, 19 nt, Mycobacterium avium subsp. paratuberculosis
cugcccaggaucaccggga

SEQ ID NO: 2897720 - RNA, 19 nt, Mycobacterium avium subsp. paratuberculosis
cugcccagggcguuugcca

SEQ ID NO: 2897721 - RNA, 16 nt, Mycobacterium avium subsp. paratuberculosis
cugcccagguccaccg

SEQ ID NO: 2897722 - RNA, 20 nt, Mycobacterium avium subsp. paratuberculosis
cugccccagccacagccgca

SEQ ID NO: 2897723 - RNA, 15 nt, Mycobacterium avium subsp. paratuberculosis
cugccccagggacca

SEQ ID NO: 2897724 - RNA, 21 nt, Mycobacterium avium subsp. paratuberculosis
cugccccagggaccaguggug

SEQ ID NO: 2897725 - RNA, 21 nt, Mycobacterium avium subsp. paratuberculosis
cugccccaucuugaccagggu

SEQ ID NO: 2897726 - RNA, 23 nt, Mycobacterium avium subsp. paratuberculosis
cugccccccuugagccgguccga

SEQ ID NO: 2897727 - RNA, 13 nt, Mycobacterium avium subsp. paratuberculosis
cugccccggcgag

SEQ ID NO: 2897728 - RNA, 20 nt, Mycobacterium avium subsp. paratuberculosis
cugccccggcgaggccaggc

SEQ ID NO: 2897729 - RNA, 16 nt, Mycobacterium avium subsp. paratuberculosis
cugccccuucgcgaca

SEQ ID NO: 2897730 - RNA, 19 nt, Mycobacterium avium subsp. paratuberculosis
cugcccgacccgcaccacc

SEQ ID NO: 2897731 - RNA, 20 nt, Mycobacterium avium subsp. paratuberculosis
cugcccgacccgcaccaccg

SEQ ID NO: 2897732 - RNA, 21 nt, Mycobacterium avium subsp. paratuberculosis
cugcccgacccgcaccaccgc

SEQ ID NO: 2897733 - RNA, 23 nt, Mycobacterium avium subsp. paratuberculosis
cugcccgacccgcaccaccgccc

SEQ ID NO: 2897734 - RNA, 24 nt, Mycobacterium avium subsp. paratuberculosis
cugcccgacccgcaccaccgcccg

SEQ ID NO: 2897735 - RNA, 15 nt, Mycobacterium avium subsp. paratuberculosis
cugcccgacccgccu

SEQ ID NO: 2897736 - RNA, 17 nt, Mycobacterium avium subsp. paratuberculosis
cugcccgacccgccuac

SEQ ID NO: 2897737 - RNA, 12 nt, Mycobacterium avium subsp. paratuberculosis
cugcccgaccgc

SEQ ID NO: 2897738 - RNA, 16 nt, Mycobacterium avium subsp. paratuberculosis
cugcccgaccgcgccg

SEQ ID NO: 2897739 - RNA, 19 nt, Mycobacterium avium subsp. paratuberculosis
cugcccgaccgcgccgaac

SEQ ID NO: 2897740 - RNA, 20 nt, Mycobacterium avium subsp. paratuberculosis
cugcccgaccgcgccgaaca

SEQ ID NO: 2897741 - RNA, 12 nt, Mycobacterium avium subsp. paratuberculosis
cugcccgaccug

SEQ ID NO: 2897742 - RNA, 13 nt, Mycobacterium avium subsp. paratuberculosis
cugcccgaccuga

SEQ ID NO: 2897743 - RNA, 14 nt, Mycobacterium avium subsp. paratuberculosis
cugcccgcacuggu

SEQ ID NO: 2897744 - RNA, 14 nt, Mycobacterium avium subsp. paratuberculosis
cugcccgccgccga

SEQ ID NO: 2897745 - RNA, 18 nt, Mycobacterium avium subsp. paratuberculosis
cugcccgccgccgaugcu

SEQ ID NO: 2897746 - RNA, 17 nt, Mycobacterium avium subsp. paratuberculosis
cugcccgccgcggccgc

SEQ ID NO: 2897747 - RNA, 22 nt, Mycobacterium avium subsp. paratuberculosis
cugcccgccgcggccgcuggcg

SEQ ID NO: 2897748 - RNA, 14 nt, Mycobacterium avium subsp. paratuberculosis
cugcccgccgcggu

SEQ ID NO: 2897749 - RNA, 15 nt, Mycobacterium avium subsp. paratuberculosis
cugcccgccgcggug

SEQ ID NO: 2897750 - RNA, 15 nt, Mycobacterium avium subsp. paratuberculosis
cugcccgccgcguac

SEQ ID NO: 2897751 - RNA, 20 nt, Mycobacterium avium subsp. paratuberculosis
cugcccgccgcguacagcag

SEQ ID NO: 2897752 - RNA, 15 nt, Mycobacterium avium subsp. paratuberculosis
cugcccgcgacggcg

SEQ ID NO: 2897753 - RNA, 16 nt, Mycobacterium avium subsp. paratuberculosis
cugcccgcgacggcga

SEQ ID NO: 2897754 - RNA, 17 nt, Mycobacterium avium subsp. paratuberculosis
cugcccgcgacggcgag

SEQ ID NO: 2897755 - RNA, 14 nt, Mycobacterium avium subsp. paratuberculosis
cugcccgcgacugu

SEQ ID NO: 2897756 - RNA, 20 nt, Mycobacterium avium subsp. paratuberculosis
cugcccgcgacugucggcgc

SEQ ID NO: 2897757 - RNA, 20 nt, Mycobacterium avium subsp. paratuberculosis
cugcccgcgcaggccccggg

SEQ ID NO: 2897758 - RNA, 13 nt, Mycobacterium avium subsp. paratuberculosis
cugcccgcggccg

SEQ ID NO: 2897759 - RNA, 14 nt, Mycobacterium avium subsp. paratuberculosis
cugcccgcggccgc

SEQ ID NO: 2897760 - RNA, 16 nt, Mycobacterium avium subsp. paratuberculosis
cugcccgcggccgccg

SEQ ID NO: 2897761 - RNA, 19 nt, Mycobacterium avium subsp. paratuberculosis
cugcccgcggguggccuuc

SEQ ID NO: 2897762 - RNA, 22 nt, Mycobacterium avium subsp. paratuberculosis
cugcccggagaaaccgucggcc

SEQ ID NO: 2897763 - RNA, 18 nt, Mycobacterium avium subsp. paratuberculosis
cugcccggaguccggcuc

SEQ ID NO: 2897764 - RNA, 13 nt, Mycobacterium avium subsp. paratuberculosis
cugcccggccagc

SEQ ID NO: 2897765 - RNA, 17 nt, Mycobacterium avium subsp. paratuberculosis
cugcccggccagcaggu

SEQ ID NO: 2897766 - RNA, 13 nt, Mycobacterium avium subsp. paratuberculosis
cugcccggcccgc

SEQ ID NO: 2897767 - RNA, 15 nt, Mycobacterium avium subsp. paratuberculosis
cugcccggcccgccg

SEQ ID NO: 2897768 - RNA, 17 nt, Mycobacterium avium subsp. paratuberculosis
cugcccggcccgccgcu

SEQ ID NO: 2897769 - RNA, 19 nt, Mycobacterium avium subsp. paratuberculosis
cugcccggcccgccgcugc

SEQ ID NO: 2897770 - RNA, 18 nt, Mycobacterium avium subsp. paratuberculosis
cugcccggcgccggucgu

SEQ ID NO: 2897771 - RNA, 14 nt, Mycobacterium avium subsp. paratuberculosis
cugcccggcgcgga

SEQ ID NO: 2897772 - RNA, 12 nt, Mycobacterium avium subsp. paratuberculosis
cugcccggcgcu

SEQ ID NO: 2897773 - RNA, 13 nt, Mycobacterium avium subsp. paratuberculosis
cugcccggcgugu

SEQ ID NO: 2897774 - RNA, 15 nt, Mycobacterium avium subsp. paratuberculosis
cugcccgggcauccc

SEQ ID NO: 2897775 - RNA, 13 nt, Mycobacterium avium subsp. paratuberculosis
cugcccgggcccg

SEQ ID NO: 2897776 - RNA, 19 nt, Mycobacterium avium subsp. paratuberculosis
cugcccgggcccgauggcg

SEQ ID NO: 2897777 - RNA, 15 nt, Mycobacterium avium subsp. paratuberculosis
cugcccgggcgccga

SEQ ID NO: 2897778 - RNA, 18 nt, Mycobacterium avium subsp. paratuberculosis
cugcccgggcgccgagaa

SEQ ID NO: 2897779 - RNA, 18 nt, Mycobacterium avium subsp. paratuberculosis
cugcccggucugcggccg

SEQ ID NO: 2897780 - RNA, 19 nt, Mycobacterium avium subsp. paratuberculosis
cugcccggucugcggccgc

SEQ ID NO: 2897781 - RNA, 18 nt, Mycobacterium avium subsp. paratuberculosis
cugcccguagucggcggc

SEQ ID NO: 2897782 - RNA, 23 nt, Mycobacterium avium subsp. paratuberculosis
cugcccgucgaccuccucgaccc

SEQ ID NO: 2897783 - RNA, 15 nt, Mycobacterium avium subsp. paratuberculosis
cugcccgucgggcgc

SEQ ID NO: 2897784 - RNA, 18 nt, Mycobacterium avium subsp. paratuberculosis
cugcccgucgggcgcggc

SEQ ID NO: 2897785 - RNA, 14 nt, Mycobacterium avium subsp. paratuberculosis
cugcccgugccgca

SEQ ID NO: 2897786 - RNA, 23 nt, Mycobacterium avium subsp. paratuberculosis
cugcccgugccgcaccugguuga

SEQ ID NO: 2897787 - RNA, 14 nt, Mycobacterium avium subsp. paratuberculosis
cugcccucuuccuc

SEQ ID NO: 2897788 - RNA, 15 nt, Mycobacterium avium subsp. paratuberculosis
cugcccucuuccucg

SEQ ID NO: 2897789 - RNA, 16 nt, Mycobacterium avium subsp. paratuberculosis
cugcccugaagcuggg

SEQ ID NO: 2897790 - RNA, 18 nt, Mycobacterium avium subsp. paratuberculosis
cugcccugaagcugggcg

SEQ ID NO: 2897791 - RNA, 13 nt, Mycobacterium avium subsp. paratuberculosis
cugcccugggagg

SEQ ID NO: 2897792 - RNA, 17 nt, Mycobacterium avium subsp. paratuberculosis
cugccgaacaucagccg

SEQ ID NO: 2897793 - RNA, 12 nt, Mycobacterium avium subsp. paratuberculosis
cugccgaccagg

SEQ ID NO: 2897794 - RNA, 14 nt, Mycobacterium avium subsp. paratuberculosis
cugccgaccaggaa

SEQ ID NO: 2897795 - RNA, 19 nt, Mycobacterium avium subsp. paratuberculosis
cugccgaccucgauggcga

SEQ ID NO: 2897796 - RNA, 15 nt, Mycobacterium avium subsp. paratuberculosis
cugccgaccugcgcg

SEQ ID NO: 2897797 - RNA, 17 nt, Mycobacterium avium subsp. paratuberculosis
cugccgaccugcgcgac

SEQ ID NO: 2897798 - RNA, 15 nt, Mycobacterium avium subsp. paratuberculosis
cugccgacgguccca

SEQ ID NO: 2897799 - RNA, 16 nt, Mycobacterium avium subsp. paratuberculosis
cugccgacggucccac

SEQ ID NO: 2897800 - RNA, 19 nt, Mycobacterium avium subsp. paratuberculosis
cugccgagcaccucgucgc

SEQ ID NO: 2897801 - RNA, 19 nt, Mycobacterium avium subsp. paratuberculosis
cugccgagcaucagcugcc

SEQ ID NO: 2897802 - RNA, 21 nt, Mycobacterium avium subsp. paratuberculosis
cugccgagcaucagcugccgu

SEQ ID NO: 2897803 - RNA, 18 nt, Mycobacterium avium subsp. paratuberculosis
cugccgagguacgcgcug

SEQ ID NO: 2897804 - RNA, 15 nt, Mycobacterium avium subsp. paratuberculosis
cugccgaugcugagc

SEQ ID NO: 2897805 - RNA, 16 nt, Mycobacterium avium subsp. paratuberculosis
cugccgaugcugagcg

SEQ ID NO: 2897806 - RNA, 22 nt, Mycobacterium avium subsp. paratuberculosis
cugccgcaacgggccgcagccg

SEQ ID NO: 2897807 - RNA, 12 nt, Mycobacterium avium subsp. paratuberculosis
cugccgccaccg

SEQ ID NO: 2897808 - RNA, 13 nt, Mycobacterium avium subsp. paratuberculosis
cugccgccaccgc

SEQ ID NO: 2897809 - RNA, 16 nt, Mycobacterium avium subsp. paratuberculosis
cugccgcccccgcugg

SEQ ID NO: 2897810 - RNA, 18 nt, Mycobacterium avium subsp. paratuberculosis
cugccgcccccgcuggcg

SEQ ID NO: 2897811 - RNA, 17 nt, Mycobacterium avium subsp. paratuberculosis
cugccgccgcagcagcc

SEQ ID NO: 2897812 - RNA, 19 nt, Mycobacterium avium subsp. paratuberculosis
cugccgccgcccaggccga

SEQ ID NO: 2897813 - RNA, 14 nt, Mycobacterium avium subsp. paratuberculosis
cugccgccgccgcu

SEQ ID NO: 2897814 - RNA, 19 nt, Mycobacterium avium subsp. paratuberculosis
cugccgccgccgcugucga

SEQ ID NO: 2897815 - RNA, 14 nt, Mycobacterium avium subsp. paratuberculosis
cugccgccggcgaa

SEQ ID NO: 2897816 - RNA, 16 nt, Mycobacterium avium subsp. paratuberculosis
cugccgcgacucggug

SEQ ID NO: 2897817 - RNA, 13 nt, Mycobacterium avium subsp. paratuberculosis
cugccgcgccccg

SEQ ID NO: 2897818 - RNA, 18 nt, Mycobacterium avium subsp. paratuberculosis
cugccgcgccccgagcag

SEQ ID NO: 2897819 - RNA, 23 nt, Mycobacterium avium subsp. paratuberculosis
cugccgcgccccgagcagcgggu

SEQ ID NO: 2897820 - RNA, 13 nt, Mycobacterium avium subsp. paratuberculosis
cugccgcgccgcc

SEQ ID NO: 2897821 - RNA, 14 nt, Mycobacterium avium subsp. paratuberculosis
cugccgcgcgccga

SEQ ID NO: 2897822 - RNA, 16 nt, Mycobacterium avium subsp. paratuberculosis
cugccgcgcgccgaca

SEQ ID NO: 2897823 - RNA, 17 nt, Mycobacterium avium subsp. paratuberculosis
cugccgcgcgccgacag

SEQ ID NO: 2897824 - RNA, 16 nt, Mycobacterium avium subsp. paratuberculosis
cugccggaacgagccg

SEQ ID NO: 2897825 - RNA, 13 nt, Mycobacterium avium subsp. paratuberculosis
cugccggacaccc

SEQ ID NO: 2897826 - RNA, 17 nt, Mycobacterium avium subsp. paratuberculosis
cugccggacaccccggc

SEQ ID NO: 2897827 - RNA, 20 nt, Mycobacterium avium subsp. paratuberculosis
cugccggaccucgaccagcc

SEQ ID NO: 2897828 - RNA, 21 nt, Mycobacterium avium subsp. paratuberculosis
cugccggaccucgaccagccg

SEQ ID NO: 2897829 - RNA, 22 nt, Mycobacterium avium subsp. paratuberculosis
cugccggaccucgaccagccgg

SEQ ID NO: 2897830 - RNA, 16 nt, Mycobacterium avium subsp. paratuberculosis
cugccggaugccgcgc

SEQ ID NO: 2897831 - RNA, 18 nt, Mycobacterium avium subsp. paratuberculosis
cugccggaugccgcgcgg

SEQ ID NO: 2897832 - RNA, 19 nt, Mycobacterium avium subsp. paratuberculosis
cugccggaugccgcgcggc

SEQ ID NO: 2897833 - RNA, 21 nt, Mycobacterium avium subsp. paratuberculosis
cugccggaugccgcgcggcgc

SEQ ID NO: 2897834 - RNA, 23 nt, Mycobacterium avium subsp. paratuberculosis
cugccggaugccgcgcggcgcca

SEQ ID NO: 2897835 - RNA, 18 nt, Mycobacterium avium subsp. paratuberculosis
cugccggcauaggccagc

SEQ ID NO: 2897836 - RNA, 19 nt, Mycobacterium avium subsp. paratuberculosis
cugccggcauaggccagca

SEQ ID NO: 2897837 - RNA, 21 nt, Mycobacterium avium subsp. paratuberculosis
cugccggcauaggccagcacc

SEQ ID NO: 2897838 - RNA, 14 nt, Mycobacterium avium subsp. paratuberculosis
cugccggccaaggc

SEQ ID NO: 2897839 - RNA, 16 nt, Mycobacterium avium subsp. paratuberculosis
cugccggccgccgcgc

SEQ ID NO: 2897840 - RNA, 14 nt, Mycobacterium avium subsp. paratuberculosis
cugccggccgccgu

SEQ ID NO: 2897841 - RNA, 23 nt, Mycobacterium avium subsp. paratuberculosis
cugccggccgccguaucccugcc

SEQ ID NO: 2897842 - RNA, 13 nt, Mycobacterium avium subsp. paratuberculosis
cugccggccggca

SEQ ID NO: 2897843 - RNA, 14 nt, Mycobacterium avium subsp. paratuberculosis
cugccggccggcag

SEQ ID NO: 2897844 - RNA, 15 nt, Mycobacterium avium subsp. paratuberculosis
cugccggccggcagc

SEQ ID NO: 2897845 - RNA, 16 nt, Mycobacterium avium subsp. paratuberculosis
cugccggccggcagcu

SEQ ID NO: 2897846 - RNA, 19 nt, Mycobacterium avium subsp. paratuberculosis
cugccggccggcagcugcc

SEQ ID NO: 2897847 - RNA, 18 nt, Mycobacterium avium subsp. paratuberculosis
cugccggccggggcggcg

SEQ ID NO: 2897848 - RNA, 12 nt, Mycobacterium avium subsp. paratuberculosis
cugccggccguu

SEQ ID NO: 2897849 - RNA, 15 nt, Mycobacterium avium subsp. paratuberculosis
cugccggcgaccagc

SEQ ID NO: 2897850 - RNA, 16 nt, Mycobacterium avium subsp. paratuberculosis
cugccggcgaccagcc

SEQ ID NO: 2897851 - RNA, 21 nt, Mycobacterium avium subsp. paratuberculosis
cugccggcgaccagccccucg

SEQ ID NO: 2897852 - RNA, 20 nt, Mycobacterium avium subsp. paratuberculosis
cugccggcgacgguggcgcc

SEQ ID NO: 2897853 - RNA, 14 nt, Mycobacterium avium subsp. paratuberculosis
cugccggcgccgga

SEQ ID NO: 2897854 - RNA, 21 nt, Mycobacterium avium subsp. paratuberculosis
cugccggcgcuucugcgccgg

SEQ ID NO: 2897855 - RNA, 12 nt, Mycobacterium avium subsp. paratuberculosis
cugccggcggcc

SEQ ID NO: 2897856 - RNA, 15 nt, Mycobacterium avium subsp. paratuberculosis
cugccggcggccgcc

SEQ ID NO: 2897857 - RNA, 18 nt, Mycobacterium avium subsp. paratuberculosis
cugccggcggccgccggc

SEQ ID NO: 2897858 - RNA, 19 nt, Mycobacterium avium subsp. paratuberculosis
cugccggcggccgccggca

SEQ ID NO: 2897859 - RNA, 20 nt, Mycobacterium avium subsp. paratuberculosis
cugccggcggccgccggcac

SEQ ID NO: 2897860 - RNA, 23 nt, Mycobacterium avium subsp. paratuberculosis
cugccggcggccgccggcaccgu

SEQ ID NO: 2897861 - RNA, 15 nt, Mycobacterium avium subsp. paratuberculosis
cugccgggccgcauc

SEQ ID NO: 2897862 - RNA, 20 nt, Mycobacterium avium subsp. paratuberculosis
cugccgggccgcauccagcg

SEQ ID NO: 2897863 - RNA, 14 nt, Mycobacterium avium subsp. paratuberculosis
cugccgggcgucga

SEQ ID NO: 2897864 - RNA, 15 nt, Mycobacterium avium subsp. paratuberculosis
cugccggggcgcagc

SEQ ID NO: 2897865 - RNA, 17 nt, Mycobacterium avium subsp. paratuberculosis
cugccggggcgcagcug

SEQ ID NO: 2897866 - RNA, 20 nt, Mycobacterium avium subsp. paratuberculosis
cugccggggcgcagcugcag

SEQ ID NO: 2897867 - RNA, 22 nt, Mycobacterium avium subsp. paratuberculosis
cugccggggcgcagcugcagcu

SEQ ID NO: 2897868 - RNA, 13 nt, Mycobacterium avium subsp. paratuberculosis
cugccggggugca

SEQ ID NO: 2897869 - RNA, 14 nt, Mycobacterium avium subsp. paratuberculosis
cugccggggugcag

SEQ ID NO: 2897870 - RNA, 22 nt, Mycobacterium avium subsp. paratuberculosis
cugccggggugcagcaccacga

SEQ ID NO: 2897871 - RNA, 14 nt, Mycobacterium avium subsp. paratuberculosis
cugccggucgaugu

SEQ ID NO: 2897872 - RNA, 19 nt, Mycobacterium avium subsp. paratuberculosis
cugccggucgaugucggcg

SEQ ID NO: 2897873 - RNA, 20 nt, Mycobacterium avium subsp. paratuberculosis
cugccggucgaugucggcga

SEQ ID NO: 2897874 - RNA, 16 nt, Mycobacterium avium subsp. paratuberculosis
cugccggugccgccgg

SEQ ID NO: 2897875 - RNA, 17 nt, Mycobacterium avium subsp. paratuberculosis
cugccggugccgccggc

SEQ ID NO: 2897876 - RNA, 16 nt, Mycobacterium avium subsp. paratuberculosis
cugccguagcgcuggg

SEQ ID NO: 2897877 - RNA, 18 nt, Mycobacterium avium subsp. paratuberculosis
cugccguagcgcugggug

SEQ ID NO: 2897878 - RNA, 20 nt, Mycobacterium avium subsp. paratuberculosis
cugccguagcgcugggugaa

SEQ ID NO: 2897879 - RNA, 15 nt, Mycobacterium avium subsp. paratuberculosis
cugccgucaccggcc

SEQ ID NO: 2897880 - RNA, 14 nt, Mycobacterium avium subsp. paratuberculosis
cugccguccggcgg

SEQ ID NO: 2897881 - RNA, 15 nt, Mycobacterium avium subsp. paratuberculosis
cugccguccggcggc

SEQ ID NO: 2897882 - RNA, 16 nt, Mycobacterium avium subsp. paratuberculosis
cugccguccggcggca

SEQ ID NO: 2897883 - RNA, 14 nt, Mycobacterium avium subsp. paratuberculosis
cugccguccggguc

SEQ ID NO: 2897884 - RNA, 21 nt, Mycobacterium avium subsp. paratuberculosis
cugccguccuucucgaaccgg

SEQ ID NO: 2897885 - RNA, 15 nt, Mycobacterium avium subsp. paratuberculosis
cugccgucgacgacc

SEQ ID NO: 2897886 - RNA, 13 nt, Mycobacterium avium subsp. paratuberculosis
cugccgucgguuu

SEQ ID NO: 2897887 - RNA, 14 nt, Mycobacterium avium subsp. paratuberculosis
cugccgugccgauu

SEQ ID NO: 2897888 - RNA, 14 nt, Mycobacterium avium subsp. paratuberculosis
cugccguucggcca

SEQ ID NO: 2897889 - RNA, 21 nt, Mycobacterium avium subsp. paratuberculosis
cugccguugauugaccauccg

SEQ ID NO: 2897890 - RNA, 22 nt, Mycobacterium avium subsp. paratuberculosis
cugccguugauugaccauccgg

SEQ ID NO: 2897891 - RNA, 19 nt, Mycobacterium avium subsp. paratuberculosis
cugccguugggcacggugu

SEQ ID NO: 2897892 - RNA, 20 nt, Mycobacterium avium subsp. paratuberculosis
cugccguugggcacggugua

SEQ ID NO: 2897893 - RNA, 22 nt, Mycobacterium avium subsp. paratuberculosis
cugccguugggcacgguguagc

SEQ ID NO: 2897894 - RNA, 18 nt, Mycobacterium avium subsp. paratuberculosis
cugccuacuugcggccgc

SEQ ID NO: 2897895 - RNA, 20 nt, Mycobacterium avium subsp. paratuberculosis
cugccuacuugcggccgcga

SEQ ID NO: 2897896 - RNA, 17 nt, Mycobacterium avium subsp. paratuberculosis
cugccugacccggccgu

SEQ ID NO: 2897897 - RNA, 14 nt, Mycobacterium avium subsp. paratuberculosis
cugccuggccacgu

SEQ ID NO: 2897898 - RNA, 20 nt, Mycobacterium avium subsp. paratuberculosis
cugccuggccacguggucgc

SEQ ID NO: 2897899 - RNA, 21 nt, Mycobacterium avium subsp. paratuberculosis
cugccuggcgaacucgcgcag

SEQ ID NO: 2897900 - RNA, 21 nt, Mycobacterium avium subsp. paratuberculosis
cugccuugcugacgccgcggu

SEQ ID NO: 2897901 - RNA, 22 nt, Mycobacterium avium subsp. paratuberculosis
cugccuugcugacgccgcggug

SEQ ID NO: 2897902 - RNA, 23 nt, Mycobacterium avium subsp. paratuberculosis
cugccuugcugacgccgcggugc

SEQ ID NO: 2897903 - RNA, 17 nt, Mycobacterium avium subsp. paratuberculosis
cugcgaauacccgccca

SEQ ID NO: 2897904 - RNA, 18 nt, Mycobacterium avium subsp. paratuberculosis
cugcgaauacccgcccag

SEQ ID NO: 2897905 - RNA, 21 nt, Mycobacterium avium subsp. paratuberculosis
cugcgacaggucggcggucgc

SEQ ID NO: 2897906 - RNA, 15 nt, Mycobacterium avium subsp. paratuberculosis
cugcgaccacccgga

SEQ ID NO: 2897907 - RNA, 19 nt, Mycobacterium avium subsp. paratuberculosis
cugcgaccacccggacgau

SEQ ID NO: 2897908 - RNA, 16 nt, Mycobacterium avium subsp. paratuberculosis
cugcgacccaccgucg

SEQ ID NO: 2897909 - RNA, 14 nt, Mycobacterium avium subsp. paratuberculosis
cugcgaccgccgcc

SEQ ID NO: 2897910 - RNA, 16 nt, Mycobacterium avium subsp. paratuberculosis
cugcgaccgccgccgc

SEQ ID NO: 2897911 - RNA, 21 nt, Mycobacterium avium subsp. paratuberculosis
cugcgacggaucugcucgugc

SEQ ID NO: 2897912 - RNA, 16 nt, Mycobacterium avium subsp. paratuberculosis
cugcgacggcagcacc

SEQ ID NO: 2897913 - RNA, 20 nt, Mycobacterium avium subsp. paratuberculosis
cugcgacuucuacggcgggc

SEQ ID NO: 2897914 - RNA, 14 nt, Mycobacterium avium subsp. paratuberculosis
cugcgagaucggca

SEQ ID NO: 2897915 - RNA, 16 nt, Mycobacterium avium subsp. paratuberculosis
cugcgagaucggcaga

SEQ ID NO: 2897916 - RNA, 18 nt, Mycobacterium avium subsp. paratuberculosis
cugcgagcacacccucac

SEQ ID NO: 2897917 - RNA, 18 nt, Mycobacterium avium subsp. paratuberculosis
cugcgagcccggccaguc

SEQ ID NO: 2897918 - RNA, 13 nt, Mycobacterium avium subsp. paratuberculosis
cugcgaggcgggc

SEQ ID NO: 2897919 - RNA, 14 nt, Mycobacterium avium subsp. paratuberculosis
cugcgaucgccgac

SEQ ID NO: 2897920 - RNA, 15 nt, Mycobacterium avium subsp. paratuberculosis
cugcgaucgccgacg

SEQ ID NO: 2897921 - RNA, 16 nt, Mycobacterium avium subsp. paratuberculosis
cugcgaucgccgacgc

SEQ ID NO: 2897922 - RNA, 17 nt, Mycobacterium avium subsp. paratuberculosis
cugcgaucgccgacgcc

SEQ ID NO: 2897923 - RNA, 21 nt, Mycobacterium avium subsp. paratuberculosis
cugcgaucgccgacgccagca

SEQ ID NO: 2897924 - RNA, 19 nt, Mycobacterium avium subsp. paratuberculosis
cugcgauugguggcccggu

SEQ ID NO: 2897925 - RNA, 16 nt, Mycobacterium avium subsp. paratuberculosis
cugcgcaacaccucgg

SEQ ID NO: 2897926 - RNA, 20 nt, Mycobacterium avium subsp. paratuberculosis
cugcgcaacaccucggcgac

SEQ ID NO: 2897927 - RNA, 21 nt, Mycobacterium avium subsp. paratuberculosis
cugcgcaacaccucggcgacg

SEQ ID NO: 2897928 - RNA, 13 nt, Mycobacterium avium subsp. paratuberculosis
cugcgcacccggu

SEQ ID NO: 2897929 - RNA, 14 nt, Mycobacterium avium subsp. paratuberculosis
cugcgcacccgguc

SEQ ID NO: 2897930 - RNA, 23 nt, Mycobacterium avium subsp. paratuberculosis
cugcgcacccgguccggcugguc

SEQ ID NO: 2897931 - RNA, 12 nt, Mycobacterium avium subsp. paratuberculosis
cugcgcaccgcc

SEQ ID NO: 2897932 - RNA, 15 nt, Mycobacterium avium subsp. paratuberculosis
cugcgcaccgccagc

SEQ ID NO: 2897933 - RNA, 17 nt, Mycobacterium avium subsp. paratuberculosis
cugcgcaccgccagcac

SEQ ID NO: 2897934 - RNA, 18 nt, Mycobacterium avium subsp. paratuberculosis
cugcgcaccgccagcacc

SEQ ID NO: 2897935 - RNA, 19 nt, Mycobacterium avium subsp. paratuberculosis
cugcgcaccgccagcaccg

SEQ ID NO: 2897936 - RNA, 21 nt, Mycobacterium avium subsp. paratuberculosis
cugcgcaccgccagcaccgac

SEQ ID NO: 2897937 - RNA, 13 nt, Mycobacterium avium subsp. paratuberculosis
cugcgcacguagc

SEQ ID NO: 2897938 - RNA, 21 nt, Mycobacterium avium subsp. paratuberculosis
cugcgcacguagcccagcgcg

SEQ ID NO: 2897939 - RNA, 22 nt, Mycobacterium avium subsp. paratuberculosis
cugcgcacguagcccagcgcgu

SEQ ID NO: 2897940 - RNA, 13 nt, Mycobacterium avium subsp. paratuberculosis
cugcgcagcaccg

SEQ ID NO: 2897941 - RNA, 15 nt, Mycobacterium avium subsp. paratuberculosis
cugcgcagcagcgcc

SEQ ID NO: 2897942 - RNA, 17 nt, Mycobacterium avium subsp. paratuberculosis
cugcgcagcagcgccag

SEQ ID NO: 2897943 - RNA, 11 nt, Mycobacterium avium subsp. paratuberculosis
cugcgcagccg

SEQ ID NO: 2897944 - RNA, 17 nt, Mycobacterium avium subsp. paratuberculosis
cugcgcagccgugccca

SEQ ID NO: 2897945 - RNA, 13 nt, Mycobacterium avium subsp. paratuberculosis
cugcgcagcgcag

SEQ ID NO: 2897946 - RNA, 16 nt, Mycobacterium avium subsp. paratuberculosis
cugcgcagcgcagcac

SEQ ID NO: 2897947 - RNA, 17 nt, Mycobacterium avium subsp. paratuberculosis
cugcgccacaacuggcc

SEQ ID NO: 2897948 - RNA, 13 nt, Mycobacterium avium subsp. paratuberculosis
cugcgccagcagc

SEQ ID NO: 2897949 - RNA, 16 nt, Mycobacterium avium subsp. paratuberculosis
cugcgccagcagcagc

SEQ ID NO: 2897950 - RNA, 22 nt, Mycobacterium avium subsp. paratuberculosis
cugcgccagcagcagcgcggca

SEQ ID NO: 2897951 - RNA, 14 nt, Mycobacterium avium subsp. paratuberculosis
cugcgccagccguc

SEQ ID NO: 2897952 - RNA, 16 nt, Mycobacterium avium subsp. paratuberculosis
cugcgccagccgucgc

SEQ ID NO: 2897953 - RNA, 23 nt, Mycobacterium avium subsp. paratuberculosis
cugcgccagccgucgccgcgccc

SEQ ID NO: 2897954 - RNA, 14 nt, Mycobacterium avium subsp. paratuberculosis
cugcgccagcucca

SEQ ID NO: 2897955 - RNA, 15 nt, Mycobacterium avium subsp. paratuberculosis
cugcgccagcuccag

SEQ ID NO: 2897956 - RNA, 16 nt, Mycobacterium avium subsp. paratuberculosis
cugcgccagcuccagc

SEQ ID NO: 2897957 - RNA, 19 nt, Mycobacterium avium subsp. paratuberculosis
cugcgccagcuccagcagc

SEQ ID NO: 2897958 - RNA, 15 nt, Mycobacterium avium subsp. paratuberculosis
cugcgccagcugggu

SEQ ID NO: 2897959 - RNA, 16 nt, Mycobacterium avium subsp. paratuberculosis
cugcgccagcugggug

SEQ ID NO: 2897960 - RNA, 21 nt, Mycobacterium avium subsp. paratuberculosis
cugcgccagcuggguggucac

SEQ ID NO: 2897961 - RNA, 23 nt, Mycobacterium avium subsp. paratuberculosis
cugcgccaggauccgcccgccgg

SEQ ID NO: 2897962 - RNA, 17 nt, Mycobacterium avium subsp. paratuberculosis
cugcgccgccuccgggc

SEQ ID NO: 2897963 - RNA, 23 nt, Mycobacterium avium subsp. paratuberculosis
cugcgccgccuccgggcugccgu

SEQ ID NO: 2897964 - RNA, 12 nt, Mycobacterium avium subsp. paratuberculosis
cugcgccgcggu

SEQ ID NO: 2897965 - RNA, 13 nt, Mycobacterium avium subsp. paratuberculosis
cugcgccgcggug

SEQ ID NO: 2897966 - RNA, 15 nt, Mycobacterium avium subsp. paratuberculosis
cugcgccgcggugcg

SEQ ID NO: 2897967 - RNA, 17 nt, Mycobacterium avium subsp. paratuberculosis
cugcgccgcgucgacgc

SEQ ID NO: 2897968 - RNA, 19 nt, Mycobacterium avium subsp. paratuberculosis
cugcgccgcgucgacgccg

SEQ ID NO: 2897969 - RNA, 13 nt, Mycobacterium avium subsp. paratuberculosis
cugcgccggcggu

SEQ ID NO: 2897970 - RNA, 14 nt, Mycobacterium avium subsp. paratuberculosis
cugcgccggggccg

SEQ ID NO: 2897971 - RNA, 17 nt, Mycobacterium avium subsp. paratuberculosis
cugcgccggggccgcgg

SEQ ID NO: 2897972 - RNA, 22 nt, Mycobacterium avium subsp. paratuberculosis
cugcgccggggccgcggcucgc

SEQ ID NO: 2897973 - RNA, 16 nt, Mycobacterium avium subsp. paratuberculosis
cugcgccgucaccggc

SEQ ID NO: 2897974 - RNA, 18 nt, Mycobacterium avium subsp. paratuberculosis
cugcgccgucaccggcug

SEQ ID NO: 2897975 - RNA, 19 nt, Mycobacterium avium subsp. paratuberculosis
cugcgccgucaccggcugc

SEQ ID NO: 2897976 - RNA, 20 nt, Mycobacterium avium subsp. paratuberculosis
cugcgccgucaccggcugcc

SEQ ID NO: 2897977 - RNA, 15 nt, Mycobacterium avium subsp. paratuberculosis
cugcgccgucaucga

SEQ ID NO: 2897978 - RNA, 20 nt, Mycobacterium avium subsp. paratuberculosis
cugcgccgucaucgacaccg

SEQ ID NO: 2897979 - RNA, 20 nt, Mycobacterium avium subsp. paratuberculosis
cugcgccgugaagggcccgc

SEQ ID NO: 2897980 - RNA, 23 nt, Mycobacterium avium subsp. paratuberculosis
cugcgccgugaagggcccgccgg

SEQ ID NO: 2897981 - RNA, 22 nt, Mycobacterium avium subsp. paratuberculosis
cugcgccguugauugcgcccgc

SEQ ID NO: 2897982 - RNA, 15 nt, Mycobacterium avium subsp. paratuberculosis
cugcgccucgaucag

SEQ ID NO: 2897983 - RNA, 17 nt, Mycobacterium avium subsp. paratuberculosis
cugcgccucgaucagcg

SEQ ID NO: 2897984 - RNA, 20 nt, Mycobacterium avium subsp. paratuberculosis
cugcgccucgaucagcgcga

SEQ ID NO: 2897985 - RNA, 17 nt, Mycobacterium avium subsp. paratuberculosis
cugcgcgaaaggcccac

SEQ ID NO: 2897986 - RNA, 19 nt, Mycobacterium avium subsp. paratuberculosis
cugcgcgaaaggcccaccg

SEQ ID NO: 2897987 - RNA, 20 nt, Mycobacterium avium subsp. paratuberculosis
cugcgcgaaaggcccaccgc

SEQ ID NO: 2897988 - RNA, 16 nt, Mycobacterium avium subsp. paratuberculosis
cugcgcgaacagcgaa

SEQ ID NO: 2897989 - RNA, 21 nt, Mycobacterium avium subsp. paratuberculosis
cugcgcgacgaauccggugac

SEQ ID NO: 2897990 - RNA, 13 nt, Mycobacterium avium subsp. paratuberculosis
cugcgcgacggcg

SEQ ID NO: 2897991 - RNA, 15 nt, Mycobacterium avium subsp. paratuberculosis
cugcgcgacggcgcu

SEQ ID NO: 2897992 - RNA, 14 nt, Mycobacterium avium subsp. paratuberculosis
cugcgcgagcagau

SEQ ID NO: 2897993 - RNA, 17 nt, Mycobacterium avium subsp. paratuberculosis
cugcgcgagcagaucgc

SEQ ID NO: 2897994 - RNA, 13 nt, Mycobacterium avium subsp. paratuberculosis
cugcgcgaucgcc

SEQ ID NO: 2897995 - RNA, 14 nt, Mycobacterium avium subsp. paratuberculosis
cugcgcgaucgccg

SEQ ID NO: 2897996 - RNA, 20 nt, Mycobacterium avium subsp. paratuberculosis
cugcgcgaucgccggaucgg

SEQ ID NO: 2897997 - RNA, 16 nt, Mycobacterium avium subsp. paratuberculosis
cugcgcgaugucgacg

SEQ ID NO: 2897998 - RNA, 17 nt, Mycobacterium avium subsp. paratuberculosis
cugcgcgaugucgacgg

SEQ ID NO: 2897999 - RNA, 14 nt, Mycobacterium avium subsp. paratuberculosis
cugcgcgccccggc

SEQ ID NO: 2898000 - RNA, 15 nt, Mycobacterium avium subsp. paratuberculosis
cugcgcgccccggcc

SEQ ID NO: 2898001 - RNA, 19 nt, Mycobacterium avium subsp. paratuberculosis
cugcgcgccccggcccggc

SEQ ID NO: 2898002 - RNA, 12 nt, Mycobacterium avium subsp. paratuberculosis
cugcgcgcccga

SEQ ID NO: 2898003 - RNA, 14 nt, Mycobacterium avium subsp. paratuberculosis
cugcgcgcccgagc

SEQ ID NO: 2898004 - RNA, 15 nt, Mycobacterium avium subsp. paratuberculosis
cugcgcgccgauccg

SEQ ID NO: 2898005 - RNA, 21 nt, Mycobacterium avium subsp. paratuberculosis
cugcgcgccgauguggccggc

SEQ ID NO: 2898006 - RNA, 23 nt, Mycobacterium avium subsp. paratuberculosis
cugcgcgccgauguggccggcga

SEQ ID NO: 2898007 - RNA, 13 nt, Mycobacterium avium subsp. paratuberculosis
cugcgcgccggcg

SEQ ID NO: 2898008 - RNA, 15 nt, Mycobacterium avium subsp. paratuberculosis
cugcgcgccggcggc

SEQ ID NO: 2898009 - RNA, 16 nt, Mycobacterium avium subsp. paratuberculosis
cugcgcgccggcggcc

SEQ ID NO: 2898010 - RNA, 17 nt, Mycobacterium avium subsp. paratuberculosis
cugcgcgccggcggccg

SEQ ID NO: 2898011 - RNA, 18 nt, Mycobacterium avium subsp. paratuberculosis
cugcgcgccggcggccgc

SEQ ID NO: 2898012 - RNA, 20 nt, Mycobacterium avium subsp. paratuberculosis
cugcgcgccggcggccgccg

SEQ ID NO: 2898013 - RNA, 14 nt, Mycobacterium avium subsp. paratuberculosis
cugcgcgccgucgg

SEQ ID NO: 2898014 - RNA, 20 nt, Mycobacterium avium subsp. paratuberculosis
cugcgcgcgcgaucgguguc

SEQ ID NO: 2898015 - RNA, 19 nt, Mycobacterium avium subsp. paratuberculosis
cugcgcgcguuguccagca

SEQ ID NO: 2898016 - RNA, 14 nt, Mycobacterium avium subsp. paratuberculosis
cugcgcggccgaac

SEQ ID NO: 2898017 - RNA, 13 nt, Mycobacterium avium subsp. paratuberculosis
cugcgcggccggc

SEQ ID NO: 2898018 - RNA, 14 nt, Mycobacterium avium subsp. paratuberculosis
cugcgcggccggcg

SEQ ID NO: 2898019 - RNA, 17 nt, Mycobacterium avium subsp. paratuberculosis
cugcgcggccggcgugu

SEQ ID NO: 2898020 - RNA, 16 nt, Mycobacterium avium subsp. paratuberculosis
cugcgcggccugcagc

SEQ ID NO: 2898021 - RNA, 10 nt, Mycobacterium avium subsp. paratuberculosis
cugcgcggcg

SEQ ID NO: 2898022 - RNA, 14 nt, Mycobacterium avium subsp. paratuberculosis
cugcgcggcgaugc

SEQ ID NO: 2898023 - RNA, 13 nt, Mycobacterium avium subsp. paratuberculosis
cugcgcggcggcg

SEQ ID NO: 2898024 - RNA, 15 nt, Mycobacterium avium subsp. paratuberculosis
cugcgcggcggcggc

SEQ ID NO: 2898025 - RNA, 15 nt, Mycobacterium avium subsp. paratuberculosis
cugcgcgggcgcggc

SEQ ID NO: 2898026 - RNA, 16 nt, Mycobacterium avium subsp. paratuberculosis
cugcgcgggcgcggcc

SEQ ID NO: 2898027 - RNA, 17 nt, Mycobacterium avium subsp. paratuberculosis
cugcgcgggcgcggcca

SEQ ID NO: 2898028 - RNA, 23 nt, Mycobacterium avium subsp. paratuberculosis
cugcgcgggcgcggccagcgcga

SEQ ID NO: 2898029 - RNA, 20 nt, Mycobacterium avium subsp. paratuberculosis
cugcgcgggucggcgccggc

SEQ ID NO: 2898030 - RNA, 11 nt, Mycobacterium avium subsp. paratuberculosis
cugcgcgucga

SEQ ID NO: 2898031 - RNA, 13 nt, Mycobacterium avium subsp. paratuberculosis
cugcgcgucgagc

SEQ ID NO: 2898032 - RNA, 23 nt, Mycobacterium avium subsp. paratuberculosis
cugcgcgucgagcagcaccaccc

SEQ ID NO: 2898033 - RNA, 11 nt, Mycobacterium avium subsp. paratuberculosis
cugcgcgucgg

SEQ ID NO: 2898034 - RNA, 14 nt, Mycobacterium avium subsp. paratuberculosis
cugcgcgucggccg

SEQ ID NO: 2898035 - RNA, 17 nt, Mycobacterium avium subsp. paratuberculosis
cugcgcguucggcgcca

SEQ ID NO: 2898036 - RNA, 21 nt, Mycobacterium avium subsp. paratuberculosis
cugcgcguucggcgccacccc

SEQ ID NO: 2898037 - RNA, 12 nt, Mycobacterium avium subsp. paratuberculosis
cugcgcuaccag

SEQ ID NO: 2898038 - RNA, 13 nt, Mycobacterium avium subsp. paratuberculosis
cugcgcucagcac

SEQ ID NO: 2898039 - RNA, 14 nt, Mycobacterium avium subsp. paratuberculosis
cugcgcucagcacg

SEQ ID NO: 2898040 - RNA, 16 nt, Mycobacterium avium subsp. paratuberculosis
cugcgcucagcacgcg

SEQ ID NO: 2898041 - RNA, 14 nt, Mycobacterium avium subsp. paratuberculosis
cugcgcucgccguc

SEQ ID NO: 2898042 - RNA, 16 nt, Mycobacterium avium subsp. paratuberculosis
cugcgcucgccgucgg

SEQ ID NO: 2898043 - RNA, 16 nt, Mycobacterium avium subsp. paratuberculosis
cugcgcuucgagcaga

SEQ ID NO: 2898044 - RNA, 15 nt, Mycobacterium avium subsp. paratuberculosis
cugcgcuugcggcgc

SEQ ID NO: 2898045 - RNA, 16 nt, Mycobacterium avium subsp. paratuberculosis
cugcgcuugcggcgca

SEQ ID NO: 2898046 - RNA, 17 nt, Mycobacterium avium subsp. paratuberculosis
cugcgcuugcggcgcag

SEQ ID NO: 2898047 - RNA, 21 nt, Mycobacterium avium subsp. paratuberculosis
cugcgcuugcggcgcagccag

SEQ ID NO: 2898048 - RNA, 22 nt, Mycobacterium avium subsp. paratuberculosis
cugcgcuugcggcgcagccagc

SEQ ID NO: 2898049 - RNA, 23 nt, Mycobacterium avium subsp. paratuberculosis
cugcgcuugcggcgcagccagcu

SEQ ID NO: 2898050 - RNA, 17 nt, Mycobacterium avium subsp. paratuberculosis
cugcggaaaugcccgcg

SEQ ID NO: 2898051 - RNA, 20 nt, Mycobacterium avium subsp. paratuberculosis
cugcggaaaugcccgcgccc

SEQ ID NO: 2898052 - RNA, 17 nt, Mycobacterium avium subsp. paratuberculosis
cugcggaccaucuacga

SEQ ID NO: 2898053 - RNA, 21 nt, Mycobacterium avium subsp. paratuberculosis
cugcggaccaucuacgaccuc

SEQ ID NO: 2898054 - RNA, 15 nt, Mycobacterium avium subsp. paratuberculosis
cugcggauccgacga

SEQ ID NO: 2898055 - RNA, 16 nt, Mycobacterium avium subsp. paratuberculosis
cugcggauccgacgaa

SEQ ID NO: 2898056 - RNA, 12 nt, Mycobacterium avium subsp. paratuberculosis
cugcggaucgcg

SEQ ID NO: 2898057 - RNA, 23 nt, Mycobacterium avium subsp. paratuberculosis
cugcggaugucggugugcagcag

SEQ ID NO: 2898058 - RNA, 16 nt, Mycobacterium avium subsp. paratuberculosis
cugcggcaacagcacc

SEQ ID NO: 2898059 - RNA, 17 nt, Mycobacterium avium subsp. paratuberculosis
cugcggcaacagcacca

SEQ ID NO: 2898060 - RNA, 15 nt, Mycobacterium avium subsp. paratuberculosis
cugcggcacggugcg

SEQ ID NO: 2898061 - RNA, 18 nt, Mycobacterium avium subsp. paratuberculosis
cugcggcagguaggcgcc

SEQ ID NO: 2898062 - RNA, 20 nt, Mycobacterium avium subsp. paratuberculosis
cugcggcagguaggcgccgc

SEQ ID NO: 2898063 - RNA, 21 nt, Mycobacterium avium subsp. paratuberculosis
cugcggcaggucggccagcgc

SEQ ID NO: 2898064 - RNA, 22 nt, Mycobacterium avium subsp. paratuberculosis
cugcggccagugccgggccagc

SEQ ID NO: 2898065 - RNA, 23 nt, Mycobacterium avium subsp. paratuberculosis
cugcggccccugcggggugucga

SEQ ID NO: 2898066 - RNA, 19 nt, Mycobacterium avium subsp. paratuberculosis
cugcggcccgucgccgugc

SEQ ID NO: 2898067 - RNA, 13 nt, Mycobacterium avium subsp. paratuberculosis
cugcggccggggc

SEQ ID NO: 2898068 - RNA, 21 nt, Mycobacterium avium subsp. paratuberculosis
cugcggccugcacaggggcgc

SEQ ID NO: 2898069 - RNA, 15 nt, Mycobacterium avium subsp. paratuberculosis
cugcggcgacaacgc

SEQ ID NO: 2898070 - RNA, 20 nt, Mycobacterium avium subsp. paratuberculosis
cugcggcgagucccggcgca

SEQ ID NO: 2898071 - RNA, 14 nt, Mycobacterium avium subsp. paratuberculosis
cugcggcgccgggc

SEQ ID NO: 2898072 - RNA, 21 nt, Mycobacterium avium subsp. paratuberculosis
cugcggcgcggccaccccggu

SEQ ID NO: 2898073 - RNA, 14 nt, Mycobacterium avium subsp. paratuberculosis
cugcggcggccgca

SEQ ID NO: 2898074 - RNA, 16 nt, Mycobacterium avium subsp. paratuberculosis
cugcggcggccgcagc

SEQ ID NO: 2898075 - RNA, 17 nt, Mycobacterium avium subsp. paratuberculosis
cugcggcggccgcagcg

SEQ ID NO: 2898076 - RNA, 20 nt, Mycobacterium avium subsp. paratuberculosis
cugcggcgucgucuuggccu

SEQ ID NO: 2898077 - RNA, 15 nt, Mycobacterium avium subsp. paratuberculosis
cugcggcucggcgcu

SEQ ID NO: 2898078 - RNA, 16 nt, Mycobacterium avium subsp. paratuberculosis
cugcggcucggcgcug

SEQ ID NO: 2898079 - RNA, 16 nt, Mycobacterium avium subsp. paratuberculosis
cugcggcucgucggcg

SEQ ID NO: 2898080 - RNA, 20 nt, Mycobacterium avium subsp. paratuberculosis
cugcggcugcaucaugccgc

SEQ ID NO: 2898081 - RNA, 23 nt, Mycobacterium avium subsp. paratuberculosis
cugcggcugcaucaugccgccca

SEQ ID NO: 2898082 - RNA, 20 nt, Mycobacterium avium subsp. paratuberculosis
cugcggcugggagagcaggu

SEQ ID NO: 2898083 - RNA, 21 nt, Mycobacterium avium subsp. paratuberculosis
cugcggcugggucggucccga

SEQ ID NO: 2898084 - RNA, 20 nt, Mycobacterium avium subsp. paratuberculosis
cugcggcugguagaugccga

SEQ ID NO: 2898085 - RNA, 20 nt, Mycobacterium avium subsp. paratuberculosis
cugcgggaacagcgggaaca

SEQ ID NO: 2898086 - RNA, 14 nt, Mycobacterium avium subsp. paratuberculosis
cugcgggaacguca

SEQ ID NO: 2898087 - RNA, 23 nt, Mycobacterium avium subsp. paratuberculosis
cugcgggaacgucauggccagcu

SEQ ID NO: 2898088 - RNA, 17 nt, Mycobacterium avium subsp. paratuberculosis
cugcgggaagcccaccg

SEQ ID NO: 2898089 - RNA, 13 nt, Mycobacterium avium subsp. paratuberculosis
cugcgggacgccg

SEQ ID NO: 2898090 - RNA, 14 nt, Mycobacterium avium subsp. paratuberculosis
cugcgggacgccgu

SEQ ID NO: 2898091 - RNA, 16 nt, Mycobacterium avium subsp. paratuberculosis
cugcgggcaucgcugg

SEQ ID NO: 2898092 - RNA, 15 nt, Mycobacterium avium subsp. paratuberculosis
cugcgggccagcgca

SEQ ID NO: 2898093 - RNA, 12 nt, Mycobacterium avium subsp. paratuberculosis
cugcgggccauc

SEQ ID NO: 2898094 - RNA, 21 nt, Mycobacterium avium subsp. paratuberculosis
cugcgggcccaccgcgcgcug

SEQ ID NO: 2898095 - RNA, 22 nt, Mycobacterium avium subsp. paratuberculosis
cugcgggcccaccgcgcgcugc

SEQ ID NO: 2898096 - RNA, 13 nt, Mycobacterium avium subsp. paratuberculosis
cugcgggcccagc

SEQ ID NO: 2898097 - RNA, 22 nt, Mycobacterium avium subsp. paratuberculosis
cugcgggcccagcucggugcgc

SEQ ID NO: 2898098 - RNA, 13 nt, Mycobacterium avium subsp. paratuberculosis
cugcgggcgccgg

SEQ ID NO: 2898099 - RNA, 12 nt, Mycobacterium avium subsp. paratuberculosis
cugcgggcgggc

SEQ ID NO: 2898100 - RNA, 15 nt, Mycobacterium avium subsp. paratuberculosis
cugcgggcgggccgc

SEQ ID NO: 2898101 - RNA, 16 nt, Mycobacterium avium subsp. paratuberculosis
cugcgggucagcagcu

SEQ ID NO: 2898102 - RNA, 19 nt, Mycobacterium avium subsp. paratuberculosis
cugcgggucagcagcuugg

SEQ ID NO: 2898103 - RNA, 22 nt, Mycobacterium avium subsp. paratuberculosis
cugcgggugcaacgugaugccg

SEQ ID NO: 2898104 - RNA, 16 nt, Mycobacterium avium subsp. paratuberculosis
cugcgggugcggccag

SEQ ID NO: 2898105 - RNA, 15 nt, Mycobacterium avium subsp. paratuberculosis
cugcgggugcucagc

SEQ ID NO: 2898106 - RNA, 17 nt, Mycobacterium avium subsp. paratuberculosis
cugcggguucuggccgu

SEQ ID NO: 2898107 - RNA, 15 nt, Mycobacterium avium subsp. paratuberculosis
cugcggguugcgggc

SEQ ID NO: 2898108 - RNA, 17 nt, Mycobacterium avium subsp. paratuberculosis
cugcggguugcgggcca

SEQ ID NO: 2898109 - RNA, 21 nt, Mycobacterium avium subsp. paratuberculosis
cugcgguacacguggccgauc

SEQ ID NO: 2898110 - RNA, 15 nt, Mycobacterium avium subsp. paratuberculosis
cugcggugagcguag

SEQ ID NO: 2898111 - RNA, 17 nt, Mycobacterium avium subsp. paratuberculosis
cugcggugaugcgcggc

SEQ ID NO: 2898112 - RNA, 18 nt, Mycobacterium avium subsp. paratuberculosis
cugcggugaugcgcggcg

SEQ ID NO: 2898113 - RNA, 14 nt, Mycobacterium avium subsp. paratuberculosis
cugcggugcgccca

SEQ ID NO: 2898114 - RNA, 19 nt, Mycobacterium avium subsp. paratuberculosis
cugcgguucgucgcggcgg

SEQ ID NO: 2898115 - RNA, 20 nt, Mycobacterium avium subsp. paratuberculosis
cugcgguucgucgcggcggc

SEQ ID NO: 2898116 - RNA, 15 nt, Mycobacterium avium subsp. paratuberculosis
cugcgguuggccggc

SEQ ID NO: 2898117 - RNA, 16 nt, Mycobacterium avium subsp. paratuberculosis
cugcgucaucggcucg

SEQ ID NO: 2898118 - RNA, 20 nt, Mycobacterium avium subsp. paratuberculosis
cugcgucaucggcucgaucg

SEQ ID NO: 2898119 - RNA, 20 nt, Mycobacterium avium subsp. paratuberculosis
cugcgucauggagaucaccg

SEQ ID NO: 2898120 - RNA, 22 nt, Mycobacterium avium subsp. paratuberculosis
cugcgucauggagaucaccgcg

SEQ ID NO: 2898121 - RNA, 23 nt, Mycobacterium avium subsp. paratuberculosis
cugcgucauggagaucaccgcgu

SEQ ID NO: 2898122 - RNA, 23 nt, Mycobacterium avium subsp. paratuberculosis
cugcguccgauaccagccgcgga

SEQ ID NO: 2898123 - RNA, 16 nt, Mycobacterium avium subsp. paratuberculosis
cugcguccggcccggc

SEQ ID NO: 2898124 - RNA, 20 nt, Mycobacterium avium subsp. paratuberculosis
cugcgucggcaccagcggca

SEQ ID NO: 2898125 - RNA, 17 nt, Mycobacterium avium subsp. paratuberculosis
cugcgugaaugggugua

SEQ ID NO: 2898126 - RNA, 18 nt, Mycobacterium avium subsp. paratuberculosis
cugcgugcccggaucgcc

SEQ ID NO: 2898127 - RNA, 20 nt, Mycobacterium avium subsp. paratuberculosis
cugcgugcccggaucgccga

SEQ ID NO: 2898128 - RNA, 23 nt, Mycobacterium avium subsp. paratuberculosis
cugcgugcccggaucgccgaacg

SEQ ID NO: 2898129 - RNA, 20 nt, Mycobacterium avium subsp. paratuberculosis
cugcgugcggguggccgggu

SEQ ID NO: 2898130 - RNA, 17 nt, Mycobacterium avium subsp. paratuberculosis
cugcgugcugggcaccg

SEQ ID NO: 2898131 - RNA, 16 nt, Mycobacterium avium subsp. paratuberculosis
cugcguguggcgcacg

SEQ ID NO: 2898132 - RNA, 18 nt, Mycobacterium avium subsp. paratuberculosis
cugcguguggcgcacgcc

SEQ ID NO: 2898133 - RNA, 19 nt, Mycobacterium avium subsp. paratuberculosis
cugcguguggcgcacgccc

SEQ ID NO: 2898134 - RNA, 16 nt, Mycobacterium avium subsp. paratuberculosis
cugcguucggcgauca

SEQ ID NO: 2898135 - RNA, 15 nt, Mycobacterium avium subsp. paratuberculosis
cugcguugcggcaca

SEQ ID NO: 2898136 - RNA, 20 nt, Mycobacterium avium subsp. paratuberculosis
cugcguugcggcacaggcga

SEQ ID NO: 2898137 - RNA, 18 nt, Mycobacterium avium subsp. paratuberculosis
cugcucaccgagcugggc

SEQ ID NO: 2898138 - RNA, 21 nt, Mycobacterium avium subsp. paratuberculosis
cugcucaccgagcugggccgg

SEQ ID NO: 2898139 - RNA, 14 nt, Mycobacterium avium subsp. paratuberculosis
cugcucagcggcca

SEQ ID NO: 2898140 - RNA, 18 nt, Mycobacterium avium subsp. paratuberculosis
cugcucaugagcccucca

SEQ ID NO: 2898141 - RNA, 20 nt, Mycobacterium avium subsp. paratuberculosis
cugcucaugagcccuccagc

SEQ ID NO: 2898142 - RNA, 21 nt, Mycobacterium avium subsp. paratuberculosis
cugcucaugagcccuccagcu

SEQ ID NO: 2898143 - RNA, 18 nt, Mycobacterium avium subsp. paratuberculosis
cugcucccaggacggcgc

SEQ ID NO: 2898144 - RNA, 20 nt, Mycobacterium avium subsp. paratuberculosis
cugcucccaggacggcgcgg

SEQ ID NO: 2898145 - RNA, 23 nt, Mycobacterium avium subsp. paratuberculosis
cugcucccaggacggcgcggugg

SEQ ID NO: 2898146 - RNA, 13 nt, Mycobacterium avium subsp. paratuberculosis
cugcucccaggcg

SEQ ID NO: 2898147 - RNA, 19 nt, Mycobacterium avium subsp. paratuberculosis
cugcucccaggcgucgucg

SEQ ID NO: 2898148 - RNA, 20 nt, Mycobacterium avium subsp. paratuberculosis
cugcucccaggcgucgucgu

SEQ ID NO: 2898149 - RNA, 12 nt, Mycobacterium avium subsp. paratuberculosis
cugcuccggggu

SEQ ID NO: 2898150 - RNA, 14 nt, Mycobacterium avium subsp. paratuberculosis
cugcuccggggugg

SEQ ID NO: 2898151 - RNA, 23 nt, Mycobacterium avium subsp. paratuberculosis
cugcuccucggucagcggcgugc

SEQ ID NO: 2898152 - RNA, 17 nt, Mycobacterium avium subsp. paratuberculosis
cugcucgaaccgcgaga

SEQ ID NO: 2898153 - RNA, 12 nt, Mycobacterium avium subsp. paratuberculosis
cugcucgaaggc

SEQ ID NO: 2898154 - RNA, 17 nt, Mycobacterium avium subsp. paratuberculosis
cugcucgaaggcaacuc

SEQ ID NO: 2898155 - RNA, 15 nt, Mycobacterium avium subsp. paratuberculosis
cugcucgaccagccc

SEQ ID NO: 2898156 - RNA, 15 nt, Mycobacterium avium subsp. paratuberculosis
cugcucgaccagcgc

SEQ ID NO: 2898157 - RNA, 16 nt, Mycobacterium avium subsp. paratuberculosis
cugcucgaccagcgcc

SEQ ID NO: 2898158 - RNA, 19 nt, Mycobacterium avium subsp. paratuberculosis
cugcucgaccucggcgacc

SEQ ID NO: 2898159 - RNA, 22 nt, Mycobacterium avium subsp. paratuberculosis
cugcucgaccucggcgaccagc

SEQ ID NO: 2898160 - RNA, 12 nt, Mycobacterium avium subsp. paratuberculosis
cugcucgacgua

SEQ ID NO: 2898161 - RNA, 20 nt, Mycobacterium avium subsp. paratuberculosis
cugcucgacguagucgcgca

SEQ ID NO: 2898162 - RNA, 20 nt, Mycobacterium avium subsp. paratuberculosis
cugcucgagcaucuccagcc

SEQ ID NO: 2898163 - RNA, 23 nt, Mycobacterium avium subsp. paratuberculosis
cugcucgagggccuccaccacca

SEQ ID NO: 2898164 - RNA, 17 nt, Mycobacterium avium subsp. paratuberculosis
cugcucgaucucggcca

SEQ ID NO: 2898165 - RNA, 19 nt, Mycobacterium avium subsp. paratuberculosis
cugcucgaucucggccacc

SEQ ID NO: 2898166 - RNA, 21 nt, Mycobacterium avium subsp. paratuberculosis
cugcucgaucucggccaccgu

SEQ ID NO: 2898167 - RNA, 22 nt, Mycobacterium avium subsp. paratuberculosis
cugcucgaugcgcgccagcagc

SEQ ID NO: 2898168 - RNA, 20 nt, Mycobacterium avium subsp. paratuberculosis
cugcucgcagauggucggga

SEQ ID NO: 2898169 - RNA, 13 nt, Mycobacterium avium subsp. paratuberculosis
cugcucgccagac

SEQ ID NO: 2898170 - RNA, 22 nt, Mycobacterium avium subsp. paratuberculosis
cugcucgccagacucacggcgg

SEQ ID NO: 2898171 - RNA, 22 nt, Mycobacterium avium subsp. paratuberculosis
cugcucgccggcuaccggcgcu

SEQ ID NO: 2898172 - RNA, 13 nt, Mycobacterium avium subsp. paratuberculosis
cugcucgccguca

SEQ ID NO: 2898173 - RNA, 13 nt, Mycobacterium avium subsp. paratuberculosis
cugcucgcgcccu

SEQ ID NO: 2898174 - RNA, 14 nt, Mycobacterium avium subsp. paratuberculosis
cugcucgcgcugcc

SEQ ID NO: 2898175 - RNA, 20 nt, Mycobacterium avium subsp. paratuberculosis
cugcucgcgcugccgcgcgc

SEQ ID NO: 2898176 - RNA, 21 nt, Mycobacterium avium subsp. paratuberculosis
cugcucgcgcugccgcgcgcc

SEQ ID NO: 2898177 - RNA, 15 nt, Mycobacterium avium subsp. paratuberculosis
cugcucgcgggccac

SEQ ID NO: 2898178 - RNA, 19 nt, Mycobacterium avium subsp. paratuberculosis
cugcucgcgguuccugcgc

SEQ ID NO: 2898179 - RNA, 20 nt, Mycobacterium avium subsp. paratuberculosis
cugcucgcgguuccugcgcu

SEQ ID NO: 2898180 - RNA, 12 nt, Mycobacterium avium subsp. paratuberculosis
cugcucgcugug

SEQ ID NO: 2898181 - RNA, 16 nt, Mycobacterium avium subsp. paratuberculosis
cugcucgcuguggcgg

SEQ ID NO: 2898182 - RNA, 17 nt, Mycobacterium avium subsp. paratuberculosis
cugcucgcuguggcgga

SEQ ID NO: 2898183 - RNA, 14 nt, Mycobacterium avium subsp. paratuberculosis
cugcucggccaccg

SEQ ID NO: 2898184 - RNA, 20 nt, Mycobacterium avium subsp. paratuberculosis
cugcucggccaccgcgcggu

SEQ ID NO: 2898185 - RNA, 15 nt, Mycobacterium avium subsp. paratuberculosis
cugcucggccagcgg

SEQ ID NO: 2898186 - RNA, 13 nt, Mycobacterium avium subsp. paratuberculosis
cugcucggccgca

SEQ ID NO: 2898187 - RNA, 16 nt, Mycobacterium avium subsp. paratuberculosis
cugcucggccgcaucg

SEQ ID NO: 2898188 - RNA, 16 nt, Mycobacterium avium subsp. paratuberculosis
cugcucggcgacgcug

SEQ ID NO: 2898189 - RNA, 21 nt, Mycobacterium avium subsp. paratuberculosis
cugcucggcgacgcugugcuc

SEQ ID NO: 2898190 - RNA, 15 nt, Mycobacterium avium subsp. paratuberculosis
cugcucggcgcggcu

SEQ ID NO: 2898191 - RNA, 17 nt, Mycobacterium avium subsp. paratuberculosis
cugcucggcgggcucgc

SEQ ID NO: 2898192 - RNA, 20 nt, Mycobacterium avium subsp. paratuberculosis
cugcucggcgggcucgcgcu

SEQ ID NO: 2898193 - RNA, 17 nt, Mycobacterium avium subsp. paratuberculosis
cugcucggcgucgcacg

SEQ ID NO: 2898194 - RNA, 14 nt, Mycobacterium avium subsp. paratuberculosis
cugcucggugaugc

SEQ ID NO: 2898195 - RNA, 17 nt, Mycobacterium avium subsp. paratuberculosis
cugcucggugaugccga

SEQ ID NO: 2898196 - RNA, 14 nt, Mycobacterium avium subsp. paratuberculosis
cugcucguccuggc

SEQ ID NO: 2898197 - RNA, 17 nt, Mycobacterium avium subsp. paratuberculosis
cugcucguccuggcgcu

SEQ ID NO: 2898198 - RNA, 19 nt, Mycobacterium avium subsp. paratuberculosis
cugcucguccuggcgcugg

SEQ ID NO: 2898199 - RNA, 17 nt, Mycobacterium avium subsp. paratuberculosis
cugcucgucgacgcuga

SEQ ID NO: 2898200 - RNA, 21 nt, Mycobacterium avium subsp. paratuberculosis
cugcucgugcaaaccggaccg

SEQ ID NO: 2898201 - RNA, 20 nt, Mycobacterium avium subsp. paratuberculosis
cugcucguucgucaugacga

SEQ ID NO: 2898202 - RNA, 23 nt, Mycobacterium avium subsp. paratuberculosis
cugcucguugugcauguggccgu

SEQ ID NO: 2898203 - RNA, 15 nt, Mycobacterium avium subsp. paratuberculosis
cugcucugcgcgcgg

SEQ ID NO: 2898204 - RNA, 16 nt, Mycobacterium avium subsp. paratuberculosis
cugcucugcgcgcggu

SEQ ID NO: 2898205 - RNA, 18 nt, Mycobacterium avium subsp. paratuberculosis
cugcucugcgcgcggugc

SEQ ID NO: 2898206 - RNA, 20 nt, Mycobacterium avium subsp. paratuberculosis
cugcucuucgguggugugga

SEQ ID NO: 2898207 - RNA, 17 nt, Mycobacterium avium subsp. paratuberculosis
cugcugcacgacgaccg

SEQ ID NO: 2898208 - RNA, 18 nt, Mycobacterium avium subsp. paratuberculosis
cugcugcacguccgccuc

SEQ ID NO: 2898209 - RNA, 19 nt, Mycobacterium avium subsp. paratuberculosis
cugcugcacguccgccucc

SEQ ID NO: 2898210 - RNA, 17 nt, Mycobacterium avium subsp. paratuberculosis
cugcugcacgucgccgg

SEQ ID NO: 2898211 - RNA, 17 nt, Mycobacterium avium subsp. paratuberculosis
cugcugcccgacuugcc

SEQ ID NO: 2898212 - RNA, 15 nt, Mycobacterium avium subsp. paratuberculosis
cugcugccgccgcag

SEQ ID NO: 2898213 - RNA, 16 nt, Mycobacterium avium subsp. paratuberculosis
cugcugccgccgcagc

SEQ ID NO: 2898214 - RNA, 12 nt, Mycobacterium avium subsp. paratuberculosis
cugcugcggccg

SEQ ID NO: 2898215 - RNA, 21 nt, Mycobacterium avium subsp. paratuberculosis
cugcugcgggugcggccagcg

SEQ ID NO: 2898216 - RNA, 22 nt, Mycobacterium avium subsp. paratuberculosis
cugcugcucgucgcgggcgccg

SEQ ID NO: 2898217 - RNA, 23 nt, Mycobacterium avium subsp. paratuberculosis
cugcugcucgucgcgggcgccga

SEQ ID NO: 2898218 - RNA, 23 nt, Mycobacterium avium subsp. paratuberculosis
cugcuggauggucucgcgcaccu

SEQ ID NO: 2898219 - RNA, 23 nt, Mycobacterium avium subsp. paratuberculosis
cugcuggaugugguugcuggcgu

SEQ ID NO: 2898220 - RNA, 14 nt, Mycobacterium avium subsp. paratuberculosis
cugcuggccgggcu

SEQ ID NO: 2898221 - RNA, 14 nt, Mycobacterium avium subsp. paratuberculosis
cugcuggcgcugcc

SEQ ID NO: 2898222 - RNA, 17 nt, Mycobacterium avium subsp. paratuberculosis
cugcuggcguucgccga

SEQ ID NO: 2898223 - RNA, 17 nt, Mycobacterium avium subsp. paratuberculosis
cugcugggacgggucgg

SEQ ID NO: 2898224 - RNA, 21 nt, Mycobacterium avium subsp. paratuberculosis
cugcugggacgggucggcggc

SEQ ID NO: 2898225 - RNA, 16 nt, Mycobacterium avium subsp. paratuberculosis
cugcugggagcggccc

SEQ ID NO: 2898226 - RNA, 17 nt, Mycobacterium avium subsp. paratuberculosis
cugcugggagcggccca

SEQ ID NO: 2898227 - RNA, 14 nt, Mycobacterium avium subsp. paratuberculosis
cugcugggcggcac

SEQ ID NO: 2898228 - RNA, 15 nt, Mycobacterium avium subsp. paratuberculosis
cugcugggcggcacc

SEQ ID NO: 2898229 - RNA, 14 nt, Mycobacterium avium subsp. paratuberculosis
cugcugggcgggca

SEQ ID NO: 2898230 - RNA, 16 nt, Mycobacterium avium subsp. paratuberculosis
cugcugggcgggcagc

SEQ ID NO: 2898231 - RNA, 18 nt, Mycobacterium avium subsp. paratuberculosis
cugcugggcgggcagccg

SEQ ID NO: 2898232 - RNA, 20 nt, Mycobacterium avium subsp. paratuberculosis
cugcugggcgggcagccgcu

SEQ ID NO: 2898233 - RNA, 20 nt, Mycobacterium avium subsp. paratuberculosis
cugcugggcguugccggucu

SEQ ID NO: 2898234 - RNA, 14 nt, Mycobacterium avium subsp. paratuberculosis
cugcugggugccgc

SEQ ID NO: 2898235 - RNA, 14 nt, Mycobacterium avium subsp. paratuberculosis
cugcuggucgacgu

SEQ ID NO: 2898236 - RNA, 16 nt, Mycobacterium avium subsp. paratuberculosis
cugcuggucgacguca

SEQ ID NO: 2898237 - RNA, 20 nt, Mycobacterium avium subsp. paratuberculosis
cugcuggucuugccgugcag

SEQ ID NO: 2898238 - RNA, 22 nt, Mycobacterium avium subsp. paratuberculosis
cugcuggucuugccgugcagca

SEQ ID NO: 2898239 - RNA, 19 nt, Mycobacterium avium subsp. paratuberculosis
cugcuguagcucacggugu

SEQ ID NO: 2898240 - RNA, 14 nt, Mycobacterium avium subsp. paratuberculosis
cugcuguuccucga

SEQ ID NO: 2898241 - RNA, 20 nt, Mycobacterium avium subsp. paratuberculosis
cugcuguucguccgugcugc

SEQ ID NO: 2898242 - RNA, 12 nt, Mycobacterium avium subsp. paratuberculosis
cugcuucgucgc

SEQ ID NO: 2898243 - RNA, 15 nt, Mycobacterium avium subsp. paratuberculosis
cugcuucucgccguc

SEQ ID NO: 2898244 - RNA, 14 nt, Mycobacterium avium subsp. paratuberculosis
cugcuugaacagca

SEQ ID NO: 2898245 - RNA, 16 nt, Mycobacterium avium subsp. paratuberculosis
cugcuugaacagcacc

SEQ ID NO: 2898246 - RNA, 17 nt, Mycobacterium avium subsp. paratuberculosis
cugcuugaacagcaccc

SEQ ID NO: 2898247 - RNA, 16 nt, Mycobacterium avium subsp. paratuberculosis
cugcuugacccgcucc

SEQ ID NO: 2898248 - RNA, 23 nt, Mycobacterium avium subsp. paratuberculosis
cugcuugacccgcuccagcggcc

SEQ ID NO: 2898249 - RNA, 13 nt, Mycobacterium avium subsp. paratuberculosis
cugcuugaccgcg

SEQ ID NO: 2898250 - RNA, 14 nt, Mycobacterium avium subsp. paratuberculosis
cugcuugaucaggu

SEQ ID NO: 2898251 - RNA, 20 nt, Mycobacterium avium subsp. paratuberculosis
cugcuugaugaugccggccg

SEQ ID NO: 2898252 - RNA, 22 nt, Mycobacterium avium subsp. paratuberculosis
cugcuuggucgccugcacgaaa

SEQ ID NO: 2898253 - RNA, 20 nt, Mycobacterium avium subsp. paratuberculosis
cugcuugugaaugggcugcg

SEQ ID NO: 2898254 - RNA, 21 nt, Mycobacterium avium subsp. paratuberculosis
cugcuuugccuuagcccggcc

SEQ ID NO: 2898255 - RNA, 21 nt, Mycobacterium avium subsp. paratuberculosis
cuggaaaccccucagccggaa

SEQ ID NO: 2898256 - RNA, 18 nt, Mycobacterium avium subsp. paratuberculosis
cuggaacaccacggccgg

SEQ ID NO: 2898257 - RNA, 14 nt, Mycobacterium avium subsp. paratuberculosis
cuggaacagguagu

SEQ ID NO: 2898258 - RNA, 19 nt, Mycobacterium avium subsp. paratuberculosis
cuggaaccgaaucggucga

SEQ ID NO: 2898259 - RNA, 13 nt, Mycobacterium avium subsp. paratuberculosis
cuggaaccggguc

SEQ ID NO: 2898260 - RNA, 17 nt, Mycobacterium avium subsp. paratuberculosis
cuggaaccgggucucgc

SEQ ID NO: 2898261 - RNA, 18 nt, Mycobacterium avium subsp. paratuberculosis
cuggaagaugacccgccu

SEQ ID NO: 2898262 - RNA, 23 nt, Mycobacterium avium subsp. paratuberculosis
cuggaagccuggcacgacgccgc

SEQ ID NO: 2898263 - RNA, 17 nt, Mycobacterium avium subsp. paratuberculosis
cuggaaggcgaucacga

SEQ ID NO: 2898264 - RNA, 17 nt, Mycobacterium avium subsp. paratuberculosis
cuggaaucccgccucgg

SEQ ID NO: 2898265 - RNA, 19 nt, Mycobacterium avium subsp. paratuberculosis
cuggacaccacgucgucgg

SEQ ID NO: 2898266 - RNA, 18 nt, Mycobacterium avium subsp. paratuberculosis
cuggacagccacagcucg

SEQ ID NO: 2898267 - RNA, 19 nt, Mycobacterium avium subsp. paratuberculosis
cuggacauucacgaggccg

SEQ ID NO: 2898268 - RNA, 23 nt, Mycobacterium avium subsp. paratuberculosis
cuggacauucacgaggccgggcu

SEQ ID NO: 2898269 - RNA, 16 nt, Mycobacterium avium subsp. paratuberculosis
cuggaccaccaugaug

SEQ ID NO: 2898270 - RNA, 21 nt, Mycobacterium avium subsp. paratuberculosis
cuggacgaguggucggccgcc

SEQ ID NO: 2898271 - RNA, 14 nt, Mycobacterium avium subsp. paratuberculosis
cuggacgaucggcu

SEQ ID NO: 2898272 - RNA, 17 nt, Mycobacterium avium subsp. paratuberculosis
cuggacgccgcacgcga

SEQ ID NO: 2898273 - RNA, 14 nt, Mycobacterium avium subsp. paratuberculosis
cuggacgccgugga

SEQ ID NO: 2898274 - RNA, 14 nt, Mycobacterium avium subsp. paratuberculosis
cuggacggcccgac

SEQ ID NO: 2898275 - RNA, 20 nt, Mycobacterium avium subsp. paratuberculosis
cuggacgguuucaccgccgu

SEQ ID NO: 2898276 - RNA, 20 nt, Mycobacterium avium subsp. paratuberculosis
cuggacgucgucgcuguccu

SEQ ID NO: 2898277 - RNA, 16 nt, Mycobacterium avium subsp. paratuberculosis
cuggacuugcgucgcg

SEQ ID NO: 2898278 - RNA, 18 nt, Mycobacterium avium subsp. paratuberculosis
cuggacuugcgucgcgau

SEQ ID NO: 2898279 - RNA, 15 nt, Mycobacterium avium subsp. paratuberculosis
cuggagaggcccggc

SEQ ID NO: 2898280 - RNA, 19 nt, Mycobacterium avium subsp. paratuberculosis
cuggagcggguccgccccg

SEQ ID NO: 2898281 - RNA, 21 nt, Mycobacterium avium subsp. paratuberculosis
cuggaggccaacgagcgcgcc

SEQ ID NO: 2898282 - RNA, 22 nt, Mycobacterium avium subsp. paratuberculosis
cuggagugaggggauccagcgg

SEQ ID NO: 2898283 - RNA, 14 nt, Mycobacterium avium subsp. paratuberculosis
cuggaguggucagg

SEQ ID NO: 2898284 - RNA, 19 nt, Mycobacterium avium subsp. paratuberculosis
cuggaguggucaggcccag

SEQ ID NO: 2898285 - RNA, 20 nt, Mycobacterium avium subsp. paratuberculosis
cuggaguggucaggcccagg

SEQ ID NO: 2898286 - RNA, 14 nt, Mycobacterium avium subsp. paratuberculosis
cuggaucagccagu

SEQ ID NO: 2898287 - RNA, 14 nt, Mycobacterium avium subsp. paratuberculosis
cuggaucaucucgu

SEQ ID NO: 2898288 - RNA, 17 nt, Mycobacterium avium subsp. paratuberculosis
cuggaucccgaacugcc

SEQ ID NO: 2898289 - RNA, 20 nt, Mycobacterium avium subsp. paratuberculosis
cuggaucccgaacugccgcg

SEQ ID NO: 2898290 - RNA, 15 nt, Mycobacterium avium subsp. paratuberculosis
cuggaucgcgcaggu

SEQ ID NO: 2898291 - RNA, 11 nt, Mycobacterium avium subsp. paratuberculosis
cuggaugaaca

SEQ ID NO: 2898292 - RNA, 22 nt, Mycobacterium avium subsp. paratuberculosis
cuggaugaucgucucggccgcg

SEQ ID NO: 2898293 - RNA, 18 nt, Mycobacterium avium subsp. paratuberculosis
cuggaugcggucgucgcc

SEQ ID NO: 2898294 - RNA, 21 nt, Mycobacterium avium subsp. paratuberculosis
cuggaugcggucgucgcccac

SEQ ID NO: 2898295 - RNA, 20 nt, Mycobacterium avium subsp. paratuberculosis
cuggaugucacgguccaggu

SEQ ID NO: 2898296 - RNA, 22 nt, Mycobacterium avium subsp. paratuberculosis
cuggauguccaggccgucgagg

SEQ ID NO: 2898297 - RNA, 21 nt, Mycobacterium avium subsp. paratuberculosis
cuggauucgucgcuggccagg

SEQ ID NO: 2898298 - RNA, 12 nt, Mycobacterium avium subsp. paratuberculosis
cuggcacgacgc

SEQ ID NO: 2898299 - RNA, 14 nt, Mycobacterium avium subsp. paratuberculosis
cuggcacgacgccg

SEQ ID NO: 2898300 - RNA, 16 nt, Mycobacterium avium subsp. paratuberculosis
cuggcacgacgccgcc

SEQ ID NO: 2898301 - RNA, 20 nt, Mycobacterium avium subsp. paratuberculosis
cuggcagcauccgccgacga

SEQ ID NO: 2898302 - RNA, 21 nt, Mycobacterium avium subsp. paratuberculosis
cuggcagcauccgccgacgau

SEQ ID NO: 2898303 - RNA, 15 nt, Mycobacterium avium subsp. paratuberculosis
cuggcagccggccgg

SEQ ID NO: 2898304 - RNA, 16 nt, Mycobacterium avium subsp. paratuberculosis
cuggcagcugccgaac

SEQ ID NO: 2898305 - RNA, 15 nt, Mycobacterium avium subsp. paratuberculosis
cuggcaggucgcgcc

SEQ ID NO: 2898306 - RNA, 17 nt, Mycobacterium avium subsp. paratuberculosis
cuggcaggucgcgccgg

SEQ ID NO: 2898307 - RNA, 18 nt, Mycobacterium avium subsp. paratuberculosis
cuggcaggucgcgccgga

SEQ ID NO: 2898308 - RNA, 14 nt, Mycobacterium avium subsp. paratuberculosis
cuggcaggugagcc

SEQ ID NO: 2898309 - RNA, 18 nt, Mycobacterium avium subsp. paratuberculosis
cuggcaggugagccgggu

SEQ ID NO: 2898310 - RNA, 14 nt, Mycobacterium avium subsp. paratuberculosis
cuggcauccgucgg

SEQ ID NO: 2898311 - RNA, 16 nt, Mycobacterium avium subsp. paratuberculosis
cuggcauccgucggcc

SEQ ID NO: 2898312 - RNA, 20 nt, Mycobacterium avium subsp. paratuberculosis
cuggcaucgucggcgccggc

SEQ ID NO: 2898313 - RNA, 15 nt, Mycobacterium avium subsp. paratuberculosis
cuggccaacucgacc

SEQ ID NO: 2898314 - RNA, 23 nt, Mycobacterium avium subsp. paratuberculosis
cuggccaacucgaccugcccggg

SEQ ID NO: 2898315 - RNA, 21 nt, Mycobacterium avium subsp. paratuberculosis
cuggccaccacgggucggucg

SEQ ID NO: 2898316 - RNA, 23 nt, Mycobacterium avium subsp. paratuberculosis
cuggccaccacgggucggucggc

SEQ ID NO: 2898317 - RNA, 13 nt, Mycobacterium avium subsp. paratuberculosis
cuggccaccagca

SEQ ID NO: 2898318 - RNA, 14 nt, Mycobacterium avium subsp. paratuberculosis
cuggccaccagcag

SEQ ID NO: 2898319 - RNA, 14 nt, Mycobacterium avium subsp. paratuberculosis
cuggccaccgaagc

SEQ ID NO: 2898320 - RNA, 16 nt, Mycobacterium avium subsp. paratuberculosis
cuggccaccucgacgg

SEQ ID NO: 2898321 - RNA, 22 nt, Mycobacterium avium subsp. paratuberculosis
cuggccacguggucgcugaccu

SEQ ID NO: 2898322 - RNA, 13 nt, Mycobacterium avium subsp. paratuberculosis
cuggccagcaccg

SEQ ID NO: 2898323 - RNA, 15 nt, Mycobacterium avium subsp. paratuberculosis
cuggccagcaccgcg

SEQ ID NO: 2898324 - RNA, 19 nt, Mycobacterium avium subsp. paratuberculosis
cuggccagcgucagggcga

SEQ ID NO: 2898325 - RNA, 23 nt, Mycobacterium avium subsp. paratuberculosis
cuggccagguacaccaccagguu

SEQ ID NO: 2898326 - RNA, 16 nt, Mycobacterium avium subsp. paratuberculosis
cuggccaucgccgagc

SEQ ID NO: 2898327 - RNA, 19 nt, Mycobacterium avium subsp. paratuberculosis
cuggcccagacaggccggc

SEQ ID NO: 2898328 - RNA, 21 nt, Mycobacterium avium subsp. paratuberculosis
cuggcccagacaggccggccg

SEQ ID NO: 2898329 - RNA, 23 nt, Mycobacterium avium subsp. paratuberculosis
cuggcccagccgcgucacgucgg

SEQ ID NO: 2898330 - RNA, 13 nt, Mycobacterium avium subsp. paratuberculosis
cuggccccgucgu

SEQ ID NO: 2898331 - RNA, 17 nt, Mycobacterium avium subsp. paratuberculosis
cuggcccgccaucgccc

SEQ ID NO: 2898332 - RNA, 20 nt, Mycobacterium avium subsp. paratuberculosis
cuggcccgccaucgcccggu

SEQ ID NO: 2898333 - RNA, 16 nt, Mycobacterium avium subsp. paratuberculosis
cuggcccggcgcggcg

SEQ ID NO: 2898334 - RNA, 19 nt, Mycobacterium avium subsp. paratuberculosis
cuggcccggcgcggcggcg

SEQ ID NO: 2898335 - RNA, 22 nt, Mycobacterium avium subsp. paratuberculosis
cuggcccggcgcggcggcgccg

SEQ ID NO: 2898336 - RNA, 18 nt, Mycobacterium avium subsp. paratuberculosis
cuggcccggugcgacgcc

SEQ ID NO: 2898337 - RNA, 19 nt, Mycobacterium avium subsp. paratuberculosis
cuggcccggugcgacgccg

SEQ ID NO: 2898338 - RNA, 20 nt, Mycobacterium avium subsp. paratuberculosis
cuggcccggugcgacgccgc

SEQ ID NO: 2898339 - RNA, 20 nt, Mycobacterium avium subsp. paratuberculosis
cuggcccucggaggugccgc

SEQ ID NO: 2898340 - RNA, 18 nt, Mycobacterium avium subsp. paratuberculosis
cuggcccuugaccgccug

SEQ ID NO: 2898341 - RNA, 21 nt, Mycobacterium avium subsp. paratuberculosis
cuggcccuugaccgccugcuu

SEQ ID NO: 2898342 - RNA, 21 nt, Mycobacterium avium subsp. paratuberculosis
cuggccgaaggugggguugaa

SEQ ID NO: 2898343 - RNA, 22 nt, Mycobacterium avium subsp. paratuberculosis
cuggccgaccccgaugcgcucg

SEQ ID NO: 2898344 - RNA, 13 nt, Mycobacterium avium subsp. paratuberculosis
cuggccgaccgcc

SEQ ID NO: 2898345 - RNA, 16 nt, Mycobacterium avium subsp. paratuberculosis
cuggccgaccgccgcc

SEQ ID NO: 2898346 - RNA, 21 nt, Mycobacterium avium subsp. paratuberculosis
cuggccgaucccggccacguc

SEQ ID NO: 2898347 - RNA, 17 nt, Mycobacterium avium subsp. paratuberculosis
cuggccgaucuugucga

SEQ ID NO: 2898348 - RNA, 19 nt, Mycobacterium avium subsp. paratuberculosis
cuggccgaucuugucgacc

SEQ ID NO: 2898349 - RNA, 20 nt, Mycobacterium avium subsp. paratuberculosis
cuggccgauggucagcugcc

SEQ ID NO: 2898350 - RNA, 23 nt, Mycobacterium avium subsp. paratuberculosis
cuggccgauggucagcugccgca

SEQ ID NO: 2898351 - RNA, 17 nt, Mycobacterium avium subsp. paratuberculosis
cuggccgcacggugcag

SEQ ID NO: 2898352 - RNA, 13 nt, Mycobacterium avium subsp. paratuberculosis
cuggccgcccacc

SEQ ID NO: 2898353 - RNA, 14 nt, Mycobacterium avium subsp. paratuberculosis
cuggccgcccacca

SEQ ID NO: 2898354 - RNA, 18 nt, Mycobacterium avium subsp. paratuberculosis
cuggccgcccaccacgaa

SEQ ID NO: 2898355 - RNA, 21 nt, Mycobacterium avium subsp. paratuberculosis
cuggccgccgcuagucgccca

SEQ ID NO: 2898356 - RNA, 17 nt, Mycobacterium avium subsp. paratuberculosis
cuggccgccggccgcgc

SEQ ID NO: 2898357 - RNA, 21 nt, Mycobacterium avium subsp. paratuberculosis
cuggccgcgaacggcccgccg

SEQ ID NO: 2898358 - RNA, 14 nt, Mycobacterium avium subsp. paratuberculosis
cuggccgcgcagcg

SEQ ID NO: 2898359 - RNA, 15 nt, Mycobacterium avium subsp. paratuberculosis
cuggccgcggccagc

SEQ ID NO: 2898360 - RNA, 18 nt, Mycobacterium avium subsp. paratuberculosis
cuggccgcggccagcugc

SEQ ID NO: 2898361 - RNA, 19 nt, Mycobacterium avium subsp. paratuberculosis
cuggccgcggccagcugcc

SEQ ID NO: 2898362 - RNA, 16 nt, Mycobacterium avium subsp. paratuberculosis
cuggccgcggcgaucg

SEQ ID NO: 2898363 - RNA, 14 nt, Mycobacterium avium subsp. paratuberculosis
cuggccgcgggugc

SEQ ID NO: 2898364 - RNA, 20 nt, Mycobacterium avium subsp. paratuberculosis
cuggccgcgggugcggccca

SEQ ID NO: 2898365 - RNA, 18 nt, Mycobacterium avium subsp. paratuberculosis
cuggccgcguuccaggac

SEQ ID NO: 2898366 - RNA, 20 nt, Mycobacterium avium subsp. paratuberculosis
cuggccgcguuccaggaccu

SEQ ID NO: 2898367 - RNA, 21 nt, Mycobacterium avium subsp. paratuberculosis
cuggccggacgggucgaccgc

SEQ ID NO: 2898368 - RNA, 16 nt, Mycobacterium avium subsp. paratuberculosis
cuggccggccaccagc

SEQ ID NO: 2898369 - RNA, 17 nt, Mycobacterium avium subsp. paratuberculosis
cuggccggccaccagcg

SEQ ID NO: 2898370 - RNA, 20 nt, Mycobacterium avium subsp. paratuberculosis
cuggccggccaccagcggcc

SEQ ID NO: 2898371 - RNA, 22 nt, Mycobacterium avium subsp. paratuberculosis
cuggccggccaccagcggccgg

SEQ ID NO: 2898372 - RNA, 17 nt, Mycobacterium avium subsp. paratuberculosis
cuggccggccaucuuca

SEQ ID NO: 2898373 - RNA, 14 nt, Mycobacterium avium subsp. paratuberculosis
cuggccggccucga

SEQ ID NO: 2898374 - RNA, 23 nt, Mycobacterium avium subsp. paratuberculosis
cuggccggccucgaugucgucga

SEQ ID NO: 2898375 - RNA, 14 nt, Mycobacterium avium subsp. paratuberculosis
cuggccgggcucga

SEQ ID NO: 2898376 - RNA, 16 nt, Mycobacterium avium subsp. paratuberculosis
cuggccgggcucgagg

SEQ ID NO: 2898377 - RNA, 20 nt, Mycobacterium avium subsp. paratuberculosis
cuggccgguauuggccacgc

SEQ ID NO: 2898378 - RNA, 14 nt, Mycobacterium avium subsp. paratuberculosis
cuggccguccggau

SEQ ID NO: 2898379 - RNA, 24 nt, Mycobacterium avium subsp. paratuberculosis
cuggccguccggauagccgucggc

SEQ ID NO: 2898380 - RNA, 16 nt, Mycobacterium avium subsp. paratuberculosis
cuggccgucgcggcgc

SEQ ID NO: 2898381 - RNA, 17 nt, Mycobacterium avium subsp. paratuberculosis
cuggccgucgcggcgcg

SEQ ID NO: 2898382 - RNA, 14 nt, Mycobacterium avium subsp. paratuberculosis
cuggccgucggcga

SEQ ID NO: 2898383 - RNA, 17 nt, Mycobacterium avium subsp. paratuberculosis
cuggccgucggcgaugg

SEQ ID NO: 2898384 - RNA, 14 nt, Mycobacterium avium subsp. paratuberculosis
cuggccgucggugg

SEQ ID NO: 2898385 - RNA, 17 nt, Mycobacterium avium subsp. paratuberculosis
cuggccgucgguggccg

SEQ ID NO: 2898386 - RNA, 16 nt, Mycobacterium avium subsp. paratuberculosis
cuggccgucgucgagg

SEQ ID NO: 2898387 - RNA, 22 nt, Mycobacterium avium subsp. paratuberculosis
cuggccgucgucgaggccgaac

SEQ ID NO: 2898388 - RNA, 14 nt, Mycobacterium avium subsp. paratuberculosis
cuggccgugcaccg

SEQ ID NO: 2898389 - RNA, 20 nt, Mycobacterium avium subsp. paratuberculosis
cuggccgugcaccgucgccg

SEQ ID NO: 2898390 - RNA, 15 nt, Mycobacterium avium subsp. paratuberculosis
cuggccguggucggc

SEQ ID NO: 2898391 - RNA, 21 nt, Mycobacterium avium subsp. paratuberculosis
cuggccguggucggcgaugcg

SEQ ID NO: 2898392 - RNA, 23 nt, Mycobacterium avium subsp. paratuberculosis
cuggccguucaggucgaucagcg

SEQ ID NO: 2898393 - RNA, 12 nt, Mycobacterium avium subsp. paratuberculosis
cuggccuccagc

SEQ ID NO: 2898394 - RNA, 21 nt, Mycobacterium avium subsp. paratuberculosis
cuggccugauugacggcccac

SEQ ID NO: 2898395 - RNA, 17 nt, Mycobacterium avium subsp. paratuberculosis
cuggccuugcagcccgc

SEQ ID NO: 2898396 - RNA, 15 nt, Mycobacterium avium subsp. paratuberculosis
cuggcgaacauggug

SEQ ID NO: 2898397 - RNA, 20 nt, Mycobacterium avium subsp. paratuberculosis
cuggcgaacaugguggucga

SEQ ID NO: 2898398 - RNA, 21 nt, Mycobacterium avium subsp. paratuberculosis
cuggcgaaccgcggcggcagc

SEQ ID NO: 2898399 - RNA, 17 nt, Mycobacterium avium subsp. paratuberculosis
cuggcgaacucgcgcag

SEQ ID NO: 2898400 - RNA, 17 nt, Mycobacterium avium subsp. paratuberculosis
cuggcgaauuccccgua

SEQ ID NO: 2898401 - RNA, 12 nt, Mycobacterium avium subsp. paratuberculosis
cuggcgaccggu

SEQ ID NO: 2898402 - RNA, 22 nt, Mycobacterium avium subsp. paratuberculosis
cuggcgaucaccuugcggccgg

SEQ ID NO: 2898403 - RNA, 23 nt, Mycobacterium avium subsp. paratuberculosis
cuggcgaucaccuugcggccggc

SEQ ID NO: 2898404 - RNA, 17 nt, Mycobacterium avium subsp. paratuberculosis
cuggcgaucaucgucgu

SEQ ID NO: 2898405 - RNA, 15 nt, Mycobacterium avium subsp. paratuberculosis
cuggcgaucgaugcc

SEQ ID NO: 2898406 - RNA, 16 nt, Mycobacterium avium subsp. paratuberculosis
cuggcgaugaucaaca

SEQ ID NO: 2898407 - RNA, 20 nt, Mycobacterium avium subsp. paratuberculosis
cuggcgaugugaucgcggcc

SEQ ID NO: 2898408 - RNA, 21 nt, Mycobacterium avium subsp. paratuberculosis
cuggcgaugugaucgcggccc

SEQ ID NO: 2898409 - RNA, 13 nt, Mycobacterium avium subsp. paratuberculosis
cuggcgcaccgcc

SEQ ID NO: 2898410 - RNA, 17 nt, Mycobacterium avium subsp. paratuberculosis
cuggcgcaccgccgcgg

SEQ ID NO: 2898411 - RNA, 18 nt, Mycobacterium avium subsp. paratuberculosis
cuggcgcaccgccgcggg

SEQ ID NO: 2898412 - RNA, 19 nt, Mycobacterium avium subsp. paratuberculosis
cuggcgcaccgccgcggga

SEQ ID NO: 2898413 - RNA, 13 nt, Mycobacterium avium subsp. paratuberculosis
cuggcgcagcacc

SEQ ID NO: 2898414 - RNA, 16 nt, Mycobacterium avium subsp. paratuberculosis
cuggcgcagcaccgac

SEQ ID NO: 2898415 - RNA, 20 nt, Mycobacterium avium subsp. paratuberculosis
cuggcgcaggcgcugggugu

SEQ ID NO: 2898416 - RNA, 13 nt, Mycobacterium avium subsp. paratuberculosis
cuggcgcagggcg

SEQ ID NO: 2898417 - RNA, 14 nt, Mycobacterium avium subsp. paratuberculosis
cuggcgcagggcgu

SEQ ID NO: 2898418 - RNA, 16 nt, Mycobacterium avium subsp. paratuberculosis
cuggcgcaucagcggg

SEQ ID NO: 2898419 - RNA, 18 nt, Mycobacterium avium subsp. paratuberculosis
cuggcgccggcguccagc

SEQ ID NO: 2898420 - RNA, 22 nt, Mycobacterium avium subsp. paratuberculosis
cuggcgccggcguccagcgccg

SEQ ID NO: 2898421 - RNA, 13 nt, Mycobacterium avium subsp. paratuberculosis
cuggcgccggucg

SEQ ID NO: 2898422 - RNA, 17 nt, Mycobacterium avium subsp. paratuberculosis
cuggcgccggucggugc

SEQ ID NO: 2898423 - RNA, 13 nt, Mycobacterium avium subsp. paratuberculosis
cuggcgcuccagc

SEQ ID NO: 2898424 - RNA, 16 nt, Mycobacterium avium subsp. paratuberculosis
cuggcgcuccagccac

SEQ ID NO: 2898425 - RNA, 17 nt, Mycobacterium avium subsp. paratuberculosis
cuggcgcuccagccacu

SEQ ID NO: 2898426 - RNA, 19 nt, Mycobacterium avium subsp. paratuberculosis
cuggcgcuccagccacucc

SEQ ID NO: 2898427 - RNA, 23 nt, Mycobacterium avium subsp. paratuberculosis
cuggcgcuccagccacuccacca

SEQ ID NO: 2898428 - RNA, 12 nt, Mycobacterium avium subsp. paratuberculosis
cuggcgcugcca

SEQ ID NO: 2898429 - RNA, 14 nt, Mycobacterium avium subsp. paratuberculosis
cuggcgcugccagu

SEQ ID NO: 2898430 - RNA, 19 nt, Mycobacterium avium subsp. paratuberculosis
cuggcgcugcgcuucgagc

SEQ ID NO: 2898431 - RNA, 14 nt, Mycobacterium avium subsp. paratuberculosis
cuggcgcugcucgg

SEQ ID NO: 2898432 - RNA, 14 nt, Mycobacterium avium subsp. paratuberculosis
cuggcgcuggaucu

SEQ ID NO: 2898433 - RNA, 20 nt, Mycobacterium avium subsp. paratuberculosis
cuggcgcuggaucugcccga

SEQ ID NO: 2898434 - RNA, 18 nt, Mycobacterium avium subsp. paratuberculosis
cuggcgcuggugcagcag

SEQ ID NO: 2898435 - RNA, 23 nt, Mycobacterium avium subsp. paratuberculosis
cuggcgcuggugcagcagggcgc

SEQ ID NO: 2898436 - RNA, 20 nt, Mycobacterium avium subsp. paratuberculosis
cuggcggaaggccgcgcggg

SEQ ID NO: 2898437 - RNA, 21 nt, Mycobacterium avium subsp. paratuberculosis
cuggcggaaggccgcgcgggc

SEQ ID NO: 2898438 - RNA, 21 nt, Mycobacterium avium subsp. paratuberculosis
cuggcggacccgcucccggga

SEQ ID NO: 2898439 - RNA, 17 nt, Mycobacterium avium subsp. paratuberculosis
cuggcggauggcgcccu

SEQ ID NO: 2898440 - RNA, 14 nt, Mycobacterium avium subsp. paratuberculosis
cuggcggccagcgu

SEQ ID NO: 2898441 - RNA, 20 nt, Mycobacterium avium subsp. paratuberculosis
cuggcggccaucgccgcggu

SEQ ID NO: 2898442 - RNA, 13 nt, Mycobacterium avium subsp. paratuberculosis
cuggcggccggcc

SEQ ID NO: 2898443 - RNA, 15 nt, Mycobacterium avium subsp. paratuberculosis
cuggcggccggccgc

SEQ ID NO: 2898444 - RNA, 16 nt, Mycobacterium avium subsp. paratuberculosis
cuggcggccggccgcg

SEQ ID NO: 2898445 - RNA, 23 nt, Mycobacterium avium subsp. paratuberculosis
cuggcggccggccgcgcccaucg

SEQ ID NO: 2898446 - RNA, 15 nt, Mycobacterium avium subsp. paratuberculosis
cuggcggccuucuug

SEQ ID NO: 2898447 - RNA, 17 nt, Mycobacterium avium subsp. paratuberculosis
cuggcggccuucuuggc

SEQ ID NO: 2898448 - RNA, 14 nt, Mycobacterium avium subsp. paratuberculosis
cuggcggcgaucac

SEQ ID NO: 2898449 - RNA, 13 nt, Mycobacterium avium subsp. paratuberculosis
cuggcggcgcggu

SEQ ID NO: 2898450 - RNA, 15 nt, Mycobacterium avium subsp. paratuberculosis
cuggcggcggcgguc

SEQ ID NO: 2898451 - RNA, 14 nt, Mycobacterium avium subsp. paratuberculosis
cuggcgggccagcu

SEQ ID NO: 2898452 - RNA, 14 nt, Mycobacterium avium subsp. paratuberculosis
cuggcgggcgaagc

SEQ ID NO: 2898453 - RNA, 16 nt, Mycobacterium avium subsp. paratuberculosis
cuggcgggcggcccgc

SEQ ID NO: 2898454 - RNA, 19 nt, Mycobacterium avium subsp. paratuberculosis
cuggcggggcgugcccggc

SEQ ID NO: 2898455 - RNA, 19 nt, Mycobacterium avium subsp. paratuberculosis
cuggcggguguucagcccc

SEQ ID NO: 2898456 - RNA, 20 nt, Mycobacterium avium subsp. paratuberculosis
cuggcggguguucagccccu

SEQ ID NO: 2898457 - RNA, 20 nt, Mycobacterium avium subsp. paratuberculosis
cuggcggucgcugaccccgc

SEQ ID NO: 2898458 - RNA, 16 nt, Mycobacterium avium subsp. paratuberculosis
cuggcgguggcccggu

SEQ ID NO: 2898459 - RNA, 20 nt, Mycobacterium avium subsp. paratuberculosis
cuggcgguggcccgguacag

SEQ ID NO: 2898460 - RNA, 13 nt, Mycobacterium avium subsp. paratuberculosis
cuggcggugucga

SEQ ID NO: 2898461 - RNA, 18 nt, Mycobacterium avium subsp. paratuberculosis
cuggcggugucgaagacc

SEQ ID NO: 2898462 - RNA, 16 nt, Mycobacterium avium subsp. paratuberculosis
cuggcgguuggacagg

SEQ ID NO: 2898463 - RNA, 21 nt, Mycobacterium avium subsp. paratuberculosis
cuggcgguuggacaggccggc

SEQ ID NO: 2898464 - RNA, 21 nt, Mycobacterium avium subsp. paratuberculosis
cuggcguagaucugcacgcug

SEQ ID NO: 2898465 - RNA, 19 nt, Mycobacterium avium subsp. paratuberculosis
cuggcguaggacagcagcc

SEQ ID NO: 2898466 - RNA, 22 nt, Mycobacterium avium subsp. paratuberculosis
cuggcguaggacagcagccgcu

SEQ ID NO: 2898467 - RNA, 13 nt, Mycobacterium avium subsp. paratuberculosis
cuggcgucgaucg

SEQ ID NO: 2898468 - RNA, 13 nt, Mycobacterium avium subsp. paratuberculosis
cuggcgucgggcu

SEQ ID NO: 2898469 - RNA, 13 nt, Mycobacterium avium subsp. paratuberculosis
cuggcgucguugg

SEQ ID NO: 2898470 - RNA, 18 nt, Mycobacterium avium subsp. paratuberculosis
cuggcgucguuggcgccg

SEQ ID NO: 2898471 - RNA, 18 nt, Mycobacterium avium subsp. paratuberculosis
cuggcgugacagucgagg

SEQ ID NO: 2898472 - RNA, 21 nt, Mycobacterium avium subsp. paratuberculosis
cuggcgugacgcucgacggcc

SEQ ID NO: 2898473 - RNA, 16 nt, Mycobacterium avium subsp. paratuberculosis
cuggcgugacgcucgc

SEQ ID NO: 2898474 - RNA, 21 nt, Mycobacterium avium subsp. paratuberculosis
cuggcgugacgcucgccggcg

SEQ ID NO: 2898475 - RNA, 18 nt, Mycobacterium avium subsp. paratuberculosis
cuggcgugacgcucggcg

SEQ ID NO: 2898476 - RNA, 19 nt, Mycobacterium avium subsp. paratuberculosis
cuggcgugacgcucggcgc

SEQ ID NO: 2898477 - RNA, 22 nt, Mycobacterium avium subsp. paratuberculosis
cuggcgugacgcucggcgcguc

SEQ ID NO: 2898478 - RNA, 23 nt, Mycobacterium avium subsp. paratuberculosis
cuggcgugacgcucggcgcgucg

SEQ ID NO: 2898479 - RNA, 22 nt, Mycobacterium avium subsp. paratuberculosis
cuggcgugacgcucggcggccg

SEQ ID NO: 2898480 - RNA, 12 nt, Mycobacterium avium subsp. paratuberculosis
cuggcgugacgg

SEQ ID NO: 2898481 - RNA, 22 nt, Mycobacterium avium subsp. paratuberculosis
cuggcgugacggucgaccucga

SEQ ID NO: 2898482 - RNA, 20 nt, Mycobacterium avium subsp. paratuberculosis
cuggcgugacguucggccaa

SEQ ID NO: 2898483 - RNA, 21 nt, Mycobacterium avium subsp. paratuberculosis
cuggcgugcuugaacgccgcc

SEQ ID NO: 2898484 - RNA, 23 nt, Mycobacterium avium subsp. paratuberculosis
cuggcgugcuugaacgccgcccc

SEQ ID NO: 2898485 - RNA, 16 nt, Mycobacterium avium subsp. paratuberculosis
cuggcguggcacccgg

SEQ ID NO: 2898486 - RNA, 18 nt, Mycobacterium avium subsp. paratuberculosis
cuggcguggcacccgggc

SEQ ID NO: 2898487 - RNA, 14 nt, Mycobacterium avium subsp. paratuberculosis
cuggcguggcgccg

SEQ ID NO: 2898488 - RNA, 16 nt, Mycobacterium avium subsp. paratuberculosis
cuggcguggcgccggc

SEQ ID NO: 2898489 - RNA, 17 nt, Mycobacterium avium subsp. paratuberculosis
cuggcguggcgccggcg

SEQ ID NO: 2898490 - RNA, 18 nt, Mycobacterium avium subsp. paratuberculosis
cuggcguggcgccggcgc

SEQ ID NO: 2898491 - RNA, 15 nt, Mycobacterium avium subsp. paratuberculosis
cuggcguggcucggc

SEQ ID NO: 2898492 - RNA, 19 nt, Mycobacterium avium subsp. paratuberculosis
cuggcguggcucggcccgc

SEQ ID NO: 2898493 - RNA, 21 nt, Mycobacterium avium subsp. paratuberculosis
cuggcguggcucggcccgccg

SEQ ID NO: 2898494 - RNA, 17 nt, Mycobacterium avium subsp. paratuberculosis
cuggcguugagcacgcg

SEQ ID NO: 2898495 - RNA, 22 nt, Mycobacterium avium subsp. paratuberculosis
cuggcguugagcacgcggaccu

SEQ ID NO: 2898496 - RNA, 17 nt, Mycobacterium avium subsp. paratuberculosis
cuggcguugaugcgggc

SEQ ID NO: 2898497 - RNA, 20 nt, Mycobacterium avium subsp. paratuberculosis
cuggcucaacacguccuggc

SEQ ID NO: 2898498 - RNA, 14 nt, Mycobacterium avium subsp. paratuberculosis
cuggcuccccggcg

SEQ ID NO: 2898499 - RNA, 18 nt, Mycobacterium avium subsp. paratuberculosis
cuggcucggcaccagagc

SEQ ID NO: 2898500 - RNA, 13 nt, Mycobacterium avium subsp. paratuberculosis
cuggcugacggcg

SEQ ID NO: 2898501 - RNA, 13 nt, Mycobacterium avium subsp. paratuberculosis
cuggcugagcacc

SEQ ID NO: 2898502 - RNA, 16 nt, Mycobacterium avium subsp. paratuberculosis
cuggcugagcagcacc

SEQ ID NO: 2898503 - RNA, 17 nt, Mycobacterium avium subsp. paratuberculosis
cuggcugagcagcaccc

SEQ ID NO: 2898504 - RNA, 15 nt, Mycobacterium avium subsp. paratuberculosis
cuggcugcggccccg

SEQ ID NO: 2898505 - RNA, 19 nt, Mycobacterium avium subsp. paratuberculosis
cuggcuggucacccacugg

SEQ ID NO: 2898506 - RNA, 19 nt, Mycobacterium avium subsp. paratuberculosis
cuggcuggugauggccauc

SEQ ID NO: 2898507 - RNA, 14 nt, Mycobacterium avium subsp. paratuberculosis
cuggcuguagcggu

SEQ ID NO: 2898508 - RNA, 11 nt, Mycobacterium avium subsp. paratuberculosis
cugggacagcc

SEQ ID NO: 2898509 - RNA, 18 nt, Mycobacterium avium subsp. paratuberculosis
cugggacgggucggcggc

SEQ ID NO: 2898510 - RNA, 23 nt, Mycobacterium avium subsp. paratuberculosis
cugggagaacucgaucugcagcc

SEQ ID NO: 2898511 - RNA, 15 nt, Mycobacterium avium subsp. paratuberculosis
cugggagcggcccaa

SEQ ID NO: 2898512 - RNA, 20 nt, Mycobacterium avium subsp. paratuberculosis
cugggaggaagugcacgccg

SEQ ID NO: 2898513 - RNA, 21 nt, Mycobacterium avium subsp. paratuberculosis
cugggaguugacuccucugcc

SEQ ID NO: 2898514 - RNA, 19 nt, Mycobacterium avium subsp. paratuberculosis
cugggaucggugcgcggcg

SEQ ID NO: 2898515 - RNA, 23 nt, Mycobacterium avium subsp. paratuberculosis
cugggaucggugcgcggcgaagg

SEQ ID NO: 2898516 - RNA, 18 nt, Mycobacterium avium subsp. paratuberculosis
cugggaugucuagccgcc

SEQ ID NO: 2898517 - RNA, 19 nt, Mycobacterium avium subsp. paratuberculosis
cugggaugucuagccgccg

SEQ ID NO: 2898518 - RNA, 22 nt, Mycobacterium avium subsp. paratuberculosis
cugggaugucuagccgccgagc

SEQ ID NO: 2898519 - RNA, 17 nt, Mycobacterium avium subsp. paratuberculosis
cugggauugccgggcac

SEQ ID NO: 2898520 - RNA, 21 nt, Mycobacterium avium subsp. paratuberculosis
cugggauugccgggcaccagc

SEQ ID NO: 2898521 - RNA, 15 nt, Mycobacterium avium subsp. paratuberculosis
cugggcaauggccgc

SEQ ID NO: 2898522 - RNA, 16 nt, Mycobacterium avium subsp. paratuberculosis
cugggcaauggccgcg

SEQ ID NO: 2898523 - RNA, 17 nt, Mycobacterium avium subsp. paratuberculosis
cugggcaauggccgcga

SEQ ID NO: 2898524 - RNA, 19 nt, Mycobacterium avium subsp. paratuberculosis
cugggcaauggccgcgacu

SEQ ID NO: 2898525 - RNA, 23 nt, Mycobacterium avium subsp. paratuberculosis
cugggcaauggccgcgacucugc

SEQ ID NO: 2898526 - RNA, 15 nt, Mycobacterium avium subsp. paratuberculosis
cugggcagccgcgcg

SEQ ID NO: 2898527 - RNA, 21 nt, Mycobacterium avium subsp. paratuberculosis
cugggcaucaucggcacgccg

SEQ ID NO: 2898528 - RNA, 12 nt, Mycobacterium avium subsp. paratuberculosis
cugggccagcgc

SEQ ID NO: 2898529 - RNA, 20 nt, Mycobacterium avium subsp. paratuberculosis
cugggccagcgcgguggcca

SEQ ID NO: 2898530 - RNA, 16 nt, Mycobacterium avium subsp. paratuberculosis
cugggccccuccagcc

SEQ ID NO: 2898531 - RNA, 16 nt, Mycobacterium avium subsp. paratuberculosis
cugggccgccagccgg

SEQ ID NO: 2898532 - RNA, 19 nt, Mycobacterium avium subsp. paratuberculosis
cugggccgccagccgguac

SEQ ID NO: 2898533 - RNA, 16 nt, Mycobacterium avium subsp. paratuberculosis
cugggccgcggcgccg

SEQ ID NO: 2898534 - RNA, 14 nt, Mycobacterium avium subsp. paratuberculosis
cugggccgggcggu

SEQ ID NO: 2898535 - RNA, 13 nt, Mycobacterium avium subsp. paratuberculosis
cugggccuccggc

SEQ ID NO: 2898536 - RNA, 15 nt, Mycobacterium avium subsp. paratuberculosis
cugggccuccggcgg

SEQ ID NO: 2898537 - RNA, 17 nt, Mycobacterium avium subsp. paratuberculosis
cugggccuccggcggca

SEQ ID NO: 2898538 - RNA, 19 nt, Mycobacterium avium subsp. paratuberculosis
cugggccuccggcggcaga

SEQ ID NO: 2898539 - RNA, 21 nt, Mycobacterium avium subsp. paratuberculosis
cugggccucguccagggacuc

SEQ ID NO: 2898540 - RNA, 14 nt, Mycobacterium avium subsp. paratuberculosis
cugggccuggcgcu

SEQ ID NO: 2898541 - RNA, 19 nt, Mycobacterium avium subsp. paratuberculosis
cugggcgaagccgaggucu

SEQ ID NO: 2898542 - RNA, 22 nt, Mycobacterium avium subsp. paratuberculosis
cugggcgaccacguccagcugg

SEQ ID NO: 2898543 - RNA, 24 nt, Mycobacterium avium subsp. paratuberculosis
cugggcgaccagauaggccagcgc

SEQ ID NO: 2898544 - RNA, 23 nt, Mycobacterium avium subsp. paratuberculosis
cugggcgaccaugccgcgggcca

SEQ ID NO: 2898545 - RNA, 23 nt, Mycobacterium avium subsp. paratuberculosis
cugggcgcccacccguuggcagg

SEQ ID NO: 2898546 - RNA, 13 nt, Mycobacterium avium subsp. paratuberculosis
cugggcgcccaga

SEQ ID NO: 2898547 - RNA, 23 nt, Mycobacterium avium subsp. paratuberculosis
cugggcgcccagaugccgccgcc

SEQ ID NO: 2898548 - RNA, 22 nt, Mycobacterium avium subsp. paratuberculosis
cugggcgccgccggcgucgacg

SEQ ID NO: 2898549 - RNA, 17 nt, Mycobacterium avium subsp. paratuberculosis
cugggcgccgucgccga

SEQ ID NO: 2898550 - RNA, 17 nt, Mycobacterium avium subsp. paratuberculosis
cugggcgcgcacccccu

SEQ ID NO: 2898551 - RNA, 19 nt, Mycobacterium avium subsp. paratuberculosis
cugggcgcuagcugcgccg

SEQ ID NO: 2898552 - RNA, 22 nt, Mycobacterium avium subsp. paratuberculosis
cugggcgcuagcugcgccggcu

SEQ ID NO: 2898553 - RNA, 21 nt, Mycobacterium avium subsp. paratuberculosis
cugggcggacgggaccacccg

SEQ ID NO: 2898554 - RNA, 15 nt, Mycobacterium avium subsp. paratuberculosis
cugggcggcaccacc

SEQ ID NO: 2898555 - RNA, 18 nt, Mycobacterium avium subsp. paratuberculosis
cugggcggcaccacccgg

SEQ ID NO: 2898556 - RNA, 15 nt, Mycobacterium avium subsp. paratuberculosis
cugggcggccugcac

SEQ ID NO: 2898557 - RNA, 20 nt, Mycobacterium avium subsp. paratuberculosis
cugggcggcgacaucgccga

SEQ ID NO: 2898558 - RNA, 16 nt, Mycobacterium avium subsp. paratuberculosis
cugggcggcgcgcugc

SEQ ID NO: 2898559 - RNA, 14 nt, Mycobacterium avium subsp. paratuberculosis
cugggcggcgcggc

SEQ ID NO: 2898560 - RNA, 15 nt, Mycobacterium avium subsp. paratuberculosis
cugggcggcgcggcg

SEQ ID NO: 2898561 - RNA, 17 nt, Mycobacterium avium subsp. paratuberculosis
cugggcggcggcgggaa

SEQ ID NO: 2898562 - RNA, 13 nt, Mycobacterium avium subsp. paratuberculosis
cugggcgggcagc

SEQ ID NO: 2898563 - RNA, 16 nt, Mycobacterium avium subsp. paratuberculosis
cugggcgggcagccgc

SEQ ID NO: 2898564 - RNA, 13 nt, Mycobacterium avium subsp. paratuberculosis
cugggcguacagc

SEQ ID NO: 2898565 - RNA, 19 nt, Mycobacterium avium subsp. paratuberculosis
cugggcguacugcucggcg

SEQ ID NO: 2898566 - RNA, 21 nt, Mycobacterium avium subsp. paratuberculosis
cugggcgucgucggccggcuc

SEQ ID NO: 2898567 - RNA, 18 nt, Mycobacterium avium subsp. paratuberculosis
cugggcguggugcggugc

SEQ ID NO: 2898568 - RNA, 23 nt, Mycobacterium avium subsp. paratuberculosis
cugggcguggugcggugcaccgc

SEQ ID NO: 2898569 - RNA, 15 nt, Mycobacterium avium subsp. paratuberculosis
cugggcguugccggu

SEQ ID NO: 2898570 - RNA, 16 nt, Mycobacterium avium subsp. paratuberculosis
cugggcguugccgguc

SEQ ID NO: 2898571 - RNA, 20 nt, Mycobacterium avium subsp. paratuberculosis
cugggcuaccagccccagga

SEQ ID NO: 2898572 - RNA, 23 nt, Mycobacterium avium subsp. paratuberculosis
cugggcuaccagccccaggaggc

SEQ ID NO: 2898573 - RNA, 15 nt, Mycobacterium avium subsp. paratuberculosis
cugggcuccgaccgu

SEQ ID NO: 2898574 - RNA, 20 nt, Mycobacterium avium subsp. paratuberculosis
cugggcucgagugccggcag

SEQ ID NO: 2898575 - RNA, 17 nt, Mycobacterium avium subsp. paratuberculosis
cuggggcagaucgucgg

SEQ ID NO: 2898576 - RNA, 19 nt, Mycobacterium avium subsp. paratuberculosis
cuggggcagaucgucggca

SEQ ID NO: 2898577 - RNA, 24 nt, Mycobacterium avium subsp. paratuberculosis
cuggggcagaucgucggcacugcc

SEQ ID NO: 2898578 - RNA, 12 nt, Mycobacterium avium subsp. paratuberculosis
cuggggcccagc

SEQ ID NO: 2898579 - RNA, 19 nt, Mycobacterium avium subsp. paratuberculosis
cuggggguggcgucgacgg

SEQ ID NO: 2898580 - RNA, 17 nt, Mycobacterium avium subsp. paratuberculosis
cugggguaguucugcuc

SEQ ID NO: 2898581 - RNA, 17 nt, Mycobacterium avium subsp. paratuberculosis
cuggggucggccagcga

SEQ ID NO: 2898582 - RNA, 17 nt, Mycobacterium avium subsp. paratuberculosis
cuggggugcccaccagc

SEQ ID NO: 2898583 - RNA, 19 nt, Mycobacterium avium subsp. paratuberculosis
cuggggugcccaccagcau

SEQ ID NO: 2898584 - RNA, 18 nt, Mycobacterium avium subsp. paratuberculosis
cuggguaagccaggucac

SEQ ID NO: 2898585 - RNA, 14 nt, Mycobacterium avium subsp. paratuberculosis
cuggguacgaaccu

SEQ ID NO: 2898586 - RNA, 22 nt, Mycobacterium avium subsp. paratuberculosis
cugggucaaaacaacgcgcagc

SEQ ID NO: 2898587 - RNA, 18 nt, Mycobacterium avium subsp. paratuberculosis
cugggucaccacggucac

SEQ ID NO: 2898588 - RNA, 17 nt, Mycobacterium avium subsp. paratuberculosis
cugggucaccgucacgu

SEQ ID NO: 2898589 - RNA, 12 nt, Mycobacterium avium subsp. paratuberculosis
cugggucacgcu

SEQ ID NO: 2898590 - RNA, 15 nt, Mycobacterium avium subsp. paratuberculosis
cugggucacgcugaa

SEQ ID NO: 2898591 - RNA, 22 nt, Mycobacterium avium subsp. paratuberculosis
cuggguccgauuucccgacucc

SEQ ID NO: 2898592 - RNA, 15 nt, Mycobacterium avium subsp. paratuberculosis
cugggucggucccga

SEQ ID NO: 2898593 - RNA, 20 nt, Mycobacterium avium subsp. paratuberculosis
cugggucucgggaucgccga

SEQ ID NO: 2898594 - RNA, 15 nt, Mycobacterium avium subsp. paratuberculosis
cugggucugcggccg

SEQ ID NO: 2898595 - RNA, 14 nt, Mycobacterium avium subsp. paratuberculosis
cugggugaccgagu

SEQ ID NO: 2898596 - RNA, 17 nt, Mycobacterium avium subsp. paratuberculosis
cugggugagcgacacca

SEQ ID NO: 2898597 - RNA, 19 nt, Mycobacterium avium subsp. paratuberculosis
cugggugccccgccguuuc

SEQ ID NO: 2898598 - RNA, 14 nt, Mycobacterium avium subsp. paratuberculosis
cugggugcgcggcg

SEQ ID NO: 2898599 - RNA, 16 nt, Mycobacterium avium subsp. paratuberculosis
cugggugcgcgggcgc

SEQ ID NO: 2898600 - RNA, 21 nt, Mycobacterium avium subsp. paratuberculosis
cuggguggcgaaaccaacacc

SEQ ID NO: 2898601 - RNA, 13 nt, Mycobacterium avium subsp. paratuberculosis
cugggugggugcg

SEQ ID NO: 2898602 - RNA, 15 nt, Mycobacterium avium subsp. paratuberculosis
cugggugggugcggu

SEQ ID NO: 2898603 - RNA, 22 nt, Mycobacterium avium subsp. paratuberculosis
cugggugggugcggugcggccg

SEQ ID NO: 2898604 - RNA, 17 nt, Mycobacterium avium subsp. paratuberculosis
cuggguggucaccagcg

SEQ ID NO: 2898605 - RNA, 16 nt, Mycobacterium avium subsp. paratuberculosis
cuggguguaaccggcu

SEQ ID NO: 2898606 - RNA, 17 nt, Mycobacterium avium subsp. paratuberculosis
cuggguguaaccggcuu

SEQ ID NO: 2898607 - RNA, 20 nt, Mycobacterium avium subsp. paratuberculosis
cuggguguuccccgggcgag

SEQ ID NO: 2898608 - RNA, 17 nt, Mycobacterium avium subsp. paratuberculosis
cuggguuccgcgagacg

SEQ ID NO: 2898609 - RNA, 22 nt, Mycobacterium avium subsp. paratuberculosis
cuggguuccgcgagacguaagc

SEQ ID NO: 2898610 - RNA, 20 nt, Mycobacterium avium subsp. paratuberculosis
cugguacagcaccgccgcgg

SEQ ID NO: 2898611 - RNA, 17 nt, Mycobacterium avium subsp. paratuberculosis
cugguacgcgccgucgu

SEQ ID NO: 2898612 - RNA, 19 nt, Mycobacterium avium subsp. paratuberculosis
cugguacgcgccgucgucg

SEQ ID NO: 2898613 - RNA, 14 nt, Mycobacterium avium subsp. paratuberculosis
cugguagaugccga

SEQ ID NO: 2898614 - RNA, 18 nt, Mycobacterium avium subsp. paratuberculosis
cugguagaugguggccgu

SEQ ID NO: 2898615 - RNA, 14 nt, Mycobacterium avium subsp. paratuberculosis
cugguaggcggccg

SEQ ID NO: 2898616 - RNA, 22 nt, Mycobacterium avium subsp. paratuberculosis
cugguaggcggcgcagccagcg

SEQ ID NO: 2898617 - RNA, 22 nt, Mycobacterium avium subsp. paratuberculosis
cugguagggguccuccagcggc

SEQ ID NO: 2898618 - RNA, 17 nt, Mycobacterium avium subsp. paratuberculosis
cugguaguacaccgggc

SEQ ID NO: 2898619 - RNA, 16 nt, Mycobacterium avium subsp. paratuberculosis
cugguaguggcgugcg

SEQ ID NO: 2898620 - RNA, 24 nt, Mycobacterium avium subsp. paratuberculosis
cugguaugccuuggcccgcgcggc

SEQ ID NO: 2898621 - RNA, 21 nt, Mycobacterium avium subsp. paratuberculosis
cuggucaacucgacccgcacc

SEQ ID NO: 2898622 - RNA, 22 nt, Mycobacterium avium subsp. paratuberculosis
cuggucaacucgacccgcaccu

SEQ ID NO: 2898623 - RNA, 13 nt, Mycobacterium avium subsp. paratuberculosis
cuggucaaggugc

SEQ ID NO: 2898624 - RNA, 17 nt, Mycobacterium avium subsp. paratuberculosis
cuggucaaggugcugaa

SEQ ID NO: 2898625 - RNA, 15 nt, Mycobacterium avium subsp. paratuberculosis
cuggucacacccuug

SEQ ID NO: 2898626 - RNA, 21 nt, Mycobacterium avium subsp. paratuberculosis
cuggucacccacuggcggccg

SEQ ID NO: 2898627 - RNA, 23 nt, Mycobacterium avium subsp. paratuberculosis
cuggucacccacuggcggccggc

SEQ ID NO: 2898628 - RNA, 16 nt, Mycobacterium avium subsp. paratuberculosis
cugguccaccgcggcg

SEQ ID NO: 2898629 - RNA, 18 nt, Mycobacterium avium subsp. paratuberculosis
cugguccaccgcggcggc

SEQ ID NO: 2898630 - RNA, 13 nt, Mycobacterium avium subsp. paratuberculosis
cugguccagcgug

SEQ ID NO: 2898631 - RNA, 14 nt, Mycobacterium avium subsp. paratuberculosis
cugguccagcgugc

SEQ ID NO: 2898632 - RNA, 14 nt, Mycobacterium avium subsp. paratuberculosis
cuggucccacagcg

SEQ ID NO: 2898633 - RNA, 18 nt, Mycobacterium avium subsp. paratuberculosis
cugguccggaaccgcgcc

SEQ ID NO: 2898634 - RNA, 14 nt, Mycobacterium avium subsp. paratuberculosis
cugguccggccggc

SEQ ID NO: 2898635 - RNA, 21 nt, Mycobacterium avium subsp. paratuberculosis
cugguccuccaacggcaccac

SEQ ID NO: 2898636 - RNA, 16 nt, Mycobacterium avium subsp. paratuberculosis
cuggucgaacagcacg

SEQ ID NO: 2898637 - RNA, 21 nt, Mycobacterium avium subsp. paratuberculosis
cuggucgaacagcacgccggc

SEQ ID NO: 2898638 - RNA, 22 nt, Mycobacterium avium subsp. paratuberculosis
cuggucgaacagcacgccggcc

SEQ ID NO: 2898639 - RNA, 23 nt, Mycobacterium avium subsp. paratuberculosis
cuggucgaacagcacgccggccg

SEQ ID NO: 2898640 - RNA, 15 nt, Mycobacterium avium subsp. paratuberculosis
cuggucgaacagcgc

SEQ ID NO: 2898641 - RNA, 18 nt, Mycobacterium avium subsp. paratuberculosis
cuggucgaacagcgcgcc

SEQ ID NO: 2898642 - RNA, 22 nt, Mycobacterium avium subsp. paratuberculosis
cuggucgaaccgcgagcgcgcg

SEQ ID NO: 2898643 - RNA, 23 nt, Mycobacterium avium subsp. paratuberculosis
cuggucgaaccgcgagcgcgcgg

SEQ ID NO: 2898644 - RNA, 23 nt, Mycobacterium avium subsp. paratuberculosis
cuggucgaacgccaccuucaccg

SEQ ID NO: 2898645 - RNA, 17 nt, Mycobacterium avium subsp. paratuberculosis
cuggucgaagauggcca

SEQ ID NO: 2898646 - RNA, 23 nt, Mycobacterium avium subsp. paratuberculosis
cuggucgaagauggccagguagu

SEQ ID NO: 2898647 - RNA, 19 nt, Mycobacterium avium subsp. paratuberculosis
cuggucgacgucauccggc

SEQ ID NO: 2898648 - RNA, 19 nt, Mycobacterium avium subsp. paratuberculosis
cuggucgcccaccacgacg

SEQ ID NO: 2898649 - RNA, 23 nt, Mycobacterium avium subsp. paratuberculosis
cuggucgccgaacgugcgcggcg

SEQ ID NO: 2898650 - RNA, 23 nt, Mycobacterium avium subsp. paratuberculosis
cuggucgcuuucggugaccauca

SEQ ID NO: 2898651 - RNA, 14 nt, Mycobacterium avium subsp. paratuberculosis
cuggucggccagcg

SEQ ID NO: 2898652 - RNA, 16 nt, Mycobacterium avium subsp. paratuberculosis
cuggucggccagcgcg

SEQ ID NO: 2898653 - RNA, 13 nt, Mycobacterium avium subsp. paratuberculosis
cuggucggccagg

SEQ ID NO: 2898654 - RNA, 16 nt, Mycobacterium avium subsp. paratuberculosis
cuggucggccagggcg

SEQ ID NO: 2898655 - RNA, 17 nt, Mycobacterium avium subsp. paratuberculosis
cuggucggccggcaggc

SEQ ID NO: 2898656 - RNA, 13 nt, Mycobacterium avium subsp. paratuberculosis
cuggucggcgggc

SEQ ID NO: 2898657 - RNA, 17 nt, Mycobacterium avium subsp. paratuberculosis
cuggucggucagcucga

SEQ ID NO: 2898658 - RNA, 23 nt, Mycobacterium avium subsp. paratuberculosis
cuggucgucccaggguuggucgg

SEQ ID NO: 2898659 - RNA, 14 nt, Mycobacterium avium subsp. paratuberculosis
cuggucgucgagcu

SEQ ID NO: 2898660 - RNA, 17 nt, Mycobacterium avium subsp. paratuberculosis
cuggucgucgagcugac

SEQ ID NO: 2898661 - RNA, 16 nt, Mycobacterium avium subsp. paratuberculosis
cuggucgugcagcacc

SEQ ID NO: 2898662 - RNA, 21 nt, Mycobacterium avium subsp. paratuberculosis
cuggucucgggcaccacgccg

SEQ ID NO: 2898663 - RNA, 19 nt, Mycobacterium avium subsp. paratuberculosis
cuggugaaguucuccagca

SEQ ID NO: 2898664 - RNA, 21 nt, Mycobacterium avium subsp. paratuberculosis
cuggugaaguucuccagcacg

SEQ ID NO: 2898665 - RNA, 16 nt, Mycobacterium avium subsp. paratuberculosis
cuggugaccgacgacg

SEQ ID NO: 2898666 - RNA, 20 nt, Mycobacterium avium subsp. paratuberculosis
cuggugauagaucaucccgg

SEQ ID NO: 2898667 - RNA, 21 nt, Mycobacterium avium subsp. paratuberculosis
cuggugauagaucaucccggc

SEQ ID NO: 2898668 - RNA, 22 nt, Mycobacterium avium subsp. paratuberculosis
cuggugauccucgucuccggcg

SEQ ID NO: 2898669 - RNA, 13 nt, Mycobacterium avium subsp. paratuberculosis
cuggugcaccagg

SEQ ID NO: 2898670 - RNA, 20 nt, Mycobacterium avium subsp. paratuberculosis
cuggugcagcagggcgcgca

SEQ ID NO: 2898671 - RNA, 23 nt, Mycobacterium avium subsp. paratuberculosis
cuggugcagcagggcgcgcaucu

SEQ ID NO: 2898672 - RNA, 14 nt, Mycobacterium avium subsp. paratuberculosis
cuggugccgccgau

SEQ ID NO: 2898673 - RNA, 21 nt, Mycobacterium avium subsp. paratuberculosis
cuggugccgccgaugacggcg

SEQ ID NO: 2898674 - RNA, 15 nt, Mycobacterium avium subsp. paratuberculosis
cuggugccgccggcg

SEQ ID NO: 2898675 - RNA, 14 nt, Mycobacterium avium subsp. paratuberculosis
cuggugcgcagccg

SEQ ID NO: 2898676 - RNA, 14 nt, Mycobacterium avium subsp. paratuberculosis
cuggugcgcgccgg

SEQ ID NO: 2898677 - RNA, 16 nt, Mycobacterium avium subsp. paratuberculosis
cuggugcgcgccggcg

SEQ ID NO: 2898678 - RNA, 13 nt, Mycobacterium avium subsp. paratuberculosis
cuggugcgcgcgc

SEQ ID NO: 2898679 - RNA, 14 nt, Mycobacterium avium subsp. paratuberculosis
cuggugcggaugau

SEQ ID NO: 2898680 - RNA, 15 nt, Mycobacterium avium subsp. paratuberculosis
cuggugcgggccagc

SEQ ID NO: 2898681 - RNA, 13 nt, Mycobacterium avium subsp. paratuberculosis
cuggugcucgcgc

SEQ ID NO: 2898682 - RNA, 22 nt, Mycobacterium avium subsp. paratuberculosis
cuggugcugcugccccucgacg

SEQ ID NO: 2898683 - RNA, 15 nt, Mycobacterium avium subsp. paratuberculosis
cugguggcagcggac

SEQ ID NO: 2898684 - RNA, 14 nt, Mycobacterium avium subsp. paratuberculosis
cugguggcccaggc

SEQ ID NO: 2898685 - RNA, 19 nt, Mycobacterium avium subsp. paratuberculosis
cugguggcccaggcagacc

SEQ ID NO: 2898686 - RNA, 15 nt, Mycobacterium avium subsp. paratuberculosis
cuggugggccaucgc

SEQ ID NO: 2898687 - RNA, 14 nt, Mycobacterium avium subsp. paratuberculosis
cuggugggugugcg

SEQ ID NO: 2898688 - RNA, 15 nt, Mycobacterium avium subsp. paratuberculosis
cugguggugaucggc

SEQ ID NO: 2898689 - RNA, 20 nt, Mycobacterium avium subsp. paratuberculosis
cugguggugaucggccaggc

SEQ ID NO: 2898690 - RNA, 13 nt, Mycobacterium avium subsp. paratuberculosis
cuggugugacgcu

SEQ ID NO: 2898691 - RNA, 15 nt, Mycobacterium avium subsp. paratuberculosis
cuggugugacgcucg

SEQ ID NO: 2898692 - RNA, 17 nt, Mycobacterium avium subsp. paratuberculosis
cugguucaccgccacca

SEQ ID NO: 2898693 - RNA, 21 nt, Mycobacterium avium subsp. paratuberculosis
cugguucaccgccaccagcag

SEQ ID NO: 2898694 - RNA, 23 nt, Mycobacterium avium subsp. paratuberculosis
cugguucaccgccaccagcaggc

SEQ ID NO: 2898695 - RNA, 14 nt, Mycobacterium avium subsp. paratuberculosis
cugguucgacguga

SEQ ID NO: 2898696 - RNA, 18 nt, Mycobacterium avium subsp. paratuberculosis
cugguugacgccgaugcg

SEQ ID NO: 2898697 - RNA, 17 nt, Mycobacterium avium subsp. paratuberculosis
cugguugagcaccgcga

SEQ ID NO: 2898698 - RNA, 17 nt, Mycobacterium avium subsp. paratuberculosis
cugguugauccagcggc

SEQ ID NO: 2898699 - RNA, 18 nt, Mycobacterium avium subsp. paratuberculosis
cugguugauccagcggcg

SEQ ID NO: 2898700 - RNA, 22 nt, Mycobacterium avium subsp. paratuberculosis
cugguuggcccgcaccacccag

SEQ ID NO: 2898701 - RNA, 16 nt, Mycobacterium avium subsp. paratuberculosis
cugguuggccggcggg

SEQ ID NO: 2898702 - RNA, 13 nt, Mycobacterium avium subsp. paratuberculosis
cugguugucgacg

SEQ ID NO: 2898703 - RNA, 17 nt, Mycobacterium avium subsp. paratuberculosis
cugguugucgacgcugc

SEQ ID NO: 2898704 - RNA, 20 nt, Mycobacterium avium subsp. paratuberculosis
cugguuucggggguaaaccg

SEQ ID NO: 2898705 - RNA, 23 nt, Mycobacterium avium subsp. paratuberculosis
cugguuuuacacaccagcggucg

SEQ ID NO: 2898706 - RNA, 17 nt, Mycobacterium avium subsp. paratuberculosis
cuguaccgcgagaucag

SEQ ID NO: 2898707 - RNA, 16 nt, Mycobacterium avium subsp. paratuberculosis
cuguacgacaacagug

SEQ ID NO: 2898708 - RNA, 22 nt, Mycobacterium avium subsp. paratuberculosis
cuguacuggggugucagcgcga

SEQ ID NO: 2898709 - RNA, 23 nt, Mycobacterium avium subsp. paratuberculosis
cuguacuggggugucagcgcgac

SEQ ID NO: 2898710 - RNA, 20 nt, Mycobacterium avium subsp. paratuberculosis
cuguagcucacggugucggc

SEQ ID NO: 2898711 - RNA, 22 nt, Mycobacterium avium subsp. paratuberculosis
cuguagcucacggugucggcgg

SEQ ID NO: 2898712 - RNA, 15 nt, Mycobacterium avium subsp. paratuberculosis
cuguaggccagcccg

SEQ ID NO: 2898713 - RNA, 22 nt, Mycobacterium avium subsp. paratuberculosis
cuguaggccagcccggcgugca

SEQ ID NO: 2898714 - RNA, 15 nt, Mycobacterium avium subsp. paratuberculosis
cuguaggccagccgg

SEQ ID NO: 2898715 - RNA, 17 nt, Mycobacterium avium subsp. paratuberculosis
cuguaggcggcgugcca

SEQ ID NO: 2898716 - RNA, 12 nt, Mycobacterium avium subsp. paratuberculosis
cuguagggccac

SEQ ID NO: 2898717 - RNA, 14 nt, Mycobacterium avium subsp. paratuberculosis
cuguagggccacca

SEQ ID NO: 2898718 - RNA, 21 nt, Mycobacterium avium subsp. paratuberculosis
cuguagggccaccacgccagc

SEQ ID NO: 2898719 - RNA, 23 nt, Mycobacterium avium subsp. paratuberculosis
cuguagggccaccacgccagccu

SEQ ID NO: 2898720 - RNA, 18 nt, Mycobacterium avium subsp. paratuberculosis
cuguagggcgagcucguu

SEQ ID NO: 2898721 - RNA, 21 nt, Mycobacterium avium subsp. paratuberculosis
cuguaguagccggggacggug

SEQ ID NO: 2898722 - RNA, 21 nt, Mycobacterium avium subsp. paratuberculosis
cuguauuaagcuggcaggguu

SEQ ID NO: 2898723 - RNA, 21 nt, Mycobacterium avium subsp. paratuberculosis
cugucaacgagacacccucgc

SEQ ID NO: 2898724 - RNA, 22 nt, Mycobacterium avium subsp. paratuberculosis
cugucaguuugcgcgacgggcg

SEQ ID NO: 2898725 - RNA, 13 nt, Mycobacterium avium subsp. paratuberculosis
cuguccaccugca

SEQ ID NO: 2898726 - RNA, 17 nt, Mycobacterium avium subsp. paratuberculosis
cuguccacguccugcca

SEQ ID NO: 2898727 - RNA, 13 nt, Mycobacterium avium subsp. paratuberculosis
cuguccagcagcg

SEQ ID NO: 2898728 - RNA, 16 nt, Mycobacterium avium subsp. paratuberculosis
cuguccaggccgaggc

SEQ ID NO: 2898729 - RNA, 18 nt, Mycobacterium avium subsp. paratuberculosis
cuguccaggccgaggcug

SEQ ID NO: 2898730 - RNA, 16 nt, Mycobacterium avium subsp. paratuberculosis
cugucccggccgcgac

SEQ ID NO: 2898731 - RNA, 19 nt, Mycobacterium avium subsp. paratuberculosis
cugucccggccgcgacagc

SEQ ID NO: 2898732 - RNA, 22 nt, Mycobacterium avium subsp. paratuberculosis
cuguccgcgugaaugcccagcg

SEQ ID NO: 2898733 - RNA, 16 nt, Mycobacterium avium subsp. paratuberculosis
cuguccgggucguagc

SEQ ID NO: 2898734 - RNA, 21 nt, Mycobacterium avium subsp. paratuberculosis
cuguccggucucggucgcggc

SEQ ID NO: 2898735 - RNA, 22 nt, Mycobacterium avium subsp. paratuberculosis
cuguccggucuucucggccagg

SEQ ID NO: 2898736 - RNA, 19 nt, Mycobacterium avium subsp. paratuberculosis
cuguccucgagcgcgucga

SEQ ID NO: 2898737 - RNA, 18 nt, Mycobacterium avium subsp. paratuberculosis
cuguccugccgggcgucg

SEQ ID NO: 2898738 - RNA, 21 nt, Mycobacterium avium subsp. paratuberculosis
cuguccugccgggcgucgacg

SEQ ID NO: 2898739 - RNA, 20 nt, Mycobacterium avium subsp. paratuberculosis
cuguccugcgguucgggccc

SEQ ID NO: 2898740 - RNA, 21 nt, Mycobacterium avium subsp. paratuberculosis
cuguccugcgguucgggcccc

SEQ ID NO: 2898741 - RNA, 22 nt, Mycobacterium avium subsp. paratuberculosis
cuguccugcgguucgggcccca

SEQ ID NO: 2898742 - RNA, 12 nt, Mycobacterium avium subsp. paratuberculosis
cugucgaacacc

SEQ ID NO: 2898743 - RNA, 18 nt, Mycobacterium avium subsp. paratuberculosis
cugucgaacaccgugccg

SEQ ID NO: 2898744 - RNA, 19 nt, Mycobacterium avium subsp. paratuberculosis
cugucgcccucgaucgcga

SEQ ID NO: 2898745 - RNA, 19 nt, Mycobacterium avium subsp. paratuberculosis
cugucgccgagguccucga

SEQ ID NO: 2898746 - RNA, 13 nt, Mycobacterium avium subsp. paratuberculosis
cugucgcgggccc

SEQ ID NO: 2898747 - RNA, 14 nt, Mycobacterium avium subsp. paratuberculosis
cugucgcgggucug

SEQ ID NO: 2898748 - RNA, 20 nt, Mycobacterium avium subsp. paratuberculosis
cugucgcgggucuggcucgg

SEQ ID NO: 2898749 - RNA, 21 nt, Mycobacterium avium subsp. paratuberculosis
cugucgcgggucuggcucggc

SEQ ID NO: 2898750 - RNA, 19 nt, Mycobacterium avium subsp. paratuberculosis
cugucggaggccuccaggc

SEQ ID NO: 2898751 - RNA, 18 nt, Mycobacterium avium subsp. paratuberculosis
cugucggcgaaacaccaa

SEQ ID NO: 2898752 - RNA, 13 nt, Mycobacterium avium subsp. paratuberculosis
cugucggcgccca

SEQ ID NO: 2898753 - RNA, 17 nt, Mycobacterium avium subsp. paratuberculosis
cugucggcgccccgccc

SEQ ID NO: 2898754 - RNA, 18 nt, Mycobacterium avium subsp. paratuberculosis
cugucggcgccccgcccg

SEQ ID NO: 2898755 - RNA, 13 nt, Mycobacterium avium subsp. paratuberculosis
cugucggcgcgga

SEQ ID NO: 2898756 - RNA, 15 nt, Mycobacterium avium subsp. paratuberculosis
cugucggcucgcccg

SEQ ID NO: 2898757 - RNA, 21 nt, Mycobacterium avium subsp. paratuberculosis
cugucggggaccguccccguc

SEQ ID NO: 2898758 - RNA, 19 nt, Mycobacterium avium subsp. paratuberculosis
cugucguagcggcccaggu

SEQ ID NO: 2898759 - RNA, 17 nt, Mycobacterium avium subsp. paratuberculosis
cugucgucgaccaacgc

SEQ ID NO: 2898760 - RNA, 13 nt, Mycobacterium avium subsp. paratuberculosis
cugucgucgcccu

SEQ ID NO: 2898761 - RNA, 22 nt, Mycobacterium avium subsp. paratuberculosis
cugucgucgcccugacacagca

SEQ ID NO: 2898762 - RNA, 17 nt, Mycobacterium avium subsp. paratuberculosis
cugucgucguccuccuc

SEQ ID NO: 2898763 - RNA, 15 nt, Mycobacterium avium subsp. paratuberculosis
cugugaccacgguca

SEQ ID NO: 2898764 - RNA, 16 nt, Mycobacterium avium subsp. paratuberculosis
cugugaccacggucac

SEQ ID NO: 2898765 - RNA, 22 nt, Mycobacterium avium subsp. paratuberculosis
cugugaggcaccgaacgccagc

SEQ ID NO: 2898766 - RNA, 22 nt, Mycobacterium avium subsp. paratuberculosis
cugugcgaacuccggugauuga

SEQ ID NO: 2898767 - RNA, 13 nt, Mycobacterium avium subsp. paratuberculosis
cugugcgacggcg

SEQ ID NO: 2898768 - RNA, 19 nt, Mycobacterium avium subsp. paratuberculosis
cugugcgaugucggugcga

SEQ ID NO: 2898769 - RNA, 21 nt, Mycobacterium avium subsp. paratuberculosis
cugugcgccauguccggcagg

SEQ ID NO: 2898770 - RNA, 23 nt, Mycobacterium avium subsp. paratuberculosis
cugugcgccccacggcgcgugcu

SEQ ID NO: 2898771 - RNA, 15 nt, Mycobacterium avium subsp. paratuberculosis
cugugcgccuugccg

SEQ ID NO: 2898772 - RNA, 21 nt, Mycobacterium avium subsp. paratuberculosis
cugugcgccuugccgucgagc

SEQ ID NO: 2898773 - RNA, 22 nt, Mycobacterium avium subsp. paratuberculosis
cugugcgccuugccgucgagca

SEQ ID NO: 2898774 - RNA, 13 nt, Mycobacterium avium subsp. paratuberculosis
cugugcggcccgg

SEQ ID NO: 2898775 - RNA, 18 nt, Mycobacterium avium subsp. paratuberculosis
cugugcgggugaggccag

SEQ ID NO: 2898776 - RNA, 22 nt, Mycobacterium avium subsp. paratuberculosis
cugugcgggugaggccaggcgu

SEQ ID NO: 2898777 - RNA, 16 nt, Mycobacterium avium subsp. paratuberculosis
cugugcugccugccgu

SEQ ID NO: 2898778 - RNA, 15 nt, Mycobacterium avium subsp. paratuberculosis
cuguggaacacgucg

SEQ ID NO: 2898779 - RNA, 23 nt, Mycobacterium avium subsp. paratuberculosis
cuguggaagggccccggcaucga

SEQ ID NO: 2898780 - RNA, 15 nt, Mycobacterium avium subsp. paratuberculosis
cuguggacaggucga

SEQ ID NO: 2898781 - RNA, 22 nt, Mycobacterium avium subsp. paratuberculosis
cuguggaucgugucuggccccg

SEQ ID NO: 2898782 - RNA, 23 nt, Mycobacterium avium subsp. paratuberculosis
cuguggaucgugucuggccccgu

SEQ ID NO: 2898783 - RNA, 15 nt, Mycobacterium avium subsp. paratuberculosis
cuguggaugacgcag

SEQ ID NO: 2898784 - RNA, 17 nt, Mycobacterium avium subsp. paratuberculosis
cugugggcgcagggccg

SEQ ID NO: 2898785 - RNA, 13 nt, Mycobacterium avium subsp. paratuberculosis
cugugggucgaca

SEQ ID NO: 2898786 - RNA, 12 nt, Mycobacterium avium subsp. paratuberculosis
cuguggugacgg

SEQ ID NO: 2898787 - RNA, 19 nt, Mycobacterium avium subsp. paratuberculosis
cugugguuuucgaaaccgg

SEQ ID NO: 2898788 - RNA, 13 nt, Mycobacterium avium subsp. paratuberculosis
cuguuacgcccga

SEQ ID NO: 2898789 - RNA, 19 nt, Mycobacterium avium subsp. paratuberculosis
cuguuagggcgaccaccac

SEQ ID NO: 2898790 - RNA, 16 nt, Mycobacterium avium subsp. paratuberculosis
cuguuccccggcgggc

SEQ ID NO: 2898791 - RNA, 20 nt, Mycobacterium avium subsp. paratuberculosis
cuguuccugguagucgucgu

SEQ ID NO: 2898792 - RNA, 15 nt, Mycobacterium avium subsp. paratuberculosis
cuguucgccgucgcg

SEQ ID NO: 2898793 - RNA, 15 nt, Mycobacterium avium subsp. paratuberculosis
cuguucgcggcuggc

SEQ ID NO: 2898794 - RNA, 18 nt, Mycobacterium avium subsp. paratuberculosis
cuguucgcggcuggccgc

SEQ ID NO: 2898795 - RNA, 23 nt, Mycobacterium avium subsp. paratuberculosis
cuguucggcggcgauccggccgg

SEQ ID NO: 2898796 - RNA, 20 nt, Mycobacterium avium subsp. paratuberculosis
cuguucgggcagauggucgc

SEQ ID NO: 2898797 - RNA, 23 nt, Mycobacterium avium subsp. paratuberculosis
cuguucguccgugcugccggccg

SEQ ID NO: 2898798 - RNA, 17 nt, Mycobacterium avium subsp. paratuberculosis
cuguugaccacggccug

SEQ ID NO: 2898799 - RNA, 17 nt, Mycobacterium avium subsp. paratuberculosis
cuguugacgggccgcgg

SEQ ID NO: 2898800 - RNA, 23 nt, Mycobacterium avium subsp. paratuberculosis
cuguugcacguaggcggcgagcu

SEQ ID NO: 2898801 - RNA, 21 nt, Mycobacterium avium subsp. paratuberculosis
cuguugccggacaccuggagu

SEQ ID NO: 2898802 - RNA, 17 nt, Mycobacterium avium subsp. paratuberculosis
cuguuggaaccggccac

SEQ ID NO: 2898803 - RNA, 19 nt, Mycobacterium avium subsp. paratuberculosis
cuguuggcgacggcgcugu

SEQ ID NO: 2898804 - RNA, 18 nt, Mycobacterium avium subsp. paratuberculosis
cuguugguagcccaggau

SEQ ID NO: 2898805 - RNA, 13 nt, Mycobacterium avium subsp. paratuberculosis
cuguugucccgga

SEQ ID NO: 2898806 - RNA, 14 nt, Mycobacterium avium subsp. paratuberculosis
cuguuugaacaccu

SEQ ID NO: 2898807 - RNA, 17 nt, Mycobacterium avium subsp. paratuberculosis
cuguuugaugccgucgg

SEQ ID NO: 2898808 - RNA, 14 nt, Mycobacterium avium subsp. paratuberculosis
cuguuuggccagcc

SEQ ID NO: 2898809 - RNA, 23 nt, Mycobacterium avium subsp. paratuberculosis
cuuaacuucacgcucggcgagca

SEQ ID NO: 2898810 - RNA, 14 nt, Mycobacterium avium subsp. paratuberculosis
cuuaccgaccucga

SEQ ID NO: 2898811 - RNA, 15 nt, Mycobacterium avium subsp. paratuberculosis
cuuaccggccggccg

SEQ ID NO: 2898812 - RNA, 18 nt, Mycobacterium avium subsp. paratuberculosis
cuuaccggcgggcggcgg

SEQ ID NO: 2898813 - RNA, 14 nt, Mycobacterium avium subsp. paratuberculosis
cuuacgcaucgccg

SEQ ID NO: 2898814 - RNA, 18 nt, Mycobacterium avium subsp. paratuberculosis
cuuacgccggggucgaca

SEQ ID NO: 2898815 - RNA, 15 nt, Mycobacterium avium subsp. paratuberculosis
cuuagccccucccac

SEQ ID NO: 2898816 - RNA, 17 nt, Mycobacterium avium subsp. paratuberculosis
cuuagcccggccgcggc

SEQ ID NO: 2898817 - RNA, 19 nt, Mycobacterium avium subsp. paratuberculosis
cuuagcccggccgcggccc

SEQ ID NO: 2898818 - RNA, 14 nt, Mycobacterium avium subsp. paratuberculosis
cuucaaaaaccugu

SEQ ID NO: 2898819 - RNA, 16 nt, Mycobacterium avium subsp. paratuberculosis
cuucaacuugcgcgac

SEQ ID NO: 2898820 - RNA, 15 nt, Mycobacterium avium subsp. paratuberculosis
cuucacaggccgccu

SEQ ID NO: 2898821 - RNA, 22 nt, Mycobacterium avium subsp. paratuberculosis
cuucaccagggugccccgcgac

SEQ ID NO: 2898822 - RNA, 18 nt, Mycobacterium avium subsp. paratuberculosis
cuucaccgaccagcuguu

SEQ ID NO: 2898823 - RNA, 17 nt, Mycobacterium avium subsp. paratuberculosis
cuucaccgcgccggucc

SEQ ID NO: 2898824 - RNA, 22 nt, Mycobacterium avium subsp. paratuberculosis
cuucacgaagugcccggcgccg

SEQ ID NO: 2898825 - RNA, 19 nt, Mycobacterium avium subsp. paratuberculosis
cuucacgaccggcagcacc

SEQ ID NO: 2898826 - RNA, 21 nt, Mycobacterium avium subsp. paratuberculosis
cuucacgcucgcaggcgagcc

SEQ ID NO: 2898827 - RNA, 24 nt, Mycobacterium avium subsp. paratuberculosis
cuucacgcucgcgugcgaacguga

SEQ ID NO: 2898828 - RNA, 13 nt, Mycobacterium avium subsp. paratuberculosis
cuucacgcucggc

SEQ ID NO: 2898829 - RNA, 15 nt, Mycobacterium avium subsp. paratuberculosis
cuucacgcucggcag

SEQ ID NO: 2898830 - RNA, 17 nt, Mycobacterium avium subsp. paratuberculosis
cuucacgcucggcgccg

SEQ ID NO: 2898831 - RNA, 20 nt, Mycobacterium avium subsp. paratuberculosis
cuucacgcucggcgccgagc

SEQ ID NO: 2898832 - RNA, 12 nt, Mycobacterium avium subsp. paratuberculosis
cuucacgcuggc

SEQ ID NO: 2898833 - RNA, 13 nt, Mycobacterium avium subsp. paratuberculosis
cuucacgcuggcc

SEQ ID NO: 2898834 - RNA, 23 nt, Mycobacterium avium subsp. paratuberculosis
cuucacgcuggccuccagcuuug

SEQ ID NO: 2898835 - RNA, 19 nt, Mycobacterium avium subsp. paratuberculosis
cuucacggucggagcccag

SEQ ID NO: 2898836 - RNA, 15 nt, Mycobacterium avium subsp. paratuberculosis
cuucagcgcgacagc

SEQ ID NO: 2898837 - RNA, 14 nt, Mycobacterium avium subsp. paratuberculosis
cuucaggcagcgca

SEQ ID NO: 2898838 - RNA, 16 nt, Mycobacterium avium subsp. paratuberculosis
cuucaggcagcgcacg

SEQ ID NO: 2898839 - RNA, 21 nt, Mycobacterium avium subsp. paratuberculosis
cuucaggcagcgcacgaugug

SEQ ID NO: 2898840 - RNA, 21 nt, Mycobacterium avium subsp. paratuberculosis
cuucaggcccucaucgucgac

SEQ ID NO: 2898841 - RNA, 19 nt, Mycobacterium avium subsp. paratuberculosis
cuucagggcggugcggugc

SEQ ID NO: 2898842 - RNA, 19 nt, Mycobacterium avium subsp. paratuberculosis
cuucagugaaccccgggcu

SEQ ID NO: 2898843 - RNA, 16 nt, Mycobacterium avium subsp. paratuberculosis
cuucauaugacgccgg

SEQ ID NO: 2898844 - RNA, 20 nt, Mycobacterium avium subsp. paratuberculosis
cuucauaugacgccggccuc

SEQ ID NO: 2898845 - RNA, 10 nt, Mycobacterium avium subsp. paratuberculosis
cuucaucacc

SEQ ID NO: 2898846 - RNA, 15 nt, Mycobacterium avium subsp. paratuberculosis
cuucaucgaucgggu

SEQ ID NO: 2898847 - RNA, 14 nt, Mycobacterium avium subsp. paratuberculosis
cuucauggucgucg

SEQ ID NO: 2898848 - RNA, 14 nt, Mycobacterium avium subsp. paratuberculosis
cuucauguaccggu

SEQ ID NO: 2898849 - RNA, 20 nt, Mycobacterium avium subsp. paratuberculosis
cuuccaccaccgcggcgccg

SEQ ID NO: 2898850 - RNA, 14 nt, Mycobacterium avium subsp. paratuberculosis
cuuccacgaccugg

SEQ ID NO: 2898851 - RNA, 14 nt, Mycobacterium avium subsp. paratuberculosis
cuuccagcaccggc

SEQ ID NO: 2898852 - RNA, 23 nt, Mycobacterium avium subsp. paratuberculosis
cuuccagcccguugucgagcacc

SEQ ID NO: 2898853 - RNA, 15 nt, Mycobacterium avium subsp. paratuberculosis
cuuccagcgcggcga

SEQ ID NO: 2898854 - RNA, 16 nt, Mycobacterium avium subsp. paratuberculosis
cuuccaucacgccccg

SEQ ID NO: 2898855 - RNA, 16 nt, Mycobacterium avium subsp. paratuberculosis
cuuccaucgacgcuga

SEQ ID NO: 2898856 - RNA, 18 nt, Mycobacterium avium subsp. paratuberculosis
cuucccaaccccgggcgg

SEQ ID NO: 2898857 - RNA, 20 nt, Mycobacterium avium subsp. paratuberculosis
cuucccaaccccgggcggcu

SEQ ID NO: 2898858 - RNA, 21 nt, Mycobacterium avium subsp. paratuberculosis
cuucccaaccccgggcggcuc

SEQ ID NO: 2898859 - RNA, 18 nt, Mycobacterium avium subsp. paratuberculosis
cuucccacagucgcuggg

SEQ ID NO: 2898860 - RNA, 13 nt, Mycobacterium avium subsp. paratuberculosis
cuucccacccggu

SEQ ID NO: 2898861 - RNA, 19 nt, Mycobacterium avium subsp. paratuberculosis
cuucccacgccuugcgguu

SEQ ID NO: 2898862 - RNA, 19 nt, Mycobacterium avium subsp. paratuberculosis
cuucccagugccgcaggug

SEQ ID NO: 2898863 - RNA, 14 nt, Mycobacterium avium subsp. paratuberculosis
cuuccccggcggcc

SEQ ID NO: 2898864 - RNA, 13 nt, Mycobacterium avium subsp. paratuberculosis
cuucccgccgccg

SEQ ID NO: 2898865 - RNA, 12 nt, Mycobacterium avium subsp. paratuberculosis
cuucccggccgc

SEQ ID NO: 2898866 - RNA, 14 nt, Mycobacterium avium subsp. paratuberculosis
cuucccggccgcca

SEQ ID NO: 2898867 - RNA, 18 nt, Mycobacterium avium subsp. paratuberculosis
cuuccgaaccgcacgagc

SEQ ID NO: 2898868 - RNA, 19 nt, Mycobacterium avium subsp. paratuberculosis
cuuccgagacguggucggg

SEQ ID NO: 2898869 - RNA, 15 nt, Mycobacterium avium subsp. paratuberculosis
cuuccgagccgguga

SEQ ID NO: 2898870 - RNA, 17 nt, Mycobacterium avium subsp. paratuberculosis
cuuccgagccggugaug

SEQ ID NO: 2898871 - RNA, 20 nt, Mycobacterium avium subsp. paratuberculosis
cuuccgaucaacggcagcga

SEQ ID NO: 2898872 - RNA, 21 nt, Mycobacterium avium subsp. paratuberculosis
cuuccgccacgcccagggcgc

SEQ ID NO: 2898873 - RNA, 14 nt, Mycobacterium avium subsp. paratuberculosis
cuuccgcccggcga

SEQ ID NO: 2898874 - RNA, 15 nt, Mycobacterium avium subsp. paratuberculosis
cuuccgcccggcgag

SEQ ID NO: 2898875 - RNA, 13 nt, Mycobacterium avium subsp. paratuberculosis
cuuccgccgagac

SEQ ID NO: 2898876 - RNA, 15 nt, Mycobacterium avium subsp. paratuberculosis
cuuccgccgagacgg

SEQ ID NO: 2898877 - RNA, 13 nt, Mycobacterium avium subsp. paratuberculosis
cuuccgccucggc

SEQ ID NO: 2898878 - RNA, 17 nt, Mycobacterium avium subsp. paratuberculosis
cuuccgcggcggccggc

SEQ ID NO: 2898879 - RNA, 17 nt, Mycobacterium avium subsp. paratuberculosis
cuuccgggccaccgucu

SEQ ID NO: 2898880 - RNA, 20 nt, Mycobacterium avium subsp. paratuberculosis
cuuccgugcuugcccgacga

SEQ ID NO: 2898881 - RNA, 14 nt, Mycobacterium avium subsp. paratuberculosis
cuuccuccucuucg

SEQ ID NO: 2898882 - RNA, 22 nt, Mycobacterium avium subsp. paratuberculosis
cuuccugggacagccggucgac

SEQ ID NO: 2898883 - RNA, 16 nt, Mycobacterium avium subsp. paratuberculosis
cuucgaaaagcuguug

SEQ ID NO: 2898884 - RNA, 17 nt, Mycobacterium avium subsp. paratuberculosis
cuucgaacaucuugauc

SEQ ID NO: 2898885 - RNA, 14 nt, Mycobacterium avium subsp. paratuberculosis
cuucgaacgcgacg

SEQ ID NO: 2898886 - RNA, 22 nt, Mycobacterium avium subsp. paratuberculosis
cuucgacccgcauccgccgggc

SEQ ID NO: 2898887 - RNA, 21 nt, Mycobacterium avium subsp. paratuberculosis
cuucgacccgguagcgcagca

SEQ ID NO: 2898888 - RNA, 15 nt, Mycobacterium avium subsp. paratuberculosis
cuucgacccgguggc

SEQ ID NO: 2898889 - RNA, 22 nt, Mycobacterium avium subsp. paratuberculosis
cuucgacccgguggcccggucg

SEQ ID NO: 2898890 - RNA, 14 nt, Mycobacterium avium subsp. paratuberculosis
cuucgagccgggcg

SEQ ID NO: 2898891 - RNA, 23 nt, Mycobacterium avium subsp. paratuberculosis
cuucgagccgggcgcgggcgccg

SEQ ID NO: 2898892 - RNA, 19 nt, Mycobacterium avium subsp. paratuberculosis
cuucgaggugcacgcccag

SEQ ID NO: 2898893 - RNA, 18 nt, Mycobacterium avium subsp. paratuberculosis
cuucgaucaggcgcagcc

SEQ ID NO: 2898894 - RNA, 20 nt, Mycobacterium avium subsp. paratuberculosis
cuucgaucaggcgcagcccg

SEQ ID NO: 2898895 - RNA, 17 nt, Mycobacterium avium subsp. paratuberculosis
cuucgaugacggccgua

SEQ ID NO: 2898896 - RNA, 15 nt, Mycobacterium avium subsp. paratuberculosis
cuucgaugccggugg

SEQ ID NO: 2898897 - RNA, 16 nt, Mycobacterium avium subsp. paratuberculosis
cuucgaugccgguggc

SEQ ID NO: 2898898 - RNA, 19 nt, Mycobacterium avium subsp. paratuberculosis
cuucgauggccaucgucga

SEQ ID NO: 2898899 - RNA, 19 nt, Mycobacterium avium subsp. paratuberculosis
cuucgauguagaagccgug

SEQ ID NO: 2898900 - RNA, 21 nt, Mycobacterium avium subsp. paratuberculosis
cuucgauguagaagccguggg

SEQ ID NO: 2898901 - RNA, 19 nt, Mycobacterium avium subsp. paratuberculosis
cuucgaugucgccggcgac

SEQ ID NO: 2898902 - RNA, 20 nt, Mycobacterium avium subsp. paratuberculosis
cuucgaugucgccggcgacc

SEQ ID NO: 2898903 - RNA, 23 nt, Mycobacterium avium subsp. paratuberculosis
cuucgaugucgccggcgaccgcc

SEQ ID NO: 2898904 - RNA, 18 nt, Mycobacterium avium subsp. paratuberculosis
cuucgcagcagauccuca

SEQ ID NO: 2898905 - RNA, 14 nt, Mycobacterium avium subsp. paratuberculosis
cuucgccagcgggc

SEQ ID NO: 2898906 - RNA, 23 nt, Mycobacterium avium subsp. paratuberculosis
cuucgccagcgggccgaccuggc

SEQ ID NO: 2898907 - RNA, 18 nt, Mycobacterium avium subsp. paratuberculosis
cuucgcccggcugcgccg

SEQ ID NO: 2898908 - RNA, 13 nt, Mycobacterium avium subsp. paratuberculosis
cuucgccgcagcc

SEQ ID NO: 2898909 - RNA, 14 nt, Mycobacterium avium subsp. paratuberculosis
cuucgccgcagccu

SEQ ID NO: 2898910 - RNA, 22 nt, Mycobacterium avium subsp. paratuberculosis
cuucgccgccgcaccggccggc

SEQ ID NO: 2898911 - RNA, 13 nt, Mycobacterium avium subsp. paratuberculosis
cuucgccgcgcuu

SEQ ID NO: 2898912 - RNA, 20 nt, Mycobacterium avium subsp. paratuberculosis
cuucgccuccgggaaggcgg

SEQ ID NO: 2898913 - RNA, 22 nt, Mycobacterium avium subsp. paratuberculosis
cuucgcgaagaacgacgccacc

SEQ ID NO: 2898914 - RNA, 15 nt, Mycobacterium avium subsp. paratuberculosis
cuucgcgcgcggcgu

SEQ ID NO: 2898915 - RNA, 20 nt, Mycobacterium avium subsp. paratuberculosis
cuucgcggauccgggccgcc

SEQ ID NO: 2898916 - RNA, 20 nt, Mycobacterium avium subsp. paratuberculosis
cuucgcggcguacugcgcga

SEQ ID NO: 2898917 - RNA, 15 nt, Mycobacterium avium subsp. paratuberculosis
cuucgcgggcggcgc

SEQ ID NO: 2898918 - RNA, 17 nt, Mycobacterium avium subsp. paratuberculosis
cuucgcgggugccuucu

SEQ ID NO: 2898919 - RNA, 21 nt, Mycobacterium avium subsp. paratuberculosis
cuucgcgggugccuucuuggc

SEQ ID NO: 2898920 - RNA, 17 nt, Mycobacterium avium subsp. paratuberculosis
cuucgcgguccaucucc

SEQ ID NO: 2898921 - RNA, 19 nt, Mycobacterium avium subsp. paratuberculosis
cuucgcgguccaucuccag

SEQ ID NO: 2898922 - RNA, 17 nt, Mycobacterium avium subsp. paratuberculosis
cuucgcggucggcaacc

SEQ ID NO: 2898923 - RNA, 18 nt, Mycobacterium avium subsp. paratuberculosis
cuucgcggucggcaaccc

SEQ ID NO: 2898924 - RNA, 20 nt, Mycobacterium avium subsp. paratuberculosis
cuucgcggucggcaacccga

SEQ ID NO: 2898925 - RNA, 22 nt, Mycobacterium avium subsp. paratuberculosis
cuucgcggucggcaacccgacc

SEQ ID NO: 2898926 - RNA, 18 nt, Mycobacterium avium subsp. paratuberculosis
cuucgcggugugcggcag

SEQ ID NO: 2898927 - RNA, 22 nt, Mycobacterium avium subsp. paratuberculosis
cuucgcggugugcggcagcucg

SEQ ID NO: 2898928 - RNA, 23 nt, Mycobacterium avium subsp. paratuberculosis
cuucgcguuccgccacggcgggg

SEQ ID NO: 2898929 - RNA, 17 nt, Mycobacterium avium subsp. paratuberculosis
cuucggagacguggcgg

SEQ ID NO: 2898930 - RNA, 19 nt, Mycobacterium avium subsp. paratuberculosis
cuucggagacguggcggcg

SEQ ID NO: 2898931 - RNA, 20 nt, Mycobacterium avium subsp. paratuberculosis
cuucggagacguggcggcgg

SEQ ID NO: 2898932 - RNA, 14 nt, Mycobacterium avium subsp. paratuberculosis
cuucggagguacuc

SEQ ID NO: 2898933 - RNA, 17 nt, Mycobacterium avium subsp. paratuberculosis
cuucggcacgaagccga

SEQ ID NO: 2898934 - RNA, 15 nt, Mycobacterium avium subsp. paratuberculosis
cuucggccagcgcgu

SEQ ID NO: 2898935 - RNA, 17 nt, Mycobacterium avium subsp. paratuberculosis
cuucggccagcgcgucg

SEQ ID NO: 2898936 - RNA, 21 nt, Mycobacterium avium subsp. paratuberculosis
cuucggccagcgcgucggcca

SEQ ID NO: 2898937 - RNA, 13 nt, Mycobacterium avium subsp. paratuberculosis
cuucggccaucga

SEQ ID NO: 2898938 - RNA, 22 nt, Mycobacterium avium subsp. paratuberculosis
cuucggccggcagcggugccgc

SEQ ID NO: 2898939 - RNA, 22 nt, Mycobacterium avium subsp. paratuberculosis
cuucggccucgguuucgaacug

SEQ ID NO: 2898940 - RNA, 21 nt, Mycobacterium avium subsp. paratuberculosis
cuucggcgccaaccuguuugg

SEQ ID NO: 2898941 - RNA, 16 nt, Mycobacterium avium subsp. paratuberculosis
cuucggcgccagcccg

SEQ ID NO: 2898942 - RNA, 17 nt, Mycobacterium avium subsp. paratuberculosis
cuucggcgccagcccgc

SEQ ID NO: 2898943 - RNA, 19 nt, Mycobacterium avium subsp. paratuberculosis
cuucggcgccagcccgccg

SEQ ID NO: 2898944 - RNA, 15 nt, Mycobacterium avium subsp. paratuberculosis
cuucggcgcccgcuc

SEQ ID NO: 2898945 - RNA, 23 nt, Mycobacterium avium subsp. paratuberculosis
cuucggcgcccgcuccggcggac

SEQ ID NO: 2898946 - RNA, 13 nt, Mycobacterium avium subsp. paratuberculosis
cuucggcgccgag

SEQ ID NO: 2898947 - RNA, 14 nt, Mycobacterium avium subsp. paratuberculosis
cuucggcgccgagc

SEQ ID NO: 2898948 - RNA, 15 nt, Mycobacterium avium subsp. paratuberculosis
cuucggcgccgagcg

SEQ ID NO: 2898949 - RNA, 22 nt, Mycobacterium avium subsp. paratuberculosis
cuucggcgccgagcgucacgcu

SEQ ID NO: 2898950 - RNA, 14 nt, Mycobacterium avium subsp. paratuberculosis
cuucggcgccggca

SEQ ID NO: 2898951 - RNA, 14 nt, Mycobacterium avium subsp. paratuberculosis
cuucggcgcgccgg

SEQ ID NO: 2898952 - RNA, 15 nt, Mycobacterium avium subsp. paratuberculosis
cuucggcgcgccggc

SEQ ID NO: 2898953 - RNA, 13 nt, Mycobacterium avium subsp. paratuberculosis
cuucggcgucacu

SEQ ID NO: 2898954 - RNA, 16 nt, Mycobacterium avium subsp. paratuberculosis
cuucggcgugucgggu

SEQ ID NO: 2898955 - RNA, 16 nt, Mycobacterium avium subsp. paratuberculosis
cuucggcucggcgaca

SEQ ID NO: 2898956 - RNA, 20 nt, Mycobacterium avium subsp. paratuberculosis
cuucggcucggggucggccg

SEQ ID NO: 2898957 - RNA, 13 nt, Mycobacterium avium subsp. paratuberculosis
cuucgggaucagc

SEQ ID NO: 2898958 - RNA, 22 nt, Mycobacterium avium subsp. paratuberculosis
cuucggggauguagccgccggu

SEQ ID NO: 2898959 - RNA, 13 nt, Mycobacterium avium subsp. paratuberculosis
cuucggggccgcc

SEQ ID NO: 2898960 - RNA, 22 nt, Mycobacterium avium subsp. paratuberculosis
cuucgggguggucaccggcaag

SEQ ID NO: 2898961 - RNA, 15 nt, Mycobacterium avium subsp. paratuberculosis
cuucgggucgccggu

SEQ ID NO: 2898962 - RNA, 17 nt, Mycobacterium avium subsp. paratuberculosis
cuucggucaucgugauc

SEQ ID NO: 2898963 - RNA, 13 nt, Mycobacterium avium subsp. paratuberculosis
cuucggucccggc

SEQ ID NO: 2898964 - RNA, 17 nt, Mycobacterium avium subsp. paratuberculosis
cuucggucccggcgggg

SEQ ID NO: 2898965 - RNA, 16 nt, Mycobacterium avium subsp. paratuberculosis
cuucguaacacccucg

SEQ ID NO: 2898966 - RNA, 19 nt, Mycobacterium avium subsp. paratuberculosis
cuucguacggcccgggaag

SEQ ID NO: 2898967 - RNA, 15 nt, Mycobacterium avium subsp. paratuberculosis
cuucgucgccgggcu

SEQ ID NO: 2898968 - RNA, 23 nt, Mycobacterium avium subsp. paratuberculosis
cuucgugguggugcgggugaucu

SEQ ID NO: 2898969 - RNA, 16 nt, Mycobacterium avium subsp. paratuberculosis
cuucuacggcgggccg

SEQ ID NO: 2898970 - RNA, 13 nt, Mycobacterium avium subsp. paratuberculosis
cuucuccacgccg

SEQ ID NO: 2898971 - RNA, 17 nt, Mycobacterium avium subsp. paratuberculosis
cuucuccacgccgacga

SEQ ID NO: 2898972 - RNA, 15 nt, Mycobacterium avium subsp. paratuberculosis
cuucuccccgccucg

SEQ ID NO: 2898973 - RNA, 19 nt, Mycobacterium avium subsp. paratuberculosis
cuucucccgcggcagccgg

SEQ ID NO: 2898974 - RNA, 20 nt, Mycobacterium avium subsp. paratuberculosis
cuucucccgcggcagccggg

SEQ ID NO: 2898975 - RNA, 14 nt, Mycobacterium avium subsp. paratuberculosis
cuucuccgccgggc

SEQ ID NO: 2898976 - RNA, 14 nt, Mycobacterium avium subsp. paratuberculosis
cuucuccgcggccg

SEQ ID NO: 2898977 - RNA, 13 nt, Mycobacterium avium subsp. paratuberculosis
cuucuccgggucg

SEQ ID NO: 2898978 - RNA, 23 nt, Mycobacterium avium subsp. paratuberculosis
cuucucgaaccggggcaccacgu

SEQ ID NO: 2898979 - RNA, 21 nt, Mycobacterium avium subsp. paratuberculosis
cuucucgaagcgcagcagcuc

SEQ ID NO: 2898980 - RNA, 17 nt, Mycobacterium avium subsp. paratuberculosis
cuucucgcacagcacca

SEQ ID NO: 2898981 - RNA, 12 nt, Mycobacterium avium subsp. paratuberculosis
cuucucggccag

SEQ ID NO: 2898982 - RNA, 16 nt, Mycobacterium avium subsp. paratuberculosis
cuucucggcgugcccg

SEQ ID NO: 2898983 - RNA, 17 nt, Mycobacterium avium subsp. paratuberculosis
cuucucggcgugcccgc

SEQ ID NO: 2898984 - RNA, 21 nt, Mycobacterium avium subsp. paratuberculosis
cuucucggugaucacccgccg

SEQ ID NO: 2898985 - RNA, 17 nt, Mycobacterium avium subsp. paratuberculosis
cuucugcccggccagca

SEQ ID NO: 2898986 - RNA, 23 nt, Mycobacterium avium subsp. paratuberculosis
cuucugcgccgguucgcuggcgg

SEQ ID NO: 2898987 - RNA, 14 nt, Mycobacterium avium subsp. paratuberculosis
cuucugcgcgccgu

SEQ ID NO: 2898988 - RNA, 15 nt, Mycobacterium avium subsp. paratuberculosis
cuucuggcgcugcuc

SEQ ID NO: 2898989 - RNA, 13 nt, Mycobacterium avium subsp. paratuberculosis
cuucuggcugggg

SEQ ID NO: 2898990 - RNA, 16 nt, Mycobacterium avium subsp. paratuberculosis
cuucuggguguagguc

SEQ ID NO: 2898991 - RNA, 22 nt, Mycobacterium avium subsp. paratuberculosis
cuucuucagccccucggggcug

SEQ ID NO: 2898992 - RNA, 15 nt, Mycobacterium avium subsp. paratuberculosis
cuucuucagccgcag

SEQ ID NO: 2898993 - RNA, 17 nt, Mycobacterium avium subsp. paratuberculosis
cuucuucagccgcagcu

SEQ ID NO: 2898994 - RNA, 21 nt, Mycobacterium avium subsp. paratuberculosis
cuucuucgccgcagccuucuu

SEQ ID NO: 2898995 - RNA, 22 nt, Mycobacterium avium subsp. paratuberculosis
cuucuugaccgcagccuucuuc

SEQ ID NO: 2898996 - RNA, 17 nt, Mycobacterium avium subsp. paratuberculosis
cuucuugcugcccgcgg

SEQ ID NO: 2898997 - RNA, 11 nt, Mycobacterium avium subsp. paratuberculosis
cuucuuggccg

SEQ ID NO: 2898998 - RNA, 18 nt, Mycobacterium avium subsp. paratuberculosis
cuucuuggccgcggccuu

SEQ ID NO: 2898999 - RNA, 22 nt, Mycobacterium avium subsp. paratuberculosis
cuucuuggccggagccuucuuc

SEQ ID NO: 2899000 - RNA, 16 nt, Mycobacterium avium subsp. paratuberculosis
cuucuuggcggcggcc

SEQ ID NO: 2899001 - RNA, 21 nt, Mycobacterium avium subsp. paratuberculosis
cuucuuggcggcggucuucuu

SEQ ID NO: 2899002 - RNA, 13 nt, Mycobacterium avium subsp. paratuberculosis
cuucuuggcgggc

SEQ ID NO: 2899003 - RNA, 21 nt, Mycobacterium avium subsp. paratuberculosis
cuucuuggcgggcgccuucuu

SEQ ID NO: 2899004 - RNA, 10 nt, Mycobacterium avium subsp. paratuberculosis
cuugaacagc

SEQ ID NO: 2899005 - RNA, 22 nt, Mycobacterium avium subsp. paratuberculosis
cuugaaccggcuggacaccccc

SEQ ID NO: 2899006 - RNA, 14 nt, Mycobacterium avium subsp. paratuberculosis
cuugaacgccgccc

SEQ ID NO: 2899007 - RNA, 19 nt, Mycobacterium avium subsp. paratuberculosis
cuugaacgcguacagcgcc

SEQ ID NO: 2899008 - RNA, 20 nt, Mycobacterium avium subsp. paratuberculosis
cuugaacgcguacagcgccc

SEQ ID NO: 2899009 - RNA, 17 nt, Mycobacterium avium subsp. paratuberculosis
cuugaacggcgcgucgu

SEQ ID NO: 2899010 - RNA, 17 nt, Mycobacterium avium subsp. paratuberculosis
cuugaacucggccaggg

SEQ ID NO: 2899011 - RNA, 20 nt, Mycobacterium avium subsp. paratuberculosis
cuugaacucggccagggcuc

SEQ ID NO: 2899012 - RNA, 15 nt, Mycobacterium avium subsp. paratuberculosis
cuugaagaaccggga

SEQ ID NO: 2899013 - RNA, 20 nt, Mycobacterium avium subsp. paratuberculosis
cuugaccacccggucgacga

SEQ ID NO: 2899014 - RNA, 19 nt, Mycobacterium avium subsp. paratuberculosis
cuugaccaccgagccgggc

SEQ ID NO: 2899015 - RNA, 14 nt, Mycobacterium avium subsp. paratuberculosis
cuugaccagcagcu

SEQ ID NO: 2899016 - RNA, 17 nt, Mycobacterium avium subsp. paratuberculosis
cuugaccagcagcugga

SEQ ID NO: 2899017 - RNA, 12 nt, Mycobacterium avium subsp. paratuberculosis
cuugaccaggau

SEQ ID NO: 2899018 - RNA, 19 nt, Mycobacterium avium subsp. paratuberculosis
cuugacccgcaaggccgcc

SEQ ID NO: 2899019 - RNA, 20 nt, Mycobacterium avium subsp. paratuberculosis
cuugacccgcuccagcggcc

SEQ ID NO: 2899020 - RNA, 14 nt, Mycobacterium avium subsp. paratuberculosis
cuugacccggccca

SEQ ID NO: 2899021 - RNA, 23 nt, Mycobacterium avium subsp. paratuberculosis
cuugacccggcccaucaccggac

SEQ ID NO: 2899022 - RNA, 15 nt, Mycobacterium avium subsp. paratuberculosis
cuugacccggccgca

SEQ ID NO: 2899023 - RNA, 13 nt, Mycobacterium avium subsp. paratuberculosis
cuugaccgcagcc

SEQ ID NO: 2899024 - RNA, 22 nt, Mycobacterium avium subsp. paratuberculosis
cuugaccggcucgccggcgcgc

SEQ ID NO: 2899025 - RNA, 14 nt, Mycobacterium avium subsp. paratuberculosis
cuugaccgggcucc

SEQ ID NO: 2899026 - RNA, 17 nt, Mycobacterium avium subsp. paratuberculosis
cuugaccgggcuccagc

SEQ ID NO: 2899027 - RNA, 13 nt, Mycobacterium avium subsp. paratuberculosis
cuugaccgugacg

SEQ ID NO: 2899028 - RNA, 17 nt, Mycobacterium avium subsp. paratuberculosis
cuugaccucgccgagca

SEQ ID NO: 2899029 - RNA, 18 nt, Mycobacterium avium subsp. paratuberculosis
cuugaccucgccgagcag

SEQ ID NO: 2899030 - RNA, 18 nt, Mycobacterium avium subsp. paratuberculosis
cuugacgaacgccaccac

SEQ ID NO: 2899031 - RNA, 20 nt, Mycobacterium avium subsp. paratuberculosis
cuugacgacggccaccgcga

SEQ ID NO: 2899032 - RNA, 13 nt, Mycobacterium avium subsp. paratuberculosis
cuugacgccgggc

SEQ ID NO: 2899033 - RNA, 15 nt, Mycobacterium avium subsp. paratuberculosis
cuugacggccgggcc

SEQ ID NO: 2899034 - RNA, 18 nt, Mycobacterium avium subsp. paratuberculosis
cuugacguacuggcgccg

SEQ ID NO: 2899035 - RNA, 20 nt, Mycobacterium avium subsp. paratuberculosis
cuugacguacuggcgccggu

SEQ ID NO: 2899036 - RNA, 23 nt, Mycobacterium avium subsp. paratuberculosis
cuugacguagaagucgauugccg

SEQ ID NO: 2899037 - RNA, 20 nt, Mycobacterium avium subsp. paratuberculosis
cuugacgugcgacaccggcg

SEQ ID NO: 2899038 - RNA, 15 nt, Mycobacterium avium subsp. paratuberculosis
cuugacuaccgcgcc

SEQ ID NO: 2899039 - RNA, 13 nt, Mycobacterium avium subsp. paratuberculosis
cuugacucccucg

SEQ ID NO: 2899040 - RNA, 14 nt, Mycobacterium avium subsp. paratuberculosis
cuugagcaccgcgu

SEQ ID NO: 2899041 - RNA, 17 nt, Mycobacterium avium subsp. paratuberculosis
cuugagcaccgcgucgu

SEQ ID NO: 2899042 - RNA, 22 nt, Mycobacterium avium subsp. paratuberculosis
cuugagcccccaccugaucgcg

SEQ ID NO: 2899043 - RNA, 16 nt, Mycobacterium avium subsp. paratuberculosis
cuugagccccgccggg

SEQ ID NO: 2899044 - RNA, 16 nt, Mycobacterium avium subsp. paratuberculosis
cuugagccgccgcggc

SEQ ID NO: 2899045 - RNA, 22 nt, Mycobacterium avium subsp. paratuberculosis
cuugagccgccgcggcaccuuc

SEQ ID NO: 2899046 - RNA, 17 nt, Mycobacterium avium subsp. paratuberculosis
cuugagcgccagcgcgg

SEQ ID NO: 2899047 - RNA, 18 nt, Mycobacterium avium subsp. paratuberculosis
cuugagcgccagcgcggu

SEQ ID NO: 2899048 - RNA, 17 nt, Mycobacterium avium subsp. paratuberculosis
cuugagcgcgucgucgc

SEQ ID NO: 2899049 - RNA, 21 nt, Mycobacterium avium subsp. paratuberculosis
cuugaucagcgggcuguccgc

SEQ ID NO: 2899050 - RNA, 14 nt, Mycobacterium avium subsp. paratuberculosis
cuugauccggccgc

SEQ ID NO: 2899051 - RNA, 16 nt, Mycobacterium avium subsp. paratuberculosis
cuugauccggccgcgg

SEQ ID NO: 2899052 - RNA, 15 nt, Mycobacterium avium subsp. paratuberculosis
cuugaucgcacccau

SEQ ID NO: 2899053 - RNA, 23 nt, Mycobacterium avium subsp. paratuberculosis
cuugaucgcacccauccccagga

SEQ ID NO: 2899054 - RNA, 19 nt, Mycobacterium avium subsp. paratuberculosis
cuugaucgccggggcgcug

SEQ ID NO: 2899055 - RNA, 20 nt, Mycobacterium avium subsp. paratuberculosis
cuugaucucgucgcggcugc

SEQ ID NO: 2899056 - RNA, 19 nt, Mycobacterium avium subsp. paratuberculosis
cuugaucuuggccugggcc

SEQ ID NO: 2899057 - RNA, 17 nt, Mycobacterium avium subsp. paratuberculosis
cuugaugaacgccucga

SEQ ID NO: 2899058 - RNA, 14 nt, Mycobacterium avium subsp. paratuberculosis
cuugaugaugccgg

SEQ ID NO: 2899059 - RNA, 15 nt, Mycobacterium avium subsp. paratuberculosis
cuugaugaugccggc

SEQ ID NO: 2899060 - RNA, 20 nt, Mycobacterium avium subsp. paratuberculosis
cuugaugaugccggccgcgu

SEQ ID NO: 2899061 - RNA, 19 nt, Mycobacterium avium subsp. paratuberculosis
cuugaugaugucggcggcc

SEQ ID NO: 2899062 - RNA, 20 nt, Mycobacterium avium subsp. paratuberculosis
cuugaugaugucggcggccg

SEQ ID NO: 2899063 - RNA, 14 nt, Mycobacterium avium subsp. paratuberculosis
cuugaugcagcgcc

SEQ ID NO: 2899064 - RNA, 18 nt, Mycobacterium avium subsp. paratuberculosis
cuugaugcagcgccucgg

SEQ ID NO: 2899065 - RNA, 14 nt, Mycobacterium avium subsp. paratuberculosis
cuugaugucggggc

SEQ ID NO: 2899066 - RNA, 17 nt, Mycobacterium avium subsp. paratuberculosis
cuugcacccagcggaac

SEQ ID NO: 2899067 - RNA, 11 nt, Mycobacterium avium subsp. paratuberculosis
cuugcagcaca

SEQ ID NO: 2899068 - RNA, 14 nt, Mycobacterium avium subsp. paratuberculosis
cuugcagcacaccg

SEQ ID NO: 2899069 - RNA, 20 nt, Mycobacterium avium subsp. paratuberculosis
cuugcagcccgcugaccagg

SEQ ID NO: 2899070 - RNA, 19 nt, Mycobacterium avium subsp. paratuberculosis
cuugcagccgcugccgcac

SEQ ID NO: 2899071 - RNA, 20 nt, Mycobacterium avium subsp. paratuberculosis
cuugcagcuguccugccaga

SEQ ID NO: 2899072 - RNA, 23 nt, Mycobacterium avium subsp. paratuberculosis
cuugccaacgguuuccaccacca

SEQ ID NO: 2899073 - RNA, 14 nt, Mycobacterium avium subsp. paratuberculosis
cuugcccagcgggg

SEQ ID NO: 2899074 - RNA, 18 nt, Mycobacterium avium subsp. paratuberculosis
cuugccccaccaccgccg

SEQ ID NO: 2899075 - RNA, 23 nt, Mycobacterium avium subsp. paratuberculosis
cuugcccgaggucauaucgacgg

SEQ ID NO: 2899076 - RNA, 21 nt, Mycobacterium avium subsp. paratuberculosis
cuugcccggcgagcgacgcca

SEQ ID NO: 2899077 - RNA, 16 nt, Mycobacterium avium subsp. paratuberculosis
cuugcccggcucggug

SEQ ID NO: 2899078 - RNA, 17 nt, Mycobacterium avium subsp. paratuberculosis
cuugcccggcucggugc

SEQ ID NO: 2899079 - RNA, 14 nt, Mycobacterium avium subsp. paratuberculosis
cuugcccgucgcgu

SEQ ID NO: 2899080 - RNA, 15 nt, Mycobacterium avium subsp. paratuberculosis
cuugccgaacaggcg

SEQ ID NO: 2899081 - RNA, 23 nt, Mycobacterium avium subsp. paratuberculosis
cuugccgaacaggcgcaacagca

SEQ ID NO: 2899082 - RNA, 22 nt, Mycobacterium avium subsp. paratuberculosis
cuugccgaagaugucggugccg

SEQ ID NO: 2899083 - RNA, 23 nt, Mycobacterium avium subsp. paratuberculosis
cuugccgaagaugucggugccga

SEQ ID NO: 2899084 - RNA, 17 nt, Mycobacterium avium subsp. paratuberculosis
cuugccgaucagcuggc

SEQ ID NO: 2899085 - RNA, 15 nt, Mycobacterium avium subsp. paratuberculosis
cuugccgaucgccgc

SEQ ID NO: 2899086 - RNA, 15 nt, Mycobacterium avium subsp. paratuberculosis
cuugccgccgcagcg

SEQ ID NO: 2899087 - RNA, 14 nt, Mycobacterium avium subsp. paratuberculosis
cuugccgcgacccg

SEQ ID NO: 2899088 - RNA, 20 nt, Mycobacterium avium subsp. paratuberculosis
cuugccgcugaaauccgggg

SEQ ID NO: 2899089 - RNA, 21 nt, Mycobacterium avium subsp. paratuberculosis
cuugccgcugugauagcggcg

SEQ ID NO: 2899090 - RNA, 15 nt, Mycobacterium avium subsp. paratuberculosis
cuugccggagcccag

SEQ ID NO: 2899091 - RNA, 15 nt, Mycobacterium avium subsp. paratuberculosis
cuugccggcggcggg

SEQ ID NO: 2899092 - RNA, 16 nt, Mycobacterium avium subsp. paratuberculosis
cuugccggcggcgggc

SEQ ID NO: 2899093 - RNA, 17 nt, Mycobacterium avium subsp. paratuberculosis
cuugccgucgagcaggg

SEQ ID NO: 2899094 - RNA, 16 nt, Mycobacterium avium subsp. paratuberculosis
cuugccgucggccgcc

SEQ ID NO: 2899095 - RNA, 17 nt, Mycobacterium avium subsp. paratuberculosis
cuugccgucggccgccg

SEQ ID NO: 2899096 - RNA, 15 nt, Mycobacterium avium subsp. paratuberculosis
cuugccgugcagcag

SEQ ID NO: 2899097 - RNA, 17 nt, Mycobacterium avium subsp. paratuberculosis
cuugccgugcagcaguu

SEQ ID NO: 2899098 - RNA, 15 nt, Mycobacterium avium subsp. paratuberculosis
cuugcgaccgccgcu

SEQ ID NO: 2899099 - RNA, 14 nt, Mycobacterium avium subsp. paratuberculosis
cuugcgagccggag

SEQ ID NO: 2899100 - RNA, 13 nt, Mycobacterium avium subsp. paratuberculosis
cuugcgaucgccg

SEQ ID NO: 2899101 - RNA, 14 nt, Mycobacterium avium subsp. paratuberculosis
cuugcgaucgccgc

SEQ ID NO: 2899102 - RNA, 15 nt, Mycobacterium avium subsp. paratuberculosis
cuugcgaucgccgcg

SEQ ID NO: 2899103 - RNA, 14 nt, Mycobacterium avium subsp. paratuberculosis
cuugcgcaccacgu

SEQ ID NO: 2899104 - RNA, 19 nt, Mycobacterium avium subsp. paratuberculosis
cuugcgcaccacgucgggu

SEQ ID NO: 2899105 - RNA, 18 nt, Mycobacterium avium subsp. paratuberculosis
cuugcgcagcgucgugua

SEQ ID NO: 2899106 - RNA, 16 nt, Mycobacterium avium subsp. paratuberculosis
cuugcgccauccccgc

SEQ ID NO: 2899107 - RNA, 12 nt, Mycobacterium avium subsp. paratuberculosis
cuugcgccgcag

SEQ ID NO: 2899108 - RNA, 15 nt, Mycobacterium avium subsp. paratuberculosis
cuugcgcgacgccgu

SEQ ID NO: 2899109 - RNA, 11 nt, Mycobacterium avium subsp. paratuberculosis
cuugcgcgccg

SEQ ID NO: 2899110 - RNA, 15 nt, Mycobacterium avium subsp. paratuberculosis
cuugcgcgccgcgac

SEQ ID NO: 2899111 - RNA, 16 nt, Mycobacterium avium subsp. paratuberculosis
cuugcgcgccgugacg

SEQ ID NO: 2899112 - RNA, 14 nt, Mycobacterium avium subsp. paratuberculosis
cuugcgcggcgcga

SEQ ID NO: 2899113 - RNA, 18 nt, Mycobacterium avium subsp. paratuberculosis
cuugcgcucggucgcggc

SEQ ID NO: 2899114 - RNA, 16 nt, Mycobacterium avium subsp. paratuberculosis
cuugcggaaccgcugc

SEQ ID NO: 2899115 - RNA, 18 nt, Mycobacterium avium subsp. paratuberculosis
cuugcggaaccgcugcau

SEQ ID NO: 2899116 - RNA, 21 nt, Mycobacterium avium subsp. paratuberculosis
cuugcggcccaaccggaucgg

SEQ ID NO: 2899117 - RNA, 14 nt, Mycobacterium avium subsp. paratuberculosis
cuugcggccgauca

SEQ ID NO: 2899118 - RNA, 12 nt, Mycobacterium avium subsp. paratuberculosis
cuugcggccgcc

SEQ ID NO: 2899119 - RNA, 12 nt, Mycobacterium avium subsp. paratuberculosis
cuugcggcgcaa

SEQ ID NO: 2899120 - RNA, 23 nt, Mycobacterium avium subsp. paratuberculosis
cuugcggcgcagccagcucggcg

SEQ ID NO: 2899121 - RNA, 14 nt, Mycobacterium avium subsp. paratuberculosis
cuugcgggccggag

SEQ ID NO: 2899122 - RNA, 20 nt, Mycobacterium avium subsp. paratuberculosis
cuugcgggccggagccuucu

SEQ ID NO: 2899123 - RNA, 13 nt, Mycobacterium avium subsp. paratuberculosis
cuugcgggcggca

SEQ ID NO: 2899124 - RNA, 15 nt, Mycobacterium avium subsp. paratuberculosis
cuugcgggcggucag

SEQ ID NO: 2899125 - RNA, 15 nt, Mycobacterium avium subsp. paratuberculosis
cuugcgggugaucca

SEQ ID NO: 2899126 - RNA, 22 nt, Mycobacterium avium subsp. paratuberculosis
cuugcgucgcgaugcccaagcc

SEQ ID NO: 2899127 - RNA, 19 nt, Mycobacterium avium subsp. paratuberculosis
cuugcguucccagcccggc

SEQ ID NO: 2899128 - RNA, 20 nt, Mycobacterium avium subsp. paratuberculosis
cuugcguucccagcccggcc

SEQ ID NO: 2899129 - RNA, 20 nt, Mycobacterium avium subsp. paratuberculosis
cuugcguuccucgacggcga

SEQ ID NO: 2899130 - RNA, 21 nt, Mycobacterium avium subsp. paratuberculosis
cuugcguugcgcggcggccaa

SEQ ID NO: 2899131 - RNA, 23 nt, Mycobacterium avium subsp. paratuberculosis
cuugcguugcgcggcggccaauc

SEQ ID NO: 2899132 - RNA, 20 nt, Mycobacterium avium subsp. paratuberculosis
cuugcucuucaggaacccga

SEQ ID NO: 2899133 - RNA, 15 nt, Mycobacterium avium subsp. paratuberculosis
cuugcugagccggcc

SEQ ID NO: 2899134 - RNA, 15 nt, Mycobacterium avium subsp. paratuberculosis
cuugcugagcugcgc

SEQ ID NO: 2899135 - RNA, 19 nt, Mycobacterium avium subsp. paratuberculosis
cuugcugagcugcgcccac

SEQ ID NO: 2899136 - RNA, 16 nt, Mycobacterium avium subsp. paratuberculosis
cuugcugauccccagc

SEQ ID NO: 2899137 - RNA, 16 nt, Mycobacterium avium subsp. paratuberculosis
cuugcugcggaaccca

SEQ ID NO: 2899138 - RNA, 17 nt, Mycobacterium avium subsp. paratuberculosis
cuugcuggcggccuucu

SEQ ID NO: 2899139 - RNA, 14 nt, Mycobacterium avium subsp. paratuberculosis
cuuggacagcagca

SEQ ID NO: 2899140 - RNA, 16 nt, Mycobacterium avium subsp. paratuberculosis
cuuggacaggcccagc

SEQ ID NO: 2899141 - RNA, 14 nt, Mycobacterium avium subsp. paratuberculosis
cuuggacgcccggu

SEQ ID NO: 2899142 - RNA, 17 nt, Mycobacterium avium subsp. paratuberculosis
cuuggacgcccggucga

SEQ ID NO: 2899143 - RNA, 19 nt, Mycobacterium avium subsp. paratuberculosis
cuuggacgcccggucgacc

SEQ ID NO: 2899144 - RNA, 18 nt, Mycobacterium avium subsp. paratuberculosis
cuuggacucccccaccac

SEQ ID NO: 2899145 - RNA, 19 nt, Mycobacterium avium subsp. paratuberculosis
cuuggacucccccaccacg

SEQ ID NO: 2899146 - RNA, 11 nt, Mycobacterium avium subsp. paratuberculosis
cuuggagccga

SEQ ID NO: 2899147 - RNA, 15 nt, Mycobacterium avium subsp. paratuberculosis
cuuggcacgggcccg

SEQ ID NO: 2899148 - RNA, 16 nt, Mycobacterium avium subsp. paratuberculosis
cuuggcacgggcccgc

SEQ ID NO: 2899149 - RNA, 13 nt, Mycobacterium avium subsp. paratuberculosis
cuuggccacgucg

SEQ ID NO: 2899150 - RNA, 18 nt, Mycobacterium avium subsp. paratuberculosis
cuuggccagcagccgcga

SEQ ID NO: 2899151 - RNA, 19 nt, Mycobacterium avium subsp. paratuberculosis
cuuggccagcucggcggcc

SEQ ID NO: 2899152 - RNA, 22 nt, Mycobacterium avium subsp. paratuberculosis
cuuggccagcucggcggccaug

SEQ ID NO: 2899153 - RNA, 14 nt, Mycobacterium avium subsp. paratuberculosis
cuuggccagcugcg

SEQ ID NO: 2899154 - RNA, 14 nt, Mycobacterium avium subsp. paratuberculosis
cuuggcccaccgaa

SEQ ID NO: 2899155 - RNA, 16 nt, Mycobacterium avium subsp. paratuberculosis
cuuggcccgccgccgg

SEQ ID NO: 2899156 - RNA, 14 nt, Mycobacterium avium subsp. paratuberculosis
cuuggcccgcgcgg

SEQ ID NO: 2899157 - RNA, 19 nt, Mycobacterium avium subsp. paratuberculosis
cuuggcccgcgcggccgcc

SEQ ID NO: 2899158 - RNA, 20 nt, Mycobacterium avium subsp. paratuberculosis
cuuggcccgcgcggccgcca

SEQ ID NO: 2899159 - RNA, 13 nt, Mycobacterium avium subsp. paratuberculosis
cuuggccgacacg

SEQ ID NO: 2899160 - RNA, 17 nt, Mycobacterium avium subsp. paratuberculosis
cuuggccgacacguagg

SEQ ID NO: 2899161 - RNA, 14 nt, Mycobacterium avium subsp. paratuberculosis
cuuggccgcggccu

SEQ ID NO: 2899162 - RNA, 15 nt, Mycobacterium avium subsp. paratuberculosis
cuuggccgcggccuu

SEQ ID NO: 2899163 - RNA, 17 nt, Mycobacterium avium subsp. paratuberculosis
cuuggccggagccuugg

SEQ ID NO: 2899164 - RNA, 12 nt, Mycobacterium avium subsp. paratuberculosis
cuuggccgggcg

SEQ ID NO: 2899165 - RNA, 14 nt, Mycobacterium avium subsp. paratuberculosis
cuuggccgggcgga

SEQ ID NO: 2899166 - RNA, 22 nt, Mycobacterium avium subsp. paratuberculosis
cuuggccgugcagggggcgcag

SEQ ID NO: 2899167 - RNA, 22 nt, Mycobacterium avium subsp. paratuberculosis
cuuggccuccaccggcaaucgg

SEQ ID NO: 2899168 - RNA, 17 nt, Mycobacterium avium subsp. paratuberculosis
cuuggccuccgugcugg

SEQ ID NO: 2899169 - RNA, 13 nt, Mycobacterium avium subsp. paratuberculosis
cuuggcgacgaag

SEQ ID NO: 2899170 - RNA, 21 nt, Mycobacterium avium subsp. paratuberculosis
cuuggcgagcugaccggccac

SEQ ID NO: 2899171 - RNA, 14 nt, Mycobacterium avium subsp. paratuberculosis
cuuggcgcagccgg

SEQ ID NO: 2899172 - RNA, 17 nt, Mycobacterium avium subsp. paratuberculosis
cuuggcgcccagcgugg

SEQ ID NO: 2899173 - RNA, 16 nt, Mycobacterium avium subsp. paratuberculosis
cuuggcggagagcggu

SEQ ID NO: 2899174 - RNA, 13 nt, Mycobacterium avium subsp. paratuberculosis
cuuggcggccacc

SEQ ID NO: 2899175 - RNA, 16 nt, Mycobacterium avium subsp. paratuberculosis
cuuggcggccagcgcc

SEQ ID NO: 2899176 - RNA, 12 nt, Mycobacterium avium subsp. paratuberculosis
cuuggcggccug

SEQ ID NO: 2899177 - RNA, 15 nt, Mycobacterium avium subsp. paratuberculosis
cuuggcggccugcgc

SEQ ID NO: 2899178 - RNA, 14 nt, Mycobacterium avium subsp. paratuberculosis
cuuggcggccugcu

SEQ ID NO: 2899179 - RNA, 18 nt, Mycobacterium avium subsp. paratuberculosis
cuuggcggccugcucgaa

SEQ ID NO: 2899180 - RNA, 20 nt, Mycobacterium avium subsp. paratuberculosis
cuuggcggcgcacuccauca

SEQ ID NO: 2899181 - RNA, 14 nt, Mycobacterium avium subsp. paratuberculosis
cuuggcggcggcca

SEQ ID NO: 2899182 - RNA, 19 nt, Mycobacterium avium subsp. paratuberculosis
cuuggcggcggccuucuug

SEQ ID NO: 2899183 - RNA, 23 nt, Mycobacterium avium subsp. paratuberculosis
cuuggcggcggccuucuuggccg

SEQ ID NO: 2899184 - RNA, 14 nt, Mycobacterium avium subsp. paratuberculosis
cuuggcggcggucu

SEQ ID NO: 2899185 - RNA, 20 nt, Mycobacterium avium subsp. paratuberculosis
cuuggcggcggucuucuugg

SEQ ID NO: 2899186 - RNA, 22 nt, Mycobacterium avium subsp. paratuberculosis
cuuggcggcggucuucuuggcc

SEQ ID NO: 2899187 - RNA, 23 nt, Mycobacterium avium subsp. paratuberculosis
cuuggcggcggucuucuuggccg

SEQ ID NO: 2899188 - RNA, 23 nt, Mycobacterium avium subsp. paratuberculosis
cuuggcggcggucuucuuggcgg

SEQ ID NO: 2899189 - RNA, 13 nt, Mycobacterium avium subsp. paratuberculosis
cuuggcggcgugg

SEQ ID NO: 2899190 - RNA, 12 nt, Mycobacterium avium subsp. paratuberculosis
cuuggcgggcgc

SEQ ID NO: 2899191 - RNA, 18 nt, Mycobacterium avium subsp. paratuberculosis
cuuggcgggcgccuucuu

SEQ ID NO: 2899192 - RNA, 20 nt, Mycobacterium avium subsp. paratuberculosis
cuuggcggugauguugucca

SEQ ID NO: 2899193 - RNA, 20 nt, Mycobacterium avium subsp. paratuberculosis
cuuggcguaugccuccucgg

SEQ ID NO: 2899194 - RNA, 19 nt, Mycobacterium avium subsp. paratuberculosis
cuuggcguauucggcgcgc

SEQ ID NO: 2899195 - RNA, 14 nt, Mycobacterium avium subsp. paratuberculosis
cuuggcguccaugu

SEQ ID NO: 2899196 - RNA, 20 nt, Mycobacterium avium subsp. paratuberculosis
cuuggcgucgaucagcgcgc

SEQ ID NO: 2899197 - RNA, 22 nt, Mycobacterium avium subsp. paratuberculosis
cuuggcgucgaucagcgcgccg

SEQ ID NO: 2899198 - RNA, 20 nt, Mycobacterium avium subsp. paratuberculosis
cuuggcuugaaaguccgccg

SEQ ID NO: 2899199 - RNA, 15 nt, Mycobacterium avium subsp. paratuberculosis
cuugggacuggaugg

SEQ ID NO: 2899200 - RNA, 20 nt, Mycobacterium avium subsp. paratuberculosis
cuugggcacguacgcgcuga

SEQ ID NO: 2899201 - RNA, 14 nt, Mycobacterium avium subsp. paratuberculosis
cuugggcccgucgg

SEQ ID NO: 2899202 - RNA, 20 nt, Mycobacterium avium subsp. paratuberculosis
cuugggcgaaucugucgaug

SEQ ID NO: 2899203 - RNA, 19 nt, Mycobacterium avium subsp. paratuberculosis
cuugggcgccucgccgacc

SEQ ID NO: 2899204 - RNA, 17 nt, Mycobacterium avium subsp. paratuberculosis
cuugggcgcgaucggca

SEQ ID NO: 2899205 - RNA, 20 nt, Mycobacterium avium subsp. paratuberculosis
cuugggcucgcgggugucga

SEQ ID NO: 2899206 - RNA, 14 nt, Mycobacterium avium subsp. paratuberculosis
cuuggggaagccgg

SEQ ID NO: 2899207 - RNA, 13 nt, Mycobacterium avium subsp. paratuberculosis
cuuggggcugacc

SEQ ID NO: 2899208 - RNA, 16 nt, Mycobacterium avium subsp. paratuberculosis
cuuggguucggcggcg

SEQ ID NO: 2899209 - RNA, 17 nt, Mycobacterium avium subsp. paratuberculosis
cuuggucacaaagcccg

SEQ ID NO: 2899210 - RNA, 17 nt, Mycobacterium avium subsp. paratuberculosis
cuuggucaccagcucgc

SEQ ID NO: 2899211 - RNA, 17 nt, Mycobacterium avium subsp. paratuberculosis
cuuggucaccugacgcu

SEQ ID NO: 2899212 - RNA, 15 nt, Mycobacterium avium subsp. paratuberculosis
cuuggucagcccgcg

SEQ ID NO: 2899213 - RNA, 13 nt, Mycobacterium avium subsp. paratuberculosis
cuuggucagccgc

SEQ ID NO: 2899214 - RNA, 16 nt, Mycobacterium avium subsp. paratuberculosis
cuuggucagccgcggc

SEQ ID NO: 2899215 - RNA, 19 nt, Mycobacterium avium subsp. paratuberculosis
cuuggucagcgcggcccgc

SEQ ID NO: 2899216 - RNA, 23 nt, Mycobacterium avium subsp. paratuberculosis
cuuggucagcgcggcccgcggcg

SEQ ID NO: 2899217 - RNA, 17 nt, Mycobacterium avium subsp. paratuberculosis
cuuggucagcucccggc

SEQ ID NO: 2899218 - RNA, 20 nt, Mycobacterium avium subsp. paratuberculosis
cuuggucagcucccggcaga

SEQ ID NO: 2899219 - RNA, 22 nt, Mycobacterium avium subsp. paratuberculosis
cuugguccgcaacgcggcggug

SEQ ID NO: 2899220 - RNA, 23 nt, Mycobacterium avium subsp. paratuberculosis
cuuggucgcggccuucuuggccg

SEQ ID NO: 2899221 - RNA, 22 nt, Mycobacterium avium subsp. paratuberculosis
cuuggucgcggcguugcccgcu

SEQ ID NO: 2899222 - RNA, 13 nt, Mycobacterium avium subsp. paratuberculosis
cuuggucuccggc

SEQ ID NO: 2899223 - RNA, 15 nt, Mycobacterium avium subsp. paratuberculosis
cuuggucuccggccc

SEQ ID NO: 2899224 - RNA, 17 nt, Mycobacterium avium subsp. paratuberculosis
cuuggugagcaccgcga

SEQ ID NO: 2899225 - RNA, 17 nt, Mycobacterium avium subsp. paratuberculosis
cuuggugaugggcagcg

SEQ ID NO: 2899226 - RNA, 20 nt, Mycobacterium avium subsp. paratuberculosis
cuuggugaugggcagcgccc

SEQ ID NO: 2899227 - RNA, 19 nt, Mycobacterium avium subsp. paratuberculosis
cuuggugauuucgcgcacc

SEQ ID NO: 2899228 - RNA, 20 nt, Mycobacterium avium subsp. paratuberculosis
cuuggugauuucgcgcacca

SEQ ID NO: 2899229 - RNA, 23 nt, Mycobacterium avium subsp. paratuberculosis
cuuggugauuucgcgcaccaccu

SEQ ID NO: 2899230 - RNA, 17 nt, Mycobacterium avium subsp. paratuberculosis
cuuggugcgagccaccu

SEQ ID NO: 2899231 - RNA, 14 nt, Mycobacterium avium subsp. paratuberculosis
cuuggugcggucga

SEQ ID NO: 2899232 - RNA, 22 nt, Mycobacterium avium subsp. paratuberculosis
cuuggugcggucgaugacgccg

SEQ ID NO: 2899233 - RNA, 14 nt, Mycobacterium avium subsp. paratuberculosis
cuugguggccgcgg

SEQ ID NO: 2899234 - RNA, 15 nt, Mycobacterium avium subsp. paratuberculosis
cuugguggccgcggc

SEQ ID NO: 2899235 - RNA, 17 nt, Mycobacterium avium subsp. paratuberculosis
cuugguggcgacgaagu

SEQ ID NO: 2899236 - RNA, 12 nt, Mycobacterium avium subsp. paratuberculosis
cuuggugguggu

SEQ ID NO: 2899237 - RNA, 17 nt, Mycobacterium avium subsp. paratuberculosis
cuuggugguggucgucg

SEQ ID NO: 2899238 - RNA, 18 nt, Mycobacterium avium subsp. paratuberculosis
cuuggugguggucgucga

SEQ ID NO: 2899239 - RNA, 19 nt, Mycobacterium avium subsp. paratuberculosis
cuuggugugugcgucggca

SEQ ID NO: 2899240 - RNA, 16 nt, Mycobacterium avium subsp. paratuberculosis
cuuguacaggucgacc

SEQ ID NO: 2899241 - RNA, 20 nt, Mycobacterium avium subsp. paratuberculosis
cuugucagguaucucugauu

SEQ ID NO: 2899242 - RNA, 11 nt, Mycobacterium avium subsp. paratuberculosis
cuuguccagga

SEQ ID NO: 2899243 - RNA, 15 nt, Mycobacterium avium subsp. paratuberculosis
cuugucccgcauggc

SEQ ID NO: 2899244 - RNA, 20 nt, Mycobacterium avium subsp. paratuberculosis
cuugucgcgcacccgcacgu

SEQ ID NO: 2899245 - RNA, 21 nt, Mycobacterium avium subsp. paratuberculosis
cuugucgcgcaccgcggcggg

SEQ ID NO: 2899246 - RNA, 22 nt, Mycobacterium avium subsp. paratuberculosis
cuugucgcgcaccgcggcgggg

SEQ ID NO: 2899247 - RNA, 17 nt, Mycobacterium avium subsp. paratuberculosis
cuugucgcugaccaccg

SEQ ID NO: 2899248 - RNA, 18 nt, Mycobacterium avium subsp. paratuberculosis
cuugucggcgcccaggau

SEQ ID NO: 2899249 - RNA, 17 nt, Mycobacterium avium subsp. paratuberculosis
cuugucggcguggccgu

SEQ ID NO: 2899250 - RNA, 19 nt, Mycobacterium avium subsp. paratuberculosis
cuugucggcguggccgucc

SEQ ID NO: 2899251 - RNA, 13 nt, Mycobacterium avium subsp. paratuberculosis
cuugucgggccgc

SEQ ID NO: 2899252 - RNA, 16 nt, Mycobacterium avium subsp. paratuberculosis
cuugucgggccgcggg

SEQ ID NO: 2899253 - RNA, 18 nt, Mycobacterium avium subsp. paratuberculosis
cuugucguagcggcgcca

SEQ ID NO: 2899254 - RNA, 15 nt, Mycobacterium avium subsp. paratuberculosis
cuugucgugucgaug

SEQ ID NO: 2899255 - RNA, 19 nt, Mycobacterium avium subsp. paratuberculosis
cuuguggaaggcgccggcg

SEQ ID NO: 2899256 - RNA, 12 nt, Mycobacterium avium subsp. paratuberculosis
cuuguggcccag

SEQ ID NO: 2899257 - RNA, 19 nt, Mycobacterium avium subsp. paratuberculosis
cuuguggcccaggccggcg

SEQ ID NO: 2899258 - RNA, 14 nt, Mycobacterium avium subsp. paratuberculosis
cuuguggucgaucc

SEQ ID NO: 2899259 - RNA, 22 nt, Mycobacterium avium subsp. paratuberculosis
cuuguggucgaucccgccggcg

SEQ ID NO: 2899260 - RNA, 13 nt, Mycobacterium avium subsp. paratuberculosis
cuuguggucgaug

SEQ ID NO: 2899261 - RNA, 14 nt, Mycobacterium avium subsp. paratuberculosis
cuuguugaccuucu

SEQ ID NO: 2899262 - RNA, 20 nt, Mycobacterium avium subsp. paratuberculosis
cuuguugagggugacggugg

SEQ ID NO: 2899263 - RNA, 15 nt, Mycobacterium avium subsp. paratuberculosis
cuuguugaugguguu

SEQ ID NO: 2899264 - RNA, 16 nt, Mycobacterium avium subsp. paratuberculosis
cuuguugcggcgcacc

SEQ ID NO: 2899265 - RNA, 21 nt, Mycobacterium avium subsp. paratuberculosis
cuuuacgaggcgugcagcccg

SEQ ID NO: 2899266 - RNA, 14 nt, Mycobacterium avium subsp. paratuberculosis
cuuuagaaggccgc

SEQ ID NO: 2899267 - RNA, 16 nt, Mycobacterium avium subsp. paratuberculosis
cuuuagaaggccgccu

SEQ ID NO: 2899268 - RNA, 15 nt, Mycobacterium avium subsp. paratuberculosis
cuuuccaaccaggcg

SEQ ID NO: 2899269 - RNA, 16 nt, Mycobacterium avium subsp. paratuberculosis
cuuuccaaccaggcgc

SEQ ID NO: 2899270 - RNA, 17 nt, Mycobacterium avium subsp. paratuberculosis
cuuuccaccucgagcaa

SEQ ID NO: 2899271 - RNA, 16 nt, Mycobacterium avium subsp. paratuberculosis
cuuuccgcgcggcggg

SEQ ID NO: 2899272 - RNA, 21 nt, Mycobacterium avium subsp. paratuberculosis
cuuuccgcgcggcgggcccgc

SEQ ID NO: 2899273 - RNA, 18 nt, Mycobacterium avium subsp. paratuberculosis
cuuucgauuucgccugca

SEQ ID NO: 2899274 - RNA, 12 nt, Mycobacterium avium subsp. paratuberculosis
cuuucgccgaau

SEQ ID NO: 2899275 - RNA, 14 nt, Mycobacterium avium subsp. paratuberculosis
cuuucgcggucagc

SEQ ID NO: 2899276 - RNA, 15 nt, Mycobacterium avium subsp. paratuberculosis
cuuucgcgucugcuc

SEQ ID NO: 2899277 - RNA, 18 nt, Mycobacterium avium subsp. paratuberculosis
cuuucgcgucugcucgcc

SEQ ID NO: 2899278 - RNA, 14 nt, Mycobacterium avium subsp. paratuberculosis
cuuucggccgcgga

SEQ ID NO: 2899279 - RNA, 19 nt, Mycobacterium avium subsp. paratuberculosis
cuuucgggcggccugccgg

SEQ ID NO: 2899280 - RNA, 14 nt, Mycobacterium avium subsp. paratuberculosis
cuuucgggucgacg

SEQ ID NO: 2899281 - RNA, 15 nt, Mycobacterium avium subsp. paratuberculosis
cuuucgggucgacga

SEQ ID NO: 2899282 - RNA, 22 nt, Mycobacterium avium subsp. paratuberculosis
cuuucgucgaccgucacgcugg

SEQ ID NO: 2899283 - RNA, 20 nt, Mycobacterium avium subsp. paratuberculosis
cuuucguucgaugucggcca

SEQ ID NO: 2899284 - RNA, 21 nt, Mycobacterium avium subsp. paratuberculosis
cuuugaaccuggccaccagca

SEQ ID NO: 2899285 - RNA, 14 nt, Mycobacterium avium subsp. paratuberculosis
cuuugaucagcucg

SEQ ID NO: 2899286 - RNA, 23 nt, Mycobacterium avium subsp. paratuberculosis
cuuugcauacagcaggcuguccu

SEQ ID NO: 2899287 - RNA, 17 nt, Mycobacterium avium subsp. paratuberculosis
cuuugccguuccagccg

SEQ ID NO: 2899288 - RNA, 18 nt, Mycobacterium avium subsp. paratuberculosis
cuuugccguuccagccgg

SEQ ID NO: 2899289 - RNA, 18 nt, Mycobacterium avium subsp. paratuberculosis
cuuugccuuagcccggcc

SEQ ID NO: 2899290 - RNA, 16 nt, Mycobacterium avium subsp. paratuberculosis
cuuugcggccguggcg

SEQ ID NO: 2899291 - RNA, 22 nt, Mycobacterium avium subsp. paratuberculosis
cuuuggcuaaacaauggccccg

SEQ ID NO: 2899292 - RNA, 18 nt, Mycobacterium avium subsp. paratuberculosis
cuuuggucgaacacuucg

SEQ ID NO: 2899293 - RNA, 19 nt, Mycobacterium avium subsp. paratuberculosis
cuuuuccaucugggcgcgc

SEQ ID NO: 2899294 - RNA, 19 nt, Mycobacterium avium subsp. paratuberculosis
cuuuuccggcgacaccgca

SEQ ID NO: 2899295 - RNA, 14 nt, Mycobacterium avium subsp. paratuberculosis
gaaaaaacggcggc

SEQ ID NO: 2899296 - RNA, 16 nt, Mycobacterium avium subsp. paratuberculosis
gaaaaacgcgacggcc

SEQ ID NO: 2899297 - RNA, 21 nt, Mycobacterium avium subsp. paratuberculosis
gaaaaacggcuuaaucgccca

SEQ ID NO: 2899298 - RNA, 22 nt, Mycobacterium avium subsp. paratuberculosis
gaaaaagcguugcgccagcagg

SEQ ID NO: 2899299 - RNA, 11 nt, Mycobacterium avium subsp. paratuberculosis
gaaaaccagca

SEQ ID NO: 2899300 - RNA, 12 nt, Mycobacterium avium subsp. paratuberculosis
gaaaaccagcac

SEQ ID NO: 2899301 - RNA, 12 nt, Mycobacterium avium subsp. paratuberculosis
gaaaaccagcga

SEQ ID NO: 2899302 - RNA, 17 nt, Mycobacterium avium subsp. paratuberculosis
gaaaaccagcgacgcca

SEQ ID NO: 2899303 - RNA, 23 nt, Mycobacterium avium subsp. paratuberculosis
gaaaaccagcgacgccagcggca

SEQ ID NO: 2899304 - RNA, 13 nt, Mycobacterium avium subsp. paratuberculosis
gaaaaccccaccc

SEQ ID NO: 2899305 - RNA, 17 nt, Mycobacterium avium subsp. paratuberculosis
gaaaacgccugcgccgc

SEQ ID NO: 2899306 - RNA, 18 nt, Mycobacterium avium subsp. paratuberculosis
gaaaagauguaucaggau

SEQ ID NO: 2899307 - RNA, 18 nt, Mycobacterium avium subsp. paratuberculosis
gaaaagcgaccagcgcgc

SEQ ID NO: 2899308 - RNA, 23 nt, Mycobacterium avium subsp. paratuberculosis
gaaaagcuucuugcugccgucgg

SEQ ID NO: 2899309 - RNA, 11 nt, Mycobacterium avium subsp. paratuberculosis
gaaaagugggu

SEQ ID NO: 2899310 - RNA, 18 nt, Mycobacterium avium subsp. paratuberculosis
gaaaauggcugcccggca

SEQ ID NO: 2899311 - RNA, 16 nt, Mycobacterium avium subsp. paratuberculosis
gaaacacagcagcacg

SEQ ID NO: 2899312 - RNA, 16 nt, Mycobacterium avium subsp. paratuberculosis
gaaacaccaagcacca

SEQ ID NO: 2899313 - RNA, 23 nt, Mycobacterium avium subsp. paratuberculosis
gaaaccaacacccuugcgccgcu

SEQ ID NO: 2899314 - RNA, 18 nt, Mycobacterium avium subsp. paratuberculosis
gaaaccaccugccgcaac

SEQ ID NO: 2899315 - RNA, 17 nt, Mycobacterium avium subsp. paratuberculosis
gaaaccauugcaccgca

SEQ ID NO: 2899316 - RNA, 19 nt, Mycobacterium avium subsp. paratuberculosis
gaaaccccacgaucgcguc

SEQ ID NO: 2899317 - RNA, 15 nt, Mycobacterium avium subsp. paratuberculosis
gaaaccccagccggc

SEQ ID NO: 2899318 - RNA, 16 nt, Mycobacterium avium subsp. paratuberculosis
gaaaccccagccggcc

SEQ ID NO: 2899319 - RNA, 18 nt, Mycobacterium avium subsp. paratuberculosis
gaaacccucgacgccggg

SEQ ID NO: 2899320 - RNA, 14 nt, Mycobacterium avium subsp. paratuberculosis
gaaaccggccagca

SEQ ID NO: 2899321 - RNA, 17 nt, Mycobacterium avium subsp. paratuberculosis
gaaaccggccagcagca

SEQ ID NO: 2899322 - RNA, 21 nt, Mycobacterium avium subsp. paratuberculosis
gaaaccggcgccgaagcccgc

SEQ ID NO: 2899323 - RNA, 20 nt, Mycobacterium avium subsp. paratuberculosis
gaaaccggucaacggcucgg

SEQ ID NO: 2899324 - RNA, 13 nt, Mycobacterium avium subsp. paratuberculosis
gaaaccgucgacc

SEQ ID NO: 2899325 - RNA, 16 nt, Mycobacterium avium subsp. paratuberculosis
gaaaccgucggcccgc

SEQ ID NO: 2899326 - RNA, 17 nt, Mycobacterium avium subsp. paratuberculosis
gaaaccgucggcccgcc

SEQ ID NO: 2899327 - RNA, 18 nt, Mycobacterium avium subsp. paratuberculosis
gaaaccguggaagucgcc

SEQ ID NO: 2899328 - RNA, 19 nt, Mycobacterium avium subsp. paratuberculosis
gaaaccguuuucacagcuc

SEQ ID NO: 2899329 - RNA, 22 nt, Mycobacterium avium subsp. paratuberculosis
gaaaccuccggagaucgccccg

SEQ ID NO: 2899330 - RNA, 18 nt, Mycobacterium avium subsp. paratuberculosis
gaaaccucuugcggcgca

SEQ ID NO: 2899331 - RNA, 17 nt, Mycobacterium avium subsp. paratuberculosis
gaaacgcaacagcgagu

SEQ ID NO: 2899332 - RNA, 15 nt, Mycobacterium avium subsp. paratuberculosis
gaaacgcccggcuca

SEQ ID NO: 2899333 - RNA, 15 nt, Mycobacterium avium subsp. paratuberculosis
gaaacgccgcgcucg

SEQ ID NO: 2899334 - RNA, 20 nt, Mycobacterium avium subsp. paratuberculosis
gaaacggcugcugcgcggca

SEQ ID NO: 2899335 - RNA, 16 nt, Mycobacterium avium subsp. paratuberculosis
gaaacggugcccgcag

SEQ ID NO: 2899336 - RNA, 19 nt, Mycobacterium avium subsp. paratuberculosis
gaaacuaacuucacgcucg

SEQ ID NO: 2899337 - RNA, 19 nt, Mycobacterium avium subsp. paratuberculosis
gaaacuagcuucacgcucg

SEQ ID NO: 2899338 - RNA, 20 nt, Mycobacterium avium subsp. paratuberculosis
gaaacuagcuucacgcucgg

SEQ ID NO: 2899339 - RNA, 20 nt, Mycobacterium avium subsp. paratuberculosis
gaaacuagcuucacggucgg

SEQ ID NO: 2899340 - RNA, 20 nt, Mycobacterium avium subsp. paratuberculosis
gaaacuagcuucacguucgg

SEQ ID NO: 2899341 - RNA, 14 nt, Mycobacterium avium subsp. paratuberculosis
gaaacucaccgcgu

SEQ ID NO: 2899342 - RNA, 17 nt, Mycobacterium avium subsp. paratuberculosis
gaaacuccuggccccga

SEQ ID NO: 2899343 - RNA, 22 nt, Mycobacterium avium subsp. paratuberculosis
gaaacuuguggaaggcgccggc

SEQ ID NO: 2899344 - RNA, 23 nt, Mycobacterium avium subsp. paratuberculosis
gaaacuuguggaaggcgccggcg

SEQ ID NO: 2899345 - RNA, 14 nt, Mycobacterium avium subsp. paratuberculosis
gaaagcacccgaca

SEQ ID NO: 2899346 - RNA, 21 nt, Mycobacterium avium subsp. paratuberculosis
gaaagcagcguucggucagca

SEQ ID NO: 2899347 - RNA, 20 nt, Mycobacterium avium subsp. paratuberculosis
gaaagccacccgcgccucca

SEQ ID NO: 2899348 - RNA, 11 nt, Mycobacterium avium subsp. paratuberculosis
gaaagcccagg

SEQ ID NO: 2899349 - RNA, 14 nt, Mycobacterium avium subsp. paratuberculosis
gaaagcccaggccc

SEQ ID NO: 2899350 - RNA, 15 nt, Mycobacterium avium subsp. paratuberculosis
gaaagcccccagcuc

SEQ ID NO: 2899351 - RNA, 22 nt, Mycobacterium avium subsp. paratuberculosis
gaaagccguaccgcaacaccga

SEQ ID NO: 2899352 - RNA, 20 nt, Mycobacterium avium subsp. paratuberculosis
gaaagcgcuugucgcagacc

SEQ ID NO: 2899353 - RNA, 20 nt, Mycobacterium avium subsp. paratuberculosis
gaaagcgcuuucgcuggucg

SEQ ID NO: 2899354 - RNA, 16 nt, Mycobacterium avium subsp. paratuberculosis
gaaagcucgcgucgac

SEQ ID NO: 2899355 - RNA, 17 nt, Mycobacterium avium subsp. paratuberculosis
gaaagcucgcgucgacg

SEQ ID NO: 2899356 - RNA, 11 nt, Mycobacterium avium subsp. paratuberculosis
gaaaggaucug

SEQ ID NO: 2899357 - RNA, 12 nt, Mycobacterium avium subsp. paratuberculosis
gaaaggaucuga

SEQ ID NO: 2899358 - RNA, 13 nt, Mycobacterium avium subsp. paratuberculosis
gaaaggcagcagc

SEQ ID NO: 2899359 - RNA, 14 nt, Mycobacterium avium subsp. paratuberculosis
gaaaggccagcacg

SEQ ID NO: 2899360 - RNA, 18 nt, Mycobacterium avium subsp. paratuberculosis
gaaaguacggcauggaca

SEQ ID NO: 2899361 - RNA, 20 nt, Mycobacterium avium subsp. paratuberculosis
gaaagugcaacugccgacgg

SEQ ID NO: 2899362 - RNA, 20 nt, Mycobacterium avium subsp. paratuberculosis
gaaagugcuacugccgacgc

SEQ ID NO: 2899363 - RNA, 12 nt, Mycobacterium avium subsp. paratuberculosis
gaaauccgggcg

SEQ ID NO: 2899364 - RNA, 16 nt, Mycobacterium avium subsp. paratuberculosis
gaaauccgggcgcgga

SEQ ID NO: 2899365 - RNA, 14 nt, Mycobacterium avium subsp. paratuberculosis
gaaaucgagcgcgc

SEQ ID NO: 2899366 - RNA, 15 nt, Mycobacterium avium subsp. paratuberculosis
gaaaucgagcgcgcu

SEQ ID NO: 2899367 - RNA, 22 nt, Mycobacterium avium subsp. paratuberculosis
gaaaucgagcgcgcugugcgcc

SEQ ID NO: 2899368 - RNA, 20 nt, Mycobacterium avium subsp. paratuberculosis
gaaaucgccuguccgaccag

SEQ ID NO: 2899369 - RNA, 16 nt, Mycobacterium avium subsp. paratuberculosis
gaaaucggacccagcc

SEQ ID NO: 2899370 - RNA, 19 nt, Mycobacterium avium subsp. paratuberculosis
gaaaucguagaagcguacc

SEQ ID NO: 2899371 - RNA, 16 nt, Mycobacterium avium subsp. paratuberculosis
gaaaucucgaagugga

SEQ ID NO: 2899372 - RNA, 22 nt, Mycobacterium avium subsp. paratuberculosis
gaaaugcaacgcacgggcggcg

SEQ ID NO: 2899373 - RNA, 14 nt, Mycobacterium avium subsp. paratuberculosis
gaaaugccgggccg

SEQ ID NO: 2899374 - RNA, 22 nt, Mycobacterium avium subsp. paratuberculosis
gaaaugccgugccagccggccg

SEQ ID NO: 2899375 - RNA, 18 nt, Mycobacterium avium subsp. paratuberculosis
gaaaugccuuggcggcgu

SEQ ID NO: 2899376 - RNA, 23 nt, Mycobacterium avium subsp. paratuberculosis
gaaaugcgggcgauggcgggccg

SEQ ID NO: 2899377 - RNA, 15 nt, Mycobacterium avium subsp. paratuberculosis
gaaaugcgucgccag

SEQ ID NO: 2899378 - RNA, 16 nt, Mycobacterium avium subsp. paratuberculosis
gaaaugcgucgccagu

SEQ ID NO: 2899379 - RNA, 14 nt, Mycobacterium avium subsp. paratuberculosis
gaaaugggccaugc

SEQ ID NO: 2899380 - RNA, 16 nt, Mycobacterium avium subsp. paratuberculosis
gaaauucaggccacgc

SEQ ID NO: 2899381 - RNA, 17 nt, Mycobacterium avium subsp. paratuberculosis
gaacaacccggccgcga

SEQ ID NO: 2899382 - RNA, 14 nt, Mycobacterium avium subsp. paratuberculosis
gaacaaccgcagcg

SEQ ID NO: 2899383 - RNA, 17 nt, Mycobacterium avium subsp. paratuberculosis
gaacaacgcgcacaaca

SEQ ID NO: 2899384 - RNA, 20 nt, Mycobacterium avium subsp. paratuberculosis
gaacaacgcgcacaacagcc

SEQ ID NO: 2899385 - RNA, 23 nt, Mycobacterium avium subsp. paratuberculosis
gaacaacgcgcacaacagccaug

SEQ ID NO: 2899386 - RNA, 13 nt, Mycobacterium avium subsp. paratuberculosis
gaacaacgcggug

SEQ ID NO: 2899387 - RNA, 22 nt, Mycobacterium avium subsp. paratuberculosis
gaacaacgcggugaccgcggcc

SEQ ID NO: 2899388 - RNA, 18 nt, Mycobacterium avium subsp. paratuberculosis
gaacaacggcggaccggc

SEQ ID NO: 2899389 - RNA, 21 nt, Mycobacterium avium subsp. paratuberculosis
gaacaacggcggaccggcggc

SEQ ID NO: 2899390 - RNA, 19 nt, Mycobacterium avium subsp. paratuberculosis
gaacaacugaccgauggcc

SEQ ID NO: 2899391 - RNA, 23 nt, Mycobacterium avium subsp. paratuberculosis
gaacacaucguggcgcaucaccu

SEQ ID NO: 2899392 - RNA, 16 nt, Mycobacterium avium subsp. paratuberculosis
gaacaccaccaggccg

SEQ ID NO: 2899393 - RNA, 13 nt, Mycobacterium avium subsp. paratuberculosis
gaacaccaccgcc

SEQ ID NO: 2899394 - RNA, 22 nt, Mycobacterium avium subsp. paratuberculosis
gaacaccaccggcaaccgccac

SEQ ID NO: 2899395 - RNA, 14 nt, Mycobacterium avium subsp. paratuberculosis
gaacaccacgccga

SEQ ID NO: 2899396 - RNA, 16 nt, Mycobacterium avium subsp. paratuberculosis
gaacaccacggccggc

SEQ ID NO: 2899397 - RNA, 23 nt, Mycobacterium avium subsp. paratuberculosis
gaacaccacgguguagcggcggc

SEQ ID NO: 2899398 - RNA, 19 nt, Mycobacterium avium subsp. paratuberculosis
gaacaccacguagccgacc

SEQ ID NO: 2899399 - RNA, 20 nt, Mycobacterium avium subsp. paratuberculosis
gaacaccagaugccgcucgg

SEQ ID NO: 2899400 - RNA, 22 nt, Mycobacterium avium subsp. paratuberculosis
gaacaccagaugccgcucggcg

SEQ ID NO: 2899401 - RNA, 14 nt, Mycobacterium avium subsp. paratuberculosis
gaacaccagcaccc

SEQ ID NO: 2899402 - RNA, 15 nt, Mycobacterium avium subsp. paratuberculosis
gaacaccagcaccca

SEQ ID NO: 2899403 - RNA, 17 nt, Mycobacterium avium subsp. paratuberculosis
gaacaccagcacccagc

SEQ ID NO: 2899404 - RNA, 13 nt, Mycobacterium avium subsp. paratuberculosis
gaacaccagcccg

SEQ ID NO: 2899405 - RNA, 13 nt, Mycobacterium avium subsp. paratuberculosis
gaacaccagcgca

SEQ ID NO: 2899406 - RNA, 20 nt, Mycobacterium avium subsp. paratuberculosis
gaacacccggcuucgcugcg

SEQ ID NO: 2899407 - RNA, 23 nt, Mycobacterium avium subsp. paratuberculosis
gaacacccggcuucgcugcgccg

SEQ ID NO: 2899408 - RNA, 15 nt, Mycobacterium avium subsp. paratuberculosis
gaacaccgagccggc

SEQ ID NO: 2899409 - RNA, 16 nt, Mycobacterium avium subsp. paratuberculosis
gaacaccgccuugccc

SEQ ID NO: 2899410 - RNA, 14 nt, Mycobacterium avium subsp. paratuberculosis
gaacaccgcgcuga

SEQ ID NO: 2899411 - RNA, 16 nt, Mycobacterium avium subsp. paratuberculosis
gaacaccggcagcgcc

SEQ ID NO: 2899412 - RNA, 17 nt, Mycobacterium avium subsp. paratuberculosis
gaacaccggcagcgcca

SEQ ID NO: 2899413 - RNA, 18 nt, Mycobacterium avium subsp. paratuberculosis
gaacaccggcagcgccac

SEQ ID NO: 2899414 - RNA, 17 nt, Mycobacterium avium subsp. paratuberculosis
gaacaccgucaucgugu

SEQ ID NO: 2899415 - RNA, 22 nt, Mycobacterium avium subsp. paratuberculosis
gaacaccgucaucgugugggcg

SEQ ID NO: 2899416 - RNA, 18 nt, Mycobacterium avium subsp. paratuberculosis
gaacaccgugccgucacg

SEQ ID NO: 2899417 - RNA, 14 nt, Mycobacterium avium subsp. paratuberculosis
gaacaccuccucgg

SEQ ID NO: 2899418 - RNA, 17 nt, Mycobacterium avium subsp. paratuberculosis
gaacaccuccucggugu

SEQ ID NO: 2899419 - RNA, 23 nt, Mycobacterium avium subsp. paratuberculosis
gaacaccuccucgguguacagcg

SEQ ID NO: 2899420 - RNA, 12 nt, Mycobacterium avium subsp. paratuberculosis
gaacaccucgaa

SEQ ID NO: 2899421 - RNA, 22 nt, Mycobacterium avium subsp. paratuberculosis
gaacaccucgaaguucuccucg

SEQ ID NO: 2899422 - RNA, 18 nt, Mycobacterium avium subsp. paratuberculosis
gaacacgaacccggcggc

SEQ ID NO: 2899423 - RNA, 17 nt, Mycobacterium avium subsp. paratuberculosis
gaacacgcaggugcgcc

SEQ ID NO: 2899424 - RNA, 17 nt, Mycobacterium avium subsp. paratuberculosis
gaacacgcccagcgccg

SEQ ID NO: 2899425 - RNA, 19 nt, Mycobacterium avium subsp. paratuberculosis
gaacacgcccagcgccgcg

SEQ ID NO: 2899426 - RNA, 20 nt, Mycobacterium avium subsp. paratuberculosis
gaacacgcccagcgccgcgu

SEQ ID NO: 2899427 - RNA, 22 nt, Mycobacterium avium subsp. paratuberculosis
gaacacgcccagcgccgcguag

SEQ ID NO: 2899428 - RNA, 15 nt, Mycobacterium avium subsp. paratuberculosis
gaacacgccccggcg

SEQ ID NO: 2899429 - RNA, 16 nt, Mycobacterium avium subsp. paratuberculosis
gaacacgccccggcgg

SEQ ID NO: 2899430 - RNA, 17 nt, Mycobacterium avium subsp. paratuberculosis
gaacacgccccggcggg

SEQ ID NO: 2899431 - RNA, 21 nt, Mycobacterium avium subsp. paratuberculosis
gaacacgcgaugaucagcucg

SEQ ID NO: 2899432 - RNA, 24 nt, Mycobacterium avium subsp. paratuberculosis
gaacacggccgccuccagcacguc

SEQ ID NO: 2899433 - RNA, 21 nt, Mycobacterium avium subsp. paratuberculosis
gaacacggcucgggggccgcu

SEQ ID NO: 2899434 - RNA, 13 nt, Mycobacterium avium subsp. paratuberculosis
gaacacgggcggc

SEQ ID NO: 2899435 - RNA, 14 nt, Mycobacterium avium subsp. paratuberculosis
gaacacgggcggca

SEQ ID NO: 2899436 - RNA, 20 nt, Mycobacterium avium subsp. paratuberculosis
gaacacgggcggcagggcca

SEQ ID NO: 2899437 - RNA, 15 nt, Mycobacterium avium subsp. paratuberculosis
gaacacggucgccgg

SEQ ID NO: 2899438 - RNA, 17 nt, Mycobacterium avium subsp. paratuberculosis
gaacacggucgccggcu

SEQ ID NO: 2899439 - RNA, 17 nt, Mycobacterium avium subsp. paratuberculosis
gaacacguacagcggcg

SEQ ID NO: 2899440 - RNA, 19 nt, Mycobacterium avium subsp. paratuberculosis
gaacacguacagcggcggc

SEQ ID NO: 2899441 - RNA, 17 nt, Mycobacterium avium subsp. paratuberculosis
gaacacguagcgaucgg

SEQ ID NO: 2899442 - RNA, 20 nt, Mycobacterium avium subsp. paratuberculosis
gaacacgucggccagcgcgu

SEQ ID NO: 2899443 - RNA, 14 nt, Mycobacterium avium subsp. paratuberculosis
gaacacgucggcga

SEQ ID NO: 2899444 - RNA, 14 nt, Mycobacterium avium subsp. paratuberculosis
gaacacgugcagcu

SEQ ID NO: 2899445 - RNA, 16 nt, Mycobacterium avium subsp. paratuberculosis
gaacacgugcagcucg

SEQ ID NO: 2899446 - RNA, 19 nt, Mycobacterium avium subsp. paratuberculosis
gaacacguugcgcaucagc

SEQ ID NO: 2899447 - RNA, 19 nt, Mycobacterium avium subsp. paratuberculosis
gaacagacucagcccggcc

SEQ ID NO: 2899448 - RNA, 16 nt, Mycobacterium avium subsp. paratuberculosis
gaacagaugccugccc

SEQ ID NO: 2899449 - RNA, 22 nt, Mycobacterium avium subsp. paratuberculosis
gaacagcacccccucggcgccg

SEQ ID NO: 2899450 - RNA, 15 nt, Mycobacterium avium subsp. paratuberculosis
gaacagcaccgccac

SEQ ID NO: 2899451 - RNA, 16 nt, Mycobacterium avium subsp. paratuberculosis
gaacagcacgccggcc

SEQ ID NO: 2899452 - RNA, 17 nt, Mycobacterium avium subsp. paratuberculosis
gaacagcacgccggccg

SEQ ID NO: 2899453 - RNA, 19 nt, Mycobacterium avium subsp. paratuberculosis
gaacagcacgccggccggc

SEQ ID NO: 2899454 - RNA, 23 nt, Mycobacterium avium subsp. paratuberculosis
gaacagcagaaaauagcccagcc

SEQ ID NO: 2899455 - RNA, 16 nt, Mycobacterium avium subsp. paratuberculosis
gaacagcagcagcagc

SEQ ID NO: 2899456 - RNA, 17 nt, Mycobacterium avium subsp. paratuberculosis
gaacagcagcagcagcg

SEQ ID NO: 2899457 - RNA, 14 nt, Mycobacterium avium subsp. paratuberculosis
gaacagcagccacg

SEQ ID NO: 2899458 - RNA, 11 nt, Mycobacterium avium subsp. paratuberculosis
gaacagcagcg

SEQ ID NO: 2899459 - RNA, 16 nt, Mycobacterium avium subsp. paratuberculosis
gaacagcagcgaaccc

SEQ ID NO: 2899460 - RNA, 18 nt, Mycobacterium avium subsp. paratuberculosis
gaacagcagcgaacccgc

SEQ ID NO: 2899461 - RNA, 20 nt, Mycobacterium avium subsp. paratuberculosis
gaacagcagcgcgccgacca

SEQ ID NO: 2899462 - RNA, 18 nt, Mycobacterium avium subsp. paratuberculosis
gaacagcaggcccaggcc

SEQ ID NO: 2899463 - RNA, 19 nt, Mycobacterium avium subsp. paratuberculosis
gaacagcaggcccaggccg

SEQ ID NO: 2899464 - RNA, 23 nt, Mycobacterium avium subsp. paratuberculosis
gaacagcaggcccaggccgaugg

SEQ ID NO: 2899465 - RNA, 23 nt, Mycobacterium avium subsp. paratuberculosis
gaacagccacgguccuuggcgua

SEQ ID NO: 2899466 - RNA, 14 nt, Mycobacterium avium subsp. paratuberculosis
gaacagcccgagca

SEQ ID NO: 2899467 - RNA, 15 nt, Mycobacterium avium subsp. paratuberculosis
gaacagcccgagcac

SEQ ID NO: 2899468 - RNA, 17 nt, Mycobacterium avium subsp. paratuberculosis
gaacagcccgagcacgu

SEQ ID NO: 2899469 - RNA, 13 nt, Mycobacterium avium subsp. paratuberculosis
gaacagccgaccg

SEQ ID NO: 2899470 - RNA, 17 nt, Mycobacterium avium subsp. paratuberculosis
gaacagccggaucagcg

SEQ ID NO: 2899471 - RNA, 24 nt, Mycobacterium avium subsp. paratuberculosis
gaacagccggaucagcguuccggc

SEQ ID NO: 2899472 - RNA, 16 nt, Mycobacterium avium subsp. paratuberculosis
gaacagccgggccagc

SEQ ID NO: 2899473 - RNA, 17 nt, Mycobacterium avium subsp. paratuberculosis
gaacagccgggccagca

SEQ ID NO: 2899474 - RNA, 19 nt, Mycobacterium avium subsp. paratuberculosis
gaacagccgggccagcagc

SEQ ID NO: 2899475 - RNA, 20 nt, Mycobacterium avium subsp. paratuberculosis
gaacagccgggccagcagcu

SEQ ID NO: 2899476 - RNA, 21 nt, Mycobacterium avium subsp. paratuberculosis
gaacagccgggccgcccgcgc

SEQ ID NO: 2899477 - RNA, 22 nt, Mycobacterium avium subsp. paratuberculosis
gaacagccgggccgcccgcgcg

SEQ ID NO: 2899478 - RNA, 15 nt, Mycobacterium avium subsp. paratuberculosis
gaacagccgggcggc

SEQ ID NO: 2899479 - RNA, 17 nt, Mycobacterium avium subsp. paratuberculosis
gaacagccgggcggccg

SEQ ID NO: 2899480 - RNA, 13 nt, Mycobacterium avium subsp. paratuberculosis
gaacagccggucc

SEQ ID NO: 2899481 - RNA, 15 nt, Mycobacterium avium subsp. paratuberculosis
gaacagcgaagccac

SEQ ID NO: 2899482 - RNA, 20 nt, Mycobacterium avium subsp. paratuberculosis
gaacagcgacgucugcggcu

SEQ ID NO: 2899483 - RNA, 22 nt, Mycobacterium avium subsp. paratuberculosis
gaacagcgacgucugcggcucg

SEQ ID NO: 2899484 - RNA, 19 nt, Mycobacterium avium subsp. paratuberculosis
gaacagcgacuccugacgc

SEQ ID NO: 2899485 - RNA, 17 nt, Mycobacterium avium subsp. paratuberculosis
gaacagcgcgcccgacg

SEQ ID NO: 2899486 - RNA, 15 nt, Mycobacterium avium subsp. paratuberculosis
gaacagcgcggccac

SEQ ID NO: 2899487 - RNA, 16 nt, Mycobacterium avium subsp. paratuberculosis
gaacagcgcggccacc

SEQ ID NO: 2899488 - RNA, 19 nt, Mycobacterium avium subsp. paratuberculosis
gaacagcgcggccaccacg

SEQ ID NO: 2899489 - RNA, 19 nt, Mycobacterium avium subsp. paratuberculosis
gaacagcgggccggcgucg

SEQ ID NO: 2899490 - RNA, 14 nt, Mycobacterium avium subsp. paratuberculosis
gaacagcggggugc

SEQ ID NO: 2899491 - RNA, 17 nt, Mycobacterium avium subsp. paratuberculosis
gaacagcggggugccca

SEQ ID NO: 2899492 - RNA, 18 nt, Mycobacterium avium subsp. paratuberculosis
gaacagcggguucuucag

SEQ ID NO: 2899493 - RNA, 17 nt, Mycobacterium avium subsp. paratuberculosis
gaacagcgucaggucac

SEQ ID NO: 2899494 - RNA, 17 nt, Mycobacterium avium subsp. paratuberculosis
gaacagcucgaccagcc

SEQ ID NO: 2899495 - RNA, 21 nt, Mycobacterium avium subsp. paratuberculosis
gaacagcuggucccacagcgg

SEQ ID NO: 2899496 - RNA, 13 nt, Mycobacterium avium subsp. paratuberculosis
gaacagcuuggcg

SEQ ID NO: 2899497 - RNA, 18 nt, Mycobacterium avium subsp. paratuberculosis
gaacagcuuggcgcagcc

SEQ ID NO: 2899498 - RNA, 16 nt, Mycobacterium avium subsp. paratuberculosis
gaacaggaugcagccg

SEQ ID NO: 2899499 - RNA, 22 nt, Mycobacterium avium subsp. paratuberculosis
gaacaggcccugcugcagcgcg

SEQ ID NO: 2899500 - RNA, 19 nt, Mycobacterium avium subsp. paratuberculosis
gaacaggcgcaacagcacc

SEQ ID NO: 2899501 - RNA, 14 nt, Mycobacterium avium subsp. paratuberculosis
gaacaggcuggcca

SEQ ID NO: 2899502 - RNA, 17 nt, Mycobacterium avium subsp. paratuberculosis
gaacagggcgacggcgg

SEQ ID NO: 2899503 - RNA, 15 nt, Mycobacterium avium subsp. paratuberculosis
gaacagggcggcggg

SEQ ID NO: 2899504 - RNA, 22 nt, Mycobacterium avium subsp. paratuberculosis
gaacagggcggcgggcccggcg

SEQ ID NO: 2899505 - RNA, 19 nt, Mycobacterium avium subsp. paratuberculosis
gaacagguaggacaccgaa

SEQ ID NO: 2899506 - RNA, 17 nt, Mycobacterium avium subsp. paratuberculosis
gaacagguaggcggcgc

SEQ ID NO: 2899507 - RNA, 19 nt, Mycobacterium avium subsp. paratuberculosis
gaacagguaggcggcgccg

SEQ ID NO: 2899508 - RNA, 22 nt, Mycobacterium avium subsp. paratuberculosis
gaacagguaggcggcgccgucg

SEQ ID NO: 2899509 - RNA, 20 nt, Mycobacterium avium subsp. paratuberculosis
gaacagguaguagcgcgccg

SEQ ID NO: 2899510 - RNA, 13 nt, Mycobacterium avium subsp. paratuberculosis
gaacagguccgcg

SEQ ID NO: 2899511 - RNA, 14 nt, Mycobacterium avium subsp. paratuberculosis
gaacagguccgcga

SEQ ID NO: 2899512 - RNA, 17 nt, Mycobacterium avium subsp. paratuberculosis
gaacagguccuugccca

SEQ ID NO: 2899513 - RNA, 22 nt, Mycobacterium avium subsp. paratuberculosis
gaacagguccuugcccagcagu

SEQ ID NO: 2899514 - RNA, 15 nt, Mycobacterium avium subsp. paratuberculosis
gaacagucggccggc

SEQ ID NO: 2899515 - RNA, 16 nt, Mycobacterium avium subsp. paratuberculosis
gaacagucggccggcg

SEQ ID NO: 2899516 - RNA, 17 nt, Mycobacterium avium subsp. paratuberculosis
gaacagucggccggcgu

SEQ ID NO: 2899517 - RNA, 20 nt, Mycobacterium avium subsp. paratuberculosis
gaacagugcacugccgaccc

SEQ ID NO: 2899518 - RNA, 15 nt, Mycobacterium avium subsp. paratuberculosis
gaacaguucgacgua

SEQ ID NO: 2899519 - RNA, 18 nt, Mycobacterium avium subsp. paratuberculosis
gaacaguucgacguagcc

SEQ ID NO: 2899520 - RNA, 16 nt, Mycobacterium avium subsp. paratuberculosis
gaacaucacccggcgg

SEQ ID NO: 2899521 - RNA, 11 nt, Mycobacterium avium subsp. paratuberculosis
gaacaucagcc

SEQ ID NO: 2899522 - RNA, 15 nt, Mycobacterium avium subsp. paratuberculosis
gaacauccacggcau

SEQ ID NO: 2899523 - RNA, 19 nt, Mycobacterium avium subsp. paratuberculosis
gaacauccacggcauggug

SEQ ID NO: 2899524 - RNA, 18 nt, Mycobacterium avium subsp. paratuberculosis
gaacaucgagcccaccgc

SEQ ID NO: 2899525 - RNA, 19 nt, Mycobacterium avium subsp. paratuberculosis
gaacaucgagcccaccgcg

SEQ ID NO: 2899526 - RNA, 13 nt, Mycobacterium avium subsp. paratuberculosis
gaacaucgccagc

SEQ ID NO: 2899527 - RNA, 15 nt, Mycobacterium avium subsp. paratuberculosis
gaacaucgccagcaa

SEQ ID NO: 2899528 - RNA, 20 nt, Mycobacterium avium subsp. paratuberculosis
gaacaucgccucggccgcgg

SEQ ID NO: 2899529 - RNA, 14 nt, Mycobacterium avium subsp. paratuberculosis
gaacaucggccggg

SEQ ID NO: 2899530 - RNA, 20 nt, Mycobacterium avium subsp. paratuberculosis
gaacaucuuggucagccgcg

SEQ ID NO: 2899531 - RNA, 23 nt, Mycobacterium avium subsp. paratuberculosis
gaacaucuuggucagccgcggcg

SEQ ID NO: 2899532 - RNA, 24 nt, Mycobacterium avium subsp. paratuberculosis
gaacauggccuugaacucggccag

SEQ ID NO: 2899533 - RNA, 19 nt, Mycobacterium avium subsp. paratuberculosis
gaacauggcggccagccgg

SEQ ID NO: 2899534 - RNA, 18 nt, Mycobacterium avium subsp. paratuberculosis
gaaccaacugagcgcggc

SEQ ID NO: 2899535 - RNA, 16 nt, Mycobacterium avium subsp. paratuberculosis
gaaccacaccccggcc

SEQ ID NO: 2899536 - RNA, 20 nt, Mycobacterium avium subsp. paratuberculosis
gaaccacaccccggccacca

SEQ ID NO: 2899537 - RNA, 16 nt, Mycobacterium avium subsp. paratuberculosis
gaaccaccgcgcccac

SEQ ID NO: 2899538 - RNA, 13 nt, Mycobacterium avium subsp. paratuberculosis
gaaccacgcggcg

SEQ ID NO: 2899539 - RNA, 14 nt, Mycobacterium avium subsp. paratuberculosis
gaaccacgggucgc

SEQ ID NO: 2899540 - RNA, 16 nt, Mycobacterium avium subsp. paratuberculosis
gaaccacuucuggcgc

SEQ ID NO: 2899541 - RNA, 14 nt, Mycobacterium avium subsp. paratuberculosis
gaaccagcaccgcc

SEQ ID NO: 2899542 - RNA, 17 nt, Mycobacterium avium subsp. paratuberculosis
gaaccagcaccgccgcg

SEQ ID NO: 2899543 - RNA, 23 nt, Mycobacterium avium subsp. paratuberculosis
gaaccagcaugcgccagagcgcg

SEQ ID NO: 2899544 - RNA, 14 nt, Mycobacterium avium subsp. paratuberculosis
gaaccagcccaggu

SEQ ID NO: 2899545 - RNA, 14 nt, Mycobacterium avium subsp. paratuberculosis
gaaccagcccggcc

SEQ ID NO: 2899546 - RNA, 12 nt, Mycobacterium avium subsp. paratuberculosis
gaaccagcgccc

SEQ ID NO: 2899547 - RNA, 14 nt, Mycobacterium avium subsp. paratuberculosis
gaaccagcgcccgc

SEQ ID NO: 2899548 - RNA, 14 nt, Mycobacterium avium subsp. paratuberculosis
gaaccaggccgcgc

SEQ ID NO: 2899549 - RNA, 17 nt, Mycobacterium avium subsp. paratuberculosis
gaaccaggccgcgcugg

SEQ ID NO: 2899550 - RNA, 18 nt, Mycobacterium avium subsp. paratuberculosis
gaaccaggccgcgcuggc

SEQ ID NO: 2899551 - RNA, 20 nt, Mycobacterium avium subsp. paratuberculosis
gaaccaggccgcgcuggcgc

SEQ ID NO: 2899552 - RNA, 14 nt, Mycobacterium avium subsp. paratuberculosis
gaaccaggcgccgg

SEQ ID NO: 2899553 - RNA, 15 nt, Mycobacterium avium subsp. paratuberculosis
gaaccaggcgccggc

SEQ ID NO: 2899554 - RNA, 16 nt, Mycobacterium avium subsp. paratuberculosis
gaaccaggcgccggcc

SEQ ID NO: 2899555 - RNA, 18 nt, Mycobacterium avium subsp. paratuberculosis
gaaccaggcgccggccag

SEQ ID NO: 2899556 - RNA, 22 nt, Mycobacterium avium subsp. paratuberculosis
gaaccagggcagccagcccgcg

SEQ ID NO: 2899557 - RNA, 16 nt, Mycobacterium avium subsp. paratuberculosis
gaaccagugcccggcc

SEQ ID NO: 2899558 - RNA, 15 nt, Mycobacterium avium subsp. paratuberculosis
gaaccagugcgccuu

SEQ ID NO: 2899559 - RNA, 15 nt, Mycobacterium avium subsp. paratuberculosis
gaaccaguucgccac

SEQ ID NO: 2899560 - RNA, 16 nt, Mycobacterium avium subsp. paratuberculosis
gaaccaguucgccacc

SEQ ID NO: 2899561 - RNA, 19 nt, Mycobacterium avium subsp. paratuberculosis
gaaccaguucgccaccacg

SEQ ID NO: 2899562 - RNA, 20 nt, Mycobacterium avium subsp. paratuberculosis
gaaccaguucgccaccacgg

SEQ ID NO: 2899563 - RNA, 15 nt, Mycobacterium avium subsp. paratuberculosis
gaaccauucguggcu

SEQ ID NO: 2899564 - RNA, 18 nt, Mycobacterium avium subsp. paratuberculosis
gaaccauuugcccagcag

SEQ ID NO: 2899565 - RNA, 19 nt, Mycobacterium avium subsp. paratuberculosis
gaaccauuugcccagcagg

SEQ ID NO: 2899566 - RNA, 22 nt, Mycobacterium avium subsp. paratuberculosis
gaaccauuugcccagcagggcg

SEQ ID NO: 2899567 - RNA, 14 nt, Mycobacterium avium subsp. paratuberculosis
gaacccaccagcgc

SEQ ID NO: 2899568 - RNA, 15 nt, Mycobacterium avium subsp. paratuberculosis
gaacccaccagcgcc

SEQ ID NO: 2899569 - RNA, 17 nt, Mycobacterium avium subsp. paratuberculosis
gaacccacgugcggcgc

SEQ ID NO: 2899570 - RNA, 12 nt, Mycobacterium avium subsp. paratuberculosis
gaacccagcacc

SEQ ID NO: 2899571 - RNA, 14 nt, Mycobacterium avium subsp. paratuberculosis
gaacccagcacccc

SEQ ID NO: 2899572 - RNA, 12 nt, Mycobacterium avium subsp. paratuberculosis
gaacccagcgcc

SEQ ID NO: 2899573 - RNA, 14 nt, Mycobacterium avium subsp. paratuberculosis
gaacccagcgccuc

SEQ ID NO: 2899574 - RNA, 14 nt, Mycobacterium avium subsp. paratuberculosis
gaacccccucgcgc

SEQ ID NO: 2899575 - RNA, 20 nt, Mycobacterium avium subsp. paratuberculosis
gaaccccgagaucgcgggcu

SEQ ID NO: 2899576 - RNA, 14 nt, Mycobacterium avium subsp. paratuberculosis
gaacccgaccgcga

SEQ ID NO: 2899577 - RNA, 16 nt, Mycobacterium avium subsp. paratuberculosis
gaacccgagcaccccg

SEQ ID NO: 2899578 - RNA, 21 nt, Mycobacterium avium subsp. paratuberculosis
gaacccgagcaccccggcggc

SEQ ID NO: 2899579 - RNA, 17 nt, Mycobacterium avium subsp. paratuberculosis
gaacccgccagggcgac

SEQ ID NO: 2899580 - RNA, 14 nt, Mycobacterium avium subsp. paratuberculosis
gaacccggccagcg

SEQ ID NO: 2899581 - RNA, 13 nt, Mycobacterium avium subsp. paratuberculosis
gaacccggcccgg

SEQ ID NO: 2899582 - RNA, 15 nt, Mycobacterium avium subsp. paratuberculosis
gaacccggcgcccgg

SEQ ID NO: 2899583 - RNA, 20 nt, Mycobacterium avium subsp. paratuberculosis
gaacccggcgugcuccagca

SEQ ID NO: 2899584 - RNA, 18 nt, Mycobacterium avium subsp. paratuberculosis
gaaccgaaucggucgacc

SEQ ID NO: 2899585 - RNA, 17 nt, Mycobacterium avium subsp. paratuberculosis
gaaccgacaccucgccg

SEQ ID NO: 2899586 - RNA, 22 nt, Mycobacterium avium subsp. paratuberculosis
gaaccgacaccucgccguccuu

SEQ ID NO: 2899587 - RNA, 19 nt, Mycobacterium avium subsp. paratuberculosis
gaaccgaucaccggcagca

SEQ ID NO: 2899588 - RNA, 17 nt, Mycobacterium avium subsp. paratuberculosis
gaaccgcaacaccagca

SEQ ID NO: 2899589 - RNA, 16 nt, Mycobacterium avium subsp. paratuberculosis
gaaccgcaccccgucg

SEQ ID NO: 2899590 - RNA, 13 nt, Mycobacterium avium subsp. paratuberculosis
gaaccgcagccgg

SEQ ID NO: 2899591 - RNA, 13 nt, Mycobacterium avium subsp. paratuberculosis
gaaccgccccgcg

SEQ ID NO: 2899592 - RNA, 16 nt, Mycobacterium avium subsp. paratuberculosis
gaaccgccccgcgcga

SEQ ID NO: 2899593 - RNA, 18 nt, Mycobacterium avium subsp. paratuberculosis
gaaccgcccuuccagcac

SEQ ID NO: 2899594 - RNA, 19 nt, Mycobacterium avium subsp. paratuberculosis
gaaccgcccuuccagcacc

SEQ ID NO: 2899595 - RNA, 19 nt, Mycobacterium avium subsp. paratuberculosis
gaaccgccgcacccagcgg

SEQ ID NO: 2899596 - RNA, 23 nt, Mycobacterium avium subsp. paratuberculosis
gaaccgcgccuucgacccggugg

SEQ ID NO: 2899597 - RNA, 22 nt, Mycobacterium avium subsp. paratuberculosis
gaaccgcggcggcagcagcccg

SEQ ID NO: 2899598 - RNA, 20 nt, Mycobacterium avium subsp. paratuberculosis
gaaccgcucgauggcgccga

SEQ ID NO: 2899599 - RNA, 14 nt, Mycobacterium avium subsp. paratuberculosis
gaaccgcucggcgg

SEQ ID NO: 2899600 - RNA, 15 nt, Mycobacterium avium subsp. paratuberculosis
gaaccgcucggcggc

SEQ ID NO: 2899601 - RNA, 23 nt, Mycobacterium avium subsp. paratuberculosis
gaaccgcucgucgggaacgccga

SEQ ID NO: 2899602 - RNA, 16 nt, Mycobacterium avium subsp. paratuberculosis
gaaccgcugaccagga

SEQ ID NO: 2899603 - RNA, 16 nt, Mycobacterium avium subsp. paratuberculosis
gaaccgcugcaaccgg

SEQ ID NO: 2899604 - RNA, 22 nt, Mycobacterium avium subsp. paratuberculosis
gaaccgcugcugcucggccgca

SEQ ID NO: 2899605 - RNA, 21 nt, Mycobacterium avium subsp. paratuberculosis
gaaccgcuugcccagccccuu

SEQ ID NO: 2899606 - RNA, 17 nt, Mycobacterium avium subsp. paratuberculosis
gaaccggaagaucagca

SEQ ID NO: 2899607 - RNA, 20 nt, Mycobacterium avium subsp. paratuberculosis
gaaccggaagaucagcaggc

SEQ ID NO: 2899608 - RNA, 13 nt, Mycobacterium avium subsp. paratuberculosis
gaaccggaucaug

SEQ ID NO: 2899609 - RNA, 17 nt, Mycobacterium avium subsp. paratuberculosis
gaaccggcaacacagcc

SEQ ID NO: 2899610 - RNA, 18 nt, Mycobacterium avium subsp. paratuberculosis
gaaccggcagccggcgua

SEQ ID NO: 2899611 - RNA, 19 nt, Mycobacterium avium subsp. paratuberculosis
gaaccggcaggacgggggc

SEQ ID NO: 2899612 - RNA, 22 nt, Mycobacterium avium subsp. paratuberculosis
gaaccggcaggacgggggccgg

SEQ ID NO: 2899613 - RNA, 13 nt, Mycobacterium avium subsp. paratuberculosis
gaaccggccacca

SEQ ID NO: 2899614 - RNA, 15 nt, Mycobacterium avium subsp. paratuberculosis
gaaccggccggggcg

SEQ ID NO: 2899615 - RNA, 16 nt, Mycobacterium avium subsp. paratuberculosis
gaaccggccggggcgc

SEQ ID NO: 2899616 - RNA, 13 nt, Mycobacterium avium subsp. paratuberculosis
gaaccgggacagc

SEQ ID NO: 2899617 - RNA, 15 nt, Mycobacterium avium subsp. paratuberculosis
gaaccgggacagccg

SEQ ID NO: 2899618 - RNA, 18 nt, Mycobacterium avium subsp. paratuberculosis
gaaccgggacagccgcgc

SEQ ID NO: 2899619 - RNA, 16 nt, Mycobacterium avium subsp. paratuberculosis
gaaccgggcacccggc

SEQ ID NO: 2899620 - RNA, 18 nt, Mycobacterium avium subsp. paratuberculosis
gaaccgggcacccggcgc

SEQ ID NO: 2899621 - RNA, 18 nt, Mycobacterium avium subsp. paratuberculosis
gaaccgggccgcuggccg

SEQ ID NO: 2899622 - RNA, 14 nt, Mycobacterium avium subsp. paratuberculosis
gaaccgggcgcgca

SEQ ID NO: 2899623 - RNA, 22 nt, Mycobacterium avium subsp. paratuberculosis
gaaccgggcggugaccacgccg

SEQ ID NO: 2899624 - RNA, 13 nt, Mycobacterium avium subsp. paratuberculosis
gaaccggggcacc

SEQ ID NO: 2899625 - RNA, 23 nt, Mycobacterium avium subsp. paratuberculosis
gaaccggggcaccacguccacca

SEQ ID NO: 2899626 - RNA, 19 nt, Mycobacterium avium subsp. paratuberculosis
gaaccggggccagcacgcc

SEQ ID NO: 2899627 - RNA, 14 nt, Mycobacterium avium subsp. paratuberculosis
gaaccggggccgca

SEQ ID NO: 2899628 - RNA, 16 nt, Mycobacterium avium subsp. paratuberculosis
gaaccgggucagcacc

SEQ ID NO: 2899629 - RNA, 18 nt, Mycobacterium avium subsp. paratuberculosis
gaaccgggucagcaccac

SEQ ID NO: 2899630 - RNA, 17 nt, Mycobacterium avium subsp. paratuberculosis
gaaccgguacaggcccc

SEQ ID NO: 2899631 - RNA, 19 nt, Mycobacterium avium subsp. paratuberculosis
gaaccggucguuggccucc

SEQ ID NO: 2899632 - RNA, 22 nt, Mycobacterium avium subsp. paratuberculosis
gaaccggucguuggccuccucg

SEQ ID NO: 2899633 - RNA, 17 nt, Mycobacterium avium subsp. paratuberculosis
gaaccguaaaucgcuca

SEQ ID NO: 2899634 - RNA, 18 nt, Mycobacterium avium subsp. paratuberculosis
gaaccguagaccaccucg

SEQ ID NO: 2899635 - RNA, 15 nt, Mycobacterium avium subsp. paratuberculosis
gaaccgucccacacg

SEQ ID NO: 2899636 - RNA, 18 nt, Mycobacterium avium subsp. paratuberculosis
gaaccgucuagcggcgug

SEQ ID NO: 2899637 - RNA, 20 nt, Mycobacterium avium subsp. paratuberculosis
gaaccgugcacgaucgcggu

SEQ ID NO: 2899638 - RNA, 20 nt, Mycobacterium avium subsp. paratuberculosis
gaaccguucgucgucgcgca

SEQ ID NO: 2899639 - RNA, 22 nt, Mycobacterium avium subsp. paratuberculosis
gaaccucgagauucugcagccg

SEQ ID NO: 2899640 - RNA, 19 nt, Mycobacterium avium subsp. paratuberculosis
gaaccucgcggcggcgucg

SEQ ID NO: 2899641 - RNA, 17 nt, Mycobacterium avium subsp. paratuberculosis
gaaccugcugggcggca

SEQ ID NO: 2899642 - RNA, 15 nt, Mycobacterium avium subsp. paratuberculosis
gaaccuggagggagc

SEQ ID NO: 2899643 - RNA, 15 nt, Mycobacterium avium subsp. paratuberculosis
gaaccuggccaccag

SEQ ID NO: 2899644 - RNA, 17 nt, Mycobacterium avium subsp. paratuberculosis
gaaccuggccaccagca

SEQ ID NO: 2899645 - RNA, 18 nt, Mycobacterium avium subsp. paratuberculosis
gaaccuggccaccagcag

SEQ ID NO: 2899646 - RNA, 12 nt, Mycobacterium avium subsp. paratuberculosis
gaaccuggccgu

SEQ ID NO: 2899647 - RNA, 13 nt, Mycobacterium avium subsp. paratuberculosis
gaacgacacgugg

SEQ ID NO: 2899648 - RNA, 14 nt, Mycobacterium avium subsp. paratuberculosis
gaacgacccuuccg

SEQ ID NO: 2899649 - RNA, 16 nt, Mycobacterium avium subsp. paratuberculosis
gaacgacccuuccgga

SEQ ID NO: 2899650 - RNA, 12 nt, Mycobacterium avium subsp. paratuberculosis
gaacgacgccac

SEQ ID NO: 2899651 - RNA, 18 nt, Mycobacterium avium subsp. paratuberculosis
gaacgacgccguucaggu

SEQ ID NO: 2899652 - RNA, 16 nt, Mycobacterium avium subsp. paratuberculosis
gaacgacgcgcucagc

SEQ ID NO: 2899653 - RNA, 18 nt, Mycobacterium avium subsp. paratuberculosis
gaacgacgcggcacgccg

SEQ ID NO: 2899654 - RNA, 15 nt, Mycobacterium avium subsp. paratuberculosis
gaacgacggugcgcc

SEQ ID NO: 2899655 - RNA, 19 nt, Mycobacterium avium subsp. paratuberculosis
gaacgacggugcgcccguc

SEQ ID NO: 2899656 - RNA, 23 nt, Mycobacterium avium subsp. paratuberculosis
gaacgacggugcgcccgucgucg

SEQ ID NO: 2899657 - RNA, 15 nt, Mycobacterium avium subsp. paratuberculosis
gaacgacgucgaggu

SEQ ID NO: 2899658 - RNA, 22 nt, Mycobacterium avium subsp. paratuberculosis
gaacgacguguucaacgcgccg

SEQ ID NO: 2899659 - RNA, 17 nt, Mycobacterium avium subsp. paratuberculosis
gaacgacuggcggcggc

SEQ ID NO: 2899660 - RNA, 18 nt, Mycobacterium avium subsp. paratuberculosis
gaacgacuggcggcggcg

SEQ ID NO: 2899661 - RNA, 16 nt, Mycobacterium avium subsp. paratuberculosis
gaacgaggccgcgccg

SEQ ID NO: 2899662 - RNA, 17 nt, Mycobacterium avium subsp. paratuberculosis
gaacgaggccgcgccgu

SEQ ID NO: 2899663 - RNA, 13 nt, Mycobacterium avium subsp. paratuberculosis
gaacgaguugccc

SEQ ID NO: 2899664 - RNA, 15 nt, Mycobacterium avium subsp. paratuberculosis
gaacgaucggcucca

SEQ ID NO: 2899665 - RNA, 17 nt, Mycobacterium avium subsp. paratuberculosis
gaacgaucggcuccagc

SEQ ID NO: 2899666 - RNA, 21 nt, Mycobacterium avium subsp. paratuberculosis
gaacgaucggcuccagcgccc

SEQ ID NO: 2899667 - RNA, 11 nt, Mycobacterium avium subsp. paratuberculosis
gaacgauggug

SEQ ID NO: 2899668 - RNA, 18 nt, Mycobacterium avium subsp. paratuberculosis
gaacgauggugugcagca

SEQ ID NO: 2899669 - RNA, 19 nt, Mycobacterium avium subsp. paratuberculosis
gaacgauggugugcagcaa

SEQ ID NO: 2899670 - RNA, 14 nt, Mycobacterium avium subsp. paratuberculosis
gaacgcaacagggc

SEQ ID NO: 2899671 - RNA, 15 nt, Mycobacterium avium subsp. paratuberculosis
gaacgcaacagggcc

SEQ ID NO: 2899672 - RNA, 18 nt, Mycobacterium avium subsp. paratuberculosis
gaacgcaagaagucggug

SEQ ID NO: 2899673 - RNA, 15 nt, Mycobacterium avium subsp. paratuberculosis
gaacgcaaucgccca

SEQ ID NO: 2899674 - RNA, 15 nt, Mycobacterium avium subsp. paratuberculosis
gaacgcacucggugu

SEQ ID NO: 2899675 - RNA, 20 nt, Mycobacterium avium subsp. paratuberculosis
gaacgccaccaccuccucgc

SEQ ID NO: 2899676 - RNA, 16 nt, Mycobacterium avium subsp. paratuberculosis
gaacgccaccacggcg

SEQ ID NO: 2899677 - RNA, 21 nt, Mycobacterium avium subsp. paratuberculosis
gaacgccaccuucaccgcgcc

SEQ ID NO: 2899678 - RNA, 14 nt, Mycobacterium avium subsp. paratuberculosis
gaacgccagcagcc

SEQ ID NO: 2899679 - RNA, 16 nt, Mycobacterium avium subsp. paratuberculosis
gaacgccagcagccgc

SEQ ID NO: 2899680 - RNA, 19 nt, Mycobacterium avium subsp. paratuberculosis
gaacgccagcagccgcagc

SEQ ID NO: 2899681 - RNA, 20 nt, Mycobacterium avium subsp. paratuberculosis
gaacgccagcagccgcagca

SEQ ID NO: 2899682 - RNA, 23 nt, Mycobacterium avium subsp. paratuberculosis
gaacgccagcagcugcgggacca

SEQ ID NO: 2899683 - RNA, 16 nt, Mycobacterium avium subsp. paratuberculosis
gaacgccaucaccagc

SEQ ID NO: 2899684 - RNA, 17 nt, Mycobacterium avium subsp. paratuberculosis
gaacgccaucaccagcg

SEQ ID NO: 2899685 - RNA, 20 nt, Mycobacterium avium subsp. paratuberculosis
gaacgccaucaccagcgcgu

SEQ ID NO: 2899686 - RNA, 21 nt, Mycobacterium avium subsp. paratuberculosis
gaacgccaucaccagcgcgua

SEQ ID NO: 2899687 - RNA, 12 nt, Mycobacterium avium subsp. paratuberculosis
gaacgcccgcac

SEQ ID NO: 2899688 - RNA, 15 nt, Mycobacterium avium subsp. paratuberculosis
gaacgcccgcaccac

SEQ ID NO: 2899689 - RNA, 22 nt, Mycobacterium avium subsp. paratuberculosis
gaacgccgaggaggccgcggcg

SEQ ID NO: 2899690 - RNA, 14 nt, Mycobacterium avium subsp. paratuberculosis
gaacgccgccaaca

SEQ ID NO: 2899691 - RNA, 22 nt, Mycobacterium avium subsp. paratuberculosis
gaacgccgccguguaggccgcg

SEQ ID NO: 2899692 - RNA, 22 nt, Mycobacterium avium subsp. paratuberculosis
gaacgccgcguccucgucgaug

SEQ ID NO: 2899693 - RNA, 13 nt, Mycobacterium avium subsp. paratuberculosis
gaacgccgggucc

SEQ ID NO: 2899694 - RNA, 12 nt, Mycobacterium avium subsp. paratuberculosis
gaacgccgguga

SEQ ID NO: 2899695 - RNA, 23 nt, Mycobacterium avium subsp. paratuberculosis
gaacgccucgaucagagcgggcc

SEQ ID NO: 2899696 - RNA, 17 nt, Mycobacterium avium subsp. paratuberculosis
gaacgccucgggccggc

SEQ ID NO: 2899697 - RNA, 18 nt, Mycobacterium avium subsp. paratuberculosis
gaacgccucgggccggca

SEQ ID NO: 2899698 - RNA, 15 nt, Mycobacterium avium subsp. paratuberculosis
gaacgccucguuggc

SEQ ID NO: 2899699 - RNA, 19 nt, Mycobacterium avium subsp. paratuberculosis
gaacgccucguuggccagc

SEQ ID NO: 2899700 - RNA, 22 nt, Mycobacterium avium subsp. paratuberculosis
gaacgccucguuggccagcucg

SEQ ID NO: 2899701 - RNA, 14 nt, Mycobacterium avium subsp. paratuberculosis
gaacgccugccggc

SEQ ID NO: 2899702 - RNA, 19 nt, Mycobacterium avium subsp. paratuberculosis
gaacgccugccggcgccgg

SEQ ID NO: 2899703 - RNA, 20 nt, Mycobacterium avium subsp. paratuberculosis
gaacgccugccggcgccgga

SEQ ID NO: 2899704 - RNA, 20 nt, Mycobacterium avium subsp. paratuberculosis
gaacgccuugaccgccuugg

SEQ ID NO: 2899705 - RNA, 14 nt, Mycobacterium avium subsp. paratuberculosis
gaacgcgaacccac

SEQ ID NO: 2899706 - RNA, 15 nt, Mycobacterium avium subsp. paratuberculosis
gaacgcgaccgucgg

SEQ ID NO: 2899707 - RNA, 15 nt, Mycobacterium avium subsp. paratuberculosis
gaacgcgccccgccg

SEQ ID NO: 2899708 - RNA, 14 nt, Mycobacterium avium subsp. paratuberculosis
gaacgcgccgccca

SEQ ID NO: 2899709 - RNA, 15 nt, Mycobacterium avium subsp. paratuberculosis
gaacgcgccgcccac

SEQ ID NO: 2899710 - RNA, 16 nt, Mycobacterium avium subsp. paratuberculosis
gaacgcgccgcccacc

SEQ ID NO: 2899711 - RNA, 14 nt, Mycobacterium avium subsp. paratuberculosis
gaacgcgccgccga

SEQ ID NO: 2899712 - RNA, 23 nt, Mycobacterium avium subsp. paratuberculosis
gaacgcgccgccgagcaacagcc

SEQ ID NO: 2899713 - RNA, 13 nt, Mycobacterium avium subsp. paratuberculosis
gaacgcgccggcg

SEQ ID NO: 2899714 - RNA, 17 nt, Mycobacterium avium subsp. paratuberculosis
gaacgcgccggcgcaca

SEQ ID NO: 2899715 - RNA, 22 nt, Mycobacterium avium subsp. paratuberculosis
gaacgcgcggaugcccaggccg

SEQ ID NO: 2899716 - RNA, 11 nt, Mycobacterium avium subsp. paratuberculosis
gaacgcgcggg

SEQ ID NO: 2899717 - RNA, 19 nt, Mycobacterium avium subsp. paratuberculosis
gaacgcgcgggugcgggcg

SEQ ID NO: 2899718 - RNA, 23 nt, Mycobacterium avium subsp. paratuberculosis
gaacgcgcggucgucgcccgucu

SEQ ID NO: 2899719 - RNA, 13 nt, Mycobacterium avium subsp. paratuberculosis
gaacgcgcgucgg

SEQ ID NO: 2899720 - RNA, 21 nt, Mycobacterium avium subsp. paratuberculosis
gaacgcggacagcucgccggc

SEQ ID NO: 2899721 - RNA, 22 nt, Mycobacterium avium subsp. paratuberculosis
gaacgcggacagcucgccggcc

SEQ ID NO: 2899722 - RNA, 13 nt, Mycobacterium avium subsp. paratuberculosis
gaacgcggccagc

SEQ ID NO: 2899723 - RNA, 15 nt, Mycobacterium avium subsp. paratuberculosis
gaacgcggccagcgg

SEQ ID NO: 2899724 - RNA, 13 nt, Mycobacterium avium subsp. paratuberculosis
gaacgcggccgcc

SEQ ID NO: 2899725 - RNA, 19 nt, Mycobacterium avium subsp. paratuberculosis
gaacgcggcgaagcaggcc

SEQ ID NO: 2899726 - RNA, 21 nt, Mycobacterium avium subsp. paratuberculosis
gaacgcggcgaaggccagcga

SEQ ID NO: 2899727 - RNA, 15 nt, Mycobacterium avium subsp. paratuberculosis
gaacgcggcgccgac

SEQ ID NO: 2899728 - RNA, 16 nt, Mycobacterium avium subsp. paratuberculosis
gaacgcggcgccgacg

SEQ ID NO: 2899729 - RNA, 20 nt, Mycobacterium avium subsp. paratuberculosis
gaacgcggcggaggccugcg

SEQ ID NO: 2899730 - RNA, 22 nt, Mycobacterium avium subsp. paratuberculosis
gaacgcggcggaggccugcgcg

SEQ ID NO: 2899731 - RNA, 19 nt, Mycobacterium avium subsp. paratuberculosis
gaacgcggcugaucagccg

SEQ ID NO: 2899732 - RNA, 20 nt, Mycobacterium avium subsp. paratuberculosis
gaacgcggcugaucagccgg

SEQ ID NO: 2899733 - RNA, 22 nt, Mycobacterium avium subsp. paratuberculosis
gaacgcggcugaucagccggcg

SEQ ID NO: 2899734 - RNA, 20 nt, Mycobacterium avium subsp. paratuberculosis
gaacgcgguaccgaugacca

SEQ ID NO: 2899735 - RNA, 17 nt, Mycobacterium avium subsp. paratuberculosis
gaacgcggugagcgugc

SEQ ID NO: 2899736 - RNA, 19 nt, Mycobacterium avium subsp. paratuberculosis
gaacgcggugggcaccagc

SEQ ID NO: 2899737 - RNA, 20 nt, Mycobacterium avium subsp. paratuberculosis
gaacgcggugggcaccagca

SEQ ID NO: 2899738 - RNA, 22 nt, Mycobacterium avium subsp. paratuberculosis
gaacgcggugggcaccagcagc

SEQ ID NO: 2899739 - RNA, 23 nt, Mycobacterium avium subsp. paratuberculosis
gaacgcggugggcaccagcagcg

SEQ ID NO: 2899740 - RNA, 17 nt, Mycobacterium avium subsp. paratuberculosis
gaacgcguacagcgccc

SEQ ID NO: 2899741 - RNA, 17 nt, Mycobacterium avium subsp. paratuberculosis
gaacgcgucccgggccu

SEQ ID NO: 2899742 - RNA, 16 nt, Mycobacterium avium subsp. paratuberculosis
gaacgcguccgacggc

SEQ ID NO: 2899743 - RNA, 20 nt, Mycobacterium avium subsp. paratuberculosis
gaacgcgucgaccgccgcga

SEQ ID NO: 2899744 - RNA, 14 nt, Mycobacterium avium subsp. paratuberculosis
gaacgcgucgccca

SEQ ID NO: 2899745 - RNA, 16 nt, Mycobacterium avium subsp. paratuberculosis
gaacgcgucgcccacg

SEQ ID NO: 2899746 - RNA, 19 nt, Mycobacterium avium subsp. paratuberculosis
gaacgcgucgcccacgccg

SEQ ID NO: 2899747 - RNA, 17 nt, Mycobacterium avium subsp. paratuberculosis
gaacgcgucgcgccagc

SEQ ID NO: 2899748 - RNA, 20 nt, Mycobacterium avium subsp. paratuberculosis
gaacgcgucggucagcggcg

SEQ ID NO: 2899749 - RNA, 22 nt, Mycobacterium avium subsp. paratuberculosis
gaacgcucacucgucuugcagc

SEQ ID NO: 2899750 - RNA, 17 nt, Mycobacterium avium subsp. paratuberculosis
gaacgcucuucagcgcg

SEQ ID NO: 2899751 - RNA, 16 nt, Mycobacterium avium subsp. paratuberculosis
gaacgcugccaggcgg

SEQ ID NO: 2899752 - RNA, 18 nt, Mycobacterium avium subsp. paratuberculosis
gaacgcugccaggcggug

SEQ ID NO: 2899753 - RNA, 18 nt, Mycobacterium avium subsp. paratuberculosis
gaacgcuuccagcaccac

SEQ ID NO: 2899754 - RNA, 22 nt, Mycobacterium avium subsp. paratuberculosis
gaacggcaaccugggcggcggc

SEQ ID NO: 2899755 - RNA, 23 nt, Mycobacterium avium subsp. paratuberculosis
gaacggcaaccugggcggcggcg

SEQ ID NO: 2899756 - RNA, 18 nt, Mycobacterium avium subsp. paratuberculosis
gaacggcaacggcggcgg

SEQ ID NO: 2899757 - RNA, 15 nt, Mycobacterium avium subsp. paratuberculosis
gaacggcaccagcgg

SEQ ID NO: 2899758 - RNA, 21 nt, Mycobacterium avium subsp. paratuberculosis
gaacggcaccccgcggucggc

SEQ ID NO: 2899759 - RNA, 13 nt, Mycobacterium avium subsp. paratuberculosis
gaacggcacccgc

SEQ ID NO: 2899760 - RNA, 18 nt, Mycobacterium avium subsp. paratuberculosis
gaacggcacccgcagcuc

SEQ ID NO: 2899761 - RNA, 14 nt, Mycobacterium avium subsp. paratuberculosis
gaacggcaccucga

SEQ ID NO: 2899762 - RNA, 15 nt, Mycobacterium avium subsp. paratuberculosis
gaacggcaccucgau

SEQ ID NO: 2899763 - RNA, 18 nt, Mycobacterium avium subsp. paratuberculosis
gaacggcaccucgaucac

SEQ ID NO: 2899764 - RNA, 17 nt, Mycobacterium avium subsp. paratuberculosis
gaacggcagcucgucga

SEQ ID NO: 2899765 - RNA, 20 nt, Mycobacterium avium subsp. paratuberculosis
gaacggcagcucgucgacgu

SEQ ID NO: 2899766 - RNA, 19 nt, Mycobacterium avium subsp. paratuberculosis
gaacggccaguccaggccg

SEQ ID NO: 2899767 - RNA, 21 nt, Mycobacterium avium subsp. paratuberculosis
gaacggccaguccaggccgcc

SEQ ID NO: 2899768 - RNA, 24 nt, Mycobacterium avium subsp. paratuberculosis
gaacggcccgccgccggcggcguc

SEQ ID NO: 2899769 - RNA, 17 nt, Mycobacterium avium subsp. paratuberculosis
gaacggccgcgcagauc

SEQ ID NO: 2899770 - RNA, 14 nt, Mycobacterium avium subsp. paratuberculosis
gaacggcggaaccg

SEQ ID NO: 2899771 - RNA, 16 nt, Mycobacterium avium subsp. paratuberculosis
gaacggcggcagcgag

SEQ ID NO: 2899772 - RNA, 20 nt, Mycobacterium avium subsp. paratuberculosis
gaacggcgggcccgucgccg

SEQ ID NO: 2899773 - RNA, 19 nt, Mycobacterium avium subsp. paratuberculosis
gaacggcuugcgcucggcc

SEQ ID NO: 2899774 - RNA, 14 nt, Mycobacterium avium subsp. paratuberculosis
gaacgggauggagc

SEQ ID NO: 2899775 - RNA, 13 nt, Mycobacterium avium subsp. paratuberculosis
gaacgggccggcg

SEQ ID NO: 2899776 - RNA, 14 nt, Mycobacterium avium subsp. paratuberculosis
gaacgggccgggca

SEQ ID NO: 2899777 - RNA, 12 nt, Mycobacterium avium subsp. paratuberculosis
gaacgggcugaa

SEQ ID NO: 2899778 - RNA, 14 nt, Mycobacterium avium subsp. paratuberculosis
gaacggguccuugc

SEQ ID NO: 2899779 - RNA, 14 nt, Mycobacterium avium subsp. paratuberculosis
gaacgggucggcga

SEQ ID NO: 2899780 - RNA, 19 nt, Mycobacterium avium subsp. paratuberculosis
gaacgggugaccggcggcc

SEQ ID NO: 2899781 - RNA, 20 nt, Mycobacterium avium subsp. paratuberculosis
gaacgggugaccggcggcca

SEQ ID NO: 2899782 - RNA, 12 nt, Mycobacterium avium subsp. paratuberculosis
gaacggucagcc

SEQ ID NO: 2899783 - RNA, 15 nt, Mycobacterium avium subsp. paratuberculosis
gaacggucagccgcg

SEQ ID NO: 2899784 - RNA, 18 nt, Mycobacterium avium subsp. paratuberculosis
gaacggucagccgcggcu

SEQ ID NO: 2899785 - RNA, 15 nt, Mycobacterium avium subsp. paratuberculosis
gaacggucggggcgg

SEQ ID NO: 2899786 - RNA, 18 nt, Mycobacterium avium subsp. paratuberculosis
gaacggucggggcggcgg

SEQ ID NO: 2899787 - RNA, 22 nt, Mycobacterium avium subsp. paratuberculosis
gaacgguuuuucccagcggccg

SEQ ID NO: 2899788 - RNA, 14 nt, Mycobacterium avium subsp. paratuberculosis
gaacgucaccaaca

SEQ ID NO: 2899789 - RNA, 15 nt, Mycobacterium avium subsp. paratuberculosis
gaacgucaccaacau

SEQ ID NO: 2899790 - RNA, 16 nt, Mycobacterium avium subsp. paratuberculosis
gaacgucaccaacaug

SEQ ID NO: 2899791 - RNA, 14 nt, Mycobacterium avium subsp. paratuberculosis
gaacgucacggcga

SEQ ID NO: 2899792 - RNA, 21 nt, Mycobacterium avium subsp. paratuberculosis
gaacgucaggauccaguucca

SEQ ID NO: 2899793 - RNA, 21 nt, Mycobacterium avium subsp. paratuberculosis
gaacgucaggcccagcgaggc

SEQ ID NO: 2899794 - RNA, 22 nt, Mycobacterium avium subsp. paratuberculosis
gaacgucaggcccagcgaggcg

SEQ ID NO: 2899795 - RNA, 16 nt, Mycobacterium avium subsp. paratuberculosis
gaacgucauggccagc

SEQ ID NO: 2899796 - RNA, 20 nt, Mycobacterium avium subsp. paratuberculosis
gaacgucauggccagcucgu

SEQ ID NO: 2899797 - RNA, 22 nt, Mycobacterium avium subsp. paratuberculosis
gaacgucauggccagcucgucg

SEQ ID NO: 2899798 - RNA, 19 nt, Mycobacterium avium subsp. paratuberculosis
gaacgucccguuggucucg

SEQ ID NO: 2899799 - RNA, 21 nt, Mycobacterium avium subsp. paratuberculosis
gaacgucgagcgcggcccgcc

SEQ ID NO: 2899800 - RNA, 13 nt, Mycobacterium avium subsp. paratuberculosis
gaacgucgauccc

SEQ ID NO: 2899801 - RNA, 19 nt, Mycobacterium avium subsp. paratuberculosis
gaacgucgauccccgcagc

SEQ ID NO: 2899802 - RNA, 20 nt, Mycobacterium avium subsp. paratuberculosis
gaacgucgcguccgagcagc

SEQ ID NO: 2899803 - RNA, 14 nt, Mycobacterium avium subsp. paratuberculosis
gaacgucucgcggg

SEQ ID NO: 2899804 - RNA, 15 nt, Mycobacterium avium subsp. paratuberculosis
gaacgucucgguguc

SEQ ID NO: 2899805 - RNA, 21 nt, Mycobacterium avium subsp. paratuberculosis
gaacgucugcgggaagcccac

SEQ ID NO: 2899806 - RNA, 17 nt, Mycobacterium avium subsp. paratuberculosis
gaacgugcgcggcgcgc

SEQ ID NO: 2899807 - RNA, 20 nt, Mycobacterium avium subsp. paratuberculosis
gaacgugcgcggcgcgcgaa

SEQ ID NO: 2899808 - RNA, 17 nt, Mycobacterium avium subsp. paratuberculosis
gaacgugcugugcgggc

SEQ ID NO: 2899809 - RNA, 20 nt, Mycobacterium avium subsp. paratuberculosis
gaacgugugggugagcaucg

SEQ ID NO: 2899810 - RNA, 22 nt, Mycobacterium avium subsp. paratuberculosis
gaacgugugggugagcaucggg

SEQ ID NO: 2899811 - RNA, 15 nt, Mycobacterium avium subsp. paratuberculosis
gaacucaagggcguc

SEQ ID NO: 2899812 - RNA, 15 nt, Mycobacterium avium subsp. paratuberculosis
gaacucaccgguggc

SEQ ID NO: 2899813 - RNA, 18 nt, Mycobacterium avium subsp. paratuberculosis
gaacucaccgguggccgc

SEQ ID NO: 2899814 - RNA, 22 nt, Mycobacterium avium subsp. paratuberculosis
gaacucaccgguggccgcgucg

SEQ ID NO: 2899815 - RNA, 19 nt, Mycobacterium avium subsp. paratuberculosis
gaacuccacccugccgacc

SEQ ID NO: 2899816 - RNA, 20 nt, Mycobacterium avium subsp. paratuberculosis
gaacuccacccugccgaccu

SEQ ID NO: 2899817 - RNA, 18 nt, Mycobacterium avium subsp. paratuberculosis
gaacuccagaucgccgcc

SEQ ID NO: 2899818 - RNA, 14 nt, Mycobacterium avium subsp. paratuberculosis
gaacuccagcagcu

SEQ ID NO: 2899819 - RNA, 15 nt, Mycobacterium avium subsp. paratuberculosis
gaacuccagcagcug

SEQ ID NO: 2899820 - RNA, 14 nt, Mycobacterium avium subsp. paratuberculosis
gaacucccgcgccg

SEQ ID NO: 2899821 - RNA, 15 nt, Mycobacterium avium subsp. paratuberculosis
gaacucccgcgccgc

SEQ ID NO: 2899822 - RNA, 17 nt, Mycobacterium avium subsp. paratuberculosis
gaacuccgacuccagca

SEQ ID NO: 2899823 - RNA, 17 nt, Mycobacterium avium subsp. paratuberculosis
gaacuccgcgauggccu

SEQ ID NO: 2899824 - RNA, 21 nt, Mycobacterium avium subsp. paratuberculosis
gaacuccuugagcuccgguga

SEQ ID NO: 2899825 - RNA, 17 nt, Mycobacterium avium subsp. paratuberculosis
gaacucgaucugcagcc

SEQ ID NO: 2899826 - RNA, 19 nt, Mycobacterium avium subsp. paratuberculosis
gaacucgaucugcagccgg

SEQ ID NO: 2899827 - RNA, 14 nt, Mycobacterium avium subsp. paratuberculosis
gaacucgcggcggg

SEQ ID NO: 2899828 - RNA, 19 nt, Mycobacterium avium subsp. paratuberculosis
gaacucgcggcgggucagc

SEQ ID NO: 2899829 - RNA, 15 nt, Mycobacterium avium subsp. paratuberculosis
gaacucgcgggcgag

SEQ ID NO: 2899830 - RNA, 16 nt, Mycobacterium avium subsp. paratuberculosis
gaacucgcgggcgagc

SEQ ID NO: 2899831 - RNA, 23 nt, Mycobacterium avium subsp. paratuberculosis
gaacucgcgggcgagcagcgccc

SEQ ID NO: 2899832 - RNA, 13 nt, Mycobacterium avium subsp. paratuberculosis
gaacucggccagg

SEQ ID NO: 2899833 - RNA, 23 nt, Mycobacterium avium subsp. paratuberculosis
gaacucgggauuggacagcggcg

SEQ ID NO: 2899834 - RNA, 15 nt, Mycobacterium avium subsp. paratuberculosis
gaacucgggcccgag

SEQ ID NO: 2899835 - RNA, 18 nt, Mycobacterium avium subsp. paratuberculosis
gaacucggugaugccggc

SEQ ID NO: 2899836 - RNA, 21 nt, Mycobacterium avium subsp. paratuberculosis
gaacucguccaugcuggugcc

SEQ ID NO: 2899837 - RNA, 11 nt, Mycobacterium avium subsp. paratuberculosis
gaacucgucga

SEQ ID NO: 2899838 - RNA, 22 nt, Mycobacterium avium subsp. paratuberculosis
gaacucgucgaugcacgccgga

SEQ ID NO: 2899839 - RNA, 15 nt, Mycobacterium avium subsp. paratuberculosis
gaacucgucgccacc

SEQ ID NO: 2899840 - RNA, 19 nt, Mycobacterium avium subsp. paratuberculosis
gaacucgugcggcgccgcc

SEQ ID NO: 2899841 - RNA, 20 nt, Mycobacterium avium subsp. paratuberculosis
gaacucgugcggcgccgccc

SEQ ID NO: 2899842 - RNA, 17 nt, Mycobacterium avium subsp. paratuberculosis
gaacucguuggcguggc

SEQ ID NO: 2899843 - RNA, 20 nt, Mycobacterium avium subsp. paratuberculosis
gaacucuucgcagcgcucag

SEQ ID NO: 2899844 - RNA, 15 nt, Mycobacterium avium subsp. paratuberculosis
gaacugauugcccuu

SEQ ID NO: 2899845 - RNA, 20 nt, Mycobacterium avium subsp. paratuberculosis
gaacugcagcccgaucucgc

SEQ ID NO: 2899846 - RNA, 13 nt, Mycobacterium avium subsp. paratuberculosis
gaacugcagccgg

SEQ ID NO: 2899847 - RNA, 15 nt, Mycobacterium avium subsp. paratuberculosis
gaacugccgaugcug

SEQ ID NO: 2899848 - RNA, 12 nt, Mycobacterium avium subsp. paratuberculosis
gaacugccgcgg

SEQ ID NO: 2899849 - RNA, 14 nt, Mycobacterium avium subsp. paratuberculosis
gaacugccgcggca

SEQ ID NO: 2899850 - RNA, 23 nt, Mycobacterium avium subsp. paratuberculosis
gaacugccggcauaggccagcac

SEQ ID NO: 2899851 - RNA, 13 nt, Mycobacterium avium subsp. paratuberculosis
gaacugcucgacc

SEQ ID NO: 2899852 - RNA, 14 nt, Mycobacterium avium subsp. paratuberculosis
gaacugcucgacca

SEQ ID NO: 2899853 - RNA, 15 nt, Mycobacterium avium subsp. paratuberculosis
gaacuggacgccgug

SEQ ID NO: 2899854 - RNA, 20 nt, Mycobacterium avium subsp. paratuberculosis
gaacugguuguagucgucga

SEQ ID NO: 2899855 - RNA, 19 nt, Mycobacterium avium subsp. paratuberculosis
gaacugugcggugcggcuu

SEQ ID NO: 2899856 - RNA, 22 nt, Mycobacterium avium subsp. paratuberculosis
gaacuucgccagcgggccgacc

SEQ ID NO: 2899857 - RNA, 16 nt, Mycobacterium avium subsp. paratuberculosis
gaacuucuccgccggc

SEQ ID NO: 2899858 - RNA, 21 nt, Mycobacterium avium subsp. paratuberculosis
gaacuugaccgggcuccagcg

SEQ ID NO: 2899859 - RNA, 17 nt, Mycobacterium avium subsp. paratuberculosis
gaacuugaucaccgcgu

SEQ ID NO: 2899860 - RNA, 20 nt, Mycobacterium avium subsp. paratuberculosis
gaacuugccgaucaccucga

SEQ ID NO: 2899861 - RNA, 17 nt, Mycobacterium avium subsp. paratuberculosis
gaacuugcgccgggugg

SEQ ID NO: 2899862 - RNA, 17 nt, Mycobacterium avium subsp. paratuberculosis
gaacuugcuggccgagu

SEQ ID NO: 2899863 - RNA, 23 nt, Mycobacterium avium subsp. paratuberculosis
gaagaacccggcgugcuccagca

SEQ ID NO: 2899864 - RNA, 14 nt, Mycobacterium avium subsp. paratuberculosis
gaagaaccgggaau

SEQ ID NO: 2899865 - RNA, 14 nt, Mycobacterium avium subsp. paratuberculosis
gaagaacgacgcca

SEQ ID NO: 2899866 - RNA, 20 nt, Mycobacterium avium subsp. paratuberculosis
gaagaacuccgcgauggccu

SEQ ID NO: 2899867 - RNA, 20 nt, Mycobacterium avium subsp. paratuberculosis
gaagaacuggcugagcaccg

SEQ ID NO: 2899868 - RNA, 22 nt, Mycobacterium avium subsp. paratuberculosis
gaagaaggacgccucgcgcagc

SEQ ID NO: 2899869 - RNA, 19 nt, Mycobacterium avium subsp. paratuberculosis
gaagaaguucucgcacccg

SEQ ID NO: 2899870 - RNA, 20 nt, Mycobacterium avium subsp. paratuberculosis
gaagaauuccaugucgucga

SEQ ID NO: 2899871 - RNA, 21 nt, Mycobacterium avium subsp. paratuberculosis
gaagaauuccaugucgucgag

SEQ ID NO: 2899872 - RNA, 17 nt, Mycobacterium avium subsp. paratuberculosis
gaagaccgggccgauga

SEQ ID NO: 2899873 - RNA, 14 nt, Mycobacterium avium subsp. paratuberculosis
gaagaccguugacg

SEQ ID NO: 2899874 - RNA, 18 nt, Mycobacterium avium subsp. paratuberculosis
gaagaccguugacgaccu

SEQ ID NO: 2899875 - RNA, 20 nt, Mycobacterium avium subsp. paratuberculosis
gaagaccuggccggccucga

SEQ ID NO: 2899876 - RNA, 19 nt, Mycobacterium avium subsp. paratuberculosis
gaagaccugguugccgccc

SEQ ID NO: 2899877 - RNA, 20 nt, Mycobacterium avium subsp. paratuberculosis
gaagaccugguugccgcccu

SEQ ID NO: 2899878 - RNA, 20 nt, Mycobacterium avium subsp. paratuberculosis
gaagacgaugaaaccccagc

SEQ ID NO: 2899879 - RNA, 21 nt, Mycobacterium avium subsp. paratuberculosis
gaagacguacggaugccccuu

SEQ ID NO: 2899880 - RNA, 19 nt, Mycobacterium avium subsp. paratuberculosis
gaagacguaggcggccagc

SEQ ID NO: 2899881 - RNA, 23 nt, Mycobacterium avium subsp. paratuberculosis
gaagacguaggcggccagcagca

SEQ ID NO: 2899882 - RNA, 13 nt, Mycobacterium avium subsp. paratuberculosis
gaagagccggcgu

SEQ ID NO: 2899883 - RNA, 23 nt, Mycobacterium avium subsp. paratuberculosis
gaagagcguuccuuacgccgacg

SEQ ID NO: 2899884 - RNA, 15 nt, Mycobacterium avium subsp. paratuberculosis
gaagagggcgugacg

SEQ ID NO: 2899885 - RNA, 22 nt, Mycobacterium avium subsp. paratuberculosis
gaagagggcgugacgccgcugc

SEQ ID NO: 2899886 - RNA, 23 nt, Mycobacterium avium subsp. paratuberculosis
gaagaguugggucgcguccgcga

SEQ ID NO: 2899887 - RNA, 19 nt, Mycobacterium avium subsp. paratuberculosis
gaagaucaacagccgcccc

SEQ ID NO: 2899888 - RNA, 17 nt, Mycobacterium avium subsp. paratuberculosis
gaagaucaccgcgucgg

SEQ ID NO: 2899889 - RNA, 23 nt, Mycobacterium avium subsp. paratuberculosis
gaagaucagcaggcuggcggcga

SEQ ID NO: 2899890 - RNA, 16 nt, Mycobacterium avium subsp. paratuberculosis
gaagaucagcgaaggc

SEQ ID NO: 2899891 - RNA, 20 nt, Mycobacterium avium subsp. paratuberculosis
gaagaucagcgccagcaaca

SEQ ID NO: 2899892 - RNA, 22 nt, Mycobacterium avium subsp. paratuberculosis
gaagaucgucgucccgucggcg

SEQ ID NO: 2899893 - RNA, 23 nt, Mycobacterium avium subsp. paratuberculosis
gaagaucgucgucccgucggcgc

SEQ ID NO: 2899894 - RNA, 20 nt, Mycobacterium avium subsp. paratuberculosis
gaagaucucggccaggauga

SEQ ID NO: 2899895 - RNA, 15 nt, Mycobacterium avium subsp. paratuberculosis
gaagaucugccggug

SEQ ID NO: 2899896 - RNA, 16 nt, Mycobacterium avium subsp. paratuberculosis
gaagaugaccugaucg

SEQ ID NO: 2899897 - RNA, 17 nt, Mycobacterium avium subsp. paratuberculosis
gaagaugaccugaucga

SEQ ID NO: 2899898 - RNA, 17 nt, Mycobacterium avium subsp. paratuberculosis
gaagaugaucagcgcgc

SEQ ID NO: 2899899 - RNA, 18 nt, Mycobacterium avium subsp. paratuberculosis
gaagaugaucagcgcgcc

SEQ ID NO: 2899900 - RNA, 17 nt, Mycobacterium avium subsp. paratuberculosis
gaagaugaucucgccga

SEQ ID NO: 2899901 - RNA, 22 nt, Mycobacterium avium subsp. paratuberculosis
gaagaugcgccggguccagccg

SEQ ID NO: 2899902 - RNA, 13 nt, Mycobacterium avium subsp. paratuberculosis
gaagauggccagc

SEQ ID NO: 2899903 - RNA, 14 nt, Mycobacterium avium subsp. paratuberculosis
gaagauggccagga

SEQ ID NO: 2899904 - RNA, 15 nt, Mycobacterium avium subsp. paratuberculosis
gaagauggccaggua

SEQ ID NO: 2899905 - RNA, 19 nt, Mycobacterium avium subsp. paratuberculosis
gaagauggccagguagugg

SEQ ID NO: 2899906 - RNA, 17 nt, Mycobacterium avium subsp. paratuberculosis
gaagaugggcgccgagu

SEQ ID NO: 2899907 - RNA, 16 nt, Mycobacterium avium subsp. paratuberculosis
gaagauggucgcgccg

SEQ ID NO: 2899908 - RNA, 16 nt, Mycobacterium avium subsp. paratuberculosis
gaagaugucgcggcgc

SEQ ID NO: 2899909 - RNA, 15 nt, Mycobacterium avium subsp. paratuberculosis
gaagauguugccgcc

SEQ ID NO: 2899910 - RNA, 22 nt, Mycobacterium avium subsp. paratuberculosis
gaagcacaccguucccaccggc

SEQ ID NO: 2899911 - RNA, 16 nt, Mycobacterium avium subsp. paratuberculosis
gaagcacgaccacacc

SEQ ID NO: 2899912 - RNA, 20 nt, Mycobacterium avium subsp. paratuberculosis
gaagcagaacgccaucacca

SEQ ID NO: 2899913 - RNA, 20 nt, Mycobacterium avium subsp. paratuberculosis
gaagcagaacuucuccgccg

SEQ ID NO: 2899914 - RNA, 22 nt, Mycobacterium avium subsp. paratuberculosis
gaagcagaacuucuccgccggc

SEQ ID NO: 2899915 - RNA, 21 nt, Mycobacterium avium subsp. paratuberculosis
gaagcagccuucuuggcgggc

SEQ ID NO: 2899916 - RNA, 22 nt, Mycobacterium avium subsp. paratuberculosis
gaagcagccuucuuggcgggcg

SEQ ID NO: 2899917 - RNA, 22 nt, Mycobacterium avium subsp. paratuberculosis
gaagcagcucgcguagcgaggu

SEQ ID NO: 2899918 - RNA, 20 nt, Mycobacterium avium subsp. paratuberculosis
gaagcaggccaggugcagcu

SEQ ID NO: 2899919 - RNA, 13 nt, Mycobacterium avium subsp. paratuberculosis
gaagccaugccgg

SEQ ID NO: 2899920 - RNA, 13 nt, Mycobacterium avium subsp. paratuberculosis
gaagcccaccgcc

SEQ ID NO: 2899921 - RNA, 14 nt, Mycobacterium avium subsp. paratuberculosis
gaagcccaccgccg

SEQ ID NO: 2899922 - RNA, 18 nt, Mycobacterium avium subsp. paratuberculosis
gaagcccaccgccguucc

SEQ ID NO: 2899923 - RNA, 13 nt, Mycobacterium avium subsp. paratuberculosis
gaagcccagcacc

SEQ ID NO: 2899924 - RNA, 15 nt, Mycobacterium avium subsp. paratuberculosis
gaagcccagcacccg

SEQ ID NO: 2899925 - RNA, 21 nt, Mycobacterium avium subsp. paratuberculosis
gaagcccagcacccgcucgcc

SEQ ID NO: 2899926 - RNA, 13 nt, Mycobacterium avium subsp. paratuberculosis
gaagcccagcgcg

SEQ ID NO: 2899927 - RNA, 22 nt, Mycobacterium avium subsp. paratuberculosis
gaagcccaugccgaugcccauc

SEQ ID NO: 2899928 - RNA, 13 nt, Mycobacterium avium subsp. paratuberculosis
gaagccccaggcc

SEQ ID NO: 2899929 - RNA, 19 nt, Mycobacterium avium subsp. paratuberculosis
gaagccccaggcccgguug

SEQ ID NO: 2899930 - RNA, 16 nt, Mycobacterium avium subsp. paratuberculosis
gaagccccggaccgga

SEQ ID NO: 2899931 - RNA, 17 nt, Mycobacterium avium subsp. paratuberculosis
gaagccccggaccggag

SEQ ID NO: 2899932 - RNA, 18 nt, Mycobacterium avium subsp. paratuberculosis
gaagccccgguuccaacc

SEQ ID NO: 2899933 - RNA, 16 nt, Mycobacterium avium subsp. paratuberculosis
gaagcccgagcgucac

SEQ ID NO: 2899934 - RNA, 17 nt, Mycobacterium avium subsp. paratuberculosis
gaagcccgagcgucacg

SEQ ID NO: 2899935 - RNA, 13 nt, Mycobacterium avium subsp. paratuberculosis
gaagcccgcagcg

SEQ ID NO: 2899936 - RNA, 18 nt, Mycobacterium avium subsp. paratuberculosis
gaagcccgugccgaugcc

SEQ ID NO: 2899937 - RNA, 19 nt, Mycobacterium avium subsp. paratuberculosis
gaagcccgugccgaugccg

SEQ ID NO: 2899938 - RNA, 15 nt, Mycobacterium avium subsp. paratuberculosis
gaagcccgugcgacg

SEQ ID NO: 2899939 - RNA, 18 nt, Mycobacterium avium subsp. paratuberculosis
gaagcccgugcgacggcu

SEQ ID NO: 2899940 - RNA, 14 nt, Mycobacterium avium subsp. paratuberculosis
gaagcccugcucgg

SEQ ID NO: 2899941 - RNA, 21 nt, Mycobacterium avium subsp. paratuberculosis
gaagcccugcucggugaugcc

SEQ ID NO: 2899942 - RNA, 13 nt, Mycobacterium avium subsp. paratuberculosis
gaagcccuucacc

SEQ ID NO: 2899943 - RNA, 13 nt, Mycobacterium avium subsp. paratuberculosis
gaagccgaacgcg

SEQ ID NO: 2899944 - RNA, 17 nt, Mycobacterium avium subsp. paratuberculosis
gaagccgaacgcgcugu

SEQ ID NO: 2899945 - RNA, 16 nt, Mycobacterium avium subsp. paratuberculosis
gaagccgacguccugg

SEQ ID NO: 2899946 - RNA, 16 nt, Mycobacterium avium subsp. paratuberculosis
gaagccgacgucgacc

SEQ ID NO: 2899947 - RNA, 17 nt, Mycobacterium avium subsp. paratuberculosis
gaagccgaggucgccga

SEQ ID NO: 2899948 - RNA, 18 nt, Mycobacterium avium subsp. paratuberculosis
gaagccgaggucgccgac

SEQ ID NO: 2899949 - RNA, 22 nt, Mycobacterium avium subsp. paratuberculosis
gaagccgaguuuggcgucgaug

SEQ ID NO: 2899950 - RNA, 16 nt, Mycobacterium avium subsp. paratuberculosis
gaagccgaucaccggc

SEQ ID NO: 2899951 - RNA, 17 nt, Mycobacterium avium subsp. paratuberculosis
gaagccgaucaccggcg

SEQ ID NO: 2899952 - RNA, 18 nt, Mycobacterium avium subsp. paratuberculosis
gaagccgaucaccggcgc

SEQ ID NO: 2899953 - RNA, 20 nt, Mycobacterium avium subsp. paratuberculosis
gaagccgcagcaggugcgcc

SEQ ID NO: 2899954 - RNA, 22 nt, Mycobacterium avium subsp. paratuberculosis
gaagccgcauggugcggguguc

SEQ ID NO: 2899955 - RNA, 13 nt, Mycobacterium avium subsp. paratuberculosis
gaagccgccgccc

SEQ ID NO: 2899956 - RNA, 16 nt, Mycobacterium avium subsp. paratuberculosis
gaagccgccgcccugc

SEQ ID NO: 2899957 - RNA, 20 nt, Mycobacterium avium subsp. paratuberculosis
gaagccgccguccccgcgcg

SEQ ID NO: 2899958 - RNA, 12 nt, Mycobacterium avium subsp. paratuberculosis
gaagccgcgacg

SEQ ID NO: 2899959 - RNA, 16 nt, Mycobacterium avium subsp. paratuberculosis
gaagccgcuggaaguc

SEQ ID NO: 2899960 - RNA, 20 nt, Mycobacterium avium subsp. paratuberculosis
gaagccggccaguucccggg

SEQ ID NO: 2899961 - RNA, 15 nt, Mycobacterium avium subsp. paratuberculosis
gaagccggccccgcc

SEQ ID NO: 2899962 - RNA, 16 nt, Mycobacterium avium subsp. paratuberculosis
gaagccggccccgccc

SEQ ID NO: 2899963 - RNA, 21 nt, Mycobacterium avium subsp. paratuberculosis
gaagccggccccgcccggggc

SEQ ID NO: 2899964 - RNA, 20 nt, Mycobacterium avium subsp. paratuberculosis
gaagccggcgacgaccgcac

SEQ ID NO: 2899965 - RNA, 13 nt, Mycobacterium avium subsp. paratuberculosis
gaagccggugccc

SEQ ID NO: 2899966 - RNA, 14 nt, Mycobacterium avium subsp. paratuberculosis
gaagccggugccca

SEQ ID NO: 2899967 - RNA, 15 nt, Mycobacterium avium subsp. paratuberculosis
gaagccggugcccau

SEQ ID NO: 2899968 - RNA, 21 nt, Mycobacterium avium subsp. paratuberculosis
gaagccgucgaccccgccggc

SEQ ID NO: 2899969 - RNA, 17 nt, Mycobacterium avium subsp. paratuberculosis
gaagccgucggugcgcu

SEQ ID NO: 2899970 - RNA, 20 nt, Mycobacterium avium subsp. paratuberculosis
gaagccgugacccgccguga

SEQ ID NO: 2899971 - RNA, 17 nt, Mycobacterium avium subsp. paratuberculosis
gaagccgugcacgccgu

SEQ ID NO: 2899972 - RNA, 16 nt, Mycobacterium avium subsp. paratuberculosis
gaagccguggcaggca

SEQ ID NO: 2899973 - RNA, 22 nt, Mycobacterium avium subsp. paratuberculosis
gaagccguugaugcgcaccgcg

SEQ ID NO: 2899974 - RNA, 23 nt, Mycobacterium avium subsp. paratuberculosis
gaagccguugaugcgcaccgcgg

SEQ ID NO: 2899975 - RNA, 19 nt, Mycobacterium avium subsp. paratuberculosis
gaagccguugccgccgcgc

SEQ ID NO: 2899976 - RNA, 18 nt, Mycobacterium avium subsp. paratuberculosis
gaagccuggcacgacgcc

SEQ ID NO: 2899977 - RNA, 19 nt, Mycobacterium avium subsp. paratuberculosis
gaagccuggcacgacgccg

SEQ ID NO: 2899978 - RNA, 21 nt, Mycobacterium avium subsp. paratuberculosis
gaagccuggcacgacgccgcc

SEQ ID NO: 2899979 - RNA, 15 nt, Mycobacterium avium subsp. paratuberculosis
gaagccuguuggcca

SEQ ID NO: 2899980 - RNA, 22 nt, Mycobacterium avium subsp. paratuberculosis
gaagcgaauccgggugucgacg

SEQ ID NO: 2899981 - RNA, 19 nt, Mycobacterium avium subsp. paratuberculosis
gaagcgcagaucgcgcauc

SEQ ID NO: 2899982 - RNA, 13 nt, Mycobacterium avium subsp. paratuberculosis
gaagcgcagcagc

SEQ ID NO: 2899983 - RNA, 17 nt, Mycobacterium avium subsp. paratuberculosis
gaagcgcagcagcucgu

SEQ ID NO: 2899984 - RNA, 18 nt, Mycobacterium avium subsp. paratuberculosis
gaagcgcaucgccggcgc

SEQ ID NO: 2899985 - RNA, 21 nt, Mycobacterium avium subsp. paratuberculosis
gaagcgcaucgccggcgcgcu

SEQ ID NO: 2899986 - RNA, 21 nt, Mycobacterium avium subsp. paratuberculosis
gaagcgccacggggcgccgcu

SEQ ID NO: 2899987 - RNA, 22 nt, Mycobacterium avium subsp. paratuberculosis
gaagcgccacggggcgccgcug

SEQ ID NO: 2899988 - RNA, 13 nt, Mycobacterium avium subsp. paratuberculosis
gaagcgcccgcgc

SEQ ID NO: 2899989 - RNA, 14 nt, Mycobacterium avium subsp. paratuberculosis
gaagcgcccgcgcg

SEQ ID NO: 2899990 - RNA, 18 nt, Mycobacterium avium subsp. paratuberculosis
gaagcgcccgcgcgcucg

SEQ ID NO: 2899991 - RNA, 14 nt, Mycobacterium avium subsp. paratuberculosis
gaagcgcgaugcgg

SEQ ID NO: 2899992 - RNA, 17 nt, Mycobacterium avium subsp. paratuberculosis
gaagcgcgaugcggcuc

SEQ ID NO: 2899993 - RNA, 20 nt, Mycobacterium avium subsp. paratuberculosis
gaagcgcuuucccugcucga

SEQ ID NO: 2899994 - RNA, 23 nt, Mycobacterium avium subsp. paratuberculosis
gaagcggccggggaguucgcggu

SEQ ID NO: 2899995 - RNA, 14 nt, Mycobacterium avium subsp. paratuberculosis
gaagcggcgcacgc

SEQ ID NO: 2899996 - RNA, 22 nt, Mycobacterium avium subsp. paratuberculosis
gaagcggcgcacgcagugccgc

SEQ ID NO: 2899997 - RNA, 15 nt, Mycobacterium avium subsp. paratuberculosis
gaagcggcgcggguc

SEQ ID NO: 2899998 - RNA, 13 nt, Mycobacterium avium subsp. paratuberculosis
gaagcgggacagc

SEQ ID NO: 2899999 - RNA, 21 nt, Mycobacterium avium subsp. paratuberculosis
gaagcgggacugcagcgcggu

SEQ ID NO: 2900000 - RNA, 15 nt, Mycobacterium avium subsp. paratuberculosis
gaagcgggccaaaga

SEQ ID NO: 2900001 - RNA, 17 nt, Mycobacterium avium subsp. paratuberculosis
gaagcgggccaaagagc

SEQ ID NO: 2900002 - RNA, 21 nt, Mycobacterium avium subsp. paratuberculosis
gaagcgggccaaagagcuugg

SEQ ID NO: 2900003 - RNA, 13 nt, Mycobacterium avium subsp. paratuberculosis
gaagcgggcggcg

SEQ ID NO: 2900004 - RNA, 23 nt, Mycobacterium avium subsp. paratuberculosis
gaagcgggcggcgaacaccagca

SEQ ID NO: 2900005 - RNA, 17 nt, Mycobacterium avium subsp. paratuberculosis
gaagcggugcaccaccg

SEQ ID NO: 2900006 - RNA, 20 nt, Mycobacterium avium subsp. paratuberculosis
gaagcggugcaccaccgugc

SEQ ID NO: 2900007 - RNA, 16 nt, Mycobacterium avium subsp. paratuberculosis
gaagcguaugccggug

SEQ ID NO: 2900008 - RNA, 18 nt, Mycobacterium avium subsp. paratuberculosis
gaagcguaugccgguggc

SEQ ID NO: 2900009 - RNA, 16 nt, Mycobacterium avium subsp. paratuberculosis
gaagcguuccgccguc

SEQ ID NO: 2900010 - RNA, 18 nt, Mycobacterium avium subsp. paratuberculosis
gaagcguucguagaaccg

SEQ ID NO: 2900011 - RNA, 14 nt, Mycobacterium avium subsp. paratuberculosis
gaagcguugcgcgu

SEQ ID NO: 2900012 - RNA, 19 nt, Mycobacterium avium subsp. paratuberculosis
gaagcuaaaccccacggcc

SEQ ID NO: 2900013 - RNA, 21 nt, Mycobacterium avium subsp. paratuberculosis
gaagcuaaaccccacggccgc

SEQ ID NO: 2900014 - RNA, 23 nt, Mycobacterium avium subsp. paratuberculosis
gaagcuaaaccccacggccgcaa

SEQ ID NO: 2900015 - RNA, 19 nt, Mycobacterium avium subsp. paratuberculosis
gaagcuaacgccagcuggg

SEQ ID NO: 2900016 - RNA, 21 nt, Mycobacterium avium subsp. paratuberculosis
gaagcuaacgccagcugggca

SEQ ID NO: 2900017 - RNA, 13 nt, Mycobacterium avium subsp. paratuberculosis
gaagcuagcuuca

SEQ ID NO: 2900018 - RNA, 16 nt, Mycobacterium avium subsp. paratuberculosis
gaagcuagcuucacgc

SEQ ID NO: 2900019 - RNA, 20 nt, Mycobacterium avium subsp. paratuberculosis
gaagcuagcuucacgcucgg

SEQ ID NO: 2900020 - RNA, 23 nt, Mycobacterium avium subsp. paratuberculosis
gaagcuaguuucacgcucggcgg

SEQ ID NO: 2900021 - RNA, 17 nt, Mycobacterium avium subsp. paratuberculosis
gaagcucagcugcugcg

SEQ ID NO: 2900022 - RNA, 18 nt, Mycobacterium avium subsp. paratuberculosis
gaagcucaucaccggcgc

SEQ ID NO: 2900023 - RNA, 18 nt, Mycobacterium avium subsp. paratuberculosis
gaagcuccacgccgccgg

SEQ ID NO: 2900024 - RNA, 14 nt, Mycobacterium avium subsp. paratuberculosis
gaagcugcgccaca

SEQ ID NO: 2900025 - RNA, 15 nt, Mycobacterium avium subsp. paratuberculosis
gaagcugcgccacaa

SEQ ID NO: 2900026 - RNA, 16 nt, Mycobacterium avium subsp. paratuberculosis
gaagcugcgccacaac

SEQ ID NO: 2900027 - RNA, 15 nt, Mycobacterium avium subsp. paratuberculosis
gaagcuggccaccgc

SEQ ID NO: 2900028 - RNA, 14 nt, Mycobacterium avium subsp. paratuberculosis
gaagcuggcgaaca

SEQ ID NO: 2900029 - RNA, 17 nt, Mycobacterium avium subsp. paratuberculosis
gaagcugggcgcccaga

SEQ ID NO: 2900030 - RNA, 23 nt, Mycobacterium avium subsp. paratuberculosis
gaagcugggguaguucugcucga

SEQ ID NO: 2900031 - RNA, 16 nt, Mycobacterium avium subsp. paratuberculosis
gaagcugucgccgagg

SEQ ID NO: 2900032 - RNA, 17 nt, Mycobacterium avium subsp. paratuberculosis
gaagcuuucggugcgca

SEQ ID NO: 2900033 - RNA, 22 nt, Mycobacterium avium subsp. paratuberculosis
gaaggacgccucgcgcagcgcg

SEQ ID NO: 2900034 - RNA, 16 nt, Mycobacterium avium subsp. paratuberculosis
gaaggacgucaggccg

SEQ ID NO: 2900035 - RNA, 23 nt, Mycobacterium avium subsp. paratuberculosis
gaaggacgucaggccggucagcg

SEQ ID NO: 2900036 - RNA, 15 nt, Mycobacterium avium subsp. paratuberculosis
gaaggaggcggucga

SEQ ID NO: 2900037 - RNA, 14 nt, Mycobacterium avium subsp. paratuberculosis
gaaggcacccagga

SEQ ID NO: 2900038 - RNA, 21 nt, Mycobacterium avium subsp. paratuberculosis
gaaggcaugggcgugccggcc

SEQ ID NO: 2900039 - RNA, 15 nt, Mycobacterium avium subsp. paratuberculosis
gaaggccaaggccag

SEQ ID NO: 2900040 - RNA, 22 nt, Mycobacterium avium subsp. paratuberculosis
gaaggccaggugcacgccgagc

SEQ ID NO: 2900041 - RNA, 14 nt, Mycobacterium avium subsp. paratuberculosis
gaaggccgccgggu

SEQ ID NO: 2900042 - RNA, 12 nt, Mycobacterium avium subsp. paratuberculosis
gaaggccgggcu

SEQ ID NO: 2900043 - RNA, 22 nt, Mycobacterium avium subsp. paratuberculosis
gaaggcgaacaccagcccggcc

SEQ ID NO: 2900044 - RNA, 20 nt, Mycobacterium avium subsp. paratuberculosis
gaaggcgacgucggucggca

SEQ ID NO: 2900045 - RNA, 13 nt, Mycobacterium avium subsp. paratuberculosis
gaaggcgccgucg

SEQ ID NO: 2900046 - RNA, 14 nt, Mycobacterium avium subsp. paratuberculosis
gaaggcgccgucgg

SEQ ID NO: 2900047 - RNA, 23 nt, Mycobacterium avium subsp. paratuberculosis
gaaggcgccgucggugggggcca

SEQ ID NO: 2900048 - RNA, 19 nt, Mycobacterium avium subsp. paratuberculosis
gaaggcgcgggcguccacg

SEQ ID NO: 2900049 - RNA, 13 nt, Mycobacterium avium subsp. paratuberculosis
gaaggcggccacc

SEQ ID NO: 2900050 - RNA, 16 nt, Mycobacterium avium subsp. paratuberculosis
gaaggcggccaccgcg

SEQ ID NO: 2900051 - RNA, 17 nt, Mycobacterium avium subsp. paratuberculosis
gaaggcggccaccgcgg

SEQ ID NO: 2900052 - RNA, 22 nt, Mycobacterium avium subsp. paratuberculosis
gaaggcggccaccgcggccagc

SEQ ID NO: 2900053 - RNA, 23 nt, Mycobacterium avium subsp. paratuberculosis
gaaggcggccaccgcggccagcu

SEQ ID NO: 2900054 - RNA, 13 nt, Mycobacterium avium subsp. paratuberculosis
gaaggcggccgcg

SEQ ID NO: 2900055 - RNA, 19 nt, Mycobacterium avium subsp. paratuberculosis
gaaggcggccgcgagcccg

SEQ ID NO: 2900056 - RNA, 23 nt, Mycobacterium avium subsp. paratuberculosis
gaaggcggccgcgagcccggcga

SEQ ID NO: 2900057 - RNA, 17 nt, Mycobacterium avium subsp. paratuberculosis
gaaggcggcgccggccg

SEQ ID NO: 2900058 - RNA, 12 nt, Mycobacterium avium subsp. paratuberculosis
gaaggcggcguc

SEQ ID NO: 2900059 - RNA, 14 nt, Mycobacterium avium subsp. paratuberculosis
gaaggcggcgucga

SEQ ID NO: 2900060 - RNA, 16 nt, Mycobacterium avium subsp. paratuberculosis
gaaggcggcgucgaug

SEQ ID NO: 2900061 - RNA, 17 nt, Mycobacterium avium subsp. paratuberculosis
gaaggcgugcgacucgg

SEQ ID NO: 2900062 - RNA, 21 nt, Mycobacterium avium subsp. paratuberculosis
gaaggcguuggacuccaccgc

SEQ ID NO: 2900063 - RNA, 20 nt, Mycobacterium avium subsp. paratuberculosis
gaaggcguuggagccgacca

SEQ ID NO: 2900064 - RNA, 22 nt, Mycobacterium avium subsp. paratuberculosis
gaaggcguuggagccgaccagc

SEQ ID NO: 2900065 - RNA, 19 nt, Mycobacterium avium subsp. paratuberculosis
gaagggaaaggcagcagcc

SEQ ID NO: 2900066 - RNA, 17 nt, Mycobacterium avium subsp. paratuberculosis
gaagggccccggcaucg

SEQ ID NO: 2900067 - RNA, 13 nt, Mycobacterium avium subsp. paratuberculosis
gaagggcgccagc

SEQ ID NO: 2900068 - RNA, 16 nt, Mycobacterium avium subsp. paratuberculosis
gaagggcgccagcacc

SEQ ID NO: 2900069 - RNA, 19 nt, Mycobacterium avium subsp. paratuberculosis
gaagggcgccagcaccucg

SEQ ID NO: 2900070 - RNA, 20 nt, Mycobacterium avium subsp. paratuberculosis
gaagggcgccagcaccucga

SEQ ID NO: 2900071 - RNA, 15 nt, Mycobacterium avium subsp. paratuberculosis
gaagggcgccagccg

SEQ ID NO: 2900072 - RNA, 19 nt, Mycobacterium avium subsp. paratuberculosis
gaagggcgccagccguucc

SEQ ID NO: 2900073 - RNA, 22 nt, Mycobacterium avium subsp. paratuberculosis
gaagggcuccccggacagccac

SEQ ID NO: 2900074 - RNA, 23 nt, Mycobacterium avium subsp. paratuberculosis
gaagggcuuuagaaggccgccuc

SEQ ID NO: 2900075 - RNA, 15 nt, Mycobacterium avium subsp. paratuberculosis
gaaggucagaucguu

SEQ ID NO: 2900076 - RNA, 15 nt, Mycobacterium avium subsp. paratuberculosis
gaaggucccggucag

SEQ ID NO: 2900077 - RNA, 16 nt, Mycobacterium avium subsp. paratuberculosis
gaagguccgguaggcg

SEQ ID NO: 2900078 - RNA, 15 nt, Mycobacterium avium subsp. paratuberculosis
gaaggucgcggacug

SEQ ID NO: 2900079 - RNA, 16 nt, Mycobacterium avium subsp. paratuberculosis
gaaggucuuucgucgc

SEQ ID NO: 2900080 - RNA, 21 nt, Mycobacterium avium subsp. paratuberculosis
gaaggucuuucgucgcuuggu

SEQ ID NO: 2900081 - RNA, 15 nt, Mycobacterium avium subsp. paratuberculosis
gaaggugaucuuguu

SEQ ID NO: 2900082 - RNA, 20 nt, Mycobacterium avium subsp. paratuberculosis
gaaggugaugaaaaccgggc

SEQ ID NO: 2900083 - RNA, 15 nt, Mycobacterium avium subsp. paratuberculosis
gaaggugccccacgc

SEQ ID NO: 2900084 - RNA, 16 nt, Mycobacterium avium subsp. paratuberculosis
gaaggugcccgcaucg

SEQ ID NO: 2900085 - RNA, 19 nt, Mycobacterium avium subsp. paratuberculosis
gaaggugcccuccucgccg

SEQ ID NO: 2900086 - RNA, 20 nt, Mycobacterium avium subsp. paratuberculosis
gaaggugcccuccucgccgg

SEQ ID NO: 2900087 - RNA, 23 nt, Mycobacterium avium subsp. paratuberculosis
gaaggugccgcgaugcccgccgg

SEQ ID NO: 2900088 - RNA, 13 nt, Mycobacterium avium subsp. paratuberculosis
gaaggugcugaau

SEQ ID NO: 2900089 - RNA, 20 nt, Mycobacterium avium subsp. paratuberculosis
gaagguggcacgccacucgu

SEQ ID NO: 2900090 - RNA, 22 nt, Mycobacterium avium subsp. paratuberculosis
gaagguggcacgccacucgucg

SEQ ID NO: 2900091 - RNA, 15 nt, Mycobacterium avium subsp. paratuberculosis
gaagguggcgccggu

SEQ ID NO: 2900092 - RNA, 17 nt, Mycobacterium avium subsp. paratuberculosis
gaaggugggcagcgcca

SEQ ID NO: 2900093 - RNA, 13 nt, Mycobacterium avium subsp. paratuberculosis
gaaggugggguug

SEQ ID NO: 2900094 - RNA, 13 nt, Mycobacterium avium subsp. paratuberculosis
gaaggugguggcg

SEQ ID NO: 2900095 - RNA, 22 nt, Mycobacterium avium subsp. paratuberculosis
gaaggugguggcguuggcgauc

SEQ ID NO: 2900096 - RNA, 16 nt, Mycobacterium avium subsp. paratuberculosis
gaaggugucggccggg

SEQ ID NO: 2900097 - RNA, 19 nt, Mycobacterium avium subsp. paratuberculosis
gaagguguuggugcggggu

SEQ ID NO: 2900098 - RNA, 20 nt, Mycobacterium avium subsp. paratuberculosis
gaagguguuggugcgggguu

SEQ ID NO: 2900099 - RNA, 20 nt, Mycobacterium avium subsp. paratuberculosis
gaaguagcccuuggacuccc

SEQ ID NO: 2900100 - RNA, 17 nt, Mycobacterium avium subsp. paratuberculosis
gaaguagccggccagcg

SEQ ID NO: 2900101 - RNA, 14 nt, Mycobacterium avium subsp. paratuberculosis
gaaguagccggcga

SEQ ID NO: 2900102 - RNA, 18 nt, Mycobacterium avium subsp. paratuberculosis
gaaguagcgggcguuggc

SEQ ID NO: 2900103 - RNA, 17 nt, Mycobacterium avium subsp. paratuberculosis
gaaguagggcagcccga

SEQ ID NO: 2900104 - RNA, 14 nt, Mycobacterium avium subsp. paratuberculosis
gaaguagggccgca

SEQ ID NO: 2900105 - RNA, 23 nt, Mycobacterium avium subsp. paratuberculosis
gaaguaguagcuguuggccagcu

SEQ ID NO: 2900106 - RNA, 22 nt, Mycobacterium avium subsp. paratuberculosis
gaagucagcgcgugaccccggc

SEQ ID NO: 2900107 - RNA, 20 nt, Mycobacterium avium subsp. paratuberculosis
gaagucaucaccggggauca

SEQ ID NO: 2900108 - RNA, 19 nt, Mycobacterium avium subsp. paratuberculosis
gaaguccaugaacggcagc

SEQ ID NO: 2900109 - RNA, 20 nt, Mycobacterium avium subsp. paratuberculosis
gaaguccaugaacggcagcu

SEQ ID NO: 2900110 - RNA, 14 nt, Mycobacterium avium subsp. paratuberculosis
gaagucccacugcc

SEQ ID NO: 2900111 - RNA, 15 nt, Mycobacterium avium subsp. paratuberculosis
gaaguccggcgcgcc

SEQ ID NO: 2900112 - RNA, 15 nt, Mycobacterium avium subsp. paratuberculosis
gaaguccggcggucg

SEQ ID NO: 2900113 - RNA, 22 nt, Mycobacterium avium subsp. paratuberculosis
gaaguccggcggucgcugcagc

SEQ ID NO: 2900114 - RNA, 18 nt, Mycobacterium avium subsp. paratuberculosis
gaaguccugcgccgcggu

SEQ ID NO: 2900115 - RNA, 20 nt, Mycobacterium avium subsp. paratuberculosis
gaaguccugcgccgcggugc

SEQ ID NO: 2900116 - RNA, 21 nt, Mycobacterium avium subsp. paratuberculosis
gaaguccuuguggcccaggcc

SEQ ID NO: 2900117 - RNA, 24 nt, Mycobacterium avium subsp. paratuberculosis
gaaguccuuguggcccaggccggc

SEQ ID NO: 2900118 - RNA, 14 nt, Mycobacterium avium subsp. paratuberculosis
gaaguccuuguucg

SEQ ID NO: 2900119 - RNA, 20 nt, Mycobacterium avium subsp. paratuberculosis
gaaguccuuguucgccgggu

SEQ ID NO: 2900120 - RNA, 15 nt, Mycobacterium avium subsp. paratuberculosis
gaagucgaccgcggc

SEQ ID NO: 2900121 - RNA, 22 nt, Mycobacterium avium subsp. paratuberculosis
gaagucgaccggggcgccccgc

SEQ ID NO: 2900122 - RNA, 14 nt, Mycobacterium avium subsp. paratuberculosis
gaagucgacgcacc

SEQ ID NO: 2900123 - RNA, 19 nt, Mycobacterium avium subsp. paratuberculosis
gaagucgauugccgcggcc

SEQ ID NO: 2900124 - RNA, 20 nt, Mycobacterium avium subsp. paratuberculosis
gaagucgauugccgcggccg

SEQ ID NO: 2900125 - RNA, 20 nt, Mycobacterium avium subsp. paratuberculosis
gaagucgcccgcguugcggc

SEQ ID NO: 2900126 - RNA, 15 nt, Mycobacterium avium subsp. paratuberculosis
gaagucgccgacgcc

SEQ ID NO: 2900127 - RNA, 13 nt, Mycobacterium avium subsp. paratuberculosis
gaagucgccgccc

SEQ ID NO: 2900128 - RNA, 18 nt, Mycobacterium avium subsp. paratuberculosis
gaagucgccgcccgggcc

SEQ ID NO: 2900129 - RNA, 23 nt, Mycobacterium avium subsp. paratuberculosis
gaagucgccgcccgggccgcgcc

SEQ ID NO: 2900130 - RNA, 13 nt, Mycobacterium avium subsp. paratuberculosis
gaagucgccgucc

SEQ ID NO: 2900131 - RNA, 22 nt, Mycobacterium avium subsp. paratuberculosis
gaagucggucagcgucgccgcc

SEQ ID NO: 2900132 - RNA, 23 nt, Mycobacterium avium subsp. paratuberculosis
gaagucggugugggucagcgagg

SEQ ID NO: 2900133 - RNA, 19 nt, Mycobacterium avium subsp. paratuberculosis
gaagucguucagcugcagc

SEQ ID NO: 2900134 - RNA, 22 nt, Mycobacterium avium subsp. paratuberculosis
gaagugcacgccgaggcgugcc

SEQ ID NO: 2900135 - RNA, 18 nt, Mycobacterium avium subsp. paratuberculosis
gaagugcccggcgccgga

SEQ ID NO: 2900136 - RNA, 13 nt, Mycobacterium avium subsp. paratuberculosis
gaagugccggcga

SEQ ID NO: 2900137 - RNA, 14 nt, Mycobacterium avium subsp. paratuberculosis
gaagugccggcgaa

SEQ ID NO: 2900138 - RNA, 20 nt, Mycobacterium avium subsp. paratuberculosis
gaagugccggcgaaccucac

SEQ ID NO: 2900139 - RNA, 21 nt, Mycobacterium avium subsp. paratuberculosis
gaagugccggcugaaccugcu

SEQ ID NO: 2900140 - RNA, 12 nt, Mycobacterium avium subsp. paratuberculosis
gaauggccgcgc

SEQ ID NO: 2900141 - RNA, 22 nt, Mycobacterium avium subsp. paratuberculosis
gaauggccgcgccguagcggcc

SEQ ID NO: 2900142 - RNA, 14 nt, Mycobacterium avium subsp. paratuberculosis
gaaugucgcgcagc

SEQ ID NO: 2900143 - RNA, 16 nt, Mycobacterium avium subsp. paratuberculosis
gaaugucguagcgguc

SEQ ID NO: 2900144 - RNA, 14 nt, Mycobacterium avium subsp. paratuberculosis
gaaugucgugacca

SEQ ID NO: 2900145 - RNA, 17 nt, Mycobacterium avium subsp. paratuberculosis
gaaugucgugaccaaug

SEQ ID NO: 2900146 - RNA, 16 nt, Mycobacterium avium subsp. paratuberculosis
gaauuccaugucgucg

SEQ ID NO: 2900147 - RNA, 17 nt, Mycobacterium avium subsp. paratuberculosis
gaauuccaugucgucga

SEQ ID NO: 2900148 - RNA, 18 nt, Mycobacterium avium subsp. paratuberculosis
gaauuccaugucgucgag

SEQ ID NO: 2900149 - RNA, 22 nt, Mycobacterium avium subsp. paratuberculosis
gaauuccaugucgucgagcucg

SEQ ID NO: 2900150 - RNA, 14 nt, Mycobacterium avium subsp. paratuberculosis
gaauuccgcaccgg

SEQ ID NO: 2900151 - RNA, 15 nt, Mycobacterium avium subsp. paratuberculosis
gaauuccucagcgcc

SEQ ID NO: 2900152 - RNA, 18 nt, Mycobacterium avium subsp. paratuberculosis
gaauuccuggccggugcg

SEQ ID NO: 2900153 - RNA, 14 nt, Mycobacterium avium subsp. paratuberculosis
gaauucgaccacgg

SEQ ID NO: 2900154 - RNA, 16 nt, Mycobacterium avium subsp. paratuberculosis
gaauucgaccacggcc

SEQ ID NO: 2900155 - RNA, 20 nt, Mycobacterium avium subsp. paratuberculosis
gaauucgcagguucgacacg

SEQ ID NO: 2900156 - RNA, 20 nt, Mycobacterium avium subsp. paratuberculosis
gaauucgcgggugcgcucga

SEQ ID NO: 2900157 - RNA, 17 nt, Mycobacterium avium subsp. paratuberculosis
gaauucggaacccugcc

SEQ ID NO: 2900158 - RNA, 13 nt, Mycobacterium avium subsp. paratuberculosis
gaauucggccacc

SEQ ID NO: 2900159 - RNA, 19 nt, Mycobacterium avium subsp. paratuberculosis
gaauucgguggcgauggug

SEQ ID NO: 2900160 - RNA, 19 nt, Mycobacterium avium subsp. paratuberculosis
gaauucgguugucgcggug

SEQ ID NO: 2900161 - RNA, 16 nt, Mycobacterium avium subsp. paratuberculosis
gaauucgucggcggug

SEQ ID NO: 2900162 - RNA, 19 nt, Mycobacterium avium subsp. paratuberculosis
gaauucuggccgaccgccg

SEQ ID NO: 2900163 - RNA, 17 nt, Mycobacterium avium subsp. paratuberculosis
gaauugaagaagcgggc

SEQ ID NO: 2900164 - RNA, 20 nt, Mycobacterium avium subsp. paratuberculosis
gaauugccuugcuccacacu

SEQ ID NO: 2900165 - RNA, 23 nt, Mycobacterium avium subsp. paratuberculosis
gaauugcuuuuugaccaccggca

SEQ ID NO: 2900166 - RNA, 14 nt, Mycobacterium avium subsp. paratuberculosis
gaauuguggcggcc

SEQ ID NO: 2900167 - RNA, 21 nt, Mycobacterium avium subsp. paratuberculosis
gaauuguucugcuuggcaggc

SEQ ID NO: 2900168 - RNA, 15 nt, Mycobacterium avium subsp. paratuberculosis
gaauuuucgccguca

SEQ ID NO: 2900169 - RNA, 19 nt, Mycobacterium avium subsp. paratuberculosis
gacaaagaucacagcgccc

SEQ ID NO: 2900170 - RNA, 20 nt, Mycobacterium avium subsp. paratuberculosis
gacaaagaucacagcgcccu

SEQ ID NO: 2900171 - RNA, 15 nt, Mycobacterium avium subsp. paratuberculosis
gacaaagcacaacuc

SEQ ID NO: 2900172 - RNA, 12 nt, Mycobacterium avium subsp. paratuberculosis
gacaaaggaggg

SEQ ID NO: 2900173 - RNA, 15 nt, Mycobacterium avium subsp. paratuberculosis
gacaacaccaccucu

SEQ ID NO: 2900174 - RNA, 22 nt, Mycobacterium avium subsp. paratuberculosis
gacaacacgaucgucaccgugc

SEQ ID NO: 2900175 - RNA, 23 nt, Mycobacterium avium subsp. paratuberculosis
gacaacacgaucgucaccgugcc

SEQ ID NO: 2900176 - RNA, 13 nt, Mycobacterium avium subsp. paratuberculosis
gacaacagcacga

SEQ ID NO: 2900177 - RNA, 16 nt, Mycobacterium avium subsp. paratuberculosis
gacaacagcacgaaca

SEQ ID NO: 2900178 - RNA, 14 nt, Mycobacterium avium subsp. paratuberculosis
gacaacagcgccga

SEQ ID NO: 2900179 - RNA, 16 nt, Mycobacterium avium subsp. paratuberculosis
gacaacagcgccgaga

SEQ ID NO: 2900180 - RNA, 17 nt, Mycobacterium avium subsp. paratuberculosis
gacaacauccgcgacga

SEQ ID NO: 2900181 - RNA, 20 nt, Mycobacterium avium subsp. paratuberculosis
gacaaccaucgaggcgauca

SEQ ID NO: 2900182 - RNA, 21 nt, Mycobacterium avium subsp. paratuberculosis
gacaacgcgucgaacagccgg

SEQ ID NO: 2900183 - RNA, 23 nt, Mycobacterium avium subsp. paratuberculosis
gacaacgcgucgaacagccgggc

SEQ ID NO: 2900184 - RNA, 22 nt, Mycobacterium avium subsp. paratuberculosis
gacaacggaucgagcgcaccgc

SEQ ID NO: 2900185 - RNA, 15 nt, Mycobacterium avium subsp. paratuberculosis
gacaacggcccccac

SEQ ID NO: 2900186 - RNA, 15 nt, Mycobacterium avium subsp. paratuberculosis
gacaacgggccgccu

SEQ ID NO: 2900187 - RNA, 23 nt, Mycobacterium avium subsp. paratuberculosis
gacaacgggccgccucacgcagg

SEQ ID NO: 2900188 - RNA, 15 nt, Mycobacterium avium subsp. paratuberculosis
gacaacggugguggc

SEQ ID NO: 2900189 - RNA, 17 nt, Mycobacterium avium subsp. paratuberculosis
gacaagccggagaaggc

SEQ ID NO: 2900190 - RNA, 13 nt, Mycobacterium avium subsp. paratuberculosis
gacaagccggcgu

SEQ ID NO: 2900191 - RNA, 18 nt, Mycobacterium avium subsp. paratuberculosis
gacaagccggcgucgaug

SEQ ID NO: 2900192 - RNA, 22 nt, Mycobacterium avium subsp. paratuberculosis
gacaagggccgggcgcuggccg

SEQ ID NO: 2900193 - RNA, 23 nt, Mycobacterium avium subsp. paratuberculosis
gacaagggccgggcgcuggccgu

SEQ ID NO: 2900194 - RNA, 16 nt, Mycobacterium avium subsp. paratuberculosis
gacaaucucgggcacc

SEQ ID NO: 2900195 - RNA, 16 nt, Mycobacterium avium subsp. paratuberculosis
gacacaaaagcgcccg

SEQ ID NO: 2900196 - RNA, 13 nt, Mycobacterium avium subsp. paratuberculosis
gacaccaccacga

SEQ ID NO: 2900197 - RNA, 12 nt, Mycobacterium avium subsp. paratuberculosis
gacaccaccgcg

SEQ ID NO: 2900198 - RNA, 14 nt, Mycobacterium avium subsp. paratuberculosis
gacaccaccgcgcg

SEQ ID NO: 2900199 - RNA, 15 nt, Mycobacterium avium subsp. paratuberculosis
gacaccaccgcgcgc

SEQ ID NO: 2900200 - RNA, 16 nt, Mycobacterium avium subsp. paratuberculosis
gacaccaccgcggugg

SEQ ID NO: 2900201 - RNA, 12 nt, Mycobacterium avium subsp. paratuberculosis
gacaccaccggc

SEQ ID NO: 2900202 - RNA, 19 nt, Mycobacterium avium subsp. paratuberculosis
gacaccaccggccgcccgg

SEQ ID NO: 2900203 - RNA, 22 nt, Mycobacterium avium subsp. paratuberculosis
gacaccaccgugcuggccacca

SEQ ID NO: 2900204 - RNA, 13 nt, Mycobacterium avium subsp. paratuberculosis
gacaccaccugca

SEQ ID NO: 2900205 - RNA, 19 nt, Mycobacterium avium subsp. paratuberculosis
gacaccacgaucagcgcgu

SEQ ID NO: 2900206 - RNA, 21 nt, Mycobacterium avium subsp. paratuberculosis
gacaccacgaucagcgcgucg

SEQ ID NO: 2900207 - RNA, 17 nt, Mycobacterium avium subsp. paratuberculosis
gacaccacggucgccgc

SEQ ID NO: 2900208 - RNA, 18 nt, Mycobacterium avium subsp. paratuberculosis
gacaccacggucgccgcg

SEQ ID NO: 2900209 - RNA, 21 nt, Mycobacterium avium subsp. paratuberculosis
gacaccacggucgccgcgccg

SEQ ID NO: 2900210 - RNA, 21 nt, Mycobacterium avium subsp. paratuberculosis
gacaccacggugaacgggccg

SEQ ID NO: 2900211 - RNA, 23 nt, Mycobacterium avium subsp. paratuberculosis
gacaccacggugaacgggccgca

SEQ ID NO: 2900212 - RNA, 22 nt, Mycobacterium avium subsp. paratuberculosis
gacaccacgucgucggccugca

SEQ ID NO: 2900213 - RNA, 19 nt, Mycobacterium avium subsp. paratuberculosis
gacaccagcauggcgauca

SEQ ID NO: 2900214 - RNA, 12 nt, Mycobacterium avium subsp. paratuberculosis
gacaccagcgcg

SEQ ID NO: 2900215 - RNA, 14 nt, Mycobacterium avium subsp. paratuberculosis
gacaccagcgcgca

SEQ ID NO: 2900216 - RNA, 11 nt, Mycobacterium avium subsp. paratuberculosis
gacacccagcg

SEQ ID NO: 2900217 - RNA, 18 nt, Mycobacterium avium subsp. paratuberculosis
gacacccagcggcgcggc

SEQ ID NO: 2900218 - RNA, 19 nt, Mycobacterium avium subsp. paratuberculosis
gacacccagcggcgcggcc

SEQ ID NO: 2900219 - RNA, 14 nt, Mycobacterium avium subsp. paratuberculosis
gacaccccacaccg

SEQ ID NO: 2900220 - RNA, 20 nt, Mycobacterium avium subsp. paratuberculosis
gacacccccgauccgccguu

SEQ ID NO: 2900221 - RNA, 17 nt, Mycobacterium avium subsp. paratuberculosis
gacaccccgaugcggug

SEQ ID NO: 2900222 - RNA, 23 nt, Mycobacterium avium subsp. paratuberculosis
gacaccccgaugcggugccgggc

SEQ ID NO: 2900223 - RNA, 21 nt, Mycobacterium avium subsp. paratuberculosis
gacaccccgcgagucaccggc

SEQ ID NO: 2900224 - RNA, 14 nt, Mycobacterium avium subsp. paratuberculosis
gacaccccgcucgg

SEQ ID NO: 2900225 - RNA, 20 nt, Mycobacterium avium subsp. paratuberculosis
gacagcaaaccgaccgccgc

SEQ ID NO: 2900226 - RNA, 21 nt, Mycobacterium avium subsp. paratuberculosis
gacagcaaaccgaccgccgcg

SEQ ID NO: 2900227 - RNA, 18 nt, Mycobacterium avium subsp. paratuberculosis
gacagcaacgccagggcc

SEQ ID NO: 2900228 - RNA, 22 nt, Mycobacterium avium subsp. paratuberculosis
gacagcaacgccagggccccgu

SEQ ID NO: 2900229 - RNA, 13 nt, Mycobacterium avium subsp. paratuberculosis
gacagcaccacca

SEQ ID NO: 2900230 - RNA, 17 nt, Mycobacterium avium subsp. paratuberculosis
gacagcaccaccagguc

SEQ ID NO: 2900231 - RNA, 13 nt, Mycobacterium avium subsp. paratuberculosis
gacagcacccagg

SEQ ID NO: 2900232 - RNA, 21 nt, Mycobacterium avium subsp. paratuberculosis
gacagcacccgcugcagccgg

SEQ ID NO: 2900233 - RNA, 14 nt, Mycobacterium avium subsp. paratuberculosis
gacagcacccggcc

SEQ ID NO: 2900234 - RNA, 15 nt, Mycobacterium avium subsp. paratuberculosis
gacagcacccggccc

SEQ ID NO: 2900235 - RNA, 16 nt, Mycobacterium avium subsp. paratuberculosis
gacagcacccggcccc

SEQ ID NO: 2900236 - RNA, 12 nt, Mycobacterium avium subsp. paratuberculosis
gacagcaccgcc

SEQ ID NO: 2900237 - RNA, 14 nt, Mycobacterium avium subsp. paratuberculosis
gacagcaccucgcc

SEQ ID NO: 2900238 - RNA, 22 nt, Mycobacterium avium subsp. paratuberculosis
gacagcaccucgcccugcagcg

SEQ ID NO: 2900239 - RNA, 12 nt, Mycobacterium avium subsp. paratuberculosis
gacagcacgccg

SEQ ID NO: 2900240 - RNA, 16 nt, Mycobacterium avium subsp. paratuberculosis
gacagcacgccgggca

SEQ ID NO: 2900241 - RNA, 23 nt, Mycobacterium avium subsp. paratuberculosis
gacagcacguuguucaggucgau

SEQ ID NO: 2900242 - RNA, 15 nt, Mycobacterium avium subsp. paratuberculosis
gacagcagcaccggc

SEQ ID NO: 2900243 - RNA, 16 nt, Mycobacterium avium subsp. paratuberculosis
gacagcagcagcuccc

SEQ ID NO: 2900244 - RNA, 18 nt, Mycobacterium avium subsp. paratuberculosis
gacagcagcagcucccac

SEQ ID NO: 2900245 - RNA, 22 nt, Mycobacterium avium subsp. paratuberculosis
gacagcagccagguccgggcac

SEQ ID NO: 2900246 - RNA, 22 nt, Mycobacterium avium subsp. paratuberculosis
gacagcagcucauacagcggcg

SEQ ID NO: 2900247 - RNA, 21 nt, Mycobacterium avium subsp. paratuberculosis
gacagcaggaucuccggccgg

SEQ ID NO: 2900248 - RNA, 22 nt, Mycobacterium avium subsp. paratuberculosis
gacagcaggaucuccggccggu

SEQ ID NO: 2900249 - RNA, 18 nt, Mycobacterium avium subsp. paratuberculosis
gacagccaaacagguugg

SEQ ID NO: 2900250 - RNA, 11 nt, Mycobacterium avium subsp. paratuberculosis
gacagccaccg

SEQ ID NO: 2900251 - RNA, 14 nt, Mycobacterium avium subsp. paratuberculosis
gacagccaccgugc

SEQ ID NO: 2900252 - RNA, 14 nt, Mycobacterium avium subsp. paratuberculosis
gacagccacuccau

SEQ ID NO: 2900253 - RNA, 16 nt, Mycobacterium avium subsp. paratuberculosis
gacagcccccgcagcc

SEQ ID NO: 2900254 - RNA, 17 nt, Mycobacterium avium subsp. paratuberculosis
gacagccccgagccgcg

SEQ ID NO: 2900255 - RNA, 15 nt, Mycobacterium avium subsp. paratuberculosis
gacagccgcaccggc

SEQ ID NO: 2900256 - RNA, 16 nt, Mycobacterium avium subsp. paratuberculosis
gacagccgcaccggcg

SEQ ID NO: 2900257 - RNA, 18 nt, Mycobacterium avium subsp. paratuberculosis
gacagccgcaccggcgcc

SEQ ID NO: 2900258 - RNA, 19 nt, Mycobacterium avium subsp. paratuberculosis
gacagccgcaccggcgccg

SEQ ID NO: 2900259 - RNA, 13 nt, Mycobacterium avium subsp. paratuberculosis
gacagccgcccgg

SEQ ID NO: 2900260 - RNA, 14 nt, Mycobacterium avium subsp. paratuberculosis
gacagccgcccggc

SEQ ID NO: 2900261 - RNA, 15 nt, Mycobacterium avium subsp. paratuberculosis
gacagccgcccggcg

SEQ ID NO: 2900262 - RNA, 20 nt, Mycobacterium avium subsp. paratuberculosis
gacagccgcccggcgccccg

SEQ ID NO: 2900263 - RNA, 15 nt, Mycobacterium avium subsp. paratuberculosis
gacagccgcgccgac

SEQ ID NO: 2900264 - RNA, 16 nt, Mycobacterium avium subsp. paratuberculosis
gacagccgcgccgaca

SEQ ID NO: 2900265 - RNA, 20 nt, Mycobacterium avium subsp. paratuberculosis
gacagccgcgccgacagaug

SEQ ID NO: 2900266 - RNA, 17 nt, Mycobacterium avium subsp. paratuberculosis
gacagccggggcagcug

SEQ ID NO: 2900267 - RNA, 20 nt, Mycobacterium avium subsp. paratuberculosis
gacagccggggcagcugcug

SEQ ID NO: 2900268 - RNA, 21 nt, Mycobacterium avium subsp. paratuberculosis
gacagccggggcagcugcugg

SEQ ID NO: 2900269 - RNA, 15 nt, Mycobacterium avium subsp. paratuberculosis
gacagccggucgcgc

SEQ ID NO: 2900270 - RNA, 22 nt, Mycobacterium avium subsp. paratuberculosis
gacagccggucgcgcaucgccu

SEQ ID NO: 2900271 - RNA, 13 nt, Mycobacterium avium subsp. paratuberculosis
gacagccugaccg

SEQ ID NO: 2900272 - RNA, 16 nt, Mycobacterium avium subsp. paratuberculosis
gacagccugaccgcgg

SEQ ID NO: 2900273 - RNA, 20 nt, Mycobacterium avium subsp. paratuberculosis
gacagccugaccgcggguga

SEQ ID NO: 2900274 - RNA, 13 nt, Mycobacterium avium subsp. paratuberculosis
gacagcgaaccga

SEQ ID NO: 2900275 - RNA, 13 nt, Mycobacterium avium subsp. paratuberculosis
gacagcgacgggc

SEQ ID NO: 2900276 - RNA, 15 nt, Mycobacterium avium subsp. paratuberculosis
gacagcgacgggccg

SEQ ID NO: 2900277 - RNA, 19 nt, Mycobacterium avium subsp. paratuberculosis
gacagcgacgggccgggca

SEQ ID NO: 2900278 - RNA, 19 nt, Mycobacterium avium subsp. paratuberculosis
gacagcgagaagucgccga

SEQ ID NO: 2900279 - RNA, 20 nt, Mycobacterium avium subsp. paratuberculosis
gacagcgagaagucgccgac

SEQ ID NO: 2900280 - RNA, 13 nt, Mycobacterium avium subsp. paratuberculosis
gacagcgccugcc

SEQ ID NO: 2900281 - RNA, 15 nt, Mycobacterium avium subsp. paratuberculosis
gacagcgcgacgcac

SEQ ID NO: 2900282 - RNA, 16 nt, Mycobacterium avium subsp. paratuberculosis
gacagcgcgacgcacg

SEQ ID NO: 2900283 - RNA, 20 nt, Mycobacterium avium subsp. paratuberculosis
gacagcgcgguggucagcgg

SEQ ID NO: 2900284 - RNA, 22 nt, Mycobacterium avium subsp. paratuberculosis
gacagcgcgguggucagcggcg

SEQ ID NO: 2900285 - RNA, 15 nt, Mycobacterium avium subsp. paratuberculosis
gacagcgcgucggcc

SEQ ID NO: 2900286 - RNA, 18 nt, Mycobacterium avium subsp. paratuberculosis
gacagcgcgucggccagc

SEQ ID NO: 2900287 - RNA, 22 nt, Mycobacterium avium subsp. paratuberculosis
gacagcggccccccgcacaccg

SEQ ID NO: 2900288 - RNA, 15 nt, Mycobacterium avium subsp. paratuberculosis
gacagcgggccgacc

SEQ ID NO: 2900289 - RNA, 18 nt, Mycobacterium avium subsp. paratuberculosis
gacagcgggccgacccgg

SEQ ID NO: 2900290 - RNA, 13 nt, Mycobacterium avium subsp. paratuberculosis
gacagcgucacca

SEQ ID NO: 2900291 - RNA, 17 nt, Mycobacterium avium subsp. paratuberculosis
gacagcgucagccccga

SEQ ID NO: 2900292 - RNA, 16 nt, Mycobacterium avium subsp. paratuberculosis
gacagcguggucgcgc

SEQ ID NO: 2900293 - RNA, 17 nt, Mycobacterium avium subsp. paratuberculosis
gacagcguggucgcgca

SEQ ID NO: 2900294 - RNA, 18 nt, Mycobacterium avium subsp. paratuberculosis
gacagcucaccgggcucg

SEQ ID NO: 2900295 - RNA, 13 nt, Mycobacterium avium subsp. paratuberculosis
gacagcuccaaca

SEQ ID NO: 2900296 - RNA, 13 nt, Mycobacterium avium subsp. paratuberculosis
gacagcucgccgg

SEQ ID NO: 2900297 - RNA, 15 nt, Mycobacterium avium subsp. paratuberculosis
gacagcucgccggcc

SEQ ID NO: 2900298 - RNA, 18 nt, Mycobacterium avium subsp. paratuberculosis
gacagcucgccggccgcg

SEQ ID NO: 2900299 - RNA, 22 nt, Mycobacterium avium subsp. paratuberculosis
gacagcucgccggccgcgggcg

SEQ ID NO: 2900300 - RNA, 22 nt, Mycobacterium avium subsp. paratuberculosis
gacagcucgcgcugaagccgcu

SEQ ID NO: 2900301 - RNA, 15 nt, Mycobacterium avium subsp. paratuberculosis
gacagcugagcagcc

SEQ ID NO: 2900302 - RNA, 17 nt, Mycobacterium avium subsp. paratuberculosis
gacagcugagcagcccg

SEQ ID NO: 2900303 - RNA, 17 nt, Mycobacterium avium subsp. paratuberculosis
gacagcugcgcgggcgc

SEQ ID NO: 2900304 - RNA, 15 nt, Mycobacterium avium subsp. paratuberculosis
gacaggaacgggccg

SEQ ID NO: 2900305 - RNA, 17 nt, Mycobacterium avium subsp. paratuberculosis
gacaggaacgggccggc

SEQ ID NO: 2900306 - RNA, 18 nt, Mycobacterium avium subsp. paratuberculosis
gacaggaacgggccggcg

SEQ ID NO: 2900307 - RNA, 17 nt, Mycobacterium avium subsp. paratuberculosis
gacaggaggacaaguca

SEQ ID NO: 2900308 - RNA, 12 nt, Mycobacterium avium subsp. paratuberculosis
gacaggaucugg

SEQ ID NO: 2900309 - RNA, 23 nt, Mycobacterium avium subsp. paratuberculosis
gacaggaugcuggggucggccag

SEQ ID NO: 2900310 - RNA, 15 nt, Mycobacterium avium subsp. paratuberculosis
gacauucacgaggcc

SEQ ID NO: 2900311 - RNA, 16 nt, Mycobacterium avium subsp. paratuberculosis
gacauucacgaggccg

SEQ ID NO: 2900312 - RNA, 17 nt, Mycobacterium avium subsp. paratuberculosis
gacauucggggccacca

SEQ ID NO: 2900313 - RNA, 17 nt, Mycobacterium avium subsp. paratuberculosis
gacauuggccgcgcgca

SEQ ID NO: 2900314 - RNA, 20 nt, Mycobacterium avium subsp. paratuberculosis
gacauuggccgcgcgcaggc

SEQ ID NO: 2900315 - RNA, 17 nt, Mycobacterium avium subsp. paratuberculosis
gaccaacacccccgcgc

SEQ ID NO: 2900316 - RNA, 19 nt, Mycobacterium avium subsp. paratuberculosis
gaccaacacccccgcgcug

SEQ ID NO: 2900317 - RNA, 13 nt, Mycobacterium avium subsp. paratuberculosis
gaccaacgccgcc

SEQ ID NO: 2900318 - RNA, 22 nt, Mycobacterium avium subsp. paratuberculosis
gaccaacgccgccuccgacagc

SEQ ID NO: 2900319 - RNA, 20 nt, Mycobacterium avium subsp. paratuberculosis
gaccaacuccaccgcccgga

SEQ ID NO: 2900320 - RNA, 21 nt, Mycobacterium avium subsp. paratuberculosis
gaccaagaaccaacugagcgc

SEQ ID NO: 2900321 - RNA, 12 nt, Mycobacterium avium subsp. paratuberculosis
gaccaagccccg

SEQ ID NO: 2900322 - RNA, 19 nt, Mycobacterium avium subsp. paratuberculosis
gaccaauugcgagcaggcc

SEQ ID NO: 2900323 - RNA, 20 nt, Mycobacterium avium subsp. paratuberculosis
gaccaauugcgagcaggccg

SEQ ID NO: 2900324 - RNA, 16 nt, Mycobacterium avium subsp. paratuberculosis
gaccacaagggccacc

SEQ ID NO: 2900325 - RNA, 15 nt, Mycobacterium avium subsp. paratuberculosis
gaccacaccgccggc

SEQ ID NO: 2900326 - RNA, 13 nt, Mycobacterium avium subsp. paratuberculosis
gaccacaccggcg

SEQ ID NO: 2900327 - RNA, 17 nt, Mycobacterium avium subsp. paratuberculosis
gaccacaccggcgcugc

SEQ ID NO: 2900328 - RNA, 21 nt, Mycobacterium avium subsp. paratuberculosis
gaccacaccggcgcugcccgc

SEQ ID NO: 2900329 - RNA, 15 nt, Mycobacterium avium subsp. paratuberculosis
gaccacaccgucgac

SEQ ID NO: 2900330 - RNA, 18 nt, Mycobacterium avium subsp. paratuberculosis
gaccacaccgucgacgac

SEQ ID NO: 2900331 - RNA, 20 nt, Mycobacterium avium subsp. paratuberculosis
gaccacagcgccucgucgag

SEQ ID NO: 2900332 - RNA, 22 nt, Mycobacterium avium subsp. paratuberculosis
gaccacaugccguugccaggcc

SEQ ID NO: 2900333 - RNA, 13 nt, Mycobacterium avium subsp. paratuberculosis
gaccaccaccgcc

SEQ ID NO: 2900334 - RNA, 16 nt, Mycobacterium avium subsp. paratuberculosis
gaccaccaccgcccac

SEQ ID NO: 2900335 - RNA, 16 nt, Mycobacterium avium subsp. paratuberculosis
gaccaccacggccgca

SEQ ID NO: 2900336 - RNA, 14 nt, Mycobacterium avium subsp. paratuberculosis
gaccaccagcgugc

SEQ ID NO: 2900337 - RNA, 15 nt, Mycobacterium avium subsp. paratuberculosis
gaccaccagcgugcu

SEQ ID NO: 2900338 - RNA, 21 nt, Mycobacterium avium subsp. paratuberculosis
gaccaccaggaaggucccggu

SEQ ID NO: 2900339 - RNA, 19 nt, Mycobacterium avium subsp. paratuberculosis
gaccaccaggagcaccugc

SEQ ID NO: 2900340 - RNA, 21 nt, Mycobacterium avium subsp. paratuberculosis
gaccaccaggagcaccugcgc

SEQ ID NO: 2900341 - RNA, 12 nt, Mycobacterium avium subsp. paratuberculosis
gaccaccaggua

SEQ ID NO: 2900342 - RNA, 21 nt, Mycobacterium avium subsp. paratuberculosis
gaccaccaugauguagcggcg

SEQ ID NO: 2900343 - RNA, 16 nt, Mycobacterium avium subsp. paratuberculosis
gaccacccacucccag

SEQ ID NO: 2900344 - RNA, 21 nt, Mycobacterium avium subsp. paratuberculosis
gaccacccacucccagccgcc

SEQ ID NO: 2900345 - RNA, 16 nt, Mycobacterium avium subsp. paratuberculosis
gaccacccccagcccg

SEQ ID NO: 2900346 - RNA, 18 nt, Mycobacterium avium subsp. paratuberculosis
gaccacccccagcccgcc

SEQ ID NO: 2900347 - RNA, 20 nt, Mycobacterium avium subsp. paratuberculosis
gaccacccccagcccgccgg

SEQ ID NO: 2900348 - RNA, 16 nt, Mycobacterium avium subsp. paratuberculosis
gaccacccgcagcgag

SEQ ID NO: 2900349 - RNA, 16 nt, Mycobacterium avium subsp. paratuberculosis
gaccacccgcagcgcg

SEQ ID NO: 2900350 - RNA, 18 nt, Mycobacterium avium subsp. paratuberculosis
gaccacccgcagcgcggc

SEQ ID NO: 2900351 - RNA, 16 nt, Mycobacterium avium subsp. paratuberculosis
gaccacccucaccacg

SEQ ID NO: 2900352 - RNA, 18 nt, Mycobacterium avium subsp. paratuberculosis
gaccacccucagggagcu

SEQ ID NO: 2900353 - RNA, 22 nt, Mycobacterium avium subsp. paratuberculosis
gaccacccucagggagcugccc

SEQ ID NO: 2900354 - RNA, 16 nt, Mycobacterium avium subsp. paratuberculosis
gaccaccgaccccugc

SEQ ID NO: 2900355 - RNA, 17 nt, Mycobacterium avium subsp. paratuberculosis
gaccaccgagccgggca

SEQ ID NO: 2900356 - RNA, 13 nt, Mycobacterium avium subsp. paratuberculosis
gaccaccgccggc

SEQ ID NO: 2900357 - RNA, 14 nt, Mycobacterium avium subsp. paratuberculosis
gaccaccgccggcc

SEQ ID NO: 2900358 - RNA, 15 nt, Mycobacterium avium subsp. paratuberculosis
gaccaccgccggccc

SEQ ID NO: 2900359 - RNA, 19 nt, Mycobacterium avium subsp. paratuberculosis
gaccaccgccggcccggcg

SEQ ID NO: 2900360 - RNA, 20 nt, Mycobacterium avium subsp. paratuberculosis
gaccaccgccggcccggcgu

SEQ ID NO: 2900361 - RNA, 14 nt, Mycobacterium avium subsp. paratuberculosis
gaccaccgcgucgg

SEQ ID NO: 2900362 - RNA, 22 nt, Mycobacterium avium subsp. paratuberculosis
gaccaccgcgugcgagccgagc

SEQ ID NO: 2900363 - RNA, 20 nt, Mycobacterium avium subsp. paratuberculosis
gaccaccgcuguggacaggu

SEQ ID NO: 2900364 - RNA, 24 nt, Mycobacterium avium subsp. paratuberculosis
gaccaccgcuguggacaggucgau

SEQ ID NO: 2900365 - RNA, 12 nt, Mycobacterium avium subsp. paratuberculosis
gaccaccggcac

SEQ ID NO: 2900366 - RNA, 16 nt, Mycobacterium avium subsp. paratuberculosis
gaccaccggcaccacg

SEQ ID NO: 2900367 - RNA, 20 nt, Mycobacterium avium subsp. paratuberculosis
gaccaccucggcgacgaugg

SEQ ID NO: 2900368 - RNA, 21 nt, Mycobacterium avium subsp. paratuberculosis
gaccaccucgguggacgccgc

SEQ ID NO: 2900369 - RNA, 23 nt, Mycobacterium avium subsp. paratuberculosis
gaccaccucgguggacgccgcgc

SEQ ID NO: 2900370 - RNA, 19 nt, Mycobacterium avium subsp. paratuberculosis
gaccaccugcaccugcggc

SEQ ID NO: 2900371 - RNA, 17 nt, Mycobacterium avium subsp. paratuberculosis
gaccaccuugcgcagca

SEQ ID NO: 2900372 - RNA, 19 nt, Mycobacterium avium subsp. paratuberculosis
gaccaccuugcgcagcagc

SEQ ID NO: 2900373 - RNA, 20 nt, Mycobacterium avium subsp. paratuberculosis
gaccaccuugcgcagcagca

SEQ ID NO: 2900374 - RNA, 23 nt, Mycobacterium avium subsp. paratuberculosis
gaccaccuuggccggugcgccga

SEQ ID NO: 2900375 - RNA, 16 nt, Mycobacterium avium subsp. paratuberculosis
gaccacgaacaccggc

SEQ ID NO: 2900376 - RNA, 19 nt, Mycobacterium avium subsp. paratuberculosis
gaccacgaagggcgccagc

SEQ ID NO: 2900377 - RNA, 23 nt, Mycobacterium avium subsp. paratuberculosis
gaccacgaagggcgccagcaccu

SEQ ID NO: 2900378 - RNA, 22 nt, Mycobacterium avium subsp. paratuberculosis
gaccacgaucugcuuggucacc

SEQ ID NO: 2900379 - RNA, 17 nt, Mycobacterium avium subsp. paratuberculosis
gaccacgcacaccaccg

SEQ ID NO: 2900380 - RNA, 21 nt, Mycobacterium avium subsp. paratuberculosis
gaccacgcacaccaccgacgc

SEQ ID NO: 2900381 - RNA, 13 nt, Mycobacterium avium subsp. paratuberculosis
gaccacgccgcgc

SEQ ID NO: 2900382 - RNA, 20 nt, Mycobacterium avium subsp. paratuberculosis
gaccacgccguacaccgugc

SEQ ID NO: 2900383 - RNA, 14 nt, Mycobacterium avium subsp. paratuberculosis
gaccacgccgugcc

SEQ ID NO: 2900384 - RNA, 15 nt, Mycobacterium avium subsp. paratuberculosis
gaccacgccgugccc

SEQ ID NO: 2900385 - RNA, 19 nt, Mycobacterium avium subsp. paratuberculosis
gaccacgccgugcccggcg

SEQ ID NO: 2900386 - RNA, 20 nt, Mycobacterium avium subsp. paratuberculosis
gaccacgcugagcaaccgcc

SEQ ID NO: 2900387 - RNA, 13 nt, Mycobacterium avium subsp. paratuberculosis
gaccacggcccca

SEQ ID NO: 2900388 - RNA, 16 nt, Mycobacterium avium subsp. paratuberculosis
gaccacggccccagcc

SEQ ID NO: 2900389 - RNA, 13 nt, Mycobacterium avium subsp. paratuberculosis
gaccacggccggu

SEQ ID NO: 2900390 - RNA, 14 nt, Mycobacterium avium subsp. paratuberculosis
gaccacggccgguc

SEQ ID NO: 2900391 - RNA, 16 nt, Mycobacterium avium subsp. paratuberculosis
gaccacggccgguccg

SEQ ID NO: 2900392 - RNA, 21 nt, Mycobacterium avium subsp. paratuberculosis
gaccacggucacagccgcgau

SEQ ID NO: 2900393 - RNA, 15 nt, Mycobacterium avium subsp. paratuberculosis
gaccacggugcgcuc

SEQ ID NO: 2900394 - RNA, 14 nt, Mycobacterium avium subsp. paratuberculosis
gaccagggcggugg

SEQ ID NO: 2900395 - RNA, 19 nt, Mycobacterium avium subsp. paratuberculosis
gaccagggcgguggcggcg

SEQ ID NO: 2900396 - RNA, 13 nt, Mycobacterium avium subsp. paratuberculosis
gaccaggguggcc

SEQ ID NO: 2900397 - RNA, 15 nt, Mycobacterium avium subsp. paratuberculosis
gaccaggguggcccc

SEQ ID NO: 2900398 - RNA, 19 nt, Mycobacterium avium subsp. paratuberculosis
gaccaggguggccccagcc

SEQ ID NO: 2900399 - RNA, 21 nt, Mycobacterium avium subsp. paratuberculosis
gaccaggguggccccagcccg

SEQ ID NO: 2900400 - RNA, 14 nt, Mycobacterium avium subsp. paratuberculosis
gaccagggugguca

SEQ ID NO: 2900401 - RNA, 17 nt, Mycobacterium avium subsp. paratuberculosis
gaccaggguggucagcg

SEQ ID NO: 2900402 - RNA, 15 nt, Mycobacterium avium subsp. paratuberculosis
gaccaggguuccggu

SEQ ID NO: 2900403 - RNA, 23 nt, Mycobacterium avium subsp. paratuberculosis
gaccaggguuucaugcacggcgc

SEQ ID NO: 2900404 - RNA, 19 nt, Mycobacterium avium subsp. paratuberculosis
gaccaggguuugggcgugc

SEQ ID NO: 2900405 - RNA, 17 nt, Mycobacterium avium subsp. paratuberculosis
gaccagguagcgcugca

SEQ ID NO: 2900406 - RNA, 21 nt, Mycobacterium avium subsp. paratuberculosis
gaccagguauucaucgcggcc

SEQ ID NO: 2900407 - RNA, 22 nt, Mycobacterium avium subsp. paratuberculosis
gaccagguauucaucgcggccg

SEQ ID NO: 2900408 - RNA, 21 nt, Mycobacterium avium subsp. paratuberculosis
gaccagguccgguucgaccgg

SEQ ID NO: 2900409 - RNA, 14 nt, Mycobacterium avium subsp. paratuberculosis
gaccaggucgccgg

SEQ ID NO: 2900410 - RNA, 19 nt, Mycobacterium avium subsp. paratuberculosis
gaccaggucgccggcggcc

SEQ ID NO: 2900411 - RNA, 20 nt, Mycobacterium avium subsp. paratuberculosis
gaccaggucgccggcggccg

SEQ ID NO: 2900412 - RNA, 17 nt, Mycobacterium avium subsp. paratuberculosis
gaccaggugggcggcca

SEQ ID NO: 2900413 - RNA, 20 nt, Mycobacterium avium subsp. paratuberculosis
gaccaggugggcggccacca

SEQ ID NO: 2900414 - RNA, 16 nt, Mycobacterium avium subsp. paratuberculosis
gaccaguaccgggccu

SEQ ID NO: 2900415 - RNA, 16 nt, Mycobacterium avium subsp. paratuberculosis
gaccaguaggccagca

SEQ ID NO: 2900416 - RNA, 18 nt, Mycobacterium avium subsp. paratuberculosis
gaccaguaggccagcauc

SEQ ID NO: 2900417 - RNA, 21 nt, Mycobacterium avium subsp. paratuberculosis
gaccagucggcgucuucgggg

SEQ ID NO: 2900418 - RNA, 18 nt, Mycobacterium avium subsp. paratuberculosis
gaccagugcaccucgacg

SEQ ID NO: 2900419 - RNA, 14 nt, Mycobacterium avium subsp. paratuberculosis
gaccagugcagagc

SEQ ID NO: 2900420 - RNA, 16 nt, Mycobacterium avium subsp. paratuberculosis
gaccagugcagagcga

SEQ ID NO: 2900421 - RNA, 17 nt, Mycobacterium avium subsp. paratuberculosis
gaccagugcagagcgau

SEQ ID NO: 2900422 - RNA, 13 nt, Mycobacterium avium subsp. paratuberculosis
gaccagugguggc

SEQ ID NO: 2900423 - RNA, 14 nt, Mycobacterium avium subsp. paratuberculosis
gaccagugguggcc

SEQ ID NO: 2900424 - RNA, 19 nt, Mycobacterium avium subsp. paratuberculosis
gaccagugguggccgaacg

SEQ ID NO: 2900425 - RNA, 18 nt, Mycobacterium avium subsp. paratuberculosis
gaccaguucgcccuggcc

SEQ ID NO: 2900426 - RNA, 16 nt, Mycobacterium avium subsp. paratuberculosis
gaccaguucggccacc

SEQ ID NO: 2900427 - RNA, 18 nt, Mycobacterium avium subsp. paratuberculosis
gaccaguucggccaccgc

SEQ ID NO: 2900428 - RNA, 19 nt, Mycobacterium avium subsp. paratuberculosis
gaccaguucggccaccgcg

SEQ ID NO: 2900429 - RNA, 21 nt, Mycobacterium avium subsp. paratuberculosis
gaccaguucuucgaugacggc

SEQ ID NO: 2900430 - RNA, 13 nt, Mycobacterium avium subsp. paratuberculosis
gaccaucagcccg

SEQ ID NO: 2900431 - RNA, 15 nt, Mycobacterium avium subsp. paratuberculosis
gaccaucagcgcccg

SEQ ID NO: 2900432 - RNA, 20 nt, Mycobacterium avium subsp. paratuberculosis
gaccaucagcgcccgggugg

SEQ ID NO: 2900433 - RNA, 21 nt, Mycobacterium avium subsp. paratuberculosis
gaccaucagcgcccggguggg

SEQ ID NO: 2900434 - RNA, 19 nt, Mycobacterium avium subsp. paratuberculosis
gaccaucauggccucccca

SEQ ID NO: 2900435 - RNA, 19 nt, Mycobacterium avium subsp. paratuberculosis
gaccaucgggucgucggcg

SEQ ID NO: 2900436 - RNA, 17 nt, Mycobacterium avium subsp. paratuberculosis
gaccaucuacgaccucg

SEQ ID NO: 2900437 - RNA, 15 nt, Mycobacterium avium subsp. paratuberculosis
gaccaucugccggcg

SEQ ID NO: 2900438 - RNA, 12 nt, Mycobacterium avium subsp. paratuberculosis
gaccaugaccca

SEQ ID NO: 2900439 - RNA, 23 nt, Mycobacterium avium subsp. paratuberculosis
gaccaugacccacggguuggggc

SEQ ID NO: 2900440 - RNA, 17 nt, Mycobacterium avium subsp. paratuberculosis
gaccaugaguugcgggu

SEQ ID NO: 2900441 - RNA, 13 nt, Mycobacterium avium subsp. paratuberculosis
gaccaugcccagc

SEQ ID NO: 2900442 - RNA, 17 nt, Mycobacterium avium subsp. paratuberculosis
gaccaugcccagcaguc

SEQ ID NO: 2900443 - RNA, 14 nt, Mycobacterium avium subsp. paratuberculosis
gaccaugcccggcg

SEQ ID NO: 2900444 - RNA, 14 nt, Mycobacterium avium subsp. paratuberculosis
gaccaugccgccga

SEQ ID NO: 2900445 - RNA, 17 nt, Mycobacterium avium subsp. paratuberculosis
gaccaugccgcgggcca

SEQ ID NO: 2900446 - RNA, 19 nt, Mycobacterium avium subsp. paratuberculosis
gaccaugccgcgggccagc

SEQ ID NO: 2900447 - RNA, 24 nt, Mycobacterium avium subsp. paratuberculosis
gaccaugccgcgggccagcagccg

SEQ ID NO: 2900448 - RNA, 18 nt, Mycobacterium avium subsp. paratuberculosis
gaccauggcgcggcggcc

SEQ ID NO: 2900449 - RNA, 21 nt, Mycobacterium avium subsp. paratuberculosis
gaccauggcgcggcggccggc

SEQ ID NO: 2900450 - RNA, 22 nt, Mycobacterium avium subsp. paratuberculosis
gaccaugucgacgcugagccgc

SEQ ID NO: 2900451 - RNA, 15 nt, Mycobacterium avium subsp. paratuberculosis
gaccaugucggccag

SEQ ID NO: 2900452 - RNA, 14 nt, Mycobacterium avium subsp. paratuberculosis
gaccaugucggcga

SEQ ID NO: 2900453 - RNA, 15 nt, Mycobacterium avium subsp. paratuberculosis
gaccaugucggcgac

SEQ ID NO: 2900454 - RNA, 18 nt, Mycobacterium avium subsp. paratuberculosis
gaccaugucggcgacccg

SEQ ID NO: 2900455 - RNA, 19 nt, Mycobacterium avium subsp. paratuberculosis
gaccaugucggcgacccgc

SEQ ID NO: 2900456 - RNA, 18 nt, Mycobacterium avium subsp. paratuberculosis
gacccacaccucgcaggu

SEQ ID NO: 2900457 - RNA, 15 nt, Mycobacterium avium subsp. paratuberculosis
gacccacagcugccg

SEQ ID NO: 2900458 - RNA, 18 nt, Mycobacterium avium subsp. paratuberculosis
gacccagacuugggcagc

SEQ ID NO: 2900459 - RNA, 22 nt, Mycobacterium avium subsp. paratuberculosis
gacccagacuugggcagcaggu

SEQ ID NO: 2900460 - RNA, 15 nt, Mycobacterium avium subsp. paratuberculosis
gacccagcagcggcc

SEQ ID NO: 2900461 - RNA, 18 nt, Mycobacterium avium subsp. paratuberculosis
gacccagcagcggccggc

SEQ ID NO: 2900462 - RNA, 19 nt, Mycobacterium avium subsp. paratuberculosis
gacccagcagcggccggcg

SEQ ID NO: 2900463 - RNA, 20 nt, Mycobacterium avium subsp. paratuberculosis
gacccagcagcggccggcgc

SEQ ID NO: 2900464 - RNA, 21 nt, Mycobacterium avium subsp. paratuberculosis
gacccagcagcggccggcgca

SEQ ID NO: 2900465 - RNA, 15 nt, Mycobacterium avium subsp. paratuberculosis
gacccagcaucgccg

SEQ ID NO: 2900466 - RNA, 19 nt, Mycobacterium avium subsp. paratuberculosis
gacccagcccagcugcucg

SEQ ID NO: 2900467 - RNA, 13 nt, Mycobacterium avium subsp. paratuberculosis
gacccagcccgau

SEQ ID NO: 2900468 - RNA, 16 nt, Mycobacterium avium subsp. paratuberculosis
gacccagcccggcgac

SEQ ID NO: 2900469 - RNA, 11 nt, Mycobacterium avium subsp. paratuberculosis
gacccagcgcg

SEQ ID NO: 2900470 - RNA, 12 nt, Mycobacterium avium subsp. paratuberculosis
gacccagcgcgg

SEQ ID NO: 2900471 - RNA, 15 nt, Mycobacterium avium subsp. paratuberculosis
gacccagcgcggggg

SEQ ID NO: 2900472 - RNA, 13 nt, Mycobacterium avium subsp. paratuberculosis
gacccagcuccuc

SEQ ID NO: 2900473 - RNA, 15 nt, Mycobacterium avium subsp. paratuberculosis
gacccagcuccucgg

SEQ ID NO: 2900474 - RNA, 22 nt, Mycobacterium avium subsp. paratuberculosis
gacccagcuccucggccagcac

SEQ ID NO: 2900475 - RNA, 23 nt, Mycobacterium avium subsp. paratuberculosis
gacccagcuccucggccagcacc

SEQ ID NO: 2900476 - RNA, 14 nt, Mycobacterium avium subsp. paratuberculosis
gacccaggccgccg

SEQ ID NO: 2900477 - RNA, 20 nt, Mycobacterium avium subsp. paratuberculosis
gacccaggccgccgccaccg

SEQ ID NO: 2900478 - RNA, 20 nt, Mycobacterium avium subsp. paratuberculosis
gaccccacaccuucgcgguc

SEQ ID NO: 2900479 - RNA, 13 nt, Mycobacterium avium subsp. paratuberculosis
gacccggaacccg

SEQ ID NO: 2900480 - RNA, 17 nt, Mycobacterium avium subsp. paratuberculosis
gacccggaggcggcggg

SEQ ID NO: 2900481 - RNA, 20 nt, Mycobacterium avium subsp. paratuberculosis
gacccggaggcggcgggggc

SEQ ID NO: 2900482 - RNA, 22 nt, Mycobacterium avium subsp. paratuberculosis
gacccggauacacgguggugac

SEQ ID NO: 2900483 - RNA, 22 nt, Mycobacterium avium subsp. paratuberculosis
gacccggaugaucaacacgucg

SEQ ID NO: 2900484 - RNA, 16 nt, Mycobacterium avium subsp. paratuberculosis
gacccggccaccgccg

SEQ ID NO: 2900485 - RNA, 22 nt, Mycobacterium avium subsp. paratuberculosis
gacccggccaccgccgccagca

SEQ ID NO: 2900486 - RNA, 15 nt, Mycobacterium avium subsp. paratuberculosis
gacccggccagcggc

SEQ ID NO: 2900487 - RNA, 22 nt, Mycobacterium avium subsp. paratuberculosis
gacccggccagcggcagcggcg

SEQ ID NO: 2900488 - RNA, 20 nt, Mycobacterium avium subsp. paratuberculosis
gacccggccgagcgcgccga

SEQ ID NO: 2900489 - RNA, 22 nt, Mycobacterium avium subsp. paratuberculosis
gacccggccgagcgcgccgagc

SEQ ID NO: 2900490 - RNA, 21 nt, Mycobacterium avium subsp. paratuberculosis
gacccggccgcacaccaccac

SEQ ID NO: 2900491 - RNA, 23 nt, Mycobacterium avium subsp. paratuberculosis
gacccggccgcacaccaccacgu

SEQ ID NO: 2900492 - RNA, 14 nt, Mycobacterium avium subsp. paratuberculosis
gacccggccgcgcc

SEQ ID NO: 2900493 - RNA, 21 nt, Mycobacterium avium subsp. paratuberculosis
gacccggccgcgccggauggu

SEQ ID NO: 2900494 - RNA, 12 nt, Mycobacterium avium subsp. paratuberculosis
gacccggccggu

SEQ ID NO: 2900495 - RNA, 13 nt, Mycobacterium avium subsp. paratuberculosis
gacccggccgguc

SEQ ID NO: 2900496 - RNA, 18 nt, Mycobacterium avium subsp. paratuberculosis
gacccggccgugcgcagc

SEQ ID NO: 2900497 - RNA, 20 nt, Mycobacterium avium subsp. paratuberculosis
gacccggccgugcgcagcaa

SEQ ID NO: 2900498 - RNA, 19 nt, Mycobacterium avium subsp. paratuberculosis
gacccggccguugggccag

SEQ ID NO: 2900499 - RNA, 19 nt, Mycobacterium avium subsp. paratuberculosis
gacccggcgagcggcaccu

SEQ ID NO: 2900500 - RNA, 13 nt, Mycobacterium avium subsp. paratuberculosis
gacccggcucucc

SEQ ID NO: 2900501 - RNA, 13 nt, Mycobacterium avium subsp. paratuberculosis
gacccgggccagc

SEQ ID NO: 2900502 - RNA, 14 nt, Mycobacterium avium subsp. paratuberculosis
gacccgggccagca

SEQ ID NO: 2900503 - RNA, 16 nt, Mycobacterium avium subsp. paratuberculosis
gacccgggccagcagg

SEQ ID NO: 2900504 - RNA, 14 nt, Mycobacterium avium subsp. paratuberculosis
gacccgggccaggu

SEQ ID NO: 2900505 - RNA, 11 nt, Mycobacterium avium subsp. paratuberculosis
gacccgggcga

SEQ ID NO: 2900506 - RNA, 17 nt, Mycobacterium avium subsp. paratuberculosis
gacccgggcgauggugc

SEQ ID NO: 2900507 - RNA, 19 nt, Mycobacterium avium subsp. paratuberculosis
gacccgggcgauggugccg

SEQ ID NO: 2900508 - RNA, 23 nt, Mycobacterium avium subsp. paratuberculosis
gacccgggcgauggugccgccgg

SEQ ID NO: 2900509 - RNA, 15 nt, Mycobacterium avium subsp. paratuberculosis
gacccgggcggccug

SEQ ID NO: 2900510 - RNA, 20 nt, Mycobacterium avium subsp. paratuberculosis
gacccgggcggccugcugca

SEQ ID NO: 2900511 - RNA, 19 nt, Mycobacterium avium subsp. paratuberculosis
gacccgggcuagacgcgca

SEQ ID NO: 2900512 - RNA, 23 nt, Mycobacterium avium subsp. paratuberculosis
gacccggggguccagggugccga

SEQ ID NO: 2900513 - RNA, 17 nt, Mycobacterium avium subsp. paratuberculosis
gacccgguagcgcagca

SEQ ID NO: 2900514 - RNA, 19 nt, Mycobacterium avium subsp. paratuberculosis
gacccgguagcgcagcacc

SEQ ID NO: 2900515 - RNA, 20 nt, Mycobacterium avium subsp. paratuberculosis
gacccgguagcgcagcacca

SEQ ID NO: 2900516 - RNA, 17 nt, Mycobacterium avium subsp. paratuberculosis
gacccggucagcucgcc

SEQ ID NO: 2900517 - RNA, 19 nt, Mycobacterium avium subsp. paratuberculosis
gacccggucagcucgccgu

SEQ ID NO: 2900518 - RNA, 21 nt, Mycobacterium avium subsp. paratuberculosis
gacccggucagcucgccgucc

SEQ ID NO: 2900519 - RNA, 18 nt, Mycobacterium avium subsp. paratuberculosis
gacccggucgcggccgua

SEQ ID NO: 2900520 - RNA, 13 nt, Mycobacterium avium subsp. paratuberculosis
gacccggucggcc

SEQ ID NO: 2900521 - RNA, 16 nt, Mycobacterium avium subsp. paratuberculosis
gacccggucggccgcg

SEQ ID NO: 2900522 - RNA, 16 nt, Mycobacterium avium subsp. paratuberculosis
gacccggugcccaccg

SEQ ID NO: 2900523 - RNA, 21 nt, Mycobacterium avium subsp. paratuberculosis
gacccgguugaaggccgcgcu

SEQ ID NO: 2900524 - RNA, 20 nt, Mycobacterium avium subsp. paratuberculosis
gacccguaggagcugacggc

SEQ ID NO: 2900525 - RNA, 18 nt, Mycobacterium avium subsp. paratuberculosis
gacccguccagcagcaug

SEQ ID NO: 2900526 - RNA, 13 nt, Mycobacterium avium subsp. paratuberculosis
gacccguccagcg

SEQ ID NO: 2900527 - RNA, 18 nt, Mycobacterium avium subsp. paratuberculosis
gacccgucggggugcgcc

SEQ ID NO: 2900528 - RNA, 22 nt, Mycobacterium avium subsp. paratuberculosis
gacccgucggggugcgccaggc

SEQ ID NO: 2900529 - RNA, 14 nt, Mycobacterium avium subsp. paratuberculosis
gacccguuccccgg

SEQ ID NO: 2900530 - RNA, 17 nt, Mycobacterium avium subsp. paratuberculosis
gacccguuccggcgaga

SEQ ID NO: 2900531 - RNA, 17 nt, Mycobacterium avium subsp. paratuberculosis
gacccucagcagggcgg

SEQ ID NO: 2900532 - RNA, 18 nt, Mycobacterium avium subsp. paratuberculosis
gacccugccgucaccggc

SEQ ID NO: 2900533 - RNA, 18 nt, Mycobacterium avium subsp. paratuberculosis
gacccuggaugaucucga

SEQ ID NO: 2900534 - RNA, 20 nt, Mycobacterium avium subsp. paratuberculosis
gacccuggccagcaccgcgg

SEQ ID NO: 2900535 - RNA, 21 nt, Mycobacterium avium subsp. paratuberculosis
gacccuggccagcaccgcggu

SEQ ID NO: 2900536 - RNA, 17 nt, Mycobacterium avium subsp. paratuberculosis
gacccugugggucgaca

SEQ ID NO: 2900537 - RNA, 16 nt, Mycobacterium avium subsp. paratuberculosis
gacccuucgaacgcga

SEQ ID NO: 2900538 - RNA, 14 nt, Mycobacterium avium subsp. paratuberculosis
gaccgaacccgggc

SEQ ID NO: 2900539 - RNA, 15 nt, Mycobacterium avium subsp. paratuberculosis
gaccgaacccgggcg

SEQ ID NO: 2900540 - RNA, 23 nt, Mycobacterium avium subsp. paratuberculosis
gaccgacagcaaaccgaccgccg

SEQ ID NO: 2900541 - RNA, 14 nt, Mycobacterium avium subsp. paratuberculosis
gaccgacagccgca

SEQ ID NO: 2900542 - RNA, 17 nt, Mycobacterium avium subsp. paratuberculosis
gaccgacagccgcacca

SEQ ID NO: 2900543 - RNA, 15 nt, Mycobacterium avium subsp. paratuberculosis
gaccgacaguucggc

SEQ ID NO: 2900544 - RNA, 17 nt, Mycobacterium avium subsp. paratuberculosis
gaccgacaguucggcgc

SEQ ID NO: 2900545 - RNA, 20 nt, Mycobacterium avium subsp. paratuberculosis
gaccgacaguucggcgcgca

SEQ ID NO: 2900546 - RNA, 16 nt, Mycobacterium avium subsp. paratuberculosis
gaccgacauggccagc

SEQ ID NO: 2900547 - RNA, 20 nt, Mycobacterium avium subsp. paratuberculosis
gaccgacauggccagcacca

SEQ ID NO: 2900548 - RNA, 13 nt, Mycobacterium avium subsp. paratuberculosis
gaccgacccggcc

SEQ ID NO: 2900549 - RNA, 16 nt, Mycobacterium avium subsp. paratuberculosis
gaccgacccggccagc

SEQ ID NO: 2900550 - RNA, 20 nt, Mycobacterium avium subsp. paratuberculosis
gaccgaccuccaaugcgccc

SEQ ID NO: 2900551 - RNA, 22 nt, Mycobacterium avium subsp. paratuberculosis
gaccgaccuccaaugcgcccug

SEQ ID NO: 2900552 - RNA, 15 nt, Mycobacterium avium subsp. paratuberculosis
gaccgacgacgugac

SEQ ID NO: 2900553 - RNA, 14 nt, Mycobacterium avium subsp. paratuberculosis
gaccgacgcccggc

SEQ ID NO: 2900554 - RNA, 15 nt, Mycobacterium avium subsp. paratuberculosis
gaccgacgcccggcu

SEQ ID NO: 2900555 - RNA, 16 nt, Mycobacterium avium subsp. paratuberculosis
gaccgacgccuccaca

SEQ ID NO: 2900556 - RNA, 16 nt, Mycobacterium avium subsp. paratuberculosis
gaccgacgcggucacc

SEQ ID NO: 2900557 - RNA, 23 nt, Mycobacterium avium subsp. paratuberculosis
gaccgagaugaagacccggccgu

SEQ ID NO: 2900558 - RNA, 12 nt, Mycobacterium avium subsp. paratuberculosis
gaccgagccgcg

SEQ ID NO: 2900559 - RNA, 14 nt, Mycobacterium avium subsp. paratuberculosis
gaccgagcgcgcga

SEQ ID NO: 2900560 - RNA, 20 nt, Mycobacterium avium subsp. paratuberculosis
gaccgagcggcgcugcagca

SEQ ID NO: 2900561 - RNA, 21 nt, Mycobacterium avium subsp. paratuberculosis
gaccgagcggcgcugcagcag

SEQ ID NO: 2900562 - RNA, 13 nt, Mycobacterium avium subsp. paratuberculosis
gaccgaggccgcc

SEQ ID NO: 2900563 - RNA, 17 nt, Mycobacterium avium subsp. paratuberculosis
gaccgaggcgaucgcgg

SEQ ID NO: 2900564 - RNA, 18 nt, Mycobacterium avium subsp. paratuberculosis
gaccgccuugucggcgau

SEQ ID NO: 2900565 - RNA, 17 nt, Mycobacterium avium subsp. paratuberculosis
gaccgcgacgaccucgc

SEQ ID NO: 2900566 - RNA, 18 nt, Mycobacterium avium subsp. paratuberculosis
gaccgcgacgaccucgcc

SEQ ID NO: 2900567 - RNA, 20 nt, Mycobacterium avium subsp. paratuberculosis
gaccgcgacgaccucgcccg

SEQ ID NO: 2900568 - RNA, 22 nt, Mycobacterium avium subsp. paratuberculosis
gaccgcgacgaccucgcccgcc

SEQ ID NO: 2900569 - RNA, 23 nt, Mycobacterium avium subsp. paratuberculosis
gaccgcgacgaccucgcccgccg

SEQ ID NO: 2900570 - RNA, 16 nt, Mycobacterium avium subsp. paratuberculosis
gaccgcgacgcugccg

SEQ ID NO: 2900571 - RNA, 19 nt, Mycobacterium avium subsp. paratuberculosis
gaccgcgacgcugccggug

SEQ ID NO: 2900572 - RNA, 13 nt, Mycobacterium avium subsp. paratuberculosis
gaccgcgacggcg

SEQ ID NO: 2900573 - RNA, 16 nt, Mycobacterium avium subsp. paratuberculosis
gaccgcgacggcgccc

SEQ ID NO: 2900574 - RNA, 19 nt, Mycobacterium avium subsp. paratuberculosis
gaccgcgacggcgcccgcc

SEQ ID NO: 2900575 - RNA, 13 nt, Mycobacterium avium subsp. paratuberculosis
gaccgcgacgggc

SEQ ID NO: 2900576 - RNA, 20 nt, Mycobacterium avium subsp. paratuberculosis
gaccgcgacgggcucggcgu

SEQ ID NO: 2900577 - RNA, 22 nt, Mycobacterium avium subsp. paratuberculosis
gaccgcgacgggcucggcguac

SEQ ID NO: 2900578 - RNA, 18 nt, Mycobacterium avium subsp. paratuberculosis
gaccgcgacguggcgcag

SEQ ID NO: 2900579 - RNA, 19 nt, Mycobacterium avium subsp. paratuberculosis
gaccgcgaucagccccagg

SEQ ID NO: 2900580 - RNA, 17 nt, Mycobacterium avium subsp. paratuberculosis
gaccgcgaucagggccg

SEQ ID NO: 2900581 - RNA, 23 nt, Mycobacterium avium subsp. paratuberculosis
gaccgcgaugcagaacagccggu

SEQ ID NO: 2900582 - RNA, 12 nt, Mycobacterium avium subsp. paratuberculosis
gaccgcgaugcg

SEQ ID NO: 2900583 - RNA, 18 nt, Mycobacterium avium subsp. paratuberculosis
gaccgcgaugcgacaccg

SEQ ID NO: 2900584 - RNA, 21 nt, Mycobacterium avium subsp. paratuberculosis
gaccgcgaugguggcgucacg

SEQ ID NO: 2900585 - RNA, 21 nt, Mycobacterium avium subsp. paratuberculosis
gaccgcgcaccggcgcuggua

SEQ ID NO: 2900586 - RNA, 16 nt, Mycobacterium avium subsp. paratuberculosis
gaccgcgcaggcggcg

SEQ ID NO: 2900587 - RNA, 22 nt, Mycobacterium avium subsp. paratuberculosis
gaccgcgcaggcggcgacggcc

SEQ ID NO: 2900588 - RNA, 20 nt, Mycobacterium avium subsp. paratuberculosis
gaccgcgcagucggcgucgc

SEQ ID NO: 2900589 - RNA, 13 nt, Mycobacterium avium subsp. paratuberculosis
gaccgcgccgcgg

SEQ ID NO: 2900590 - RNA, 15 nt, Mycobacterium avium subsp. paratuberculosis
gaccgcgccgcgggu

SEQ ID NO: 2900591 - RNA, 18 nt, Mycobacterium avium subsp. paratuberculosis
gaccgcgccgcgggugac

SEQ ID NO: 2900592 - RNA, 14 nt, Mycobacterium avium subsp. paratuberculosis
gaccgcgcgccggc

SEQ ID NO: 2900593 - RNA, 17 nt, Mycobacterium avium subsp. paratuberculosis
gaccgcgcgcggcgccg

SEQ ID NO: 2900594 - RNA, 19 nt, Mycobacterium avium subsp. paratuberculosis
gaccgcgcgcggcgccgcg

SEQ ID NO: 2900595 - RNA, 20 nt, Mycobacterium avium subsp. paratuberculosis
gaccgcgcgcggcgccgcgu

SEQ ID NO: 2900596 - RNA, 12 nt, Mycobacterium avium subsp. paratuberculosis
gaccgcgcgggc

SEQ ID NO: 2900597 - RNA, 17 nt, Mycobacterium avium subsp. paratuberculosis
gaccgcgcgggccagcg

SEQ ID NO: 2900598 - RNA, 15 nt, Mycobacterium avium subsp. paratuberculosis
gaccgcggaaccgua

SEQ ID NO: 2900599 - RNA, 22 nt, Mycobacterium avium subsp. paratuberculosis
gaccgcggaaccguagaccacc

SEQ ID NO: 2900600 - RNA, 16 nt, Mycobacterium avium subsp. paratuberculosis
gaccgcggaugacggg

SEQ ID NO: 2900601 - RNA, 16 nt, Mycobacterium avium subsp. paratuberculosis
gaccgcggccucgucg

SEQ ID NO: 2900602 - RNA, 15 nt, Mycobacterium avium subsp. paratuberculosis
gaccgcggcgauggc

SEQ ID NO: 2900603 - RNA, 15 nt, Mycobacterium avium subsp. paratuberculosis
gaccgcggcgauggu

SEQ ID NO: 2900604 - RNA, 19 nt, Mycobacterium avium subsp. paratuberculosis
gaccgcggcgauggugggc

SEQ ID NO: 2900605 - RNA, 13 nt, Mycobacterium avium subsp. paratuberculosis
gaccgcggcgccg

SEQ ID NO: 2900606 - RNA, 18 nt, Mycobacterium avium subsp. paratuberculosis
gaccgcggcgccgauggc

SEQ ID NO: 2900607 - RNA, 13 nt, Mycobacterium avium subsp. paratuberculosis
gaccgcggcgggc

SEQ ID NO: 2900608 - RNA, 13 nt, Mycobacterium avium subsp. paratuberculosis
gaccgcggcgguc

SEQ ID NO: 2900609 - RNA, 19 nt, Mycobacterium avium subsp. paratuberculosis
gaccgcggcggucgccacu

SEQ ID NO: 2900610 - RNA, 13 nt, Mycobacterium avium subsp. paratuberculosis
gaccgcggcuccg

SEQ ID NO: 2900611 - RNA, 18 nt, Mycobacterium avium subsp. paratuberculosis
gaccgcggcuccggccgc

SEQ ID NO: 2900612 - RNA, 21 nt, Mycobacterium avium subsp. paratuberculosis
gaccgcggcuccggccgcgcc

SEQ ID NO: 2900613 - RNA, 22 nt, Mycobacterium avium subsp. paratuberculosis
gaccgcggcuccggccgcgccg

SEQ ID NO: 2900614 - RNA, 12 nt, Mycobacterium avium subsp. paratuberculosis
gaccgcgggccc

SEQ ID NO: 2900615 - RNA, 13 nt, Mycobacterium avium subsp. paratuberculosis
gaccgcgggcccg

SEQ ID NO: 2900616 - RNA, 14 nt, Mycobacterium avium subsp. paratuberculosis
gaccgcgggcccgc

SEQ ID NO: 2900617 - RNA, 15 nt, Mycobacterium avium subsp. paratuberculosis
gaccgcgggcccgcc

SEQ ID NO: 2900618 - RNA, 14 nt, Mycobacterium avium subsp. paratuberculosis
gaccgcgggugagg

SEQ ID NO: 2900619 - RNA, 19 nt, Mycobacterium avium subsp. paratuberculosis
gaccgcgggugaggggcgc

SEQ ID NO: 2900620 - RNA, 14 nt, Mycobacterium avium subsp. paratuberculosis
gaccgcggucaccg

SEQ ID NO: 2900621 - RNA, 19 nt, Mycobacterium avium subsp. paratuberculosis
gaccgcggucaccggucgg

SEQ ID NO: 2900622 - RNA, 20 nt, Mycobacterium avium subsp. paratuberculosis
gaccgcggucaccggucggu

SEQ ID NO: 2900623 - RNA, 16 nt, Mycobacterium avium subsp. paratuberculosis
gaccgcggucgcggcg

SEQ ID NO: 2900624 - RNA, 19 nt, Mycobacterium avium subsp. paratuberculosis
gaccgcggucgcggcgccg

SEQ ID NO: 2900625 - RNA, 24 nt, Mycobacterium avium subsp. paratuberculosis
gaccgcguacagggcgucggacau

SEQ ID NO: 2900626 - RNA, 23 nt, Mycobacterium avium subsp. paratuberculosis
gaccgcguagucguugucggcgg

SEQ ID NO: 2900627 - RNA, 15 nt, Mycobacterium avium subsp. paratuberculosis
gaccgcguccgaggc

SEQ ID NO: 2900628 - RNA, 17 nt, Mycobacterium avium subsp. paratuberculosis
gaccgcguccgaggcgg

SEQ ID NO: 2900629 - RNA, 16 nt, Mycobacterium avium subsp. paratuberculosis
gaccgcgucggcgccg

SEQ ID NO: 2900630 - RNA, 15 nt, Mycobacterium avium subsp. paratuberculosis
gaccgcgugugcccg

SEQ ID NO: 2900631 - RNA, 16 nt, Mycobacterium avium subsp. paratuberculosis
gaccgcgugugcccgc

SEQ ID NO: 2900632 - RNA, 18 nt, Mycobacterium avium subsp. paratuberculosis
gaccgcguuggcgccgac

SEQ ID NO: 2900633 - RNA, 15 nt, Mycobacterium avium subsp. paratuberculosis
gaccgcuugacgccg

SEQ ID NO: 2900634 - RNA, 17 nt, Mycobacterium avium subsp. paratuberculosis
gaccgcuugacgccgcc

SEQ ID NO: 2900635 - RNA, 12 nt, Mycobacterium avium subsp. paratuberculosis
gaccgcuugcgg

SEQ ID NO: 2900636 - RNA, 15 nt, Mycobacterium avium subsp. paratuberculosis
gaccgcuugcggcuc

SEQ ID NO: 2900637 - RNA, 15 nt, Mycobacterium avium subsp. paratuberculosis
gaccggaagccuguu

SEQ ID NO: 2900638 - RNA, 22 nt, Mycobacterium avium subsp. paratuberculosis
gaccggaagccuguuggccaga

SEQ ID NO: 2900639 - RNA, 17 nt, Mycobacterium avium subsp. paratuberculosis
gaccggacagcugggcg

SEQ ID NO: 2900640 - RNA, 23 nt, Mycobacterium avium subsp. paratuberculosis
gaccggauccaccaauucgcgcu

SEQ ID NO: 2900641 - RNA, 16 nt, Mycobacterium avium subsp. paratuberculosis
gaccggaucggccagc

SEQ ID NO: 2900642 - RNA, 17 nt, Mycobacterium avium subsp. paratuberculosis
gaccggaucggccagca

SEQ ID NO: 2900643 - RNA, 19 nt, Mycobacterium avium subsp. paratuberculosis
gaccggaucggccagcagg

SEQ ID NO: 2900644 - RNA, 16 nt, Mycobacterium avium subsp. paratuberculosis
gaccggcagcaccggc

SEQ ID NO: 2900645 - RNA, 18 nt, Mycobacterium avium subsp. paratuberculosis
gaccggcagcaccggccg

SEQ ID NO: 2900646 - RNA, 14 nt, Mycobacterium avium subsp. paratuberculosis
gaccggcagccgcg

SEQ ID NO: 2900647 - RNA, 15 nt, Mycobacterium avium subsp. paratuberculosis
gaccggcagccgcgc

SEQ ID NO: 2900648 - RNA, 17 nt, Mycobacterium avium subsp. paratuberculosis
gaccggccaccucgucg

SEQ ID NO: 2900649 - RNA, 20 nt, Mycobacterium avium subsp. paratuberculosis
gaccgucacgcuggcgugac

SEQ ID NO: 2900650 - RNA, 21 nt, Mycobacterium avium subsp. paratuberculosis
gaccgucacgcuggcgugaca

SEQ ID NO: 2900651 - RNA, 20 nt, Mycobacterium avium subsp. paratuberculosis
gaccgucagcagggccucgc

SEQ ID NO: 2900652 - RNA, 22 nt, Mycobacterium avium subsp. paratuberculosis
gaccgucagcagggccucgccg

SEQ ID NO: 2900653 - RNA, 17 nt, Mycobacterium avium subsp. paratuberculosis
gaccgucaucaucaccg

SEQ ID NO: 2900654 - RNA, 20 nt, Mycobacterium avium subsp. paratuberculosis
gaccguccgguucggcggca

SEQ ID NO: 2900655 - RNA, 14 nt, Mycobacterium avium subsp. paratuberculosis
gaccgucgaccaac

SEQ ID NO: 2900656 - RNA, 14 nt, Mycobacterium avium subsp. paratuberculosis
gaccgucgccgacc

SEQ ID NO: 2900657 - RNA, 17 nt, Mycobacterium avium subsp. paratuberculosis
gaccgucgccgaccagc

SEQ ID NO: 2900658 - RNA, 18 nt, Mycobacterium avium subsp. paratuberculosis
gaccgucgccgaccagcc

SEQ ID NO: 2900659 - RNA, 20 nt, Mycobacterium avium subsp. paratuberculosis
gaccgucgccgaccagccga

SEQ ID NO: 2900660 - RNA, 22 nt, Mycobacterium avium subsp. paratuberculosis
gaccgucgcgcagcccgaucgc

SEQ ID NO: 2900661 - RNA, 18 nt, Mycobacterium avium subsp. paratuberculosis
gaccgucgggacggccag

SEQ ID NO: 2900662 - RNA, 19 nt, Mycobacterium avium subsp. paratuberculosis
gaccgucgggacggccagc

SEQ ID NO: 2900663 - RNA, 17 nt, Mycobacterium avium subsp. paratuberculosis
gaccgugaggcccggcg

SEQ ID NO: 2900664 - RNA, 17 nt, Mycobacterium avium subsp. paratuberculosis
gaccgugcccaccagcc

SEQ ID NO: 2900665 - RNA, 18 nt, Mycobacterium avium subsp. paratuberculosis
gaccgugcccaccagccg

SEQ ID NO: 2900666 - RNA, 19 nt, Mycobacterium avium subsp. paratuberculosis
gaccgugcccaccagccgg

SEQ ID NO: 2900667 - RNA, 21 nt, Mycobacterium avium subsp. paratuberculosis
gaccgugcccaccagccggcc

SEQ ID NO: 2900668 - RNA, 17 nt, Mycobacterium avium subsp. paratuberculosis
gaccguggugucggaga

SEQ ID NO: 2900669 - RNA, 16 nt, Mycobacterium avium subsp. paratuberculosis
gaccgugugccagccc

SEQ ID NO: 2900670 - RNA, 17 nt, Mycobacterium avium subsp. paratuberculosis
gaccgugugccagcccg

SEQ ID NO: 2900671 - RNA, 16 nt, Mycobacterium avium subsp. paratuberculosis
gaccguucuccgaggc

SEQ ID NO: 2900672 - RNA, 17 nt, Mycobacterium avium subsp. paratuberculosis
gaccguugaccgacgcc

SEQ ID NO: 2900673 - RNA, 22 nt, Mycobacterium avium subsp. paratuberculosis
gaccucaccccgcuugcgcagc

SEQ ID NO: 2900674 - RNA, 17 nt, Mycobacterium avium subsp. paratuberculosis
gaccuccaaugcgcccu

SEQ ID NO: 2900675 - RNA, 20 nt, Mycobacterium avium subsp. paratuberculosis
gaccuccacccgcuccucgc

SEQ ID NO: 2900676 - RNA, 20 nt, Mycobacterium avium subsp. paratuberculosis
gaccuccacgagccggucgg

SEQ ID NO: 2900677 - RNA, 16 nt, Mycobacterium avium subsp. paratuberculosis
gaccucccccgacgcc

SEQ ID NO: 2900678 - RNA, 20 nt, Mycobacterium avium subsp. paratuberculosis
gaccucccccgacgccgaca

SEQ ID NO: 2900679 - RNA, 15 nt, Mycobacterium avium subsp. paratuberculosis
gaccucccggcgcca

SEQ ID NO: 2900680 - RNA, 18 nt, Mycobacterium avium subsp. paratuberculosis
gaccucccggcgccacgc

SEQ ID NO: 2900681 - RNA, 23 nt, Mycobacterium avium subsp. paratuberculosis
gaccuccgugccgauggccaccg

SEQ ID NO: 2900682 - RNA, 15 nt, Mycobacterium avium subsp. paratuberculosis
gaccuccucgacccc

SEQ ID NO: 2900683 - RNA, 21 nt, Mycobacterium avium subsp. paratuberculosis
gaccuccucgaccccgaaggc

SEQ ID NO: 2900684 - RNA, 19 nt, Mycobacterium avium subsp. paratuberculosis
gaccuccuugcccagcgcg

SEQ ID NO: 2900685 - RNA, 19 nt, Mycobacterium avium subsp. paratuberculosis
gaccucgacacgggccgcg

SEQ ID NO: 2900686 - RNA, 21 nt, Mycobacterium avium subsp. paratuberculosis
gaccucgacacgggccgcgcc

SEQ ID NO: 2900687 - RNA, 16 nt, Mycobacterium avium subsp. paratuberculosis
gaccucgaccagccgg

SEQ ID NO: 2900688 - RNA, 17 nt, Mycobacterium avium subsp. paratuberculosis
gaccucgaccagccggu

SEQ ID NO: 2900689 - RNA, 15 nt, Mycobacterium avium subsp. paratuberculosis
gaccucgagcagcgc

SEQ ID NO: 2900690 - RNA, 16 nt, Mycobacterium avium subsp. paratuberculosis
gaccucgagcagcgcg

SEQ ID NO: 2900691 - RNA, 17 nt, Mycobacterium avium subsp. paratuberculosis
gaccucgagcagcgcgc

SEQ ID NO: 2900692 - RNA, 18 nt, Mycobacterium avium subsp. paratuberculosis
gaccucgagcagcgcgcg

SEQ ID NO: 2900693 - RNA, 19 nt, Mycobacterium avium subsp. paratuberculosis
gaccucgagcagcgcgcgc

SEQ ID NO: 2900694 - RNA, 19 nt, Mycobacterium avium subsp. paratuberculosis
gaccucgaggccgaggucg

SEQ ID NO: 2900695 - RNA, 20 nt, Mycobacterium avium subsp. paratuberculosis
gaccucgaugcgcagggcgg

SEQ ID NO: 2900696 - RNA, 17 nt, Mycobacterium avium subsp. paratuberculosis
gaccucgauggcgacgc

SEQ ID NO: 2900697 - RNA, 18 nt, Mycobacterium avium subsp. paratuberculosis
gaccucgauggcgacgca

SEQ ID NO: 2900698 - RNA, 16 nt, Mycobacterium avium subsp. paratuberculosis
gaccucgcccgccgcg

SEQ ID NO: 2900699 - RNA, 17 nt, Mycobacterium avium subsp. paratuberculosis
gaccucgcccgccgcga

SEQ ID NO: 2900700 - RNA, 13 nt, Mycobacterium avium subsp. paratuberculosis
gaccucgccgacg

SEQ ID NO: 2900701 - RNA, 15 nt, Mycobacterium avium subsp. paratuberculosis
gaccucgccgacggu

SEQ ID NO: 2900702 - RNA, 14 nt, Mycobacterium avium subsp. paratuberculosis
gaccucgccgacgu

SEQ ID NO: 2900703 - RNA, 16 nt, Mycobacterium avium subsp. paratuberculosis
gaccucgccgacgucc

SEQ ID NO: 2900704 - RNA, 16 nt, Mycobacterium avium subsp. paratuberculosis
gaccucgccgagcagc

SEQ ID NO: 2900705 - RNA, 22 nt, Mycobacterium avium subsp. paratuberculosis
gaccucgccgagcagccggucc

SEQ ID NO: 2900706 - RNA, 18 nt, Mycobacterium avium subsp. paratuberculosis
gaccucgccgcccucgcc

SEQ ID NO: 2900707 - RNA, 14 nt, Mycobacterium avium subsp. paratuberculosis
gaccucgcgcaccg

SEQ ID NO: 2900708 - RNA, 15 nt, Mycobacterium avium subsp. paratuberculosis
gaccucgcgcaccgg

SEQ ID NO: 2900709 - RNA, 16 nt, Mycobacterium avium subsp. paratuberculosis
gaccucgcgcaccggc

SEQ ID NO: 2900710 - RNA, 21 nt, Mycobacterium avium subsp. paratuberculosis
gaccucgcgcaccggcugccc

SEQ ID NO: 2900711 - RNA, 14 nt, Mycobacterium avium subsp. paratuberculosis
gaccucgcgcagcc

SEQ ID NO: 2900712 - RNA, 15 nt, Mycobacterium avium subsp. paratuberculosis
gaccucgcgcccggc

SEQ ID NO: 2900713 - RNA, 18 nt, Mycobacterium avium subsp. paratuberculosis
gaccucgcgcccggcgcc

SEQ ID NO: 2900714 - RNA, 22 nt, Mycobacterium avium subsp. paratuberculosis
gaccucgcgcccggcgccggcc

SEQ ID NO: 2900715 - RNA, 15 nt, Mycobacterium avium subsp. paratuberculosis
gaccucgcgccgcga

SEQ ID NO: 2900716 - RNA, 19 nt, Mycobacterium avium subsp. paratuberculosis
gaccucgcgccgcgaucuc

SEQ ID NO: 2900717 - RNA, 15 nt, Mycobacterium avium subsp. paratuberculosis
gaccucgcgcgucac

SEQ ID NO: 2900718 - RNA, 15 nt, Mycobacterium avium subsp. paratuberculosis
gaccucggccaccac

SEQ ID NO: 2900719 - RNA, 17 nt, Mycobacterium avium subsp. paratuberculosis
gaccucggccaccaccu

SEQ ID NO: 2900720 - RNA, 14 nt, Mycobacterium avium subsp. paratuberculosis
gaccucggccagcg

SEQ ID NO: 2900721 - RNA, 16 nt, Mycobacterium avium subsp. paratuberculosis
gaccucggccagcgug

SEQ ID NO: 2900722 - RNA, 16 nt, Mycobacterium avium subsp. paratuberculosis
gaccucggcgaccagc

SEQ ID NO: 2900723 - RNA, 17 nt, Mycobacterium avium subsp. paratuberculosis
gaccucggcgaccagcg

SEQ ID NO: 2900724 - RNA, 22 nt, Mycobacterium avium subsp. paratuberculosis
gaccucggcgaccagcgacggc

SEQ ID NO: 2900725 - RNA, 23 nt, Mycobacterium avium subsp. paratuberculosis
gaccucggcgaccagcgacggca

SEQ ID NO: 2900726 - RNA, 16 nt, Mycobacterium avium subsp. paratuberculosis
gaccucggcggccagc

SEQ ID NO: 2900727 - RNA, 17 nt, Mycobacterium avium subsp. paratuberculosis
gaccucggcggccagcg

SEQ ID NO: 2900728 - RNA, 19 nt, Mycobacterium avium subsp. paratuberculosis
gaccucggcggccagcgcg

SEQ ID NO: 2900729 - RNA, 16 nt, Mycobacterium avium subsp. paratuberculosis
gaccucggggaugucg

SEQ ID NO: 2900730 - RNA, 17 nt, Mycobacterium avium subsp. paratuberculosis
gaccucggggaugucga

SEQ ID NO: 2900731 - RNA, 16 nt, Mycobacterium avium subsp. paratuberculosis
gaccucggggucggcc

SEQ ID NO: 2900732 - RNA, 19 nt, Mycobacterium avium subsp. paratuberculosis
gaccucggggucggccgga

SEQ ID NO: 2900733 - RNA, 13 nt, Mycobacterium avium subsp. paratuberculosis
gaccucggugaug

SEQ ID NO: 2900734 - RNA, 17 nt, Mycobacterium avium subsp. paratuberculosis
gaccucgucgggcgcca

SEQ ID NO: 2900735 - RNA, 19 nt, Mycobacterium avium subsp. paratuberculosis
gaccucgucgggcgccagc

SEQ ID NO: 2900736 - RNA, 22 nt, Mycobacterium avium subsp. paratuberculosis
gaccucgucgggcgccagcccg

SEQ ID NO: 2900737 - RNA, 17 nt, Mycobacterium avium subsp. paratuberculosis
gaccucuucgacccgca

SEQ ID NO: 2900738 - RNA, 18 nt, Mycobacterium avium subsp. paratuberculosis
gaccucuucgcuggacag

SEQ ID NO: 2900739 - RNA, 19 nt, Mycobacterium avium subsp. paratuberculosis
gaccucuucgcuggacagc

SEQ ID NO: 2900740 - RNA, 18 nt, Mycobacterium avium subsp. paratuberculosis
gaccucuucggcgccggc

SEQ ID NO: 2900741 - RNA, 14 nt, Mycobacterium avium subsp. paratuberculosis
gaccugcagcgccu

SEQ ID NO: 2900742 - RNA, 14 nt, Mycobacterium avium subsp. paratuberculosis
gaccugcaucucga

SEQ ID NO: 2900743 - RNA, 23 nt, Mycobacterium avium subsp. paratuberculosis
gaccugcaucucgacccgggcca

SEQ ID NO: 2900744 - RNA, 18 nt, Mycobacterium avium subsp. paratuberculosis
gaccugccggcgaucacc

SEQ ID NO: 2900745 - RNA, 15 nt, Mycobacterium avium subsp. paratuberculosis
gaccugcgcgacggc

SEQ ID NO: 2900746 - RNA, 17 nt, Mycobacterium avium subsp. paratuberculosis
gaccugcggaucgcggg

SEQ ID NO: 2900747 - RNA, 17 nt, Mycobacterium avium subsp. paratuberculosis
gaccugcggcucgucgg

SEQ ID NO: 2900748 - RNA, 18 nt, Mycobacterium avium subsp. paratuberculosis
gaccugcgggcccaccgc

SEQ ID NO: 2900749 - RNA, 19 nt, Mycobacterium avium subsp. paratuberculosis
gaccugcgggcccaccgcg

SEQ ID NO: 2900750 - RNA, 13 nt, Mycobacterium avium subsp. paratuberculosis
gaccugcgggugc

SEQ ID NO: 2900751 - RNA, 14 nt, Mycobacterium avium subsp. paratuberculosis
gaccugcucgucgg

SEQ ID NO: 2900752 - RNA, 21 nt, Mycobacterium avium subsp. paratuberculosis
gaccugcucgucggugacggu

SEQ ID NO: 2900753 - RNA, 23 nt, Mycobacterium avium subsp. paratuberculosis
gaccugcugggcgggcagccgcu

SEQ ID NO: 2900754 - RNA, 16 nt, Mycobacterium avium subsp. paratuberculosis
gaccugcuugagcccg

SEQ ID NO: 2900755 - RNA, 21 nt, Mycobacterium avium subsp. paratuberculosis
gaccugcuugagcccgucgac

SEQ ID NO: 2900756 - RNA, 17 nt, Mycobacterium avium subsp. paratuberculosis
gaccugcuuggcggccu

SEQ ID NO: 2900757 - RNA, 24 nt, Mycobacterium avium subsp. paratuberculosis
gaccugcuuggcggccugcgccag

SEQ ID NO: 2900758 - RNA, 19 nt, Mycobacterium avium subsp. paratuberculosis
gaccuggaugcgccgugcc

SEQ ID NO: 2900759 - RNA, 14 nt, Mycobacterium avium subsp. paratuberculosis
gaccuggcgggcca

SEQ ID NO: 2900760 - RNA, 16 nt, Mycobacterium avium subsp. paratuberculosis
gaccuggcgggccagc

SEQ ID NO: 2900761 - RNA, 23 nt, Mycobacterium avium subsp. paratuberculosis
gaccuggcugacggcgucguuga

SEQ ID NO: 2900762 - RNA, 13 nt, Mycobacterium avium subsp. paratuberculosis
gaccugggcggcc

SEQ ID NO: 2900763 - RNA, 16 nt, Mycobacterium avium subsp. paratuberculosis
gaccugggucaucacc

SEQ ID NO: 2900764 - RNA, 19 nt, Mycobacterium avium subsp. paratuberculosis
gaccugggucaucaccuug

SEQ ID NO: 2900765 - RNA, 15 nt, Mycobacterium avium subsp. paratuberculosis
gaccugguccaccgc

SEQ ID NO: 2900766 - RNA, 16 nt, Mycobacterium avium subsp. paratuberculosis
gaccugguccaccgcg

SEQ ID NO: 2900767 - RNA, 17 nt, Mycobacterium avium subsp. paratuberculosis
gaccugguccaccgcgg

SEQ ID NO: 2900768 - RNA, 21 nt, Mycobacterium avium subsp. paratuberculosis
gaccugguccaccgcggcggc

SEQ ID NO: 2900769 - RNA, 14 nt, Mycobacterium avium subsp. paratuberculosis
gaccuggucgccga

SEQ ID NO: 2900770 - RNA, 16 nt, Mycobacterium avium subsp. paratuberculosis
gaccuggucgccgccg

SEQ ID NO: 2900771 - RNA, 14 nt, Mycobacterium avium subsp. paratuberculosis
gaccuggugcucga

SEQ ID NO: 2900772 - RNA, 16 nt, Mycobacterium avium subsp. paratuberculosis
gaccuguccgaucacc

SEQ ID NO: 2900773 - RNA, 20 nt, Mycobacterium avium subsp. paratuberculosis
gaccuguuugaacaccucga

SEQ ID NO: 2900774 - RNA, 22 nt, Mycobacterium avium subsp. paratuberculosis
gaccuguuugaacaccucgaag

SEQ ID NO: 2900775 - RNA, 15 nt, Mycobacterium avium subsp. paratuberculosis
gaccuguuuggccag

SEQ ID NO: 2900776 - RNA, 19 nt, Mycobacterium avium subsp. paratuberculosis
gaccuguuuggccagccag

SEQ ID NO: 2900777 - RNA, 23 nt, Mycobacterium avium subsp. paratuberculosis
gaccuguuuggccagccaguugg

SEQ ID NO: 2900778 - RNA, 22 nt, Mycobacterium avium subsp. paratuberculosis
gaccuucgagccgccgccggcg

SEQ ID NO: 2900779 - RNA, 15 nt, Mycobacterium avium subsp. paratuberculosis
gaccuucucccgcgg

SEQ ID NO: 2900780 - RNA, 17 nt, Mycobacterium avium subsp. paratuberculosis
gaccuucucgaccaggc

SEQ ID NO: 2900781 - RNA, 18 nt, Mycobacterium avium subsp. paratuberculosis
gaccuucucgaccaggcu

SEQ ID NO: 2900782 - RNA, 16 nt, Mycobacterium avium subsp. paratuberculosis
gaccuucugcugcacg

SEQ ID NO: 2900783 - RNA, 17 nt, Mycobacterium avium subsp. paratuberculosis
gaccuucuuggucagcg

SEQ ID NO: 2900784 - RNA, 19 nt, Mycobacterium avium subsp. paratuberculosis
gaccuucuuggucagcggc

SEQ ID NO: 2900785 - RNA, 13 nt, Mycobacterium avium subsp. paratuberculosis
gaccuugaccagc

SEQ ID NO: 2900786 - RNA, 14 nt, Mycobacterium avium subsp. paratuberculosis
gaccuugcagcccg

SEQ ID NO: 2900787 - RNA, 14 nt, Mycobacterium avium subsp. paratuberculosis
gaccuugcgcagcc

SEQ ID NO: 2900788 - RNA, 19 nt, Mycobacterium avium subsp. paratuberculosis
gaccuugcgcagccggcag

SEQ ID NO: 2900789 - RNA, 15 nt, Mycobacterium avium subsp. paratuberculosis
gaccuugcgggcggu

SEQ ID NO: 2900790 - RNA, 16 nt, Mycobacterium avium subsp. paratuberculosis
gaccuugcgggcgguc

SEQ ID NO: 2900791 - RNA, 20 nt, Mycobacterium avium subsp. paratuberculosis
gaccuugcgggcggucagca

SEQ ID NO: 2900792 - RNA, 17 nt, Mycobacterium avium subsp. paratuberculosis
gaccuugggcauccgcu

SEQ ID NO: 2900793 - RNA, 22 nt, Mycobacterium avium subsp. paratuberculosis
gaccuugggcauccgcucgccg

SEQ ID NO: 2900794 - RNA, 12 nt, Mycobacterium avium subsp. paratuberculosis
gaccuuguccgg

SEQ ID NO: 2900795 - RNA, 14 nt, Mycobacterium avium subsp. paratuberculosis
gaccuuguccggcg

SEQ ID NO: 2900796 - RNA, 17 nt, Mycobacterium avium subsp. paratuberculosis
gaccuugucgcgcaccc

SEQ ID NO: 2900797 - RNA, 22 nt, Mycobacterium avium subsp. paratuberculosis
gaccuugucgcgcacccgcacg

SEQ ID NO: 2900798 - RNA, 16 nt, Mycobacterium avium subsp. paratuberculosis
gacgaaacccggcgga

SEQ ID NO: 2900799 - RNA, 13 nt, Mycobacterium avium subsp. paratuberculosis
gacgaaaccgcca

SEQ ID NO: 2900800 - RNA, 17 nt, Mycobacterium avium subsp. paratuberculosis
gacgaacaagggcgggu

SEQ ID NO: 2900801 - RNA, 12 nt, Mycobacterium avium subsp. paratuberculosis
gacgaacagcac

SEQ ID NO: 2900802 - RNA, 14 nt, Mycobacterium avium subsp. paratuberculosis
gacgaacagcaccg

SEQ ID NO: 2900803 - RNA, 15 nt, Mycobacterium avium subsp. paratuberculosis
gacgaacagcaccgc

SEQ ID NO: 2900804 - RNA, 18 nt, Mycobacterium avium subsp. paratuberculosis
gacgaacagcaccgccac

SEQ ID NO: 2900805 - RNA, 22 nt, Mycobacterium avium subsp. paratuberculosis
gacgaacagcaccgccacggcg

SEQ ID NO: 2900806 - RNA, 16 nt, Mycobacterium avium subsp. paratuberculosis
gacgaacaucgacgac

SEQ ID NO: 2900807 - RNA, 19 nt, Mycobacterium avium subsp. paratuberculosis
gacgaacaugcugccgccg

SEQ ID NO: 2900808 - RNA, 20 nt, Mycobacterium avium subsp. paratuberculosis
gacgaacaugcugccgccgg

SEQ ID NO: 2900809 - RNA, 21 nt, Mycobacterium avium subsp. paratuberculosis
gacgaacaugcugccgccggc

SEQ ID NO: 2900810 - RNA, 22 nt, Mycobacterium avium subsp. paratuberculosis
gacgaacaugcugccgccggcg

SEQ ID NO: 2900811 - RNA, 20 nt, Mycobacterium avium subsp. paratuberculosis
gacgaaccgugcacgaucgc

SEQ ID NO: 2900812 - RNA, 23 nt, Mycobacterium avium subsp. paratuberculosis
gacgaacgacguguucaacgcgc

SEQ ID NO: 2900813 - RNA, 13 nt, Mycobacterium avium subsp. paratuberculosis
gacgaacgccggc

SEQ ID NO: 2900814 - RNA, 18 nt, Mycobacterium avium subsp. paratuberculosis
gacgaacgcgccgcccac

SEQ ID NO: 2900815 - RNA, 14 nt, Mycobacterium avium subsp. paratuberculosis
gacgaacgcggccg

SEQ ID NO: 2900816 - RNA, 19 nt, Mycobacterium avium subsp. paratuberculosis
gacgaacgcggccgccagc

SEQ ID NO: 2900817 - RNA, 22 nt, Mycobacterium avium subsp. paratuberculosis
gacgaacgcggccgccagcgca

SEQ ID NO: 2900818 - RNA, 16 nt, Mycobacterium avium subsp. paratuberculosis
gacgacggcgccgcgu

SEQ ID NO: 2900819 - RNA, 18 nt, Mycobacterium avium subsp. paratuberculosis
gacgacggcgccgcgucg

SEQ ID NO: 2900820 - RNA, 19 nt, Mycobacterium avium subsp. paratuberculosis
gacgacggcgccgcgucgg

SEQ ID NO: 2900821 - RNA, 14 nt, Mycobacterium avium subsp. paratuberculosis
gacgacggcgggga

SEQ ID NO: 2900822 - RNA, 23 nt, Mycobacterium avium subsp. paratuberculosis
gacgacggcuccuaugucggugc

SEQ ID NO: 2900823 - RNA, 20 nt, Mycobacterium avium subsp. paratuberculosis
gacgacgggcagggugaccg

SEQ ID NO: 2900824 - RNA, 17 nt, Mycobacterium avium subsp. paratuberculosis
gacgacggucaccggca

SEQ ID NO: 2900825 - RNA, 19 nt, Mycobacterium avium subsp. paratuberculosis
gacgacggucuucccgccg

SEQ ID NO: 2900826 - RNA, 21 nt, Mycobacterium avium subsp. paratuberculosis
gacgacggucuucccgccgcc

SEQ ID NO: 2900827 - RNA, 16 nt, Mycobacterium avium subsp. paratuberculosis
gacgacgucgaccgcg

SEQ ID NO: 2900828 - RNA, 17 nt, Mycobacterium avium subsp. paratuberculosis
gacgacgucgaccgcgc

SEQ ID NO: 2900829 - RNA, 20 nt, Mycobacterium avium subsp. paratuberculosis
gacgacgucgaccgcgccgg

SEQ ID NO: 2900830 - RNA, 17 nt, Mycobacterium avium subsp. paratuberculosis
gacgacgucgacgaccc

SEQ ID NO: 2900831 - RNA, 20 nt, Mycobacterium avium subsp. paratuberculosis
gacgacgucgaugugcucgg

SEQ ID NO: 2900832 - RNA, 16 nt, Mycobacterium avium subsp. paratuberculosis
gacgacgugacgaccu

SEQ ID NO: 2900833 - RNA, 23 nt, Mycobacterium avium subsp. paratuberculosis
gacgacgugauaguggucgucgu

SEQ ID NO: 2900834 - RNA, 14 nt, Mycobacterium avium subsp. paratuberculosis
gacgacguggugga

SEQ ID NO: 2900835 - RNA, 20 nt, Mycobacterium avium subsp. paratuberculosis
gacgacgugguggaugaugc

SEQ ID NO: 2900836 - RNA, 17 nt, Mycobacterium avium subsp. paratuberculosis
gacgacguugcgggcca

SEQ ID NO: 2900837 - RNA, 20 nt, Mycobacterium avium subsp. paratuberculosis
gacgacguugcgggccaggu

SEQ ID NO: 2900838 - RNA, 16 nt, Mycobacterium avium subsp. paratuberculosis
gacgacguuggccagc

SEQ ID NO: 2900839 - RNA, 20 nt, Mycobacterium avium subsp. paratuberculosis
gacgacguuggccagcaccg

SEQ ID NO: 2900840 - RNA, 22 nt, Mycobacterium avium subsp. paratuberculosis
gacgacguuggccagcaccgcg

SEQ ID NO: 2900841 - RNA, 23 nt, Mycobacterium avium subsp. paratuberculosis
gacgacguuggccagcaccgcgg

SEQ ID NO: 2900842 - RNA, 19 nt, Mycobacterium avium subsp. paratuberculosis
gacgacucguucgacgccg

SEQ ID NO: 2900843 - RNA, 13 nt, Mycobacterium avium subsp. paratuberculosis
gacgacucuucca

SEQ ID NO: 2900844 - RNA, 14 nt, Mycobacterium avium subsp. paratuberculosis
gacgacucuuccag

SEQ ID NO: 2900845 - RNA, 20 nt, Mycobacterium avium subsp. paratuberculosis
gacgacugggugcgcgggcg

SEQ ID NO: 2900846 - RNA, 14 nt, Mycobacterium avium subsp. paratuberculosis
gacgacuucggccu

SEQ ID NO: 2900847 - RNA, 21 nt, Mycobacterium avium subsp. paratuberculosis
gacgagagcggaucggcggcg

SEQ ID NO: 2900848 - RNA, 16 nt, Mycobacterium avium subsp. paratuberculosis
gacgagaucagcacca

SEQ ID NO: 2900849 - RNA, 22 nt, Mycobacterium avium subsp. paratuberculosis
gacgagaucgguuggcucgcag

SEQ ID NO: 2900850 - RNA, 23 nt, Mycobacterium avium subsp. paratuberculosis
gacgagaucgguuggcucgcaga

SEQ ID NO: 2900851 - RNA, 14 nt, Mycobacterium avium subsp. paratuberculosis
gacgagcaggcuga

SEQ ID NO: 2900852 - RNA, 13 nt, Mycobacterium avium subsp. paratuberculosis
gacgagcccgcgc

SEQ ID NO: 2900853 - RNA, 16 nt, Mycobacterium avium subsp. paratuberculosis
gacgagcccgcgccca

SEQ ID NO: 2900854 - RNA, 14 nt, Mycobacterium avium subsp. paratuberculosis
gacgagccgacgua

SEQ ID NO: 2900855 - RNA, 14 nt, Mycobacterium avium subsp. paratuberculosis
gacgagccgccgcg

SEQ ID NO: 2900856 - RNA, 15 nt, Mycobacterium avium subsp. paratuberculosis
gacgagccgccgcgg

SEQ ID NO: 2900857 - RNA, 22 nt, Mycobacterium avium subsp. paratuberculosis
gacgagccgccgcgggucggcg

SEQ ID NO: 2900858 - RNA, 19 nt, Mycobacterium avium subsp. paratuberculosis
gacgagccgucgaagauga

SEQ ID NO: 2900859 - RNA, 15 nt, Mycobacterium avium subsp. paratuberculosis
gacgagcucgccgcu

SEQ ID NO: 2900860 - RNA, 18 nt, Mycobacterium avium subsp. paratuberculosis
gacgagcucgccgcuguc

SEQ ID NO: 2900861 - RNA, 13 nt, Mycobacterium avium subsp. paratuberculosis
gacgaggagaccu

SEQ ID NO: 2900862 - RNA, 13 nt, Mycobacterium avium subsp. paratuberculosis
gacgaggcgggcg

SEQ ID NO: 2900863 - RNA, 17 nt, Mycobacterium avium subsp. paratuberculosis
gacgaggggcagcagcg

SEQ ID NO: 2900864 - RNA, 20 nt, Mycobacterium avium subsp. paratuberculosis
gacgaggggcagcagcgccc

SEQ ID NO: 2900865 - RNA, 21 nt, Mycobacterium avium subsp. paratuberculosis
gacgaggugaugccguccagc

SEQ ID NO: 2900866 - RNA, 22 nt, Mycobacterium avium subsp. paratuberculosis
gacgaggugaugccguccagca

SEQ ID NO: 2900867 - RNA, 20 nt, Mycobacterium avium subsp. paratuberculosis
gacgagguugucccgggcga

SEQ ID NO: 2900868 - RNA, 18 nt, Mycobacterium avium subsp. paratuberculosis
gacgagucccaugggcug

SEQ ID NO: 2900869 - RNA, 13 nt, Mycobacterium avium subsp. paratuberculosis
gacgagucgccgu

SEQ ID NO: 2900870 - RNA, 21 nt, Mycobacterium avium subsp. paratuberculosis
gacgagucgccguuggucugc

SEQ ID NO: 2900871 - RNA, 16 nt, Mycobacterium avium subsp. paratuberculosis
gacgaguggucggccg

SEQ ID NO: 2900872 - RNA, 22 nt, Mycobacterium avium subsp. paratuberculosis
gacgaguggucggccgcccacg

SEQ ID NO: 2900873 - RNA, 16 nt, Mycobacterium avium subsp. paratuberculosis
gacgaguuccaccucg

SEQ ID NO: 2900874 - RNA, 16 nt, Mycobacterium avium subsp. paratuberculosis
gacgauacgugcuccc

SEQ ID NO: 2900875 - RNA, 16 nt, Mycobacterium avium subsp. paratuberculosis
gacgauaucggccgcg

SEQ ID NO: 2900876 - RNA, 12 nt, Mycobacterium avium subsp. paratuberculosis
gacgaucaccgc

SEQ ID NO: 2900877 - RNA, 15 nt, Mycobacterium avium subsp. paratuberculosis
gacgaucaccggcuu

SEQ ID NO: 2900878 - RNA, 15 nt, Mycobacterium avium subsp. paratuberculosis
gacgaucacgacgcg

SEQ ID NO: 2900879 - RNA, 14 nt, Mycobacterium avium subsp. paratuberculosis
gacgaucagcacgu

SEQ ID NO: 2900880 - RNA, 20 nt, Mycobacterium avium subsp. paratuberculosis
gacgaucagcacgucgcggc

SEQ ID NO: 2900881 - RNA, 15 nt, Mycobacterium avium subsp. paratuberculosis
gacgaucagcagccg

SEQ ID NO: 2900882 - RNA, 23 nt, Mycobacterium avium subsp. paratuberculosis
gacgaucagcagccgggccugcg

SEQ ID NO: 2900883 - RNA, 16 nt, Mycobacterium avium subsp. paratuberculosis
gacgauccacagcgcg

SEQ ID NO: 2900884 - RNA, 17 nt, Mycobacterium avium subsp. paratuberculosis
gacgauccacagcgcga

SEQ ID NO: 2900885 - RNA, 14 nt, Mycobacterium avium subsp. paratuberculosis
gacgaucccggcga

SEQ ID NO: 2900886 - RNA, 15 nt, Mycobacterium avium subsp. paratuberculosis
gacgauccgcgccgc

SEQ ID NO: 2900887 - RNA, 17 nt, Mycobacterium avium subsp. paratuberculosis
gacgauccgcgccgcga

SEQ ID NO: 2900888 - RNA, 20 nt, Mycobacterium avium subsp. paratuberculosis
gacgauccgggccggucggu

SEQ ID NO: 2900889 - RNA, 15 nt, Mycobacterium avium subsp. paratuberculosis
gacgauccgggcgcc

SEQ ID NO: 2900890 - RNA, 14 nt, Mycobacterium avium subsp. paratuberculosis
gacgauccggucga

SEQ ID NO: 2900891 - RNA, 12 nt, Mycobacterium avium subsp. paratuberculosis
gacgaucgcgac

SEQ ID NO: 2900892 - RNA, 19 nt, Mycobacterium avium subsp. paratuberculosis
gacgaucgcgccggccgcc

SEQ ID NO: 2900893 - RNA, 12 nt, Mycobacterium avium subsp. paratuberculosis
gacgaucgucga

SEQ ID NO: 2900894 - RNA, 14 nt, Mycobacterium avium subsp. paratuberculosis
gacgaucgucgacg

SEQ ID NO: 2900895 - RNA, 15 nt, Mycobacterium avium subsp. paratuberculosis
gacgaucgucgacgu

SEQ ID NO: 2900896 - RNA, 14 nt, Mycobacterium avium subsp. paratuberculosis
gacgaucucgccgu

SEQ ID NO: 2900897 - RNA, 17 nt, Mycobacterium avium subsp. paratuberculosis
gacgaucucgccguccu

SEQ ID NO: 2900898 - RNA, 15 nt, Mycobacterium avium subsp. paratuberculosis
gacgaucugcacacg

SEQ ID NO: 2900899 - RNA, 19 nt, Mycobacterium avium subsp. paratuberculosis
gacgaucuggcgcaucagc

SEQ ID NO: 2900900 - RNA, 23 nt, Mycobacterium avium subsp. paratuberculosis
gacgaugaaauccgggaccggcg

SEQ ID NO: 2900901 - RNA, 21 nt, Mycobacterium avium subsp. paratuberculosis
gacgaugaacagucggccggc

SEQ ID NO: 2900902 - RNA, 22 nt, Mycobacterium avium subsp. paratuberculosis
gacgaugaacagucggccggcg

SEQ ID NO: 2900903 - RNA, 19 nt, Mycobacterium avium subsp. paratuberculosis
cgugcagccgaagaacugg

SEQ ID NO: 2900904 - RNA, 13 nt, Mycobacterium avium subsp. paratuberculosis
cgugcagccgcaa

SEQ ID NO: 2900905 - RNA, 15 nt, Mycobacterium avium subsp. paratuberculosis
cgugcagccggcggc

SEQ ID NO: 2900906 - RNA, 17 nt, Mycobacterium avium subsp. paratuberculosis
cgugcagccggcggcgc

SEQ ID NO: 2900907 - RNA, 16 nt, Mycobacterium avium subsp. paratuberculosis
cgugcagccgggccug

SEQ ID NO: 2900908 - RNA, 22 nt, Mycobacterium avium subsp. paratuberculosis
cgugcagccgggccugcagcaa

SEQ ID NO: 2900909 - RNA, 15 nt, Mycobacterium avium subsp. paratuberculosis
cgugcagcgccagca

SEQ ID NO: 2900910 - RNA, 17 nt, Mycobacterium avium subsp. paratuberculosis
cgugcagcgccagcacc

SEQ ID NO: 2900911 - RNA, 15 nt, Mycobacterium avium subsp. paratuberculosis
cgugcagcgcccagc

SEQ ID NO: 2900912 - RNA, 14 nt, Mycobacterium avium subsp. paratuberculosis
cgugcagcgcggcg

SEQ ID NO: 2900913 - RNA, 15 nt, Mycobacterium avium subsp. paratuberculosis
cgugcagcgcggcga

SEQ ID NO: 2900914 - RNA, 18 nt, Mycobacterium avium subsp. paratuberculosis
cgugcagcgcggcgauga

SEQ ID NO: 2900915 - RNA, 21 nt, Mycobacterium avium subsp. paratuberculosis
cgugcaggaucggcuugggga

SEQ ID NO: 2900916 - RNA, 23 nt, Mycobacterium avium subsp. paratuberculosis
cgugcaggaugaccgcgucggcg

SEQ ID NO: 2900917 - RNA, 19 nt, Mycobacterium avium subsp. paratuberculosis
cgugcagggggcgcagccg

SEQ ID NO: 2900918 - RNA, 20 nt, Mycobacterium avium subsp. paratuberculosis
cgugcagggggcgcagccga

SEQ ID NO: 2900919 - RNA, 23 nt, Mycobacterium avium subsp. paratuberculosis
cgugcaggugcggcaccuccagc

SEQ ID NO: 2900920 - RNA, 14 nt, Mycobacterium avium subsp. paratuberculosis
cgugcagucccaga

SEQ ID NO: 2900921 - RNA, 17 nt, Mycobacterium avium subsp. paratuberculosis
cgugcagugcgaucgcc

SEQ ID NO: 2900922 - RNA, 18 nt, Mycobacterium avium subsp. paratuberculosis
cgugcauagcuggcgccg

SEQ ID NO: 2900923 - RNA, 20 nt, Mycobacterium avium subsp. paratuberculosis
cgugcauagcuggcgccgaa

SEQ ID NO: 2900924 - RNA, 21 nt, Mycobacterium avium subsp. paratuberculosis
cgugcauagcuggcgccgaac

SEQ ID NO: 2900925 - RNA, 14 nt, Mycobacterium avium subsp. paratuberculosis
cgugcaucgggcgc

SEQ ID NO: 2900926 - RNA, 15 nt, Mycobacterium avium subsp. paratuberculosis
cgugcaucgggcgcu

SEQ ID NO: 2900927 - RNA, 18 nt, Mycobacterium avium subsp. paratuberculosis
cgugcaucgggcgcucgg

SEQ ID NO: 2900928 - RNA, 23 nt, Mycobacterium avium subsp. paratuberculosis
cgugcauguagguggcgaccacc

SEQ ID NO: 2900929 - RNA, 20 nt, Mycobacterium avium subsp. paratuberculosis
cgugcaugugcucggcgagg

SEQ ID NO: 2900930 - RNA, 19 nt, Mycobacterium avium subsp. paratuberculosis
cgugcauucaggucaccgc

SEQ ID NO: 2900931 - RNA, 24 nt, Mycobacterium avium subsp. paratuberculosis
cgugcauucaggucaccgcgcgaa

SEQ ID NO: 2900932 - RNA, 24 nt, Mycobacterium avium subsp. paratuberculosis
cgugccaagcguauccggccagcc

SEQ ID NO: 2900933 - RNA, 23 nt, Mycobacterium avium subsp. paratuberculosis
cgugccacagcaugaagaucagc

SEQ ID NO: 2900934 - RNA, 15 nt, Mycobacterium avium subsp. paratuberculosis
cgugccacaggccga

SEQ ID NO: 2900935 - RNA, 14 nt, Mycobacterium avium subsp. paratuberculosis
cgugccaccgcugg

SEQ ID NO: 2900936 - RNA, 15 nt, Mycobacterium avium subsp. paratuberculosis
cgugccaccgcuggg

SEQ ID NO: 2900937 - RNA, 21 nt, Mycobacterium avium subsp. paratuberculosis
cgugccaccgcugggcggcgc

SEQ ID NO: 2900938 - RNA, 15 nt, Mycobacterium avium subsp. paratuberculosis
cgugccacggccgcg

SEQ ID NO: 2900939 - RNA, 16 nt, Mycobacterium avium subsp. paratuberculosis
cgugccacggccgcgg

SEQ ID NO: 2900940 - RNA, 21 nt, Mycobacterium avium subsp. paratuberculosis
cgugccacggccgcggcccgg

SEQ ID NO: 2900941 - RNA, 17 nt, Mycobacterium avium subsp. paratuberculosis
cgugccacuggcgccac

SEQ ID NO: 2900942 - RNA, 19 nt, Mycobacterium avium subsp. paratuberculosis
cgugccagcagcucguggu

SEQ ID NO: 2900943 - RNA, 14 nt, Mycobacterium avium subsp. paratuberculosis
cgugccagccggcc

SEQ ID NO: 2900944 - RNA, 16 nt, Mycobacterium avium subsp. paratuberculosis
cgugccagccggccgc

SEQ ID NO: 2900945 - RNA, 14 nt, Mycobacterium avium subsp. paratuberculosis
cgugccagggcagc

SEQ ID NO: 2900946 - RNA, 16 nt, Mycobacterium avium subsp. paratuberculosis
cgugccaucgcuggug

SEQ ID NO: 2900947 - RNA, 16 nt, Mycobacterium avium subsp. paratuberculosis
cgugcccaacacgccc

SEQ ID NO: 2900948 - RNA, 20 nt, Mycobacterium avium subsp. paratuberculosis
cgugcccaacacgccccgac

SEQ ID NO: 2900949 - RNA, 22 nt, Mycobacterium avium subsp. paratuberculosis
cgugcccaacacgccccgacag

SEQ ID NO: 2900950 - RNA, 17 nt, Mycobacterium avium subsp. paratuberculosis
cgugcccaccagccggc

SEQ ID NO: 2900951 - RNA, 19 nt, Mycobacterium avium subsp. paratuberculosis
cgugcccaccagccggccg

SEQ ID NO: 2900952 - RNA, 21 nt, Mycobacterium avium subsp. paratuberculosis
cgugcccaccagccggccggc

SEQ ID NO: 2900953 - RNA, 16 nt, Mycobacterium avium subsp. paratuberculosis
cgugcccagcccgcgc

SEQ ID NO: 2900954 - RNA, 18 nt, Mycobacterium avium subsp. paratuberculosis
cgugcccagcccgcgcga

SEQ ID NO: 2900955 - RNA, 17 nt, Mycobacterium avium subsp. paratuberculosis
cgugccccaggucgggg

SEQ ID NO: 2900956 - RNA, 19 nt, Mycobacterium avium subsp. paratuberculosis
cgugccccaggucggggug

SEQ ID NO: 2900957 - RNA, 20 nt, Mycobacterium avium subsp. paratuberculosis
cgugccccucgacccgaagc

SEQ ID NO: 2900958 - RNA, 14 nt, Mycobacterium avium subsp. paratuberculosis
cgugcccgagccga

SEQ ID NO: 2900959 - RNA, 17 nt, Mycobacterium avium subsp. paratuberculosis
cgugcccgaucucgucg

SEQ ID NO: 2900960 - RNA, 18 nt, Mycobacterium avium subsp. paratuberculosis
cgugcccgaucucgucgg

SEQ ID NO: 2900961 - RNA, 12 nt, Mycobacterium avium subsp. paratuberculosis
cgugcccgccga

SEQ ID NO: 2900962 - RNA, 13 nt, Mycobacterium avium subsp. paratuberculosis
cgugcccgccgug

SEQ ID NO: 2900963 - RNA, 16 nt, Mycobacterium avium subsp. paratuberculosis
cgugcccgccgugcgc

SEQ ID NO: 2900964 - RNA, 18 nt, Mycobacterium avium subsp. paratuberculosis
cgugcccgccgugcgccc

SEQ ID NO: 2900965 - RNA, 21 nt, Mycobacterium avium subsp. paratuberculosis
cgugcccgccgugcgccccgc

SEQ ID NO: 2900966 - RNA, 15 nt, Mycobacterium avium subsp. paratuberculosis
cgugcccgcgcccac

SEQ ID NO: 2900967 - RNA, 21 nt, Mycobacterium avium subsp. paratuberculosis
cgugcccgcgcccaccuggag

SEQ ID NO: 2900968 - RNA, 20 nt, Mycobacterium avium subsp. paratuberculosis
cgugcccgcgggacacggcg

SEQ ID NO: 2900969 - RNA, 19 nt, Mycobacterium avium subsp. paratuberculosis
cgugcccggaucgccgaac

SEQ ID NO: 2900970 - RNA, 14 nt, Mycobacterium avium subsp. paratuberculosis
cgugcccggccagc

SEQ ID NO: 2900971 - RNA, 12 nt, Mycobacterium avium subsp. paratuberculosis
cgugcccggcgc

SEQ ID NO: 2900972 - RNA, 13 nt, Mycobacterium avium subsp. paratuberculosis
cgugcccggcgca

SEQ ID NO: 2900973 - RNA, 13 nt, Mycobacterium avium subsp. paratuberculosis
cgugcccggcgcc

SEQ ID NO: 2900974 - RNA, 14 nt, Mycobacterium avium subsp. paratuberculosis
cgugcccggcgccc

SEQ ID NO: 2900975 - RNA, 15 nt, Mycobacterium avium subsp. paratuberculosis
cgugcccggcgccga

SEQ ID NO: 2900976 - RNA, 12 nt, Mycobacterium avium subsp. paratuberculosis
cgugcccgggcc

SEQ ID NO: 2900977 - RNA, 14 nt, Mycobacterium avium subsp. paratuberculosis
cgugcccgggcccg

SEQ ID NO: 2900978 - RNA, 15 nt, Mycobacterium avium subsp. paratuberculosis
cgugcccuuccccgg

SEQ ID NO: 2900979 - RNA, 18 nt, Mycobacterium avium subsp. paratuberculosis
cgugcccuuccccggcgg

SEQ ID NO: 2900980 - RNA, 22 nt, Mycobacterium avium subsp. paratuberculosis
cgugcccuuccccggcggccgg

SEQ ID NO: 2900981 - RNA, 14 nt, Mycobacterium avium subsp. paratuberculosis
cgugccgaacggcg

SEQ ID NO: 2900982 - RNA, 16 nt, Mycobacterium avium subsp. paratuberculosis
cgugccgaacggcgcu

SEQ ID NO: 2900983 - RNA, 15 nt, Mycobacterium avium subsp. paratuberculosis
cgugccgaccagccg

SEQ ID NO: 2900984 - RNA, 12 nt, Mycobacterium avium subsp. paratuberculosis
cgugccgaugcc

SEQ ID NO: 2900985 - RNA, 17 nt, Mycobacterium avium subsp. paratuberculosis
cgugccgaugccggccu

SEQ ID NO: 2900986 - RNA, 17 nt, Mycobacterium avium subsp. paratuberculosis
cgugccgauggccaccg

SEQ ID NO: 2900987 - RNA, 18 nt, Mycobacterium avium subsp. paratuberculosis
cgugccgauggccaccgg

SEQ ID NO: 2900988 - RNA, 20 nt, Mycobacterium avium subsp. paratuberculosis
cgugccgauggccaccgggc

SEQ ID NO: 2900989 - RNA, 23 nt, Mycobacterium avium subsp. paratuberculosis
cgugccgauuccagcaacugcuc

SEQ ID NO: 2900990 - RNA, 13 nt, Mycobacterium avium subsp. paratuberculosis
cgugccgcacccg

SEQ ID NO: 2900991 - RNA, 17 nt, Mycobacterium avium subsp. paratuberculosis
cgugccgcaccugguug

SEQ ID NO: 2900992 - RNA, 13 nt, Mycobacterium avium subsp. paratuberculosis
cgugccgcccgga

SEQ ID NO: 2900993 - RNA, 17 nt, Mycobacterium avium subsp. paratuberculosis
cgugccgcccgucgccu

SEQ ID NO: 2900994 - RNA, 19 nt, Mycobacterium avium subsp. paratuberculosis
cgugccgcccgucgccucc

SEQ ID NO: 2900995 - RNA, 15 nt, Mycobacterium avium subsp. paratuberculosis
cgugccgcgcaccac

SEQ ID NO: 2900996 - RNA, 13 nt, Mycobacterium avium subsp. paratuberculosis
cgugccgcgcggc

SEQ ID NO: 2900997 - RNA, 14 nt, Mycobacterium avium subsp. paratuberculosis
cgugccgcgcggcg

SEQ ID NO: 2900998 - RNA, 15 nt, Mycobacterium avium subsp. paratuberculosis
cgugccgcgcggcgg

SEQ ID NO: 2900999 - RNA, 15 nt, Mycobacterium avium subsp. paratuberculosis
cgugccgcugggagc

SEQ ID NO: 2901000 - RNA, 19 nt, Mycobacterium avium subsp. paratuberculosis
cgugccggaauugaagaag

SEQ ID NO: 2901001 - RNA, 14 nt, Mycobacterium avium subsp. paratuberculosis
cgugccggacaccg

SEQ ID NO: 2901002 - RNA, 18 nt, Mycobacterium avium subsp. paratuberculosis
cgugccggacaccggcac

SEQ ID NO: 2901003 - RNA, 14 nt, Mycobacterium avium subsp. paratuberculosis
cgugccggaccgcg

SEQ ID NO: 2901004 - RNA, 18 nt, Mycobacterium avium subsp. paratuberculosis
cgugccggaccgcgcggg

SEQ ID NO: 2901005 - RNA, 16 nt, Mycobacterium avium subsp. paratuberculosis
cgugccggacuccuuc

SEQ ID NO: 2901006 - RNA, 24 nt, Mycobacterium avium subsp. paratuberculosis
cgugccggacuccuucaucgaucg

SEQ ID NO: 2901007 - RNA, 12 nt, Mycobacterium avium subsp. paratuberculosis
cgugccggcccg

SEQ ID NO: 2901008 - RNA, 13 nt, Mycobacterium avium subsp. paratuberculosis
cgugccggcccgg

SEQ ID NO: 2901009 - RNA, 16 nt, Mycobacterium avium subsp. paratuberculosis
cgugccggcccggcgg

SEQ ID NO: 2901010 - RNA, 17 nt, Mycobacterium avium subsp. paratuberculosis
cgugccggcccggcggg

SEQ ID NO: 2901011 - RNA, 14 nt, Mycobacterium avium subsp. paratuberculosis
cgugccggcgaugg

SEQ ID NO: 2901012 - RNA, 16 nt, Mycobacterium avium subsp. paratuberculosis
cgugccggcgauggug

SEQ ID NO: 2901013 - RNA, 23 nt, Mycobacterium avium subsp. paratuberculosis
cgugccggcgaugguggcgcugc

SEQ ID NO: 2901014 - RNA, 12 nt, Mycobacterium avium subsp. paratuberculosis
cgugccggcgcu

SEQ ID NO: 2901015 - RNA, 13 nt, Mycobacterium avium subsp. paratuberculosis
cgugccggcucgg

SEQ ID NO: 2901016 - RNA, 16 nt, Mycobacterium avium subsp. paratuberculosis
cgugccggcucggcgg

SEQ ID NO: 2901017 - RNA, 18 nt, Mycobacterium avium subsp. paratuberculosis
cgugccggcucggcggcu

SEQ ID NO: 2901018 - RNA, 13 nt, Mycobacterium avium subsp. paratuberculosis
cgugccgggcggu

SEQ ID NO: 2901019 - RNA, 17 nt, Mycobacterium avium subsp. paratuberculosis
cgugccgggugaugcag

SEQ ID NO: 2901020 - RNA, 14 nt, Mycobacterium avium subsp. paratuberculosis
cgugccgucacgcc

SEQ ID NO: 2901021 - RNA, 15 nt, Mycobacterium avium subsp. paratuberculosis
cgugccgucacgccc

SEQ ID NO: 2901022 - RNA, 15 nt, Mycobacterium avium subsp. paratuberculosis
cgugccguccagcuc

SEQ ID NO: 2901023 - RNA, 23 nt, Mycobacterium avium subsp. paratuberculosis
cgugccguccagcuccgccgaca

SEQ ID NO: 2901024 - RNA, 13 nt, Mycobacterium avium subsp. paratuberculosis
cgugccguccggc

SEQ ID NO: 2901025 - RNA, 14 nt, Mycobacterium avium subsp. paratuberculosis
cgugccguccggcc

SEQ ID NO: 2901026 - RNA, 16 nt, Mycobacterium avium subsp. paratuberculosis
cgugccguccggccgg

SEQ ID NO: 2901027 - RNA, 19 nt, Mycobacterium avium subsp. paratuberculosis
cgugccguccggccgguug

SEQ ID NO: 2901028 - RNA, 15 nt, Mycobacterium avium subsp. paratuberculosis
cgugccgucgcgggc

SEQ ID NO: 2901029 - RNA, 19 nt, Mycobacterium avium subsp. paratuberculosis
cgugccgucgcgggcgucg

SEQ ID NO: 2901030 - RNA, 14 nt, Mycobacterium avium subsp. paratuberculosis
cgugccgucgcugu

SEQ ID NO: 2901031 - RNA, 23 nt, Mycobacterium avium subsp. paratuberculosis
cgugccgucgcuguuggcgacgg

SEQ ID NO: 2901032 - RNA, 13 nt, Mycobacterium avium subsp. paratuberculosis
cgugccgucggcg

SEQ ID NO: 2901033 - RNA, 18 nt, Mycobacterium avium subsp. paratuberculosis
cgugccguggucggugcc

SEQ ID NO: 2901034 - RNA, 15 nt, Mycobacterium avium subsp. paratuberculosis
cgugccguugacgaa

SEQ ID NO: 2901035 - RNA, 15 nt, Mycobacterium avium subsp. paratuberculosis
cgugccuuacgccgg

SEQ ID NO: 2901036 - RNA, 16 nt, Mycobacterium avium subsp. paratuberculosis
cgugccuugcacccag

SEQ ID NO: 2901037 - RNA, 17 nt, Mycobacterium avium subsp. paratuberculosis
cgugccuugcacccagc

SEQ ID NO: 2901038 - RNA, 20 nt, Mycobacterium avium subsp. paratuberculosis
cgugccuugcacccagcgga

SEQ ID NO: 2901039 - RNA, 17 nt, Mycobacterium avium subsp. paratuberculosis
cgugcgacaccggcgug

SEQ ID NO: 2901040 - RNA, 18 nt, Mycobacterium avium subsp. paratuberculosis
cgugcgacaccggcguga

SEQ ID NO: 2901041 - RNA, 15 nt, Mycobacterium avium subsp. paratuberculosis
cgugcgacuccuggg

SEQ ID NO: 2901042 - RNA, 17 nt, Mycobacterium avium subsp. paratuberculosis
cgugcgacucggucacg

SEQ ID NO: 2901043 - RNA, 22 nt, Mycobacterium avium subsp. paratuberculosis
cgugcgacuugguggccagcac

SEQ ID NO: 2901044 - RNA, 23 nt, Mycobacterium avium subsp. paratuberculosis
cgugcgacuugguggccagcacc

SEQ ID NO: 2901045 - RNA, 15 nt, Mycobacterium avium subsp. paratuberculosis
cgugcgagccgagca

SEQ ID NO: 2901046 - RNA, 21 nt, Mycobacterium avium subsp. paratuberculosis
cgugcgagccgagcacgcagc

SEQ ID NO: 2901047 - RNA, 17 nt, Mycobacterium avium subsp. paratuberculosis
cgugcgcaaguagcgcu

SEQ ID NO: 2901048 - RNA, 15 nt, Mycobacterium avium subsp. paratuberculosis
cgugcgccagcgacc

SEQ ID NO: 2901049 - RNA, 19 nt, Mycobacterium avium subsp. paratuberculosis
cgugcgccagcgaccgcag

SEQ ID NO: 2901050 - RNA, 20 nt, Mycobacterium avium subsp. paratuberculosis
cgugcgccaguuugccgucg

SEQ ID NO: 2901051 - RNA, 18 nt, Mycobacterium avium subsp. paratuberculosis
cgugcgcccauccggcgc

SEQ ID NO: 2901052 - RNA, 14 nt, Mycobacterium avium subsp. paratuberculosis
cgugcgccccgccc

SEQ ID NO: 2901053 - RNA, 15 nt, Mycobacterium avium subsp. paratuberculosis
cgugcgcccgacgcc

SEQ ID NO: 2901054 - RNA, 21 nt, Mycobacterium avium subsp. paratuberculosis
cgugcgcccgacgccggaccc

SEQ ID NO: 2901055 - RNA, 18 nt, Mycobacterium avium subsp. paratuberculosis
cgugcgccgcccacaccg

SEQ ID NO: 2901056 - RNA, 21 nt, Mycobacterium avium subsp. paratuberculosis
cgugcgccgcccacaccgaca

SEQ ID NO: 2901057 - RNA, 13 nt, Mycobacterium avium subsp. paratuberculosis
cgugcgccgcggc

SEQ ID NO: 2901058 - RNA, 14 nt, Mycobacterium avium subsp. paratuberculosis
cgugcgccgcggcg

SEQ ID NO: 2901059 - RNA, 15 nt, Mycobacterium avium subsp. paratuberculosis
cgugcgccgcggcgg

SEQ ID NO: 2901060 - RNA, 17 nt, Mycobacterium avium subsp. paratuberculosis
cgugcgccgcggcggcu

SEQ ID NO: 2901061 - RNA, 12 nt, Mycobacterium avium subsp. paratuberculosis
cgugcgccggcg

SEQ ID NO: 2901062 - RNA, 15 nt, Mycobacterium avium subsp. paratuberculosis
cgugcgccggcggug

SEQ ID NO: 2901063 - RNA, 18 nt, Mycobacterium avium subsp. paratuberculosis
cgugcgccggcggugcgg

SEQ ID NO: 2901064 - RNA, 18 nt, Mycobacterium avium subsp. paratuberculosis
cgugcgccucgaucaacg

SEQ ID NO: 2901065 - RNA, 20 nt, Mycobacterium avium subsp. paratuberculosis
cgugcgccucgaucaacgcc

SEQ ID NO: 2901066 - RNA, 14 nt, Mycobacterium avium subsp. paratuberculosis
cgugcgcgaagcug

SEQ ID NO: 2901067 - RNA, 13 nt, Mycobacterium avium subsp. paratuberculosis
cgugcgcgccgac

SEQ ID NO: 2901068 - RNA, 16 nt, Mycobacterium avium subsp. paratuberculosis
cgugcgcgccgaccgc

SEQ ID NO: 2901069 - RNA, 14 nt, Mycobacterium avium subsp. paratuberculosis
cgugcgcgcuggug

SEQ ID NO: 2901070 - RNA, 13 nt, Mycobacterium avium subsp. paratuberculosis
cgugcgcggcgac

SEQ ID NO: 2901071 - RNA, 15 nt, Mycobacterium avium subsp. paratuberculosis
cgugcgcggcgacca

SEQ ID NO: 2901072 - RNA, 17 nt, Mycobacterium avium subsp. paratuberculosis
cgugcgcggcgaccacc

SEQ ID NO: 2901073 - RNA, 13 nt, Mycobacterium avium subsp. paratuberculosis
cgugcgcggcgcg

SEQ ID NO: 2901074 - RNA, 13 nt, Mycobacterium avium subsp. paratuberculosis
cgugcgcggcguc

SEQ ID NO: 2901075 - RNA, 23 nt, Mycobacterium avium subsp. paratuberculosis
cgugcgcggcguucuccagcacc

SEQ ID NO: 2901076 - RNA, 19 nt, Mycobacterium avium subsp. paratuberculosis
cgugcgcggcuggccgucg

SEQ ID NO: 2901077 - RNA, 12 nt, Mycobacterium avium subsp. paratuberculosis
cgugcgcgucga

SEQ ID NO: 2901078 - RNA, 19 nt, Mycobacterium avium subsp. paratuberculosis
cgugcgcgucgacaccccg

SEQ ID NO: 2901079 - RNA, 23 nt, Mycobacterium avium subsp. paratuberculosis
cgugcgcgucgacaccccgcucg

SEQ ID NO: 2901080 - RNA, 21 nt, Mycobacterium avium subsp. paratuberculosis
cgugcgcguggggcgucgccg

SEQ ID NO: 2901081 - RNA, 23 nt, Mycobacterium avium subsp. paratuberculosis
cgugcgcucgaccucggcggcca

SEQ ID NO: 2901082 - RNA, 17 nt, Mycobacterium avium subsp. paratuberculosis
cgugcggauggccccgg

SEQ ID NO: 2901083 - RNA, 14 nt, Mycobacterium avium subsp. paratuberculosis
cgugcggcacgccg

SEQ ID NO: 2901084 - RNA, 14 nt, Mycobacterium avium subsp. paratuberculosis
cgugcggccgcagc

SEQ ID NO: 2901085 - RNA, 15 nt, Mycobacterium avium subsp. paratuberculosis
cgugcggccgcagcg

SEQ ID NO: 2901086 - RNA, 13 nt, Mycobacterium avium subsp. paratuberculosis
cgugcggccggcg

SEQ ID NO: 2901087 - RNA, 14 nt, Mycobacterium avium subsp. paratuberculosis
cgugcggccggcgc

SEQ ID NO: 2901088 - RNA, 15 nt, Mycobacterium avium subsp. paratuberculosis
cgugcggccggcgcc

SEQ ID NO: 2901089 - RNA, 16 nt, Mycobacterium avium subsp. paratuberculosis
cgugcggccggcgccg

SEQ ID NO: 2901090 - RNA, 18 nt, Mycobacterium avium subsp. paratuberculosis
cgugcggccggcgccggc

SEQ ID NO: 2901091 - RNA, 22 nt, Mycobacterium avium subsp. paratuberculosis
cgugcggccggcgccggcgguc

SEQ ID NO: 2901092 - RNA, 14 nt, Mycobacterium avium subsp. paratuberculosis
cgugcggccucggc

SEQ ID NO: 2901093 - RNA, 16 nt, Mycobacterium avium subsp. paratuberculosis
cgugcggccucggcac

SEQ ID NO: 2901094 - RNA, 22 nt, Mycobacterium avium subsp. paratuberculosis
cgugcggcgcccuucccggucg

SEQ ID NO: 2901095 - RNA, 13 nt, Mycobacterium avium subsp. paratuberculosis
cgugcggcgccgc

SEQ ID NO: 2901096 - RNA, 14 nt, Mycobacterium avium subsp. paratuberculosis
cgugcggcgccgcc

SEQ ID NO: 2901097 - RNA, 15 nt, Mycobacterium avium subsp. paratuberculosis
cgugcggcgcggucg

SEQ ID NO: 2901098 - RNA, 12 nt, Mycobacterium avium subsp. paratuberculosis
cgugcggcggcg

SEQ ID NO: 2901099 - RNA, 13 nt, Mycobacterium avium subsp. paratuberculosis
cgugcggcggcgg

SEQ ID NO: 2901100 - RNA, 18 nt, Mycobacterium avium subsp. paratuberculosis
cgugcggcguucggugcc

SEQ ID NO: 2901101 - RNA, 15 nt, Mycobacterium avium subsp. paratuberculosis
cgugcggcugcccag

SEQ ID NO: 2901102 - RNA, 23 nt, Mycobacterium avium subsp. paratuberculosis
cgugcggcugcgcguucggcgcc

SEQ ID NO: 2901103 - RNA, 18 nt, Mycobacterium avium subsp. paratuberculosis
cgugcgggaugccgagca

SEQ ID NO: 2901104 - RNA, 20 nt, Mycobacterium avium subsp. paratuberculosis
cgugcgggaugccgagcagc

SEQ ID NO: 2901105 - RNA, 19 nt, Mycobacterium avium subsp. paratuberculosis
cgugcgggcuccgcacgac

SEQ ID NO: 2901106 - RNA, 22 nt, Mycobacterium avium subsp. paratuberculosis
cgugcgggcuccgcacgaccug

SEQ ID NO: 2901107 - RNA, 12 nt, Mycobacterium avium subsp. paratuberculosis
cgugcggggccu

SEQ ID NO: 2901108 - RNA, 17 nt, Mycobacterium avium subsp. paratuberculosis
cgugcggggccucgucg

SEQ ID NO: 2901109 - RNA, 17 nt, Mycobacterium avium subsp. paratuberculosis
cgugcgggucgcgcggc

SEQ ID NO: 2901110 - RNA, 15 nt, Mycobacterium avium subsp. paratuberculosis
cgugcggguggccgg

SEQ ID NO: 2901111 - RNA, 19 nt, Mycobacterium avium subsp. paratuberculosis
cgugcggguggccgggucg

SEQ ID NO: 2901112 - RNA, 20 nt, Mycobacterium avium subsp. paratuberculosis
cgugcggguggccgggucgc

SEQ ID NO: 2901113 - RNA, 17 nt, Mycobacterium avium subsp. paratuberculosis
cgugcgggugguccacc

SEQ ID NO: 2901114 - RNA, 19 nt, Mycobacterium avium subsp. paratuberculosis
cgugcgggugguccaccca

SEQ ID NO: 2901115 - RNA, 16 nt, Mycobacterium avium subsp. paratuberculosis
cgugcgguggucggcg

SEQ ID NO: 2901116 - RNA, 16 nt, Mycobacterium avium subsp. paratuberculosis
cgugcgguuggcccgc

SEQ ID NO: 2901117 - RNA, 20 nt, Mycobacterium avium subsp. paratuberculosis
cgugcgguuggcccgcggcg

SEQ ID NO: 2901118 - RNA, 21 nt, Mycobacterium avium subsp. paratuberculosis
cgugcgguuggcccgcggcgc

SEQ ID NO: 2901119 - RNA, 15 nt, Mycobacterium avium subsp. paratuberculosis
cgugcguagcggccc

SEQ ID NO: 2901120 - RNA, 17 nt, Mycobacterium avium subsp. paratuberculosis
cgugcguagcggcccga

SEQ ID NO: 2901121 - RNA, 13 nt, Mycobacterium avium subsp. paratuberculosis
cgugcgucacgcu

SEQ ID NO: 2901122 - RNA, 15 nt, Mycobacterium avium subsp. paratuberculosis
cgugcgucacgcugg

SEQ ID NO: 2901123 - RNA, 17 nt, Mycobacterium avium subsp. paratuberculosis
cgugcgucacgcuggug

SEQ ID NO: 2901124 - RNA, 20 nt, Mycobacterium avium subsp. paratuberculosis
cgugcgucacgcuggugacg

SEQ ID NO: 2901125 - RNA, 17 nt, Mycobacterium avium subsp. paratuberculosis
cgugcguccaggacucg

SEQ ID NO: 2901126 - RNA, 16 nt, Mycobacterium avium subsp. paratuberculosis
cgugcgugcgcucgac

SEQ ID NO: 2901127 - RNA, 17 nt, Mycobacterium avium subsp. paratuberculosis
cgugcgugcgcucgacc

SEQ ID NO: 2901128 - RNA, 21 nt, Mycobacterium avium subsp. paratuberculosis
cgugcgugcgcucgaccucgg

SEQ ID NO: 2901129 - RNA, 19 nt, Mycobacterium avium subsp. paratuberculosis
cgugcucaucuacgucguc

SEQ ID NO: 2901130 - RNA, 20 nt, Mycobacterium avium subsp. paratuberculosis
cgugcucaucuacgucgucg

SEQ ID NO: 2901131 - RNA, 22 nt, Mycobacterium avium subsp. paratuberculosis
cgugcucaucuacgucgucgcc

SEQ ID NO: 2901132 - RNA, 13 nt, Mycobacterium avium subsp. paratuberculosis
cgugcuccagcag

SEQ ID NO: 2901133 - RNA, 14 nt, Mycobacterium avium subsp. paratuberculosis
cgugcuccagcagg

SEQ ID NO: 2901134 - RNA, 17 nt, Mycobacterium avium subsp. paratuberculosis
cgugcuccagcaggcgc

SEQ ID NO: 2901135 - RNA, 13 nt, Mycobacterium avium subsp. paratuberculosis
cgugcucgagcau

SEQ ID NO: 2901136 - RNA, 14 nt, Mycobacterium avium subsp. paratuberculosis
cgugcucgaucgcg

SEQ ID NO: 2901137 - RNA, 23 nt, Mycobacterium avium subsp. paratuberculosis
cgugcucggaguaguccagcacc

SEQ ID NO: 2901138 - RNA, 13 nt, Mycobacterium avium subsp. paratuberculosis
cgugcucggccac

SEQ ID NO: 2901139 - RNA, 14 nt, Mycobacterium avium subsp. paratuberculosis
cgugcucggccacg

SEQ ID NO: 2901140 - RNA, 20 nt, Mycobacterium avium subsp. paratuberculosis
cgugcucggccacgacgcgc

SEQ ID NO: 2901141 - RNA, 18 nt, Mycobacterium avium subsp. paratuberculosis
cgugcucggcgagcaccg

SEQ ID NO: 2901142 - RNA, 23 nt, Mycobacterium avium subsp. paratuberculosis
cgugcucggcgagcaccgugccg

SEQ ID NO: 2901143 - RNA, 14 nt, Mycobacterium avium subsp. paratuberculosis
cgugcucggcggcc

SEQ ID NO: 2901144 - RNA, 15 nt, Mycobacterium avium subsp. paratuberculosis
cgugcucggcggccg

SEQ ID NO: 2901145 - RNA, 16 nt, Mycobacterium avium subsp. paratuberculosis
cgugcucggcggccgc

SEQ ID NO: 2901146 - RNA, 17 nt, Mycobacterium avium subsp. paratuberculosis
cgugcucggcggccgcc

SEQ ID NO: 2901147 - RNA, 15 nt, Mycobacterium avium subsp. paratuberculosis
cgugcucggcggcgg

SEQ ID NO: 2901148 - RNA, 14 nt, Mycobacterium avium subsp. paratuberculosis
cgugcucgucgcgg

SEQ ID NO: 2901149 - RNA, 14 nt, Mycobacterium avium subsp. paratuberculosis
cgugcucgucggcg

SEQ ID NO: 2901150 - RNA, 16 nt, Mycobacterium avium subsp. paratuberculosis
cgugcucgucggcggg

SEQ ID NO: 2901151 - RNA, 17 nt, Mycobacterium avium subsp. paratuberculosis
cgugcucgucggcgggc

SEQ ID NO: 2901152 - RNA, 20 nt, Mycobacterium avium subsp. paratuberculosis
cgugcucugccuacuugcgg

SEQ ID NO: 2901153 - RNA, 16 nt, Mycobacterium avium subsp. paratuberculosis
cgugcugacgucgucg

SEQ ID NO: 2901154 - RNA, 18 nt, Mycobacterium avium subsp. paratuberculosis
cgugcugacgucgucgcc

SEQ ID NO: 2901155 - RNA, 13 nt, Mycobacterium avium subsp. paratuberculosis
cgugcugccggcc

SEQ ID NO: 2901156 - RNA, 15 nt, Mycobacterium avium subsp. paratuberculosis
cgugcugccggccgg

SEQ ID NO: 2901157 - RNA, 18 nt, Mycobacterium avium subsp. paratuberculosis
cgugcugccggccggcag

SEQ ID NO: 2901158 - RNA, 19 nt, Mycobacterium avium subsp. paratuberculosis
cgugcugccggccggcagc

SEQ ID NO: 2901159 - RNA, 21 nt, Mycobacterium avium subsp. paratuberculosis
cgugcuggagcggaucccggu

SEQ ID NO: 2901160 - RNA, 17 nt, Mycobacterium avium subsp. paratuberculosis
cgugcuggccaccacgg

SEQ ID NO: 2901161 - RNA, 16 nt, Mycobacterium avium subsp. paratuberculosis
cgugcuggccaucgcg

SEQ ID NO: 2901162 - RNA, 14 nt, Mycobacterium avium subsp. paratuberculosis
cgugcuggccgggu

SEQ ID NO: 2901163 - RNA, 17 nt, Mycobacterium avium subsp. paratuberculosis
cgugcugggcaccgucg

SEQ ID NO: 2901164 - RNA, 17 nt, Mycobacterium avium subsp. paratuberculosis
cgugcugggccgggcgg

SEQ ID NO: 2901165 - RNA, 18 nt, Mycobacterium avium subsp. paratuberculosis
cgugcugggccgggcggu

SEQ ID NO: 2901166 - RNA, 18 nt, Mycobacterium avium subsp. paratuberculosis
cgugcugggcggacggga

SEQ ID NO: 2901167 - RNA, 18 nt, Mycobacterium avium subsp. paratuberculosis
cgugcugugcgggcggug

SEQ ID NO: 2901168 - RNA, 19 nt, Mycobacterium avium subsp. paratuberculosis
cgugcugugcgggcggugc

SEQ ID NO: 2901169 - RNA, 19 nt, Mycobacterium avium subsp. paratuberculosis
cgugcuguggaacacgucg

SEQ ID NO: 2901170 - RNA, 20 nt, Mycobacterium avium subsp. paratuberculosis
cgugcuguggaacacgucgg

SEQ ID NO: 2901171 - RNA, 21 nt, Mycobacterium avium subsp. paratuberculosis
cgugcuuaacacaugcaaguc

SEQ ID NO: 2901172 - RNA, 14 nt, Mycobacterium avium subsp. paratuberculosis
cgugcuugaacgcc

SEQ ID NO: 2901173 - RNA, 17 nt, Mycobacterium avium subsp. paratuberculosis
cgugcuugaacgccgcc

SEQ ID NO: 2901174 - RNA, 18 nt, Mycobacterium avium subsp. paratuberculosis
cgugcuugaacgccgccc

SEQ ID NO: 2901175 - RNA, 15 nt, Mycobacterium avium subsp. paratuberculosis
cgugcuuggccagcu

SEQ ID NO: 2901176 - RNA, 22 nt, Mycobacterium avium subsp. paratuberculosis
cgugcuuggccagcucggcggc

SEQ ID NO: 2901177 - RNA, 21 nt, Mycobacterium avium subsp. paratuberculosis
cgugcuuuugcgucugcucgc

SEQ ID NO: 2901178 - RNA, 16 nt, Mycobacterium avium subsp. paratuberculosis
cguggaaaucgagcgc

SEQ ID NO: 2901179 - RNA, 15 nt, Mycobacterium avium subsp. paratuberculosis
cguggaacaccgcgc

SEQ ID NO: 2901180 - RNA, 20 nt, Mycobacterium avium subsp. paratuberculosis
cguggaacacgcccagcgcc

SEQ ID NO: 2901181 - RNA, 13 nt, Mycobacterium avium subsp. paratuberculosis
cguggaacgacgc

SEQ ID NO: 2901182 - RNA, 17 nt, Mycobacterium avium subsp. paratuberculosis
cguggaacgacgccaga

SEQ ID NO: 2901183 - RNA, 19 nt, Mycobacterium avium subsp. paratuberculosis
cguggaacgcgucgcgcca

SEQ ID NO: 2901184 - RNA, 21 nt, Mycobacterium avium subsp. paratuberculosis
cguggaacgcgucgcgccagc

SEQ ID NO: 2901185 - RNA, 14 nt, Mycobacterium avium subsp. paratuberculosis
cguggacaccgcac

SEQ ID NO: 2901186 - RNA, 15 nt, Mycobacterium avium subsp. paratuberculosis
cguggacaccgcacc

SEQ ID NO: 2901187 - RNA, 19 nt, Mycobacterium avium subsp. paratuberculosis
cguggacaccgcacccaga

SEQ ID NO: 2901188 - RNA, 17 nt, Mycobacterium avium subsp. paratuberculosis
cguggacgaacgcggcg

SEQ ID NO: 2901189 - RNA, 18 nt, Mycobacterium avium subsp. paratuberculosis
cguggacgaacgcggcga

SEQ ID NO: 2901190 - RNA, 16 nt, Mycobacterium avium subsp. paratuberculosis
cguggacgcgcgcggc

SEQ ID NO: 2901191 - RNA, 17 nt, Mycobacterium avium subsp. paratuberculosis
cguggacgcgcgcggcg

SEQ ID NO: 2901192 - RNA, 18 nt, Mycobacterium avium subsp. paratuberculosis
cguggacgcgcgcggcgu

SEQ ID NO: 2901193 - RNA, 13 nt, Mycobacterium avium subsp. paratuberculosis
cguggacggcgag

SEQ ID NO: 2901194 - RNA, 21 nt, Mycobacterium avium subsp. paratuberculosis
cguggacggcgagcggcccug

SEQ ID NO: 2901195 - RNA, 21 nt, Mycobacterium avium subsp. paratuberculosis
cguggacgucguuuuccagcc

SEQ ID NO: 2901196 - RNA, 23 nt, Mycobacterium avium subsp. paratuberculosis
cguggacgucguuuuccagccgg

SEQ ID NO: 2901197 - RNA, 20 nt, Mycobacterium avium subsp. paratuberculosis
cguggaggcguagugcgccc

SEQ ID NO: 2901198 - RNA, 23 nt, Mycobacterium avium subsp. paratuberculosis
cguggaggcguagugcgcccaga

SEQ ID NO: 2901199 - RNA, 21 nt, Mycobacterium avium subsp. paratuberculosis
cguggagucgaagcggugcac

SEQ ID NO: 2901200 - RNA, 21 nt, Mycobacterium avium subsp. paratuberculosis
cguggaucucgaacggcccgg

SEQ ID NO: 2901201 - RNA, 23 nt, Mycobacterium avium subsp. paratuberculosis
cguggauggacgcccagaacugg

SEQ ID NO: 2901202 - RNA, 14 nt, Mycobacterium avium subsp. paratuberculosis
cguggauggccggc

SEQ ID NO: 2901203 - RNA, 17 nt, Mycobacterium avium subsp. paratuberculosis
cguggauggccggccgg

SEQ ID NO: 2901204 - RNA, 19 nt, Mycobacterium avium subsp. paratuberculosis
cguggauggccggccgggu

SEQ ID NO: 2901205 - RNA, 15 nt, Mycobacterium avium subsp. paratuberculosis
cguggcacccgggcg

SEQ ID NO: 2901206 - RNA, 19 nt, Mycobacterium avium subsp. paratuberculosis
cguggcacccgggcgcgac

SEQ ID NO: 2901207 - RNA, 19 nt, Mycobacterium avium subsp. paratuberculosis
cguggcagcggucggcggc

SEQ ID NO: 2901208 - RNA, 16 nt, Mycobacterium avium subsp. paratuberculosis
cguggcaggcacgagc

SEQ ID NO: 2901209 - RNA, 17 nt, Mycobacterium avium subsp. paratuberculosis
cguggcaggccaucagc

SEQ ID NO: 2901210 - RNA, 23 nt, Mycobacterium avium subsp. paratuberculosis
cguggcaggccaucagcccggcg

SEQ ID NO: 2901211 - RNA, 17 nt, Mycobacterium avium subsp. paratuberculosis
cguggcaggcgauggug

SEQ ID NO: 2901212 - RNA, 18 nt, Mycobacterium avium subsp. paratuberculosis
cguggcagggccagcagc

SEQ ID NO: 2901213 - RNA, 22 nt, Mycobacterium avium subsp. paratuberculosis
cguggcagggccagcagcccgg

SEQ ID NO: 2901214 - RNA, 16 nt, Mycobacterium avium subsp. paratuberculosis
cguggcaggucgggcu

SEQ ID NO: 2901215 - RNA, 22 nt, Mycobacterium avium subsp. paratuberculosis
cguggccagcaccgucagccag

SEQ ID NO: 2901216 - RNA, 23 nt, Mycobacterium avium subsp. paratuberculosis
cguggccagcaccgucagccagg

SEQ ID NO: 2901217 - RNA, 13 nt, Mycobacterium avium subsp. paratuberculosis
cguggccagcgcc

SEQ ID NO: 2901218 - RNA, 14 nt, Mycobacterium avium subsp. paratuberculosis
cguggccagcgcca

SEQ ID NO: 2901219 - RNA, 14 nt, Mycobacterium avium subsp. paratuberculosis
cguggcccacggga

SEQ ID NO: 2901220 - RNA, 17 nt, Mycobacterium avium subsp. paratuberculosis
cguggcccagccggugc

SEQ ID NO: 2901221 - RNA, 14 nt, Mycobacterium avium subsp. paratuberculosis
cguggccccagcca

SEQ ID NO: 2901222 - RNA, 15 nt, Mycobacterium avium subsp. paratuberculosis
cguggcccgcccagc

SEQ ID NO: 2901223 - RNA, 22 nt, Mycobacterium avium subsp. paratuberculosis
cguggcccggauggccgggcag

SEQ ID NO: 2901224 - RNA, 12 nt, Mycobacterium avium subsp. paratuberculosis
cguggcccugcu

SEQ ID NO: 2901225 - RNA, 17 nt, Mycobacterium avium subsp. paratuberculosis
cguggcccugcucgucg

SEQ ID NO: 2901226 - RNA, 12 nt, Mycobacterium avium subsp. paratuberculosis
cguggccgagga

SEQ ID NO: 2901227 - RNA, 23 nt, Mycobacterium avium subsp. paratuberculosis
cguggccgaucagcugcucggcc

SEQ ID NO: 2901228 - RNA, 15 nt, Mycobacterium avium subsp. paratuberculosis
cguggccgcguagaa

SEQ ID NO: 2901229 - RNA, 14 nt, Mycobacterium avium subsp. paratuberculosis
cguggccggcaggu

SEQ ID NO: 2901230 - RNA, 17 nt, Mycobacterium avium subsp. paratuberculosis
cguggccgucacgcugg

SEQ ID NO: 2901231 - RNA, 18 nt, Mycobacterium avium subsp. paratuberculosis
cguggccgucacgcuggc

SEQ ID NO: 2901232 - RNA, 19 nt, Mycobacterium avium subsp. paratuberculosis
cguggccgugugcgcaucg

SEQ ID NO: 2901233 - RNA, 22 nt, Mycobacterium avium subsp. paratuberculosis
cguggccgugugcgcaucggcg

SEQ ID NO: 2901234 - RNA, 16 nt, Mycobacterium avium subsp. paratuberculosis
cguggccucccgguag

SEQ ID NO: 2901235 - RNA, 12 nt, Mycobacterium avium subsp. paratuberculosis
cguggccugcga

SEQ ID NO: 2901236 - RNA, 23 nt, Mycobacterium avium subsp. paratuberculosis
cguggccugcgacuucuacggcg

SEQ ID NO: 2901237 - RNA, 18 nt, Mycobacterium avium subsp. paratuberculosis
cguggcgaacgcgaccug

SEQ ID NO: 2901238 - RNA, 17 nt, Mycobacterium avium subsp. paratuberculosis
cguggcgacaucgccgc

SEQ ID NO: 2901239 - RNA, 15 nt, Mycobacterium avium subsp. paratuberculosis
cguggcgacgacgcc

SEQ ID NO: 2901240 - RNA, 16 nt, Mycobacterium avium subsp. paratuberculosis
cguggcgacgacgccg

SEQ ID NO: 2901241 - RNA, 19 nt, Mycobacterium avium subsp. paratuberculosis
cguggcgacgacgccgauc

SEQ ID NO: 2901242 - RNA, 13 nt, Mycobacterium avium subsp. paratuberculosis
cguggcgcacagc

SEQ ID NO: 2901243 - RNA, 13 nt, Mycobacterium avium subsp. paratuberculosis
cguggcgccggcg

SEQ ID NO: 2901244 - RNA, 14 nt, Mycobacterium avium subsp. paratuberculosis
cguggcgccggcgc

SEQ ID NO: 2901245 - RNA, 17 nt, Mycobacterium avium subsp. paratuberculosis
cguggcgccggcgcgcg

SEQ ID NO: 2901246 - RNA, 20 nt, Mycobacterium avium subsp. paratuberculosis
cguggcgccggcgcgcgagc

SEQ ID NO: 2901247 - RNA, 15 nt, Mycobacterium avium subsp. paratuberculosis
cguggcgcgacgcgg

SEQ ID NO: 2901248 - RNA, 16 nt, Mycobacterium avium subsp. paratuberculosis
cguggcgcgccccggc

SEQ ID NO: 2901249 - RNA, 18 nt, Mycobacterium avium subsp. paratuberculosis
cguggcgcgccccggccc

SEQ ID NO: 2901250 - RNA, 21 nt, Mycobacterium avium subsp. paratuberculosis
cguggcgcgccccggcccguc

SEQ ID NO: 2901251 - RNA, 13 nt, Mycobacterium avium subsp. paratuberculosis
cguggcgcucagc

SEQ ID NO: 2901252 - RNA, 14 nt, Mycobacterium avium subsp. paratuberculosis
cguggcgcucagcg

SEQ ID NO: 2901253 - RNA, 15 nt, Mycobacterium avium subsp. paratuberculosis
cguggcgcucagcgg

SEQ ID NO: 2901254 - RNA, 17 nt, Mycobacterium avium subsp. paratuberculosis
cguggcgcucagcggca

SEQ ID NO: 2901255 - RNA, 19 nt, Mycobacterium avium subsp. paratuberculosis
cguggcgcucagcggcagc

SEQ ID NO: 2901256 - RNA, 20 nt, Mycobacterium avium subsp. paratuberculosis
cguggcgcucagcggcagcg

SEQ ID NO: 2901257 - RNA, 24 nt, Mycobacterium avium subsp. paratuberculosis
cguggcgcucagcggcagcgucgc

SEQ ID NO: 2901258 - RNA, 19 nt, Mycobacterium avium subsp. paratuberculosis
cguggcggaagcgcguuca

SEQ ID NO: 2901259 - RNA, 21 nt, Mycobacterium avium subsp. paratuberculosis
cguggcggaagcgcguucagg

SEQ ID NO: 2901260 - RNA, 14 nt, Mycobacterium avium subsp. paratuberculosis
cguggcggcccgac

SEQ ID NO: 2901261 - RNA, 18 nt, Mycobacterium avium subsp. paratuberculosis
cguggcggcccgaccagc

SEQ ID NO: 2901262 - RNA, 19 nt, Mycobacterium avium subsp. paratuberculosis
cguggcggcccgaccagcg

SEQ ID NO: 2901263 - RNA, 13 nt, Mycobacterium avium subsp. paratuberculosis
cguggcggccguc

SEQ ID NO: 2901264 - RNA, 15 nt, Mycobacterium avium subsp. paratuberculosis
cguggcggcgggcca

SEQ ID NO: 2901265 - RNA, 16 nt, Mycobacterium avium subsp. paratuberculosis
cguggcggcgggccag

SEQ ID NO: 2901266 - RNA, 21 nt, Mycobacterium avium subsp. paratuberculosis
cguggcggcgggccagcucgu

SEQ ID NO: 2901267 - RNA, 23 nt, Mycobacterium avium subsp. paratuberculosis
cguggcggcgggccagcucgucg

SEQ ID NO: 2901268 - RNA, 17 nt, Mycobacterium avium subsp. paratuberculosis
cguggcggcgguggcga

SEQ ID NO: 2901269 - RNA, 17 nt, Mycobacterium avium subsp. paratuberculosis
cguggcggcggugucgc

SEQ ID NO: 2901270 - RNA, 14 nt, Mycobacterium avium subsp. paratuberculosis
cguggcgggccagg

SEQ ID NO: 2901271 - RNA, 17 nt, Mycobacterium avium subsp. paratuberculosis
cguggcgggccaggcgg

SEQ ID NO: 2901272 - RNA, 13 nt, Mycobacterium avium subsp. paratuberculosis
cguggcgggcccg

SEQ ID NO: 2901273 - RNA, 17 nt, Mycobacterium avium subsp. paratuberculosis
cguggcgggggagccgu

SEQ ID NO: 2901274 - RNA, 19 nt, Mycobacterium avium subsp. paratuberculosis
cguggcgggggagccgugc

SEQ ID NO: 2901275 - RNA, 22 nt, Mycobacterium avium subsp. paratuberculosis
cguggcgggggagccgugcagc

SEQ ID NO: 2901276 - RNA, 23 nt, Mycobacterium avium subsp. paratuberculosis
cguggcgggggagccgugcagcg

SEQ ID NO: 2901277 - RNA, 22 nt, Mycobacterium avium subsp. paratuberculosis
cguggcggucggugcgcagcac

SEQ ID NO: 2901278 - RNA, 14 nt, Mycobacterium avium subsp. paratuberculosis
cguggcggugcucu

SEQ ID NO: 2901279 - RNA, 15 nt, Mycobacterium avium subsp. paratuberculosis
cguggcgguggcggc

SEQ ID NO: 2901280 - RNA, 12 nt, Mycobacterium avium subsp. paratuberculosis
cguggcgucggc

SEQ ID NO: 2901281 - RNA, 14 nt, Mycobacterium avium subsp. paratuberculosis
cguggcgucggcgc

SEQ ID NO: 2901282 - RNA, 15 nt, Mycobacterium avium subsp. paratuberculosis
cguggcgucggcgcg

SEQ ID NO: 2901283 - RNA, 16 nt, Mycobacterium avium subsp. paratuberculosis
cguggcgucggcgcgc

SEQ ID NO: 2901284 - RNA, 17 nt, Mycobacterium avium subsp. paratuberculosis
cguggcgucggcgcgca

SEQ ID NO: 2901285 - RNA, 15 nt, Mycobacterium avium subsp. paratuberculosis
cguggcgugccgggc

SEQ ID NO: 2901286 - RNA, 17 nt, Mycobacterium avium subsp. paratuberculosis
cguggcgugccgggcgg

SEQ ID NO: 2901287 - RNA, 14 nt, Mycobacterium avium subsp. paratuberculosis
cguggcucagcggc

SEQ ID NO: 2901288 - RNA, 15 nt, Mycobacterium avium subsp. paratuberculosis
cguggcucagcggca

SEQ ID NO: 2901289 - RNA, 16 nt, Mycobacterium avium subsp. paratuberculosis
cguggcucagcggcag

SEQ ID NO: 2901290 - RNA, 19 nt, Mycobacterium avium subsp. paratuberculosis
cguggcucagcggcaggug

SEQ ID NO: 2901291 - RNA, 17 nt, Mycobacterium avium subsp. paratuberculosis
cguggcucggcccgccg

SEQ ID NO: 2901292 - RNA, 18 nt, Mycobacterium avium subsp. paratuberculosis
cguggcucggcccgccgg

SEQ ID NO: 2901293 - RNA, 20 nt, Mycobacterium avium subsp. paratuberculosis
cguggcucggcccgccgggc

SEQ ID NO: 2901294 - RNA, 17 nt, Mycobacterium avium subsp. paratuberculosis
cguggcugaacagcgcg

SEQ ID NO: 2901295 - RNA, 18 nt, Mycobacterium avium subsp. paratuberculosis
cguggcugaacagcgcgc

SEQ ID NO: 2901296 - RNA, 15 nt, Mycobacterium avium subsp. paratuberculosis
cguggcugaccgacg

SEQ ID NO: 2901297 - RNA, 21 nt, Mycobacterium avium subsp. paratuberculosis
cguggcugaccgacggcgacc

SEQ ID NO: 2901298 - RNA, 15 nt, Mycobacterium avium subsp. paratuberculosis
cguggcugaggccgc

SEQ ID NO: 2901299 - RNA, 16 nt, Mycobacterium avium subsp. paratuberculosis
cguggcugaggccgcc

SEQ ID NO: 2901300 - RNA, 19 nt, Mycobacterium avium subsp. paratuberculosis
cguggcugaggccgccccg

SEQ ID NO: 2901301 - RNA, 19 nt, Mycobacterium avium subsp. paratuberculosis
cguggcuugaucgcaccca

SEQ ID NO: 2901302 - RNA, 20 nt, Mycobacterium avium subsp. paratuberculosis
cguggcuugaucgcacccau

SEQ ID NO: 2901303 - RNA, 15 nt, Mycobacterium avium subsp. paratuberculosis
cguggcuuucggcgc

SEQ ID NO: 2901304 - RNA, 18 nt, Mycobacterium avium subsp. paratuberculosis
cguggcuuucggcgccaa

SEQ ID NO: 2901305 - RNA, 23 nt, Mycobacterium avium subsp. paratuberculosis
cguggcuuuggucgccagcacca

SEQ ID NO: 2901306 - RNA, 18 nt, Mycobacterium avium subsp. paratuberculosis
cgugggaaugcggcuggg

SEQ ID NO: 2901307 - RNA, 21 nt, Mycobacterium avium subsp. paratuberculosis
cgugggaaugcggcugggugg

SEQ ID NO: 2901308 - RNA, 17 nt, Mycobacterium avium subsp. paratuberculosis
cgugggcaccggcaccg

SEQ ID NO: 2901309 - RNA, 19 nt, Mycobacterium avium subsp. paratuberculosis
cgugggcaccggcaccgcc

SEQ ID NO: 2901310 - RNA, 13 nt, Mycobacterium avium subsp. paratuberculosis
cgugggccaacgc

SEQ ID NO: 2901311 - RNA, 15 nt, Mycobacterium avium subsp. paratuberculosis
cgugggccaacgcga

SEQ ID NO: 2901312 - RNA, 13 nt, Mycobacterium avium subsp. paratuberculosis
cgugggccaccac

SEQ ID NO: 2901313 - RNA, 15 nt, Mycobacterium avium subsp. paratuberculosis
cgugggccaccacgu

SEQ ID NO: 2901314 - RNA, 18 nt, Mycobacterium avium subsp. paratuberculosis
cgugggccgaccggccgg

SEQ ID NO: 2901315 - RNA, 16 nt, Mycobacterium avium subsp. paratuberculosis
cgugggccgcagcgcg

SEQ ID NO: 2901316 - RNA, 22 nt, Mycobacterium avium subsp. paratuberculosis
cgugggccgcagcgcggcgaca

SEQ ID NO: 2901317 - RNA, 16 nt, Mycobacterium avium subsp. paratuberculosis
cgugggcgauccgcag

SEQ ID NO: 2901318 - RNA, 20 nt, Mycobacterium avium subsp. paratuberculosis
cgugggcgauccgcaggccg

SEQ ID NO: 2901319 - RNA, 18 nt, Mycobacterium avium subsp. paratuberculosis
cgugggcgccgucgccgc

SEQ ID NO: 2901320 - RNA, 17 nt, Mycobacterium avium subsp. paratuberculosis
cgugggcggccaccaac

SEQ ID NO: 2901321 - RNA, 16 nt, Mycobacterium avium subsp. paratuberculosis
cguggggcgucgccgc

SEQ ID NO: 2901322 - RNA, 20 nt, Mycobacterium avium subsp. paratuberculosis
cgugggggucgacccgccgc

SEQ ID NO: 2901323 - RNA, 18 nt, Mycobacterium avium subsp. paratuberculosis
cgugggguucccggccgg

SEQ ID NO: 2901324 - RNA, 24 nt, Mycobacterium avium subsp. paratuberculosis
cgugggguucccggccgguggccg

SEQ ID NO: 2901325 - RNA, 23 nt, Mycobacterium avium subsp. paratuberculosis
cgugggguuuucggcgcgcgccg

SEQ ID NO: 2901326 - RNA, 18 nt, Mycobacterium avium subsp. paratuberculosis
cguggguauccgccgcca

SEQ ID NO: 2901327 - RNA, 17 nt, Mycobacterium avium subsp. paratuberculosis
cgugggucaaccgguag

SEQ ID NO: 2901328 - RNA, 12 nt, Mycobacterium avium subsp. paratuberculosis
cgugggugccga

SEQ ID NO: 2901329 - RNA, 23 nt, Mycobacterium avium subsp. paratuberculosis
cgugggugccgacgagcucgccg

SEQ ID NO: 2901330 - RNA, 22 nt, Mycobacterium avium subsp. paratuberculosis
cguggguguccuugcgcaccac

SEQ ID NO: 2901331 - RNA, 17 nt, Mycobacterium avium subsp. paratuberculosis
cgugguaccggcgccag

SEQ ID NO: 2901332 - RNA, 19 nt, Mycobacterium avium subsp. paratuberculosis
cgugguaccggcgccaggc

SEQ ID NO: 2901333 - RNA, 16 nt, Mycobacterium avium subsp. paratuberculosis
cgugguagacgccgga

SEQ ID NO: 2901334 - RNA, 14 nt, Mycobacterium avium subsp. paratuberculosis
cgugguagccgccg

SEQ ID NO: 2901335 - RNA, 17 nt, Mycobacterium avium subsp. paratuberculosis
cguggucaacggcaccg

SEQ ID NO: 2901336 - RNA, 15 nt, Mycobacterium avium subsp. paratuberculosis
cguggucacccgcag

SEQ ID NO: 2901337 - RNA, 22 nt, Mycobacterium avium subsp. paratuberculosis
cguggucacccgcagcccgacc

SEQ ID NO: 2901338 - RNA, 19 nt, Mycobacterium avium subsp. paratuberculosis
cguggucagcgucucgccg

SEQ ID NO: 2901339 - RNA, 23 nt, Mycobacterium avium subsp. paratuberculosis
cguggucagcgucucgccgggga

SEQ ID NO: 2901340 - RNA, 14 nt, Mycobacterium avium subsp. paratuberculosis
cgugguccagcacg

SEQ ID NO: 2901341 - RNA, 20 nt, Mycobacterium avium subsp. paratuberculosis
cgugguccagcacgugccca

SEQ ID NO: 2901342 - RNA, 15 nt, Mycobacterium avium subsp. paratuberculosis
cguggucccaggacc

SEQ ID NO: 2901343 - RNA, 20 nt, Mycobacterium avium subsp. paratuberculosis
cguggucccaggaccacucc

SEQ ID NO: 2901344 - RNA, 16 nt, Mycobacterium avium subsp. paratuberculosis
cguggucgacgccgug

SEQ ID NO: 2901345 - RNA, 18 nt, Mycobacterium avium subsp. paratuberculosis
cguggucgacgccguggu

SEQ ID NO: 2901346 - RNA, 18 nt, Mycobacterium avium subsp. paratuberculosis
cguggucgaggcccucga

SEQ ID NO: 2901347 - RNA, 14 nt, Mycobacterium avium subsp. paratuberculosis
cguggucgccguug

SEQ ID NO: 2901348 - RNA, 13 nt, Mycobacterium avium subsp. paratuberculosis
cguggucgcgcag

SEQ ID NO: 2901349 - RNA, 15 nt, Mycobacterium avium subsp. paratuberculosis
cguggucgcgcagca

SEQ ID NO: 2901350 - RNA, 18 nt, Mycobacterium avium subsp. paratuberculosis
cguggucgcugaccuucu

SEQ ID NO: 2901351 - RNA, 16 nt, Mycobacterium avium subsp. paratuberculosis
cguggucgcugcucau

SEQ ID NO: 2901352 - RNA, 14 nt, Mycobacterium avium subsp. paratuberculosis
cguggucggcagca

SEQ ID NO: 2901353 - RNA, 16 nt, Mycobacterium avium subsp. paratuberculosis
cguggucggcagcacc

SEQ ID NO: 2901354 - RNA, 17 nt, Mycobacterium avium subsp. paratuberculosis
cguggucggcagcaccg

SEQ ID NO: 2901355 - RNA, 19 nt, Mycobacterium avium subsp. paratuberculosis
cguggucggcagcaccggc

SEQ ID NO: 2901356 - RNA, 21 nt, Mycobacterium avium subsp. paratuberculosis
cguggucggcagcaccggcag

SEQ ID NO: 2901357 - RNA, 20 nt, Mycobacterium avium subsp. paratuberculosis
cguggucggcgaacgcccgg

SEQ ID NO: 2901358 - RNA, 15 nt, Mycobacterium avium subsp. paratuberculosis
cguggucggcgaugc

SEQ ID NO: 2901359 - RNA, 15 nt, Mycobacterium avium subsp. paratuberculosis
cguggucggcgcggu

SEQ ID NO: 2901360 - RNA, 17 nt, Mycobacterium avium subsp. paratuberculosis
cguggucggcgcggucc

SEQ ID NO: 2901361 - RNA, 20 nt, Mycobacterium avium subsp. paratuberculosis
cguggucgggcaugccggcc

SEQ ID NO: 2901362 - RNA, 21 nt, Mycobacterium avium subsp. paratuberculosis
cguggucgggcaugccggccg

SEQ ID NO: 2901363 - RNA, 22 nt, Mycobacterium avium subsp. paratuberculosis
cguggucgggcaugccggccgg

SEQ ID NO: 2901364 - RNA, 23 nt, Mycobacterium avium subsp. paratuberculosis
cguggucggugcccugugaggcg

SEQ ID NO: 2901365 - RNA, 18 nt, Mycobacterium avium subsp. paratuberculosis
cguggucuccuggccgcc

SEQ ID NO: 2901366 - RNA, 22 nt, Mycobacterium avium subsp. paratuberculosis
cguggucuccuggccgccgugc

SEQ ID NO: 2901367 - RNA, 17 nt, Mycobacterium avium subsp. paratuberculosis
cguggucucgcaccugc

SEQ ID NO: 2901368 - RNA, 21 nt, Mycobacterium avium subsp. paratuberculosis
cguggucucgcaccugccguc

SEQ ID NO: 2901369 - RNA, 22 nt, Mycobacterium avium subsp. paratuberculosis
cguggucucguugugcaccggc

SEQ ID NO: 2901370 - RNA, 16 nt, Mycobacterium avium subsp. paratuberculosis
cguggugacgggcguc

SEQ ID NO: 2901371 - RNA, 16 nt, Mycobacterium avium subsp. paratuberculosis
cguggugaucgccgcg

SEQ ID NO: 2901372 - RNA, 17 nt, Mycobacterium avium subsp. paratuberculosis
cguggugaucgccgcgg

SEQ ID NO: 2901373 - RNA, 13 nt, Mycobacterium avium subsp. paratuberculosis
cguggugcaccgc

SEQ ID NO: 2901374 - RNA, 15 nt, Mycobacterium avium subsp. paratuberculosis
cguggugcaccgcca

SEQ ID NO: 2901375 - RNA, 21 nt, Mycobacterium avium subsp. paratuberculosis
cguggugcaccgccagcgcgg

SEQ ID NO: 2901376 - RNA, 16 nt, Mycobacterium avium subsp. paratuberculosis
cguggugcgcccgucg

SEQ ID NO: 2901377 - RNA, 18 nt, Mycobacterium avium subsp. paratuberculosis
cguggugcggugcaccgc

SEQ ID NO: 2901378 - RNA, 14 nt, Mycobacterium avium subsp. paratuberculosis
cgugguggaaggug

SEQ ID NO: 2901379 - RNA, 21 nt, Mycobacterium avium subsp. paratuberculosis
cgugguggaaggugacgucgc

SEQ ID NO: 2901380 - RNA, 22 nt, Mycobacterium avium subsp. paratuberculosis
cgugguggaaggugacgucgcc

SEQ ID NO: 2901381 - RNA, 20 nt, Mycobacterium avium subsp. paratuberculosis
cgugguggaugaugccggcg

SEQ ID NO: 2901382 - RNA, 23 nt, Mycobacterium avium subsp. paratuberculosis
cgugguggaugaugccggcggug

SEQ ID NO: 2901383 - RNA, 22 nt, Mycobacterium avium subsp. paratuberculosis
cguggugggcagaugcccgcug

SEQ ID NO: 2901384 - RNA, 16 nt, Mycobacterium avium subsp. paratuberculosis
cguggugggcgaacag

SEQ ID NO: 2901385 - RNA, 19 nt, Mycobacterium avium subsp. paratuberculosis
cguggugggcgaacagcag

SEQ ID NO: 2901386 - RNA, 16 nt, Mycobacterium avium subsp. paratuberculosis
cguggugugcaccagc

SEQ ID NO: 2901387 - RNA, 17 nt, Mycobacterium avium subsp. paratuberculosis
cguggugugcaccagcg

SEQ ID NO: 2901388 - RNA, 18 nt, Mycobacterium avium subsp. paratuberculosis
cguggugugcaccagcga

SEQ ID NO: 2901389 - RNA, 21 nt, Mycobacterium avium subsp. paratuberculosis
cguggugugcccgcgggccag

SEQ ID NO: 2901390 - RNA, 21 nt, Mycobacterium avium subsp. paratuberculosis
cgugguguugaucauccggcg

SEQ ID NO: 2901391 - RNA, 23 nt, Mycobacterium avium subsp. paratuberculosis
cgugguguugaucauccggcggg

SEQ ID NO: 2901392 - RNA, 20 nt, Mycobacterium avium subsp. paratuberculosis
cgugguucuccgcgacaucg

SEQ ID NO: 2901393 - RNA, 16 nt, Mycobacterium avium subsp. paratuberculosis
cgugguugcaaucucg

SEQ ID NO: 2901394 - RNA, 19 nt, Mycobacterium avium subsp. paratuberculosis
cgugguugcguucgccggc

SEQ ID NO: 2901395 - RNA, 21 nt, Mycobacterium avium subsp. paratuberculosis
cgugguugcguucgccggcgu

SEQ ID NO: 2901396 - RNA, 15 nt, Mycobacterium avium subsp. paratuberculosis
cgugguuggcgauca

SEQ ID NO: 2901397 - RNA, 12 nt, Mycobacterium avium subsp. paratuberculosis
cguguacagcag

SEQ ID NO: 2901398 - RNA, 20 nt, Mycobacterium avium subsp. paratuberculosis
cguguagccugcggccugca

SEQ ID NO: 2901399 - RNA, 14 nt, Mycobacterium avium subsp. paratuberculosis
cguguaggccgcgc

SEQ ID NO: 2901400 - RNA, 16 nt, Mycobacterium avium subsp. paratuberculosis
cguguaggccgcgcug

SEQ ID NO: 2901401 - RNA, 14 nt, Mycobacterium avium subsp. paratuberculosis
cguguaguacaggc

SEQ ID NO: 2901402 - RNA, 14 nt, Mycobacterium avium subsp. paratuberculosis
cgugucaccgccca

SEQ ID NO: 2901403 - RNA, 20 nt, Mycobacterium avium subsp. paratuberculosis
cgugucacuacccgcgaugg

SEQ ID NO: 2901404 - RNA, 22 nt, Mycobacterium avium subsp. paratuberculosis
cgugucccggauggagcgcgac

SEQ ID NO: 2901405 - RNA, 16 nt, Mycobacterium avium subsp. paratuberculosis
cgugucccugcggcug

SEQ ID NO: 2901406 - RNA, 21 nt, Mycobacterium avium subsp. paratuberculosis
cgugucccugcggcugcauca

SEQ ID NO: 2901407 - RNA, 17 nt, Mycobacterium avium subsp. paratuberculosis
cguguccgacgccgucg

SEQ ID NO: 2901408 - RNA, 14 nt, Mycobacterium avium subsp. paratuberculosis
cguguccgaugacg

SEQ ID NO: 2901409 - RNA, 15 nt, Mycobacterium avium subsp. paratuberculosis
cguguccgaugacga

SEQ ID NO: 2901410 - RNA, 18 nt, Mycobacterium avium subsp. paratuberculosis
cguguccgaugacgagca

SEQ ID NO: 2901411 - RNA, 15 nt, Mycobacterium avium subsp. paratuberculosis
cguguccgcgccggc

SEQ ID NO: 2901412 - RNA, 17 nt, Mycobacterium avium subsp. paratuberculosis
cguguccgcgccggcgc

SEQ ID NO: 2901413 - RNA, 13 nt, Mycobacterium avium subsp. paratuberculosis
cguguccgggccc

SEQ ID NO: 2901414 - RNA, 15 nt, Mycobacterium avium subsp. paratuberculosis
cguguccgucgccgg

SEQ ID NO: 2901415 - RNA, 21 nt, Mycobacterium avium subsp. paratuberculosis
cguguccgucgccggaggcga

SEQ ID NO: 2901416 - RNA, 14 nt, Mycobacterium avium subsp. paratuberculosis
cgugucgccggggc

SEQ ID NO: 2901417 - RNA, 19 nt, Mycobacterium avium subsp. paratuberculosis
cgugucgccggggcggauc

SEQ ID NO: 2901418 - RNA, 22 nt, Mycobacterium avium subsp. paratuberculosis
cgugucgcggccuccgagcggc

SEQ ID NO: 2901419 - RNA, 13 nt, Mycobacterium avium subsp. paratuberculosis
cgugucgcgugcu

SEQ ID NO: 2901420 - RNA, 13 nt, Mycobacterium avium subsp. paratuberculosis
cgugucggcgauc

SEQ ID NO: 2901421 - RNA, 14 nt, Mycobacterium avium subsp. paratuberculosis
cgugucggcgaucg

SEQ ID NO: 2901422 - RNA, 15 nt, Mycobacterium avium subsp. paratuberculosis
cgugucggcgaucgc

SEQ ID NO: 2901423 - RNA, 16 nt, Mycobacterium avium subsp. paratuberculosis
cgugucggcgaucgcg

SEQ ID NO: 2901424 - RNA, 13 nt, Mycobacterium avium subsp. paratuberculosis
cgugucggcgcca

SEQ ID NO: 2901425 - RNA, 14 nt, Mycobacterium avium subsp. paratuberculosis
cgugucggcgccac

SEQ ID NO: 2901426 - RNA, 13 nt, Mycobacterium avium subsp. paratuberculosis
cgugucggcgucg

SEQ ID NO: 2901427 - RNA, 19 nt, Mycobacterium avium subsp. paratuberculosis
cgugucggggucggcgccg

SEQ ID NO: 2901428 - RNA, 16 nt, Mycobacterium avium subsp. paratuberculosis
cgugucggugauggcc

SEQ ID NO: 2901429 - RNA, 20 nt, Mycobacterium avium subsp. paratuberculosis
cgugucgucgucgccgccgg

SEQ ID NO: 2901430 - RNA, 23 nt, Mycobacterium avium subsp. paratuberculosis
cgugucgucgucgccgccgguga

SEQ ID NO: 2901431 - RNA, 15 nt, Mycobacterium avium subsp. paratuberculosis
cgugucuggccccgu

SEQ ID NO: 2901432 - RNA, 21 nt, Mycobacterium avium subsp. paratuberculosis
cgugugacgaugcugagcaga

SEQ ID NO: 2901433 - RNA, 19 nt, Mycobacterium avium subsp. paratuberculosis
cgugugcaccugagucugg

SEQ ID NO: 2901434 - RNA, 14 nt, Mycobacterium avium subsp. paratuberculosis
cgugugccagcccg

SEQ ID NO: 2901435 - RNA, 19 nt, Mycobacterium avium subsp. paratuberculosis
cgugugcgcaucggcgacg

SEQ ID NO: 2901436 - RNA, 23 nt, Mycobacterium avium subsp. paratuberculosis
cgugugcgcaucggcgacgccgc

SEQ ID NO: 2901437 - RNA, 19 nt, Mycobacterium avium subsp. paratuberculosis
cgugugcuagcgagcgggc

SEQ ID NO: 2901438 - RNA, 14 nt, Mycobacterium avium subsp. paratuberculosis
cgugugcucagcuc

SEQ ID NO: 2901439 - RNA, 20 nt, Mycobacterium avium subsp. paratuberculosis
cgugugcucagcucccgagc

SEQ ID NO: 2901440 - RNA, 19 nt, Mycobacterium avium subsp. paratuberculosis
cguguggcccugcgucauc

SEQ ID NO: 2901441 - RNA, 17 nt, Mycobacterium avium subsp. paratuberculosis
cguguggcgcacgccca

SEQ ID NO: 2901442 - RNA, 18 nt, Mycobacterium avium subsp. paratuberculosis
cguguggcgcacgcccau

SEQ ID NO: 2901443 - RNA, 19 nt, Mycobacterium avium subsp. paratuberculosis
cguguggcgugugggcucg

SEQ ID NO: 2901444 - RNA, 22 nt, Mycobacterium avium subsp. paratuberculosis
cgugugggcgcccgcggcgcgc

SEQ ID NO: 2901445 - RNA, 21 nt, Mycobacterium avium subsp. paratuberculosis
cgugugguacagcgccagcgg

SEQ ID NO: 2901446 - RNA, 22 nt, Mycobacterium avium subsp. paratuberculosis
cgugugguacagcgccagcggc

SEQ ID NO: 2901447 - RNA, 22 nt, Mycobacterium avium subsp. paratuberculosis
cguguguaccauugcgccgguc

SEQ ID NO: 2901448 - RNA, 13 nt, Mycobacterium avium subsp. paratuberculosis
cguguucaacgcg

SEQ ID NO: 2901449 - RNA, 13 nt, Mycobacterium avium subsp. paratuberculosis
cguguucaccagc

SEQ ID NO: 2901450 - RNA, 16 nt, Mycobacterium avium subsp. paratuberculosis
cguguucaccagcggg

SEQ ID NO: 2901451 - RNA, 16 nt, Mycobacterium avium subsp. paratuberculosis
cguguuccuugcggcc

SEQ ID NO: 2901452 - RNA, 13 nt, Mycobacterium avium subsp. paratuberculosis
cguguucgccgag

SEQ ID NO: 2901453 - RNA, 21 nt, Mycobacterium avium subsp. paratuberculosis
cguguucgggaucggcgccca

SEQ ID NO: 2901454 - RNA, 14 nt, Mycobacterium avium subsp. paratuberculosis
cguguucucacggc

SEQ ID NO: 2901455 - RNA, 18 nt, Mycobacterium avium subsp. paratuberculosis
cguguucucacggcgaau

SEQ ID NO: 2901456 - RNA, 21 nt, Mycobacterium avium subsp. paratuberculosis
cguguucucacggcgaauauu

SEQ ID NO: 2901457 - RNA, 18 nt, Mycobacterium avium subsp. paratuberculosis
cguguugaucucgucgau

SEQ ID NO: 2901458 - RNA, 20 nt, Mycobacterium avium subsp. paratuberculosis
cguguugaucucgucgauga

SEQ ID NO: 2901459 - RNA, 16 nt, Mycobacterium avium subsp. paratuberculosis
cguguuggacgcccgc

SEQ ID NO: 2901460 - RNA, 18 nt, Mycobacterium avium subsp. paratuberculosis
cguguuggacgcccgcuc

SEQ ID NO: 2901461 - RNA, 21 nt, Mycobacterium avium subsp. paratuberculosis
cguguuguagucagacccugu

SEQ ID NO: 2901462 - RNA, 19 nt, Mycobacterium avium subsp. paratuberculosis
cguguuugcugcaugcgcu

SEQ ID NO: 2901463 - RNA, 18 nt, Mycobacterium avium subsp. paratuberculosis
cguuauuugugcgcuggc

SEQ ID NO: 2901464 - RNA, 20 nt, Mycobacterium avium subsp. paratuberculosis
cguucaacggccaaccgccc

SEQ ID NO: 2901465 - RNA, 19 nt, Mycobacterium avium subsp. paratuberculosis
cguucaccaccggagcggc

SEQ ID NO: 2901466 - RNA, 21 nt, Mycobacterium avium subsp. paratuberculosis
cguucaccaccggagcggcgg

SEQ ID NO: 2901467 - RNA, 14 nt, Mycobacterium avium subsp. paratuberculosis
cguucaccucuucg

SEQ ID NO: 2901468 - RNA, 16 nt, Mycobacterium avium subsp. paratuberculosis
cguucacgucgaucac

SEQ ID NO: 2901469 - RNA, 19 nt, Mycobacterium avium subsp. paratuberculosis
cguucagccggagccggcc

SEQ ID NO: 2901470 - RNA, 22 nt, Mycobacterium avium subsp. paratuberculosis
cguucagcgacuugccgccggc

SEQ ID NO: 2901471 - RNA, 16 nt, Mycobacterium avium subsp. paratuberculosis
cguucagcgcggccac

SEQ ID NO: 2901472 - RNA, 20 nt, Mycobacterium avium subsp. paratuberculosis
cguucagcggcaccgucacc

SEQ ID NO: 2901473 - RNA, 17 nt, Mycobacterium avium subsp. paratuberculosis
cguucaggucgaucagc

SEQ ID NO: 2901474 - RNA, 23 nt, Mycobacterium avium subsp. paratuberculosis
cguucaggucgaucagcggucca

SEQ ID NO: 2901475 - RNA, 14 nt, Mycobacterium avium subsp. paratuberculosis
cguucaugaucggc

SEQ ID NO: 2901476 - RNA, 15 nt, Mycobacterium avium subsp. paratuberculosis
cguuccacgcagauc

SEQ ID NO: 2901477 - RNA, 19 nt, Mycobacterium avium subsp. paratuberculosis
cguuccagccggcccgcau

SEQ ID NO: 2901478 - RNA, 21 nt, Mycobacterium avium subsp. paratuberculosis
cguuccagcgcacacaccgua

SEQ ID NO: 2901479 - RNA, 17 nt, Mycobacterium avium subsp. paratuberculosis
cguuccagguccgcggu

SEQ ID NO: 2901480 - RNA, 19 nt, Mycobacterium avium subsp. paratuberculosis
cguuccagguccgcggugg

SEQ ID NO: 2901481 - RNA, 22 nt, Mycobacterium avium subsp. paratuberculosis
cguuccaggugugccgcuggua

SEQ ID NO: 2901482 - RNA, 16 nt, Mycobacterium avium subsp. paratuberculosis
cguuccaucagcgccc

SEQ ID NO: 2901483 - RNA, 18 nt, Mycobacterium avium subsp. paratuberculosis
cguuccaucgggcccagc

SEQ ID NO: 2901484 - RNA, 15 nt, Mycobacterium avium subsp. paratuberculosis
cguucccaccggcuu

SEQ ID NO: 2901485 - RNA, 15 nt, Mycobacterium avium subsp. paratuberculosis
cguucccagcccggc

SEQ ID NO: 2901486 - RNA, 19 nt, Mycobacterium avium subsp. paratuberculosis
cguucccagcccggccagu

SEQ ID NO: 2901487 - RNA, 19 nt, Mycobacterium avium subsp. paratuberculosis
cguuccccggcgugggugu

SEQ ID NO: 2901488 - RNA, 13 nt, Mycobacterium avium subsp. paratuberculosis
cguucccgggccc

SEQ ID NO: 2901489 - RNA, 17 nt, Mycobacterium avium subsp. paratuberculosis
cguucccugcgcggcga

SEQ ID NO: 2901490 - RNA, 21 nt, Mycobacterium avium subsp. paratuberculosis
cguuccgaugaagaacacccc

SEQ ID NO: 2901491 - RNA, 21 nt, Mycobacterium avium subsp. paratuberculosis
cguuccgccacggcgggguca

SEQ ID NO: 2901492 - RNA, 12 nt, Mycobacterium avium subsp. paratuberculosis
cguuccgcgaca

SEQ ID NO: 2901493 - RNA, 16 nt, Mycobacterium avium subsp. paratuberculosis
cguuccgcgacaaggu

SEQ ID NO: 2901494 - RNA, 21 nt, Mycobacterium avium subsp. paratuberculosis
cguuccgcgacaaggucgacc

SEQ ID NO: 2901495 - RNA, 13 nt, Mycobacterium avium subsp. paratuberculosis
cguuccggcggcc

SEQ ID NO: 2901496 - RNA, 19 nt, Mycobacterium avium subsp. paratuberculosis
cguuccggcggccggcggc

SEQ ID NO: 2901497 - RNA, 18 nt, Mycobacterium avium subsp. paratuberculosis
cguuccuggugggcgaau

SEQ ID NO: 2901498 - RNA, 21 nt, Mycobacterium avium subsp. paratuberculosis
cguucgaauuguggcggccca

SEQ ID NO: 2901499 - RNA, 15 nt, Mycobacterium avium subsp. paratuberculosis
cguucgacgccggug

SEQ ID NO: 2901500 - RNA, 12 nt, Mycobacterium avium subsp. paratuberculosis
cguucgagcgcc

SEQ ID NO: 2901501 - RNA, 16 nt, Mycobacterium avium subsp. paratuberculosis
cguucgagcgccggac

SEQ ID NO: 2901502 - RNA, 21 nt, Mycobacterium avium subsp. paratuberculosis
cguucgaguucgucgaccagc

SEQ ID NO: 2901503 - RNA, 20 nt, Mycobacterium avium subsp. paratuberculosis
cguucgaugaugggcgaucg

SEQ ID NO: 2901504 - RNA, 16 nt, Mycobacterium avium subsp. paratuberculosis
cguucgaugucggcca

SEQ ID NO: 2901505 - RNA, 16 nt, Mycobacterium avium subsp. paratuberculosis
cguucgauugcaccac

SEQ ID NO: 2901506 - RNA, 14 nt, Mycobacterium avium subsp. paratuberculosis
cguucgccgacagc

SEQ ID NO: 2901507 - RNA, 15 nt, Mycobacterium avium subsp. paratuberculosis
cguucgccgacagca

SEQ ID NO: 2901508 - RNA, 16 nt, Mycobacterium avium subsp. paratuberculosis
cguucgccgacagcag

SEQ ID NO: 2901509 - RNA, 13 nt, Mycobacterium avium subsp. paratuberculosis
cguucgccgccag

SEQ ID NO: 2901510 - RNA, 14 nt, Mycobacterium avium subsp. paratuberculosis
cguucgccggccag

SEQ ID NO: 2901511 - RNA, 22 nt, Mycobacterium avium subsp. paratuberculosis
cguucgccggcguagaccagcg

SEQ ID NO: 2901512 - RNA, 15 nt, Mycobacterium avium subsp. paratuberculosis
cguucgccgguaccg

SEQ ID NO: 2901513 - RNA, 23 nt, Mycobacterium avium subsp. paratuberculosis
cguucgccgguaccgccggccag

SEQ ID NO: 2901514 - RNA, 19 nt, Mycobacterium avium subsp. paratuberculosis
cguucgcgcacggcgcgca

SEQ ID NO: 2901515 - RNA, 15 nt, Mycobacterium avium subsp. paratuberculosis
cguucgcggucgagc

SEQ ID NO: 2901516 - RNA, 21 nt, Mycobacterium avium subsp. paratuberculosis
cguucgcggugggcucgucga

SEQ ID NO: 2901517 - RNA, 14 nt, Mycobacterium avium subsp. paratuberculosis
cguucgcucucgcg

SEQ ID NO: 2901518 - RNA, 22 nt, Mycobacterium avium subsp. paratuberculosis
cguucgcugcccaacgucgacu

SEQ ID NO: 2901519 - RNA, 22 nt, Mycobacterium avium subsp. paratuberculosis
cguucgcugcccucggucgccg

SEQ ID NO: 2901520 - RNA, 16 nt, Mycobacterium avium subsp. paratuberculosis
cguucgcuuucgccgg

SEQ ID NO: 2901521 - RNA, 16 nt, Mycobacterium avium subsp. paratuberculosis
cguucggccagcgccg

SEQ ID NO: 2901522 - RNA, 12 nt, Mycobacterium avium subsp. paratuberculosis
cguucggccagu

SEQ ID NO: 2901523 - RNA, 22 nt, Mycobacterium avium subsp. paratuberculosis
cguucggccaguucggguccgc

SEQ ID NO: 2901524 - RNA, 15 nt, Mycobacterium avium subsp. paratuberculosis
cguucggccgcagcg

SEQ ID NO: 2901525 - RNA, 21 nt, Mycobacterium avium subsp. paratuberculosis
cguucggcgagugaggccgag

SEQ ID NO: 2901526 - RNA, 12 nt, Mycobacterium avium subsp. paratuberculosis
cguucggcgcca

SEQ ID NO: 2901527 - RNA, 16 nt, Mycobacterium avium subsp. paratuberculosis
cguucggcgccacccc

SEQ ID NO: 2901528 - RNA, 17 nt, Mycobacterium avium subsp. paratuberculosis
cguucggcgccaccccg

SEQ ID NO: 2901529 - RNA, 16 nt, Mycobacterium avium subsp. paratuberculosis
cguucggcgcggaucg

SEQ ID NO: 2901530 - RNA, 19 nt, Mycobacterium avium subsp. paratuberculosis
cguucggcggcgcgcugca

SEQ ID NO: 2901531 - RNA, 15 nt, Mycobacterium avium subsp. paratuberculosis
cguucggcgggcagg

SEQ ID NO: 2901532 - RNA, 21 nt, Mycobacterium avium subsp. paratuberculosis
cguucggcucugcagagcggu

SEQ ID NO: 2901533 - RNA, 18 nt, Mycobacterium avium subsp. paratuberculosis
cguucgggauccucgccg

SEQ ID NO: 2901534 - RNA, 20 nt, Mycobacterium avium subsp. paratuberculosis
cguucgggauccucgccgcg

SEQ ID NO: 2901535 - RNA, 14 nt, Mycobacterium avium subsp. paratuberculosis
cguucgggcccggc

SEQ ID NO: 2901536 - RNA, 17 nt, Mycobacterium avium subsp. paratuberculosis
cguucgggcccggccgc

SEQ ID NO: 2901537 - RNA, 23 nt, Mycobacterium avium subsp. paratuberculosis
cguucggguuacguggacgcgcg

SEQ ID NO: 2901538 - RNA, 18 nt, Mycobacterium avium subsp. paratuberculosis
cguucggucagcacgaca

SEQ ID NO: 2901539 - RNA, 13 nt, Mycobacterium avium subsp. paratuberculosis
cguucgguccgga

SEQ ID NO: 2901540 - RNA, 20 nt, Mycobacterium avium subsp. paratuberculosis
cguucguagggacugcgccg

SEQ ID NO: 2901541 - RNA, 15 nt, Mycobacterium avium subsp. paratuberculosis
cguucgucggcgcgu

SEQ ID NO: 2901542 - RNA, 16 nt, Mycobacterium avium subsp. paratuberculosis
cguucgucggcgcguc

SEQ ID NO: 2901543 - RNA, 21 nt, Mycobacterium avium subsp. paratuberculosis
cguucgugagcgguggccacg

SEQ ID NO: 2901544 - RNA, 14 nt, Mycobacterium avium subsp. paratuberculosis
cguucuccacccgc

SEQ ID NO: 2901545 - RNA, 16 nt, Mycobacterium avium subsp. paratuberculosis
cguucuccauccgggc

SEQ ID NO: 2901546 - RNA, 18 nt, Mycobacterium avium subsp. paratuberculosis
cguucuccauccgggcgg

SEQ ID NO: 2901547 - RNA, 15 nt, Mycobacterium avium subsp. paratuberculosis
cguucuccccgccgg

SEQ ID NO: 2901548 - RNA, 19 nt, Mycobacterium avium subsp. paratuberculosis
cguucuccgaggcguccuc

SEQ ID NO: 2901549 - RNA, 21 nt, Mycobacterium avium subsp. paratuberculosis
cguucuccgaggcguccuccu

SEQ ID NO: 2901550 - RNA, 22 nt, Mycobacterium avium subsp. paratuberculosis
cguucuccgaggcguccuccuc

SEQ ID NO: 2901551 - RNA, 13 nt, Mycobacterium avium subsp. paratuberculosis
cguucucggcgaa

SEQ ID NO: 2901552 - RNA, 19 nt, Mycobacterium avium subsp. paratuberculosis
cguucucgggggcgggcac

SEQ ID NO: 2901553 - RNA, 21 nt, Mycobacterium avium subsp. paratuberculosis
cguucuggcccgccaucgccc

SEQ ID NO: 2901554 - RNA, 17 nt, Mycobacterium avium subsp. paratuberculosis
cguugaaaguccuugcu

SEQ ID NO: 2901555 - RNA, 19 nt, Mycobacterium avium subsp. paratuberculosis
cguugaacaguucggugca

SEQ ID NO: 2901556 - RNA, 21 nt, Mycobacterium avium subsp. paratuberculosis
cguugaacgacaucaccaccg

SEQ ID NO: 2901557 - RNA, 17 nt, Mycobacterium avium subsp. paratuberculosis
cguugaacgcgcgggug

SEQ ID NO: 2901558 - RNA, 17 nt, Mycobacterium avium subsp. paratuberculosis
cguugaccaacgccgcc

SEQ ID NO: 2901559 - RNA, 18 nt, Mycobacterium avium subsp. paratuberculosis
cguugaccaacgccgccu

SEQ ID NO: 2901560 - RNA, 18 nt, Mycobacterium avium subsp. paratuberculosis
cguugaccaccagguagg

SEQ ID NO: 2901561 - RNA, 14 nt, Mycobacterium avium subsp. paratuberculosis
cguugaccagaccg

SEQ ID NO: 2901562 - RNA, 21 nt, Mycobacterium avium subsp. paratuberculosis
cguugaccccgacggcgccgc

SEQ ID NO: 2901563 - RNA, 23 nt, Mycobacterium avium subsp. paratuberculosis
cguugaccccgacggcgccgcgg

SEQ ID NO: 2901564 - RNA, 16 nt, Mycobacterium avium subsp. paratuberculosis
cguugaccgcggcgau

SEQ ID NO: 2901565 - RNA, 19 nt, Mycobacterium avium subsp. paratuberculosis
cguugaccgggccgcuggu

SEQ ID NO: 2901566 - RNA, 14 nt, Mycobacterium avium subsp. paratuberculosis
cguugaccgggucg

SEQ ID NO: 2901567 - RNA, 17 nt, Mycobacterium avium subsp. paratuberculosis
cguugaccgggucgccg

SEQ ID NO: 2901568 - RNA, 22 nt, Mycobacterium avium subsp. paratuberculosis
cguugaccgggucgccgaucac

SEQ ID NO: 2901569 - RNA, 21 nt, Mycobacterium avium subsp. paratuberculosis
cguugaccugcuugagcccgu

SEQ ID NO: 2901570 - RNA, 21 nt, Mycobacterium avium subsp. paratuberculosis
cguugacgaccuugucgcgca

SEQ ID NO: 2901571 - RNA, 23 nt, Mycobacterium avium subsp. paratuberculosis
cguugagcacacccagcgagccg

SEQ ID NO: 2901572 - RNA, 15 nt, Mycobacterium avium subsp. paratuberculosis
cguugagcacccgga

SEQ ID NO: 2901573 - RNA, 14 nt, Mycobacterium avium subsp. paratuberculosis
cguugagcaccgcg

SEQ ID NO: 2901574 - RNA, 18 nt, Mycobacterium avium subsp. paratuberculosis
cguugagcaccgcgaaga

SEQ ID NO: 2901575 - RNA, 15 nt, Mycobacterium avium subsp. paratuberculosis
cguugagcacgcccg

SEQ ID NO: 2901576 - RNA, 17 nt, Mycobacterium avium subsp. paratuberculosis
cguugagcacgcccgcg

SEQ ID NO: 2901577 - RNA, 20 nt, Mycobacterium avium subsp. paratuberculosis
cguugagcacgcccgcgauc

SEQ ID NO: 2901578 - RNA, 15 nt, Mycobacterium avium subsp. paratuberculosis
cguugagcacgcgga

SEQ ID NO: 2901579 - RNA, 15 nt, Mycobacterium avium subsp. paratuberculosis
cguugagcaggcugg

SEQ ID NO: 2901580 - RNA, 17 nt, Mycobacterium avium subsp. paratuberculosis
cguugagcaggcuggag

SEQ ID NO: 2901581 - RNA, 13 nt, Mycobacterium avium subsp. paratuberculosis
cguugagcccgga

SEQ ID NO: 2901582 - RNA, 15 nt, Mycobacterium avium subsp. paratuberculosis
cguugagcccggacc

SEQ ID NO: 2901583 - RNA, 22 nt, Mycobacterium avium subsp. paratuberculosis
cguugagcccggaccggccgug

SEQ ID NO: 2901584 - RNA, 16 nt, Mycobacterium avium subsp. paratuberculosis
cguugagccggcgcac

SEQ ID NO: 2901585 - RNA, 18 nt, Mycobacterium avium subsp. paratuberculosis
cguugagccggcgcaccg

SEQ ID NO: 2901586 - RNA, 15 nt, Mycobacterium avium subsp. paratuberculosis
cguugagcgucgcca

SEQ ID NO: 2901587 - RNA, 17 nt, Mycobacterium avium subsp. paratuberculosis
cguugagcgucgccacc

SEQ ID NO: 2901588 - RNA, 18 nt, Mycobacterium avium subsp. paratuberculosis
cguugagcgucgccacca

SEQ ID NO: 2901589 - RNA, 19 nt, Mycobacterium avium subsp. paratuberculosis
cguugagcgucgccaccac

SEQ ID NO: 2901590 - RNA, 16 nt, Mycobacterium avium subsp. paratuberculosis
cguugagcuucucggu

SEQ ID NO: 2901591 - RNA, 11 nt, Mycobacterium avium subsp. paratuberculosis
cguugaggcga

SEQ ID NO: 2901592 - RNA, 14 nt, Mycobacterium avium subsp. paratuberculosis
cguugaggcgagcc

SEQ ID NO: 2901593 - RNA, 15 nt, Mycobacterium avium subsp. paratuberculosis
cguugaggcgagccg

SEQ ID NO: 2901594 - RNA, 12 nt, Mycobacterium avium subsp. paratuberculosis
cguugaggcggc

SEQ ID NO: 2901595 - RNA, 19 nt, Mycobacterium avium subsp. paratuberculosis
cguugaggcggcggcgggc

SEQ ID NO: 2901596 - RNA, 22 nt, Mycobacterium avium subsp. paratuberculosis
cguugaggcggcggcgggccag

SEQ ID NO: 2901597 - RNA, 20 nt, Mycobacterium avium subsp. paratuberculosis
cguugagggcggggcagcag

SEQ ID NO: 2901598 - RNA, 22 nt, Mycobacterium avium subsp. paratuberculosis
cguugagggcggggcagcagug

SEQ ID NO: 2901599 - RNA, 19 nt, Mycobacterium avium subsp. paratuberculosis
cguugagucccucggcgag

SEQ ID NO: 2901600 - RNA, 23 nt, Mycobacterium avium subsp. paratuberculosis
cguugagugcgcuguggugacgg

SEQ ID NO: 2901601 - RNA, 13 nt, Mycobacterium avium subsp. paratuberculosis
cguugaucagggc

SEQ ID NO: 2901602 - RNA, 17 nt, Mycobacterium avium subsp. paratuberculosis
cguugaucaggugcagc

SEQ ID NO: 2901603 - RNA, 18 nt, Mycobacterium avium subsp. paratuberculosis
cguugaucaugucgaugc

SEQ ID NO: 2901604 - RNA, 13 nt, Mycobacterium avium subsp. paratuberculosis
cguugaucgagca

SEQ ID NO: 2901605 - RNA, 20 nt, Mycobacterium avium subsp. paratuberculosis
cguugaucgagcaccgggcg

SEQ ID NO: 2901606 - RNA, 15 nt, Mycobacterium avium subsp. paratuberculosis
cguugaucuugaccg

SEQ ID NO: 2901607 - RNA, 22 nt, Mycobacterium avium subsp. paratuberculosis
cguugaugaaacuuccgcccgg

SEQ ID NO: 2901608 - RNA, 21 nt, Mycobacterium avium subsp. paratuberculosis
cguugaugaagaccuggccgg

SEQ ID NO: 2901609 - RNA, 17 nt, Mycobacterium avium subsp. paratuberculosis
cguugaugccgcccagc

SEQ ID NO: 2901610 - RNA, 19 nt, Mycobacterium avium subsp. paratuberculosis
cguugaugccgcccagcag

SEQ ID NO: 2901611 - RNA, 20 nt, Mycobacterium avium subsp. paratuberculosis
cguugaugccgucgaucacc

SEQ ID NO: 2901612 - RNA, 16 nt, Mycobacterium avium subsp. paratuberculosis
cguugaugcgcaccgc

SEQ ID NO: 2901613 - RNA, 17 nt, Mycobacterium avium subsp. paratuberculosis
cguugaugcgcaccgcg

SEQ ID NO: 2901614 - RNA, 20 nt, Mycobacterium avium subsp. paratuberculosis
cguugaugcgcaccgcggcg

SEQ ID NO: 2901615 - RNA, 21 nt, Mycobacterium avium subsp. paratuberculosis
cguugaugcgcaccgcggcgu

SEQ ID NO: 2901616 - RNA, 15 nt, Mycobacterium avium subsp. paratuberculosis
cguugaugucggcca

SEQ ID NO: 2901617 - RNA, 16 nt, Mycobacterium avium subsp. paratuberculosis
cguugaugucggccag

SEQ ID NO: 2901618 - RNA, 20 nt, Mycobacterium avium subsp. paratuberculosis
cguugauugaccauccgguc

SEQ ID NO: 2901619 - RNA, 18 nt, Mycobacterium avium subsp. paratuberculosis
cguugauugcgcccgccg

SEQ ID NO: 2901620 - RNA, 18 nt, Mycobacterium avium subsp. paratuberculosis
cguugcacaccaccagcg

SEQ ID NO: 2901621 - RNA, 16 nt, Mycobacterium avium subsp. paratuberculosis
cguugcacacccggug

SEQ ID NO: 2901622 - RNA, 19 nt, Mycobacterium avium subsp. paratuberculosis
cguugcacacccggugcgc

SEQ ID NO: 2901623 - RNA, 12 nt, Mycobacterium avium subsp. paratuberculosis
cguugcaccgcg

SEQ ID NO: 2901624 - RNA, 16 nt, Mycobacterium avium subsp. paratuberculosis
cguugcaccgcgggca

SEQ ID NO: 2901625 - RNA, 13 nt, Mycobacterium avium subsp. paratuberculosis
cguugcagcgccg

SEQ ID NO: 2901626 - RNA, 14 nt, Mycobacterium avium subsp. paratuberculosis
cguugcagcgccgc

SEQ ID NO: 2901627 - RNA, 17 nt, Mycobacterium avium subsp. paratuberculosis
cguugcagcgccgcggc

SEQ ID NO: 2901628 - RNA, 16 nt, Mycobacterium avium subsp. paratuberculosis
cguugcauuucggcgu

SEQ ID NO: 2901629 - RNA, 20 nt, Mycobacterium avium subsp. paratuberculosis
cguugcauuucggcguccuc

SEQ ID NO: 2901630 - RNA, 17 nt, Mycobacterium avium subsp. paratuberculosis
cguugccaggccgcgag

SEQ ID NO: 2901631 - RNA, 22 nt, Mycobacterium avium subsp. paratuberculosis
cguugcccaggaaguagccggc

SEQ ID NO: 2901632 - RNA, 23 nt, Mycobacterium avium subsp. paratuberculosis
cguugcccaggaaguagccggcc

SEQ ID NO: 2901633 - RNA, 17 nt, Mycobacterium avium subsp. paratuberculosis
cguugcccgaucagccg

SEQ ID NO: 2901634 - RNA, 19 nt, Mycobacterium avium subsp. paratuberculosis
cguugcccgaucagccggg

SEQ ID NO: 2901635 - RNA, 14 nt, Mycobacterium avium subsp. paratuberculosis
cguugcccgccagc

SEQ ID NO: 2901636 - RNA, 16 nt, Mycobacterium avium subsp. paratuberculosis
cguugcccgccagcau

SEQ ID NO: 2901637 - RNA, 13 nt, Mycobacterium avium subsp. paratuberculosis
cguugcccgccgc

SEQ ID NO: 2901638 - RNA, 23 nt, Mycobacterium avium subsp. paratuberculosis
cguugcccgccgcggcgagccgg

SEQ ID NO: 2901639 - RNA, 20 nt, Mycobacterium avium subsp. paratuberculosis
cguugccgcacaccgcgcag

SEQ ID NO: 2901640 - RNA, 16 nt, Mycobacterium avium subsp. paratuberculosis
cguugccgccgcgcgc

SEQ ID NO: 2901641 - RNA, 18 nt, Mycobacterium avium subsp. paratuberculosis
cguugccgccgcgcgcgg

SEQ ID NO: 2901642 - RNA, 13 nt, Mycobacterium avium subsp. paratuberculosis
cguugccgccggc

SEQ ID NO: 2901643 - RNA, 14 nt, Mycobacterium avium subsp. paratuberculosis
cguugccgccggcg

SEQ ID NO: 2901644 - RNA, 15 nt, Mycobacterium avium subsp. paratuberculosis
cguugccgccggcgc

SEQ ID NO: 2901645 - RNA, 14 nt, Mycobacterium avium subsp. paratuberculosis
cguugccgcgcgcc

SEQ ID NO: 2901646 - RNA, 20 nt, Mycobacterium avium subsp. paratuberculosis
cguugccgcgcgcccgcggc

SEQ ID NO: 2901647 - RNA, 21 nt, Mycobacterium avium subsp. paratuberculosis
cguugccggcccgcagcgccu

SEQ ID NO: 2901648 - RNA, 16 nt, Mycobacterium avium subsp. paratuberculosis
cguugccggccgaagu

SEQ ID NO: 2901649 - RNA, 17 nt, Mycobacterium avium subsp. paratuberculosis
cguugccggcggccagc

SEQ ID NO: 2901650 - RNA, 18 nt, Mycobacterium avium subsp. paratuberculosis
cguugccggcggccagca

SEQ ID NO: 2901651 - RNA, 14 nt, Mycobacterium avium subsp. paratuberculosis
cguugccggcggcg

SEQ ID NO: 2901652 - RNA, 20 nt, Mycobacterium avium subsp. paratuberculosis
cguugccggucccguugauc

SEQ ID NO: 2901653 - RNA, 20 nt, Mycobacterium avium subsp. paratuberculosis
cguugccggugccgacgauc

SEQ ID NO: 2901654 - RNA, 20 nt, Mycobacterium avium subsp. paratuberculosis
cguugcgagucaucgccacc

SEQ ID NO: 2901655 - RNA, 16 nt, Mycobacterium avium subsp. paratuberculosis
cguugcgcaucagcgc

SEQ ID NO: 2901656 - RNA, 21 nt, Mycobacterium avium subsp. paratuberculosis
cguugcgccagcaccgacagc

SEQ ID NO: 2901657 - RNA, 14 nt, Mycobacterium avium subsp. paratuberculosis
cguugcgccagcag

SEQ ID NO: 2901658 - RNA, 15 nt, Mycobacterium avium subsp. paratuberculosis
cguugcgccagcagg

SEQ ID NO: 2901659 - RNA, 23 nt, Mycobacterium avium subsp. paratuberculosis
cguugcgccccacggucuuugcc

SEQ ID NO: 2901660 - RNA, 13 nt, Mycobacterium avium subsp. paratuberculosis
cguugcgcccggc

SEQ ID NO: 2901661 - RNA, 20 nt, Mycobacterium avium subsp. paratuberculosis
cguugcgccgcaacggcgca

SEQ ID NO: 2901662 - RNA, 13 nt, Mycobacterium avium subsp. paratuberculosis
cguugcgccgcca

SEQ ID NO: 2901663 - RNA, 15 nt, Mycobacterium avium subsp. paratuberculosis
cguugcgccgcgagc

SEQ ID NO: 2901664 - RNA, 20 nt, Mycobacterium avium subsp. paratuberculosis
cguugcgccgcgagcgcagc

SEQ ID NO: 2901665 - RNA, 21 nt, Mycobacterium avium subsp. paratuberculosis
cguugcgcucuguuggccguc

SEQ ID NO: 2901666 - RNA, 12 nt, Mycobacterium avium subsp. paratuberculosis
cguugcggaucu

SEQ ID NO: 2901667 - RNA, 14 nt, Mycobacterium avium subsp. paratuberculosis
cguugcggccgucc

SEQ ID NO: 2901668 - RNA, 15 nt, Mycobacterium avium subsp. paratuberculosis
cguugcggccgucca

SEQ ID NO: 2901669 - RNA, 21 nt, Mycobacterium avium subsp. paratuberculosis
cguugcggccguccagcgucu

SEQ ID NO: 2901670 - RNA, 15 nt, Mycobacterium avium subsp. paratuberculosis
cguugcgggccaggu

SEQ ID NO: 2901671 - RNA, 19 nt, Mycobacterium avium subsp. paratuberculosis
cguugcgggccaggucgag

SEQ ID NO: 2901672 - RNA, 20 nt, Mycobacterium avium subsp. paratuberculosis
cguugcgggccaggucgagc

SEQ ID NO: 2901673 - RNA, 15 nt, Mycobacterium avium subsp. paratuberculosis
cguugcgggcggcgc

SEQ ID NO: 2901674 - RNA, 20 nt, Mycobacterium avium subsp. paratuberculosis
cguugcgggcggcgcggcgc

SEQ ID NO: 2901675 - RNA, 15 nt, Mycobacterium avium subsp. paratuberculosis
cguugcgggucggcg

SEQ ID NO: 2901676 - RNA, 18 nt, Mycobacterium avium subsp. paratuberculosis
cguugcgggugucgccgg

SEQ ID NO: 2901677 - RNA, 20 nt, Mycobacterium avium subsp. paratuberculosis
cguugcgggugucgccggug

SEQ ID NO: 2901678 - RNA, 13 nt, Mycobacterium avium subsp. paratuberculosis
cguugcggugacg

SEQ ID NO: 2901679 - RNA, 15 nt, Mycobacterium avium subsp. paratuberculosis
cguugcggugacgau

SEQ ID NO: 2901680 - RNA, 20 nt, Mycobacterium avium subsp. paratuberculosis
cguugcgucccgcgccggag

SEQ ID NO: 2901681 - RNA, 19 nt, Mycobacterium avium subsp. paratuberculosis
cguugcugcguucggcgau

SEQ ID NO: 2901682 - RNA, 20 nt, Mycobacterium avium subsp. paratuberculosis
cguugcugcguucggcgauc

SEQ ID NO: 2901683 - RNA, 18 nt, Mycobacterium avium subsp. paratuberculosis
cguugcuggcgcgauagc

SEQ ID NO: 2901684 - RNA, 17 nt, Mycobacterium avium subsp. paratuberculosis
cguuggacagcucgacg

SEQ ID NO: 2901685 - RNA, 18 nt, Mycobacterium avium subsp. paratuberculosis
cguuggacuccaccgcca

SEQ ID NO: 2901686 - RNA, 19 nt, Mycobacterium avium subsp. paratuberculosis
cguuggagccgaccagcgc

SEQ ID NO: 2901687 - RNA, 22 nt, Mycobacterium avium subsp. paratuberculosis
cguuggaggugaucgccagccc

SEQ ID NO: 2901688 - RNA, 18 nt, Mycobacterium avium subsp. paratuberculosis
cguuggcaggcccgguag

SEQ ID NO: 2901689 - RNA, 20 nt, Mycobacterium avium subsp. paratuberculosis
cguuggcaggcccgguagau

SEQ ID NO: 2901690 - RNA, 13 nt, Mycobacterium avium subsp. paratuberculosis
cguuggccagcac

SEQ ID NO: 2901691 - RNA, 15 nt, Mycobacterium avium subsp. paratuberculosis
cguuggccagcaccg

SEQ ID NO: 2901692 - RNA, 17 nt, Mycobacterium avium subsp. paratuberculosis
cguuggccagcaccgcg

SEQ ID NO: 2901693 - RNA, 17 nt, Mycobacterium avium subsp. paratuberculosis
cguuggccagcucggcc

SEQ ID NO: 2901694 - RNA, 21 nt, Mycobacterium avium subsp. paratuberculosis
cguuggccagguugcgccguc

SEQ ID NO: 2901695 - RNA, 22 nt, Mycobacterium avium subsp. paratuberculosis
cguuggccagguugcgccgucc

SEQ ID NO: 2901696 - RNA, 13 nt, Mycobacterium avium subsp. paratuberculosis
cguuggcccgcac

SEQ ID NO: 2901697 - RNA, 17 nt, Mycobacterium avium subsp. paratuberculosis
cguuggcccgcacccgc

SEQ ID NO: 2901698 - RNA, 21 nt, Mycobacterium avium subsp. paratuberculosis
cguuggcccgcacccgccgcc

SEQ ID NO: 2901699 - RNA, 15 nt, Mycobacterium avium subsp. paratuberculosis
cguuggcccgccgcg

SEQ ID NO: 2901700 - RNA, 16 nt, Mycobacterium avium subsp. paratuberculosis
cguuggcccgccgcgg

SEQ ID NO: 2901701 - RNA, 18 nt, Mycobacterium avium subsp. paratuberculosis
cguuggcccgccgcggcu

SEQ ID NO: 2901702 - RNA, 19 nt, Mycobacterium avium subsp. paratuberculosis
cguuggcccgugucgcggc

SEQ ID NO: 2901703 - RNA, 15 nt, Mycobacterium avium subsp. paratuberculosis
cguuggccgagcagc

SEQ ID NO: 2901704 - RNA, 16 nt, Mycobacterium avium subsp. paratuberculosis
cguuggccgagcagcc

SEQ ID NO: 2901705 - RNA, 15 nt, Mycobacterium avium subsp. paratuberculosis
cguuggccgccgccu

SEQ ID NO: 2901706 - RNA, 15 nt, Mycobacterium avium subsp. paratuberculosis
cguuggccggcugga

SEQ ID NO: 2901707 - RNA, 18 nt, Mycobacterium avium subsp. paratuberculosis
cguuggcgaucucgaugg

SEQ ID NO: 2901708 - RNA, 14 nt, Mycobacterium avium subsp. paratuberculosis
cguuggcgccgguc

SEQ ID NO: 2901709 - RNA, 14 nt, Mycobacterium avium subsp. paratuberculosis
cguuggcgccgucc

SEQ ID NO: 2901710 - RNA, 14 nt, Mycobacterium avium subsp. paratuberculosis
cguuggcggccagc

SEQ ID NO: 2901711 - RNA, 16 nt, Mycobacterium avium subsp. paratuberculosis
cguuggcggccagcgc

SEQ ID NO: 2901712 - RNA, 17 nt, Mycobacterium avium subsp. paratuberculosis
cguuggcggccagcgcg

SEQ ID NO: 2901713 - RNA, 22 nt, Mycobacterium avium subsp. paratuberculosis
cguuggcggccagcgcgccgcc

SEQ ID NO: 2901714 - RNA, 23 nt, Mycobacterium avium subsp. paratuberculosis
cguuggcggccagcgcgccgccg

SEQ ID NO: 2901715 - RNA, 23 nt, Mycobacterium avium subsp. paratuberculosis
cguuggcggcggugggcugggcg

SEQ ID NO: 2901716 - RNA, 23 nt, Mycobacterium avium subsp. paratuberculosis
cguuggcguggauggccggccgg

SEQ ID NO: 2901717 - RNA, 19 nt, Mycobacterium avium subsp. paratuberculosis
cguuggcuuccucgcugac

SEQ ID NO: 2901718 - RNA, 20 nt, Mycobacterium avium subsp. paratuberculosis
cguuggcuuuucgggccggc

SEQ ID NO: 2901719 - RNA, 17 nt, Mycobacterium avium subsp. paratuberculosis
cguugggcaacgcggca

SEQ ID NO: 2901720 - RNA, 17 nt, Mycobacterium avium subsp. paratuberculosis
cguugggcagcucggcg

SEQ ID NO: 2901721 - RNA, 14 nt, Mycobacterium avium subsp. paratuberculosis
cguugggccagaac

SEQ ID NO: 2901722 - RNA, 21 nt, Mycobacterium avium subsp. paratuberculosis
cguugggccagcggcgccggg

SEQ ID NO: 2901723 - RNA, 17 nt, Mycobacterium avium subsp. paratuberculosis
cguugggcgggaucgcg

SEQ ID NO: 2901724 - RNA, 16 nt, Mycobacterium avium subsp. paratuberculosis
cguugggggcgccgcg

SEQ ID NO: 2901725 - RNA, 18 nt, Mycobacterium avium subsp. paratuberculosis
cguugggggcgccgcggc

SEQ ID NO: 2901726 - RNA, 18 nt, Mycobacterium avium subsp. paratuberculosis
cguugggggucgacuggg

SEQ ID NO: 2901727 - RNA, 22 nt, Mycobacterium avium subsp. paratuberculosis
cguugggguccucgauggcggc

SEQ ID NO: 2901728 - RNA, 17 nt, Mycobacterium avium subsp. paratuberculosis
cguuggucaccaucagc

SEQ ID NO: 2901729 - RNA, 19 nt, Mycobacterium avium subsp. paratuberculosis
cguuggugaucgccgacgu

SEQ ID NO: 2901730 - RNA, 18 nt, Mycobacterium avium subsp. paratuberculosis
cguuggugaugcggucgg

SEQ ID NO: 2901731 - RNA, 17 nt, Mycobacterium avium subsp. paratuberculosis
cguuggugcgcaccagc

SEQ ID NO: 2901732 - RNA, 19 nt, Mycobacterium avium subsp. paratuberculosis
cguuggugcgcaccagcag

SEQ ID NO: 2901733 - RNA, 21 nt, Mycobacterium avium subsp. paratuberculosis
cguugguggucgacgcgccgc

SEQ ID NO: 2901734 - RNA, 16 nt, Mycobacterium avium subsp. paratuberculosis
cguugguugcggcccc

SEQ ID NO: 2901735 - RNA, 23 nt, Mycobacterium avium subsp. paratuberculosis
cguugguugcggccccgccagca

SEQ ID NO: 2901736 - RNA, 15 nt, Mycobacterium avium subsp. paratuberculosis
cguuguaguagaccu

SEQ ID NO: 2901737 - RNA, 15 nt, Mycobacterium avium subsp. paratuberculosis
cguuguccacccccg

SEQ ID NO: 2901738 - RNA, 13 nt, Mycobacterium avium subsp. paratuberculosis
cguuguccagcag

SEQ ID NO: 2901739 - RNA, 15 nt, Mycobacterium avium subsp. paratuberculosis
cguuguccagcagcg

SEQ ID NO: 2901740 - RNA, 17 nt, Mycobacterium avium subsp. paratuberculosis
cguuguccagcagcgcc

SEQ ID NO: 2901741 - RNA, 23 nt, Mycobacterium avium subsp. paratuberculosis
cguuguccagcagcgccggcagc

SEQ ID NO: 2901742 - RNA, 13 nt, Mycobacterium avium subsp. paratuberculosis
cguugucgagcga

SEQ ID NO: 2901743 - RNA, 17 nt, Mycobacterium avium subsp. paratuberculosis
cguugucgagcgagccg

SEQ ID NO: 2901744 - RNA, 19 nt, Mycobacterium avium subsp. paratuberculosis
cguugucgaggucggugag

SEQ ID NO: 2901745 - RNA, 13 nt, Mycobacterium avium subsp. paratuberculosis
cguugucgcccgg

SEQ ID NO: 2901746 - RNA, 19 nt, Mycobacterium avium subsp. paratuberculosis
cguugucgcggcccagcac

SEQ ID NO: 2901747 - RNA, 16 nt, Mycobacterium avium subsp. paratuberculosis
cguugucggcgacggc

SEQ ID NO: 2901748 - RNA, 20 nt, Mycobacterium avium subsp. paratuberculosis
cguugucggcggucugagcc

SEQ ID NO: 2901749 - RNA, 17 nt, Mycobacterium avium subsp. paratuberculosis
cguugucgucgccggcc

SEQ ID NO: 2901750 - RNA, 20 nt, Mycobacterium avium subsp. paratuberculosis
cguugucgucggggcuggcg

SEQ ID NO: 2901751 - RNA, 16 nt, Mycobacterium avium subsp. paratuberculosis
cguugucguucucccc

SEQ ID NO: 2901752 - RNA, 18 nt, Mycobacterium avium subsp. paratuberculosis
cguugucguucuccccgc

SEQ ID NO: 2901753 - RNA, 15 nt, Mycobacterium avium subsp. paratuberculosis
cguugugacccgcuc

SEQ ID NO: 2901754 - RNA, 17 nt, Mycobacterium avium subsp. paratuberculosis
cguugugacccgcucgg

SEQ ID NO: 2901755 - RNA, 18 nt, Mycobacterium avium subsp. paratuberculosis
cguugugacccgcucggg

SEQ ID NO: 2901756 - RNA, 19 nt, Mycobacterium avium subsp. paratuberculosis
cguugugccaccgccgaug

SEQ ID NO: 2901757 - RNA, 20 nt, Mycobacterium avium subsp. paratuberculosis
cguugugccaccgccgaugg

SEQ ID NO: 2901758 - RNA, 20 nt, Mycobacterium avium subsp. paratuberculosis
cguugugggccagcgcggug

SEQ ID NO: 2901759 - RNA, 17 nt, Mycobacterium avium subsp. paratuberculosis
cguuguucaggucgaug

SEQ ID NO: 2901760 - RNA, 18 nt, Mycobacterium avium subsp. paratuberculosis
cguuguucaggucgaugg

SEQ ID NO: 2901761 - RNA, 21 nt, Mycobacterium avium subsp. paratuberculosis
cguuguuccacgugucggcgu

SEQ ID NO: 2901762 - RNA, 22 nt, Mycobacterium avium subsp. paratuberculosis
cguuguugagcagauccugcag

SEQ ID NO: 2901763 - RNA, 14 nt, Mycobacterium avium subsp. paratuberculosis
cguuguugcgcggg

SEQ ID NO: 2901764 - RNA, 15 nt, Mycobacterium avium subsp. paratuberculosis
cguuguugcucggcg

SEQ ID NO: 2901765 - RNA, 18 nt, Mycobacterium avium subsp. paratuberculosis
cguuguugcucggcggcc

SEQ ID NO: 2901766 - RNA, 21 nt, Mycobacterium avium subsp. paratuberculosis
cguuguuguugccggucggga

SEQ ID NO: 2901767 - RNA, 12 nt, Mycobacterium avium subsp. paratuberculosis
cguuuccagcgc

SEQ ID NO: 2901768 - RNA, 14 nt, Mycobacterium avium subsp. paratuberculosis
cguuuccagcgccg

SEQ ID NO: 2901769 - RNA, 20 nt, Mycobacterium avium subsp. paratuberculosis
cguuucggccggccccgccc

SEQ ID NO: 2901770 - RNA, 16 nt, Mycobacterium avium subsp. paratuberculosis
cguuugaugccguccg

SEQ ID NO: 2901771 - RNA, 18 nt, Mycobacterium avium subsp. paratuberculosis
cguuugccgucgaggggg

SEQ ID NO: 2901772 - RNA, 14 nt, Mycobacterium avium subsp. paratuberculosis
cguuuuccagccgg

SEQ ID NO: 2901773 - RNA, 14 nt, Mycobacterium avium subsp. paratuberculosis
cguuuucggcgcgc

SEQ ID NO: 2901774 - RNA, 22 nt, Mycobacterium avium subsp. paratuberculosis
cguuuugaaauccgggcgcgga

SEQ ID NO: 2901775 - RNA, 16 nt, Mycobacterium avium subsp. paratuberculosis
cguuuuuguggguggu

SEQ ID NO: 2901776 - RNA, 19 nt, Mycobacterium avium subsp. paratuberculosis
cuaaaccccacggccgcaa

SEQ ID NO: 2901777 - RNA, 15 nt, Mycobacterium avium subsp. paratuberculosis
cuaaagccgacugcc

SEQ ID NO: 2901778 - RNA, 18 nt, Mycobacterium avium subsp. paratuberculosis
cuaaccgcgggcaucgcc

SEQ ID NO: 2901779 - RNA, 15 nt, Mycobacterium avium subsp. paratuberculosis
cuaacgccagcuggg

SEQ ID NO: 2901780 - RNA, 21 nt, Mycobacterium avium subsp. paratuberculosis
cuaacgccagcugggcagcca

SEQ ID NO: 2901781 - RNA, 15 nt, Mycobacterium avium subsp. paratuberculosis
cuaacggcgcggcag

SEQ ID NO: 2901782 - RNA, 14 nt, Mycobacterium avium subsp. paratuberculosis
cuaacgugcccggc

SEQ ID NO: 2901783 - RNA, 23 nt, Mycobacterium avium subsp. paratuberculosis
cuaacgugcccggcccaggcaca

SEQ ID NO: 2901784 - RNA, 18 nt, Mycobacterium avium subsp. paratuberculosis
cuaacuccgcucgggccc

SEQ ID NO: 2901785 - RNA, 23 nt, Mycobacterium avium subsp. paratuberculosis
cuaacugagcccggcgacgaagc

SEQ ID NO: 2901786 - RNA, 19 nt, Mycobacterium avium subsp. paratuberculosis
cuaacuguugucagccacu

SEQ ID NO: 2901787 - RNA, 22 nt, Mycobacterium avium subsp. paratuberculosis
cuaagcgcugaaccgguagucg

SEQ ID NO: 2901788 - RNA, 14 nt, Mycobacterium avium subsp. paratuberculosis
cuaaggccgcugcc

SEQ ID NO: 2901789 - RNA, 18 nt, Mycobacterium avium subsp. paratuberculosis
cuaaggccgcugcccggc

SEQ ID NO: 2901790 - RNA, 19 nt, Mycobacterium avium subsp. paratuberculosis
cuaaggccgcugcccggcg

SEQ ID NO: 2901791 - RNA, 22 nt, Mycobacterium avium subsp. paratuberculosis
cuaaucgccgcgcguuccagca

SEQ ID NO: 2901792 - RNA, 17 nt, Mycobacterium avium subsp. paratuberculosis
cuaaugcaucgaugccg

SEQ ID NO: 2901793 - RNA, 14 nt, Mycobacterium avium subsp. paratuberculosis
cuacaggugccggc

SEQ ID NO: 2901794 - RNA, 17 nt, Mycobacterium avium subsp. paratuberculosis
cuacaggugccggcggc

SEQ ID NO: 2901795 - RNA, 20 nt, Mycobacterium avium subsp. paratuberculosis
cuaccaggcgugcacccggu

SEQ ID NO: 2901796 - RNA, 14 nt, Mycobacterium avium subsp. paratuberculosis
cuacccguccagcg

SEQ ID NO: 2901797 - RNA, 14 nt, Mycobacterium avium subsp. paratuberculosis
cuaccgccgggcgg

SEQ ID NO: 2901798 - RNA, 16 nt, Mycobacterium avium subsp. paratuberculosis
cuaccgccgggcgggc

SEQ ID NO: 2901799 - RNA, 23 nt, Mycobacterium avium subsp. paratuberculosis
cuaccgccgggcgggccgcagca

SEQ ID NO: 2901800 - RNA, 22 nt, Mycobacterium avium subsp. paratuberculosis
cuaccgcgcccaggggagcggc

SEQ ID NO: 2901801 - RNA, 17 nt, Mycobacterium avium subsp. paratuberculosis
cuaccggcucggcccgg

SEQ ID NO: 2901802 - RNA, 22 nt, Mycobacterium avium subsp. paratuberculosis
cuaccuaggcgucgucggccca

SEQ ID NO: 2901803 - RNA, 14 nt, Mycobacterium avium subsp. paratuberculosis
cuaccucaccacgu

SEQ ID NO: 2901804 - RNA, 15 nt, Mycobacterium avium subsp. paratuberculosis
cuaccugaccagcgg

SEQ ID NO: 2901805 - RNA, 21 nt, Mycobacterium avium subsp. paratuberculosis
cuaccugaccagcggcgcgcc

SEQ ID NO: 2901806 - RNA, 18 nt, Mycobacterium avium subsp. paratuberculosis
cuaccugguugacgcccc

SEQ ID NO: 2901807 - RNA, 16 nt, Mycobacterium avium subsp. paratuberculosis
cuacgcacccgacacg

SEQ ID NO: 2901808 - RNA, 19 nt, Mycobacterium avium subsp. paratuberculosis
cuacgcacccgacacgccg

SEQ ID NO: 2901809 - RNA, 19 nt, Mycobacterium avium subsp. paratuberculosis
cuacgccgaggcgcaggag

SEQ ID NO: 2901810 - RNA, 13 nt, Mycobacterium avium subsp. paratuberculosis
cuacgccguggcc

SEQ ID NO: 2901811 - RNA, 19 nt, Mycobacterium avium subsp. paratuberculosis
cuacgccguggccugcgac

SEQ ID NO: 2901812 - RNA, 14 nt, Mycobacterium avium subsp. paratuberculosis
cuacgcgagcugcu

SEQ ID NO: 2901813 - RNA, 22 nt, Mycobacterium avium subsp. paratuberculosis
cuacggacgcauccacggccgg

SEQ ID NO: 2901814 - RNA, 15 nt, Mycobacterium avium subsp. paratuberculosis
cuacggcgggccggc

SEQ ID NO: 2901815 - RNA, 18 nt, Mycobacterium avium subsp. paratuberculosis
cuacggcgggccggcgcc

SEQ ID NO: 2901816 - RNA, 20 nt, Mycobacterium avium subsp. paratuberculosis
cuacggcgggugcgacggca

SEQ ID NO: 2901817 - RNA, 15 nt, Mycobacterium avium subsp. paratuberculosis
cuacgucggcuggcg

SEQ ID NO: 2901818 - RNA, 12 nt, Mycobacterium avium subsp. paratuberculosis
cuacgucgucgc

SEQ ID NO: 2901819 - RNA, 13 nt, Mycobacterium avium subsp. paratuberculosis
cuacuccaccaag

SEQ ID NO: 2901820 - RNA, 14 nt, Mycobacterium avium subsp. paratuberculosis
cuacucggacgccg

SEQ ID NO: 2901821 - RNA, 20 nt, Mycobacterium avium subsp. paratuberculosis
cuacucggacgccggcagcc

SEQ ID NO: 2901822 - RNA, 14 nt, Mycobacterium avium subsp. paratuberculosis
cuacugccgacgca

SEQ ID NO: 2901823 - RNA, 22 nt, Mycobacterium avium subsp. paratuberculosis
cuacugcgccaauacacuucgg

SEQ ID NO: 2901824 - RNA, 20 nt, Mycobacterium avium subsp. paratuberculosis
cuacugcugguagacccggg

SEQ ID NO: 2901825 - RNA, 14 nt, Mycobacterium avium subsp. paratuberculosis
cuacuugcggccgc

SEQ ID NO: 2901826 - RNA, 16 nt, Mycobacterium avium subsp. paratuberculosis
cuacuugcggccgcga

SEQ ID NO: 2901827 - RNA, 14 nt, Mycobacterium avium subsp. paratuberculosis
cuacuuggccagcu

SEQ ID NO: 2901828 - RNA, 15 nt, Mycobacterium avium subsp. paratuberculosis
cuagacgcgcaccag

SEQ ID NO: 2901829 - RNA, 23 nt, Mycobacterium avium subsp. paratuberculosis
cuagacgcgcaccagggccgcga

SEQ ID NO: 2901830 - RNA, 20 nt, Mycobacterium avium subsp. paratuberculosis
cuagacgcgcagcacggaac

SEQ ID NO: 2901831 - RNA, 21 nt, Mycobacterium avium subsp. paratuberculosis
cuagaucuccaggcucgacaa

SEQ ID NO: 2901832 - RNA, 18 nt, Mycobacterium avium subsp. paratuberculosis
cuagcagcuccggucggc

SEQ ID NO: 2901833 - RNA, 23 nt, Mycobacterium avium subsp. paratuberculosis
cuagcagcuccggucggcgcucg

SEQ ID NO: 2901834 - RNA, 13 nt, Mycobacterium avium subsp. paratuberculosis
cuagccgccgagc

SEQ ID NO: 2901835 - RNA, 21 nt, Mycobacterium avium subsp. paratuberculosis
cuagccgccgagcgucacgcu

SEQ ID NO: 2901836 - RNA, 15 nt, Mycobacterium avium subsp. paratuberculosis
cuagccuuggccgca

SEQ ID NO: 2901837 - RNA, 18 nt, Mycobacterium avium subsp. paratuberculosis
cuagccuuggccgcaggc

SEQ ID NO: 2901838 - RNA, 13 nt, Mycobacterium avium subsp. paratuberculosis
cuagcgacggccg

SEQ ID NO: 2901839 - RNA, 21 nt, Mycobacterium avium subsp. paratuberculosis
cuagcgagcgggcacgccgcc

SEQ ID NO: 2901840 - RNA, 19 nt, Mycobacterium avium subsp. paratuberculosis
cuagcgcgaaaagacgcga

SEQ ID NO: 2901841 - RNA, 13 nt, Mycobacterium avium subsp. paratuberculosis
cuagcgcggcggc

SEQ ID NO: 2901842 - RNA, 20 nt, Mycobacterium avium subsp. paratuberculosis
cuagcggccuaggacgccgc

SEQ ID NO: 2901843 - RNA, 13 nt, Mycobacterium avium subsp. paratuberculosis
cuagcgggcgcgc

SEQ ID NO: 2901844 - RNA, 15 nt, Mycobacterium avium subsp. paratuberculosis
cuagcgggcgcgcag

SEQ ID NO: 2901845 - RNA, 21 nt, Mycobacterium avium subsp. paratuberculosis
cuagcgugccguccagcuccg

SEQ ID NO: 2901846 - RNA, 21 nt, Mycobacterium avium subsp. paratuberculosis
cuagcucggccggggcgacca

SEQ ID NO: 2901847 - RNA, 15 nt, Mycobacterium avium subsp. paratuberculosis
cuagcuucacgcucg

SEQ ID NO: 2901848 - RNA, 18 nt, Mycobacterium avium subsp. paratuberculosis
cuagcuucacgcucggcg

SEQ ID NO: 2901849 - RNA, 21 nt, Mycobacterium avium subsp. paratuberculosis
cuagcuucacgcucggcgccg

SEQ ID NO: 2901850 - RNA, 15 nt, Mycobacterium avium subsp. paratuberculosis
cuaggacgcgggccu

SEQ ID NO: 2901851 - RNA, 19 nt, Mycobacterium avium subsp. paratuberculosis
cuaggacgcgggccugggc

SEQ ID NO: 2901852 - RNA, 14 nt, Mycobacterium avium subsp. paratuberculosis
cuaggccagcagcg

SEQ ID NO: 2901853 - RNA, 16 nt, Mycobacterium avium subsp. paratuberculosis
cuaggccagcagcgcg

SEQ ID NO: 2901854 - RNA, 18 nt, Mycobacterium avium subsp. paratuberculosis
cuaggccagcagcgcggc

SEQ ID NO: 2901855 - RNA, 14 nt, Mycobacterium avium subsp. paratuberculosis
cuaggcgucgucgg

SEQ ID NO: 2901856 - RNA, 16 nt, Mycobacterium avium subsp. paratuberculosis
cuaggcucggcagccg

SEQ ID NO: 2901857 - RNA, 22 nt, Mycobacterium avium subsp. paratuberculosis
cuagguuuggccagcaccgcgg

SEQ ID NO: 2901858 - RNA, 17 nt, Mycobacterium avium subsp. paratuberculosis
cuagucgcccagcagcc

SEQ ID NO: 2901859 - RNA, 17 nt, Mycobacterium avium subsp. paratuberculosis
cuagugccgggggccga

SEQ ID NO: 2901860 - RNA, 15 nt, Mycobacterium avium subsp. paratuberculosis
cuauacacgccugga

SEQ ID NO: 2901861 - RNA, 16 nt, Mycobacterium avium subsp. paratuberculosis
cuaugcgcccgggaag

SEQ ID NO: 2901862 - RNA, 18 nt, Mycobacterium avium subsp. paratuberculosis
cuauggcaucgccaaggc

SEQ ID NO: 2901863 - RNA, 13 nt, Mycobacterium avium subsp. paratuberculosis
cuauucgggccag

SEQ ID NO: 2901864 - RNA, 14 nt, Mycobacterium avium subsp. paratuberculosis
cuauucgggccagc

SEQ ID NO: 2901865 - RNA, 20 nt, Mycobacterium avium subsp. paratuberculosis
cuauuggccgagccgggcgg

SEQ ID NO: 2901866 - RNA, 21 nt, Mycobacterium avium subsp. paratuberculosis
cuauuggccgagccgggcggc

SEQ ID NO: 2901867 - RNA, 14 nt, Mycobacterium avium subsp. paratuberculosis
cuauugggucagcu

SEQ ID NO: 2901868 - RNA, 18 nt, Mycobacterium avium subsp. paratuberculosis
cucaaaccgggccugcgc

SEQ ID NO: 2901869 - RNA, 17 nt, Mycobacterium avium subsp. paratuberculosis
cucaaccgcccagcggc

SEQ ID NO: 2901870 - RNA, 13 nt, Mycobacterium avium subsp. paratuberculosis
cucaacggccggc

SEQ ID NO: 2901871 - RNA, 17 nt, Mycobacterium avium subsp. paratuberculosis
cucaacggccggcgccg

SEQ ID NO: 2901872 - RNA, 18 nt, Mycobacterium avium subsp. paratuberculosis
cucaacggccggcgccgc

SEQ ID NO: 2901873 - RNA, 20 nt, Mycobacterium avium subsp. paratuberculosis
cucaaucuucuccgcggccg

SEQ ID NO: 2901874 - RNA, 21 nt, Mycobacterium avium subsp. paratuberculosis
cucaaucuucuccgcggccgc

SEQ ID NO: 2901875 - RNA, 20 nt, Mycobacterium avium subsp. paratuberculosis
cucacaaauccagcagcgcg

SEQ ID NO: 2901876 - RNA, 11 nt, Mycobacterium avium subsp. paratuberculosis
cucacaccucg

SEQ ID NO: 2901877 - RNA, 16 nt, Mycobacterium avium subsp. paratuberculosis
cucacaccucgcuacg

SEQ ID NO: 2901878 - RNA, 21 nt, Mycobacterium avium subsp. paratuberculosis
cucacaccucgcuacgcgagc

SEQ ID NO: 2901879 - RNA, 21 nt, Mycobacterium avium subsp. paratuberculosis
cucacagcgacaacgggccgc

SEQ ID NO: 2901880 - RNA, 18 nt, Mycobacterium avium subsp. paratuberculosis
cucacagcgcggcgguga

SEQ ID NO: 2901881 - RNA, 23 nt, Mycobacterium avium subsp. paratuberculosis
cucacaugggcgcguuggccggc

SEQ ID NO: 2901882 - RNA, 16 nt, Mycobacterium avium subsp. paratuberculosis
cucaccccagcgcgac

SEQ ID NO: 2901883 - RNA, 17 nt, Mycobacterium avium subsp. paratuberculosis
cucaccccagcgcgacc

SEQ ID NO: 2901884 - RNA, 23 nt, Mycobacterium avium subsp. paratuberculosis
cucaccccggccagggugccgac

SEQ ID NO: 2901885 - RNA, 14 nt, Mycobacterium avium subsp. paratuberculosis
cucacccggcccac

SEQ ID NO: 2901886 - RNA, 16 nt, Mycobacterium avium subsp. paratuberculosis
cucacccggcccaccg

SEQ ID NO: 2901887 - RNA, 22 nt, Mycobacterium avium subsp. paratuberculosis
cucacccggcccaccggcccgg

SEQ ID NO: 2901888 - RNA, 21 nt, Mycobacterium avium subsp. paratuberculosis
cucaccgaauuugaaaauguc

SEQ ID NO: 2901889 - RNA, 13 nt, Mycobacterium avium subsp. paratuberculosis
cucaccgccgagc

SEQ ID NO: 2901890 - RNA, 17 nt, Mycobacterium avium subsp. paratuberculosis
cucaccgccgagccgcu

SEQ ID NO: 2901891 - RNA, 15 nt, Mycobacterium avium subsp. paratuberculosis
cucaccgccgaugau

SEQ ID NO: 2901892 - RNA, 22 nt, Mycobacterium avium subsp. paratuberculosis
cucaccgcgggccaggcccacc

SEQ ID NO: 2901893 - RNA, 12 nt, Mycobacterium avium subsp. paratuberculosis
cucaccgcgggg

SEQ ID NO: 2901894 - RNA, 21 nt, Mycobacterium avium subsp. paratuberculosis
cucaccgcgucagcagcgcga

SEQ ID NO: 2901895 - RNA, 17 nt, Mycobacterium avium subsp. paratuberculosis
cucaccggccagggccg

SEQ ID NO: 2901896 - RNA, 22 nt, Mycobacterium avium subsp. paratuberculosis
cucaccggccagggccgccgca

SEQ ID NO: 2901897 - RNA, 13 nt, Mycobacterium avium subsp. paratuberculosis
cucaccggcggcg

SEQ ID NO: 2901898 - RNA, 15 nt, Mycobacterium avium subsp. paratuberculosis
cucaccggcggcggc

SEQ ID NO: 2901899 - RNA, 16 nt, Mycobacterium avium subsp. paratuberculosis
cucaccggcggcggcc

SEQ ID NO: 2901900 - RNA, 20 nt, Mycobacterium avium subsp. paratuberculosis
cucaccgggaggacagggag

SEQ ID NO: 2901901 - RNA, 14 nt, Mycobacterium avium subsp. paratuberculosis
cucaccgggcucgg

SEQ ID NO: 2901902 - RNA, 23 nt, Mycobacterium avium subsp. paratuberculosis
cucaccgggcucggucaccccgg

SEQ ID NO: 2901903 - RNA, 22 nt, Mycobacterium avium subsp. paratuberculosis
cucaccggucagcuggugcaga

SEQ ID NO: 2901904 - RNA, 16 nt, Mycobacterium avium subsp. paratuberculosis
cucaccgguggccgcg

SEQ ID NO: 2901905 - RNA, 17 nt, Mycobacterium avium subsp. paratuberculosis
cucaccgguggccgcgu

SEQ ID NO: 2901906 - RNA, 21 nt, Mycobacterium avium subsp. paratuberculosis
cucaccgguggccgcgucgac

SEQ ID NO: 2901907 - RNA, 18 nt, Mycobacterium avium subsp. paratuberculosis
cucaccgguggugagacc

SEQ ID NO: 2901908 - RNA, 19 nt, Mycobacterium avium subsp. paratuberculosis
cucaccgguggugagaccc

SEQ ID NO: 2901909 - RNA, 21 nt, Mycobacterium avium subsp. paratuberculosis
cucaccgucgcggucagcucg

SEQ ID NO: 2901910 - RNA, 13 nt, Mycobacterium avium subsp. paratuberculosis
cucaccugcggcc

SEQ ID NO: 2901911 - RNA, 16 nt, Mycobacterium avium subsp. paratuberculosis
cucaccugcggcccgu

SEQ ID NO: 2901912 - RNA, 14 nt, Mycobacterium avium subsp. paratuberculosis
cucaccugcgugcc

SEQ ID NO: 2901913 - RNA, 20 nt, Mycobacterium avium subsp. paratuberculosis
cucacgacgcggucugcggu

SEQ ID NO: 2901914 - RNA, 17 nt, Mycobacterium avium subsp. paratuberculosis
cucacgacuccuggccg

SEQ ID NO: 2901915 - RNA, 14 nt, Mycobacterium avium subsp. paratuberculosis
cucacgcagggcca

SEQ ID NO: 2901916 - RNA, 15 nt, Mycobacterium avium subsp. paratuberculosis
cucacgccucgucga

SEQ ID NO: 2901917 - RNA, 18 nt, Mycobacterium avium subsp. paratuberculosis
cucacgccucgucgagca

SEQ ID NO: 2901918 - RNA, 16 nt, Mycobacterium avium subsp. paratuberculosis
cucacggcgaauauuu

SEQ ID NO: 2901919 - RNA, 22 nt, Mycobacterium avium subsp. paratuberculosis
cucacggcgaauauuucgccga

SEQ ID NO: 2901920 - RNA, 17 nt, Mycobacterium avium subsp. paratuberculosis
cucacggcggcagcgcg

SEQ ID NO: 2901921 - RNA, 18 nt, Mycobacterium avium subsp. paratuberculosis
cucacggcggcagcgcgg

SEQ ID NO: 2901922 - RNA, 21 nt, Mycobacterium avium subsp. paratuberculosis
cucacggcggcagcgcggcgu

SEQ ID NO: 2901923 - RNA, 22 nt, Mycobacterium avium subsp. paratuberculosis
cucacggucggcguccagcgcg

SEQ ID NO: 2901924 - RNA, 13 nt, Mycobacterium avium subsp. paratuberculosis
cucacggugucgg

SEQ ID NO: 2901925 - RNA, 14 nt, Mycobacterium avium subsp. paratuberculosis
cucacggugucggc

SEQ ID NO: 2901926 - RNA, 17 nt, Mycobacterium avium subsp. paratuberculosis
cucacguagucgaccgg

SEQ ID NO: 2901927 - RNA, 18 nt, Mycobacterium avium subsp. paratuberculosis
cucacuccagcggcggcc

SEQ ID NO: 2901928 - RNA, 20 nt, Mycobacterium avium subsp. paratuberculosis
cucagacugccgagcaucag

SEQ ID NO: 2901929 - RNA, 15 nt, Mycobacterium avium subsp. paratuberculosis
cucagagcagcgccu

SEQ ID NO: 2901930 - RNA, 16 nt, Mycobacterium avium subsp. paratuberculosis
cucagagcugcaccgg

SEQ ID NO: 2901931 - RNA, 23 nt, Mycobacterium avium subsp. paratuberculosis
cucagauucuucuucagccccuc

SEQ ID NO: 2901932 - RNA, 18 nt, Mycobacterium avium subsp. paratuberculosis
cucagcaacccgccgagc

SEQ ID NO: 2901933 - RNA, 22 nt, Mycobacterium avium subsp. paratuberculosis
cucagcaacccgccgagcguga

SEQ ID NO: 2901934 - RNA, 13 nt, Mycobacterium avium subsp. paratuberculosis
cucagcacgcgga

SEQ ID NO: 2901935 - RNA, 15 nt, Mycobacterium avium subsp. paratuberculosis
cucagcacggccgcg

SEQ ID NO: 2901936 - RNA, 16 nt, Mycobacterium avium subsp. paratuberculosis
cucagcacggccgcgg

SEQ ID NO: 2901937 - RNA, 17 nt, Mycobacterium avium subsp. paratuberculosis
cucagcacggccgcggc

SEQ ID NO: 2901938 - RNA, 20 nt, Mycobacterium avium subsp. paratuberculosis
cucagcacggccgcggccag

SEQ ID NO: 2901939 - RNA, 21 nt, Mycobacterium avium subsp. paratuberculosis
cucagcagcugcuggcgugaa

SEQ ID NO: 2901940 - RNA, 15 nt, Mycobacterium avium subsp. paratuberculosis
cucagcagggcggca

SEQ ID NO: 2901941 - RNA, 18 nt, Mycobacterium avium subsp. paratuberculosis
cucagcagggcggcaccg

SEQ ID NO: 2901942 - RNA, 24 nt, Mycobacterium avium subsp. paratuberculosis
cucagccacgccggcacaccgagc

SEQ ID NO: 2901943 - RNA, 14 nt, Mycobacterium avium subsp. paratuberculosis
cucagccccagcgg

SEQ ID NO: 2901944 - RNA, 18 nt, Mycobacterium avium subsp. paratuberculosis
cucagccccagcggagcg

SEQ ID NO: 2901945 - RNA, 18 nt, Mycobacterium avium subsp. paratuberculosis
cucagcccggcagcgggg

SEQ ID NO: 2901946 - RNA, 22 nt, Mycobacterium avium subsp. paratuberculosis
cucagcccggcgcucaccgcga

SEQ ID NO: 2901947 - RNA, 20 nt, Mycobacterium avium subsp. paratuberculosis
cucagccgaagccggcgcag

SEQ ID NO: 2901948 - RNA, 14 nt, Mycobacterium avium subsp. paratuberculosis
cucagccgcacgga

SEQ ID NO: 2901949 - RNA, 17 nt, Mycobacterium avium subsp. paratuberculosis
cucagcgauugcggccg

SEQ ID NO: 2901950 - RNA, 14 nt, Mycobacterium avium subsp. paratuberculosis
cucagcgcaccgcc

SEQ ID NO: 2901951 - RNA, 14 nt, Mycobacterium avium subsp. paratuberculosis
cucagcgcccagga

SEQ ID NO: 2901952 - RNA, 14 nt, Mycobacterium avium subsp. paratuberculosis
cucagcgcccgccc

SEQ ID NO: 2901953 - RNA, 18 nt, Mycobacterium avium subsp. paratuberculosis
cucagcgcccgcccggcc

SEQ ID NO: 2901954 - RNA, 20 nt, Mycobacterium avium subsp. paratuberculosis
cucagcgcccgcccggcccg

SEQ ID NO: 2901955 - RNA, 23 nt, Mycobacterium avium subsp. paratuberculosis
cucagcgcccgcccggcccggcg

SEQ ID NO: 2901956 - RNA, 20 nt, Mycobacterium avium subsp. paratuberculosis
cucagcgcgacgugccggcg

SEQ ID NO: 2901957 - RNA, 17 nt, Mycobacterium avium subsp. paratuberculosis
cucagcgcgcaacgacg

SEQ ID NO: 2901958 - RNA, 12 nt, Mycobacterium avium subsp. paratuberculosis
cucagcgcggcc

SEQ ID NO: 2901959 - RNA, 16 nt, Mycobacterium avium subsp. paratuberculosis
cucagcgcggccacac

SEQ ID NO: 2901960 - RNA, 17 nt, Mycobacterium avium subsp. paratuberculosis
cucagcgcggccacacc

SEQ ID NO: 2901961 - RNA, 15 nt, Mycobacterium avium subsp. paratuberculosis
cucagcgcggcgggc

SEQ ID NO: 2901962 - RNA, 18 nt, Mycobacterium avium subsp. paratuberculosis
cucagcgcggcgggccag

SEQ ID NO: 2901963 - RNA, 22 nt, Mycobacterium avium subsp. paratuberculosis
cucagcgcugucgcgggcccgc

SEQ ID NO: 2901964 - RNA, 23 nt, Mycobacterium avium subsp. paratuberculosis
cucagcgcugucgcgggcccgcg

SEQ ID NO: 2901965 - RNA, 17 nt, Mycobacterium avium subsp. paratuberculosis
cucagcggcagcgucgc

SEQ ID NO: 2901966 - RNA, 21 nt, Mycobacterium avium subsp. paratuberculosis
cucagcggccaucgccgccau

SEQ ID NO: 2901967 - RNA, 15 nt, Mycobacterium avium subsp. paratuberculosis
cucagcgggcggcca

SEQ ID NO: 2901968 - RNA, 20 nt, Mycobacterium avium subsp. paratuberculosis
cucagcgggcggccagccgc

SEQ ID NO: 2901969 - RNA, 13 nt, Mycobacterium avium subsp. paratuberculosis
cucagcugcugcg

SEQ ID NO: 2901970 - RNA, 17 nt, Mycobacterium avium subsp. paratuberculosis
cucagcugcugcgcggc

SEQ ID NO: 2901971 - RNA, 20 nt, Mycobacterium avium subsp. paratuberculosis
cucaggaauuugcggcccgg

SEQ ID NO: 2901972 - RNA, 21 nt, Mycobacterium avium subsp. paratuberculosis
cucaggaauuugcggcccggc

SEQ ID NO: 2901973 - RNA, 22 nt, Mycobacterium avium subsp. paratuberculosis
cucaggaauuugcggcccggcu

SEQ ID NO: 2901974 - RNA, 23 nt, Mycobacterium avium subsp. paratuberculosis
cucaggaauuugcggcccggcuc

SEQ ID NO: 2901975 - RNA, 13 nt, Mycobacterium avium subsp. paratuberculosis
cucaggaucagca

SEQ ID NO: 2901976 - RNA, 13 nt, Mycobacterium avium subsp. paratuberculosis
cucaggccggccu

SEQ ID NO: 2901977 - RNA, 21 nt, Mycobacterium avium subsp. paratuberculosis
cucaggccgguggcgacaaca

SEQ ID NO: 2901978 - RNA, 17 nt, Mycobacterium avium subsp. paratuberculosis
cucaggcgcgcacguug

SEQ ID NO: 2901979 - RNA, 19 nt, Mycobacterium avium subsp. paratuberculosis
cucaggcguccagcaccug

SEQ ID NO: 2901980 - RNA, 23 nt, Mycobacterium avium subsp. paratuberculosis
cucaggcguggguuccgccgucg

SEQ ID NO: 2901981 - RNA, 16 nt, Mycobacterium avium subsp. paratuberculosis
cucaggucggccgcgg

SEQ ID NO: 2901982 - RNA, 19 nt, Mycobacterium avium subsp. paratuberculosis
cucaggugcgacgcccacu

SEQ ID NO: 2901983 - RNA, 19 nt, Mycobacterium avium subsp. paratuberculosis
cucagguggacagaugcca

SEQ ID NO: 2901984 - RNA, 17 nt, Mycobacterium avium subsp. paratuberculosis
cucagguugcgcagcag

SEQ ID NO: 2901985 - RNA, 16 nt, Mycobacterium avium subsp. paratuberculosis
cucaguccagcuccca

SEQ ID NO: 2901986 - RNA, 15 nt, Mycobacterium avium subsp. paratuberculosis
cucaguccgacgcga

SEQ ID NO: 2901987 - RNA, 15 nt, Mycobacterium avium subsp. paratuberculosis
cucaguccucgccga

SEQ ID NO: 2901988 - RNA, 18 nt, Mycobacterium avium subsp. paratuberculosis
cucaguccucgccgagaa

SEQ ID NO: 2901989 - RNA, 13 nt, Mycobacterium avium subsp. paratuberculosis
cucagucggccac

SEQ ID NO: 2901990 - RNA, 20 nt, Mycobacterium avium subsp. paratuberculosis
cucagugcacgcucggcgcg

SEQ ID NO: 2901991 - RNA, 20 nt, Mycobacterium avium subsp. paratuberculosis
cucagugucacugcgguaga

SEQ ID NO: 2901992 - RNA, 14 nt, Mycobacterium avium subsp. paratuberculosis
cucauacagcggcg

SEQ ID NO: 2901993 - RNA, 13 nt, Mycobacterium avium subsp. paratuberculosis
cucauagccggcc

SEQ ID NO: 2901994 - RNA, 15 nt, Mycobacterium avium subsp. paratuberculosis
cucaucaccggcgcg

SEQ ID NO: 2901995 - RNA, 14 nt, Mycobacterium avium subsp. paratuberculosis
cucaucaggcggcc

SEQ ID NO: 2901996 - RNA, 15 nt, Mycobacterium avium subsp. paratuberculosis
cucaucaggcggccg

SEQ ID NO: 2901997 - RNA, 17 nt, Mycobacterium avium subsp. paratuberculosis
cucaucaggcggccggc

SEQ ID NO: 2901998 - RNA, 23 nt, Mycobacterium avium subsp. paratuberculosis
cucaucgaggucgaaccacgcgg

SEQ ID NO: 2901999 - RNA, 13 nt, Mycobacterium avium subsp. paratuberculosis
cucaucgcccagc

SEQ ID NO: 2902000 - RNA, 17 nt, Mycobacterium avium subsp. paratuberculosis
cucaucgucgacccggc

SEQ ID NO: 2902001 - RNA, 16 nt, Mycobacterium avium subsp. paratuberculosis
cucaucguguccagca

SEQ ID NO: 2902002 - RNA, 17 nt, Mycobacterium avium subsp. paratuberculosis
cucaucuacgucgucgc

SEQ ID NO: 2902003 - RNA, 15 nt, Mycobacterium avium subsp. paratuberculosis
cucaugagcccucca

SEQ ID NO: 2902004 - RNA, 20 nt, Mycobacterium avium subsp. paratuberculosis
cucaugccagacgcgcaccg

SEQ ID NO: 2902005 - RNA, 12 nt, Mycobacterium avium subsp. paratuberculosis
cucaugcccgcc

SEQ ID NO: 2902006 - RNA, 19 nt, Mycobacterium avium subsp. paratuberculosis
cucaugcccgccacggcca

SEQ ID NO: 2902007 - RNA, 22 nt, Mycobacterium avium subsp. paratuberculosis
cucaugcccgccacggccagca

SEQ ID NO: 2902008 - RNA, 16 nt, Mycobacterium avium subsp. paratuberculosis
cucaugguguuccacc

SEQ ID NO: 2902009 - RNA, 23 nt, Mycobacterium avium subsp. paratuberculosis
cucaugguguuccaccagcggcc

SEQ ID NO: 2902010 - RNA, 18 nt, Mycobacterium avium subsp. paratuberculosis
cucaugucguacgggcgc

SEQ ID NO: 2902011 - RNA, 21 nt, Mycobacterium avium subsp. paratuberculosis
cucauguugugcaggcagccg

SEQ ID NO: 2902012 - RNA, 18 nt, Mycobacterium avium subsp. paratuberculosis
cucauugggaccggugcg

SEQ ID NO: 2902013 - RNA, 20 nt, Mycobacterium avium subsp. paratuberculosis
cuccaacccaaccugugcca

SEQ ID NO: 2902014 - RNA, 12 nt, Mycobacterium avium subsp. paratuberculosis
cuccaacggcac

SEQ ID NO: 2902015 - RNA, 21 nt, Mycobacterium avium subsp. paratuberculosis
cuccaacggcaccaccacggu

SEQ ID NO: 2902016 - RNA, 16 nt, Mycobacterium avium subsp. paratuberculosis
cuccaauacggcccgg

SEQ ID NO: 2902017 - RNA, 20 nt, Mycobacterium avium subsp. paratuberculosis
cuccaauacggcccggcgaa

SEQ ID NO: 2902018 - RNA, 16 nt, Mycobacterium avium subsp. paratuberculosis
cuccaaugcggccgac

SEQ ID NO: 2902019 - RNA, 14 nt, Mycobacterium avium subsp. paratuberculosis
cuccacaaccagcg

SEQ ID NO: 2902020 - RNA, 19 nt, Mycobacterium avium subsp. paratuberculosis
cuccacacggcaggcggcc

SEQ ID NO: 2902021 - RNA, 20 nt, Mycobacterium avium subsp. paratuberculosis
cuccacacggcaggcggccc

SEQ ID NO: 2902022 - RNA, 19 nt, Mycobacterium avium subsp. paratuberculosis
cuccacauacgcggcggcc

SEQ ID NO: 2902023 - RNA, 18 nt, Mycobacterium avium subsp. paratuberculosis
cuccaccaccggccgcgc

SEQ ID NO: 2902024 - RNA, 16 nt, Mycobacterium avium subsp. paratuberculosis
cuccaccaccuggccg

SEQ ID NO: 2902025 - RNA, 18 nt, Mycobacterium avium subsp. paratuberculosis
cuccaccaccuggccggc

SEQ ID NO: 2902026 - RNA, 19 nt, Mycobacterium avium subsp. paratuberculosis
cuccaccaccuggccggcc

SEQ ID NO: 2902027 - RNA, 20 nt, Mycobacterium avium subsp. paratuberculosis
cuccaccaccuggccggcca

SEQ ID NO: 2902028 - RNA, 14 nt, Mycobacterium avium subsp. paratuberculosis
cuccaccagcgcgg

SEQ ID NO: 2902029 - RNA, 14 nt, Mycobacterium avium subsp. paratuberculosis
cuccaccagcggcg

SEQ ID NO: 2902030 - RNA, 17 nt, Mycobacterium avium subsp. paratuberculosis
cuccaccagcggcgcgu

SEQ ID NO: 2902031 - RNA, 21 nt, Mycobacterium avium subsp. paratuberculosis
cuccaccagcggcgcgucgcu

SEQ ID NO: 2902032 - RNA, 19 nt, Mycobacterium avium subsp. paratuberculosis
cuccaccagguucgcgcag

SEQ ID NO: 2902033 - RNA, 15 nt, Mycobacterium avium subsp. paratuberculosis
cuccacccgccccuc

SEQ ID NO: 2902034 - RNA, 19 nt, Mycobacterium avium subsp. paratuberculosis
cuccacccugccgaccugc

SEQ ID NO: 2902035 - RNA, 23 nt, Mycobacterium avium subsp. paratuberculosis
cuccacccugccgaccugcgcga

SEQ ID NO: 2902036 - RNA, 14 nt, Mycobacterium avium subsp. paratuberculosis
cuccaccgaaaagc

SEQ ID NO: 2902037 - RNA, 22 nt, Mycobacterium avium subsp. paratuberculosis
cuccaccgaaaagcccgccgcc

SEQ ID NO: 2902038 - RNA, 13 nt, Mycobacterium avium subsp. paratuberculosis
cuccaccgccacc

SEQ ID NO: 2902039 - RNA, 14 nt, Mycobacterium avium subsp. paratuberculosis
cuccaccgcccgga

SEQ ID NO: 2902040 - RNA, 15 nt, Mycobacterium avium subsp. paratuberculosis
cuccaccgcgccggc

SEQ ID NO: 2902041 - RNA, 16 nt, Mycobacterium avium subsp. paratuberculosis
cuccaccgcgccgucg

SEQ ID NO: 2902042 - RNA, 14 nt, Mycobacterium avium subsp. paratuberculosis
cuccaccgcgcgcg

SEQ ID NO: 2902043 - RNA, 16 nt, Mycobacterium avium subsp. paratuberculosis
cuccaccgcgcgcggg

SEQ ID NO: 2902044 - RNA, 19 nt, Mycobacterium avium subsp. paratuberculosis
cuccaccgcguccugcagg

SEQ ID NO: 2902045 - RNA, 18 nt, Mycobacterium avium subsp. paratuberculosis
cuccaccgucgauggaca

SEQ ID NO: 2902046 - RNA, 15 nt, Mycobacterium avium subsp. paratuberculosis
cuccaccucgggcau

SEQ ID NO: 2902047 - RNA, 16 nt, Mycobacterium avium subsp. paratuberculosis
cuccaccugcggcacc

SEQ ID NO: 2902048 - RNA, 22 nt, Mycobacterium avium subsp. paratuberculosis
cuccacgacuucacaggccgcc

SEQ ID NO: 2902049 - RNA, 14 nt, Mycobacterium avium subsp. paratuberculosis
cuccacgccgacga

SEQ ID NO: 2902050 - RNA, 15 nt, Mycobacterium avium subsp. paratuberculosis
cuccacgccgacgaa

SEQ ID NO: 2902051 - RNA, 17 nt, Mycobacterium avium subsp. paratuberculosis
cuccacgcguagccgac

SEQ ID NO: 2902052 - RNA, 19 nt, Mycobacterium avium subsp. paratuberculosis
cuccacgcguagccgacca

SEQ ID NO: 2902053 - RNA, 20 nt, Mycobacterium avium subsp. paratuberculosis
cuccacggugcgcaccgaca

SEQ ID NO: 2902054 - RNA, 16 nt, Mycobacterium avium subsp. paratuberculosis
cuccacgucaccgacg

SEQ ID NO: 2902055 - RNA, 13 nt, Mycobacterium avium subsp. paratuberculosis
cuccacgucgucg

SEQ ID NO: 2902056 - RNA, 14 nt, Mycobacterium avium subsp. paratuberculosis
cuccacgucgucgg

SEQ ID NO: 2902057 - RNA, 17 nt, Mycobacterium avium subsp. paratuberculosis
cuccacgucgucggaca

SEQ ID NO: 2902058 - RNA, 16 nt, Mycobacterium avium subsp. paratuberculosis
cuccagauagaggaac

SEQ ID NO: 2902059 - RNA, 22 nt, Mycobacterium avium subsp. paratuberculosis
cuccagauugcggaucuuggug

SEQ ID NO: 2902060 - RNA, 14 nt, Mycobacterium avium subsp. paratuberculosis
cuccagcaccagca

SEQ ID NO: 2902061 - RNA, 15 nt, Mycobacterium avium subsp. paratuberculosis
cuccagcaccagcac

SEQ ID NO: 2902062 - RNA, 14 nt, Mycobacterium avium subsp. paratuberculosis
cuccagcaccggau

SEQ ID NO: 2902063 - RNA, 13 nt, Mycobacterium avium subsp. paratuberculosis
cuccagcaccggc

SEQ ID NO: 2902064 - RNA, 17 nt, Mycobacterium avium subsp. paratuberculosis
cuccagcaccggcgcca

SEQ ID NO: 2902065 - RNA, 17 nt, Mycobacterium avium subsp. paratuberculosis
cuccagcaccgucggcg

SEQ ID NO: 2902066 - RNA, 19 nt, Mycobacterium avium subsp. paratuberculosis
cuccagcacgaaggccgcc

SEQ ID NO: 2902067 - RNA, 17 nt, Mycobacterium avium subsp. paratuberculosis
cuccagcagcccgggcu

SEQ ID NO: 2902068 - RNA, 15 nt, Mycobacterium avium subsp. paratuberculosis
cuccagcagcgccag

SEQ ID NO: 2902069 - RNA, 20 nt, Mycobacterium avium subsp. paratuberculosis
cuccagcagcgccagcaccg

SEQ ID NO: 2902070 - RNA, 14 nt, Mycobacterium avium subsp. paratuberculosis
cuccagcagcgccu

SEQ ID NO: 2902071 - RNA, 12 nt, Mycobacterium avium subsp. paratuberculosis
cuccagcagcgg

SEQ ID NO: 2902072 - RNA, 13 nt, Mycobacterium avium subsp. paratuberculosis
cuccagcagcggc

SEQ ID NO: 2902073 - RNA, 14 nt, Mycobacterium avium subsp. paratuberculosis
cuccagcagcuuca

SEQ ID NO: 2902074 - RNA, 19 nt, Mycobacterium avium subsp. paratuberculosis
cuccagcagcuucaugccc

SEQ ID NO: 2902075 - RNA, 17 nt, Mycobacterium avium subsp. paratuberculosis
cuccagcaggcgcgccg

SEQ ID NO: 2902076 - RNA, 16 nt, Mycobacterium avium subsp. paratuberculosis
cuccagcaggcuggcg

SEQ ID NO: 2902077 - RNA, 16 nt, Mycobacterium avium subsp. paratuberculosis
cuccagcagggacauc

SEQ ID NO: 2902078 - RNA, 14 nt, Mycobacterium avium subsp. paratuberculosis
cuccagccacucca

SEQ ID NO: 2902079 - RNA, 16 nt, Mycobacterium avium subsp. paratuberculosis
cuccagccacuccacc

SEQ ID NO: 2902080 - RNA, 13 nt, Mycobacterium avium subsp. paratuberculosis
cuccagccagcgc

SEQ ID NO: 2902081 - RNA, 14 nt, Mycobacterium avium subsp. paratuberculosis
cuccagcccggcga

SEQ ID NO: 2902082 - RNA, 12 nt, Mycobacterium avium subsp. paratuberculosis
cuccagccgccg

SEQ ID NO: 2902083 - RNA, 16 nt, Mycobacterium avium subsp. paratuberculosis
cuccagccgcgcggcc

SEQ ID NO: 2902084 - RNA, 18 nt, Mycobacterium avium subsp. paratuberculosis
cuccagccgcuccgcggc

SEQ ID NO: 2902085 - RNA, 14 nt, Mycobacterium avium subsp. paratuberculosis
cuccagcgcccgcc

SEQ ID NO: 2902086 - RNA, 16 nt, Mycobacterium avium subsp. paratuberculosis
cuccagcgcccgccgc

SEQ ID NO: 2902087 - RNA, 17 nt, Mycobacterium avium subsp. paratuberculosis
cuccagcgcgaucaacg

SEQ ID NO: 2902088 - RNA, 17 nt, Mycobacterium avium subsp. paratuberculosis
cuccagcgcggucucga

SEQ ID NO: 2902089 - RNA, 13 nt, Mycobacterium avium subsp. paratuberculosis
cuccagcggccac

SEQ ID NO: 2902090 - RNA, 17 nt, Mycobacterium avium subsp. paratuberculosis
cuccagcggccacaccg

SEQ ID NO: 2902091 - RNA, 12 nt, Mycobacterium avium subsp. paratuberculosis
cuccagcggccg

SEQ ID NO: 2902092 - RNA, 14 nt, Mycobacterium avium subsp. paratuberculosis
cuccagcggccgca

SEQ ID NO: 2902093 - RNA, 19 nt, Mycobacterium avium subsp. paratuberculosis
cuccagcggccgcagcgcg

SEQ ID NO: 2902094 - RNA, 22 nt, Mycobacterium avium subsp. paratuberculosis
cuccagcggccgcagcgcgacg

SEQ ID NO: 2902095 - RNA, 14 nt, Mycobacterium avium subsp. paratuberculosis
cuccagcggccggg

SEQ ID NO: 2902096 - RNA, 15 nt, Mycobacterium avium subsp. paratuberculosis
cuccagcggccgggc

SEQ ID NO: 2902097 - RNA, 17 nt, Mycobacterium avium subsp. paratuberculosis
cuccagcggccgggcga

SEQ ID NO: 2902098 - RNA, 16 nt, Mycobacterium avium subsp. paratuberculosis
cuccagcggcggcccu

SEQ ID NO: 2902099 - RNA, 19 nt, Mycobacterium avium subsp. paratuberculosis
cuccagcggcggcccuucu

SEQ ID NO: 2902100 - RNA, 15 nt, Mycobacterium avium subsp. paratuberculosis
cuccagcgggcggcg

SEQ ID NO: 2902101 - RNA, 19 nt, Mycobacterium avium subsp. paratuberculosis
cuccagcgggcggcggugg

SEQ ID NO: 2902102 - RNA, 20 nt, Mycobacterium avium subsp. paratuberculosis
cuccagcggguccagccgcc

SEQ ID NO: 2902103 - RNA, 18 nt, Mycobacterium avium subsp. paratuberculosis
cuccagcuaggagccugc

SEQ ID NO: 2902104 - RNA, 16 nt, Mycobacterium avium subsp. paratuberculosis
cuccagcuccgcggcc

SEQ ID NO: 2902105 - RNA, 20 nt, Mycobacterium avium subsp. paratuberculosis
cuccagcuccgcggccagcu

SEQ ID NO: 2902106 - RNA, 13 nt, Mycobacterium avium subsp. paratuberculosis
cuccagcuccucg

SEQ ID NO: 2902107 - RNA, 14 nt, Mycobacterium avium subsp. paratuberculosis
cuccagcuccucgg

SEQ ID NO: 2902108 - RNA, 15 nt, Mycobacterium avium subsp. paratuberculosis
cuccagcuccucggu

SEQ ID NO: 2902109 - RNA, 22 nt, Mycobacterium avium subsp. paratuberculosis
cuccagcuggagaggcccggca

SEQ ID NO: 2902110 - RNA, 21 nt, Mycobacterium avium subsp. paratuberculosis
cuccagcuguugacgggccgc

SEQ ID NO: 2902111 - RNA, 21 nt, Mycobacterium avium subsp. paratuberculosis
cuccaggaagaacccggcgug

SEQ ID NO: 2902112 - RNA, 21 nt, Mycobacterium avium subsp. paratuberculosis
cuccaggaugucgacgacacc

SEQ ID NO: 2902113 - RNA, 22 nt, Mycobacterium avium subsp. paratuberculosis
cuccaggcaugggaucagcagc

SEQ ID NO: 2902114 - RNA, 15 nt, Mycobacterium avium subsp. paratuberculosis
cuccaggcucgacaa

SEQ ID NO: 2902115 - RNA, 22 nt, Mycobacterium avium subsp. paratuberculosis
cuccaggguucucgcggcggcc

SEQ ID NO: 2902116 - RNA, 19 nt, Mycobacterium avium subsp. paratuberculosis
cuccagguagggcacaccg

SEQ ID NO: 2902117 - RNA, 16 nt, Mycobacterium avium subsp. paratuberculosis
cuccagguucgccgcc

SEQ ID NO: 2902118 - RNA, 17 nt, Mycobacterium avium subsp. paratuberculosis
cuccagguucgccgccc

SEQ ID NO: 2902119 - RNA, 14 nt, Mycobacterium avium subsp. paratuberculosis
cuccaguugacggc

SEQ ID NO: 2902120 - RNA, 18 nt, Mycobacterium avium subsp. paratuberculosis
cuccaguugacggcgcaa

SEQ ID NO: 2902121 - RNA, 17 nt, Mycobacterium avium subsp. paratuberculosis
cuccaguugcgaccccg

SEQ ID NO: 2902122 - RNA, 20 nt, Mycobacterium avium subsp. paratuberculosis
cuccaguugcgaccccgccg

SEQ ID NO: 2902123 - RNA, 13 nt, Mycobacterium avium subsp. paratuberculosis
cuccaucacgacc

SEQ ID NO: 2902124 - RNA, 15 nt, Mycobacterium avium subsp. paratuberculosis
cuccauccgggcggc

SEQ ID NO: 2902125 - RNA, 12 nt, Mycobacterium avium subsp. paratuberculosis
cuccaugucguc

SEQ ID NO: 2902126 - RNA, 14 nt, Mycobacterium avium subsp. paratuberculosis
cuccaugucgucgg

SEQ ID NO: 2902127 - RNA, 17 nt, Mycobacterium avium subsp. paratuberculosis
cuccaugucgucggcgg

SEQ ID NO: 2902128 - RNA, 19 nt, Mycobacterium avium subsp. paratuberculosis
cuccaugucgucggcggac

SEQ ID NO: 2902129 - RNA, 13 nt, Mycobacterium avium subsp. paratuberculosis
cucccacagcgga

SEQ ID NO: 2902130 - RNA, 20 nt, Mycobacterium avium subsp. paratuberculosis
cucccacagcggaucggccu

SEQ ID NO: 2902131 - RNA, 13 nt, Mycobacterium avium subsp. paratuberculosis
cucccacaggucg

SEQ ID NO: 2902132 - RNA, 16 nt, Mycobacterium avium subsp. paratuberculosis
cucccaccacggccga

SEQ ID NO: 2902133 - RNA, 19 nt, Mycobacterium avium subsp. paratuberculosis
cucccaccacggccgaugc

SEQ ID NO: 2902134 - RNA, 14 nt, Mycobacterium avium subsp. paratuberculosis
cucccagccgccgg

SEQ ID NO: 2902135 - RNA, 19 nt, Mycobacterium avium subsp. paratuberculosis
cucccagccgccggccacc

SEQ ID NO: 2902136 - RNA, 20 nt, Mycobacterium avium subsp. paratuberculosis
cucccagccgccggccacca

SEQ ID NO: 2902137 - RNA, 18 nt, Mycobacterium avium subsp. paratuberculosis
cucccaggacagcugacg

SEQ ID NO: 2902138 - RNA, 16 nt, Mycobacterium avium subsp. paratuberculosis
cucccaggacgcggug

SEQ ID NO: 2902139 - RNA, 16 nt, Mycobacterium avium subsp. paratuberculosis
cucccaggacggcgcg

SEQ ID NO: 2902140 - RNA, 17 nt, Mycobacterium avium subsp. paratuberculosis
cucccaggacggcgcgg

SEQ ID NO: 2902141 - RNA, 20 nt, Mycobacterium avium subsp. paratuberculosis
cucccaggacggcgcggugg

SEQ ID NO: 2902142 - RNA, 21 nt, Mycobacterium avium subsp. paratuberculosis
cucccaggauuccgucggcgg

SEQ ID NO: 2902143 - RNA, 22 nt, Mycobacterium avium subsp. paratuberculosis
cucccaggauuccgucggcggc

SEQ ID NO: 2902144 - RNA, 14 nt, Mycobacterium avium subsp. paratuberculosis
cucccaggccgcgg

SEQ ID NO: 2902145 - RNA, 17 nt, Mycobacterium avium subsp. paratuberculosis
cucccaggccgcggcca

SEQ ID NO: 2902146 - RNA, 15 nt, Mycobacterium avium subsp. paratuberculosis
cucccagucccagca

SEQ ID NO: 2902147 - RNA, 17 nt, Mycobacterium avium subsp. paratuberculosis
cucccagucccagcaca

SEQ ID NO: 2902148 - RNA, 23 nt, Mycobacterium avium subsp. paratuberculosis
cucccagucccagcacagccguc

SEQ ID NO: 2902149 - RNA, 21 nt, Mycobacterium avium subsp. paratuberculosis
cucccccgacaccgccagcag

SEQ ID NO: 2902150 - RNA, 19 nt, Mycobacterium avium subsp. paratuberculosis
cucccccgacgccgacacc

SEQ ID NO: 2902151 - RNA, 22 nt, Mycobacterium avium subsp. paratuberculosis
cucccccgagucggagacccgc

SEQ ID NO: 2902152 - RNA, 14 nt, Mycobacterium avium subsp. paratuberculosis
cucccccgcccgga

SEQ ID NO: 2902153 - RNA, 15 nt, Mycobacterium avium subsp. paratuberculosis
cucccccggaccugc

SEQ ID NO: 2902154 - RNA, 18 nt, Mycobacterium avium subsp. paratuberculosis
cucccccggcgugagcga

SEQ ID NO: 2902155 - RNA, 20 nt, Mycobacterium avium subsp. paratuberculosis
cucccccgucgggccguccg

SEQ ID NO: 2902156 - RNA, 21 nt, Mycobacterium avium subsp. paratuberculosis
cuccccgaccacaccggcgcu

SEQ ID NO: 2902157 - RNA, 19 nt, Mycobacterium avium subsp. paratuberculosis
cuccccgcccggcaacacg

SEQ ID NO: 2902158 - RNA, 20 nt, Mycobacterium avium subsp. paratuberculosis
cuccccgcuagccucaacga

SEQ ID NO: 2902159 - RNA, 12 nt, Mycobacterium avium subsp. paratuberculosis
cuccccgcuggc

SEQ ID NO: 2902160 - RNA, 18 nt, Mycobacterium avium subsp. paratuberculosis
cuccccgcuggcgccggc

SEQ ID NO: 2902161 - RNA, 23 nt, Mycobacterium avium subsp. paratuberculosis
cuccccgcuggcgccggcgucca

SEQ ID NO: 2902162 - RNA, 12 nt, Mycobacterium avium subsp. paratuberculosis
cuccccggccag

SEQ ID NO: 2902163 - RNA, 16 nt, Mycobacterium avium subsp. paratuberculosis
cuccccggccagcacg

SEQ ID NO: 2902164 - RNA, 18 nt, Mycobacterium avium subsp. paratuberculosis
cuccccggccagcacgcc

SEQ ID NO: 2902165 - RNA, 13 nt, Mycobacterium avium subsp. paratuberculosis
cuccccggcgauc

SEQ ID NO: 2902166 - RNA, 14 nt, Mycobacterium avium subsp. paratuberculosis
cuccccggcgaucu

SEQ ID NO: 2902167 - RNA, 13 nt, Mycobacterium avium subsp. paratuberculosis
cuccccguugcgg

SEQ ID NO: 2902168 - RNA, 20 nt, Mycobacterium avium subsp. paratuberculosis
cucccgagcaucgccgagcg

SEQ ID NO: 2902169 - RNA, 19 nt, Mycobacterium avium subsp. paratuberculosis
cucccgauggcucgcgggg

SEQ ID NO: 2902170 - RNA, 23 nt, Mycobacterium avium subsp. paratuberculosis
cucccgcacccguucggcgucga

SEQ ID NO: 2902171 - RNA, 11 nt, Mycobacterium avium subsp. paratuberculosis
cucccgcagcg

SEQ ID NO: 2902172 - RNA, 14 nt, Mycobacterium avium subsp. paratuberculosis
cucccgcagcgcca

SEQ ID NO: 2902173 - RNA, 17 nt, Mycobacterium avium subsp. paratuberculosis
cucccgcagcgccagcg

SEQ ID NO: 2902174 - RNA, 21 nt, Mycobacterium avium subsp. paratuberculosis
cucccgccaauaagaucgugc

SEQ ID NO: 2902175 - RNA, 12 nt, Mycobacterium avium subsp. paratuberculosis
cucccgcgccgc

SEQ ID NO: 2902176 - RNA, 17 nt, Mycobacterium avium subsp. paratuberculosis
cucccgcgccgcggcca

SEQ ID NO: 2902177 - RNA, 20 nt, Mycobacterium avium subsp. paratuberculosis
cucccgcgccgcggccagcg

SEQ ID NO: 2902178 - RNA, 13 nt, Mycobacterium avium subsp. paratuberculosis
cucccgcggcagc

SEQ ID NO: 2902179 - RNA, 22 nt, Mycobacterium avium subsp. paratuberculosis
cucccgcggcagccgggcgauc

SEQ ID NO: 2902180 - RNA, 23 nt, Mycobacterium avium subsp. paratuberculosis
cucccgcggcagccgggcgauca

SEQ ID NO: 2902181 - RNA, 21 nt, Mycobacterium avium subsp. paratuberculosis
cucccgcguauugcacggcgg

SEQ ID NO: 2902182 - RNA, 24 nt, Mycobacterium avium subsp. paratuberculosis
cucccgcguauugcacggcggcga

SEQ ID NO: 2902183 - RNA, 18 nt, Mycobacterium avium subsp. paratuberculosis
cucccgcuccauggcggc

SEQ ID NO: 2902184 - RNA, 21 nt, Mycobacterium avium subsp. paratuberculosis
cucccgcuccauggcggcgac

SEQ ID NO: 2902185 - RNA, 22 nt, Mycobacterium avium subsp. paratuberculosis
cucccgcuccauggcggcgacc

SEQ ID NO: 2902186 - RNA, 20 nt, Mycobacterium avium subsp. paratuberculosis
cucccggaacagcuuggcgc

SEQ ID NO: 2902187 - RNA, 19 nt, Mycobacterium avium subsp. paratuberculosis
cucccggcagaucgcggcc

SEQ ID NO: 2902188 - RNA, 22 nt, Mycobacterium avium subsp. paratuberculosis
cucccggcagaucgcggcccgc

SEQ ID NO: 2902189 - RNA, 13 nt, Mycobacterium avium subsp. paratuberculosis
cucccggcgccac

SEQ ID NO: 2902190 - RNA, 17 nt, Mycobacterium avium subsp. paratuberculosis
cucccggcgccacgccg

SEQ ID NO: 2902191 - RNA, 20 nt, Mycobacterium avium subsp. paratuberculosis
cucccggcgccacgccgcga

SEQ ID NO: 2902192 - RNA, 15 nt, Mycobacterium avium subsp. paratuberculosis
cucccggcgccgccg

SEQ ID NO: 2902193 - RNA, 18 nt, Mycobacterium avium subsp. paratuberculosis
cucccggcgccgccguuc

SEQ ID NO: 2902194 - RNA, 14 nt, Mycobacterium avium subsp. paratuberculosis
cucccgggacagcc

SEQ ID NO: 2902195 - RNA, 17 nt, Mycobacterium avium subsp. paratuberculosis
cucccgggcggcgccga

SEQ ID NO: 2902196 - RNA, 15 nt, Mycobacterium avium subsp. paratuberculosis
cucccgggcggucgc

SEQ ID NO: 2902197 - RNA, 16 nt, Mycobacterium avium subsp. paratuberculosis
cucccgggugcgcguc

SEQ ID NO: 2902198 - RNA, 23 nt, Mycobacterium avium subsp. paratuberculosis
cucccgggugcgcgucgcggugg

SEQ ID NO: 2902199 - RNA, 20 nt, Mycobacterium avium subsp. paratuberculosis
cucccgggugggcagcgcga

SEQ ID NO: 2902200 - RNA, 19 nt, Mycobacterium avium subsp. paratuberculosis
cucccgguagagcggcacc

SEQ ID NO: 2902201 - RNA, 20 nt, Mycobacterium avium subsp. paratuberculosis
cucccgguagagcggcacca

SEQ ID NO: 2902202 - RNA, 22 nt, Mycobacterium avium subsp. paratuberculosis
cucccgguagagcggcaccagg

SEQ ID NO: 2902203 - RNA, 16 nt, Mycobacterium avium subsp. paratuberculosis
cucccgguagccgaca

SEQ ID NO: 2902204 - RNA, 17 nt, Mycobacterium avium subsp. paratuberculosis
cucccgguaggcggcga

SEQ ID NO: 2902205 - RNA, 15 nt, Mycobacterium avium subsp. paratuberculosis
cucccgguccacggu

SEQ ID NO: 2902206 - RNA, 13 nt, Mycobacterium avium subsp. paratuberculosis
cucccgucgcgac

SEQ ID NO: 2902207 - RNA, 23 nt, Mycobacterium avium subsp. paratuberculosis
cucccgugcgguccaccaauggc

SEQ ID NO: 2902208 - RNA, 17 nt, Mycobacterium avium subsp. paratuberculosis
cuccgaauccagcgcgc

SEQ ID NO: 2902209 - RNA, 18 nt, Mycobacterium avium subsp. paratuberculosis
cuccgaauccagcgcgcc

SEQ ID NO: 2902210 - RNA, 19 nt, Mycobacterium avium subsp. paratuberculosis
cuccgaauccagcgcgccg

SEQ ID NO: 2902211 - RNA, 20 nt, Mycobacterium avium subsp. paratuberculosis
cuccgaauccagcgcgccgc

SEQ ID NO: 2902212 - RNA, 21 nt, Mycobacterium avium subsp. paratuberculosis
cuccgaauccagcgcgccgcu

SEQ ID NO: 2902213 - RNA, 24 nt, Mycobacterium avium subsp. paratuberculosis
cuccgaauccagcgcgccgcugac

SEQ ID NO: 2902214 - RNA, 21 nt, Mycobacterium avium subsp. paratuberculosis
cuccgacagauacuucgucga

SEQ ID NO: 2902215 - RNA, 13 nt, Mycobacterium avium subsp. paratuberculosis
cuccgacagccgc

SEQ ID NO: 2902216 - RNA, 19 nt, Mycobacterium avium subsp. paratuberculosis
cuccgacagccgcaccggc

SEQ ID NO: 2902217 - RNA, 23 nt, Mycobacterium avium subsp. paratuberculosis
cuccgacagccgcaccggcgccg

SEQ ID NO: 2902218 - RNA, 14 nt, Mycobacterium avium subsp. paratuberculosis
cuccgaccagccgg

SEQ ID NO: 2902219 - RNA, 16 nt, Mycobacterium avium subsp. paratuberculosis
cuccgacccguccagc

SEQ ID NO: 2902220 - RNA, 16 nt, Mycobacterium avium subsp. paratuberculosis
cuccgacuccagcagc

SEQ ID NO: 2902221 - RNA, 23 nt, Mycobacterium avium subsp. paratuberculosis
cuccgacugugaauuccgacgug

SEQ ID NO: 2902222 - RNA, 15 nt, Mycobacterium avium subsp. paratuberculosis
cuccgagccggugga

SEQ ID NO: 2902223 - RNA, 17 nt, Mycobacterium avium subsp. paratuberculosis
cuccgagccgguggagu

SEQ ID NO: 2902224 - RNA, 14 nt, Mycobacterium avium subsp. paratuberculosis
cuccgagcggcgca

SEQ ID NO: 2902225 - RNA, 21 nt, Mycobacterium avium subsp. paratuberculosis
cuccgagcggcgcaggccggu

SEQ ID NO: 2902226 - RNA, 16 nt, Mycobacterium avium subsp. paratuberculosis
cuccgaggcguccucc

SEQ ID NO: 2902227 - RNA, 19 nt, Mycobacterium avium subsp. paratuberculosis
cuccgaggcguccuccucg

SEQ ID NO: 2902228 - RNA, 16 nt, Mycobacterium avium subsp. paratuberculosis
cuccgagucggcgucg

SEQ ID NO: 2902229 - RNA, 21 nt, Mycobacterium avium subsp. paratuberculosis
cuccgaucuccuggugucgua

SEQ ID NO: 2902230 - RNA, 22 nt, Mycobacterium avium subsp. paratuberculosis
cuccgccacccugcgcaccgcg

SEQ ID NO: 2902231 - RNA, 15 nt, Mycobacterium avium subsp. paratuberculosis
cuccgccaccuccuc

SEQ ID NO: 2902232 - RNA, 17 nt, Mycobacterium avium subsp. paratuberculosis
cuccgccaccuccuccg

SEQ ID NO: 2902233 - RNA, 14 nt, Mycobacterium avium subsp. paratuberculosis
cuccgcccgggugc

SEQ ID NO: 2902234 - RNA, 23 nt, Mycobacterium avium subsp. paratuberculosis
cuccgccgaaccgaucaccggca

SEQ ID NO: 2902235 - RNA, 15 nt, Mycobacterium avium subsp. paratuberculosis
cuccgccgccccguc

SEQ ID NO: 2902236 - RNA, 23 nt, Mycobacterium avium subsp. paratuberculosis
cuccgccgggcugagcugugccg

SEQ ID NO: 2902237 - RNA, 19 nt, Mycobacterium avium subsp. paratuberculosis
cuccgcgacaucggcgccg

SEQ ID NO: 2902238 - RNA, 14 nt, Mycobacterium avium subsp. paratuberculosis
cuccgcgcagccag

SEQ ID NO: 2902239 - RNA, 13 nt, Mycobacterium avium subsp. paratuberculosis
cuccgcgcugacc

SEQ ID NO: 2902240 - RNA, 14 nt, Mycobacterium avium subsp. paratuberculosis
cuccgcgcugacca

SEQ ID NO: 2902241 - RNA, 14 nt, Mycobacterium avium subsp. paratuberculosis
cuccgcggccgcgc

SEQ ID NO: 2902242 - RNA, 17 nt, Mycobacterium avium subsp. paratuberculosis
cuccgcggccgcgcgcc

SEQ ID NO: 2902243 - RNA, 18 nt, Mycobacterium avium subsp. paratuberculosis
cuccgcggccgcgcgccc

SEQ ID NO: 2902244 - RNA, 13 nt, Mycobacterium avium subsp. paratuberculosis
cuccgcggcgaug

SEQ ID NO: 2902245 - RNA, 17 nt, Mycobacterium avium subsp. paratuberculosis
cuccgcgggcagcgagc

SEQ ID NO: 2902246 - RNA, 18 nt, Mycobacterium avium subsp. paratuberculosis
cuccgcgggcagcgagca

SEQ ID NO: 2902247 - RNA, 24 nt, Mycobacterium avium subsp. paratuberculosis
cuccgcguucgaccuccacgagcc

SEQ ID NO: 2902248 - RNA, 19 nt, Mycobacterium avium subsp. paratuberculosis
cuccggagaucgccccggg

SEQ ID NO: 2902249 - RNA, 19 nt, Mycobacterium avium subsp. paratuberculosis
cuccggagugacgucgcgc

SEQ ID NO: 2902250 - RNA, 17 nt, Mycobacterium avium subsp. paratuberculosis
cuccggauggcggucgc

SEQ ID NO: 2902251 - RNA, 22 nt, Mycobacterium avium subsp. paratuberculosis
cuccggauggcggucgcgccag

SEQ ID NO: 2902252 - RNA, 15 nt, Mycobacterium avium subsp. paratuberculosis
cuccggcaacgaggc

SEQ ID NO: 2902253 - RNA, 13 nt, Mycobacterium avium subsp. paratuberculosis
cuccggcaggccg

SEQ ID NO: 2902254 - RNA, 15 nt, Mycobacterium avium subsp. paratuberculosis
cuccggcaggccgcg

SEQ ID NO: 2902255 - RNA, 17 nt, Mycobacterium avium subsp. paratuberculosis
cuccggcaggccgcggc

SEQ ID NO: 2902256 - RNA, 18 nt, Mycobacterium avium subsp. paratuberculosis
cuccggcaggccgcggcc

SEQ ID NO: 2902257 - RNA, 20 nt, Mycobacterium avium subsp. paratuberculosis
cuccggcaggccgcggccgu

SEQ ID NO: 2902258 - RNA, 21 nt, Mycobacterium avium subsp. paratuberculosis
cuccggcaguacgcgccggcc

SEQ ID NO: 2902259 - RNA, 22 nt, Mycobacterium avium subsp. paratuberculosis
cuccggcaguacgcgccggccu

SEQ ID NO: 2902260 - RNA, 17 nt, Mycobacterium avium subsp. paratuberculosis
cuccggccccgagccga

SEQ ID NO: 2902261 - RNA, 15 nt, Mycobacterium avium subsp. paratuberculosis
cuccggcccgagcac

SEQ ID NO: 2902262 - RNA, 16 nt, Mycobacterium avium subsp. paratuberculosis
cuccggcccgaucgcg

SEQ ID NO: 2902263 - RNA, 21 nt, Mycobacterium avium subsp. paratuberculosis
cuccggcccgaucgcggcgag

SEQ ID NO: 2902264 - RNA, 13 nt, Mycobacterium avium subsp. paratuberculosis
cuccggcccgcuc

SEQ ID NO: 2902265 - RNA, 15 nt, Mycobacterium avium subsp. paratuberculosis
cuccggcccgcucgg

SEQ ID NO: 2902266 - RNA, 13 nt, Mycobacterium avium subsp. paratuberculosis
cuccggcccggcg

SEQ ID NO: 2902267 - RNA, 14 nt, Mycobacterium avium subsp. paratuberculosis
cuccggcccggcgu

SEQ ID NO: 2902268 - RNA, 16 nt, Mycobacterium avium subsp. paratuberculosis
cuccggccgcgccggc

SEQ ID NO: 2902269 - RNA, 17 nt, Mycobacterium avium subsp. paratuberculosis
cuccggccggugaucgg

SEQ ID NO: 2902270 - RNA, 23 nt, Mycobacterium avium subsp. paratuberculosis
cuccggcgacacguccagcucuc

SEQ ID NO: 2902271 - RNA, 16 nt, Mycobacterium avium subsp. paratuberculosis
cuccggcgccggucag

SEQ ID NO: 2902272 - RNA, 21 nt, Mycobacterium avium subsp. paratuberculosis
cuccggcgccggucagcggca

SEQ ID NO: 2902273 - RNA, 12 nt, Mycobacterium avium subsp. paratuberculosis
cuccggcgccug

SEQ ID NO: 2902274 - RNA, 14 nt, Mycobacterium avium subsp. paratuberculosis
cuccggcgccuggu

SEQ ID NO: 2902275 - RNA, 12 nt, Mycobacterium avium subsp. paratuberculosis
cuccggcgcggu

SEQ ID NO: 2902276 - RNA, 18 nt, Mycobacterium avium subsp. paratuberculosis
cuccggcggacccagcuc

SEQ ID NO: 2902277 - RNA, 22 nt, Mycobacterium avium subsp. paratuberculosis
cuccggcggacccagcuccucg

SEQ ID NO: 2902278 - RNA, 16 nt, Mycobacterium avium subsp. paratuberculosis
cuccggcggcagccag

SEQ ID NO: 2902279 - RNA, 13 nt, Mycobacterium avium subsp. paratuberculosis
cuccggcgucgaa

SEQ ID NO: 2902280 - RNA, 17 nt, Mycobacterium avium subsp. paratuberculosis
cuccgggaacgcggcga

SEQ ID NO: 2902281 - RNA, 18 nt, Mycobacterium avium subsp. paratuberculosis
cuccgggaaggcggccgc

SEQ ID NO: 2902282 - RNA, 20 nt, Mycobacterium avium subsp. paratuberculosis
cuccgggaaggcggccgcga

SEQ ID NO: 2902283 - RNA, 15 nt, Mycobacterium avium subsp. paratuberculosis
cuccgggcccaccag

SEQ ID NO: 2902284 - RNA, 17 nt, Mycobacterium avium subsp. paratuberculosis
cuccgggcccaccaggu

SEQ ID NO: 2902285 - RNA, 18 nt, Mycobacterium avium subsp. paratuberculosis
cuccgggcggcaccgcug

SEQ ID NO: 2902286 - RNA, 23 nt, Mycobacterium avium subsp. paratuberculosis
cuccgggguggccuuguggucga

SEQ ID NO: 2902287 - RNA, 16 nt, Mycobacterium avium subsp. paratuberculosis
cuccggguccccgccg

SEQ ID NO: 2902288 - RNA, 19 nt, Mycobacterium avium subsp. paratuberculosis
cuccggguccccgccgccg

SEQ ID NO: 2902289 - RNA, 16 nt, Mycobacterium avium subsp. paratuberculosis
cuccgguaccacgccg

SEQ ID NO: 2902290 - RNA, 17 nt, Mycobacterium avium subsp. paratuberculosis
cuccgguaccacgccgu

SEQ ID NO: 2902291 - RNA, 19 nt, Mycobacterium avium subsp. paratuberculosis
cuccgguaccacgccgucg

SEQ ID NO: 2902292 - RNA, 22 nt, Mycobacterium avium subsp. paratuberculosis
cuccgguaccacgccgucgacg

SEQ ID NO: 2902293 - RNA, 14 nt, Mycobacterium avium subsp. paratuberculosis
cuccgguccgggcu

SEQ ID NO: 2902294 - RNA, 23 nt, Mycobacterium avium subsp. paratuberculosis
cuccggucgcgucgugcggccgg

SEQ ID NO: 2902295 - RNA, 14 nt, Mycobacterium avium subsp. paratuberculosis
cuccggucggcgcu

SEQ ID NO: 2902296 - RNA, 12 nt, Mycobacterium avium subsp. paratuberculosis
cuccggugaacc

SEQ ID NO: 2902297 - RNA, 23 nt, Mycobacterium avium subsp. paratuberculosis
cuccggugaaccgcugaccagga

SEQ ID NO: 2902298 - RNA, 14 nt, Mycobacterium avium subsp. paratuberculosis
cuccgucagcgccg

SEQ ID NO: 2902299 - RNA, 20 nt, Mycobacterium avium subsp. paratuberculosis
cuccgucagcgccgcccgca

SEQ ID NO: 2902300 - RNA, 18 nt, Mycobacterium avium subsp. paratuberculosis
cuccgucgagucggccac

SEQ ID NO: 2902301 - RNA, 20 nt, Mycobacterium avium subsp. paratuberculosis
cuccgucgagucggccaccg

SEQ ID NO: 2902302 - RNA, 22 nt, Mycobacterium avium subsp. paratuberculosis
cuccgucgcgaucacaccacca

SEQ ID NO: 2902303 - RNA, 20 nt, Mycobacterium avium subsp. paratuberculosis
cuccgugccgauggccaccg

SEQ ID NO: 2902304 - RNA, 14 nt, Mycobacterium avium subsp. paratuberculosis
cuccgugcuggccg

SEQ ID NO: 2902305 - RNA, 14 nt, Mycobacterium avium subsp. paratuberculosis
cuccguggacggcg

SEQ ID NO: 2902306 - RNA, 16 nt, Mycobacterium avium subsp. paratuberculosis
cuccguggacggcgag

SEQ ID NO: 2902307 - RNA, 17 nt, Mycobacterium avium subsp. paratuberculosis
cuccguggacggcgagc

SEQ ID NO: 2902308 - RNA, 20 nt, Mycobacterium avium subsp. paratuberculosis
cuccguugggucucaucccg

SEQ ID NO: 2902309 - RNA, 21 nt, Mycobacterium avium subsp. paratuberculosis
cuccguugggucucaucccgc

SEQ ID NO: 2902310 - RNA, 18 nt, Mycobacterium avium subsp. paratuberculosis
cuccguugucgaggucgg

SEQ ID NO: 2902311 - RNA, 23 nt, Mycobacterium avium subsp. paratuberculosis
cuccuaugucggugcggcgggcu

SEQ ID NO: 2902312 - RNA, 12 nt, Mycobacterium avium subsp. paratuberculosis
cuccucacaccu

SEQ ID NO: 2902313 - RNA, 18 nt, Mycobacterium avium subsp. paratuberculosis
cuccucauaggcguacac

SEQ ID NO: 2902314 - RNA, 19 nt, Mycobacterium avium subsp. paratuberculosis
cuccuccaggaaacggccc

SEQ ID NO: 2902315 - RNA, 14 nt, Mycobacterium avium subsp. paratuberculosis
cuccuccggcccga

SEQ ID NO: 2902316 - RNA, 21 nt, Mycobacterium avium subsp. paratuberculosis
cuccuccgggcugaccucgcg

SEQ ID NO: 2902317 - RNA, 20 nt, Mycobacterium avium subsp. paratuberculosis
cuccuccggguccccgccgc

SEQ ID NO: 2902318 - RNA, 22 nt, Mycobacterium avium subsp. paratuberculosis
cuccuccggguccccgccgccg

SEQ ID NO: 2902319 - RNA, 15 nt, Mycobacterium avium subsp. paratuberculosis
cuccuccucgcugcc

SEQ ID NO: 2902320 - RNA, 15 nt, Mycobacterium avium subsp. paratuberculosis
cuccuccucggccag

SEQ ID NO: 2902321 - RNA, 16 nt, Mycobacterium avium subsp. paratuberculosis
cuccuccucggccagc

SEQ ID NO: 2902322 - RNA, 23 nt, Mycobacterium avium subsp. paratuberculosis
cuccucgaagaacgcgucccaca

SEQ ID NO: 2902323 - RNA, 18 nt, Mycobacterium avium subsp. paratuberculosis
cuccucgaccagcgcgcc

SEQ ID NO: 2902324 - RNA, 20 nt, Mycobacterium avium subsp. paratuberculosis
cuccucgaccagcgcgccgc

SEQ ID NO: 2902325 - RNA, 13 nt, Mycobacterium avium subsp. paratuberculosis
cuccucgaccccg

SEQ ID NO: 2902326 - RNA, 23 nt, Mycobacterium avium subsp. paratuberculosis
cuccucgacguaggugagcaacg

SEQ ID NO: 2902327 - RNA, 19 nt, Mycobacterium avium subsp. paratuberculosis
cuccucgaucugggccagg

SEQ ID NO: 2902328 - RNA, 21 nt, Mycobacterium avium subsp. paratuberculosis
cuccucgaucugggccaggau

SEQ ID NO: 2902329 - RNA, 17 nt, Mycobacterium avium subsp. paratuberculosis
cuccucgauggucgucg

SEQ ID NO: 2902330 - RNA, 14 nt, Mycobacterium avium subsp. paratuberculosis
cuccucgcgccgcc

SEQ ID NO: 2902331 - RNA, 23 nt, Mycobacterium avium subsp. paratuberculosis
cuccucgcgccgccacgcggcgc

SEQ ID NO: 2902332 - RNA, 22 nt, Mycobacterium avium subsp. paratuberculosis
cuccucgcggaacugcucccag

SEQ ID NO: 2902333 - RNA, 16 nt, Mycobacterium avium subsp. paratuberculosis
cuccucgcugccggcc

SEQ ID NO: 2902334 - RNA, 14 nt, Mycobacterium avium subsp. paratuberculosis
cuccucggccagca

SEQ ID NO: 2902335 - RNA, 15 nt, Mycobacterium avium subsp. paratuberculosis
cuccucggccagcac

SEQ ID NO: 2902336 - RNA, 23 nt, Mycobacterium avium subsp. paratuberculosis
cuccucggccagcaccagcagcc

SEQ ID NO: 2902337 - RNA, 16 nt, Mycobacterium avium subsp. paratuberculosis
cuccucggccagcccc

SEQ ID NO: 2902338 - RNA, 13 nt, Mycobacterium avium subsp. paratuberculosis
cuccucggcccca

SEQ ID NO: 2902339 - RNA, 14 nt, Mycobacterium avium subsp. paratuberculosis
cuccucggccccaa

SEQ ID NO: 2902340 - RNA, 14 nt, Mycobacterium avium subsp. paratuberculosis
cuccucggcggccu

SEQ ID NO: 2902341 - RNA, 16 nt, Mycobacterium avium subsp. paratuberculosis
cuccucggggaugacg

SEQ ID NO: 2902342 - RNA, 16 nt, Mycobacterium avium subsp. paratuberculosis
cuccucggucagcggc

SEQ ID NO: 2902343 - RNA, 18 nt, Mycobacterium avium subsp. paratuberculosis
cuccucggucagcucggg

SEQ ID NO: 2902344 - RNA, 20 nt, Mycobacterium avium subsp. paratuberculosis
cuccucggucagcucggggu

SEQ ID NO: 2902345 - RNA, 16 nt, Mycobacterium avium subsp. paratuberculosis
cuccucggugaccucg

SEQ ID NO: 2902346 - RNA, 17 nt, Mycobacterium avium subsp. paratuberculosis
cuccucgucggcuccgu

SEQ ID NO: 2902347 - RNA, 17 nt, Mycobacterium avium subsp. paratuberculosis
cuccucuucgcugccgc

SEQ ID NO: 2902348 - RNA, 20 nt, Mycobacterium avium subsp. paratuberculosis
cuccucuucgcugccgccgc

SEQ ID NO: 2902349 - RNA, 14 nt, Mycobacterium avium subsp. paratuberculosis
cuccugacgcaccu

SEQ ID NO: 2902350 - RNA, 19 nt, Mycobacterium avium subsp. paratuberculosis
cuccugcaggaucagcacu

SEQ ID NO: 2902351 - RNA, 23 nt, Mycobacterium avium subsp. paratuberculosis
cuccugcaggaucagcacuucau

SEQ ID NO: 2902352 - RNA, 14 nt, Mycobacterium avium subsp. paratuberculosis
cuccugcaggccga

SEQ ID NO: 2902353 - RNA, 18 nt, Mycobacterium avium subsp. paratuberculosis
cuccugcaggccgagccg

SEQ ID NO: 2902354 - RNA, 15 nt, Mycobacterium avium subsp. paratuberculosis
cuccugccagcggcg

SEQ ID NO: 2902355 - RNA, 19 nt, Mycobacterium avium subsp. paratuberculosis
cuccugccguucggccagc

SEQ ID NO: 2902356 - RNA, 15 nt, Mycobacterium avium subsp. paratuberculosis
cuccugcgacggcag

SEQ ID NO: 2902357 - RNA, 17 nt, Mycobacterium avium subsp. paratuberculosis
cuccugcuggcgcugcc

SEQ ID NO: 2902358 - RNA, 23 nt, Mycobacterium avium subsp. paratuberculosis
cuccuggaagaagucggugucga

SEQ ID NO: 2902359 - RNA, 19 nt, Mycobacterium avium subsp. paratuberculosis
cuccuggaaggacgucagg

SEQ ID NO: 2902360 - RNA, 13 nt, Mycobacterium avium subsp. paratuberculosis
cuccuggccccga

SEQ ID NO: 2902361 - RNA, 13 nt, Mycobacterium avium subsp. paratuberculosis
cuccuggccgccg

SEQ ID NO: 2902362 - RNA, 14 nt, Mycobacterium avium subsp. paratuberculosis
cuccuggccgccgu

SEQ ID NO: 2902363 - RNA, 16 nt, Mycobacterium avium subsp. paratuberculosis
cuccuggggcagaucg

SEQ ID NO: 2902364 - RNA, 23 nt, Mycobacterium avium subsp. paratuberculosis
cuccugggugagcggcgcgucca

SEQ ID NO: 2902365 - RNA, 21 nt, Mycobacterium avium subsp. paratuberculosis
cuccugggugaguucgucggc

SEQ ID NO: 2902366 - RNA, 23 nt, Mycobacterium avium subsp. paratuberculosis
cuccugggugaguucgucggcga

SEQ ID NO: 2902367 - RNA, 23 nt, Mycobacterium avium subsp. paratuberculosis
cuccuggugucguauuguccugu

SEQ ID NO: 2902368 - RNA, 15 nt, Mycobacterium avium subsp. paratuberculosis
cuccuugacccggcc

SEQ ID NO: 2902369 - RNA, 17 nt, Mycobacterium avium subsp. paratuberculosis
cuccuugagccgccgcg

SEQ ID NO: 2902370 - RNA, 21 nt, Mycobacterium avium subsp. paratuberculosis
cuccuuggccaggcgggccac

SEQ ID NO: 2902371 - RNA, 22 nt, Mycobacterium avium subsp. paratuberculosis
cuccuuggggcugaccucgccg

SEQ ID NO: 2902372 - RNA, 15 nt, Mycobacterium avium subsp. paratuberculosis
cuccuuggguucggc

SEQ ID NO: 2902373 - RNA, 19 nt, Mycobacterium avium subsp. paratuberculosis
cuccuuggguucggcggcg

SEQ ID NO: 2902374 - RNA, 13 nt, Mycobacterium avium subsp. paratuberculosis
cucgaaagccgcu

SEQ ID NO: 2902375 - RNA, 16 nt, Mycobacterium avium subsp. paratuberculosis
cucgaacacccggcuu

SEQ ID NO: 2902376 - RNA, 12 nt, Mycobacterium avium subsp. paratuberculosis
cucgaacaccgc

SEQ ID NO: 2902377 - RNA, 14 nt, Mycobacterium avium subsp. paratuberculosis
cucgaacaccgucg

SEQ ID NO: 2902378 - RNA, 16 nt, Mycobacterium avium subsp. paratuberculosis
cucgaacacgccgucg

SEQ ID NO: 2902379 - RNA, 20 nt, Mycobacterium avium subsp. paratuberculosis
cucgaacacgccgucguggg

SEQ ID NO: 2902380 - RNA, 15 nt, Mycobacterium avium subsp. paratuberculosis
cucgaacaggcuggc

SEQ ID NO: 2902381 - RNA, 17 nt, Mycobacterium avium subsp. paratuberculosis
cucgaacaggcuggcca

SEQ ID NO: 2902382 - RNA, 19 nt, Mycobacterium avium subsp. paratuberculosis
cucgaacaggcuggccagc

SEQ ID NO: 2902383 - RNA, 20 nt, Mycobacterium avium subsp. paratuberculosis
cucgaacaggcuggccagcu

SEQ ID NO: 2902384 - RNA, 18 nt, Mycobacterium avium subsp. paratuberculosis
cucgaacaucggcacgug

SEQ ID NO: 2902385 - RNA, 23 nt, Mycobacterium avium subsp. paratuberculosis
cucgaaccgcuugcccagccccu

SEQ ID NO: 2902386 - RNA, 15 nt, Mycobacterium avium subsp. paratuberculosis
cucgaaccgggcggu

SEQ ID NO: 2902387 - RNA, 17 nt, Mycobacterium avium subsp. paratuberculosis
cucgaaccgggcgguga

SEQ ID NO: 2902388 - RNA, 13 nt, Mycobacterium avium subsp. paratuberculosis
cucgaaccggggc

SEQ ID NO: 2902389 - RNA, 14 nt, Mycobacterium avium subsp. paratuberculosis
cucgaaccggggca

SEQ ID NO: 2902390 - RNA, 13 nt, Mycobacterium avium subsp. paratuberculosis
cucgaaccuggag

SEQ ID NO: 2902391 - RNA, 12 nt, Mycobacterium avium subsp. paratuberculosis
cucgaacgccgg

SEQ ID NO: 2902392 - RNA, 14 nt, Mycobacterium avium subsp. paratuberculosis
cucgaacgcgccga

SEQ ID NO: 2902393 - RNA, 14 nt, Mycobacterium avium subsp. paratuberculosis
cucgaacggcccgg

SEQ ID NO: 2902394 - RNA, 14 nt, Mycobacterium avium subsp. paratuberculosis
cucgaacgggucga

SEQ ID NO: 2902395 - RNA, 21 nt, Mycobacterium avium subsp. paratuberculosis
cucgaacucaccgguggccgc

SEQ ID NO: 2902396 - RNA, 22 nt, Mycobacterium avium subsp. paratuberculosis
cucgaagaaccgcaacaccagc

SEQ ID NO: 2902397 - RNA, 13 nt, Mycobacterium avium subsp. paratuberculosis
cucgaagaucucc

SEQ ID NO: 2902398 - RNA, 18 nt, Mycobacterium avium subsp. paratuberculosis
cucgaagaucuccgggaa

SEQ ID NO: 2902399 - RNA, 23 nt, Mycobacterium avium subsp. paratuberculosis
cucgaagauggucgcgccgcggc

SEQ ID NO: 2902400 - RNA, 18 nt, Mycobacterium avium subsp. paratuberculosis
cucgaagcagccuucuug

SEQ ID NO: 2902401 - RNA, 16 nt, Mycobacterium avium subsp. paratuberculosis
cucgaagccgaucgcg

SEQ ID NO: 2902402 - RNA, 20 nt, Mycobacterium avium subsp. paratuberculosis
cucgaagccgaucgcggcga

SEQ ID NO: 2902403 - RNA, 19 nt, Mycobacterium avium subsp. paratuberculosis
cucgaagcgacaaaggagg

SEQ ID NO: 2902404 - RNA, 20 nt, Mycobacterium avium subsp. paratuberculosis
cucgaagcgacaaaggaggg

SEQ ID NO: 2902405 - RNA, 17 nt, Mycobacterium avium subsp. paratuberculosis
cucgaagcgcagcagcu

SEQ ID NO: 2902406 - RNA, 20 nt, Mycobacterium avium subsp. paratuberculosis
cucgaagcgcagcagcucgu

SEQ ID NO: 2902407 - RNA, 14 nt, Mycobacterium avium subsp. paratuberculosis
cucgaagcugcgcc

SEQ ID NO: 2902408 - RNA, 23 nt, Mycobacterium avium subsp. paratuberculosis
cucgaagcugcgccacaacuggc

SEQ ID NO: 2902409 - RNA, 16 nt, Mycobacterium avium subsp. paratuberculosis
cucgaaguagagccgc

SEQ ID NO: 2902410 - RNA, 17 nt, Mycobacterium avium subsp. paratuberculosis
cucgaagucgccggccu

SEQ ID NO: 2902411 - RNA, 20 nt, Mycobacterium avium subsp. paratuberculosis
cucgaaguggacaugcagcc

SEQ ID NO: 2902412 - RNA, 16 nt, Mycobacterium avium subsp. paratuberculosis
cucgaaguggcagcgc

SEQ ID NO: 2902413 - RNA, 17 nt, Mycobacterium avium subsp. paratuberculosis
cucgaaguggcagcgcu

SEQ ID NO: 2902414 - RNA, 21 nt, Mycobacterium avium subsp. paratuberculosis
cucgaaguggcagcgcuccug

SEQ ID NO: 2902415 - RNA, 13 nt, Mycobacterium avium subsp. paratuberculosis
cucgacaccggcg

SEQ ID NO: 2902416 - RNA, 21 nt, Mycobacterium avium subsp. paratuberculosis
cucgacacgggccgcgccgag

SEQ ID NO: 2902417 - RNA, 15 nt, Mycobacterium avium subsp. paratuberculosis
cucgacaggcagccc

SEQ ID NO: 2902418 - RNA, 18 nt, Mycobacterium avium subsp. paratuberculosis
cucgacaggcagcccggc

SEQ ID NO: 2902419 - RNA, 13 nt, Mycobacterium avium subsp. paratuberculosis
cucgaccacccgg

SEQ ID NO: 2902420 - RNA, 18 nt, Mycobacterium avium subsp. paratuberculosis
cucgaccacccggcgggc

SEQ ID NO: 2902421 - RNA, 20 nt, Mycobacterium avium subsp. paratuberculosis
cucgaccacccggcgggcca

SEQ ID NO: 2902422 - RNA, 23 nt, Mycobacterium avium subsp. paratuberculosis
cucgaccaccucuucgcggucca

SEQ ID NO: 2902423 - RNA, 20 nt, Mycobacterium avium subsp. paratuberculosis
cucgaccagauugcggcacc

SEQ ID NO: 2902424 - RNA, 14 nt, Mycobacterium avium subsp. paratuberculosis
cucgaccagcaccg

SEQ ID NO: 2902425 - RNA, 13 nt, Mycobacterium avium subsp. paratuberculosis
cucgaccagcgcc

SEQ ID NO: 2902426 - RNA, 14 nt, Mycobacterium avium subsp. paratuberculosis
cucgaccagcgccg

SEQ ID NO: 2902427 - RNA, 18 nt, Mycobacterium avium subsp. paratuberculosis
cucgaccagcgcgccgcc

SEQ ID NO: 2902428 - RNA, 19 nt, Mycobacterium avium subsp. paratuberculosis
cucgaccagcgcgccgccc

SEQ ID NO: 2902429 - RNA, 22 nt, Mycobacterium avium subsp. paratuberculosis
cucgaccagcgcgccgcccagc

SEQ ID NO: 2902430 - RNA, 20 nt, Mycobacterium avium subsp. paratuberculosis
cucgaccaggcuuggcccgc

SEQ ID NO: 2902431 - RNA, 20 nt, Mycobacterium avium subsp. paratuberculosis
cucgaccccgaaggcguugg

SEQ ID NO: 2902432 - RNA, 13 nt, Mycobacterium avium subsp. paratuberculosis
cucgaccccgccc

SEQ ID NO: 2902433 - RNA, 16 nt, Mycobacterium avium subsp. paratuberculosis
cucgaccccucggcau

SEQ ID NO: 2902434 - RNA, 15 nt, Mycobacterium avium subsp. paratuberculosis
cucgacccgcaccuc

SEQ ID NO: 2902435 - RNA, 16 nt, Mycobacterium avium subsp. paratuberculosis
cucgacccgcaccucg

SEQ ID NO: 2902436 - RNA, 16 nt, Mycobacterium avium subsp. paratuberculosis
cucgacccgggccagc

SEQ ID NO: 2902437 - RNA, 17 nt, Mycobacterium avium subsp. paratuberculosis
cucgacccgggccagca

SEQ ID NO: 2902438 - RNA, 19 nt, Mycobacterium avium subsp. paratuberculosis
cucgacccguuccggcgag

SEQ ID NO: 2902439 - RNA, 22 nt, Mycobacterium avium subsp. paratuberculosis
cucgaccgcggcgauggcccgc

SEQ ID NO: 2902440 - RNA, 18 nt, Mycobacterium avium subsp. paratuberculosis
cucgaccgcggcgccgau

SEQ ID NO: 2902441 - RNA, 15 nt, Mycobacterium avium subsp. paratuberculosis
cucgaccgcgguggc

SEQ ID NO: 2902442 - RNA, 21 nt, Mycobacterium avium subsp. paratuberculosis
cucgaccgcgguggcggugcg

SEQ ID NO: 2902443 - RNA, 17 nt, Mycobacterium avium subsp. paratuberculosis
cucgaccucggcgacca

SEQ ID NO: 2902444 - RNA, 14 nt, Mycobacterium avium subsp. paratuberculosis
cucgaccucggcgg

SEQ ID NO: 2902445 - RNA, 15 nt, Mycobacterium avium subsp. paratuberculosis
cucgaccucggcggc

SEQ ID NO: 2902446 - RNA, 19 nt, Mycobacterium avium subsp. paratuberculosis
cucgaccucggcggccagc

SEQ ID NO: 2902447 - RNA, 21 nt, Mycobacterium avium subsp. paratuberculosis
cucgaccucggcggccagcgc

SEQ ID NO: 2902448 - RNA, 14 nt, Mycobacterium avium subsp. paratuberculosis
cucgaccucgucgg

SEQ ID NO: 2902449 - RNA, 20 nt, Mycobacterium avium subsp. paratuberculosis
cucgaccucgucggcggcga

SEQ ID NO: 2902450 - RNA, 21 nt, Mycobacterium avium subsp. paratuberculosis
cucgaccucgucggcggcgac

SEQ ID NO: 2902451 - RNA, 22 nt, Mycobacterium avium subsp. paratuberculosis
cucgaccucgucggcggcgacg

SEQ ID NO: 2902452 - RNA, 23 nt, Mycobacterium avium subsp. paratuberculosis
cucgaccucgucggcggcgacgg

SEQ ID NO: 2902453 - RNA, 19 nt, Mycobacterium avium subsp. paratuberculosis
cucgaccucuucggcgccg

SEQ ID NO: 2902454 - RNA, 21 nt, Mycobacterium avium subsp. paratuberculosis
cucgaccucuucggcgccggc

SEQ ID NO: 2902455 - RNA, 22 nt, Mycobacterium avium subsp. paratuberculosis
cucgaccucuucggcgccggca

SEQ ID NO: 2902456 - RNA, 23 nt, Mycobacterium avium subsp. paratuberculosis
cucgaccucuucggcgccggcau

SEQ ID NO: 2902457 - RNA, 17 nt, Mycobacterium avium subsp. paratuberculosis
cucgaccugcccgggcc

SEQ ID NO: 2902458 - RNA, 19 nt, Mycobacterium avium subsp. paratuberculosis
cucgaccugggucaucacc

SEQ ID NO: 2902459 - RNA, 21 nt, Mycobacterium avium subsp. paratuberculosis
cucgaccugggucaucaccuu

SEQ ID NO: 2902460 - RNA, 16 nt, Mycobacterium avium subsp. paratuberculosis
cucgaccuucgagccg

SEQ ID NO: 2902461 - RNA, 17 nt, Mycobacterium avium subsp. paratuberculosis
cucgaccuucgagccgc

SEQ ID NO: 2902462 - RNA, 18 nt, Mycobacterium avium subsp. paratuberculosis
cucgaccuucgagccgcc

SEQ ID NO: 2902463 - RNA, 20 nt, Mycobacterium avium subsp. paratuberculosis
cucgaccuucgagccgccgc

SEQ ID NO: 2902464 - RNA, 22 nt, Mycobacterium avium subsp. paratuberculosis
cucgaccuucgagccgccgccg

SEQ ID NO: 2902465 - RNA, 13 nt, Mycobacterium avium subsp. paratuberculosis
cucgaccuucuug

SEQ ID NO: 2902466 - RNA, 14 nt, Mycobacterium avium subsp. paratuberculosis
cucgaccuucuugu

SEQ ID NO: 2902467 - RNA, 19 nt, Mycobacterium avium subsp. paratuberculosis
cucgacgaacgcggcggag

SEQ ID NO: 2902468 - RNA, 16 nt, Mycobacterium avium subsp. paratuberculosis
cucgacgaacuccgcg

SEQ ID NO: 2902469 - RNA, 23 nt, Mycobacterium avium subsp. paratuberculosis
cucgacgaacuccgcgcgcggca

SEQ ID NO: 2902470 - RNA, 24 nt, Mycobacterium avium subsp. paratuberculosis
cucgacgaagauggcgugccacag

SEQ ID NO: 2902471 - RNA, 19 nt, Mycobacterium avium subsp. paratuberculosis
cucgacgaccucgccgacg

SEQ ID NO: 2902472 - RNA, 17 nt, Mycobacterium avium subsp. paratuberculosis
cucgacgaggcgggcga

SEQ ID NO: 2902473 - RNA, 13 nt, Mycobacterium avium subsp. paratuberculosis
cucgacgaucagc

SEQ ID NO: 2902474 - RNA, 16 nt, Mycobacterium avium subsp. paratuberculosis
cucgacgaucagcacg

SEQ ID NO: 2902475 - RNA, 19 nt, Mycobacterium avium subsp. paratuberculosis
cucgacgaugucgacgccc

SEQ ID NO: 2902476 - RNA, 22 nt, Mycobacterium avium subsp. paratuberculosis
cucgacgauugucggggccgca

SEQ ID NO: 2902477 - RNA, 13 nt, Mycobacterium avium subsp. paratuberculosis
cucgacgccgcgc

SEQ ID NO: 2902478 - RNA, 14 nt, Mycobacterium avium subsp. paratuberculosis
cucgacgccgcgca

SEQ ID NO: 2902479 - RNA, 13 nt, Mycobacterium avium subsp. paratuberculosis
cucgacgccgggc

SEQ ID NO: 2902480 - RNA, 15 nt, Mycobacterium avium subsp. paratuberculosis
cucgacgccgggcag

SEQ ID NO: 2902481 - RNA, 13 nt, Mycobacterium avium subsp. paratuberculosis
cucgacgcgucga

SEQ ID NO: 2902482 - RNA, 14 nt, Mycobacterium avium subsp. paratuberculosis
cucgacgcucggcg

SEQ ID NO: 2902483 - RNA, 15 nt, Mycobacterium avium subsp. paratuberculosis
cucgacgcucggcga

SEQ ID NO: 2902484 - RNA, 14 nt, Mycobacterium avium subsp. paratuberculosis
cucgacggcacccg

SEQ ID NO: 2902485 - RNA, 15 nt, Mycobacterium avium subsp. paratuberculosis
cucgacggccgguga

SEQ ID NO: 2902486 - RNA, 15 nt, Mycobacterium avium subsp. paratuberculosis
cucgacggcgccgac

SEQ ID NO: 2902487 - RNA, 16 nt, Mycobacterium avium subsp. paratuberculosis
cucgacggcgccgacg

SEQ ID NO: 2902488 - RNA, 13 nt, Mycobacterium avium subsp. paratuberculosis
cucgacggcgugg

SEQ ID NO: 2902489 - RNA, 13 nt, Mycobacterium avium subsp. paratuberculosis
cucgacggugacc

SEQ ID NO: 2902490 - RNA, 14 nt, Mycobacterium avium subsp. paratuberculosis
cucgacggugaccg

SEQ ID NO: 2902491 - RNA, 18 nt, Mycobacterium avium subsp. paratuberculosis
cucgacggugaccggcuc

SEQ ID NO: 2902492 - RNA, 22 nt, Mycobacterium avium subsp. paratuberculosis
cucgacggugaccucgucgggc

SEQ ID NO: 2902493 - RNA, 15 nt, Mycobacterium avium subsp. paratuberculosis
cucgacggugcugcc

SEQ ID NO: 2902494 - RNA, 20 nt, Mycobacterium avium subsp. paratuberculosis
cucgacgguggagcggccca

SEQ ID NO: 2902495 - RNA, 22 nt, Mycobacterium avium subsp. paratuberculosis
cucgacgguggagcggcccagc

SEQ ID NO: 2902496 - RNA, 17 nt, Mycobacterium avium subsp. paratuberculosis
cucgacgguggccucgg

SEQ ID NO: 2902497 - RNA, 18 nt, Mycobacterium avium subsp. paratuberculosis
cucgacgguggccucggc

SEQ ID NO: 2902498 - RNA, 16 nt, Mycobacterium avium subsp. paratuberculosis
cucgacguaggccaga

SEQ ID NO: 2902499 - RNA, 23 nt, Mycobacterium avium subsp. paratuberculosis
cucgacguaggugagcaacgcca

SEQ ID NO: 2902500 - RNA, 22 nt, Mycobacterium avium subsp. paratuberculosis
cucgacguaguccggccagucc

SEQ ID NO: 2902501 - RNA, 23 nt, Mycobacterium avium subsp. paratuberculosis
cucgacguaguccggccagucca

SEQ ID NO: 2902502 - RNA, 20 nt, Mycobacterium avium subsp. paratuberculosis
cucgacguagucgcgcacca

SEQ ID NO: 2902503 - RNA, 20 nt, Mycobacterium avium subsp. paratuberculosis
cucgacguccaggccggcgc

SEQ ID NO: 2902504 - RNA, 19 nt, Mycobacterium avium subsp. paratuberculosis
cucgagagucgcuggcgcg

SEQ ID NO: 2902505 - RNA, 19 nt, Mycobacterium avium subsp. paratuberculosis
cucgagauucugcagccgc

SEQ ID NO: 2902506 - RNA, 19 nt, Mycobacterium avium subsp. paratuberculosis
cucgagcaacggccgcagc

SEQ ID NO: 2902507 - RNA, 23 nt, Mycobacterium avium subsp. paratuberculosis
cucgagcaacggccgcagcgacu

SEQ ID NO: 2902508 - RNA, 13 nt, Mycobacterium avium subsp. paratuberculosis
cucgagcaccacg

SEQ ID NO: 2902509 - RNA, 19 nt, Mycobacterium avium subsp. paratuberculosis
cucgagcaccacggcccgc

SEQ ID NO: 2902510 - RNA, 11 nt, Mycobacterium avium subsp. paratuberculosis
cucgagcaccg

SEQ ID NO: 2902511 - RNA, 14 nt, Mycobacterium avium subsp. paratuberculosis
cucgagcaccggcg

SEQ ID NO: 2902512 - RNA, 17 nt, Mycobacterium avium subsp. paratuberculosis
cucgagcaccggcggca

SEQ ID NO: 2902513 - RNA, 14 nt, Mycobacterium avium subsp. paratuberculosis
cucgagcacgcccu

SEQ ID NO: 2902514 - RNA, 17 nt, Mycobacterium avium subsp. paratuberculosis
cucgagcacucgcggga

SEQ ID NO: 2902515 - RNA, 14 nt, Mycobacterium avium subsp. paratuberculosis
cucgagcagcgcgc

SEQ ID NO: 2902516 - RNA, 16 nt, Mycobacterium avium subsp. paratuberculosis
cucgagcagcgcgcgc

SEQ ID NO: 2902517 - RNA, 18 nt, Mycobacterium avium subsp. paratuberculosis
cucgagcagcgcgcgcuu

SEQ ID NO: 2902518 - RNA, 21 nt, Mycobacterium avium subsp. paratuberculosis
cucgagcaggaacagacacag

SEQ ID NO: 2902519 - RNA, 22 nt, Mycobacterium avium subsp. paratuberculosis
cucgagcaggaacagacacagc

SEQ ID NO: 2902520 - RNA, 21 nt, Mycobacterium avium subsp. paratuberculosis
cucgagcagugcaucgcugcc

SEQ ID NO: 2902521 - RNA, 18 nt, Mycobacterium avium subsp. paratuberculosis
cucgagcauccggugccg

SEQ ID NO: 2902522 - RNA, 19 nt, Mycobacterium avium subsp. paratuberculosis
cucgagcaucuccagccgg

SEQ ID NO: 2902523 - RNA, 14 nt, Mycobacterium avium subsp. paratuberculosis
cucgagcaucucga

SEQ ID NO: 2902524 - RNA, 19 nt, Mycobacterium avium subsp. paratuberculosis
cucgagcaucucggugccg

SEQ ID NO: 2902525 - RNA, 20 nt, Mycobacterium avium subsp. paratuberculosis
cucgagcaucucggugccgu

SEQ ID NO: 2902526 - RNA, 23 nt, Mycobacterium avium subsp. paratuberculosis
cucgagcaucucggugccgucga

SEQ ID NO: 2902527 - RNA, 22 nt, Mycobacterium avium subsp. paratuberculosis
cucgagccauaaaccggccggc

SEQ ID NO: 2902528 - RNA, 14 nt, Mycobacterium avium subsp. paratuberculosis
cucgagccggcgca

SEQ ID NO: 2902529 - RNA, 17 nt, Mycobacterium avium subsp. paratuberculosis
cucgagccggcgcacuc

SEQ ID NO: 2902530 - RNA, 13 nt, Mycobacterium avium subsp. paratuberculosis
cucgagcgcccgg

SEQ ID NO: 2902531 - RNA, 13 nt, Mycobacterium avium subsp. paratuberculosis
cucgagcgcgcuc

SEQ ID NO: 2902532 - RNA, 20 nt, Mycobacterium avium subsp. paratuberculosis
cucgagcgcgcucaaccgcc

SEQ ID NO: 2902533 - RNA, 22 nt, Mycobacterium avium subsp. paratuberculosis
cucgagcgcgucgaccagccgc

SEQ ID NO: 2902534 - RNA, 15 nt, Mycobacterium avium subsp. paratuberculosis
cucgagcgucacgcu

SEQ ID NO: 2902535 - RNA, 15 nt, Mycobacterium avium subsp. paratuberculosis
cucgagcgugcccgc

SEQ ID NO: 2902536 - RNA, 16 nt, Mycobacterium avium subsp. paratuberculosis
cucgagcgugcccgcg

SEQ ID NO: 2902537 - RNA, 17 nt, Mycobacterium avium subsp. paratuberculosis
cucgagcgugcccgcgc

SEQ ID NO: 2902538 - RNA, 20 nt, Mycobacterium avium subsp. paratuberculosis
cucgagcgugcccgcgccca

SEQ ID NO: 2902539 - RNA, 16 nt, Mycobacterium avium subsp. paratuberculosis
cucgagcucaccgaca

SEQ ID NO: 2902540 - RNA, 13 nt, Mycobacterium avium subsp. paratuberculosis
cucgagcucggcg

SEQ ID NO: 2902541 - RNA, 23 nt, Mycobacterium avium subsp. paratuberculosis
cucgagcuuccgccgagucgcgc

SEQ ID NO: 2902542 - RNA, 18 nt, Mycobacterium avium subsp. paratuberculosis
cucgaggaucgcggccac

SEQ ID NO: 2902543 - RNA, 20 nt, Mycobacterium avium subsp. paratuberculosis
cucgaggaucgcggccacgc

SEQ ID NO: 2902544 - RNA, 19 nt, Mycobacterium avium subsp. paratuberculosis
cucgaggccccgcgugacg

SEQ ID NO: 2902545 - RNA, 23 nt, Mycobacterium avium subsp. paratuberculosis
cucgaggccccgcgugacggccg

SEQ ID NO: 2902546 - RNA, 24 nt, Mycobacterium avium subsp. paratuberculosis
cucgaggccccgcgugacggccgc

SEQ ID NO: 2902547 - RNA, 15 nt, Mycobacterium avium subsp. paratuberculosis
cucgaggccgagguc

SEQ ID NO: 2902548 - RNA, 21 nt, Mycobacterium avium subsp. paratuberculosis
cucgagggccuccaccaccau

SEQ ID NO: 2902549 - RNA, 16 nt, Mycobacterium avium subsp. paratuberculosis
cucgagggcggcgacc

SEQ ID NO: 2902550 - RNA, 15 nt, Mycobacterium avium subsp. paratuberculosis
cucgagugccggcag

SEQ ID NO: 2902551 - RNA, 18 nt, Mycobacterium avium subsp. paratuberculosis
cucgagugccggcagccc

SEQ ID NO: 2902552 - RNA, 20 nt, Mycobacterium avium subsp. paratuberculosis
cucgagugccggcagcccgg

SEQ ID NO: 2902553 - RNA, 18 nt, Mycobacterium avium subsp. paratuberculosis
cucgaguuuggccagcuc

SEQ ID NO: 2902554 - RNA, 20 nt, Mycobacterium avium subsp. paratuberculosis
cucgaguuuggccagcucgg

SEQ ID NO: 2902555 - RNA, 20 nt, Mycobacterium avium subsp. paratuberculosis
cucgauaauggcggccgccg

SEQ ID NO: 2902556 - RNA, 17 nt, Mycobacterium avium subsp. paratuberculosis
cucgaucaacgccgggu

SEQ ID NO: 2902557 - RNA, 22 nt, Mycobacterium avium subsp. paratuberculosis
cucgaucaacgccgggucgacg

SEQ ID NO: 2902558 - RNA, 23 nt, Mycobacterium avium subsp. paratuberculosis
cucgaucaacgccgggucgacgc

SEQ ID NO: 2902559 - RNA, 13 nt, Mycobacterium avium subsp. paratuberculosis
cucgaucacccag

SEQ ID NO: 2902560 - RNA, 15 nt, Mycobacterium avium subsp. paratuberculosis
cucgaucacccaggu

SEQ ID NO: 2902561 - RNA, 13 nt, Mycobacterium avium subsp. paratuberculosis
cucgaucaccgac

SEQ ID NO: 2902562 - RNA, 18 nt, Mycobacterium avium subsp. paratuberculosis
cucgaucaccgggcggcc

SEQ ID NO: 2902563 - RNA, 18 nt, Mycobacterium avium subsp. paratuberculosis
cucgaucagagcgggccg

SEQ ID NO: 2902564 - RNA, 20 nt, Mycobacterium avium subsp. paratuberculosis
cucgaucagagcgggccgac

SEQ ID NO: 2902565 - RNA, 22 nt, Mycobacterium avium subsp. paratuberculosis
cucgaucagagcgggccgaccg

SEQ ID NO: 2902566 - RNA, 17 nt, Mycobacterium avium subsp. paratuberculosis
cucgaucagcaccgcca

SEQ ID NO: 2902567 - RNA, 23 nt, Mycobacterium avium subsp. paratuberculosis
cucgaucagcgacucgaccccgc

SEQ ID NO: 2902568 - RNA, 17 nt, Mycobacterium avium subsp. paratuberculosis
cucgaucagcggcaucg

SEQ ID NO: 2902569 - RNA, 14 nt, Mycobacterium avium subsp. paratuberculosis
cucgaucagucguc

SEQ ID NO: 2902570 - RNA, 18 nt, Mycobacterium avium subsp. paratuberculosis
cucgaucaucaccaccgc

SEQ ID NO: 2902571 - RNA, 22 nt, Mycobacterium avium subsp. paratuberculosis
cucgaucaucaccaccgccgcc

SEQ ID NO: 2902572 - RNA, 23 nt, Mycobacterium avium subsp. paratuberculosis
cucgaucaucaccaccgccgccg

SEQ ID NO: 2902573 - RNA, 21 nt, Mycobacterium avium subsp. paratuberculosis
cucgauccgguccagcccggu

SEQ ID NO: 2902574 - RNA, 16 nt, Mycobacterium avium subsp. paratuberculosis
cucgaucgacaccucg

SEQ ID NO: 2902575 - RNA, 15 nt, Mycobacterium avium subsp. paratuberculosis
cucgaucgacgacgc

SEQ ID NO: 2902576 - RNA, 18 nt, Mycobacterium avium subsp. paratuberculosis
cucgaucgacgacgccag

SEQ ID NO: 2902577 - RNA, 22 nt, Mycobacterium avium subsp. paratuberculosis
cucgaucgacgacgccagcugc

SEQ ID NO: 2902578 - RNA, 15 nt, Mycobacterium avium subsp. paratuberculosis
cucgaucgccaccga

SEQ ID NO: 2902579 - RNA, 18 nt, Mycobacterium avium subsp. paratuberculosis
cucgaucgccaccgagau

SEQ ID NO: 2902580 - RNA, 15 nt, Mycobacterium avium subsp. paratuberculosis
cucgaucgccgcgcc

SEQ ID NO: 2902581 - RNA, 18 nt, Mycobacterium avium subsp. paratuberculosis
cucgaucgccgcgcccag

SEQ ID NO: 2902582 - RNA, 19 nt, Mycobacterium avium subsp. paratuberculosis
cucgaucgcgaccaccggc

SEQ ID NO: 2902583 - RNA, 14 nt, Mycobacterium avium subsp. paratuberculosis
cucgaucgcgguca

SEQ ID NO: 2902584 - RNA, 15 nt, Mycobacterium avium subsp. paratuberculosis
cucgaucgcggucac

SEQ ID NO: 2902585 - RNA, 23 nt, Mycobacterium avium subsp. paratuberculosis
cucgaucgcguucugcaccagcu

SEQ ID NO: 2902586 - RNA, 21 nt, Mycobacterium avium subsp. paratuberculosis
cucgaucggcgcgccgaagau

SEQ ID NO: 2902587 - RNA, 22 nt, Mycobacterium avium subsp. paratuberculosis
cucgaucggggaauccuggccg

SEQ ID NO: 2902588 - RNA, 17 nt, Mycobacterium avium subsp. paratuberculosis
cucgaucguccgaggcc

SEQ ID NO: 2902589 - RNA, 22 nt, Mycobacterium avium subsp. paratuberculosis
cucgaucguccgaggccccgcc

SEQ ID NO: 2902590 - RNA, 17 nt, Mycobacterium avium subsp. paratuberculosis
cucgaucucggccaccg

SEQ ID NO: 2902591 - RNA, 17 nt, Mycobacterium avium subsp. paratuberculosis
cucgaucugcaccagcg

SEQ ID NO: 2902592 - RNA, 22 nt, Mycobacterium avium subsp. paratuberculosis
cucgaucugcagccggcgcggc

SEQ ID NO: 2902593 - RNA, 16 nt, Mycobacterium avium subsp. paratuberculosis
cucgaucuggcggacc

SEQ ID NO: 2902594 - RNA, 21 nt, Mycobacterium avium subsp. paratuberculosis
cucgaucuggcggacccgcuc

SEQ ID NO: 2902595 - RNA, 16 nt, Mycobacterium avium subsp. paratuberculosis
cucgaucugggccagg

SEQ ID NO: 2902596 - RNA, 19 nt, Mycobacterium avium subsp. paratuberculosis
cucgaucugguucaccgcc

SEQ ID NO: 2902597 - RNA, 22 nt, Mycobacterium avium subsp. paratuberculosis
cucgaucugguucaccgccacc

SEQ ID NO: 2902598 - RNA, 14 nt, Mycobacterium avium subsp. paratuberculosis
cucgaugacgccgg

SEQ ID NO: 2902599 - RNA, 15 nt, Mycobacterium avium subsp. paratuberculosis
cucgaugacgccgga

SEQ ID NO: 2902600 - RNA, 12 nt, Mycobacterium avium subsp. paratuberculosis
cucgaugagcga

SEQ ID NO: 2902601 - RNA, 18 nt, Mycobacterium avium subsp. paratuberculosis
cucgaugagcgagaugau

SEQ ID NO: 2902602 - RNA, 15 nt, Mycobacterium avium subsp. paratuberculosis
cucgaugcacggucg

SEQ ID NO: 2902603 - RNA, 17 nt, Mycobacterium avium subsp. paratuberculosis
cucgaugcacggucggc

SEQ ID NO: 2902604 - RNA, 22 nt, Mycobacterium avium subsp. paratuberculosis
cucgaugcacggucggccccgc

SEQ ID NO: 2902605 - RNA, 20 nt, Mycobacterium avium subsp. paratuberculosis
cucgaugccguucgcgccgu

SEQ ID NO: 2902606 - RNA, 19 nt, Mycobacterium avium subsp. paratuberculosis
cucgaugcgacgcaccucg

SEQ ID NO: 2902607 - RNA, 20 nt, Mycobacterium avium subsp. paratuberculosis
cucgaugcgacgcaccucgg

SEQ ID NO: 2902608 - RNA, 14 nt, Mycobacterium avium subsp. paratuberculosis
cucgaugcgcaccg

SEQ ID NO: 2902609 - RNA, 16 nt, Mycobacterium avium subsp. paratuberculosis
cucgaugcgcaccgug

SEQ ID NO: 2902610 - RNA, 17 nt, Mycobacterium avium subsp. paratuberculosis
cucgaugcgcaccgugc

SEQ ID NO: 2902611 - RNA, 14 nt, Mycobacterium avium subsp. paratuberculosis
cucgaugcgcaccu

SEQ ID NO: 2902612 - RNA, 19 nt, Mycobacterium avium subsp. paratuberculosis
cucgaugcgcagggcggaa

SEQ ID NO: 2902613 - RNA, 13 nt, Mycobacterium avium subsp. paratuberculosis
cucgaugcggcag

SEQ ID NO: 2902614 - RNA, 23 nt, Mycobacterium avium subsp. paratuberculosis
cucgaugcggguguugcgcagcg

SEQ ID NO: 2902615 - RNA, 22 nt, Mycobacterium avium subsp. paratuberculosis
cucgauggaauucgucggcggu

SEQ ID NO: 2902616 - RNA, 17 nt, Mycobacterium avium subsp. paratuberculosis
cucgauggacaggcacu

SEQ ID NO: 2902617 - RNA, 18 nt, Mycobacterium avium subsp. paratuberculosis
cucgauggacaggcacuc

SEQ ID NO: 2902618 - RNA, 14 nt, Mycobacterium avium subsp. paratuberculosis
cucgauggccacgc

SEQ ID NO: 2902619 - RNA, 15 nt, Mycobacterium avium subsp. paratuberculosis
cucgauggccacgcu

SEQ ID NO: 2902620 - RNA, 15 nt, Mycobacterium avium subsp. paratuberculosis
cucgauggccagcgc

SEQ ID NO: 2902621 - RNA, 16 nt, Mycobacterium avium subsp. paratuberculosis
cucgauggccagcgcg

SEQ ID NO: 2902622 - RNA, 17 nt, Mycobacterium avium subsp. paratuberculosis
cucgauggccagcgcgu

SEQ ID NO: 2902623 - RNA, 20 nt, Mycobacterium avium subsp. paratuberculosis
cucgauggccagcgcgucgc

SEQ ID NO: 2902624 - RNA, 13 nt, Mycobacterium avium subsp. paratuberculosis
cucgauggcccgc

SEQ ID NO: 2902625 - RNA, 19 nt, Mycobacterium avium subsp. paratuberculosis
cucgauggccucgucgaug

SEQ ID NO: 2902626 - RNA, 13 nt, Mycobacterium avium subsp. paratuberculosis
cucgauggcgccg

SEQ ID NO: 2902627 - RNA, 15 nt, Mycobacterium avium subsp. paratuberculosis
cucgauggcggcggc

SEQ ID NO: 2902628 - RNA, 17 nt, Mycobacterium avium subsp. paratuberculosis
cucgauggcggcggcug

SEQ ID NO: 2902629 - RNA, 15 nt, Mycobacterium avium subsp. paratuberculosis
cucgaugggggugcc

SEQ ID NO: 2902630 - RNA, 23 nt, Mycobacterium avium subsp. paratuberculosis
cucgaugggggugccgcagcggc

SEQ ID NO: 2902631 - RNA, 20 nt, Mycobacterium avium subsp. paratuberculosis
cucgauggguucuucgacca

SEQ ID NO: 2902632 - RNA, 14 nt, Mycobacterium avium subsp. paratuberculosis
cucgauggucgucg

SEQ ID NO: 2902633 - RNA, 15 nt, Mycobacterium avium subsp. paratuberculosis
cucgauggugccguc

SEQ ID NO: 2902634 - RNA, 18 nt, Mycobacterium avium subsp. paratuberculosis
cucgauguagagcgggau

SEQ ID NO: 2902635 - RNA, 16 nt, Mycobacterium avium subsp. paratuberculosis
cucgauguagccgggc

SEQ ID NO: 2902636 - RNA, 17 nt, Mycobacterium avium subsp. paratuberculosis
cucgauguagccgggcu

SEQ ID NO: 2902637 - RNA, 14 nt, Mycobacterium avium subsp. paratuberculosis
cucgauguugaucg

SEQ ID NO: 2902638 - RNA, 16 nt, Mycobacterium avium subsp. paratuberculosis
cucgauguugaucgcc

SEQ ID NO: 2902639 - RNA, 19 nt, Mycobacterium avium subsp. paratuberculosis
cucgauguugaucgccaug

SEQ ID NO: 2902640 - RNA, 22 nt, Mycobacterium avium subsp. paratuberculosis
cucgauguugaucgccaugcug

SEQ ID NO: 2902641 - RNA, 23 nt, Mycobacterium avium subsp. paratuberculosis
cucgauguugaucgccaugcugg

SEQ ID NO: 2902642 - RNA, 20 nt, Mycobacterium avium subsp. paratuberculosis
cucgcaaccgucuuggcugg

SEQ ID NO: 2902643 - RNA, 19 nt, Mycobacterium avium subsp. paratuberculosis
cucgcacaacccgcccggg

SEQ ID NO: 2902644 - RNA, 14 nt, Mycobacterium avium subsp. paratuberculosis
cucgcacagcacca

SEQ ID NO: 2902645 - RNA, 21 nt, Mycobacterium avium subsp. paratuberculosis
cucgcacagccggcgcgcggu

SEQ ID NO: 2902646 - RNA, 23 nt, Mycobacterium avium subsp. paratuberculosis
cucgcacagcuugucccagugcu

SEQ ID NO: 2902647 - RNA, 18 nt, Mycobacterium avium subsp. paratuberculosis
cucgcacccggucaggua

SEQ ID NO: 2902648 - RNA, 20 nt, Mycobacterium avium subsp. paratuberculosis
cucgcaccugccgucgacga

SEQ ID NO: 2902649 - RNA, 19 nt, Mycobacterium avium subsp. paratuberculosis
cucgcaggcgagccgacag

SEQ ID NO: 2902650 - RNA, 14 nt, Mycobacterium avium subsp. paratuberculosis
cucgcaggugccgg

SEQ ID NO: 2902651 - RNA, 18 nt, Mycobacterium avium subsp. paratuberculosis
cucgcaggugccggugac

SEQ ID NO: 2902652 - RNA, 22 nt, Mycobacterium avium subsp. paratuberculosis
cucgccaauaaagcgggcccgc

SEQ ID NO: 2902653 - RNA, 16 nt, Mycobacterium avium subsp. paratuberculosis
cucgccaccccgcgcc

SEQ ID NO: 2902654 - RNA, 20 nt, Mycobacterium avium subsp. paratuberculosis
cucgccaccccgcgccacgc

SEQ ID NO: 2902655 - RNA, 13 nt, Mycobacterium avium subsp. paratuberculosis
cucgccaccucgg

SEQ ID NO: 2902656 - RNA, 14 nt, Mycobacterium avium subsp. paratuberculosis
cucgccacugggcg

SEQ ID NO: 2902657 - RNA, 23 nt, Mycobacterium avium subsp. paratuberculosis
cucgccacugggcgucggcgccc

SEQ ID NO: 2902658 - RNA, 20 nt, Mycobacterium avium subsp. paratuberculosis
cucgccagaccgguugcggc

SEQ ID NO: 2902659 - RNA, 13 nt, Mycobacterium avium subsp. paratuberculosis
cucgccagccguc

SEQ ID NO: 2902660 - RNA, 20 nt, Mycobacterium avium subsp. paratuberculosis
cucgccaggauguacccgca

SEQ ID NO: 2902661 - RNA, 23 nt, Mycobacterium avium subsp. paratuberculosis
cucgccaugcgaccacgaccggg

SEQ ID NO: 2902662 - RNA, 17 nt, Mycobacterium avium subsp. paratuberculosis
cucgcccaccuuggcgu

SEQ ID NO: 2902663 - RNA, 13 nt, Mycobacterium avium subsp. paratuberculosis
cucgcccagcgcc

SEQ ID NO: 2902664 - RNA, 19 nt, Mycobacterium avium subsp. paratuberculosis
cucgcccagcgccgcggcg

SEQ ID NO: 2902665 - RNA, 16 nt, Mycobacterium avium subsp. paratuberculosis
cucgcccagcgcggcg

SEQ ID NO: 2902666 - RNA, 18 nt, Mycobacterium avium subsp. paratuberculosis
cucgcccagcgcggcggc

SEQ ID NO: 2902667 - RNA, 19 nt, Mycobacterium avium subsp. paratuberculosis
cucgcccagcgcggcggcc

SEQ ID NO: 2902668 - RNA, 21 nt, Mycobacterium avium subsp. paratuberculosis
cucgcccagcgcggcggccac

SEQ ID NO: 2902669 - RNA, 22 nt, Mycobacterium avium subsp. paratuberculosis
cucgccccgcccgaucccgucg

SEQ ID NO: 2902670 - RNA, 23 nt, Mycobacterium avium subsp. paratuberculosis
cucgccccgcccgaucccgucgu

SEQ ID NO: 2902671 - RNA, 14 nt, Mycobacterium avium subsp. paratuberculosis
cucgcccggcucca

SEQ ID NO: 2902672 - RNA, 22 nt, Mycobacterium avium subsp. paratuberculosis
cucgcccgggcuaucgcccggc

SEQ ID NO: 2902673 - RNA, 23 nt, Mycobacterium avium subsp. paratuberculosis
cucgcccgggugcugcggcucca

SEQ ID NO: 2902674 - RNA, 15 nt, Mycobacterium avium subsp. paratuberculosis
cucgcccucgguguu

SEQ ID NO: 2902675 - RNA, 14 nt, Mycobacterium avium subsp. paratuberculosis
cucgcccugcagcc

SEQ ID NO: 2902676 - RNA, 23 nt, Mycobacterium avium subsp. paratuberculosis
cucgcccugcagccggguggccc

SEQ ID NO: 2902677 - RNA, 22 nt, Mycobacterium avium subsp. paratuberculosis
cucgcccugggggucggugacc

SEQ ID NO: 2902678 - RNA, 23 nt, Mycobacterium avium subsp. paratuberculosis
cucgcccugggggucggugacca

SEQ ID NO: 2902679 - RNA, 13 nt, Mycobacterium avium subsp. paratuberculosis
cucgccgaaccgg

SEQ ID NO: 2902680 - RNA, 21 nt, Mycobacterium avium subsp. paratuberculosis
cucgccgaaccggggccgcac

SEQ ID NO: 2902681 - RNA, 16 nt, Mycobacterium avium subsp. paratuberculosis
cucgccgaaggccggg

SEQ ID NO: 2902682 - RNA, 16 nt, Mycobacterium avium subsp. paratuberculosis
cucgccgagcacaccg

SEQ ID NO: 2902683 - RNA, 14 nt, Mycobacterium avium subsp. paratuberculosis
cucgccgaucggga

SEQ ID NO: 2902684 - RNA, 21 nt, Mycobacterium avium subsp. paratuberculosis
cucgccgaucucgaccagcgc

SEQ ID NO: 2902685 - RNA, 22 nt, Mycobacterium avium subsp. paratuberculosis
cucgccgaucucgaccagcgcc

SEQ ID NO: 2902686 - RNA, 22 nt, Mycobacterium avium subsp. paratuberculosis
cgucgaaaucggguccagcgcc

SEQ ID NO: 2902687 - RNA, 23 nt, Mycobacterium avium subsp. paratuberculosis
cgucgaaaucggguccagcgccg

SEQ ID NO: 2902688 - RNA, 22 nt, Mycobacterium avium subsp. paratuberculosis
cgucgaacacguugcgcaucag

SEQ ID NO: 2902689 - RNA, 23 nt, Mycobacterium avium subsp. paratuberculosis
cgucgaacacguugcgcaucagc

SEQ ID NO: 2902690 - RNA, 14 nt, Mycobacterium avium subsp. paratuberculosis
cgucgaacagccgg

SEQ ID NO: 2902691 - RNA, 18 nt, Mycobacterium avium subsp. paratuberculosis
cgucgaacagccgggccg

SEQ ID NO: 2902692 - RNA, 21 nt, Mycobacterium avium subsp. paratuberculosis
cgucgaacagccgggccgccc

SEQ ID NO: 2902693 - RNA, 16 nt, Mycobacterium avium subsp. paratuberculosis
cgucgaacagcgggca

SEQ ID NO: 2902694 - RNA, 17 nt, Mycobacterium avium subsp. paratuberculosis
cgucgaacagcgggcag

SEQ ID NO: 2902695 - RNA, 22 nt, Mycobacterium avium subsp. paratuberculosis
cgucgaacccgaaaagcaccag

SEQ ID NO: 2902696 - RNA, 17 nt, Mycobacterium avium subsp. paratuberculosis
cgucgaacccgaccccg

SEQ ID NO: 2902697 - RNA, 23 nt, Mycobacterium avium subsp. paratuberculosis
cgucgaacccgaccccggcgagc

SEQ ID NO: 2902698 - RNA, 15 nt, Mycobacterium avium subsp. paratuberculosis
cgucgaacgcggcga

SEQ ID NO: 2902699 - RNA, 17 nt, Mycobacterium avium subsp. paratuberculosis
cgucgaacgcggcgaag

SEQ ID NO: 2902700 - RNA, 22 nt, Mycobacterium avium subsp. paratuberculosis
cgucgaacggcgucuggccgga

SEQ ID NO: 2902701 - RNA, 15 nt, Mycobacterium avium subsp. paratuberculosis
cgucgaacgggccgg

SEQ ID NO: 2902702 - RNA, 19 nt, Mycobacterium avium subsp. paratuberculosis
cgucgaacgggccgggcac

SEQ ID NO: 2902703 - RNA, 19 nt, Mycobacterium avium subsp. paratuberculosis
cgucgaacuccauccgccg

SEQ ID NO: 2902704 - RNA, 17 nt, Mycobacterium avium subsp. paratuberculosis
cgucgaacucguggaug

SEQ ID NO: 2902705 - RNA, 18 nt, Mycobacterium avium subsp. paratuberculosis
cgucgaacugcagccggc

SEQ ID NO: 2902706 - RNA, 22 nt, Mycobacterium avium subsp. paratuberculosis
cgucgaacugcagccggccaac

SEQ ID NO: 2902707 - RNA, 20 nt, Mycobacterium avium subsp. paratuberculosis
cgucgaagaagucguucagc

SEQ ID NO: 2902708 - RNA, 17 nt, Mycobacterium avium subsp. paratuberculosis
cgucgaagagcuggucg

SEQ ID NO: 2902709 - RNA, 18 nt, Mycobacterium avium subsp. paratuberculosis
cgucgaagagcuggucgc

SEQ ID NO: 2902710 - RNA, 16 nt, Mycobacterium avium subsp. paratuberculosis
cgucgaagccgaucac

SEQ ID NO: 2902711 - RNA, 17 nt, Mycobacterium avium subsp. paratuberculosis
cgucgaaggauucgggg

SEQ ID NO: 2902712 - RNA, 14 nt, Mycobacterium avium subsp. paratuberculosis
cgucgaaggccggg

SEQ ID NO: 2902713 - RNA, 18 nt, Mycobacterium avium subsp. paratuberculosis
cgucgaaggccgggcugg

SEQ ID NO: 2902714 - RNA, 21 nt, Mycobacterium avium subsp. paratuberculosis
cgucgaaggccgggcuggucc

SEQ ID NO: 2902715 - RNA, 15 nt, Mycobacterium avium subsp. paratuberculosis
cgucgaaggccugga

SEQ ID NO: 2902716 - RNA, 14 nt, Mycobacterium avium subsp. paratuberculosis
cgucgaagggucgg

SEQ ID NO: 2902717 - RNA, 19 nt, Mycobacterium avium subsp. paratuberculosis
cgucgaagggucggucgag

SEQ ID NO: 2902718 - RNA, 17 nt, Mycobacterium avium subsp. paratuberculosis
cgucgaaguagggccgc

SEQ ID NO: 2902719 - RNA, 23 nt, Mycobacterium avium subsp. paratuberculosis
cgucgaaguagggccgcagcgca

SEQ ID NO: 2902720 - RNA, 18 nt, Mycobacterium avium subsp. paratuberculosis
cgucgaauaggugauguc

SEQ ID NO: 2902721 - RNA, 15 nt, Mycobacterium avium subsp. paratuberculosis
cgucgaauucggaca

SEQ ID NO: 2902722 - RNA, 20 nt, Mycobacterium avium subsp. paratuberculosis
cgucgacaccccgcucggcc

SEQ ID NO: 2902723 - RNA, 14 nt, Mycobacterium avium subsp. paratuberculosis
cgucgacacccggg

SEQ ID NO: 2902724 - RNA, 16 nt, Mycobacterium avium subsp. paratuberculosis
cgucgacacccgggcg

SEQ ID NO: 2902725 - RNA, 15 nt, Mycobacterium avium subsp. paratuberculosis
cgucgacacgccggc

SEQ ID NO: 2902726 - RNA, 16 nt, Mycobacterium avium subsp. paratuberculosis
cgucgacacgccggcc

SEQ ID NO: 2902727 - RNA, 17 nt, Mycobacterium avium subsp. paratuberculosis
cgucgacacgccggccg

SEQ ID NO: 2902728 - RNA, 18 nt, Mycobacterium avium subsp. paratuberculosis
cgucgacacgccggccgu

SEQ ID NO: 2902729 - RNA, 19 nt, Mycobacterium avium subsp. paratuberculosis
cgucgacacgccggccguu

SEQ ID NO: 2902730 - RNA, 23 nt, Mycobacterium avium subsp. paratuberculosis
cgucgacacgccggccguucgcc

SEQ ID NO: 2902731 - RNA, 16 nt, Mycobacterium avium subsp. paratuberculosis
cgucgacagccggucg

SEQ ID NO: 2902732 - RNA, 20 nt, Mycobacterium avium subsp. paratuberculosis
cgucgacagccggucgcgca

SEQ ID NO: 2902733 - RNA, 23 nt, Mycobacterium avium subsp. paratuberculosis
cgucgacagccggucgcgcaucg

SEQ ID NO: 2902734 - RNA, 14 nt, Mycobacterium avium subsp. paratuberculosis
cgucgaccaccacg

SEQ ID NO: 2902735 - RNA, 16 nt, Mycobacterium avium subsp. paratuberculosis
cgucgaccaccacgac

SEQ ID NO: 2902736 - RNA, 20 nt, Mycobacterium avium subsp. paratuberculosis
cgucgaccaccacgaccagu

SEQ ID NO: 2902737 - RNA, 15 nt, Mycobacterium avium subsp. paratuberculosis
cgucgaccaccgccg

SEQ ID NO: 2902738 - RNA, 16 nt, Mycobacterium avium subsp. paratuberculosis
cgucgaccaccgccgg

SEQ ID NO: 2902739 - RNA, 18 nt, Mycobacterium avium subsp. paratuberculosis
cgucgaccaccgccggcc

SEQ ID NO: 2902740 - RNA, 18 nt, Mycobacterium avium subsp. paratuberculosis
cgucgaccagccgcauca

SEQ ID NO: 2902741 - RNA, 14 nt, Mycobacterium avium subsp. paratuberculosis
cgucgaccagccgg

SEQ ID NO: 2902742 - RNA, 12 nt, Mycobacterium avium subsp. paratuberculosis
cgucgaccagcg

SEQ ID NO: 2902743 - RNA, 21 nt, Mycobacterium avium subsp. paratuberculosis
cgucgaccagcgggcugucgg

SEQ ID NO: 2902744 - RNA, 22 nt, Mycobacterium avium subsp. paratuberculosis
cgucgaccagcgggcugucggc

SEQ ID NO: 2902745 - RNA, 21 nt, Mycobacterium avium subsp. paratuberculosis
cgucgaccagcuugucgaucu

SEQ ID NO: 2902746 - RNA, 14 nt, Mycobacterium avium subsp. paratuberculosis
cgucgaccaggacg

SEQ ID NO: 2902747 - RNA, 15 nt, Mycobacterium avium subsp. paratuberculosis
cgucgaccaggacgu

SEQ ID NO: 2902748 - RNA, 18 nt, Mycobacterium avium subsp. paratuberculosis
cgucgaccaggacgucgg

SEQ ID NO: 2902749 - RNA, 23 nt, Mycobacterium avium subsp. paratuberculosis
cgucgaccagggcgaucaccgcg

SEQ ID NO: 2902750 - RNA, 21 nt, Mycobacterium avium subsp. paratuberculosis
cgucgaccagguaggcgcccu

SEQ ID NO: 2902751 - RNA, 14 nt, Mycobacterium avium subsp. paratuberculosis
cgucgaccccgccg

SEQ ID NO: 2902752 - RNA, 15 nt, Mycobacterium avium subsp. paratuberculosis
cgucgaccccgccgg

SEQ ID NO: 2902753 - RNA, 17 nt, Mycobacterium avium subsp. paratuberculosis
cgucgaccccgccggcc

SEQ ID NO: 2902754 - RNA, 18 nt, Mycobacterium avium subsp. paratuberculosis
cgucgaccccgccggccc

SEQ ID NO: 2902755 - RNA, 19 nt, Mycobacterium avium subsp. paratuberculosis
cgucgaccccgccggcccg

SEQ ID NO: 2902756 - RNA, 12 nt, Mycobacterium avium subsp. paratuberculosis
cgucgacccggc

SEQ ID NO: 2902757 - RNA, 14 nt, Mycobacterium avium subsp. paratuberculosis
cgucgacccggccg

SEQ ID NO: 2902758 - RNA, 15 nt, Mycobacterium avium subsp. paratuberculosis
cgucgacccggccgc

SEQ ID NO: 2902759 - RNA, 17 nt, Mycobacterium avium subsp. paratuberculosis
cgucgacccggccgcgc

SEQ ID NO: 2902760 - RNA, 19 nt, Mycobacterium avium subsp. paratuberculosis
cgucgacccggccgcgccg

SEQ ID NO: 2902761 - RNA, 21 nt, Mycobacterium avium subsp. paratuberculosis
cgucgacccguuccccggccg

SEQ ID NO: 2902762 - RNA, 13 nt, Mycobacterium avium subsp. paratuberculosis
cgucgaccgcccc

SEQ ID NO: 2902763 - RNA, 20 nt, Mycobacterium avium subsp. paratuberculosis
cgucgaccgccccgccggug

SEQ ID NO: 2902764 - RNA, 23 nt, Mycobacterium avium subsp. paratuberculosis
cgucgaccgccccgccggugucg

SEQ ID NO: 2902765 - RNA, 19 nt, Mycobacterium avium subsp. paratuberculosis
cgucgaccgccgcgaacgg

SEQ ID NO: 2902766 - RNA, 17 nt, Mycobacterium avium subsp. paratuberculosis
cgucgaccgcgacgacc

SEQ ID NO: 2902767 - RNA, 13 nt, Mycobacterium avium subsp. paratuberculosis
cgucgaccgcgcc

SEQ ID NO: 2902768 - RNA, 14 nt, Mycobacterium avium subsp. paratuberculosis
cgucgaccgcgccg

SEQ ID NO: 2902769 - RNA, 16 nt, Mycobacterium avium subsp. paratuberculosis
cgucgaccgcgccggg

SEQ ID NO: 2902770 - RNA, 20 nt, Mycobacterium avium subsp. paratuberculosis
cgucgaccgcgccggggugg

SEQ ID NO: 2902771 - RNA, 17 nt, Mycobacterium avium subsp. paratuberculosis
cgucgaccgcggccugg

SEQ ID NO: 2902772 - RNA, 17 nt, Mycobacterium avium subsp. paratuberculosis
cgucgaccgucacgcug

SEQ ID NO: 2902773 - RNA, 18 nt, Mycobacterium avium subsp. paratuberculosis
cgucgaccgucacgcugg

SEQ ID NO: 2902774 - RNA, 20 nt, Mycobacterium avium subsp. paratuberculosis
cgucgaccgucacgcuggcg

SEQ ID NO: 2902775 - RNA, 15 nt, Mycobacterium avium subsp. paratuberculosis
cgucgaccgucaggu

SEQ ID NO: 2902776 - RNA, 14 nt, Mycobacterium avium subsp. paratuberculosis
cgucgaccuccucg

SEQ ID NO: 2902777 - RNA, 20 nt, Mycobacterium avium subsp. paratuberculosis
cgucgaccuccucgaccccg

SEQ ID NO: 2902778 - RNA, 17 nt, Mycobacterium avium subsp. paratuberculosis
cgucgaccucgaucagu

SEQ ID NO: 2902779 - RNA, 16 nt, Mycobacterium avium subsp. paratuberculosis
cgucgaccugcucguc

SEQ ID NO: 2902780 - RNA, 20 nt, Mycobacterium avium subsp. paratuberculosis
cgucgaccuugcagcccgcg

SEQ ID NO: 2902781 - RNA, 21 nt, Mycobacterium avium subsp. paratuberculosis
cgucgaccuugcagcccgcgu

SEQ ID NO: 2902782 - RNA, 16 nt, Mycobacterium avium subsp. paratuberculosis
cgucgacgaccaccac

SEQ ID NO: 2902783 - RNA, 17 nt, Mycobacterium avium subsp. paratuberculosis
cgucgacgaccaccacc

SEQ ID NO: 2902784 - RNA, 14 nt, Mycobacterium avium subsp. paratuberculosis
cgucgacgacccgu

SEQ ID NO: 2902785 - RNA, 13 nt, Mycobacterium avium subsp. paratuberculosis
cgucgacgacgaa

SEQ ID NO: 2902786 - RNA, 18 nt, Mycobacterium avium subsp. paratuberculosis
cgucgacgacgaaucccg

SEQ ID NO: 2902787 - RNA, 16 nt, Mycobacterium avium subsp. paratuberculosis
cgucgacgacggcgcc

SEQ ID NO: 2902788 - RNA, 18 nt, Mycobacterium avium subsp. paratuberculosis
cgucgacgacggcgccgc

SEQ ID NO: 2902789 - RNA, 19 nt, Mycobacterium avium subsp. paratuberculosis
cgucgacgacggcgccgcg

SEQ ID NO: 2902790 - RNA, 23 nt, Mycobacterium avium subsp. paratuberculosis
cgucgacgacggcgccgcgucgg

SEQ ID NO: 2902791 - RNA, 21 nt, Mycobacterium avium subsp. paratuberculosis
cgucgacgagcccgccggcgg

SEQ ID NO: 2902792 - RNA, 23 nt, Mycobacterium avium subsp. paratuberculosis
cgucgacgagcccgccggcgggu

SEQ ID NO: 2902793 - RNA, 19 nt, Mycobacterium avium subsp. paratuberculosis
cgucgacgauggcccggac

SEQ ID NO: 2902794 - RNA, 20 nt, Mycobacterium avium subsp. paratuberculosis
cgucgacgauggcccggacc

SEQ ID NO: 2902795 - RNA, 16 nt, Mycobacterium avium subsp. paratuberculosis
cgucgacgcccaccug

SEQ ID NO: 2902796 - RNA, 21 nt, Mycobacterium avium subsp. paratuberculosis
cgucgacgcccugccacagcg

SEQ ID NO: 2902797 - RNA, 16 nt, Mycobacterium avium subsp. paratuberculosis
cgucgacgccgcugcc

SEQ ID NO: 2902798 - RNA, 18 nt, Mycobacterium avium subsp. paratuberculosis
cgucgacgcgcugcuuga

SEQ ID NO: 2902799 - RNA, 22 nt, Mycobacterium avium subsp. paratuberculosis
cgucgacgcgcugcuugacccg

SEQ ID NO: 2902800 - RNA, 14 nt, Mycobacterium avium subsp. paratuberculosis
cgucgacgcgggcg

SEQ ID NO: 2902801 - RNA, 19 nt, Mycobacterium avium subsp. paratuberculosis
cgucgacgcgggcgacguc

SEQ ID NO: 2902802 - RNA, 13 nt, Mycobacterium avium subsp. paratuberculosis
cgucgacgcgguc

SEQ ID NO: 2902803 - RNA, 15 nt, Mycobacterium avium subsp. paratuberculosis
cgucgacgcggucga

SEQ ID NO: 2902804 - RNA, 17 nt, Mycobacterium avium subsp. paratuberculosis
cgucgacgcugaccgug

SEQ ID NO: 2902805 - RNA, 19 nt, Mycobacterium avium subsp. paratuberculosis
cgucgacgcugaccguggu

SEQ ID NO: 2902806 - RNA, 20 nt, Mycobacterium avium subsp. paratuberculosis
cgucgacgcugaccguggug

SEQ ID NO: 2902807 - RNA, 14 nt, Mycobacterium avium subsp. paratuberculosis
cgucgacggcagcg

SEQ ID NO: 2902808 - RNA, 12 nt, Mycobacterium avium subsp. paratuberculosis
cgucgacggccg

SEQ ID NO: 2902809 - RNA, 18 nt, Mycobacterium avium subsp. paratuberculosis
cgucgacggccgccgcga

SEQ ID NO: 2902810 - RNA, 20 nt, Mycobacterium avium subsp. paratuberculosis
cgucgacggccgccgcgacg

SEQ ID NO: 2902811 - RNA, 18 nt, Mycobacterium avium subsp. paratuberculosis
cgucgacggccgcgccga

SEQ ID NO: 2902812 - RNA, 20 nt, Mycobacterium avium subsp. paratuberculosis
cgucgacggccgcgccgaac

SEQ ID NO: 2902813 - RNA, 12 nt, Mycobacterium avium subsp. paratuberculosis
cgucgacggcgc

SEQ ID NO: 2902814 - RNA, 13 nt, Mycobacterium avium subsp. paratuberculosis
cgucgacggcgcc

SEQ ID NO: 2902815 - RNA, 15 nt, Mycobacterium avium subsp. paratuberculosis
cgucgacggcgccgg

SEQ ID NO: 2902816 - RNA, 17 nt, Mycobacterium avium subsp. paratuberculosis
cgucgacggcggcgucc

SEQ ID NO: 2902817 - RNA, 12 nt, Mycobacterium avium subsp. paratuberculosis
cgucgacggcgu

SEQ ID NO: 2902818 - RNA, 15 nt, Mycobacterium avium subsp. paratuberculosis
cgucgacggcgugga

SEQ ID NO: 2902819 - RNA, 10 nt, Mycobacterium avium subsp. paratuberculosis
cgucgacggg

SEQ ID NO: 2902820 - RNA, 18 nt, Mycobacterium avium subsp. paratuberculosis
cgucgacgggccaccagc

SEQ ID NO: 2902821 - RNA, 16 nt, Mycobacterium avium subsp. paratuberculosis
cgucgacgucaacacc

SEQ ID NO: 2902822 - RNA, 19 nt, Mycobacterium avium subsp. paratuberculosis
cgucgacgucaacaccgug

SEQ ID NO: 2902823 - RNA, 20 nt, Mycobacterium avium subsp. paratuberculosis
cgucgacgucaacaccgugg

SEQ ID NO: 2902824 - RNA, 13 nt, Mycobacterium avium subsp. paratuberculosis
cgucgacguccac

SEQ ID NO: 2902825 - RNA, 20 nt, Mycobacterium avium subsp. paratuberculosis
cgucgacguccacguugaug

SEQ ID NO: 2902826 - RNA, 14 nt, Mycobacterium avium subsp. paratuberculosis
cgucgacgucgaga

SEQ ID NO: 2902827 - RNA, 22 nt, Mycobacterium avium subsp. paratuberculosis
cgucgacgucgagggcgccguu

SEQ ID NO: 2902828 - RNA, 21 nt, Mycobacterium avium subsp. paratuberculosis
cgucgacgucggacgcggccg

SEQ ID NO: 2902829 - RNA, 14 nt, Mycobacterium avium subsp. paratuberculosis
cgucgacgucggga

SEQ ID NO: 2902830 - RNA, 15 nt, Mycobacterium avium subsp. paratuberculosis
cgucgacgucgggca

SEQ ID NO: 2902831 - RNA, 16 nt, Mycobacterium avium subsp. paratuberculosis
cgucgacgucggggau

SEQ ID NO: 2902832 - RNA, 16 nt, Mycobacterium avium subsp. paratuberculosis
cgucgacgugcgcggc

SEQ ID NO: 2902833 - RNA, 17 nt, Mycobacterium avium subsp. paratuberculosis
cgucgacgugcgcggcg

SEQ ID NO: 2902834 - RNA, 19 nt, Mycobacterium avium subsp. paratuberculosis
cgucgacgugcgcggcguu

SEQ ID NO: 2902835 - RNA, 19 nt, Mycobacterium avium subsp. paratuberculosis
cgucgacgugggcggccac

SEQ ID NO: 2902836 - RNA, 14 nt, Mycobacterium avium subsp. paratuberculosis
cgucgacguucgcc

SEQ ID NO: 2902837 - RNA, 15 nt, Mycobacterium avium subsp. paratuberculosis
cgucgacguucgccg

SEQ ID NO: 2902838 - RNA, 20 nt, Mycobacterium avium subsp. paratuberculosis
cgucgacguucgccgccagc

SEQ ID NO: 2902839 - RNA, 15 nt, Mycobacterium avium subsp. paratuberculosis
cgucgacucggcggu

SEQ ID NO: 2902840 - RNA, 16 nt, Mycobacterium avium subsp. paratuberculosis
cgucgacucggcggug

SEQ ID NO: 2902841 - RNA, 17 nt, Mycobacterium avium subsp. paratuberculosis
cgucgacucggcggugc

SEQ ID NO: 2902842 - RNA, 20 nt, Mycobacterium avium subsp. paratuberculosis
cgucgagaaaagcggcgaaa

SEQ ID NO: 2902843 - RNA, 13 nt, Mycobacterium avium subsp. paratuberculosis
cgucgagcaccac

SEQ ID NO: 2902844 - RNA, 18 nt, Mycobacterium avium subsp. paratuberculosis
cgucgagcaccacccggg

SEQ ID NO: 2902845 - RNA, 13 nt, Mycobacterium avium subsp. paratuberculosis
cgucgagcaccgc

SEQ ID NO: 2902846 - RNA, 14 nt, Mycobacterium avium subsp. paratuberculosis
cgucgagcaccggc

SEQ ID NO: 2902847 - RNA, 18 nt, Mycobacterium avium subsp. paratuberculosis
cgucgagcaccggcagcc

SEQ ID NO: 2902848 - RNA, 19 nt, Mycobacterium avium subsp. paratuberculosis
cgucgagcaccggcagccg

SEQ ID NO: 2902849 - RNA, 16 nt, Mycobacterium avium subsp. paratuberculosis
cgucgagcaccggcug

SEQ ID NO: 2902850 - RNA, 17 nt, Mycobacterium avium subsp. paratuberculosis
cgucgagcaccggcugg

SEQ ID NO: 2902851 - RNA, 20 nt, Mycobacterium avium subsp. paratuberculosis
cgucgagcaccggcuggugc

SEQ ID NO: 2902852 - RNA, 12 nt, Mycobacterium avium subsp. paratuberculosis
cgucgagcaccu

SEQ ID NO: 2902853 - RNA, 13 nt, Mycobacterium avium subsp. paratuberculosis
cgucgagcaccuc

SEQ ID NO: 2902854 - RNA, 14 nt, Mycobacterium avium subsp. paratuberculosis
cgucgagcaccucc

SEQ ID NO: 2902855 - RNA, 15 nt, Mycobacterium avium subsp. paratuberculosis
cgucgagcagcacca

SEQ ID NO: 2902856 - RNA, 18 nt, Mycobacterium avium subsp. paratuberculosis
cgucgagcagcaccaccc

SEQ ID NO: 2902857 - RNA, 20 nt, Mycobacterium avium subsp. paratuberculosis
cgucgagcagcaccacccgc

SEQ ID NO: 2902858 - RNA, 15 nt, Mycobacterium avium subsp. paratuberculosis
cgucgagcagcgccc

SEQ ID NO: 2902859 - RNA, 18 nt, Mycobacterium avium subsp. paratuberculosis
cgucgagcagcgcccggc

SEQ ID NO: 2902860 - RNA, 20 nt, Mycobacterium avium subsp. paratuberculosis
cgucgagcagcgcccggcga

SEQ ID NO: 2902861 - RNA, 14 nt, Mycobacterium avium subsp. paratuberculosis
cgucgagccagcgg

SEQ ID NO: 2902862 - RNA, 18 nt, Mycobacterium avium subsp. paratuberculosis
cgucgagccagcgggccg

SEQ ID NO: 2902863 - RNA, 19 nt, Mycobacterium avium subsp. paratuberculosis
cgucgagccagcgggccga

SEQ ID NO: 2902864 - RNA, 22 nt, Mycobacterium avium subsp. paratuberculosis
cgucgagccgcucgcgcaccgg

SEQ ID NO: 2902865 - RNA, 23 nt, Mycobacterium avium subsp. paratuberculosis
cgucgagccgcucgcgcaccggg

SEQ ID NO: 2902866 - RNA, 15 nt, Mycobacterium avium subsp. paratuberculosis
cgucgagccggccgg

SEQ ID NO: 2902867 - RNA, 17 nt, Mycobacterium avium subsp. paratuberculosis
cgucgagccggccggac

SEQ ID NO: 2902868 - RNA, 22 nt, Mycobacterium avium subsp. paratuberculosis
cgucgagccggccggacaccga

SEQ ID NO: 2902869 - RNA, 20 nt, Mycobacterium avium subsp. paratuberculosis
cgucgagccgggcccgggug

SEQ ID NO: 2902870 - RNA, 14 nt, Mycobacterium avium subsp. paratuberculosis
cgucgagccuggug

SEQ ID NO: 2902871 - RNA, 20 nt, Mycobacterium avium subsp. paratuberculosis
cgucgagcgcggcccgccga

SEQ ID NO: 2902872 - RNA, 23 nt, Mycobacterium avium subsp. paratuberculosis
cgucgagcgcggcccgccgaacg

SEQ ID NO: 2902873 - RNA, 18 nt, Mycobacterium avium subsp. paratuberculosis
cgucgagcgcgucguugc

SEQ ID NO: 2902874 - RNA, 14 nt, Mycobacterium avium subsp. paratuberculosis
cgucgagcgcucgc

SEQ ID NO: 2902875 - RNA, 15 nt, Mycobacterium avium subsp. paratuberculosis
cgucgagcgcucgcg

SEQ ID NO: 2902876 - RNA, 15 nt, Mycobacterium avium subsp. paratuberculosis
cgucgagcggcgccu

SEQ ID NO: 2902877 - RNA, 19 nt, Mycobacterium avium subsp. paratuberculosis
cgucgagcggcuugccgcc

SEQ ID NO: 2902878 - RNA, 23 nt, Mycobacterium avium subsp. paratuberculosis
cgucgagcggcuugccgccgcag

SEQ ID NO: 2902879 - RNA, 12 nt, Mycobacterium avium subsp. paratuberculosis
cgucgagcguca

SEQ ID NO: 2902880 - RNA, 16 nt, Mycobacterium avium subsp. paratuberculosis
cgucgagcgucacgcc

SEQ ID NO: 2902881 - RNA, 18 nt, Mycobacterium avium subsp. paratuberculosis
cgucgagcgucacgccgc

SEQ ID NO: 2902882 - RNA, 22 nt, Mycobacterium avium subsp. paratuberculosis
cgucgagcgucacgccgcgccc

SEQ ID NO: 2902883 - RNA, 14 nt, Mycobacterium avium subsp. paratuberculosis
cgucgagcuccucg

SEQ ID NO: 2902884 - RNA, 16 nt, Mycobacterium avium subsp. paratuberculosis
cgucgagcuccucggc

SEQ ID NO: 2902885 - RNA, 18 nt, Mycobacterium avium subsp. paratuberculosis
cgucgagcuccucggcca

SEQ ID NO: 2902886 - RNA, 16 nt, Mycobacterium avium subsp. paratuberculosis
cgucgagcucgaagcc

SEQ ID NO: 2902887 - RNA, 22 nt, Mycobacterium avium subsp. paratuberculosis
cgucgaggccgaaccgcagccg

SEQ ID NO: 2902888 - RNA, 16 nt, Mycobacterium avium subsp. paratuberculosis
cgucgaggcgcugcag

SEQ ID NO: 2902889 - RNA, 15 nt, Mycobacterium avium subsp. paratuberculosis
cgucgagggccaccg

SEQ ID NO: 2902890 - RNA, 16 nt, Mycobacterium avium subsp. paratuberculosis
cgucgagggccaccgg

SEQ ID NO: 2902891 - RNA, 14 nt, Mycobacterium avium subsp. paratuberculosis
cgucgagggcgccg

SEQ ID NO: 2902892 - RNA, 15 nt, Mycobacterium avium subsp. paratuberculosis
cgucgagggcgccgu

SEQ ID NO: 2902893 - RNA, 18 nt, Mycobacterium avium subsp. paratuberculosis
cgucgagggcgccguugu

SEQ ID NO: 2902894 - RNA, 21 nt, Mycobacterium avium subsp. paratuberculosis
cgucgagggugaugucgcugc

SEQ ID NO: 2902895 - RNA, 18 nt, Mycobacterium avium subsp. paratuberculosis
cgucgagguacugcagca

SEQ ID NO: 2902896 - RNA, 17 nt, Mycobacterium avium subsp. paratuberculosis
cgucgaggucggacgcc

SEQ ID NO: 2902897 - RNA, 19 nt, Mycobacterium avium subsp. paratuberculosis
cgucgaggucggacgccuc

SEQ ID NO: 2902898 - RNA, 21 nt, Mycobacterium avium subsp. paratuberculosis
cgucgaggucggacgccuccc

SEQ ID NO: 2902899 - RNA, 15 nt, Mycobacterium avium subsp. paratuberculosis
cgucgaggucgucgg

SEQ ID NO: 2902900 - RNA, 20 nt, Mycobacterium avium subsp. paratuberculosis
cgucgaggucgucgggcgcc

SEQ ID NO: 2902901 - RNA, 22 nt, Mycobacterium avium subsp. paratuberculosis
cgucgaggucgucgggcgccgg

SEQ ID NO: 2902902 - RNA, 12 nt, Mycobacterium avium subsp. paratuberculosis
cgucgagguguu

SEQ ID NO: 2902903 - RNA, 22 nt, Mycobacterium avium subsp. paratuberculosis
cgucgagguguugucgugccgg

SEQ ID NO: 2902904 - RNA, 19 nt, Mycobacterium avium subsp. paratuberculosis
cgucgagguugaaucgccu

SEQ ID NO: 2902905 - RNA, 20 nt, Mycobacterium avium subsp. paratuberculosis
cgucgaguccguggucaggg

SEQ ID NO: 2902906 - RNA, 23 nt, Mycobacterium avium subsp. paratuberculosis
cgucgagucggccaccgcggucg

SEQ ID NO: 2902907 - RNA, 19 nt, Mycobacterium avium subsp. paratuberculosis
cgucgagugcucgauggcc

SEQ ID NO: 2902908 - RNA, 17 nt, Mycobacterium avium subsp. paratuberculosis
cgucgaguucgccgucg

SEQ ID NO: 2902909 - RNA, 19 nt, Mycobacterium avium subsp. paratuberculosis
cgucgaguucgccgucgac

SEQ ID NO: 2902910 - RNA, 20 nt, Mycobacterium avium subsp. paratuberculosis
cgucgaguucgccgucgacg

SEQ ID NO: 2902911 - RNA, 16 nt, Mycobacterium avium subsp. paratuberculosis
cgucgaguucgcggcg

SEQ ID NO: 2902912 - RNA, 17 nt, Mycobacterium avium subsp. paratuberculosis
cgucgaguucgcggcgc

SEQ ID NO: 2902913 - RNA, 21 nt, Mycobacterium avium subsp. paratuberculosis
cgucgaguucgcggcgcagca

SEQ ID NO: 2902914 - RNA, 22 nt, Mycobacterium avium subsp. paratuberculosis
cgucgaguucgcggcgcagcac

SEQ ID NO: 2902915 - RNA, 19 nt, Mycobacterium avium subsp. paratuberculosis
cgucgaguuguugggccga

SEQ ID NO: 2902916 - RNA, 21 nt, Mycobacterium avium subsp. paratuberculosis
cgucgaguuguugggccgaaa

SEQ ID NO: 2902917 - RNA, 13 nt, Mycobacterium avium subsp. paratuberculosis
cgucgaucaccug

SEQ ID NO: 2902918 - RNA, 12 nt, Mycobacterium avium subsp. paratuberculosis
cgucgaucacgc

SEQ ID NO: 2902919 - RNA, 13 nt, Mycobacterium avium subsp. paratuberculosis
cgucgaucacgcc

SEQ ID NO: 2902920 - RNA, 15 nt, Mycobacterium avium subsp. paratuberculosis
cgucgaucacgccgc

SEQ ID NO: 2902921 - RNA, 16 nt, Mycobacterium avium subsp. paratuberculosis
cgucgaucacgccgcc

SEQ ID NO: 2902922 - RNA, 17 nt, Mycobacterium avium subsp. paratuberculosis
cgucgaucacgccgccg

SEQ ID NO: 2902923 - RNA, 18 nt, Mycobacterium avium subsp. paratuberculosis
cgucgaucacgccgccgg

SEQ ID NO: 2902924 - RNA, 13 nt, Mycobacterium avium subsp. paratuberculosis
cgucgaucagcau

SEQ ID NO: 2902925 - RNA, 14 nt, Mycobacterium avium subsp. paratuberculosis
cgucgaucagcgcg

SEQ ID NO: 2902926 - RNA, 17 nt, Mycobacterium avium subsp. paratuberculosis
cgucgaucagcgcgccg

SEQ ID NO: 2902927 - RNA, 18 nt, Mycobacterium avium subsp. paratuberculosis
cgucgaucagcgcgccgc

SEQ ID NO: 2902928 - RNA, 19 nt, Mycobacterium avium subsp. paratuberculosis
cgucgaucagcgcgccgcc

SEQ ID NO: 2902929 - RNA, 13 nt, Mycobacterium avium subsp. paratuberculosis
cgucgaucagggc

SEQ ID NO: 2902930 - RNA, 16 nt, Mycobacterium avium subsp. paratuberculosis
cgucgauccccacguc

SEQ ID NO: 2902931 - RNA, 19 nt, Mycobacterium avium subsp. paratuberculosis
cgucgauccccacgucgcc

SEQ ID NO: 2902932 - RNA, 19 nt, Mycobacterium avium subsp. paratuberculosis
cgucgauccccgcagcucc

SEQ ID NO: 2902933 - RNA, 21 nt, Mycobacterium avium subsp. paratuberculosis
cgucgaucccggacuccucgg

SEQ ID NO: 2902934 - RNA, 16 nt, Mycobacterium avium subsp. paratuberculosis
cgucgaucgacgccga

SEQ ID NO: 2902935 - RNA, 17 nt, Mycobacterium avium subsp. paratuberculosis
cgucgaucgacgccgac

SEQ ID NO: 2902936 - RNA, 21 nt, Mycobacterium avium subsp. paratuberculosis
cgucgaucgacgccgacaucg

SEQ ID NO: 2902937 - RNA, 15 nt, Mycobacterium avium subsp. paratuberculosis
cgucgaucgccguca

SEQ ID NO: 2902938 - RNA, 14 nt, Mycobacterium avium subsp. paratuberculosis
cgucgaucgcggcg

SEQ ID NO: 2902939 - RNA, 16 nt, Mycobacterium avium subsp. paratuberculosis
cgucgaucgcggcgau

SEQ ID NO: 2902940 - RNA, 16 nt, Mycobacterium avium subsp. paratuberculosis
cgucgaucucggugag

SEQ ID NO: 2902941 - RNA, 17 nt, Mycobacterium avium subsp. paratuberculosis
cgucgaucuucgcggcg

SEQ ID NO: 2902942 - RNA, 18 nt, Mycobacterium avium subsp. paratuberculosis
cgucgaucuugucgucca

SEQ ID NO: 2902943 - RNA, 17 nt, Mycobacterium avium subsp. paratuberculosis
cgucgaugaacaucgcc

SEQ ID NO: 2902944 - RNA, 20 nt, Mycobacterium avium subsp. paratuberculosis
cgucgaugaaccgcugcugc

SEQ ID NO: 2902945 - RNA, 19 nt, Mycobacterium avium subsp. paratuberculosis
cgucgaugaagucggugag

SEQ ID NO: 2902946 - RNA, 14 nt, Mycobacterium avium subsp. paratuberculosis
cgucgaugaccucg

SEQ ID NO: 2902947 - RNA, 16 nt, Mycobacterium avium subsp. paratuberculosis
cgucgaugaccucgcg

SEQ ID NO: 2902948 - RNA, 19 nt, Mycobacterium avium subsp. paratuberculosis
cgucgaugaccucgcgcag

SEQ ID NO: 2902949 - RNA, 22 nt, Mycobacterium avium subsp. paratuberculosis
cgucgaugaccucgcgcagccc

SEQ ID NO: 2902950 - RNA, 12 nt, Mycobacterium avium subsp. paratuberculosis
cgucgaugacga

SEQ ID NO: 2902951 - RNA, 13 nt, Mycobacterium avium subsp. paratuberculosis
cgucgaugacgau

SEQ ID NO: 2902952 - RNA, 16 nt, Mycobacterium avium subsp. paratuberculosis
cgucgaugacgaugcc

SEQ ID NO: 2902953 - RNA, 13 nt, Mycobacterium avium subsp. paratuberculosis
cgucgaugacguc

SEQ ID NO: 2902954 - RNA, 23 nt, Mycobacterium avium subsp. paratuberculosis
cgucgaugacguccaccagggug

SEQ ID NO: 2902955 - RNA, 15 nt, Mycobacterium avium subsp. paratuberculosis
cgucgaugaugccgg

SEQ ID NO: 2902956 - RNA, 19 nt, Mycobacterium avium subsp. paratuberculosis
cgucgaugaugccggcgga

SEQ ID NO: 2902957 - RNA, 20 nt, Mycobacterium avium subsp. paratuberculosis
cgucgaugaugccggcggac

SEQ ID NO: 2902958 - RNA, 14 nt, Mycobacterium avium subsp. paratuberculosis
cgucgaugcacgcc

SEQ ID NO: 2902959 - RNA, 15 nt, Mycobacterium avium subsp. paratuberculosis
cgucgaugcacgccg

SEQ ID NO: 2902960 - RNA, 16 nt, Mycobacterium avium subsp. paratuberculosis
cgucgaugcacgccgg

SEQ ID NO: 2902961 - RNA, 17 nt, Mycobacterium avium subsp. paratuberculosis
cgucgaugcacgccgga

SEQ ID NO: 2902962 - RNA, 19 nt, Mycobacterium avium subsp. paratuberculosis
cgucgaugcacgccggaau

SEQ ID NO: 2902963 - RNA, 15 nt, Mycobacterium avium subsp. paratuberculosis
cgucgaugccgauca

SEQ ID NO: 2902964 - RNA, 17 nt, Mycobacterium avium subsp. paratuberculosis
cgucgaugccgaucacg

SEQ ID NO: 2902965 - RNA, 24 nt, Mycobacterium avium subsp. paratuberculosis
cgucgaugccgaucacggugaucg

SEQ ID NO: 2902966 - RNA, 15 nt, Mycobacterium avium subsp. paratuberculosis
cgucgaugccggcca

SEQ ID NO: 2902967 - RNA, 15 nt, Mycobacterium avium subsp. paratuberculosis
cgucgaugccggcga

SEQ ID NO: 2902968 - RNA, 21 nt, Mycobacterium avium subsp. paratuberculosis
cgucgaugccggcgauccgcg

SEQ ID NO: 2902969 - RNA, 23 nt, Mycobacterium avium subsp. paratuberculosis
cgucgaugccguagaccagcauc

SEQ ID NO: 2902970 - RNA, 18 nt, Mycobacterium avium subsp. paratuberculosis
cgucgaugcgcagcagcg

SEQ ID NO: 2902971 - RNA, 15 nt, Mycobacterium avium subsp. paratuberculosis
cgucgaugcgcgcca

SEQ ID NO: 2902972 - RNA, 17 nt, Mycobacterium avium subsp. paratuberculosis
cgucgaugcgcgccacc

SEQ ID NO: 2902973 - RNA, 19 nt, Mycobacterium avium subsp. paratuberculosis
cgucgaugcgcgccaccag

SEQ ID NO: 2902974 - RNA, 18 nt, Mycobacterium avium subsp. paratuberculosis
cgucgaugcgggcccgca

SEQ ID NO: 2902975 - RNA, 15 nt, Mycobacterium avium subsp. paratuberculosis
cgucgauggaaggug

SEQ ID NO: 2902976 - RNA, 19 nt, Mycobacterium avium subsp. paratuberculosis
cgucgauggaaggugcuga

SEQ ID NO: 2902977 - RNA, 20 nt, Mycobacterium avium subsp. paratuberculosis
cgucgauggacagggcgaca

SEQ ID NO: 2902978 - RNA, 23 nt, Mycobacterium avium subsp. paratuberculosis
cgucgauggacagggcgacaucg

SEQ ID NO: 2902979 - RNA, 17 nt, Mycobacterium avium subsp. paratuberculosis
cgucgauggccaccagg

SEQ ID NO: 2902980 - RNA, 19 nt, Mycobacterium avium subsp. paratuberculosis
cgucgauggccaccagguc

SEQ ID NO: 2902981 - RNA, 15 nt, Mycobacterium avium subsp. paratuberculosis
cgucgauggcgcggc

SEQ ID NO: 2902982 - RNA, 16 nt, Mycobacterium avium subsp. paratuberculosis
cgucgauggcgcggcc

SEQ ID NO: 2902983 - RNA, 18 nt, Mycobacterium avium subsp. paratuberculosis
cgucgauggcgcggccca

SEQ ID NO: 2902984 - RNA, 20 nt, Mycobacterium avium subsp. paratuberculosis
cgucgauggcgcggcccagu

SEQ ID NO: 2902985 - RNA, 17 nt, Mycobacterium avium subsp. paratuberculosis
cgucgaugggcucgagc

SEQ ID NO: 2902986 - RNA, 16 nt, Mycobacterium avium subsp. paratuberculosis
cgucgaugucacguug

SEQ ID NO: 2902987 - RNA, 22 nt, Mycobacterium avium subsp. paratuberculosis
cgucgaugucgcccggcgcggc

SEQ ID NO: 2902988 - RNA, 23 nt, Mycobacterium avium subsp. paratuberculosis
cgucgaugucgcccggcgcggca

SEQ ID NO: 2902989 - RNA, 15 nt, Mycobacterium avium subsp. paratuberculosis
cgucgaugucggcgg

SEQ ID NO: 2902990 - RNA, 16 nt, Mycobacterium avium subsp. paratuberculosis
cgucgaugucggcggc

SEQ ID NO: 2902991 - RNA, 17 nt, Mycobacterium avium subsp. paratuberculosis
cgucgaugucggcggcc

SEQ ID NO: 2902992 - RNA, 19 nt, Mycobacterium avium subsp. paratuberculosis
cgucgaugucggcggcccg

SEQ ID NO: 2902993 - RNA, 20 nt, Mycobacterium avium subsp. paratuberculosis
cgucgaugucggcggcccgg

SEQ ID NO: 2902994 - RNA, 15 nt, Mycobacterium avium subsp. paratuberculosis
cgucgaugucgucgu

SEQ ID NO: 2902995 - RNA, 20 nt, Mycobacterium avium subsp. paratuberculosis
cgucgaugucgucgucgacg

SEQ ID NO: 2902996 - RNA, 18 nt, Mycobacterium avium subsp. paratuberculosis
cgucgaugugcucggggc

SEQ ID NO: 2902997 - RNA, 15 nt, Mycobacterium avium subsp. paratuberculosis
cgucgaugugggccg

SEQ ID NO: 2902998 - RNA, 14 nt, Mycobacterium avium subsp. paratuberculosis
cgucgcacaaccgg

SEQ ID NO: 2902999 - RNA, 17 nt, Mycobacterium avium subsp. paratuberculosis
cgucgcacaaccgggcc

SEQ ID NO: 2903000 - RNA, 19 nt, Mycobacterium avium subsp. paratuberculosis
cgucgcacaaccgggccaa

SEQ ID NO: 2903001 - RNA, 15 nt, Mycobacterium avium subsp. paratuberculosis
cgucgcacagcgccg

SEQ ID NO: 2903002 - RNA, 16 nt, Mycobacterium avium subsp. paratuberculosis
cgucgcacagcgccgc

SEQ ID NO: 2903003 - RNA, 18 nt, Mycobacterium avium subsp. paratuberculosis
cgucgcacagcgccgcgu

SEQ ID NO: 2903004 - RNA, 14 nt, Mycobacterium avium subsp. paratuberculosis
cgucgcacguggug

SEQ ID NO: 2903005 - RNA, 19 nt, Mycobacterium avium subsp. paratuberculosis
cgucgcagaucccgccggc

SEQ ID NO: 2903006 - RNA, 21 nt, Mycobacterium avium subsp. paratuberculosis
cgucgcagaucccgccggcgg

SEQ ID NO: 2903007 - RNA, 22 nt, Mycobacterium avium subsp. paratuberculosis
cgucgcagaucccgccggcggc

SEQ ID NO: 2903008 - RNA, 23 nt, Mycobacterium avium subsp. paratuberculosis
cgucgcagaucccgccggcggcc

SEQ ID NO: 2903009 - RNA, 15 nt, Mycobacterium avium subsp. paratuberculosis
cgucgcagcccgggu

SEQ ID NO: 2903010 - RNA, 14 nt, Mycobacterium avium subsp. paratuberculosis
cgucgcagugcccg

SEQ ID NO: 2903011 - RNA, 15 nt, Mycobacterium avium subsp. paratuberculosis
cgucgcagugcccgc

SEQ ID NO: 2903012 - RNA, 18 nt, Mycobacterium avium subsp. paratuberculosis
cgucgcagugcccgccca

SEQ ID NO: 2903013 - RNA, 19 nt, Mycobacterium avium subsp. paratuberculosis
cgucgcagugcccgcccag

SEQ ID NO: 2903014 - RNA, 22 nt, Mycobacterium avium subsp. paratuberculosis
cgucgcagugcccgcccagcug

SEQ ID NO: 2903015 - RNA, 15 nt, Mycobacterium avium subsp. paratuberculosis
cgucgcaucagcucg

SEQ ID NO: 2903016 - RNA, 16 nt, Mycobacterium avium subsp. paratuberculosis
cgucgcaucagcucgg

SEQ ID NO: 2903017 - RNA, 18 nt, Mycobacterium avium subsp. paratuberculosis
cgucgcaucagcucggca

SEQ ID NO: 2903018 - RNA, 14 nt, Mycobacterium avium subsp. paratuberculosis
cgucgccaauccgg

SEQ ID NO: 2903019 - RNA, 17 nt, Mycobacterium avium subsp. paratuberculosis
cgucgccaauccggcgg

SEQ ID NO: 2903020 - RNA, 14 nt, Mycobacterium avium subsp. paratuberculosis
cgucgccaccaccg

SEQ ID NO: 2903021 - RNA, 15 nt, Mycobacterium avium subsp. paratuberculosis
cgucgccaccaccgc

SEQ ID NO: 2903022 - RNA, 16 nt, Mycobacterium avium subsp. paratuberculosis
cgucgccaccaccgcg

SEQ ID NO: 2903023 - RNA, 18 nt, Mycobacterium avium subsp. paratuberculosis
cgucgccaccaccgcgcc

SEQ ID NO: 2903024 - RNA, 20 nt, Mycobacterium avium subsp. paratuberculosis
cgucgccaccaccgcgccgu

SEQ ID NO: 2903025 - RNA, 21 nt, Mycobacterium avium subsp. paratuberculosis
cgucgccaccaccgcgccguc

SEQ ID NO: 2903026 - RNA, 14 nt, Mycobacterium avium subsp. paratuberculosis
cgucgccaccaccu

SEQ ID NO: 2903027 - RNA, 22 nt, Mycobacterium avium subsp. paratuberculosis
cgucgccaccaccuucaucgcc

SEQ ID NO: 2903028 - RNA, 23 nt, Mycobacterium avium subsp. paratuberculosis
cgucgccaccaccuucaucgccg

SEQ ID NO: 2903029 - RNA, 17 nt, Mycobacterium avium subsp. paratuberculosis
cgucgccaccacggcgc

SEQ ID NO: 2903030 - RNA, 15 nt, Mycobacterium avium subsp. paratuberculosis
cgucgccaccagacc

SEQ ID NO: 2903031 - RNA, 19 nt, Mycobacterium avium subsp. paratuberculosis
cgucgccaccgagucgcgc

SEQ ID NO: 2903032 - RNA, 14 nt, Mycobacterium avium subsp. paratuberculosis
cgucgccaccgaug

SEQ ID NO: 2903033 - RNA, 19 nt, Mycobacterium avium subsp. paratuberculosis
cgucgccacgaucaccacc

SEQ ID NO: 2903034 - RNA, 20 nt, Mycobacterium avium subsp. paratuberculosis
cgucgccacgaucaccacca

SEQ ID NO: 2903035 - RNA, 21 nt, Mycobacterium avium subsp. paratuberculosis
cgucgccacgaucaccaccac

SEQ ID NO: 2903036 - RNA, 12 nt, Mycobacterium avium subsp. paratuberculosis
cgucgccaucgu

SEQ ID NO: 2903037 - RNA, 15 nt, Mycobacterium avium subsp. paratuberculosis
cgucgccaugccguc

SEQ ID NO: 2903038 - RNA, 18 nt, Mycobacterium avium subsp. paratuberculosis
cgucgccaugccgucgcg

SEQ ID NO: 2903039 - RNA, 20 nt, Mycobacterium avium subsp. paratuberculosis
cgucgcccacccgccagccc

SEQ ID NO: 2903040 - RNA, 22 nt, Mycobacterium avium subsp. paratuberculosis
cgucgcccacccgccagcccgc

SEQ ID NO: 2903041 - RNA, 15 nt, Mycobacterium avium subsp. paratuberculosis
cgucgcccaccgacg

SEQ ID NO: 2903042 - RNA, 14 nt, Mycobacterium avium subsp. paratuberculosis
cgucgcccaccgug

SEQ ID NO: 2903043 - RNA, 15 nt, Mycobacterium avium subsp. paratuberculosis
cgucgcccacgccgg

SEQ ID NO: 2903044 - RNA, 14 nt, Mycobacterium avium subsp. paratuberculosis
cgucgcccagcgug

SEQ ID NO: 2903045 - RNA, 14 nt, Mycobacterium avium subsp. paratuberculosis
cgucgccccgcacc

SEQ ID NO: 2903046 - RNA, 21 nt, Mycobacterium avium subsp. paratuberculosis
cgucgcccgcccaggccgcca

SEQ ID NO: 2903047 - RNA, 12 nt, Mycobacterium avium subsp. paratuberculosis
cgucgcccgccg

SEQ ID NO: 2903048 - RNA, 13 nt, Mycobacterium avium subsp. paratuberculosis
cgucgcccgccga

SEQ ID NO: 2903049 - RNA, 19 nt, Mycobacterium avium subsp. paratuberculosis
cgucgcccgccgacggcug

SEQ ID NO: 2903050 - RNA, 18 nt, Mycobacterium avium subsp. paratuberculosis
cgucgcccggcguccagu

SEQ ID NO: 2903051 - RNA, 19 nt, Mycobacterium avium subsp. paratuberculosis
cgucgcccggcguccagug

SEQ ID NO: 2903052 - RNA, 17 nt, Mycobacterium avium subsp. paratuberculosis
cgucgcccgucucggcg

SEQ ID NO: 2903053 - RNA, 14 nt, Mycobacterium avium subsp. paratuberculosis
cgucgcccugacac

SEQ ID NO: 2903054 - RNA, 20 nt, Mycobacterium avium subsp. paratuberculosis
cgucgcccugacacagcacc

SEQ ID NO: 2903055 - RNA, 23 nt, Mycobacterium avium subsp. paratuberculosis
cgucgcccugacacagcaccggc

SEQ ID NO: 2903056 - RNA, 13 nt, Mycobacterium avium subsp. paratuberculosis
cgucgccgaccag

SEQ ID NO: 2903057 - RNA, 16 nt, Mycobacterium avium subsp. paratuberculosis
cgucgccgaccagcag

SEQ ID NO: 2903058 - RNA, 19 nt, Mycobacterium avium subsp. paratuberculosis
cgucgccgacgggcccagc

SEQ ID NO: 2903059 - RNA, 16 nt, Mycobacterium avium subsp. paratuberculosis
cgucgccgagccgcgc

SEQ ID NO: 2903060 - RNA, 19 nt, Mycobacterium avium subsp. paratuberculosis
cgucgccgagccgcgccac

SEQ ID NO: 2903061 - RNA, 14 nt, Mycobacterium avium subsp. paratuberculosis
cgucgccgaucagc

SEQ ID NO: 2903062 - RNA, 16 nt, Mycobacterium avium subsp. paratuberculosis
cgucgccgaucagcac

SEQ ID NO: 2903063 - RNA, 19 nt, Mycobacterium avium subsp. paratuberculosis
cgucgccgaucagcaccag

SEQ ID NO: 2903064 - RNA, 13 nt, Mycobacterium avium subsp. paratuberculosis
cgucgccgaucgc

SEQ ID NO: 2903065 - RNA, 17 nt, Mycobacterium avium subsp. paratuberculosis
cgucgccgaucgcccgg

SEQ ID NO: 2903066 - RNA, 17 nt, Mycobacterium avium subsp. paratuberculosis
cgucgccgaugcgccgc

SEQ ID NO: 2903067 - RNA, 18 nt, Mycobacterium avium subsp. paratuberculosis
cgucgccgaugcgccgca

SEQ ID NO: 2903068 - RNA, 15 nt, Mycobacterium avium subsp. paratuberculosis
cgucgccgauggcgu

SEQ ID NO: 2903069 - RNA, 11 nt, Mycobacterium avium subsp. paratuberculosis
cgucgccgccc

SEQ ID NO: 2903070 - RNA, 15 nt, Mycobacterium avium subsp. paratuberculosis
cgucgccgcccccga

SEQ ID NO: 2903071 - RNA, 13 nt, Mycobacterium avium subsp. paratuberculosis
cgucgccgccccg

SEQ ID NO: 2903072 - RNA, 14 nt, Mycobacterium avium subsp. paratuberculosis
cgucgccgccgcaa

SEQ ID NO: 2903073 - RNA, 23 nt, Mycobacterium avium subsp. paratuberculosis
cgucgccgccgcaauacaccgcg

SEQ ID NO: 2903074 - RNA, 15 nt, Mycobacterium avium subsp. paratuberculosis
cgucgccgccggugc

SEQ ID NO: 2903075 - RNA, 16 nt, Mycobacterium avium subsp. paratuberculosis
cgucgccgccgugauc

SEQ ID NO: 2903076 - RNA, 20 nt, Mycobacterium avium subsp. paratuberculosis
cgucgccgcgcccgccggcc

SEQ ID NO: 2903077 - RNA, 17 nt, Mycobacterium avium subsp. paratuberculosis
cgucgccgcgcgcgucg

SEQ ID NO: 2903078 - RNA, 19 nt, Mycobacterium avium subsp. paratuberculosis
cgucgccgcgcgcgucgac

SEQ ID NO: 2903079 - RNA, 22 nt, Mycobacterium avium subsp. paratuberculosis
cgucgccgcgugggagagcggg

SEQ ID NO: 2903080 - RNA, 18 nt, Mycobacterium avium subsp. paratuberculosis
cgucgccgcucuucgacg

SEQ ID NO: 2903081 - RNA, 22 nt, Mycobacterium avium subsp. paratuberculosis
cgucgccgcucuucgacgaccc

SEQ ID NO: 2903082 - RNA, 17 nt, Mycobacterium avium subsp. paratuberculosis
cgucgccggacucgauc

SEQ ID NO: 2903083 - RNA, 15 nt, Mycobacterium avium subsp. paratuberculosis
cgucgccggaggcga

SEQ ID NO: 2903084 - RNA, 17 nt, Mycobacterium avium subsp. paratuberculosis
cgucgccggaggcgauc

SEQ ID NO: 2903085 - RNA, 20 nt, Mycobacterium avium subsp. paratuberculosis
cgucgccggaggcgaucagg

SEQ ID NO: 2903086 - RNA, 13 nt, Mycobacterium avium subsp. paratuberculosis
cgucgccggccgc

SEQ ID NO: 2903087 - RNA, 17 nt, Mycobacterium avium subsp. paratuberculosis
cgucgccggccgccagc

SEQ ID NO: 2903088 - RNA, 15 nt, Mycobacterium avium subsp. paratuberculosis
cgucgccggccgcgg

SEQ ID NO: 2903089 - RNA, 23 nt, Mycobacterium avium subsp. paratuberculosis
cgucgccggccugcccgccgcgg

SEQ ID NO: 2903090 - RNA, 14 nt, Mycobacterium avium subsp. paratuberculosis
cgucgccggcgacc

SEQ ID NO: 2903091 - RNA, 21 nt, Mycobacterium avium subsp. paratuberculosis
cgucgccggcgcgggccgcag

SEQ ID NO: 2903092 - RNA, 22 nt, Mycobacterium avium subsp. paratuberculosis
cgucgccggcgcgggccgcagc

SEQ ID NO: 2903093 - RNA, 13 nt, Mycobacterium avium subsp. paratuberculosis
cgucgccggcggg

SEQ ID NO: 2903094 - RNA, 15 nt, Mycobacterium avium subsp. paratuberculosis
cgucgccggcggggc

SEQ ID NO: 2903095 - RNA, 18 nt, Mycobacterium avium subsp. paratuberculosis
cgucgccggcugacugcc

SEQ ID NO: 2903096 - RNA, 13 nt, Mycobacterium avium subsp. paratuberculosis
cgucgccgggcgg

SEQ ID NO: 2903097 - RNA, 19 nt, Mycobacterium avium subsp. paratuberculosis
cgucgccgggcgggguggu

SEQ ID NO: 2903098 - RNA, 15 nt, Mycobacterium avium subsp. paratuberculosis
cgucgccgggcucag

SEQ ID NO: 2903099 - RNA, 16 nt, Mycobacterium avium subsp. paratuberculosis
cgucgccggugagcac

SEQ ID NO: 2903100 - RNA, 16 nt, Mycobacterium avium subsp. paratuberculosis
cgucgccgucaccucg

SEQ ID NO: 2903101 - RNA, 12 nt, Mycobacterium avium subsp. paratuberculosis
cgucgccgucca

SEQ ID NO: 2903102 - RNA, 13 nt, Mycobacterium avium subsp. paratuberculosis
cgucgccgugauc

SEQ ID NO: 2903103 - RNA, 20 nt, Mycobacterium avium subsp. paratuberculosis
cgucgccgugcguccagucg

SEQ ID NO: 2903104 - RNA, 15 nt, Mycobacterium avium subsp. paratuberculosis
cgucgccguggcggc

SEQ ID NO: 2903105 - RNA, 24 nt, Mycobacterium avium subsp. paratuberculosis
cgucgccguggcggcccgaccagc

SEQ ID NO: 2903106 - RNA, 23 nt, Mycobacterium avium subsp. paratuberculosis
cgucgccuccgagauggacagca

SEQ ID NO: 2903107 - RNA, 15 nt, Mycobacterium avium subsp. paratuberculosis
cgucgccucgcccuc

SEQ ID NO: 2903108 - RNA, 15 nt, Mycobacterium avium subsp. paratuberculosis
cgucgccuuccugcg

SEQ ID NO: 2903109 - RNA, 19 nt, Mycobacterium avium subsp. paratuberculosis
cgucgccuucuggcugggg

SEQ ID NO: 2903110 - RNA, 13 nt, Mycobacterium avium subsp. paratuberculosis
cgucgcgacgagc

SEQ ID NO: 2903111 - RNA, 15 nt, Mycobacterium avium subsp. paratuberculosis
cgucgcgacgagcgg

SEQ ID NO: 2903112 - RNA, 19 nt, Mycobacterium avium subsp. paratuberculosis
cgucgcgauagggccggcc

SEQ ID NO: 2903113 - RNA, 21 nt, Mycobacterium avium subsp. paratuberculosis
cgucgcgauagggccggccgg

SEQ ID NO: 2903114 - RNA, 12 nt, Mycobacterium avium subsp. paratuberculosis
cgucgcgaucac

SEQ ID NO: 2903115 - RNA, 13 nt, Mycobacterium avium subsp. paratuberculosis
cgucgcgaucgcg

SEQ ID NO: 2903116 - RNA, 18 nt, Mycobacterium avium subsp. paratuberculosis
cgucgcgaugcccaagcc

SEQ ID NO: 2903117 - RNA, 20 nt, Mycobacterium avium subsp. paratuberculosis
cgucgcgaugcccaagccgg

SEQ ID NO: 2903118 - RNA, 13 nt, Mycobacterium avium subsp. paratuberculosis
cgucgcgcaccac

SEQ ID NO: 2903119 - RNA, 14 nt, Mycobacterium avium subsp. paratuberculosis
cgucgcgcaccacc

SEQ ID NO: 2903120 - RNA, 15 nt, Mycobacterium avium subsp. paratuberculosis
cgucgcgcaccaccu

SEQ ID NO: 2903121 - RNA, 13 nt, Mycobacterium avium subsp. paratuberculosis
cgucgcgcaccca

SEQ ID NO: 2903122 - RNA, 14 nt, Mycobacterium avium subsp. paratuberculosis
cgucgcgcacccag

SEQ ID NO: 2903123 - RNA, 13 nt, Mycobacterium avium subsp. paratuberculosis
cgucgcgcaccgc

SEQ ID NO: 2903124 - RNA, 12 nt, Mycobacterium avium subsp. paratuberculosis
cgucgcgcagca

SEQ ID NO: 2903125 - RNA, 15 nt, Mycobacterium avium subsp. paratuberculosis
cgucgcgcagcagcg

SEQ ID NO: 2903126 - RNA, 14 nt, Mycobacterium avium subsp. paratuberculosis
cgucgcgcagcccg

SEQ ID NO: 2903127 - RNA, 13 nt, Mycobacterium avium subsp. paratuberculosis
cgucgcgcagcga

SEQ ID NO: 2903128 - RNA, 22 nt, Mycobacterium avium subsp. paratuberculosis
cgucgcgcagcgaagcgaggcg

SEQ ID NO: 2903129 - RNA, 12 nt, Mycobacterium avium subsp. paratuberculosis
cgucgcgcagcu

SEQ ID NO: 2903130 - RNA, 22 nt, Mycobacterium avium subsp. paratuberculosis
cgucgcgcaggucgggccggcc

SEQ ID NO: 2903131 - RNA, 14 nt, Mycobacterium avium subsp. paratuberculosis
cgucgcgccagcgg

SEQ ID NO: 2903132 - RNA, 17 nt, Mycobacterium avium subsp. paratuberculosis
cgucgcgccagcggucc

SEQ ID NO: 2903133 - RNA, 20 nt, Mycobacterium avium subsp. paratuberculosis
cgucgcgccaggaccagcgg

SEQ ID NO: 2903134 - RNA, 13 nt, Mycobacterium avium subsp. paratuberculosis
cgucgcgcccggc

SEQ ID NO: 2903135 - RNA, 14 nt, Mycobacterium avium subsp. paratuberculosis
cgucgcgcccggcg

SEQ ID NO: 2903136 - RNA, 23 nt, Mycobacterium avium subsp. paratuberculosis
cgucgcgccgauguacugggccg

SEQ ID NO: 2903137 - RNA, 15 nt, Mycobacterium avium subsp. paratuberculosis
cgucgcgccgccacc

SEQ ID NO: 2903138 - RNA, 13 nt, Mycobacterium avium subsp. paratuberculosis
cgucgcgccgccg

SEQ ID NO: 2903139 - RNA, 16 nt, Mycobacterium avium subsp. paratuberculosis
cgucgcgccgccgcgu

SEQ ID NO: 2903140 - RNA, 21 nt, Mycobacterium avium subsp. paratuberculosis
cgucgcgccgccgcgucgugc

SEQ ID NO: 2903141 - RNA, 12 nt, Mycobacterium avium subsp. paratuberculosis
cgucgcgccgcu

SEQ ID NO: 2903142 - RNA, 16 nt, Mycobacterium avium subsp. paratuberculosis
cgucgcgccgcucggc

SEQ ID NO: 2903143 - RNA, 14 nt, Mycobacterium avium subsp. paratuberculosis
cgucgcgcgacugg

SEQ ID NO: 2903144 - RNA, 15 nt, Mycobacterium avium subsp. paratuberculosis
cgucgcgcggggucg

SEQ ID NO: 2903145 - RNA, 15 nt, Mycobacterium avium subsp. paratuberculosis
cgucgcgcgggguga

SEQ ID NO: 2903146 - RNA, 19 nt, Mycobacterium avium subsp. paratuberculosis
cgucgcgcggggugacgcc

SEQ ID NO: 2903147 - RNA, 14 nt, Mycobacterium avium subsp. paratuberculosis
cgucgcgcucgacg

SEQ ID NO: 2903148 - RNA, 15 nt, Mycobacterium avium subsp. paratuberculosis
cgucgcgcugccggc

SEQ ID NO: 2903149 - RNA, 17 nt, Mycobacterium avium subsp. paratuberculosis
cgucgcggaacagccgg

SEQ ID NO: 2903150 - RNA, 20 nt, Mycobacterium avium subsp. paratuberculosis
cgucgcggaacagccggcuc

SEQ ID NO: 2903151 - RNA, 21 nt, Mycobacterium avium subsp. paratuberculosis
cgucgcggaacagccggcuca

SEQ ID NO: 2903152 - RNA, 23 nt, Mycobacterium avium subsp. paratuberculosis
cgucgcggaaccguugcagcaca

SEQ ID NO: 2903153 - RNA, 18 nt, Mycobacterium avium subsp. paratuberculosis
cgucgcggaacgggucga

SEQ ID NO: 2903154 - RNA, 19 nt, Mycobacterium avium subsp. paratuberculosis
cgucgcggacccuggccag

SEQ ID NO: 2903155 - RNA, 23 nt, Mycobacterium avium subsp. paratuberculosis
cgucgcggacccuggccagcacc

SEQ ID NO: 2903156 - RNA, 22 nt, Mycobacterium avium subsp. paratuberculosis
cgucgcggaggaugccggccag

SEQ ID NO: 2903157 - RNA, 22 nt, Mycobacterium avium subsp. paratuberculosis
cgucgcggccaacgcccaccac

SEQ ID NO: 2903158 - RNA, 15 nt, Mycobacterium avium subsp. paratuberculosis
cgucgcggcccugga

SEQ ID NO: 2903159 - RNA, 13 nt, Mycobacterium avium subsp. paratuberculosis
cgucgcggcgauc

SEQ ID NO: 2903160 - RNA, 15 nt, Mycobacterium avium subsp. paratuberculosis
cgucgcggcgaucgc

SEQ ID NO: 2903161 - RNA, 16 nt, Mycobacterium avium subsp. paratuberculosis
cgucgcggcgaucgcg

SEQ ID NO: 2903162 - RNA, 17 nt, Mycobacterium avium subsp. paratuberculosis
cgucgcggcgcacccgg

SEQ ID NO: 2903163 - RNA, 18 nt, Mycobacterium avium subsp. paratuberculosis
cgucgcggcgcacccggg

SEQ ID NO: 2903164 - RNA, 16 nt, Mycobacterium avium subsp. paratuberculosis
cgucgcggcgcggacc

SEQ ID NO: 2903165 - RNA, 15 nt, Mycobacterium avium subsp. paratuberculosis
cgucgcggcgcgggu

SEQ ID NO: 2903166 - RNA, 20 nt, Mycobacterium avium subsp. paratuberculosis
cgucgcggcgcgggucgcug

SEQ ID NO: 2903167 - RNA, 23 nt, Mycobacterium avium subsp. paratuberculosis
cgucgcggcgcuaaagccaccag

SEQ ID NO: 2903168 - RNA, 14 nt, Mycobacterium avium subsp. paratuberculosis
cgucgcggcggccc

SEQ ID NO: 2903169 - RNA, 16 nt, Mycobacterium avium subsp. paratuberculosis
cgucgcggcggcccgu

SEQ ID NO: 2903170 - RNA, 17 nt, Mycobacterium avium subsp. paratuberculosis
cgucgcggcggcccguc

SEQ ID NO: 2903171 - RNA, 13 nt, Mycobacterium avium subsp. paratuberculosis
cgucgcggcggcg

SEQ ID NO: 2903172 - RNA, 14 nt, Mycobacterium avium subsp. paratuberculosis
cgucgcggcggcgc

SEQ ID NO: 2903173 - RNA, 15 nt, Mycobacterium avium subsp. paratuberculosis
cgucgcggcggcgcu

SEQ ID NO: 2903174 - RNA, 16 nt, Mycobacterium avium subsp. paratuberculosis
cgucgcggcggcgcug

SEQ ID NO: 2903175 - RNA, 17 nt, Mycobacterium avium subsp. paratuberculosis
cgucgcggcgggggucg

SEQ ID NO: 2903176 - RNA, 20 nt, Mycobacterium avium subsp. paratuberculosis
cgucgcggcggucacgcccg

SEQ ID NO: 2903177 - RNA, 20 nt, Mycobacterium avium subsp. paratuberculosis
cgucgcggcggugcgcagcc

SEQ ID NO: 2903178 - RNA, 21 nt, Mycobacterium avium subsp. paratuberculosis
cgucgcggcugccggugcugc

SEQ ID NO: 2903179 - RNA, 21 nt, Mycobacterium avium subsp. paratuberculosis
cgucgcggcuucagucccgcg

SEQ ID NO: 2903180 - RNA, 18 nt, Mycobacterium avium subsp. paratuberculosis
cgucgcgggaaucccacc

SEQ ID NO: 2903181 - RNA, 17 nt, Mycobacterium avium subsp. paratuberculosis
cgucgcgggcccgggcc

SEQ ID NO: 2903182 - RNA, 22 nt, Mycobacterium avium subsp. paratuberculosis
cgucgcgggcccgggccacccg

SEQ ID NO: 2903183 - RNA, 13 nt, Mycobacterium avium subsp. paratuberculosis
cgucgcgggcgaa

SEQ ID NO: 2903184 - RNA, 14 nt, Mycobacterium avium subsp. paratuberculosis
cgucgcgggcgccg

SEQ ID NO: 2903185 - RNA, 15 nt, Mycobacterium avium subsp. paratuberculosis
cgucgcgggcgccga

SEQ ID NO: 2903186 - RNA, 16 nt, Mycobacterium avium subsp. paratuberculosis
cgucgcgggcgccgag

SEQ ID NO: 2903187 - RNA, 17 nt, Mycobacterium avium subsp. paratuberculosis
cgucgcgggcgucgggc

SEQ ID NO: 2903188 - RNA, 16 nt, Mycobacterium avium subsp. paratuberculosis
cgucgcgggugaccgg

SEQ ID NO: 2903189 - RNA, 18 nt, Mycobacterium avium subsp. paratuberculosis
cgucgcgggugaccggcg

SEQ ID NO: 2903190 - RNA, 20 nt, Mycobacterium avium subsp. paratuberculosis
cgucgcgggugaccggcgcc

SEQ ID NO: 2903191 - RNA, 18 nt, Mycobacterium avium subsp. paratuberculosis
cgucgcggguggggauca

SEQ ID NO: 2903192 - RNA, 20 nt, Mycobacterium avium subsp. paratuberculosis
cgucgcggguggggaucagg

SEQ ID NO: 2903193 - RNA, 19 nt, Mycobacterium avium subsp. paratuberculosis
cgucgcggucagcucgauc

SEQ ID NO: 2903194 - RNA, 24 nt, Mycobacterium avium subsp. paratuberculosis
cgucgcggucagcucgaucgccgc

SEQ ID NO: 2903195 - RNA, 17 nt, Mycobacterium avium subsp. paratuberculosis
cgucgcgguccacgccg

SEQ ID NO: 2903196 - RNA, 21 nt, Mycobacterium avium subsp. paratuberculosis
cgucgcgguccacgccggcga

SEQ ID NO: 2903197 - RNA, 16 nt, Mycobacterium avium subsp. paratuberculosis
cgucgcgguggagcac

SEQ ID NO: 2903198 - RNA, 19 nt, Mycobacterium avium subsp. paratuberculosis
cgucgcgguugaucacacc

SEQ ID NO: 2903199 - RNA, 19 nt, Mycobacterium avium subsp. paratuberculosis
cgucgcguccagcaugccc

SEQ ID NO: 2903200 - RNA, 21 nt, Mycobacterium avium subsp. paratuberculosis
cgucgcguccgagcagcagcc

SEQ ID NO: 2903201 - RNA, 22 nt, Mycobacterium avium subsp. paratuberculosis
cgucgcguccgagcagcagccg

SEQ ID NO: 2903202 - RNA, 21 nt, Mycobacterium avium subsp. paratuberculosis
cgucgcguggcaauucgaccg

SEQ ID NO: 2903203 - RNA, 15 nt, Mycobacterium avium subsp. paratuberculosis
cgucgcguucgaccc

SEQ ID NO: 2903204 - RNA, 21 nt, Mycobacterium avium subsp. paratuberculosis
cgucgcguucgacccacaccu

SEQ ID NO: 2903205 - RNA, 19 nt, Mycobacterium avium subsp. paratuberculosis
cgucgcuaccucaccacgu

SEQ ID NO: 2903206 - RNA, 19 nt, Mycobacterium avium subsp. paratuberculosis
cgucgcuaguugcacuuuc

SEQ ID NO: 2903207 - RNA, 14 nt, Mycobacterium avium subsp. paratuberculosis
cgucgcugaacgcg

SEQ ID NO: 2903208 - RNA, 13 nt, Mycobacterium avium subsp. paratuberculosis
cgucgcugacgcc

SEQ ID NO: 2903209 - RNA, 20 nt, Mycobacterium avium subsp. paratuberculosis
cgucgcugcaguagccggcc

SEQ ID NO: 2903210 - RNA, 22 nt, Mycobacterium avium subsp. paratuberculosis
cgucgcugcaguagccggccag

SEQ ID NO: 2903211 - RNA, 13 nt, Mycobacterium avium subsp. paratuberculosis
cgucgcugcccag

SEQ ID NO: 2903212 - RNA, 22 nt, Mycobacterium avium subsp. paratuberculosis
cgucgcugcccagauacgccgc

SEQ ID NO: 2903213 - RNA, 13 nt, Mycobacterium avium subsp. paratuberculosis
cgucgcuggccag

SEQ ID NO: 2903214 - RNA, 17 nt, Mycobacterium avium subsp. paratuberculosis
cgucgcugggcagccgu

SEQ ID NO: 2903215 - RNA, 18 nt, Mycobacterium avium subsp. paratuberculosis
cgucgcugggcagccguc

SEQ ID NO: 2903216 - RNA, 15 nt, Mycobacterium avium subsp. paratuberculosis
cgucgcuguuggcga

SEQ ID NO: 2903217 - RNA, 21 nt, Mycobacterium avium subsp. paratuberculosis
cgucgcuguuggcgacggcgc

SEQ ID NO: 2903218 - RNA, 23 nt, Mycobacterium avium subsp. paratuberculosis
cgucgcuguuggcgacggcgcug

SEQ ID NO: 2903219 - RNA, 21 nt, Mycobacterium avium subsp. paratuberculosis
cgucggaaacuuguucgagau

SEQ ID NO: 2903220 - RNA, 16 nt, Mycobacterium avium subsp. paratuberculosis
cgucggaauacagcag

SEQ ID NO: 2903221 - RNA, 13 nt, Mycobacterium avium subsp. paratuberculosis
cgucggacagcag

SEQ ID NO: 2903222 - RNA, 14 nt, Mycobacterium avium subsp. paratuberculosis
cgucggacaugccg

SEQ ID NO: 2903223 - RNA, 20 nt, Mycobacterium avium subsp. paratuberculosis
cgucggacaugccggcgccg

SEQ ID NO: 2903224 - RNA, 21 nt, Mycobacterium avium subsp. paratuberculosis
cgucggacaugccggcgccga

SEQ ID NO: 2903225 - RNA, 12 nt, Mycobacterium avium subsp. paratuberculosis
cgucggaccccg

SEQ ID NO: 2903226 - RNA, 17 nt, Mycobacterium avium subsp. paratuberculosis
cgucggaccccgaugcg

SEQ ID NO: 2903227 - RNA, 21 nt, Mycobacterium avium subsp. paratuberculosis
cgucggaccccgaugcgcuca

SEQ ID NO: 2903228 - RNA, 14 nt, Mycobacterium avium subsp. paratuberculosis
cgucggacgcggcc

SEQ ID NO: 2903229 - RNA, 16 nt, Mycobacterium avium subsp. paratuberculosis
cgucggacgcggccga

SEQ ID NO: 2903230 - RNA, 21 nt, Mycobacterium avium subsp. paratuberculosis
cgucggagaucaccggcaccc

SEQ ID NO: 2903231 - RNA, 14 nt, Mycobacterium avium subsp. paratuberculosis
cgucggagaucagg

SEQ ID NO: 2903232 - RNA, 20 nt, Mycobacterium avium subsp. paratuberculosis
cgucggagaucagggugcuc

SEQ ID NO: 2903233 - RNA, 18 nt, Mycobacterium avium subsp. paratuberculosis
cgucggagaugcgggcca

SEQ ID NO: 2903234 - RNA, 21 nt, Mycobacterium avium subsp. paratuberculosis
cgucggagaugcgggccaccg

SEQ ID NO: 2903235 - RNA, 23 nt, Mycobacterium avium subsp. paratuberculosis
cgucggaggacaacgcgucgaac

SEQ ID NO: 2903236 - RNA, 14 nt, Mycobacterium avium subsp. paratuberculosis
cgucggaggcggcg

SEQ ID NO: 2903237 - RNA, 12 nt, Mycobacterium avium subsp. paratuberculosis
cgucggaggcgu

SEQ ID NO: 2903238 - RNA, 20 nt, Mycobacterium avium subsp. paratuberculosis
cgucggaggcgucgacgcgc

SEQ ID NO: 2903239 - RNA, 22 nt, Mycobacterium avium subsp. paratuberculosis
cgucggcaaugaccggcaccag

SEQ ID NO: 2903240 - RNA, 23 nt, Mycobacterium avium subsp. paratuberculosis
cgucggcaaugaccggcaccagc

SEQ ID NO: 2903241 - RNA, 14 nt, Mycobacterium avium subsp. paratuberculosis
cgucggcaccagcg

SEQ ID NO: 2903242 - RNA, 17 nt, Mycobacterium avium subsp. paratuberculosis
cgucggcaccagcggca

SEQ ID NO: 2903243 - RNA, 22 nt, Mycobacterium avium subsp. paratuberculosis
cgucggcaccagcggcaucgcc

SEQ ID NO: 2903244 - RNA, 23 nt, Mycobacterium avium subsp. paratuberculosis
cgucggcaccagcggcaucgccg

SEQ ID NO: 2903245 - RNA, 16 nt, Mycobacterium avium subsp. paratuberculosis
cgucggcacugcccgc

SEQ ID NO: 2903246 - RNA, 20 nt, Mycobacterium avium subsp. paratuberculosis
cgucggcacugcccgcaucg

SEQ ID NO: 2903247 - RNA, 19 nt, Mycobacterium avium subsp. paratuberculosis
cgucggcagcgacgcggug

SEQ ID NO: 2903248 - RNA, 20 nt, Mycobacterium avium subsp. paratuberculosis
cgucggcaguugcacuuucg

SEQ ID NO: 2903249 - RNA, 18 nt, Mycobacterium avium subsp. paratuberculosis
cgucggcauccacccguu

SEQ ID NO: 2903250 - RNA, 14 nt, Mycobacterium avium subsp. paratuberculosis
cgucggccaacgga

SEQ ID NO: 2903251 - RNA, 12 nt, Mycobacterium avium subsp. paratuberculosis
cgucggccaccg

SEQ ID NO: 2903252 - RNA, 12 nt, Mycobacterium avium subsp. paratuberculosis
cgucggccacgc

SEQ ID NO: 2903253 - RNA, 14 nt, Mycobacterium avium subsp. paratuberculosis
cgucggccacgccg

SEQ ID NO: 2903254 - RNA, 16 nt, Mycobacterium avium subsp. paratuberculosis
cgucggccacgccggg

SEQ ID NO: 2903255 - RNA, 17 nt, Mycobacterium avium subsp. paratuberculosis
cgucggccacgccgggc

SEQ ID NO: 2903256 - RNA, 15 nt, Mycobacterium avium subsp. paratuberculosis
cgucggccacgcucg

SEQ ID NO: 2903257 - RNA, 18 nt, Mycobacterium avium subsp. paratuberculosis
cgucggccacgcucgcca

SEQ ID NO: 2903258 - RNA, 19 nt, Mycobacterium avium subsp. paratuberculosis
cgucggccacgcucgccag

SEQ ID NO: 2903259 - RNA, 11 nt, Mycobacterium avium subsp. paratuberculosis
cgucggccaga

SEQ ID NO: 2903260 - RNA, 11 nt, Mycobacterium avium subsp. paratuberculosis
cgucggccagc

SEQ ID NO: 2903261 - RNA, 14 nt, Mycobacterium avium subsp. paratuberculosis
cgucggccagcacc

SEQ ID NO: 2903262 - RNA, 15 nt, Mycobacterium avium subsp. paratuberculosis
cgucggccagcacca

SEQ ID NO: 2903263 - RNA, 20 nt, Mycobacterium avium subsp. paratuberculosis
cgucggccagcaccaccaac

SEQ ID NO: 2903264 - RNA, 15 nt, Mycobacterium avium subsp. paratuberculosis
cgucggccagcagcg

SEQ ID NO: 2903265 - RNA, 16 nt, Mycobacterium avium subsp. paratuberculosis
cgucggccagcagcgc

SEQ ID NO: 2903266 - RNA, 19 nt, Mycobacterium avium subsp. paratuberculosis
cgucggccagcgcgcgggc

SEQ ID NO: 2903267 - RNA, 20 nt, Mycobacterium avium subsp. paratuberculosis
cgucggccagcgcgugaugg

SEQ ID NO: 2903268 - RNA, 16 nt, Mycobacterium avium subsp. paratuberculosis
cgucggccagcggcag

SEQ ID NO: 2903269 - RNA, 18 nt, Mycobacterium avium subsp. paratuberculosis
cgucggccagcggcagcg

SEQ ID NO: 2903270 - RNA, 20 nt, Mycobacterium avium subsp. paratuberculosis
cgucggccagcggcagcgac

SEQ ID NO: 2903271 - RNA, 23 nt, Mycobacterium avium subsp. paratuberculosis
cgucggccagcggcagcgacagc

SEQ ID NO: 2903272 - RNA, 22 nt, Mycobacterium avium subsp. paratuberculosis
cgucggccaggaucucgcgggc

SEQ ID NO: 2903273 - RNA, 18 nt, Mycobacterium avium subsp. paratuberculosis
cgucggccaguucgccgg

SEQ ID NO: 2903274 - RNA, 21 nt, Mycobacterium avium subsp. paratuberculosis
cgucggccaguucgccgguga

SEQ ID NO: 2903275 - RNA, 22 nt, Mycobacterium avium subsp. paratuberculosis
cgucggccaucagccgccgucg

SEQ ID NO: 2903276 - RNA, 16 nt, Mycobacterium avium subsp. paratuberculosis
cgucggcccacgguga

SEQ ID NO: 2903277 - RNA, 13 nt, Mycobacterium avium subsp. paratuberculosis
cgucggcccgcca

SEQ ID NO: 2903278 - RNA, 17 nt, Mycobacterium avium subsp. paratuberculosis
cgucggcccgccaaaac

SEQ ID NO: 2903279 - RNA, 14 nt, Mycobacterium avium subsp. paratuberculosis
cgucggccgccagg

SEQ ID NO: 2903280 - RNA, 16 nt, Mycobacterium avium subsp. paratuberculosis
cgucggccgccagggc

SEQ ID NO: 2903281 - RNA, 14 nt, Mycobacterium avium subsp. paratuberculosis
cgucggccgccgac

SEQ ID NO: 2903282 - RNA, 16 nt, Mycobacterium avium subsp. paratuberculosis
cgucggccgcgacgac

SEQ ID NO: 2903283 - RNA, 19 nt, Mycobacterium avium subsp. paratuberculosis
cgucggccgcgacgaccgc

SEQ ID NO: 2903284 - RNA, 20 nt, Mycobacterium avium subsp. paratuberculosis
cgucggccgcgacgaccgcc

SEQ ID NO: 2903285 - RNA, 15 nt, Mycobacterium avium subsp. paratuberculosis
cgucggccggcugca

SEQ ID NO: 2903286 - RNA, 22 nt, Mycobacterium avium subsp. paratuberculosis
cgucggccggcugcagccgggc

SEQ ID NO: 2903287 - RNA, 11 nt, Mycobacterium avium subsp. paratuberculosis
cgucggccggg

SEQ ID NO: 2903288 - RNA, 22 nt, Mycobacterium avium subsp. paratuberculosis
cgucggccgggcugcccaccac

SEQ ID NO: 2903289 - RNA, 13 nt, Mycobacterium avium subsp. paratuberculosis
cgucggccggggg

SEQ ID NO: 2903290 - RNA, 14 nt, Mycobacterium avium subsp. paratuberculosis
cgucggccgggggc

SEQ ID NO: 2903291 - RNA, 16 nt, Mycobacterium avium subsp. paratuberculosis
cgucggccgggggcgc

SEQ ID NO: 2903292 - RNA, 22 nt, Mycobacterium avium subsp. paratuberculosis
cgucggccgggggcgcgggcgg

SEQ ID NO: 2903293 - RNA, 15 nt, Mycobacterium avium subsp. paratuberculosis
cgucggccgggucgu

SEQ ID NO: 2903294 - RNA, 15 nt, Mycobacterium avium subsp. paratuberculosis
cgucggccgucggcg

SEQ ID NO: 2903295 - RNA, 19 nt, Mycobacterium avium subsp. paratuberculosis
cgucggccgucggcgccgc

SEQ ID NO: 2903296 - RNA, 19 nt, Mycobacterium avium subsp. paratuberculosis
cgucggccuccagccggcg

SEQ ID NO: 2903297 - RNA, 20 nt, Mycobacterium avium subsp. paratuberculosis
cgucggccuccagccggcgg

SEQ ID NO: 2903298 - RNA, 21 nt, Mycobacterium avium subsp. paratuberculosis
cgucggccuccagccggcgga

SEQ ID NO: 2903299 - RNA, 14 nt, Mycobacterium avium subsp. paratuberculosis
cgucggccucggcg

SEQ ID NO: 2903300 - RNA, 19 nt, Mycobacterium avium subsp. paratuberculosis
cgucggccucggcggccgg

SEQ ID NO: 2903301 - RNA, 18 nt, Mycobacterium avium subsp. paratuberculosis
cgucggccugcgcugcgg

SEQ ID NO: 2903302 - RNA, 13 nt, Mycobacterium avium subsp. paratuberculosis
cgucggccuugcg

SEQ ID NO: 2903303 - RNA, 17 nt, Mycobacterium avium subsp. paratuberculosis
cgucggccuugcgccac

SEQ ID NO: 2903304 - RNA, 18 nt, Mycobacterium avium subsp. paratuberculosis
cgucggccuugcgccacu

SEQ ID NO: 2903305 - RNA, 23 nt, Mycobacterium avium subsp. paratuberculosis
cgucggcgaacagugcacugccg

SEQ ID NO: 2903306 - RNA, 17 nt, Mycobacterium avium subsp. paratuberculosis
cgucggcgaacggccag

SEQ ID NO: 2903307 - RNA, 24 nt, Mycobacterium avium subsp. paratuberculosis
cgucggcgaacuccagaucgccgc

SEQ ID NO: 2903308 - RNA, 14 nt, Mycobacterium avium subsp. paratuberculosis
cgucggcgaccgcg

SEQ ID NO: 2903309 - RNA, 17 nt, Mycobacterium avium subsp. paratuberculosis
cgucggcgaccgcgcgc

SEQ ID NO: 2903310 - RNA, 20 nt, Mycobacterium avium subsp. paratuberculosis
cgucggcgaccgcgcgcggc

SEQ ID NO: 2903311 - RNA, 13 nt, Mycobacterium avium subsp. paratuberculosis
cgucggcgacgac

SEQ ID NO: 2903312 - RNA, 13 nt, Mycobacterium avium subsp. paratuberculosis
cgucggcgacggc

SEQ ID NO: 2903313 - RNA, 15 nt, Mycobacterium avium subsp. paratuberculosis
cgucggcgacggcgu

SEQ ID NO: 2903314 - RNA, 14 nt, Mycobacterium avium subsp. paratuberculosis
cgucggcgagcagc

SEQ ID NO: 2903315 - RNA, 15 nt, Mycobacterium avium subsp. paratuberculosis
cgucggcgagcagca

SEQ ID NO: 2903316 - RNA, 14 nt, Mycobacterium avium subsp. paratuberculosis
cgucggcgagcggu

SEQ ID NO: 2903317 - RNA, 18 nt, Mycobacterium avium subsp. paratuberculosis
cgucggcgagcgguucga

SEQ ID NO: 2903318 - RNA, 17 nt, Mycobacterium avium subsp. paratuberculosis
cgucggcgagcuuggcg

SEQ ID NO: 2903319 - RNA, 14 nt, Mycobacterium avium subsp. paratuberculosis
cgucggcgaucgcc

SEQ ID NO: 2903320 - RNA, 18 nt, Mycobacterium avium subsp. paratuberculosis
cgucggcgaucgccagca

SEQ ID NO: 2903321 - RNA, 22 nt, Mycobacterium avium subsp. paratuberculosis
cgucggcgaucgccagcacggu

SEQ ID NO: 2903322 - RNA, 15 nt, Mycobacterium avium subsp. paratuberculosis
cgucggcgaucgccg

SEQ ID NO: 2903323 - RNA, 19 nt, Mycobacterium avium subsp. paratuberculosis
cgucggcgaucgccgggga

SEQ ID NO: 2903324 - RNA, 13 nt, Mycobacterium avium subsp. paratuberculosis
cgucggcgaugcg

SEQ ID NO: 2903325 - RNA, 15 nt, Mycobacterium avium subsp. paratuberculosis
cgucggcgaugcggu

SEQ ID NO: 2903326 - RNA, 12 nt, Mycobacterium avium subsp. paratuberculosis
cgucggcgaugg

SEQ ID NO: 2903327 - RNA, 14 nt, Mycobacterium avium subsp. paratuberculosis
cgucggcgauggcg

SEQ ID NO: 2903328 - RNA, 22 nt, Mycobacterium avium subsp. paratuberculosis
cgucggcgauggcggcgugcag

SEQ ID NO: 2903329 - RNA, 13 nt, Mycobacterium avium subsp. paratuberculosis
cgucggcgcccgg

SEQ ID NO: 2903330 - RNA, 14 nt, Mycobacterium avium subsp. paratuberculosis
cgucggcgcccggc

SEQ ID NO: 2903331 - RNA, 18 nt, Mycobacterium avium subsp. paratuberculosis
cgucggcgcccggcaccg

SEQ ID NO: 2903332 - RNA, 21 nt, Mycobacterium avium subsp. paratuberculosis
cgucggcgcccggcaccggga

SEQ ID NO: 2903333 - RNA, 13 nt, Mycobacterium avium subsp. paratuberculosis
cgucggcgccgcc

SEQ ID NO: 2903334 - RNA, 16 nt, Mycobacterium avium subsp. paratuberculosis
cgucggcgccgccgag

SEQ ID NO: 2903335 - RNA, 17 nt, Mycobacterium avium subsp. paratuberculosis
cgucggcgccgcgccgg

SEQ ID NO: 2903336 - RNA, 18 nt, Mycobacterium avium subsp. paratuberculosis
cgucggcgccgcgccggc

SEQ ID NO: 2903337 - RNA, 21 nt, Mycobacterium avium subsp. paratuberculosis
cgucggcgccggaucggcccc

SEQ ID NO: 2903338 - RNA, 13 nt, Mycobacterium avium subsp. paratuberculosis
cgucggcgccggc

SEQ ID NO: 2903339 - RNA, 14 nt, Mycobacterium avium subsp. paratuberculosis
cgucggcgccggcg

SEQ ID NO: 2903340 - RNA, 16 nt, Mycobacterium avium subsp. paratuberculosis
cgucggcgccggcgcg

SEQ ID NO: 2903341 - RNA, 17 nt, Mycobacterium avium subsp. paratuberculosis
cgucggcgccggcgcgc

SEQ ID NO: 2903342 - RNA, 18 nt, Mycobacterium avium subsp. paratuberculosis
cgucggcgccggcgcgca

SEQ ID NO: 2903343 - RNA, 12 nt, Mycobacterium avium subsp. paratuberculosis
cgucggcgccgu

SEQ ID NO: 2903344 - RNA, 14 nt, Mycobacterium avium subsp. paratuberculosis
cgucggcgccguag

SEQ ID NO: 2903345 - RNA, 13 nt, Mycobacterium avium subsp. paratuberculosis
cgucggcgccguc

SEQ ID NO: 2903346 - RNA, 16 nt, Mycobacterium avium subsp. paratuberculosis
cgucggcgccgucgcg

SEQ ID NO: 2903347 - RNA, 19 nt, Mycobacterium avium subsp. paratuberculosis
cgucggcgccgucgcggga

SEQ ID NO: 2903348 - RNA, 18 nt, Mycobacterium avium subsp. paratuberculosis
cgucggcgcgcaccgcga

SEQ ID NO: 2903349 - RNA, 13 nt, Mycobacterium avium subsp. paratuberculosis
cgucggcgcgcca

SEQ ID NO: 2903350 - RNA, 17 nt, Mycobacterium avium subsp. paratuberculosis
cgucggcgcgccacccg

SEQ ID NO: 2903351 - RNA, 18 nt, Mycobacterium avium subsp. paratuberculosis
cgucggcgcgccacccga

SEQ ID NO: 2903352 - RNA, 12 nt, Mycobacterium avium subsp. paratuberculosis
cgucggcgcgcu

SEQ ID NO: 2903353 - RNA, 13 nt, Mycobacterium avium subsp. paratuberculosis
cgucggcgcgcuc

SEQ ID NO: 2903354 - RNA, 15 nt, Mycobacterium avium subsp. paratuberculosis
cgucggcgcgcucgg

SEQ ID NO: 2903355 - RNA, 16 nt, Mycobacterium avium subsp. paratuberculosis
cgucggcgcgcucggu

SEQ ID NO: 2903356 - RNA, 17 nt, Mycobacterium avium subsp. paratuberculosis
cgucggcgcgcucggug

SEQ ID NO: 2903357 - RNA, 20 nt, Mycobacterium avium subsp. paratuberculosis
cgucggcgcgcucggugcug

SEQ ID NO: 2903358 - RNA, 15 nt, Mycobacterium avium subsp. paratuberculosis
cgucggcgcggccgg

SEQ ID NO: 2903359 - RNA, 16 nt, Mycobacterium avium subsp. paratuberculosis
cgucggcgcggccgga

SEQ ID NO: 2903360 - RNA, 15 nt, Mycobacterium avium subsp. paratuberculosis
cgucggcgcgggcca

SEQ ID NO: 2903361 - RNA, 16 nt, Mycobacterium avium subsp. paratuberculosis
cgucggcgcgggccag

SEQ ID NO: 2903362 - RNA, 14 nt, Mycobacterium avium subsp. paratuberculosis
cgucggcgcggucg

SEQ ID NO: 2903363 - RNA, 17 nt, Mycobacterium avium subsp. paratuberculosis
cgucggcgcggucgcag

SEQ ID NO: 2903364 - RNA, 20 nt, Mycobacterium avium subsp. paratuberculosis
cgucggcgcuggccagcgcg

SEQ ID NO: 2903365 - RNA, 23 nt, Mycobacterium avium subsp. paratuberculosis
cgucggcgcuuuccaccucgagc

SEQ ID NO: 2903366 - RNA, 21 nt, Mycobacterium avium subsp. paratuberculosis
cgucggcggagaugacgugga

SEQ ID NO: 2903367 - RNA, 18 nt, Mycobacterium avium subsp. paratuberculosis
cgucggcggaggucaugg

SEQ ID NO: 2903368 - RNA, 11 nt, Mycobacterium avium subsp. paratuberculosis
cgucggcggcc

SEQ ID NO: 2903369 - RNA, 14 nt, Mycobacterium avium subsp. paratuberculosis
cgucggcggccgcg

SEQ ID NO: 2903370 - RNA, 18 nt, Mycobacterium avium subsp. paratuberculosis
cgucggcggccugcucgc

SEQ ID NO: 2903371 - RNA, 14 nt, Mycobacterium avium subsp. paratuberculosis
cgucggcggcgacg

SEQ ID NO: 2903372 - RNA, 14 nt, Mycobacterium avium subsp. paratuberculosis
cgucggcgggcugc

SEQ ID NO: 2903373 - RNA, 18 nt, Mycobacterium avium subsp. paratuberculosis
cgucggcgggcugcagcg

SEQ ID NO: 2903374 - RNA, 20 nt, Mycobacterium avium subsp. paratuberculosis
cgucggcggggaagggcucc

SEQ ID NO: 2903375 - RNA, 17 nt, Mycobacterium avium subsp. paratuberculosis
cgucggcggucaacacg

SEQ ID NO: 2903376 - RNA, 15 nt, Mycobacterium avium subsp. paratuberculosis
cgucggcggucgcca

SEQ ID NO: 2903377 - RNA, 21 nt, Mycobacterium avium subsp. paratuberculosis
cgucggcggucgccagcgcca

SEQ ID NO: 2903378 - RNA, 22 nt, Mycobacterium avium subsp. paratuberculosis
cgucggcggucgccagcgccac

SEQ ID NO: 2903379 - RNA, 21 nt, Mycobacterium avium subsp. paratuberculosis
cgucggcggucuuggcggcca

SEQ ID NO: 2903380 - RNA, 15 nt, Mycobacterium avium subsp. paratuberculosis
cgucggcggugccga

SEQ ID NO: 2903381 - RNA, 12 nt, Mycobacterium avium subsp. paratuberculosis
cgucggcggugg

SEQ ID NO: 2903382 - RNA, 22 nt, Mycobacterium avium subsp. paratuberculosis
cgucggcggugguccgcgcgac

SEQ ID NO: 2903383 - RNA, 23 nt, Mycobacterium avium subsp. paratuberculosis
cgucggcggugguccgcgcgacc

SEQ ID NO: 2903384 - RNA, 13 nt, Mycobacterium avium subsp. paratuberculosis
cgucggcgguguc

SEQ ID NO: 2903385 - RNA, 20 nt, Mycobacterium avium subsp. paratuberculosis
cgucggcgguuucggugccg

SEQ ID NO: 2903386 - RNA, 14 nt, Mycobacterium avium subsp. paratuberculosis
cgucggcguacugc

SEQ ID NO: 2903387 - RNA, 15 nt, Mycobacterium avium subsp. paratuberculosis
cgucggcguagggca

SEQ ID NO: 2903388 - RNA, 18 nt, Mycobacterium avium subsp. paratuberculosis
cgucggcguagggcagcc

SEQ ID NO: 2903389 - RNA, 21 nt, Mycobacterium avium subsp. paratuberculosis
cgucggcguagggcagcccga

SEQ ID NO: 2903390 - RNA, 13 nt, Mycobacterium avium subsp. paratuberculosis
cgucggcgucauc

SEQ ID NO: 2903391 - RNA, 14 nt, Mycobacterium avium subsp. paratuberculosis
cgucggcgucgaac

SEQ ID NO: 2903392 - RNA, 16 nt, Mycobacterium avium subsp. paratuberculosis
cgucggcgucgaacgg

SEQ ID NO: 2903393 - RNA, 18 nt, Mycobacterium avium subsp. paratuberculosis
cgucggcgucgaacggcg

SEQ ID NO: 2903394 - RNA, 15 nt, Mycobacterium avium subsp. paratuberculosis
cgucggcgucgacga

SEQ ID NO: 2903395 - RNA, 13 nt, Mycobacterium avium subsp. paratuberculosis
cgucggcgucgga

SEQ ID NO: 2903396 - RNA, 21 nt, Mycobacterium avium subsp. paratuberculosis
cgucggcgucggaggcggcgu

SEQ ID NO: 2903397 - RNA, 15 nt, Mycobacterium avium subsp. paratuberculosis
cgucggcgucgggcg

SEQ ID NO: 2903398 - RNA, 16 nt, Mycobacterium avium subsp. paratuberculosis
cgucggcgucgggcgg

SEQ ID NO: 2903399 - RNA, 15 nt, Mycobacterium avium subsp. paratuberculosis
cgucggcgugauagg

SEQ ID NO: 2903400 - RNA, 19 nt, Mycobacterium avium subsp. paratuberculosis
cgucggcgugcccgccgac

SEQ ID NO: 2903401 - RNA, 20 nt, Mycobacterium avium subsp. paratuberculosis
cgucggcgugcccgccgacc

SEQ ID NO: 2903402 - RNA, 22 nt, Mycobacterium avium subsp. paratuberculosis
cgucggcgugcccgccgaccag

SEQ ID NO: 2903403 - RNA, 14 nt, Mycobacterium avium subsp. paratuberculosis
cgucggcguucagc

SEQ ID NO: 2903404 - RNA, 21 nt, Mycobacterium avium subsp. paratuberculosis
cgucggcguucagcggcaccg

SEQ ID NO: 2903405 - RNA, 22 nt, Mycobacterium avium subsp. paratuberculosis
cgucggcuagcggcugacccgc

SEQ ID NO: 2903406 - RNA, 23 nt, Mycobacterium avium subsp. paratuberculosis
cgucggcuagcggcugacccgcc

SEQ ID NO: 2903407 - RNA, 22 nt, Mycobacterium avium subsp. paratuberculosis
cgucggcucguguccgaugacg

SEQ ID NO: 2903408 - RNA, 19 nt, Mycobacterium avium subsp. paratuberculosis
cgucggcuggcgugcggcg

SEQ ID NO: 2903409 - RNA, 18 nt, Mycobacterium avium subsp. paratuberculosis
cgucggcuuccuccucgg

SEQ ID NO: 2903410 - RNA, 17 nt, Mycobacterium avium subsp. paratuberculosis
cgucgggaacgccgauc

SEQ ID NO: 2903411 - RNA, 18 nt, Mycobacterium avium subsp. paratuberculosis
cgucgggaacgcgaaccc

SEQ ID NO: 2903412 - RNA, 20 nt, Mycobacterium avium subsp. paratuberculosis
cgucgggaauggggcccggu

SEQ ID NO: 2903413 - RNA, 17 nt, Mycobacterium avium subsp. paratuberculosis
cgucgggaaugucggcg

SEQ ID NO: 2903414 - RNA, 18 nt, Mycobacterium avium subsp. paratuberculosis
cgucgggaaugucggcgu

SEQ ID NO: 2903415 - RNA, 14 nt, Mycobacterium avium subsp. paratuberculosis
cgucgggaccgucg

SEQ ID NO: 2903416 - RNA, 19 nt, Mycobacterium avium subsp. paratuberculosis
cgucgggaccgucgcgcag

SEQ ID NO: 2903417 - RNA, 24 nt, Mycobacterium avium subsp. paratuberculosis
cgucgggaccgucgcgcagcccga

SEQ ID NO: 2903418 - RNA, 15 nt, Mycobacterium avium subsp. paratuberculosis
cgucgggacgcggca

SEQ ID NO: 2903419 - RNA, 14 nt, Mycobacterium avium subsp. paratuberculosis
cgucgggcaccacg

SEQ ID NO: 2903420 - RNA, 18 nt, Mycobacterium avium subsp. paratuberculosis
cgucgggcaccacggcgg

SEQ ID NO: 2903421 - RNA, 22 nt, Mycobacterium avium subsp. paratuberculosis
cgucgggcaccacggcggcaug

SEQ ID NO: 2903422 - RNA, 14 nt, Mycobacterium avium subsp. paratuberculosis
cgucgggcaccagc

SEQ ID NO: 2903423 - RNA, 19 nt, Mycobacterium avium subsp. paratuberculosis
cgucgggcaccagcaccga

SEQ ID NO: 2903424 - RNA, 12 nt, Mycobacterium avium subsp. paratuberculosis
cgucgggcaccu

SEQ ID NO: 2903425 - RNA, 13 nt, Mycobacterium avium subsp. paratuberculosis
cgucgggcaccuc

SEQ ID NO: 2903426 - RNA, 14 nt, Mycobacterium avium subsp. paratuberculosis
cgucgggcaccuga

SEQ ID NO: 2903427 - RNA, 16 nt, Mycobacterium avium subsp. paratuberculosis
cgucgggccgcagcac

SEQ ID NO: 2903428 - RNA, 11 nt, Mycobacterium avium subsp. paratuberculosis
cgucgggccgg

SEQ ID NO: 2903429 - RNA, 19 nt, Mycobacterium avium subsp. paratuberculosis
cgucgggccggaucagcag

SEQ ID NO: 2903430 - RNA, 14 nt, Mycobacterium avium subsp. paratuberculosis
cgucgggccggggg

SEQ ID NO: 2903431 - RNA, 22 nt, Mycobacterium avium subsp. paratuberculosis
cgucgggccgggggcggcggcg

SEQ ID NO: 2903432 - RNA, 11 nt, Mycobacterium avium subsp. paratuberculosis
cgucgggccgu

SEQ ID NO: 2903433 - RNA, 14 nt, Mycobacterium avium subsp. paratuberculosis
cgucgggccguccg

SEQ ID NO: 2903434 - RNA, 17 nt, Mycobacterium avium subsp. paratuberculosis
cgucgggcgccggcgcg

SEQ ID NO: 2903435 - RNA, 20 nt, Mycobacterium avium subsp. paratuberculosis
cgucgggcgccggcgcgucc

SEQ ID NO: 2903436 - RNA, 14 nt, Mycobacterium avium subsp. paratuberculosis
cgucgggcgccggu

SEQ ID NO: 2903437 - RNA, 15 nt, Mycobacterium avium subsp. paratuberculosis
cgucgggcgccgguu

SEQ ID NO: 2903438 - RNA, 17 nt, Mycobacterium avium subsp. paratuberculosis
cgucgggcgcggcggca

SEQ ID NO: 2903439 - RNA, 13 nt, Mycobacterium avium subsp. paratuberculosis
cgucgggcgcggu

SEQ ID NO: 2903440 - RNA, 15 nt, Mycobacterium avium subsp. paratuberculosis
cgucgggcgcggugu

SEQ ID NO: 2903441 - RNA, 13 nt, Mycobacterium avium subsp. paratuberculosis
cgucgggcucgcg

SEQ ID NO: 2903442 - RNA, 18 nt, Mycobacterium avium subsp. paratuberculosis
cgucgggcucggccgccg

SEQ ID NO: 2903443 - RNA, 22 nt, Mycobacterium avium subsp. paratuberculosis
cgucgggcucgucgugauggcg

SEQ ID NO: 2903444 - RNA, 14 nt, Mycobacterium avium subsp. paratuberculosis
cgucgggcugggcg

SEQ ID NO: 2903445 - RNA, 19 nt, Mycobacterium avium subsp. paratuberculosis
cgucgggcuugcgcaacag

SEQ ID NO: 2903446 - RNA, 20 nt, Mycobacterium avium subsp. paratuberculosis
cgucggggaucagcgucgcg

SEQ ID NO: 2903447 - RNA, 22 nt, Mycobacterium avium subsp. paratuberculosis
cgucggggaucagcgucgcgau

SEQ ID NO: 2903448 - RNA, 14 nt, Mycobacterium avium subsp. paratuberculosis
cgucggggaugccg

SEQ ID NO: 2903449 - RNA, 18 nt, Mycobacterium avium subsp. paratuberculosis
cgucggggaugucgucgg

SEQ ID NO: 2903450 - RNA, 20 nt, Mycobacterium avium subsp. paratuberculosis
cgucggggaugucgucgggc

SEQ ID NO: 2903451 - RNA, 22 nt, Mycobacterium avium subsp. paratuberculosis
cgucggggaugucgucgggcgc

SEQ ID NO: 2903452 - RNA, 24 nt, Mycobacterium avium subsp. paratuberculosis
cgucggggaugucgucgggcgcgg

SEQ ID NO: 2903453 - RNA, 16 nt, Mycobacterium avium subsp. paratuberculosis
cgucggggcagccguc

SEQ ID NO: 2903454 - RNA, 22 nt, Mycobacterium avium subsp. paratuberculosis
cgucggggcaucgcagcgcgcg

SEQ ID NO: 2903455 - RNA, 18 nt, Mycobacterium avium subsp. paratuberculosis
cgucggggcccggcccgg

SEQ ID NO: 2903456 - RNA, 20 nt, Mycobacterium avium subsp. paratuberculosis
cgucggggcccggcccggcg

SEQ ID NO: 2903457 - RNA, 23 nt, Mycobacterium avium subsp. paratuberculosis
cgucggggcccggcccggcgaug

SEQ ID NO: 2903458 - RNA, 14 nt, Mycobacterium avium subsp. paratuberculosis
cgucggggcgucgg

SEQ ID NO: 2903459 - RNA, 15 nt, Mycobacterium avium subsp. paratuberculosis
cgucggggcgucggc

SEQ ID NO: 2903460 - RNA, 17 nt, Mycobacterium avium subsp. paratuberculosis
cgucggggcgucggcgg

SEQ ID NO: 2903461 - RNA, 19 nt, Mycobacterium avium subsp. paratuberculosis
cgucggggcgucggcggcc

SEQ ID NO: 2903462 - RNA, 19 nt, Mycobacterium avium subsp. paratuberculosis
cgucggggcuggcggcgaa

SEQ ID NO: 2903463 - RNA, 13 nt, Mycobacterium avium subsp. paratuberculosis
cgucgggggugcc

SEQ ID NO: 2903464 - RNA, 14 nt, Mycobacterium avium subsp. paratuberculosis
cgucggggucgcgc

SEQ ID NO: 2903465 - RNA, 15 nt, Mycobacterium avium subsp. paratuberculosis
cgucggggucgcgcc

SEQ ID NO: 2903466 - RNA, 16 nt, Mycobacterium avium subsp. paratuberculosis
cgucggggucgcgccg

SEQ ID NO: 2903467 - RNA, 17 nt, Mycobacterium avium subsp. paratuberculosis
cgucggggucgcgccgg

SEQ ID NO: 2903468 - RNA, 14 nt, Mycobacterium avium subsp. paratuberculosis
cgucggggucgucg

SEQ ID NO: 2903469 - RNA, 16 nt, Mycobacterium avium subsp. paratuberculosis
cgucggggucgucgcg

SEQ ID NO: 2903470 - RNA, 17 nt, Mycobacterium avium subsp. paratuberculosis
cgucggggugcgccagg

SEQ ID NO: 2903471 - RNA, 14 nt, Mycobacterium avium subsp. paratuberculosis
cgucggggugcggu

SEQ ID NO: 2903472 - RNA, 19 nt, Mycobacterium avium subsp. paratuberculosis
cgucggggugcggucggcg

SEQ ID NO: 2903473 - RNA, 23 nt, Mycobacterium avium subsp. paratuberculosis
cgucggggugcggucggcgacgu

SEQ ID NO: 2903474 - RNA, 18 nt, Mycobacterium avium subsp. paratuberculosis
cgucgggguggccggcca

SEQ ID NO: 2903475 - RNA, 19 nt, Mycobacterium avium subsp. paratuberculosis
cgucgggguggccggccag

SEQ ID NO: 2903476 - RNA, 20 nt, Mycobacterium avium subsp. paratuberculosis
cgucgggguggggacgacgc

SEQ ID NO: 2903477 - RNA, 20 nt, Mycobacterium avium subsp. paratuberculosis
cgucggguacaccgagccgg

SEQ ID NO: 2903478 - RNA, 17 nt, Mycobacterium avium subsp. paratuberculosis
cgucggguagggcgccg

SEQ ID NO: 2903479 - RNA, 21 nt, Mycobacterium avium subsp. paratuberculosis
cgucggguagggcgccgucgg

SEQ ID NO: 2903480 - RNA, 16 nt, Mycobacterium avium subsp. paratuberculosis
cgucggguccgaccag

SEQ ID NO: 2903481 - RNA, 20 nt, Mycobacterium avium subsp. paratuberculosis
cgucggguccgaccagcacc

SEQ ID NO: 2903482 - RNA, 21 nt, Mycobacterium avium subsp. paratuberculosis
cgucggguccgaccagcaccc

SEQ ID NO: 2903483 - RNA, 14 nt, Mycobacterium avium subsp. paratuberculosis
cgucgggucgaagu

SEQ ID NO: 2903484 - RNA, 22 nt, Mycobacterium avium subsp. paratuberculosis
cgucgggucgaagugcucgagc

SEQ ID NO: 2903485 - RNA, 14 nt, Mycobacterium avium subsp. paratuberculosis
cgucgggucggcga

SEQ ID NO: 2903486 - RNA, 19 nt, Mycobacterium avium subsp. paratuberculosis
cgucgggugucaggucggc

SEQ ID NO: 2903487 - RNA, 14 nt, Mycobacterium avium subsp. paratuberculosis
cgucggguucgccg

SEQ ID NO: 2903488 - RNA, 23 nt, Mycobacterium avium subsp. paratuberculosis
cgucggguucgccggugaccgcg

SEQ ID NO: 2903489 - RNA, 17 nt, Mycobacterium avium subsp. paratuberculosis
cgucgguaaucggcggu

SEQ ID NO: 2903490 - RNA, 18 nt, Mycobacterium avium subsp. paratuberculosis
cgucgguaaucggcggug

SEQ ID NO: 2903491 - RNA, 13 nt, Mycobacterium avium subsp. paratuberculosis
cgucggucacccg

SEQ ID NO: 2903492 - RNA, 14 nt, Mycobacterium avium subsp. paratuberculosis
cgucggucacccgg

SEQ ID NO: 2903493 - RNA, 21 nt, Mycobacterium avium subsp. paratuberculosis
cgucggucagcaggcgccgca

SEQ ID NO: 2903494 - RNA, 13 nt, Mycobacterium avium subsp. paratuberculosis
cgucggucagcga

SEQ ID NO: 2903495 - RNA, 21 nt, Mycobacterium avium subsp. paratuberculosis
cgucggucagcgagcgguugg

SEQ ID NO: 2903496 - RNA, 15 nt, Mycobacterium avium subsp. paratuberculosis
cgucggucagcgcca

SEQ ID NO: 2903497 - RNA, 18 nt, Mycobacterium avium subsp. paratuberculosis
cgucggucagcggcguca

SEQ ID NO: 2903498 - RNA, 20 nt, Mycobacterium avium subsp. paratuberculosis
cgucggucagcggcgucagg

SEQ ID NO: 2903499 - RNA, 20 nt, Mycobacterium avium subsp. paratuberculosis
cgucggucaggccggcgccg

SEQ ID NO: 2903500 - RNA, 22 nt, Mycobacterium avium subsp. paratuberculosis
cgucgguccaaaacaucccgga

SEQ ID NO: 2903501 - RNA, 15 nt, Mycobacterium avium subsp. paratuberculosis
cgucgguccaggugg

SEQ ID NO: 2903502 - RNA, 19 nt, Mycobacterium avium subsp. paratuberculosis
cgucggucccgacgcggcg

SEQ ID NO: 2903503 - RNA, 22 nt, Mycobacterium avium subsp. paratuberculosis
cgucggucccgacgcggcgcga

SEQ ID NO: 2903504 - RNA, 13 nt, Mycobacterium avium subsp. paratuberculosis
cgucggucggcag

SEQ ID NO: 2903505 - RNA, 15 nt, Mycobacterium avium subsp. paratuberculosis
cgucggucggcagga

SEQ ID NO: 2903506 - RNA, 15 nt, Mycobacterium avium subsp. paratuberculosis
cgucggucucgacgu

SEQ ID NO: 2903507 - RNA, 21 nt, Mycobacterium avium subsp. paratuberculosis
cgucggucucuucgacccggu

SEQ ID NO: 2903508 - RNA, 17 nt, Mycobacterium avium subsp. paratuberculosis
cgucggucugcaggucg

SEQ ID NO: 2903509 - RNA, 16 nt, Mycobacterium avium subsp. paratuberculosis
cgucggugaacgccgg

SEQ ID NO: 2903510 - RNA, 17 nt, Mycobacterium avium subsp. paratuberculosis
cgucggugaacgccggu

SEQ ID NO: 2903511 - RNA, 18 nt, Mycobacterium avium subsp. paratuberculosis
cgucggugaacgccggug

SEQ ID NO: 2903512 - RNA, 23 nt, Mycobacterium avium subsp. paratuberculosis
cgucggugacgcccuuguccucg

SEQ ID NO: 2903513 - RNA, 24 nt, Mycobacterium avium subsp. paratuberculosis
cgucggugacggugugcgggucgg

SEQ ID NO: 2903514 - RNA, 19 nt, Mycobacterium avium subsp. paratuberculosis
cgucggugaggauuucgcu

SEQ ID NO: 2903515 - RNA, 22 nt, Mycobacterium avium subsp. paratuberculosis
cgucggugaugucggugagcgc

SEQ ID NO: 2903516 - RNA, 20 nt, Mycobacterium avium subsp. paratuberculosis
cgucggugccgaagcgccac

SEQ ID NO: 2903517 - RNA, 12 nt, Mycobacterium avium subsp. paratuberculosis
cgucggugccgc

SEQ ID NO: 2903518 - RNA, 13 nt, Mycobacterium avium subsp. paratuberculosis
cgucggugcgcgc

SEQ ID NO: 2903519 - RNA, 16 nt, Mycobacterium avium subsp. paratuberculosis
cgucggugcgcgccgc

SEQ ID NO: 2903520 - RNA, 16 nt, Mycobacterium avium subsp. paratuberculosis
cgucggugcggggcgg

SEQ ID NO: 2903521 - RNA, 15 nt, Mycobacterium avium subsp. paratuberculosis
cgucggugcgguagg

SEQ ID NO: 2903522 - RNA, 12 nt, Mycobacterium avium subsp. paratuberculosis
cgucgguggcgg

SEQ ID NO: 2903523 - RNA, 23 nt, Mycobacterium avium subsp. paratuberculosis
cgucggugggccgccgcggcggc

SEQ ID NO: 2903524 - RNA, 19 nt, Mycobacterium avium subsp. paratuberculosis
cgucgguggggugaggcac

SEQ ID NO: 2903525 - RNA, 15 nt, Mycobacterium avium subsp. paratuberculosis
cgucggugguccagu

SEQ ID NO: 2903526 - RNA, 21 nt, Mycobacterium avium subsp. paratuberculosis
cgucggugguccagucgauag

SEQ ID NO: 2903527 - RNA, 19 nt, Mycobacterium avium subsp. paratuberculosis
cgucgguguagcccucccg

SEQ ID NO: 2903528 - RNA, 18 nt, Mycobacterium avium subsp. paratuberculosis
cgucgguguagucggcga

SEQ ID NO: 2903529 - RNA, 23 nt, Mycobacterium avium subsp. paratuberculosis
cgucgguguagucggcgaucggc

SEQ ID NO: 2903530 - RNA, 14 nt, Mycobacterium avium subsp. paratuberculosis
cgucgguguccagg

SEQ ID NO: 2903531 - RNA, 21 nt, Mycobacterium avium subsp. paratuberculosis
cgucggugucccgcgcccgcg

SEQ ID NO: 2903532 - RNA, 15 nt, Mycobacterium avium subsp. paratuberculosis
cgucgguuucggucg

SEQ ID NO: 2903533 - RNA, 17 nt, Mycobacterium avium subsp. paratuberculosis
cgucgguuucggucgcg

SEQ ID NO: 2903534 - RNA, 19 nt, Mycobacterium avium subsp. paratuberculosis
cgucgguuucggucgcggu

SEQ ID NO: 2903535 - RNA, 20 nt, Mycobacterium avium subsp. paratuberculosis
cgucgguuucggucgcggug

SEQ ID NO: 2903536 - RNA, 14 nt, Mycobacterium avium subsp. paratuberculosis
cgucguacaccucg

SEQ ID NO: 2903537 - RNA, 17 nt, Mycobacterium avium subsp. paratuberculosis
cgucguacagcagcccc

SEQ ID NO: 2903538 - RNA, 23 nt, Mycobacterium avium subsp. paratuberculosis
cgucguacagcagccccugcacc

SEQ ID NO: 2903539 - RNA, 18 nt, Mycobacterium avium subsp. paratuberculosis
cgucguacucgaccgcga

SEQ ID NO: 2903540 - RNA, 22 nt, Mycobacterium avium subsp. paratuberculosis
cgucguagagcugacgggaccg

SEQ ID NO: 2903541 - RNA, 15 nt, Mycobacterium avium subsp. paratuberculosis
cgucguagccgcggg

SEQ ID NO: 2903542 - RNA, 17 nt, Mycobacterium avium subsp. paratuberculosis
cgucguaguaacgcgag

SEQ ID NO: 2903543 - RNA, 17 nt, Mycobacterium avium subsp. paratuberculosis
cgucguagucgcucggc

SEQ ID NO: 2903544 - RNA, 17 nt, Mycobacterium avium subsp. paratuberculosis
cgucguaguugcggccg

SEQ ID NO: 2903545 - RNA, 18 nt, Mycobacterium avium subsp. paratuberculosis
cgucguaguugcggccgg

SEQ ID NO: 2903546 - RNA, 23 nt, Mycobacterium avium subsp. paratuberculosis
cgucguaguugcggccggcggug

SEQ ID NO: 2903547 - RNA, 19 nt, Mycobacterium avium subsp. paratuberculosis
cgucguauucgacggcgac

SEQ ID NO: 2903548 - RNA, 21 nt, Mycobacterium avium subsp. paratuberculosis
cgucguauucgacggcgacca

SEQ ID NO: 2903549 - RNA, 14 nt, Mycobacterium avium subsp. paratuberculosis
cgucgucagcaccg

SEQ ID NO: 2903550 - RNA, 17 nt, Mycobacterium avium subsp. paratuberculosis
cgucgucagcaccgugg

SEQ ID NO: 2903551 - RNA, 20 nt, Mycobacterium avium subsp. paratuberculosis
cgucgucaggccgugaucgg

SEQ ID NO: 2903552 - RNA, 18 nt, Mycobacterium avium subsp. paratuberculosis
cgucgucaucgucuccgc

SEQ ID NO: 2903553 - RNA, 20 nt, Mycobacterium avium subsp. paratuberculosis
cgucguccacgcccagcgcc

SEQ ID NO: 2903554 - RNA, 21 nt, Mycobacterium avium subsp. paratuberculosis
cgucguccacgcccagcgccc

SEQ ID NO: 2903555 - RNA, 19 nt, Mycobacterium avium subsp. paratuberculosis
cgucguccagcuucucggc

SEQ ID NO: 2903556 - RNA, 22 nt, Mycobacterium avium subsp. paratuberculosis
cgucguccagcuucucggcguc

SEQ ID NO: 2903557 - RNA, 22 nt, Mycobacterium avium subsp. paratuberculosis
cgucgucccaggguugccgcac

SEQ ID NO: 2903558 - RNA, 16 nt, Mycobacterium avium subsp. paratuberculosis
cgucgucccggugaug

SEQ ID NO: 2903559 - RNA, 15 nt, Mycobacterium avium subsp. paratuberculosis
cgucgucccgucggc

SEQ ID NO: 2903560 - RNA, 17 nt, Mycobacterium avium subsp. paratuberculosis
cgucgucccgucggcgc

SEQ ID NO: 2903561 - RNA, 23 nt, Mycobacterium avium subsp. paratuberculosis
cgucgucccgucggcgcgaggcg

SEQ ID NO: 2903562 - RNA, 15 nt, Mycobacterium avium subsp. paratuberculosis
cgucguccggcgcgc

SEQ ID NO: 2903563 - RNA, 16 nt, Mycobacterium avium subsp. paratuberculosis
cgucguccggcgcgca

SEQ ID NO: 2903564 - RNA, 19 nt, Mycobacterium avium subsp. paratuberculosis
cgucguccggcgcgcagca

SEQ ID NO: 2903565 - RNA, 15 nt, Mycobacterium avium subsp. paratuberculosis
cgucguccuccuccu

SEQ ID NO: 2903566 - RNA, 18 nt, Mycobacterium avium subsp. paratuberculosis
cgucguccucuucgcgga

SEQ ID NO: 2903567 - RNA, 14 nt, Mycobacterium avium subsp. paratuberculosis
cgucgucgaaggcc

SEQ ID NO: 2903568 - RNA, 23 nt, Mycobacterium avium subsp. paratuberculosis
cgucgucgaaggccuggaacacc

SEQ ID NO: 2903569 - RNA, 14 nt, Mycobacterium avium subsp. paratuberculosis
cgucgucgacccgc

SEQ ID NO: 2903570 - RNA, 14 nt, Mycobacterium avium subsp. paratuberculosis
cgucgucgaccguc

SEQ ID NO: 2903571 - RNA, 12 nt, Mycobacterium avium subsp. paratuberculosis
cgucgucgacgc

SEQ ID NO: 2903572 - RNA, 13 nt, Mycobacterium avium subsp. paratuberculosis
cgucgucgacgcu

SEQ ID NO: 2903573 - RNA, 12 nt, Mycobacterium avium subsp. paratuberculosis
cgucgucgacgu

SEQ ID NO: 2903574 - RNA, 14 nt, Mycobacterium avium subsp. paratuberculosis
cgucgucgagcacg

SEQ ID NO: 2903575 - RNA, 13 nt, Mycobacterium avium subsp. paratuberculosis
cgucgucgagccg

SEQ ID NO: 2903576 - RNA, 14 nt, Mycobacterium avium subsp. paratuberculosis
cgucgucgagccgc

SEQ ID NO: 2903577 - RNA, 17 nt, Mycobacterium avium subsp. paratuberculosis
cgucgucgagccgcucg

SEQ ID NO: 2903578 - RNA, 15 nt, Mycobacterium avium subsp. paratuberculosis
cgucgucgagcgcuc

SEQ ID NO: 2903579 - RNA, 17 nt, Mycobacterium avium subsp. paratuberculosis
cgucgucgaggcggauc

SEQ ID NO: 2903580 - RNA, 20 nt, Mycobacterium avium subsp. paratuberculosis
cgucgucgaugaacaucgcc

SEQ ID NO: 2903581 - RNA, 21 nt, Mycobacterium avium subsp. paratuberculosis
cgucgucgaugaacaucgccg

SEQ ID NO: 2903582 - RNA, 13 nt, Mycobacterium avium subsp. paratuberculosis
cgucgucgaugcg

SEQ ID NO: 2903583 - RNA, 16 nt, Mycobacterium avium subsp. paratuberculosis
cgucgucgaugcgcag

SEQ ID NO: 2903584 - RNA, 17 nt, Mycobacterium avium subsp. paratuberculosis
cgucgucgaugcgcagc

SEQ ID NO: 2903585 - RNA, 15 nt, Mycobacterium avium subsp. paratuberculosis
cgucgucgcaccggc

SEQ ID NO: 2903586 - RNA, 15 nt, Mycobacterium avium subsp. paratuberculosis
cgucgucgcccaccc

SEQ ID NO: 2903587 - RNA, 14 nt, Mycobacterium avium subsp. paratuberculosis
cgucgucgccgaug

SEQ ID NO: 2903588 - RNA, 22 nt, Mycobacterium avium subsp. paratuberculosis
cgucgucgccgaugcgccgcac

SEQ ID NO: 2903589 - RNA, 21 nt, Mycobacterium avium subsp. paratuberculosis
cgucgucgccguggcggcccg

SEQ ID NO: 2903590 - RNA, 13 nt, Mycobacterium avium subsp. paratuberculosis
cgucgucgcgcag

SEQ ID NO: 2903591 - RNA, 14 nt, Mycobacterium avium subsp. paratuberculosis
cgucgucgcggcgc

SEQ ID NO: 2903592 - RNA, 15 nt, Mycobacterium avium subsp. paratuberculosis
cgucgucgcggcgcu

SEQ ID NO: 2903593 - RNA, 24 nt, Mycobacterium avium subsp. paratuberculosis
cgucgucgcuccacaucugccggc

SEQ ID NO: 2903594 - RNA, 13 nt, Mycobacterium avium subsp. paratuberculosis
cgucgucgcugca

SEQ ID NO: 2903595 - RNA, 21 nt, Mycobacterium avium subsp. paratuberculosis
cgucgucggacaccagcaugg

SEQ ID NO: 2903596 - RNA, 20 nt, Mycobacterium avium subsp. paratuberculosis
cgucgucggacagcagcacc

SEQ ID NO: 2903597 - RNA, 21 nt, Mycobacterium avium subsp. paratuberculosis
cgucgucggacagcagcaccg

SEQ ID NO: 2903598 - RNA, 17 nt, Mycobacterium avium subsp. paratuberculosis
cgucgucggccggcucg

SEQ ID NO: 2903599 - RNA, 16 nt, Mycobacterium avium subsp. paratuberculosis
cgucgucggccgggcc

SEQ ID NO: 2903600 - RNA, 23 nt, Mycobacterium avium subsp. paratuberculosis
cgucgucggccgggccggcggug

SEQ ID NO: 2903601 - RNA, 13 nt, Mycobacterium avium subsp. paratuberculosis
cgucgucggccuc

SEQ ID NO: 2903602 - RNA, 14 nt, Mycobacterium avium subsp. paratuberculosis
cgucgucggccucg

SEQ ID NO: 2903603 - RNA, 15 nt, Mycobacterium avium subsp. paratuberculosis
cgucgucggccucgg

SEQ ID NO: 2903604 - RNA, 16 nt, Mycobacterium avium subsp. paratuberculosis
cgucgucggccucggc

SEQ ID NO: 2903605 - RNA, 14 nt, Mycobacterium avium subsp. paratuberculosis
cgucgucggccugc

SEQ ID NO: 2903606 - RNA, 12 nt, Mycobacterium avium subsp. paratuberculosis
cgucgucggcga

SEQ ID NO: 2903607 - RNA, 15 nt, Mycobacterium avium subsp. paratuberculosis
cgucgucggcgacga

SEQ ID NO: 2903608 - RNA, 17 nt, Mycobacterium avium subsp. paratuberculosis
cgucgucggcgacgacc

SEQ ID NO: 2903609 - RNA, 14 nt, Mycobacterium avium subsp. paratuberculosis
cgucgucggcgccg

SEQ ID NO: 2903610 - RNA, 15 nt, Mycobacterium avium subsp. paratuberculosis
cgucgucggcgccgc

SEQ ID NO: 2903611 - RNA, 13 nt, Mycobacterium avium subsp. paratuberculosis
cgucgucggcggc

SEQ ID NO: 2903612 - RNA, 15 nt, Mycobacterium avium subsp. paratuberculosis
cgucgucggcggcga

SEQ ID NO: 2903613 - RNA, 13 nt, Mycobacterium avium subsp. paratuberculosis
cgucgucggcggg

SEQ ID NO: 2903614 - RNA, 20 nt, Mycobacterium avium subsp. paratuberculosis
cgucgucggcgggcugcagc

SEQ ID NO: 2903615 - RNA, 23 nt, Mycobacterium avium subsp. paratuberculosis
cgucgucggcgggcugcagcgac

SEQ ID NO: 2903616 - RNA, 13 nt, Mycobacterium avium subsp. paratuberculosis
cgucgucggugaa

SEQ ID NO: 2903617 - RNA, 15 nt, Mycobacterium avium subsp. paratuberculosis
cgucgucggugaugg

SEQ ID NO: 2903618 - RNA, 12 nt, Mycobacterium avium subsp. paratuberculosis
cgucgucgucga

SEQ ID NO: 2903619 - RNA, 13 nt, Mycobacterium avium subsp. paratuberculosis
cgucgucgucgac

SEQ ID NO: 2903620 - RNA, 14 nt, Mycobacterium avium subsp. paratuberculosis
cgucgucgucgaga

SEQ ID NO: 2903621 - RNA, 14 nt, Mycobacterium avium subsp. paratuberculosis
cgucgucgucgagc

SEQ ID NO: 2903622 - RNA, 17 nt, Mycobacterium avium subsp. paratuberculosis
cgucgucgucgagccgc

SEQ ID NO: 2903623 - RNA, 18 nt, Mycobacterium avium subsp. paratuberculosis
cgucgucgucggccgggc

SEQ ID NO: 2903624 - RNA, 15 nt, Mycobacterium avium subsp. paratuberculosis
cgucgucgugcacca

SEQ ID NO: 2903625 - RNA, 18 nt, Mycobacterium avium subsp. paratuberculosis
cgucgucgugcaccacga

SEQ ID NO: 2903626 - RNA, 17 nt, Mycobacterium avium subsp. paratuberculosis
cgucgucgugcgcgggc

SEQ ID NO: 2903627 - RNA, 14 nt, Mycobacterium avium subsp. paratuberculosis
cgucgucguuggcc

SEQ ID NO: 2903628 - RNA, 18 nt, Mycobacterium avium subsp. paratuberculosis
cgucgucguuggcccgcc

SEQ ID NO: 2903629 - RNA, 19 nt, Mycobacterium avium subsp. paratuberculosis
cgucgucguuggcccgccg

SEQ ID NO: 2903630 - RNA, 21 nt, Mycobacterium avium subsp. paratuberculosis
cgucgucguuguuggcggcgg

SEQ ID NO: 2903631 - RNA, 14 nt, Mycobacterium avium subsp. paratuberculosis
cgucgugauggcga

SEQ ID NO: 2903632 - RNA, 23 nt, Mycobacterium avium subsp. paratuberculosis
cgucgugauggcgaaccagcgcc

SEQ ID NO: 2903633 - RNA, 20 nt, Mycobacterium avium subsp. paratuberculosis
cgucgugcaacucccgcgcc

SEQ ID NO: 2903634 - RNA, 22 nt, Mycobacterium avium subsp. paratuberculosis
cgucgugcaccacgacgucgag

SEQ ID NO: 2903635 - RNA, 15 nt, Mycobacterium avium subsp. paratuberculosis
cgucgugcacgccgu

SEQ ID NO: 2903636 - RNA, 19 nt, Mycobacterium avium subsp. paratuberculosis
cgucgugcacgccguggcg

SEQ ID NO: 2903637 - RNA, 21 nt, Mycobacterium avium subsp. paratuberculosis
cgucgugcacgccguggcggc

SEQ ID NO: 2903638 - RNA, 22 nt, Mycobacterium avium subsp. paratuberculosis
cgucgugcacgccguggcggcg

SEQ ID NO: 2903639 - RNA, 14 nt, Mycobacterium avium subsp. paratuberculosis
cgucgugcgcgggc

SEQ ID NO: 2903640 - RNA, 16 nt, Mycobacterium avium subsp. paratuberculosis
cgucgugcggccggcg

SEQ ID NO: 2903641 - RNA, 14 nt, Mycobacterium avium subsp. paratuberculosis
cgucgugcucgagc

SEQ ID NO: 2903642 - RNA, 14 nt, Mycobacterium avium subsp. paratuberculosis
cgucgugcucggcg

SEQ ID NO: 2903643 - RNA, 16 nt, Mycobacterium avium subsp. paratuberculosis
cgucgugcucggcgag

SEQ ID NO: 2903644 - RNA, 17 nt, Mycobacterium avium subsp. paratuberculosis
cgucgugcucggcgagc

SEQ ID NO: 2903645 - RNA, 21 nt, Mycobacterium avium subsp. paratuberculosis
cgucgugcucggcgagcaccg

SEQ ID NO: 2903646 - RNA, 14 nt, Mycobacterium avium subsp. paratuberculosis
cgucguggccgacg

SEQ ID NO: 2903647 - RNA, 23 nt, Mycobacterium avium subsp. paratuberculosis
cgucguggcggugcucuuggugg

SEQ ID NO: 2903648 - RNA, 20 nt, Mycobacterium avium subsp. paratuberculosis
cgucgugggugacccggccg

SEQ ID NO: 2903649 - RNA, 21 nt, Mycobacterium avium subsp. paratuberculosis
cgucgugggugacccggccgu

SEQ ID NO: 2903650 - RNA, 20 nt, Mycobacterium avium subsp. paratuberculosis
cgucgugguagcggucgggg

SEQ ID NO: 2903651 - RNA, 16 nt, Mycobacterium avium subsp. paratuberculosis
cgucguggucgacgcc

SEQ ID NO: 2903652 - RNA, 18 nt, Mycobacterium avium subsp. paratuberculosis
cgucguggucgacgccgu

SEQ ID NO: 2903653 - RNA, 22 nt, Mycobacterium avium subsp. paratuberculosis
cgucguggucgacgccgugguc

SEQ ID NO: 2903654 - RNA, 17 nt, Mycobacterium avium subsp. paratuberculosis
cgucguguagggcaaca

SEQ ID NO: 2903655 - RNA, 18 nt, Mycobacterium avium subsp. paratuberculosis
cgucguguccgggcccga

SEQ ID NO: 2903656 - RNA, 23 nt, Mycobacterium avium subsp. paratuberculosis
cgucguucuccauccgggcggcc

SEQ ID NO: 2903657 - RNA, 16 nt, Mycobacterium avium subsp. paratuberculosis
cgucguucucgggggc

SEQ ID NO: 2903658 - RNA, 17 nt, Mycobacterium avium subsp. paratuberculosis
cgucguucucgggggcg

SEQ ID NO: 2903659 - RNA, 17 nt, Mycobacterium avium subsp. paratuberculosis
cgucguugaacgcgcgg

SEQ ID NO: 2903660 - RNA, 18 nt, Mycobacterium avium subsp. paratuberculosis
cgucguugagcacaccca

SEQ ID NO: 2903661 - RNA, 15 nt, Mycobacterium avium subsp. paratuberculosis
cgucguugagcauca

SEQ ID NO: 2903662 - RNA, 18 nt, Mycobacterium avium subsp. paratuberculosis
cgucguugagcaucacca

SEQ ID NO: 2903663 - RNA, 17 nt, Mycobacterium avium subsp. paratuberculosis
cgucguugcgggcggcg

SEQ ID NO: 2903664 - RNA, 23 nt, Mycobacterium avium subsp. paratuberculosis
cgucguugcgggcggcgcggcgc

SEQ ID NO: 2903665 - RNA, 13 nt, Mycobacterium avium subsp. paratuberculosis
cgucguuggcccg

SEQ ID NO: 2903666 - RNA, 17 nt, Mycobacterium avium subsp. paratuberculosis
cgucguuggcccgccgc

SEQ ID NO: 2903667 - RNA, 20 nt, Mycobacterium avium subsp. paratuberculosis
cgucguuggcccgccgcggc

SEQ ID NO: 2903668 - RNA, 15 nt, Mycobacterium avium subsp. paratuberculosis
cgucguuggcgccgu

SEQ ID NO: 2903669 - RNA, 15 nt, Mycobacterium avium subsp. paratuberculosis
cgucguuggcgcuca

SEQ ID NO: 2903670 - RNA, 18 nt, Mycobacterium avium subsp. paratuberculosis
cgucguuggcgcucaacg

SEQ ID NO: 2903671 - RNA, 22 nt, Mycobacterium avium subsp. paratuberculosis
cgucguugucgucgccggccgc

SEQ ID NO: 2903672 - RNA, 15 nt, Mycobacterium avium subsp. paratuberculosis
cgucguugugggcca

SEQ ID NO: 2903673 - RNA, 23 nt, Mycobacterium avium subsp. paratuberculosis
cgucguugugggccagcgcggug

SEQ ID NO: 2903674 - RNA, 16 nt, Mycobacterium avium subsp. paratuberculosis
cgucguuuuccagccg

SEQ ID NO: 2903675 - RNA, 17 nt, Mycobacterium avium subsp. paratuberculosis
cgucguuuuccagccgg

SEQ ID NO: 2903676 - RNA, 18 nt, Mycobacterium avium subsp. paratuberculosis
cgucuaagucgaugccgc

SEQ ID NO: 2903677 - RNA, 22 nt, Mycobacterium avium subsp. paratuberculosis
cgucuaagucgaugccgccccu

SEQ ID NO: 2903678 - RNA, 20 nt, Mycobacterium avium subsp. paratuberculosis
cgucucaggaauuugcggcc

SEQ ID NO: 2903679 - RNA, 22 nt, Mycobacterium avium subsp. paratuberculosis
cgucucaggaauuugcggcccg

SEQ ID NO: 2903680 - RNA, 15 nt, Mycobacterium avium subsp. paratuberculosis
cgucucagucggcca

SEQ ID NO: 2903681 - RNA, 16 nt, Mycobacterium avium subsp. paratuberculosis
cgucucagucggccac

SEQ ID NO: 2903682 - RNA, 17 nt, Mycobacterium avium subsp. paratuberculosis
cgucucagucggccacc

SEQ ID NO: 2903683 - RNA, 18 nt, Mycobacterium avium subsp. paratuberculosis
cgucucagucggccaccg

SEQ ID NO: 2903684 - RNA, 20 nt, Mycobacterium avium subsp. paratuberculosis
cgucucagucggccaccgcg

SEQ ID NO: 2903685 - RNA, 15 nt, Mycobacterium avium subsp. paratuberculosis
cgucucauaccagug

SEQ ID NO: 2903686 - RNA, 16 nt, Mycobacterium avium subsp. paratuberculosis
cgucucccacgaacgg

SEQ ID NO: 2903687 - RNA, 15 nt, Mycobacterium avium subsp. paratuberculosis
cgucucccccgauca

SEQ ID NO: 2903688 - RNA, 17 nt, Mycobacterium avium subsp. paratuberculosis
cgucucccccgaucagc

SEQ ID NO: 2903689 - RNA, 21 nt, Mycobacterium avium subsp. paratuberculosis
cgucucccccgaucagcguca

SEQ ID NO: 2903690 - RNA, 14 nt, Mycobacterium avium subsp. paratuberculosis
cgucucccgggugc

SEQ ID NO: 2903691 - RNA, 19 nt, Mycobacterium avium subsp. paratuberculosis
cgucucccgggugcgcguc

SEQ ID NO: 2903692 - RNA, 22 nt, Mycobacterium avium subsp. paratuberculosis
cgucucccgggugcgcgucgcg

SEQ ID NO: 2903693 - RNA, 14 nt, Mycobacterium avium subsp. paratuberculosis
cgucuccggcgcgg

SEQ ID NO: 2903694 - RNA, 13 nt, Mycobacterium avium subsp. paratuberculosis
cgucuccggcggc

SEQ ID NO: 2903695 - RNA, 14 nt, Mycobacterium avium subsp. paratuberculosis
cgucuccggcggca

SEQ ID NO: 2903696 - RNA, 14 nt, Mycobacterium avium subsp. paratuberculosis
cgucuccggcgggc

SEQ ID NO: 2903697 - RNA, 16 nt, Mycobacterium avium subsp. paratuberculosis
cgucuccggcgggcug

SEQ ID NO: 2903698 - RNA, 13 nt, Mycobacterium avium subsp. paratuberculosis
cgucuccggcgua

SEQ ID NO: 2903699 - RNA, 20 nt, Mycobacterium avium subsp. paratuberculosis
cgucuccucgaccagcgcgc

SEQ ID NO: 2903700 - RNA, 19 nt, Mycobacterium avium subsp. paratuberculosis
cgucuccuggggcagaucg

SEQ ID NO: 2903701 - RNA, 21 nt, Mycobacterium avium subsp. paratuberculosis
cgucuccuggggcagaucguc

SEQ ID NO: 2903702 - RNA, 20 nt, Mycobacterium avium subsp. paratuberculosis
cgucucgaccacccggcggg

SEQ ID NO: 2903703 - RNA, 21 nt, Mycobacterium avium subsp. paratuberculosis
cgucucgaccacccggcgggc

SEQ ID NO: 2903704 - RNA, 15 nt, Mycobacterium avium subsp. paratuberculosis
cgucucgacccgggc

SEQ ID NO: 2903705 - RNA, 21 nt, Mycobacterium avium subsp. paratuberculosis
cgucucgacccgggccagcag

SEQ ID NO: 2903706 - RNA, 17 nt, Mycobacterium avium subsp. paratuberculosis
cgucucgaccgcggugg

SEQ ID NO: 2903707 - RNA, 18 nt, Mycobacterium avium subsp. paratuberculosis
cgucucgagcuuccgccg

SEQ ID NO: 2903708 - RNA, 22 nt, Mycobacterium avium subsp. paratuberculosis
cgucucgaucgacgacgccagc

SEQ ID NO: 2903709 - RNA, 13 nt, Mycobacterium avium subsp. paratuberculosis
cgucucgaugagc

SEQ ID NO: 2903710 - RNA, 23 nt, Mycobacterium avium subsp. paratuberculosis
cgucucgccggggaacaccggcg

SEQ ID NO: 2903711 - RNA, 23 nt, Mycobacterium avium subsp. paratuberculosis
cgucucgcgggaguggccggcgu

SEQ ID NO: 2903712 - RNA, 13 nt, Mycobacterium avium subsp. paratuberculosis
cgucucggccagc

SEQ ID NO: 2903713 - RNA, 16 nt, Mycobacterium avium subsp. paratuberculosis
cgucucggccagccgg

SEQ ID NO: 2903714 - RNA, 22 nt, Mycobacterium avium subsp. paratuberculosis
cgucucggccagccgguagugc

SEQ ID NO: 2903715 - RNA, 15 nt, Mycobacterium avium subsp. paratuberculosis
cgucucggccgcggu

SEQ ID NO: 2903716 - RNA, 12 nt, Mycobacterium avium subsp. paratuberculosis
cgucucggcgau

SEQ ID NO: 2903717 - RNA, 16 nt, Mycobacterium avium subsp. paratuberculosis
cgucucggcgaucagc

SEQ ID NO: 2903718 - RNA, 14 nt, Mycobacterium avium subsp. paratuberculosis
cgucucggcgucuc

SEQ ID NO: 2903719 - RNA, 17 nt, Mycobacterium avium subsp. paratuberculosis
cgucucggcgucucggc

SEQ ID NO: 2903720 - RNA, 19 nt, Mycobacterium avium subsp. paratuberculosis
cgucucggcgucucggcgu

SEQ ID NO: 2903721 - RNA, 13 nt, Mycobacterium avium subsp. paratuberculosis
cgucucgucggcc

SEQ ID NO: 2903722 - RNA, 14 nt, Mycobacterium avium subsp. paratuberculosis
cgucucgucggccg

SEQ ID NO: 2903723 - RNA, 16 nt, Mycobacterium avium subsp. paratuberculosis
cgucucgucggccgcg

SEQ ID NO: 2903724 - RNA, 19 nt, Mycobacterium avium subsp. paratuberculosis
cgucucgucggccgcgacg

SEQ ID NO: 2903725 - RNA, 17 nt, Mycobacterium avium subsp. paratuberculosis
cgucucugucgucgacc

SEQ ID NO: 2903726 - RNA, 18 nt, Mycobacterium avium subsp. paratuberculosis
cgucucugucgucgacca

SEQ ID NO: 2903727 - RNA, 19 nt, Mycobacterium avium subsp. paratuberculosis
cgucucuuccucgggcagu

SEQ ID NO: 2903728 - RNA, 18 nt, Mycobacterium avium subsp. paratuberculosis
cgucugcauccggaaccg

SEQ ID NO: 2903729 - RNA, 20 nt, Mycobacterium avium subsp. paratuberculosis
cgucugcauccggaaccggg

SEQ ID NO: 2903730 - RNA, 23 nt, Mycobacterium avium subsp. paratuberculosis
cgucugcauccggaaccgggcac

SEQ ID NO: 2903731 - RNA, 18 nt, Mycobacterium avium subsp. paratuberculosis
cgucugccaaggugcggu

SEQ ID NO: 2903732 - RNA, 23 nt, Mycobacterium avium subsp. paratuberculosis
cgucugccuugcugacgccgcgg

SEQ ID NO: 2903733 - RNA, 15 nt, Mycobacterium avium subsp. paratuberculosis
cgucugcgccagcug

SEQ ID NO: 2903734 - RNA, 16 nt, Mycobacterium avium subsp. paratuberculosis
cgucugcgccagcugg

SEQ ID NO: 2903735 - RNA, 20 nt, Mycobacterium avium subsp. paratuberculosis
cgucugcgccgucaccggcu

SEQ ID NO: 2903736 - RNA, 13 nt, Mycobacterium avium subsp. paratuberculosis
cgucugcggcucg

SEQ ID NO: 2903737 - RNA, 14 nt, Mycobacterium avium subsp. paratuberculosis
cgucugcggcucgg

SEQ ID NO: 2903738 - RNA, 18 nt, Mycobacterium avium subsp. paratuberculosis
cgucugcgggaagcccac

SEQ ID NO: 2903739 - RNA, 21 nt, Mycobacterium avium subsp. paratuberculosis
cgucugcgggaagcccaccgc

SEQ ID NO: 2903740 - RNA, 23 nt, Mycobacterium avium subsp. paratuberculosis
cgucugcgggaagcccaccgcgg

SEQ ID NO: 2903741 - RNA, 11 nt, Mycobacterium avium subsp. paratuberculosis
cgucugcucgc

SEQ ID NO: 2903742 - RNA, 13 nt, Mycobacterium avium subsp. paratuberculosis
cgucugcucgcca

SEQ ID NO: 2903743 - RNA, 15 nt, Mycobacterium avium subsp. paratuberculosis
cgucugcucgccggc

SEQ ID NO: 2903744 - RNA, 17 nt, Mycobacterium avium subsp. paratuberculosis
cgucugcucgccggcua

SEQ ID NO: 2903745 - RNA, 15 nt, Mycobacterium avium subsp. paratuberculosis
cgucugcucggcggc

SEQ ID NO: 2903746 - RNA, 18 nt, Mycobacterium avium subsp. paratuberculosis
cgucugcucggcggguca

SEQ ID NO: 2903747 - RNA, 13 nt, Mycobacterium avium subsp. paratuberculosis
cgucuggcagccg

SEQ ID NO: 2903748 - RNA, 17 nt, Mycobacterium avium subsp. paratuberculosis
cgucuggcagccggccg

SEQ ID NO: 2903749 - RNA, 18 nt, Mycobacterium avium subsp. paratuberculosis
cgucuggcagccggccgg

SEQ ID NO: 2903750 - RNA, 19 nt, Mycobacterium avium subsp. paratuberculosis
cgucuggcagccggccggc

SEQ ID NO: 2903751 - RNA, 16 nt, Mycobacterium avium subsp. paratuberculosis
cgucuggccggagcgg

SEQ ID NO: 2903752 - RNA, 18 nt, Mycobacterium avium subsp. paratuberculosis
cgucuggccggagcggug

SEQ ID NO: 2903753 - RNA, 17 nt, Mycobacterium avium subsp. paratuberculosis
cgucugggccgccgagc

SEQ ID NO: 2903754 - RNA, 19 nt, Mycobacterium avium subsp. paratuberculosis
cgucugggccgccgagcag

SEQ ID NO: 2903755 - RNA, 16 nt, Mycobacterium avium subsp. paratuberculosis
cgucugguuggccggc

SEQ ID NO: 2903756 - RNA, 17 nt, Mycobacterium avium subsp. paratuberculosis
cgucugguuggccggcg

SEQ ID NO: 2903757 - RNA, 20 nt, Mycobacterium avium subsp. paratuberculosis
cgucugguuggccggcgggu

SEQ ID NO: 2903758 - RNA, 15 nt, Mycobacterium avium subsp. paratuberculosis
cgucuuccgcggcgg

SEQ ID NO: 2903759 - RNA, 12 nt, Mycobacterium avium subsp. paratuberculosis
cgucuucgaccg

SEQ ID NO: 2903760 - RNA, 14 nt, Mycobacterium avium subsp. paratuberculosis
cgucuucggggccg

SEQ ID NO: 2903761 - RNA, 16 nt, Mycobacterium avium subsp. paratuberculosis
cgucuucggggccgcc

SEQ ID NO: 2903762 - RNA, 18 nt, Mycobacterium avium subsp. paratuberculosis
cgucuucuucagccgcag

SEQ ID NO: 2903763 - RNA, 16 nt, Mycobacterium avium subsp. paratuberculosis
cgucuucuucucgccg

SEQ ID NO: 2903764 - RNA, 20 nt, Mycobacterium avium subsp. paratuberculosis
cgucuucuucucgccguccc

SEQ ID NO: 2903765 - RNA, 17 nt, Mycobacterium avium subsp. paratuberculosis
cgucuucuuggccgcgg

SEQ ID NO: 2903766 - RNA, 20 nt, Mycobacterium avium subsp. paratuberculosis
cgucuucuuggccgcggccu

SEQ ID NO: 2903767 - RNA, 20 nt, Mycobacterium avium subsp. paratuberculosis
cgucuugaucucggcggcga

SEQ ID NO: 2903768 - RNA, 13 nt, Mycobacterium avium subsp. paratuberculosis
cgucuugcccagc

SEQ ID NO: 2903769 - RNA, 16 nt, Mycobacterium avium subsp. paratuberculosis
cgucuugcccagcggg

SEQ ID NO: 2903770 - RNA, 17 nt, Mycobacterium avium subsp. paratuberculosis
cgucuugcccggcgagc

SEQ ID NO: 2903771 - RNA, 13 nt, Mycobacterium avium subsp. paratuberculosis
cgucuugcggccc

SEQ ID NO: 2903772 - RNA, 15 nt, Mycobacterium avium subsp. paratuberculosis
cgucuugcugggugg

SEQ ID NO: 2903773 - RNA, 17 nt, Mycobacterium avium subsp. paratuberculosis
cgucuuggacgcccgcg

SEQ ID NO: 2903774 - RNA, 19 nt, Mycobacterium avium subsp. paratuberculosis
cgucuuggacgcccgcgac

SEQ ID NO: 2903775 - RNA, 21 nt, Mycobacterium avium subsp. paratuberculosis
cgucuuggacgcccgcgaccc

SEQ ID NO: 2903776 - RNA, 22 nt, Mycobacterium avium subsp. paratuberculosis
cgucuuggacgcccgcgacccg

SEQ ID NO: 2903777 - RNA, 19 nt, Mycobacterium avium subsp. paratuberculosis
cgucuuggucucgccgauc

SEQ ID NO: 2903778 - RNA, 21 nt, Mycobacterium avium subsp. paratuberculosis
cgucuuggugcgagccaccuc

SEQ ID NO: 2903779 - RNA, 21 nt, Mycobacterium avium subsp. paratuberculosis
cgucuuggugugugcgucggc

SEQ ID NO: 2903780 - RNA, 19 nt, Mycobacterium avium subsp. paratuberculosis
cgucuugugcccguugccc

SEQ ID NO: 2903781 - RNA, 19 nt, Mycobacterium avium subsp. paratuberculosis
cgucuuuucccacacgcuc

SEQ ID NO: 2903782 - RNA, 14 nt, Mycobacterium avium subsp. paratuberculosis
cgugaaacauggcg

SEQ ID NO: 2903783 - RNA, 20 nt, Mycobacterium avium subsp. paratuberculosis
cgugaaacuagcuucacgcu

SEQ ID NO: 2903784 - RNA, 20 nt, Mycobacterium avium subsp. paratuberculosis
cgugaaacuagcuucacggu

SEQ ID NO: 2903785 - RNA, 20 nt, Mycobacterium avium subsp. paratuberculosis
cgugaaaucccccgacccgc

SEQ ID NO: 2903786 - RNA, 19 nt, Mycobacterium avium subsp. paratuberculosis
cgugaacuuaacuucacgc

SEQ ID NO: 2903787 - RNA, 23 nt, Mycobacterium avium subsp. paratuberculosis
cgugaacuuaacuucacgcucgg

SEQ ID NO: 2903788 - RNA, 13 nt, Mycobacterium avium subsp. paratuberculosis
cgugaagccggug

SEQ ID NO: 2903789 - RNA, 19 nt, Mycobacterium avium subsp. paratuberculosis
cgugaagcuagcuucacgc

SEQ ID NO: 2903790 - RNA, 20 nt, Mycobacterium avium subsp. paratuberculosis
cgugaagcuaguuucacgcu

SEQ ID NO: 2903791 - RNA, 19 nt, Mycobacterium avium subsp. paratuberculosis
cgugaagcuaguuucacgu

SEQ ID NO: 2903792 - RNA, 20 nt, Mycobacterium avium subsp. paratuberculosis
cgugaagcuaguuucacguu

SEQ ID NO: 2903793 - RNA, 23 nt, Mycobacterium avium subsp. paratuberculosis
cgugaagcuaguuucacguucgc

SEQ ID NO: 2903794 - RNA, 19 nt, Mycobacterium avium subsp. paratuberculosis
cgugaagggcccgccggug

SEQ ID NO: 2903795 - RNA, 19 nt, Mycobacterium avium subsp. paratuberculosis
cgugaaguuaacuucacgc

SEQ ID NO: 2903796 - RNA, 20 nt, Mycobacterium avium subsp. paratuberculosis
cgugaaguuaacuucacgcu

SEQ ID NO: 2903797 - RNA, 23 nt, Mycobacterium avium subsp. paratuberculosis
cgugaaguuaacuucacgcucgc

SEQ ID NO: 2903798 - RNA, 17 nt, Mycobacterium avium subsp. paratuberculosis
cgugaaguuaguuucac

SEQ ID NO: 2903799 - RNA, 20 nt, Mycobacterium avium subsp. paratuberculosis
cgugaaguuaguuucacgcu

SEQ ID NO: 2903800 - RNA, 22 nt, Mycobacterium avium subsp. paratuberculosis
cgugaauccucagcacggccgc

SEQ ID NO: 2903801 - RNA, 21 nt, Mycobacterium avium subsp. paratuberculosis
cgugaaucuuggccagcagcg

SEQ ID NO: 2903802 - RNA, 23 nt, Mycobacterium avium subsp. paratuberculosis
cgugaauggguguaacgcgucga

SEQ ID NO: 2903803 - RNA, 19 nt, Mycobacterium avium subsp. paratuberculosis
cgugaauucggccgggucc

SEQ ID NO: 2903804 - RNA, 15 nt, Mycobacterium avium subsp. paratuberculosis
cgugacaagccggcg

SEQ ID NO: 2903805 - RNA, 21 nt, Mycobacterium avium subsp. paratuberculosis
cgugacacucggucaccggug

SEQ ID NO: 2903806 - RNA, 18 nt, Mycobacterium avium subsp. paratuberculosis
cgugacaggggcagcagc

SEQ ID NO: 2903807 - RNA, 19 nt, Mycobacterium avium subsp. paratuberculosis
cgugacaggggcagcagca

SEQ ID NO: 2903808 - RNA, 16 nt, Mycobacterium avium subsp. paratuberculosis
cgugacaggguaaccc

SEQ ID NO: 2903809 - RNA, 14 nt, Mycobacterium avium subsp. paratuberculosis
cgugacagucgacc

SEQ ID NO: 2903810 - RNA, 22 nt, Mycobacterium avium subsp. paratuberculosis
cgugaccaaugcggugaacgcg

SEQ ID NO: 2903811 - RNA, 13 nt, Mycobacterium avium subsp. paratuberculosis
cgugaccaccgug

SEQ ID NO: 2903812 - RNA, 16 nt, Mycobacterium avium subsp. paratuberculosis
cgugaccccggcgacc

SEQ ID NO: 2903813 - RNA, 18 nt, Mycobacterium avium subsp. paratuberculosis
cgugacccgccgugaccg

SEQ ID NO: 2903814 - RNA, 17 nt, Mycobacterium avium subsp. paratuberculosis
cgugacccugccgucac

SEQ ID NO: 2903815 - RNA, 15 nt, Mycobacterium avium subsp. paratuberculosis
cgugaccggcgaucc

SEQ ID NO: 2903816 - RNA, 13 nt, Mycobacterium avium subsp. paratuberculosis
cgugaccggcggu

SEQ ID NO: 2903817 - RNA, 14 nt, Mycobacterium avium subsp. paratuberculosis
cgugaccggcggug

SEQ ID NO: 2903818 - RNA, 15 nt, Mycobacterium avium subsp. paratuberculosis
cgugaccggcggugc

SEQ ID NO: 2903819 - RNA, 15 nt, Mycobacterium avium subsp. paratuberculosis
cgugaccucgacggu

SEQ ID NO: 2903820 - RNA, 16 nt, Mycobacterium avium subsp. paratuberculosis
cgugaccugcugggcg

SEQ ID NO: 2903821 - RNA, 20 nt, Mycobacterium avium subsp. paratuberculosis
cgugaccugcugggcgggca

SEQ ID NO: 2903822 - RNA, 21 nt, Mycobacterium avium subsp. paratuberculosis
cgugaccugcugggcgggcag

SEQ ID NO: 2903823 - RNA, 22 nt, Mycobacterium avium subsp. paratuberculosis
cgugaccugcugggcgggcagc

SEQ ID NO: 2903824 - RNA, 19 nt, Mycobacterium avium subsp. paratuberculosis
cgugacgaccuggucgccg

SEQ ID NO: 2903825 - RNA, 20 nt, Mycobacterium avium subsp. paratuberculosis
cgugacgaccuggucgccgc

SEQ ID NO: 2903826 - RNA, 14 nt, Mycobacterium avium subsp. paratuberculosis
cgugacgcccggcg

SEQ ID NO: 2903827 - RNA, 15 nt, Mycobacterium avium subsp. paratuberculosis
cgugacgcccggcgc

SEQ ID NO: 2903828 - RNA, 19 nt, Mycobacterium avium subsp. paratuberculosis
cgugacgcccggcgccggc

SEQ ID NO: 2903829 - RNA, 20 nt, Mycobacterium avium subsp. paratuberculosis
cgugacgcccggcgccggcg

SEQ ID NO: 2903830 - RNA, 14 nt, Mycobacterium avium subsp. paratuberculosis
cgugacgccgaucc

SEQ ID NO: 2903831 - RNA, 21 nt, Mycobacterium avium subsp. paratuberculosis
cgugacgccgauccgcugcgg

SEQ ID NO: 2903832 - RNA, 22 nt, Mycobacterium avium subsp. paratuberculosis
cgugacgccgauccgcugcgga

SEQ ID NO: 2903833 - RNA, 17 nt, Mycobacterium avium subsp. paratuberculosis
cgugacgccgcugcgug

SEQ ID NO: 2903834 - RNA, 18 nt, Mycobacterium avium subsp. paratuberculosis
cgugacgccgcugcgugc

SEQ ID NO: 2903835 - RNA, 19 nt, Mycobacterium avium subsp. paratuberculosis
cgugacgccgcugcgugcc

SEQ ID NO: 2903836 - RNA, 15 nt, Mycobacterium avium subsp. paratuberculosis
cgugacgccgggccg

SEQ ID NO: 2903837 - RNA, 16 nt, Mycobacterium avium subsp. paratuberculosis
cgugacgccgggccgc

SEQ ID NO: 2903838 - RNA, 19 nt, Mycobacterium avium subsp. paratuberculosis
cgugacgccgggccgccgc

SEQ ID NO: 2903839 - RNA, 21 nt, Mycobacterium avium subsp. paratuberculosis
cgugacgccgggccgccgcgg

SEQ ID NO: 2903840 - RNA, 21 nt, Mycobacterium avium subsp. paratuberculosis
cgugacgcgcgugacggcggg

SEQ ID NO: 2903841 - RNA, 13 nt, Mycobacterium avium subsp. paratuberculosis
cgugacgcggcgu

SEQ ID NO: 2903842 - RNA, 15 nt, Mycobacterium avium subsp. paratuberculosis
cgugacgcggcgucg

SEQ ID NO: 2903843 - RNA, 16 nt, Mycobacterium avium subsp. paratuberculosis
cgugacgcucgacggc

SEQ ID NO: 2903844 - RNA, 20 nt, Mycobacterium avium subsp. paratuberculosis
cgugacgcucgacggccggc

SEQ ID NO: 2903845 - RNA, 17 nt, Mycobacterium avium subsp. paratuberculosis
cgugacgcucgccggcg

SEQ ID NO: 2903846 - RNA, 19 nt, Mycobacterium avium subsp. paratuberculosis
cgugacgcucgccggcggc

SEQ ID NO: 2903847 - RNA, 22 nt, Mycobacterium avium subsp. paratuberculosis
cgugacgcucgccggcggccgc

SEQ ID NO: 2903848 - RNA, 14 nt, Mycobacterium avium subsp. paratuberculosis
cgugacgcucgcgu

SEQ ID NO: 2903849 - RNA, 14 nt, Mycobacterium avium subsp. paratuberculosis
cgugacgcucggcc

SEQ ID NO: 2903850 - RNA, 23 nt, Mycobacterium avium subsp. paratuberculosis
cgugacgcucggccguggccguc

SEQ ID NO: 2903851 - RNA, 16 nt, Mycobacterium avium subsp. paratuberculosis
cgugacgcucggccuc

SEQ ID NO: 2903852 - RNA, 15 nt, Mycobacterium avium subsp. paratuberculosis
cgugacgcucggcgc

SEQ ID NO: 2903853 - RNA, 17 nt, Mycobacterium avium subsp. paratuberculosis
cgugacgcucggcgccg

SEQ ID NO: 2903854 - RNA, 23 nt, Mycobacterium avium subsp. paratuberculosis
cgugacgcucggcgccgcggggc

SEQ ID NO: 2903855 - RNA, 18 nt, Mycobacterium avium subsp. paratuberculosis
cgugacgcucggcgccgg

SEQ ID NO: 2903856 - RNA, 20 nt, Mycobacterium avium subsp. paratuberculosis
cgugacgcucggcgccggcc

SEQ ID NO: 2903857 - RNA, 23 nt, Mycobacterium avium subsp. paratuberculosis
cgugacgcucggcgccggccguc

SEQ ID NO: 2903858 - RNA, 17 nt, Mycobacterium avium subsp. paratuberculosis
cgugacgcucggcgcgu

SEQ ID NO: 2903859 - RNA, 20 nt, Mycobacterium avium subsp. paratuberculosis
cgugacgcucggcgcgucgu

SEQ ID NO: 2903860 - RNA, 13 nt, Mycobacterium avium subsp. paratuberculosis
cgugacgcucggg

SEQ ID NO: 2903861 - RNA, 22 nt, Mycobacterium avium subsp. paratuberculosis
cgugacgcucgggcuucggcgu

SEQ ID NO: 2903862 - RNA, 17 nt, Mycobacterium avium subsp. paratuberculosis
cgugacgcucggggccg

SEQ ID NO: 2903863 - RNA, 20 nt, Mycobacterium avium subsp. paratuberculosis
cgugacggaugugacgcggg

SEQ ID NO: 2903864 - RNA, 21 nt, Mycobacterium avium subsp. paratuberculosis
cgugacggaugugacgcggga

SEQ ID NO: 2903865 - RNA, 13 nt, Mycobacterium avium subsp. paratuberculosis
cgugacggcaucg

SEQ ID NO: 2903866 - RNA, 16 nt, Mycobacterium avium subsp. paratuberculosis
cgugacggcaucggcg

SEQ ID NO: 2903867 - RNA, 13 nt, Mycobacterium avium subsp. paratuberculosis
cgugacggccgcg

SEQ ID NO: 2903868 - RNA, 16 nt, Mycobacterium avium subsp. paratuberculosis
cgugacggccgcggcg

SEQ ID NO: 2903869 - RNA, 17 nt, Mycobacterium avium subsp. paratuberculosis
cgugacggccgcggcgc

SEQ ID NO: 2903870 - RNA, 16 nt, Mycobacterium avium subsp. paratuberculosis
cgugacggcggggcgg

SEQ ID NO: 2903871 - RNA, 14 nt, Mycobacterium avium subsp. paratuberculosis
cgugacggucgacc

SEQ ID NO: 2903872 - RNA, 19 nt, Mycobacterium avium subsp. paratuberculosis
cgugacguaagugucgugg

SEQ ID NO: 2903873 - RNA, 16 nt, Mycobacterium avium subsp. paratuberculosis
cgucaccggccauccg

SEQ ID NO: 2903874 - RNA, 20 nt, Mycobacterium avium subsp. paratuberculosis
cgucaccggccauccgcugc

SEQ ID NO: 2903875 - RNA, 15 nt, Mycobacterium avium subsp. paratuberculosis
cgucaccggcugccc

SEQ ID NO: 2903876 - RNA, 22 nt, Mycobacterium avium subsp. paratuberculosis
cgucaccggcugcccgacccgc

SEQ ID NO: 2903877 - RNA, 15 nt, Mycobacterium avium subsp. paratuberculosis
cgucaccgugccguc

SEQ ID NO: 2903878 - RNA, 14 nt, Mycobacterium avium subsp. paratuberculosis
cgucaccguggcgg

SEQ ID NO: 2903879 - RNA, 18 nt, Mycobacterium avium subsp. paratuberculosis
cgucaccgugggcggcgc

SEQ ID NO: 2903880 - RNA, 19 nt, Mycobacterium avium subsp. paratuberculosis
cgucaccgugggcggcgcg

SEQ ID NO: 2903881 - RNA, 20 nt, Mycobacterium avium subsp. paratuberculosis
cgucaccgugggcggcgcga

SEQ ID NO: 2903882 - RNA, 21 nt, Mycobacterium avium subsp. paratuberculosis
cgucaccguggugugcccgcg

SEQ ID NO: 2903883 - RNA, 13 nt, Mycobacterium avium subsp. paratuberculosis
cgucaccucgagc

SEQ ID NO: 2903884 - RNA, 14 nt, Mycobacterium avium subsp. paratuberculosis
cgucaccucgagga

SEQ ID NO: 2903885 - RNA, 18 nt, Mycobacterium avium subsp. paratuberculosis
cgucaccuucacccccac

SEQ ID NO: 2903886 - RNA, 15 nt, Mycobacterium avium subsp. paratuberculosis
cgucacgacggucac

SEQ ID NO: 2903887 - RNA, 16 nt, Mycobacterium avium subsp. paratuberculosis
cgucacgacggucacg

SEQ ID NO: 2903888 - RNA, 23 nt, Mycobacterium avium subsp. paratuberculosis
cgucacgacggucacggccgcca

SEQ ID NO: 2903889 - RNA, 22 nt, Mycobacterium avium subsp. paratuberculosis
cgucacgcaucagggccagccg

SEQ ID NO: 2903890 - RNA, 23 nt, Mycobacterium avium subsp. paratuberculosis
cgucacgcaucagggccagccga

SEQ ID NO: 2903891 - RNA, 15 nt, Mycobacterium avium subsp. paratuberculosis
cgucacgccagcgug

SEQ ID NO: 2903892 - RNA, 22 nt, Mycobacterium avium subsp. paratuberculosis
cgucacgccagcgugacgccgg

SEQ ID NO: 2903893 - RNA, 17 nt, Mycobacterium avium subsp. paratuberculosis
cgucacgccaguguggc

SEQ ID NO: 2903894 - RNA, 22 nt, Mycobacterium avium subsp. paratuberculosis
cgucacgccaguguggccgcgg

SEQ ID NO: 2903895 - RNA, 15 nt, Mycobacterium avium subsp. paratuberculosis
cgucacgcccguccc

SEQ ID NO: 2903896 - RNA, 19 nt, Mycobacterium avium subsp. paratuberculosis
cgucacgcccguugacgcc

SEQ ID NO: 2903897 - RNA, 20 nt, Mycobacterium avium subsp. paratuberculosis
cgucacgcccguugacgccc

SEQ ID NO: 2903898 - RNA, 15 nt, Mycobacterium avium subsp. paratuberculosis
cgucacgccgcgccc

SEQ ID NO: 2903899 - RNA, 18 nt, Mycobacterium avium subsp. paratuberculosis
cgucacgccgcgcccguc

SEQ ID NO: 2903900 - RNA, 22 nt, Mycobacterium avium subsp. paratuberculosis
cgucacgcugcgcgccgauccg

SEQ ID NO: 2903901 - RNA, 24 nt, Mycobacterium avium subsp. paratuberculosis
cgucacgcugcgcgccgauccggc

SEQ ID NO: 2903902 - RNA, 12 nt, Mycobacterium avium subsp. paratuberculosis
cgucacgcuggc

SEQ ID NO: 2903903 - RNA, 13 nt, Mycobacterium avium subsp. paratuberculosis
cgucacgcuggcg

SEQ ID NO: 2903904 - RNA, 15 nt, Mycobacterium avium subsp. paratuberculosis
cgucacgcuggcgug

SEQ ID NO: 2903905 - RNA, 19 nt, Mycobacterium avium subsp. paratuberculosis
cgucacgcuggcgugacag

SEQ ID NO: 2903906 - RNA, 22 nt, Mycobacterium avium subsp. paratuberculosis
cgucacgcuggcgugacagucg

SEQ ID NO: 2903907 - RNA, 18 nt, Mycobacterium avium subsp. paratuberculosis
cgucacgcuggcgugacg

SEQ ID NO: 2903908 - RNA, 19 nt, Mycobacterium avium subsp. paratuberculosis
cgucacgcuggcgugacgc

SEQ ID NO: 2903909 - RNA, 23 nt, Mycobacterium avium subsp. paratuberculosis
cgucacgcuggcgugacggucga

SEQ ID NO: 2903910 - RNA, 16 nt, Mycobacterium avium subsp. paratuberculosis
cgucacgcuggcgugg

SEQ ID NO: 2903911 - RNA, 17 nt, Mycobacterium avium subsp. paratuberculosis
cgucacgcuggcguggc

SEQ ID NO: 2903912 - RNA, 22 nt, Mycobacterium avium subsp. paratuberculosis
cgucacgcuggcguggcacccg

SEQ ID NO: 2903913 - RNA, 19 nt, Mycobacterium avium subsp. paratuberculosis
cgucacgcuggcguggcgc

SEQ ID NO: 2903914 - RNA, 23 nt, Mycobacterium avium subsp. paratuberculosis
cgucacgcuggcguggcgccggc

SEQ ID NO: 2903915 - RNA, 13 nt, Mycobacterium avium subsp. paratuberculosis
cgucacgcuggug

SEQ ID NO: 2903916 - RNA, 15 nt, Mycobacterium avium subsp. paratuberculosis
cgucacggaucgccc

SEQ ID NO: 2903917 - RNA, 17 nt, Mycobacterium avium subsp. paratuberculosis
cgucacggaucgcccac

SEQ ID NO: 2903918 - RNA, 21 nt, Mycobacterium avium subsp. paratuberculosis
cgucacggaucgcccacccgc

SEQ ID NO: 2903919 - RNA, 14 nt, Mycobacterium avium subsp. paratuberculosis
cgucacggccgucc

SEQ ID NO: 2903920 - RNA, 15 nt, Mycobacterium avium subsp. paratuberculosis
cgucacggccgucca

SEQ ID NO: 2903921 - RNA, 20 nt, Mycobacterium avium subsp. paratuberculosis
cgucacggccguccaggcgc

SEQ ID NO: 2903922 - RNA, 14 nt, Mycobacterium avium subsp. paratuberculosis
cgucacggcgagga

SEQ ID NO: 2903923 - RNA, 23 nt, Mycobacterium avium subsp. paratuberculosis
cgucacggcgaggauggcgauca

SEQ ID NO: 2903924 - RNA, 16 nt, Mycobacterium avium subsp. paratuberculosis
cgucacggcugccgac

SEQ ID NO: 2903925 - RNA, 17 nt, Mycobacterium avium subsp. paratuberculosis
cgucacggcugccgacc

SEQ ID NO: 2903926 - RNA, 14 nt, Mycobacterium avium subsp. paratuberculosis
cgucacgggccagg

SEQ ID NO: 2903927 - RNA, 16 nt, Mycobacterium avium subsp. paratuberculosis
cgucacgggccaggcg

SEQ ID NO: 2903928 - RNA, 17 nt, Mycobacterium avium subsp. paratuberculosis
cgucacgggccaggcgc

SEQ ID NO: 2903929 - RNA, 18 nt, Mycobacterium avium subsp. paratuberculosis
cgucacgggccaggcgcg

SEQ ID NO: 2903930 - RNA, 21 nt, Mycobacterium avium subsp. paratuberculosis
cgucacgggcugaccgccagg

SEQ ID NO: 2903931 - RNA, 23 nt, Mycobacterium avium subsp. paratuberculosis
cgucacguagcgcggccgcccgu

SEQ ID NO: 2903932 - RNA, 22 nt, Mycobacterium avium subsp. paratuberculosis
cgucacgucauuucggucggca

SEQ ID NO: 2903933 - RNA, 16 nt, Mycobacterium avium subsp. paratuberculosis
cgucacgucguugagc

SEQ ID NO: 2903934 - RNA, 22 nt, Mycobacterium avium subsp. paratuberculosis
cgucacgucguugagcacaccc

SEQ ID NO: 2903935 - RNA, 13 nt, Mycobacterium avium subsp. paratuberculosis
cgucacuccucga

SEQ ID NO: 2903936 - RNA, 13 nt, Mycobacterium avium subsp. paratuberculosis
cgucacucuggcg

SEQ ID NO: 2903937 - RNA, 18 nt, Mycobacterium avium subsp. paratuberculosis
cgucacucuggcgugacg

SEQ ID NO: 2903938 - RNA, 19 nt, Mycobacterium avium subsp. paratuberculosis
cgucacucuggcgugacgc

SEQ ID NO: 2903939 - RNA, 18 nt, Mycobacterium avium subsp. paratuberculosis
cgucacugcacgcacggc

SEQ ID NO: 2903940 - RNA, 18 nt, Mycobacterium avium subsp. paratuberculosis
cgucacugucggcgcgga

SEQ ID NO: 2903941 - RNA, 19 nt, Mycobacterium avium subsp. paratuberculosis
cgucacugucggcgcggac

SEQ ID NO: 2903942 - RNA, 20 nt, Mycobacterium avium subsp. paratuberculosis
cgucacuucgccgggcuggc

SEQ ID NO: 2903943 - RNA, 17 nt, Mycobacterium avium subsp. paratuberculosis
cgucagcaccgcgacgg

SEQ ID NO: 2903944 - RNA, 19 nt, Mycobacterium avium subsp. paratuberculosis
cgucagcaccgcgacggug

SEQ ID NO: 2903945 - RNA, 11 nt, Mycobacterium avium subsp. paratuberculosis
cgucagcagcg

SEQ ID NO: 2903946 - RNA, 15 nt, Mycobacterium avium subsp. paratuberculosis
cgucagcagcgcgac

SEQ ID NO: 2903947 - RNA, 16 nt, Mycobacterium avium subsp. paratuberculosis
cgucagcagcgcgacg

SEQ ID NO: 2903948 - RNA, 22 nt, Mycobacterium avium subsp. paratuberculosis
cgucagcagggccucgccguug

SEQ ID NO: 2903949 - RNA, 14 nt, Mycobacterium avium subsp. paratuberculosis
cgucagcaucgccg

SEQ ID NO: 2903950 - RNA, 17 nt, Mycobacterium avium subsp. paratuberculosis
cgucagcaucgccgucg

SEQ ID NO: 2903951 - RNA, 22 nt, Mycobacterium avium subsp. paratuberculosis
cgucagcaucgccgucgucagc

SEQ ID NO: 2903952 - RNA, 22 nt, Mycobacterium avium subsp. paratuberculosis
cgucagccaaaccgugucccgg

SEQ ID NO: 2903953 - RNA, 17 nt, Mycobacterium avium subsp. paratuberculosis
cgucagccccgagucca

SEQ ID NO: 2903954 - RNA, 16 nt, Mycobacterium avium subsp. paratuberculosis
cgucagcccgcgucgc

SEQ ID NO: 2903955 - RNA, 18 nt, Mycobacterium avium subsp. paratuberculosis
cgucagcccgcgucgcgc

SEQ ID NO: 2903956 - RNA, 19 nt, Mycobacterium avium subsp. paratuberculosis
cgucagcccgcgucgcgca

SEQ ID NO: 2903957 - RNA, 18 nt, Mycobacterium avium subsp. paratuberculosis
cgucagccgggccagccc

SEQ ID NO: 2903958 - RNA, 19 nt, Mycobacterium avium subsp. paratuberculosis
cgucagccgggccagcccg

SEQ ID NO: 2903959 - RNA, 13 nt, Mycobacterium avium subsp. paratuberculosis
cgucagccgucgu

SEQ ID NO: 2903960 - RNA, 15 nt, Mycobacterium avium subsp. paratuberculosis
cgucagcgccgcccg

SEQ ID NO: 2903961 - RNA, 18 nt, Mycobacterium avium subsp. paratuberculosis
cgucagcgcgggccagca

SEQ ID NO: 2903962 - RNA, 14 nt, Mycobacterium avium subsp. paratuberculosis
cgucagcggcgggc

SEQ ID NO: 2903963 - RNA, 16 nt, Mycobacterium avium subsp. paratuberculosis
cgucagcgucagcacg

SEQ ID NO: 2903964 - RNA, 22 nt, Mycobacterium avium subsp. paratuberculosis
cgucagcuaggaagccagccgu

SEQ ID NO: 2903965 - RNA, 20 nt, Mycobacterium avium subsp. paratuberculosis
cgucagcucccccgacaccg

SEQ ID NO: 2903966 - RNA, 21 nt, Mycobacterium avium subsp. paratuberculosis
cgucagcucccccgacaccgc

SEQ ID NO: 2903967 - RNA, 23 nt, Mycobacterium avium subsp. paratuberculosis
cgucagcucccccgacaccgcca

SEQ ID NO: 2903968 - RNA, 16 nt, Mycobacterium avium subsp. paratuberculosis
cgucaggaacgccggc

SEQ ID NO: 2903969 - RNA, 20 nt, Mycobacterium avium subsp. paratuberculosis
cgucaggaaugcgacgacgu

SEQ ID NO: 2903970 - RNA, 17 nt, Mycobacterium avium subsp. paratuberculosis
cgucaggagugcucggc

SEQ ID NO: 2903971 - RNA, 19 nt, Mycobacterium avium subsp. paratuberculosis
cgucaggagugcucggcgu

SEQ ID NO: 2903972 - RNA, 20 nt, Mycobacterium avium subsp. paratuberculosis
cgucaggcccagcgaggcgg

SEQ ID NO: 2903973 - RNA, 21 nt, Mycobacterium avium subsp. paratuberculosis
cgucaggcccagcgaggcggc

SEQ ID NO: 2903974 - RNA, 22 nt, Mycobacterium avium subsp. paratuberculosis
cgucaggccggucagcgacgag

SEQ ID NO: 2903975 - RNA, 18 nt, Mycobacterium avium subsp. paratuberculosis
cgucaggccguagcggcu

SEQ ID NO: 2903976 - RNA, 20 nt, Mycobacterium avium subsp. paratuberculosis
cgucaggccguagcggcucg

SEQ ID NO: 2903977 - RNA, 15 nt, Mycobacterium avium subsp. paratuberculosis
cgucaggccgugauc

SEQ ID NO: 2903978 - RNA, 19 nt, Mycobacterium avium subsp. paratuberculosis
cgucaggccgugaucggcc

SEQ ID NO: 2903979 - RNA, 21 nt, Mycobacterium avium subsp. paratuberculosis
cgucaggccucgaggaucgcg

SEQ ID NO: 2903980 - RNA, 22 nt, Mycobacterium avium subsp. paratuberculosis
cgucaggccugguaggccgccu

SEQ ID NO: 2903981 - RNA, 14 nt, Mycobacterium avium subsp. paratuberculosis
cgucaggcgcuggg

SEQ ID NO: 2903982 - RNA, 17 nt, Mycobacterium avium subsp. paratuberculosis
cgucaggcgcugggugc

SEQ ID NO: 2903983 - RNA, 22 nt, Mycobacterium avium subsp. paratuberculosis
cgucagggcgacuccggcgccg

SEQ ID NO: 2903984 - RNA, 20 nt, Mycobacterium avium subsp. paratuberculosis
cgucagggguuggcgcgcag

SEQ ID NO: 2903985 - RNA, 22 nt, Mycobacterium avium subsp. paratuberculosis
cgucagggugacguggcggccg

SEQ ID NO: 2903986 - RNA, 16 nt, Mycobacterium avium subsp. paratuberculosis
cgucaggguggccucg

SEQ ID NO: 2903987 - RNA, 17 nt, Mycobacterium avium subsp. paratuberculosis
cgucaggguggccucgu

SEQ ID NO: 2903988 - RNA, 18 nt, Mycobacterium avium subsp. paratuberculosis
cgucaggguggccucguc

SEQ ID NO: 2903989 - RNA, 19 nt, Mycobacterium avium subsp. paratuberculosis
cgucaggguggccucgucg

SEQ ID NO: 2903990 - RNA, 20 nt, Mycobacterium avium subsp. paratuberculosis
cgucaggguggccucgucgg

SEQ ID NO: 2903991 - RNA, 21 nt, Mycobacterium avium subsp. paratuberculosis
cgucaggguggccucgucggc

SEQ ID NO: 2903992 - RNA, 22 nt, Mycobacterium avium subsp. paratuberculosis
cgucaggguggccucgucggcg

SEQ ID NO: 2903993 - RNA, 22 nt, Mycobacterium avium subsp. paratuberculosis
cgucaggguggugcccccgccc

SEQ ID NO: 2903994 - RNA, 14 nt, Mycobacterium avium subsp. paratuberculosis
cgucaggucaccga

SEQ ID NO: 2903995 - RNA, 17 nt, Mycobacterium avium subsp. paratuberculosis
cgucaggucaccgagcg

SEQ ID NO: 2903996 - RNA, 19 nt, Mycobacterium avium subsp. paratuberculosis
cgucaggucaccgagcggg

SEQ ID NO: 2903997 - RNA, 16 nt, Mycobacterium avium subsp. paratuberculosis
cgucagguccgcgagu

SEQ ID NO: 2903998 - RNA, 14 nt, Mycobacterium avium subsp. paratuberculosis
cgucaggucgaccg

SEQ ID NO: 2903999 - RNA, 15 nt, Mycobacterium avium subsp. paratuberculosis
cgucaggucgaccgg

SEQ ID NO: 2904000 - RNA, 17 nt, Mycobacterium avium subsp. paratuberculosis
cgucaggucgaccggcu

SEQ ID NO: 2904001 - RNA, 23 nt, Mycobacterium avium subsp. paratuberculosis
cgucaggucgaccggcucgccgu

SEQ ID NO: 2904002 - RNA, 12 nt, Mycobacterium avium subsp. paratuberculosis
cgucaggucgcg

SEQ ID NO: 2904003 - RNA, 14 nt, Mycobacterium avium subsp. paratuberculosis
cgucaggucgcggu

SEQ ID NO: 2904004 - RNA, 16 nt, Mycobacterium avium subsp. paratuberculosis
cgucaggucgcgguag

SEQ ID NO: 2904005 - RNA, 17 nt, Mycobacterium avium subsp. paratuberculosis
cgucaggucuucggucg

SEQ ID NO: 2904006 - RNA, 16 nt, Mycobacterium avium subsp. paratuberculosis
cgucagguucgaggug

SEQ ID NO: 2904007 - RNA, 22 nt, Mycobacterium avium subsp. paratuberculosis
cgucagugcgcauucggcgacg

SEQ ID NO: 2904008 - RNA, 23 nt, Mycobacterium avium subsp. paratuberculosis
cgucaguucguagaucacggcgu

SEQ ID NO: 2904009 - RNA, 15 nt, Mycobacterium avium subsp. paratuberculosis
cgucaucaccgccga

SEQ ID NO: 2904010 - RNA, 15 nt, Mycobacterium avium subsp. paratuberculosis
cgucaucaucaccgg

SEQ ID NO: 2904011 - RNA, 22 nt, Mycobacterium avium subsp. paratuberculosis
cgucaucaucaccgggauggug

SEQ ID NO: 2904012 - RNA, 20 nt, Mycobacterium avium subsp. paratuberculosis
cgucauccccaucucgagca

SEQ ID NO: 2904013 - RNA, 17 nt, Mycobacterium avium subsp. paratuberculosis
cgucaucccccgcagcu

SEQ ID NO: 2904014 - RNA, 17 nt, Mycobacterium avium subsp. paratuberculosis
cgucauccccuggccga

SEQ ID NO: 2904015 - RNA, 22 nt, Mycobacterium avium subsp. paratuberculosis
cgucauccggcugcccugggag

SEQ ID NO: 2904016 - RNA, 21 nt, Mycobacterium avium subsp. paratuberculosis
cgucaucgacuugccgccgca

SEQ ID NO: 2904017 - RNA, 14 nt, Mycobacterium avium subsp. paratuberculosis
cgucaucgccgacg

SEQ ID NO: 2904018 - RNA, 13 nt, Mycobacterium avium subsp. paratuberculosis
cgucaucgcggcg

SEQ ID NO: 2904019 - RNA, 22 nt, Mycobacterium avium subsp. paratuberculosis
cgucaucgcggcgaacaacgcc

SEQ ID NO: 2904020 - RNA, 14 nt, Mycobacterium avium subsp. paratuberculosis
cgucaucgcguagu

SEQ ID NO: 2904021 - RNA, 13 nt, Mycobacterium avium subsp. paratuberculosis
cgucaucggcgga

SEQ ID NO: 2904022 - RNA, 21 nt, Mycobacterium avium subsp. paratuberculosis
cgucaucgggcccgacgacga

SEQ ID NO: 2904023 - RNA, 17 nt, Mycobacterium avium subsp. paratuberculosis
cgucaucgucuccgcug

SEQ ID NO: 2904024 - RNA, 19 nt, Mycobacterium avium subsp. paratuberculosis
cgucaucgugugggcgccc

SEQ ID NO: 2904025 - RNA, 22 nt, Mycobacterium avium subsp. paratuberculosis
cgucaugacgaacaugcugccg

SEQ ID NO: 2904026 - RNA, 23 nt, Mycobacterium avium subsp. paratuberculosis
cgucaugccguaaguggcgccgc

SEQ ID NO: 2904027 - RNA, 13 nt, Mycobacterium avium subsp. paratuberculosis
cgucaugccuugg

SEQ ID NO: 2904028 - RNA, 16 nt, Mycobacterium avium subsp. paratuberculosis
cgucaugccuuggccg

SEQ ID NO: 2904029 - RNA, 14 nt, Mycobacterium avium subsp. paratuberculosis
cgucauggccgucg

SEQ ID NO: 2904030 - RNA, 15 nt, Mycobacterium avium subsp. paratuberculosis
cgucauggccgucgg

SEQ ID NO: 2904031 - RNA, 22 nt, Mycobacterium avium subsp. paratuberculosis
cgucauggccgucgggucggcg

SEQ ID NO: 2904032 - RNA, 13 nt, Mycobacterium avium subsp. paratuberculosis
cgucauuccgccg

SEQ ID NO: 2904033 - RNA, 15 nt, Mycobacterium avium subsp. paratuberculosis
cgucauuccgccgcg

SEQ ID NO: 2904034 - RNA, 18 nt, Mycobacterium avium subsp. paratuberculosis
cgucauuccgccgcgccc

SEQ ID NO: 2904035 - RNA, 21 nt, Mycobacterium avium subsp. paratuberculosis
cgucauuccgccgcgcccguc

SEQ ID NO: 2904036 - RNA, 22 nt, Mycobacterium avium subsp. paratuberculosis
cguccaaaaugcguuccgcgac

SEQ ID NO: 2904037 - RNA, 14 nt, Mycobacterium avium subsp. paratuberculosis
cguccaaccgcgga

SEQ ID NO: 2904038 - RNA, 18 nt, Mycobacterium avium subsp. paratuberculosis
cguccaaugcgccgaugg

SEQ ID NO: 2904039 - RNA, 14 nt, Mycobacterium avium subsp. paratuberculosis
cguccacaccggga

SEQ ID NO: 2904040 - RNA, 19 nt, Mycobacterium avium subsp. paratuberculosis
cguccacaccgggaaggug

SEQ ID NO: 2904041 - RNA, 20 nt, Mycobacterium avium subsp. paratuberculosis
cgguacgcgcaauccugccc

SEQ ID NO: 2904042 - RNA, 21 nt, Mycobacterium avium subsp. paratuberculosis
cgguacggaucgccggacagc

SEQ ID NO: 2904043 - RNA, 18 nt, Mycobacterium avium subsp. paratuberculosis
cgguacggccgacgccca

SEQ ID NO: 2904044 - RNA, 15 nt, Mycobacterium avium subsp. paratuberculosis
cgguacgugcgccgg

SEQ ID NO: 2904045 - RNA, 16 nt, Mycobacterium avium subsp. paratuberculosis
cgguacgugcgccggc

SEQ ID NO: 2904046 - RNA, 21 nt, Mycobacterium avium subsp. paratuberculosis
cgguacgugcgccggcggugc

SEQ ID NO: 2904047 - RNA, 21 nt, Mycobacterium avium subsp. paratuberculosis
cgguacuguuacgcccgaucc

SEQ ID NO: 2904048 - RNA, 20 nt, Mycobacterium avium subsp. paratuberculosis
cgguagaaccaacgcggcgc

SEQ ID NO: 2904049 - RNA, 22 nt, Mycobacterium avium subsp. paratuberculosis
cgguagaaccaacgcggcgccg

SEQ ID NO: 2904050 - RNA, 19 nt, Mycobacterium avium subsp. paratuberculosis
cgguagaagaugcgccggg

SEQ ID NO: 2904051 - RNA, 18 nt, Mycobacterium avium subsp. paratuberculosis
cgguagacaccgccguug

SEQ ID NO: 2904052 - RNA, 18 nt, Mycobacterium avium subsp. paratuberculosis
cgguagaugucggguccg

SEQ ID NO: 2904053 - RNA, 15 nt, Mycobacterium avium subsp. paratuberculosis
cgguagccagcaccg

SEQ ID NO: 2904054 - RNA, 16 nt, Mycobacterium avium subsp. paratuberculosis
cgguagccgcucgccc

SEQ ID NO: 2904055 - RNA, 12 nt, Mycobacterium avium subsp. paratuberculosis
cgguagcgacac

SEQ ID NO: 2904056 - RNA, 14 nt, Mycobacterium avium subsp. paratuberculosis
cgguagcgcagcac

SEQ ID NO: 2904057 - RNA, 15 nt, Mycobacterium avium subsp. paratuberculosis
cgguagcgcagcacc

SEQ ID NO: 2904058 - RNA, 22 nt, Mycobacterium avium subsp. paratuberculosis
cgguagcgcucgucguagucga

SEQ ID NO: 2904059 - RNA, 16 nt, Mycobacterium avium subsp. paratuberculosis
cgguagcgguccucga

SEQ ID NO: 2904060 - RNA, 18 nt, Mycobacterium avium subsp. paratuberculosis
cgguagcgguccucgaac

SEQ ID NO: 2904061 - RNA, 13 nt, Mycobacterium avium subsp. paratuberculosis
cgguaggccgccg

SEQ ID NO: 2904062 - RNA, 13 nt, Mycobacterium avium subsp. paratuberculosis
cgguaggccgcgc

SEQ ID NO: 2904063 - RNA, 14 nt, Mycobacterium avium subsp. paratuberculosis
cgguaggccgcgcc

SEQ ID NO: 2904064 - RNA, 15 nt, Mycobacterium avium subsp. paratuberculosis
cgguaggccgcgccg

SEQ ID NO: 2904065 - RNA, 18 nt, Mycobacterium avium subsp. paratuberculosis
cgguaggccgcgccgauc

SEQ ID NO: 2904066 - RNA, 22 nt, Mycobacterium avium subsp. paratuberculosis
cgguaggccgcgccgaucacga

SEQ ID NO: 2904067 - RNA, 18 nt, Mycobacterium avium subsp. paratuberculosis
cgguaggccggccgcagc

SEQ ID NO: 2904068 - RNA, 14 nt, Mycobacterium avium subsp. paratuberculosis
cgguaggcgcaccg

SEQ ID NO: 2904069 - RNA, 17 nt, Mycobacterium avium subsp. paratuberculosis
cgguaggcgcaccgccg

SEQ ID NO: 2904070 - RNA, 18 nt, Mycobacterium avium subsp. paratuberculosis
cgguaggcgcaccgccgg

SEQ ID NO: 2904071 - RNA, 19 nt, Mycobacterium avium subsp. paratuberculosis
cgguaggcgcaccgccggg

SEQ ID NO: 2904072 - RNA, 16 nt, Mycobacterium avium subsp. paratuberculosis
cgguaggcgcggucgg

SEQ ID NO: 2904073 - RNA, 14 nt, Mycobacterium avium subsp. paratuberculosis
cgguaggcggccag

SEQ ID NO: 2904074 - RNA, 15 nt, Mycobacterium avium subsp. paratuberculosis
cgguaggcggccagc

SEQ ID NO: 2904075 - RNA, 16 nt, Mycobacterium avium subsp. paratuberculosis
cgguaggcggccagcg

SEQ ID NO: 2904076 - RNA, 19 nt, Mycobacterium avium subsp. paratuberculosis
cgguaggcggccagcgccc

SEQ ID NO: 2904077 - RNA, 12 nt, Mycobacterium avium subsp. paratuberculosis
cgguagggccgg

SEQ ID NO: 2904078 - RNA, 18 nt, Mycobacterium avium subsp. paratuberculosis
cgguagggccggucaccg

SEQ ID NO: 2904079 - RNA, 19 nt, Mycobacterium avium subsp. paratuberculosis
cgguagggccggucaccgg

SEQ ID NO: 2904080 - RNA, 15 nt, Mycobacterium avium subsp. paratuberculosis
cgguagggucgggug

SEQ ID NO: 2904081 - RNA, 21 nt, Mycobacterium avium subsp. paratuberculosis
cgguagggucgggugcggcgg

SEQ ID NO: 2904082 - RNA, 18 nt, Mycobacterium avium subsp. paratuberculosis
cgguaggugaucgccucg

SEQ ID NO: 2904083 - RNA, 17 nt, Mycobacterium avium subsp. paratuberculosis
cgguaggugccggccgc

SEQ ID NO: 2904084 - RNA, 18 nt, Mycobacterium avium subsp. paratuberculosis
cgguaggugccggccgcg

SEQ ID NO: 2904085 - RNA, 21 nt, Mycobacterium avium subsp. paratuberculosis
cgguaggugucgaugaacgca

SEQ ID NO: 2904086 - RNA, 15 nt, Mycobacterium avium subsp. paratuberculosis
cgguagucgucgagg

SEQ ID NO: 2904087 - RNA, 17 nt, Mycobacterium avium subsp. paratuberculosis
cgguauacccccgguga

SEQ ID NO: 2904088 - RNA, 17 nt, Mycobacterium avium subsp. paratuberculosis
cgguauauucgcgaugg

SEQ ID NO: 2904089 - RNA, 23 nt, Mycobacterium avium subsp. paratuberculosis
cgguauccauccgccagaucgcc

SEQ ID NO: 2904090 - RNA, 15 nt, Mycobacterium avium subsp. paratuberculosis
cgguaucgggucacc

SEQ ID NO: 2904091 - RNA, 16 nt, Mycobacterium avium subsp. paratuberculosis
cgguaucgggucaccg

SEQ ID NO: 2904092 - RNA, 23 nt, Mycobacterium avium subsp. paratuberculosis
cgguaucgguggauccggugacc

SEQ ID NO: 2904093 - RNA, 15 nt, Mycobacterium avium subsp. paratuberculosis
cgguaugccaagcca

SEQ ID NO: 2904094 - RNA, 17 nt, Mycobacterium avium subsp. paratuberculosis
cgguaugcccgggccgu

SEQ ID NO: 2904095 - RNA, 21 nt, Mycobacterium avium subsp. paratuberculosis
cgguaugcccgggccgucauc

SEQ ID NO: 2904096 - RNA, 15 nt, Mycobacterium avium subsp. paratuberculosis
cgguaugcggcgacg

SEQ ID NO: 2904097 - RNA, 14 nt, Mycobacterium avium subsp. paratuberculosis
cgguauuggccacg

SEQ ID NO: 2904098 - RNA, 15 nt, Mycobacterium avium subsp. paratuberculosis
cggucaacaccggga

SEQ ID NO: 2904099 - RNA, 20 nt, Mycobacterium avium subsp. paratuberculosis
cggucaacacgaagccggug

SEQ ID NO: 2904100 - RNA, 13 nt, Mycobacterium avium subsp. paratuberculosis
cggucaacccgau

SEQ ID NO: 2904101 - RNA, 16 nt, Mycobacterium avium subsp. paratuberculosis
cggucaacgccgcgcg

SEQ ID NO: 2904102 - RNA, 20 nt, Mycobacterium avium subsp. paratuberculosis
cggucaacggcucggucaag

SEQ ID NO: 2904103 - RNA, 23 nt, Mycobacterium avium subsp. paratuberculosis
cggucaagaacgcaaucgcccag

SEQ ID NO: 2904104 - RNA, 15 nt, Mycobacterium avium subsp. paratuberculosis
cggucaagccggcca

SEQ ID NO: 2904105 - RNA, 17 nt, Mycobacterium avium subsp. paratuberculosis
cggucaagccggccagc

SEQ ID NO: 2904106 - RNA, 20 nt, Mycobacterium avium subsp. paratuberculosis
cggucaagccggccagcagc

SEQ ID NO: 2904107 - RNA, 23 nt, Mycobacterium avium subsp. paratuberculosis
cggucaagccggccagcagcggc

SEQ ID NO: 2904108 - RNA, 20 nt, Mycobacterium avium subsp. paratuberculosis
cggucaagcgcuuucgccga

SEQ ID NO: 2904109 - RNA, 22 nt, Mycobacterium avium subsp. paratuberculosis
cggucaagcgcuuucgccgaau

SEQ ID NO: 2904110 - RNA, 14 nt, Mycobacterium avium subsp. paratuberculosis
cggucaccaaggcg

SEQ ID NO: 2904111 - RNA, 16 nt, Mycobacterium avium subsp. paratuberculosis
cggucaccaaggcgau

SEQ ID NO: 2904112 - RNA, 14 nt, Mycobacterium avium subsp. paratuberculosis
cggucaccagcggc

SEQ ID NO: 2904113 - RNA, 20 nt, Mycobacterium avium subsp. paratuberculosis
cggucaccagcggcccgcug

SEQ ID NO: 2904114 - RNA, 16 nt, Mycobacterium avium subsp. paratuberculosis
cggucacccaggccga

SEQ ID NO: 2904115 - RNA, 17 nt, Mycobacterium avium subsp. paratuberculosis
cggucaccccgaguucg

SEQ ID NO: 2904116 - RNA, 17 nt, Mycobacterium avium subsp. paratuberculosis
cggucaccccggccauc

SEQ ID NO: 2904117 - RNA, 18 nt, Mycobacterium avium subsp. paratuberculosis
cggucaccccggccauca

SEQ ID NO: 2904118 - RNA, 19 nt, Mycobacterium avium subsp. paratuberculosis
cggucacccgugggccgac

SEQ ID NO: 2904119 - RNA, 21 nt, Mycobacterium avium subsp. paratuberculosis
cggucacccgugggccgaccg

SEQ ID NO: 2904120 - RNA, 14 nt, Mycobacterium avium subsp. paratuberculosis
cggucaccgagcgg

SEQ ID NO: 2904121 - RNA, 18 nt, Mycobacterium avium subsp. paratuberculosis
cggucaccgagcggccgu

SEQ ID NO: 2904122 - RNA, 20 nt, Mycobacterium avium subsp. paratuberculosis
cggucaccgagcucauggug

SEQ ID NO: 2904123 - RNA, 15 nt, Mycobacterium avium subsp. paratuberculosis
cggucaccggcucgg

SEQ ID NO: 2904124 - RNA, 14 nt, Mycobacterium avium subsp. paratuberculosis
cggucaccgguccg

SEQ ID NO: 2904125 - RNA, 19 nt, Mycobacterium avium subsp. paratuberculosis
cggucaccggucggugccc

SEQ ID NO: 2904126 - RNA, 24 nt, Mycobacterium avium subsp. paratuberculosis
cggucaccggugucacgcuggcgu

SEQ ID NO: 2904127 - RNA, 14 nt, Mycobacterium avium subsp. paratuberculosis
cggucacgcccggg

SEQ ID NO: 2904128 - RNA, 17 nt, Mycobacterium avium subsp. paratuberculosis
cggucacgcugaucgac

SEQ ID NO: 2904129 - RNA, 14 nt, Mycobacterium avium subsp. paratuberculosis
cggucacgcuggcg

SEQ ID NO: 2904130 - RNA, 19 nt, Mycobacterium avium subsp. paratuberculosis
cggucacgcuggcgugacg

SEQ ID NO: 2904131 - RNA, 17 nt, Mycobacterium avium subsp. paratuberculosis
cggucacggacagccgg

SEQ ID NO: 2904132 - RNA, 18 nt, Mycobacterium avium subsp. paratuberculosis
cggucacggacagccggc

SEQ ID NO: 2904133 - RNA, 17 nt, Mycobacterium avium subsp. paratuberculosis
cggucacggccgccagc

SEQ ID NO: 2904134 - RNA, 14 nt, Mycobacterium avium subsp. paratuberculosis
cggucacggcgucg

SEQ ID NO: 2904135 - RNA, 16 nt, Mycobacterium avium subsp. paratuberculosis
cggucacggcgucggc

SEQ ID NO: 2904136 - RNA, 17 nt, Mycobacterium avium subsp. paratuberculosis
cggucacggcgucggcg

SEQ ID NO: 2904137 - RNA, 19 nt, Mycobacterium avium subsp. paratuberculosis
cggucacggucuggcuggu

SEQ ID NO: 2904138 - RNA, 20 nt, Mycobacterium avium subsp. paratuberculosis
cggucacggucuggcuggug

SEQ ID NO: 2904139 - RNA, 17 nt, Mycobacterium avium subsp. paratuberculosis
cggucacggugacgguu

SEQ ID NO: 2904140 - RNA, 20 nt, Mycobacterium avium subsp. paratuberculosis
cggucacguagcucagcgga

SEQ ID NO: 2904141 - RNA, 14 nt, Mycobacterium avium subsp. paratuberculosis
cggucacguagugc

SEQ ID NO: 2904142 - RNA, 19 nt, Mycobacterium avium subsp. paratuberculosis
cggucagaccuucgcgauc

SEQ ID NO: 2904143 - RNA, 21 nt, Mycobacterium avium subsp. paratuberculosis
cggucagaccuucgcgaucac

SEQ ID NO: 2904144 - RNA, 19 nt, Mycobacterium avium subsp. paratuberculosis
cggucagacgaugggccgc

SEQ ID NO: 2904145 - RNA, 23 nt, Mycobacterium avium subsp. paratuberculosis
cggucagacgaugggccgcccgc

SEQ ID NO: 2904146 - RNA, 16 nt, Mycobacterium avium subsp. paratuberculosis
cggucagcaccgcgcg

SEQ ID NO: 2904147 - RNA, 17 nt, Mycobacterium avium subsp. paratuberculosis
cggucagcaccgcgcgg

SEQ ID NO: 2904148 - RNA, 19 nt, Mycobacterium avium subsp. paratuberculosis
cggucagcaccgcgcggcg

SEQ ID NO: 2904149 - RNA, 20 nt, Mycobacterium avium subsp. paratuberculosis
cggucagcaccgcgcggcgg

SEQ ID NO: 2904150 - RNA, 22 nt, Mycobacterium avium subsp. paratuberculosis
cggucagcaccgcgcggcggug

SEQ ID NO: 2904151 - RNA, 18 nt, Mycobacterium avium subsp. paratuberculosis
cggucagcaccggggcca

SEQ ID NO: 2904152 - RNA, 22 nt, Mycobacterium avium subsp. paratuberculosis
cggucagcacgcugaucaccac

SEQ ID NO: 2904153 - RNA, 18 nt, Mycobacterium avium subsp. paratuberculosis
cggucagcaggcgccgca

SEQ ID NO: 2904154 - RNA, 17 nt, Mycobacterium avium subsp. paratuberculosis
cggucagcccccaccgc

SEQ ID NO: 2904155 - RNA, 13 nt, Mycobacterium avium subsp. paratuberculosis
cggucagccggcu

SEQ ID NO: 2904156 - RNA, 16 nt, Mycobacterium avium subsp. paratuberculosis
cggucagccggcucgg

SEQ ID NO: 2904157 - RNA, 15 nt, Mycobacterium avium subsp. paratuberculosis
cggucagccgggcgg

SEQ ID NO: 2904158 - RNA, 13 nt, Mycobacterium avium subsp. paratuberculosis
cggucagcgagcg

SEQ ID NO: 2904159 - RNA, 16 nt, Mycobacterium avium subsp. paratuberculosis
cggucagcgccagcau

SEQ ID NO: 2904160 - RNA, 22 nt, Mycobacterium avium subsp. paratuberculosis
cggucagcgcgacaucgccggc

SEQ ID NO: 2904161 - RNA, 14 nt, Mycobacterium avium subsp. paratuberculosis
cggucagcgcgccg

SEQ ID NO: 2904162 - RNA, 15 nt, Mycobacterium avium subsp. paratuberculosis
cggucagcgcgccgu

SEQ ID NO: 2904163 - RNA, 18 nt, Mycobacterium avium subsp. paratuberculosis
cggucagcgcgccgucgg

SEQ ID NO: 2904164 - RNA, 16 nt, Mycobacterium avium subsp. paratuberculosis
cggucagcgcguaguc

SEQ ID NO: 2904165 - RNA, 17 nt, Mycobacterium avium subsp. paratuberculosis
cggucagcgcgucggcg

SEQ ID NO: 2904166 - RNA, 18 nt, Mycobacterium avium subsp. paratuberculosis
cggucagcgcgucggcga

SEQ ID NO: 2904167 - RNA, 20 nt, Mycobacterium avium subsp. paratuberculosis
cggucagcgcgucggcgacc

SEQ ID NO: 2904168 - RNA, 21 nt, Mycobacterium avium subsp. paratuberculosis
cggucagcgcgucggcgaccg

SEQ ID NO: 2904169 - RNA, 22 nt, Mycobacterium avium subsp. paratuberculosis
cggucagcgcgucggcgaccgc

SEQ ID NO: 2904170 - RNA, 13 nt, Mycobacterium avium subsp. paratuberculosis
cggucagcggcaa

SEQ ID NO: 2904171 - RNA, 22 nt, Mycobacterium avium subsp. paratuberculosis
cggucagcggcaacacgccggc

SEQ ID NO: 2904172 - RNA, 24 nt, Mycobacterium avium subsp. paratuberculosis
cggucagcggcaacacgccggcgg

SEQ ID NO: 2904173 - RNA, 15 nt, Mycobacterium avium subsp. paratuberculosis
cggucagcggccagc

SEQ ID NO: 2904174 - RNA, 17 nt, Mycobacterium avium subsp. paratuberculosis
cggucagcggccagccc

SEQ ID NO: 2904175 - RNA, 18 nt, Mycobacterium avium subsp. paratuberculosis
cggucagcggccagccca

SEQ ID NO: 2904176 - RNA, 19 nt, Mycobacterium avium subsp. paratuberculosis
cggucagcggccagcccau

SEQ ID NO: 2904177 - RNA, 12 nt, Mycobacterium avium subsp. paratuberculosis
cggucagcggcg

SEQ ID NO: 2904178 - RNA, 14 nt, Mycobacterium avium subsp. paratuberculosis
cggucagcguccag

SEQ ID NO: 2904179 - RNA, 17 nt, Mycobacterium avium subsp. paratuberculosis
cggucagcgucgccgcc

SEQ ID NO: 2904180 - RNA, 18 nt, Mycobacterium avium subsp. paratuberculosis
cggucagcgucgccgccc

SEQ ID NO: 2904181 - RNA, 21 nt, Mycobacterium avium subsp. paratuberculosis
cggucagcgucgccgccccga

SEQ ID NO: 2904182 - RNA, 15 nt, Mycobacterium avium subsp. paratuberculosis
cggucagcguggcgu

SEQ ID NO: 2904183 - RNA, 23 nt, Mycobacterium avium subsp. paratuberculosis
cggucagcguggcgucggcgcgc

SEQ ID NO: 2904184 - RNA, 13 nt, Mycobacterium avium subsp. paratuberculosis
cggucagcucccg

SEQ ID NO: 2904185 - RNA, 14 nt, Mycobacterium avium subsp. paratuberculosis
cggucagcucgaag

SEQ ID NO: 2904186 - RNA, 20 nt, Mycobacterium avium subsp. paratuberculosis
cggucagcucgaucgccgcg

SEQ ID NO: 2904187 - RNA, 12 nt, Mycobacterium avium subsp. paratuberculosis
cggucagcucgc

SEQ ID NO: 2904188 - RNA, 17 nt, Mycobacterium avium subsp. paratuberculosis
cggucagcucgggguag

SEQ ID NO: 2904189 - RNA, 13 nt, Mycobacterium avium subsp. paratuberculosis
cggucagcuggug

SEQ ID NO: 2904190 - RNA, 20 nt, Mycobacterium avium subsp. paratuberculosis
cggucaggaacccggcccgg

SEQ ID NO: 2904191 - RNA, 18 nt, Mycobacterium avium subsp. paratuberculosis
cggucaggaacgcggaca

SEQ ID NO: 2904192 - RNA, 17 nt, Mycobacterium avium subsp. paratuberculosis
cggucaggcacucgauc

SEQ ID NO: 2904193 - RNA, 20 nt, Mycobacterium avium subsp. paratuberculosis
cggucaggcacucgaucagc

SEQ ID NO: 2904194 - RNA, 23 nt, Mycobacterium avium subsp. paratuberculosis
cggucaggcacucgaucagcacc

SEQ ID NO: 2904195 - RNA, 19 nt, Mycobacterium avium subsp. paratuberculosis
cggucaggcauuccaccgc

SEQ ID NO: 2904196 - RNA, 22 nt, Mycobacterium avium subsp. paratuberculosis
cggucaggcauuccaccgcgcg

SEQ ID NO: 2904197 - RNA, 17 nt, Mycobacterium avium subsp. paratuberculosis
cggucaggccggcgccg

SEQ ID NO: 2904198 - RNA, 18 nt, Mycobacterium avium subsp. paratuberculosis
cggucaggccggcgccgg

SEQ ID NO: 2904199 - RNA, 21 nt, Mycobacterium avium subsp. paratuberculosis
cggucaggccggcgccgggaa

SEQ ID NO: 2904200 - RNA, 22 nt, Mycobacterium avium subsp. paratuberculosis
cggucaggccgucucgagccgg

SEQ ID NO: 2904201 - RNA, 14 nt, Mycobacterium avium subsp. paratuberculosis
cggucagggccagc

SEQ ID NO: 2904202 - RNA, 17 nt, Mycobacterium avium subsp. paratuberculosis
cggucagggccagcaac

SEQ ID NO: 2904203 - RNA, 19 nt, Mycobacterium avium subsp. paratuberculosis
cggucagggccagcaacac

SEQ ID NO: 2904204 - RNA, 12 nt, Mycobacterium avium subsp. paratuberculosis
cggucagggugu

SEQ ID NO: 2904205 - RNA, 23 nt, Mycobacterium avium subsp. paratuberculosis
cggucagguagccgaggucgccg

SEQ ID NO: 2904206 - RNA, 17 nt, Mycobacterium avium subsp. paratuberculosis
cggucagguugacgccg

SEQ ID NO: 2904207 - RNA, 20 nt, Mycobacterium avium subsp. paratuberculosis
cggucagguugacgccgaug

SEQ ID NO: 2904208 - RNA, 15 nt, Mycobacterium avium subsp. paratuberculosis
cggucagucgcgccg

SEQ ID NO: 2904209 - RNA, 20 nt, Mycobacterium avium subsp. paratuberculosis
cggucagucgcgccgccagc

SEQ ID NO: 2904210 - RNA, 22 nt, Mycobacterium avium subsp. paratuberculosis
cggucagucgcgccgccagcaa

SEQ ID NO: 2904211 - RNA, 17 nt, Mycobacterium avium subsp. paratuberculosis
cggucaguucgucgguc

SEQ ID NO: 2904212 - RNA, 18 nt, Mycobacterium avium subsp. paratuberculosis
cggucauaggccgcgcag

SEQ ID NO: 2904213 - RNA, 18 nt, Mycobacterium avium subsp. paratuberculosis
cggucauccgggccacca

SEQ ID NO: 2904214 - RNA, 20 nt, Mycobacterium avium subsp. paratuberculosis
cggucauccgggccaccacc

SEQ ID NO: 2904215 - RNA, 21 nt, Mycobacterium avium subsp. paratuberculosis
cggucauccucgccgcgccag

SEQ ID NO: 2904216 - RNA, 22 nt, Mycobacterium avium subsp. paratuberculosis
cggucauccucgccgcgccagc

SEQ ID NO: 2904217 - RNA, 17 nt, Mycobacterium avium subsp. paratuberculosis
cggucaucgugaucgcc

SEQ ID NO: 2904218 - RNA, 20 nt, Mycobacterium avium subsp. paratuberculosis
cggucaucgugaucgcccac

SEQ ID NO: 2904219 - RNA, 16 nt, Mycobacterium avium subsp. paratuberculosis
cggucaugccgagccg

SEQ ID NO: 2904220 - RNA, 17 nt, Mycobacterium avium subsp. paratuberculosis
cggucaugccgagccgc

SEQ ID NO: 2904221 - RNA, 23 nt, Mycobacterium avium subsp. paratuberculosis
cggucauugaugccccgggugac

SEQ ID NO: 2904222 - RNA, 22 nt, Mycobacterium avium subsp. paratuberculosis
cgguccaaagacguugaccgcg

SEQ ID NO: 2904223 - RNA, 22 nt, Mycobacterium avium subsp. paratuberculosis
cgguccaacguggguggccccu

SEQ ID NO: 2904224 - RNA, 23 nt, Mycobacterium avium subsp. paratuberculosis
cgguccaacguggguggccccuc

SEQ ID NO: 2904225 - RNA, 16 nt, Mycobacterium avium subsp. paratuberculosis
cgguccaccaauggcg

SEQ ID NO: 2904226 - RNA, 13 nt, Mycobacterium avium subsp. paratuberculosis
cgguccaccacca

SEQ ID NO: 2904227 - RNA, 14 nt, Mycobacterium avium subsp. paratuberculosis
cgguccaccaccac

SEQ ID NO: 2904228 - RNA, 17 nt, Mycobacterium avium subsp. paratuberculosis
cgguccaccaccacacc

SEQ ID NO: 2904229 - RNA, 20 nt, Mycobacterium avium subsp. paratuberculosis
cgguccaccaccacacccgc

SEQ ID NO: 2904230 - RNA, 21 nt, Mycobacterium avium subsp. paratuberculosis
cgguccaccaccacacccgcg

SEQ ID NO: 2904231 - RNA, 22 nt, Mycobacterium avium subsp. paratuberculosis
cgguccaccaccacacccgcgg

SEQ ID NO: 2904232 - RNA, 23 nt, Mycobacterium avium subsp. paratuberculosis
cgguccaccaccacacccgcggc

SEQ ID NO: 2904233 - RNA, 23 nt, Mycobacterium avium subsp. paratuberculosis
cgguccaccagaaguggucgauc

SEQ ID NO: 2904234 - RNA, 22 nt, Mycobacterium avium subsp. paratuberculosis
cgguccaccuggcugugcacga

SEQ ID NO: 2904235 - RNA, 14 nt, Mycobacterium avium subsp. paratuberculosis
cgguccacgccggc

SEQ ID NO: 2904236 - RNA, 15 nt, Mycobacterium avium subsp. paratuberculosis
cgguccacgccggcg

SEQ ID NO: 2904237 - RNA, 17 nt, Mycobacterium avium subsp. paratuberculosis
cgguccacgccggcgau

SEQ ID NO: 2904238 - RNA, 19 nt, Mycobacterium avium subsp. paratuberculosis
cgguccacggucagcgcgu

SEQ ID NO: 2904239 - RNA, 16 nt, Mycobacterium avium subsp. paratuberculosis
cgguccacgguggcgc

SEQ ID NO: 2904240 - RNA, 18 nt, Mycobacterium avium subsp. paratuberculosis
cgguccacgguggcgccg

SEQ ID NO: 2904241 - RNA, 21 nt, Mycobacterium avium subsp. paratuberculosis
cgguccacgguggcgccgaau

SEQ ID NO: 2904242 - RNA, 18 nt, Mycobacterium avium subsp. paratuberculosis
cgguccacuuccgcgcag

SEQ ID NO: 2904243 - RNA, 12 nt, Mycobacterium avium subsp. paratuberculosis
cgguccagcccg

SEQ ID NO: 2904244 - RNA, 16 nt, Mycobacterium avium subsp. paratuberculosis
cgguccagccgccgcg

SEQ ID NO: 2904245 - RNA, 13 nt, Mycobacterium avium subsp. paratuberculosis
cgguccagcguga

SEQ ID NO: 2904246 - RNA, 18 nt, Mycobacterium avium subsp. paratuberculosis
cgguccaggauccgcacc

SEQ ID NO: 2904247 - RNA, 20 nt, Mycobacterium avium subsp. paratuberculosis
cgguccaggauccgcaccgg

SEQ ID NO: 2904248 - RNA, 18 nt, Mycobacterium avium subsp. paratuberculosis
cgguccaggcgaccggcc

SEQ ID NO: 2904249 - RNA, 18 nt, Mycobacterium avium subsp. paratuberculosis
cgguccagguggccaugg

SEQ ID NO: 2904250 - RNA, 16 nt, Mycobacterium avium subsp. paratuberculosis
cgguccagguggggug

SEQ ID NO: 2904251 - RNA, 17 nt, Mycobacterium avium subsp. paratuberculosis
cgguccagguggggugg

SEQ ID NO: 2904252 - RNA, 18 nt, Mycobacterium avium subsp. paratuberculosis
cgguccaggugggguggu

SEQ ID NO: 2904253 - RNA, 19 nt, Mycobacterium avium subsp. paratuberculosis
cgguccaguacaccgcgag

SEQ ID NO: 2904254 - RNA, 17 nt, Mycobacterium avium subsp. paratuberculosis
cgguccagugccggcga

SEQ ID NO: 2904255 - RNA, 18 nt, Mycobacterium avium subsp. paratuberculosis
cgguccaguugugccgca

SEQ ID NO: 2904256 - RNA, 16 nt, Mycobacterium avium subsp. paratuberculosis
cgguccaucagcaccg

SEQ ID NO: 2904257 - RNA, 17 nt, Mycobacterium avium subsp. paratuberculosis
cgguccaucagcaccga

SEQ ID NO: 2904258 - RNA, 18 nt, Mycobacterium avium subsp. paratuberculosis
cgguccaucagcaccgag

SEQ ID NO: 2904259 - RNA, 21 nt, Mycobacterium avium subsp. paratuberculosis
cgguccaucagcaccgagaac

SEQ ID NO: 2904260 - RNA, 15 nt, Mycobacterium avium subsp. paratuberculosis
cgguccauccagcgc

SEQ ID NO: 2904261 - RNA, 18 nt, Mycobacterium avium subsp. paratuberculosis
cgguccauccagcgccgc

SEQ ID NO: 2904262 - RNA, 21 nt, Mycobacterium avium subsp. paratuberculosis
cgguccauccagcgccgcagc

SEQ ID NO: 2904263 - RNA, 18 nt, Mycobacterium avium subsp. paratuberculosis
cgguccaucuccagcucc

SEQ ID NO: 2904264 - RNA, 19 nt, Mycobacterium avium subsp. paratuberculosis
cgguccaucuccagcuccg

SEQ ID NO: 2904265 - RNA, 14 nt, Mycobacterium avium subsp. paratuberculosis
cgguccccgcgccc

SEQ ID NO: 2904266 - RNA, 18 nt, Mycobacterium avium subsp. paratuberculosis
cgguccccgcgcccgccg

SEQ ID NO: 2904267 - RNA, 18 nt, Mycobacterium avium subsp. paratuberculosis
cgguccccggagagccgg

SEQ ID NO: 2904268 - RNA, 15 nt, Mycobacterium avium subsp. paratuberculosis
cgguccccggcgacc

SEQ ID NO: 2904269 - RNA, 13 nt, Mycobacterium avium subsp. paratuberculosis
cggucccgacagg

SEQ ID NO: 2904270 - RNA, 13 nt, Mycobacterium avium subsp. paratuberculosis
cggucccgacgcg

SEQ ID NO: 2904271 - RNA, 17 nt, Mycobacterium avium subsp. paratuberculosis
cggucccgacgcggcgc

SEQ ID NO: 2904272 - RNA, 19 nt, Mycobacterium avium subsp. paratuberculosis
cggucccgacgcggcgcga

SEQ ID NO: 2904273 - RNA, 14 nt, Mycobacterium avium subsp. paratuberculosis
cggucccgacgcug

SEQ ID NO: 2904274 - RNA, 13 nt, Mycobacterium avium subsp. paratuberculosis
cggucccgcaugu

SEQ ID NO: 2904275 - RNA, 22 nt, Mycobacterium avium subsp. paratuberculosis
cggucccgcauguccgggguga

SEQ ID NO: 2904276 - RNA, 14 nt, Mycobacterium avium subsp. paratuberculosis
cggucccgcggcgg

SEQ ID NO: 2904277 - RNA, 16 nt, Mycobacterium avium subsp. paratuberculosis
cggucccgcggcggcg

SEQ ID NO: 2904278 - RNA, 13 nt, Mycobacterium avium subsp. paratuberculosis
cggucccgcguca

SEQ ID NO: 2904279 - RNA, 20 nt, Mycobacterium avium subsp. paratuberculosis
cggucccgcgucacauccgu

SEQ ID NO: 2904280 - RNA, 13 nt, Mycobacterium avium subsp. paratuberculosis
cggucccggcgga

SEQ ID NO: 2904281 - RNA, 19 nt, Mycobacterium avium subsp. paratuberculosis
cggucccggcggacccgga

SEQ ID NO: 2904282 - RNA, 13 nt, Mycobacterium avium subsp. paratuberculosis
cggucccggcggg

SEQ ID NO: 2904283 - RNA, 14 nt, Mycobacterium avium subsp. paratuberculosis
cggucccggcgggg

SEQ ID NO: 2904284 - RNA, 21 nt, Mycobacterium avium subsp. paratuberculosis
cggucccggcgggggcggcgg

SEQ ID NO: 2904285 - RNA, 20 nt, Mycobacterium avium subsp. paratuberculosis
cggucccggggcucgacagg

SEQ ID NO: 2904286 - RNA, 21 nt, Mycobacterium avium subsp. paratuberculosis
cggucccggggcucgacaggc

SEQ ID NO: 2904287 - RNA, 13 nt, Mycobacterium avium subsp. paratuberculosis
cggucccggucga

SEQ ID NO: 2904288 - RNA, 20 nt, Mycobacterium avium subsp. paratuberculosis
cggucccguccaucgccgcg

SEQ ID NO: 2904289 - RNA, 20 nt, Mycobacterium avium subsp. paratuberculosis
cggucccgugcgccgcccac

SEQ ID NO: 2904290 - RNA, 14 nt, Mycobacterium avium subsp. paratuberculosis
cgguccgaccagcg

SEQ ID NO: 2904291 - RNA, 16 nt, Mycobacterium avium subsp. paratuberculosis
cgguccgaccagcggc

SEQ ID NO: 2904292 - RNA, 18 nt, Mycobacterium avium subsp. paratuberculosis
cgguccgaccagcggccc

SEQ ID NO: 2904293 - RNA, 19 nt, Mycobacterium avium subsp. paratuberculosis
cgguccgaccagcggccca

SEQ ID NO: 2904294 - RNA, 22 nt, Mycobacterium avium subsp. paratuberculosis
cgggucucgaaccgggcgguga

SEQ ID NO: 2904295 - RNA, 17 nt, Mycobacterium avium subsp. paratuberculosis
cgggucucgcgccacca

SEQ ID NO: 2904296 - RNA, 14 nt, Mycobacterium avium subsp. paratuberculosis
cgggucugccacgc

SEQ ID NO: 2904297 - RNA, 15 nt, Mycobacterium avium subsp. paratuberculosis
cgggucugccacgcc

SEQ ID NO: 2904298 - RNA, 17 nt, Mycobacterium avium subsp. paratuberculosis
cgggucugccacgccca

SEQ ID NO: 2904299 - RNA, 18 nt, Mycobacterium avium subsp. paratuberculosis
cgggucugccacgcccac

SEQ ID NO: 2904300 - RNA, 14 nt, Mycobacterium avium subsp. paratuberculosis
cgggucuggcucgg

SEQ ID NO: 2904301 - RNA, 15 nt, Mycobacterium avium subsp. paratuberculosis
cgggucuggcucggc

SEQ ID NO: 2904302 - RNA, 21 nt, Mycobacterium avium subsp. paratuberculosis
cgggucuggcucggcaccaga

SEQ ID NO: 2904303 - RNA, 16 nt, Mycobacterium avium subsp. paratuberculosis
cgggucuuccacgccg

SEQ ID NO: 2904304 - RNA, 20 nt, Mycobacterium avium subsp. paratuberculosis
cgggugaacgaggccgcgcc

SEQ ID NO: 2904305 - RNA, 21 nt, Mycobacterium avium subsp. paratuberculosis
cgggugaacgaggccgcgccg

SEQ ID NO: 2904306 - RNA, 17 nt, Mycobacterium avium subsp. paratuberculosis
cgggugaaucgacaccg

SEQ ID NO: 2904307 - RNA, 18 nt, Mycobacterium avium subsp. paratuberculosis
cgggugaaucgacaccgc

SEQ ID NO: 2904308 - RNA, 22 nt, Mycobacterium avium subsp. paratuberculosis
cgggugacaacggugguggcga

SEQ ID NO: 2904309 - RNA, 21 nt, Mycobacterium avium subsp. paratuberculosis
cgggugaccgccuuggcgcgc

SEQ ID NO: 2904310 - RNA, 13 nt, Mycobacterium avium subsp. paratuberculosis
cgggugaccggcg

SEQ ID NO: 2904311 - RNA, 14 nt, Mycobacterium avium subsp. paratuberculosis
cgggugaccggcgc

SEQ ID NO: 2904312 - RNA, 15 nt, Mycobacterium avium subsp. paratuberculosis
cgggugaccggcgcc

SEQ ID NO: 2904313 - RNA, 17 nt, Mycobacterium avium subsp. paratuberculosis
cgggugaccggcgccgg

SEQ ID NO: 2904314 - RNA, 18 nt, Mycobacterium avium subsp. paratuberculosis
cgggugaccggcgcgcag

SEQ ID NO: 2904315 - RNA, 17 nt, Mycobacterium avium subsp. paratuberculosis
cgggugaccggcggcca

SEQ ID NO: 2904316 - RNA, 18 nt, Mycobacterium avium subsp. paratuberculosis
cgggugaccggcggccag

SEQ ID NO: 2904317 - RNA, 21 nt, Mycobacterium avium subsp. paratuberculosis
cgggugacgaccauggucagg

SEQ ID NO: 2904318 - RNA, 19 nt, Mycobacterium avium subsp. paratuberculosis
cgggugacgaucaccgcug

SEQ ID NO: 2904319 - RNA, 21 nt, Mycobacterium avium subsp. paratuberculosis
cgggugacgaucaccgcugcc

SEQ ID NO: 2904320 - RNA, 23 nt, Mycobacterium avium subsp. paratuberculosis
cgggugacgccucaggcgagcac

SEQ ID NO: 2904321 - RNA, 13 nt, Mycobacterium avium subsp. paratuberculosis
cgggugacgcuga

SEQ ID NO: 2904322 - RNA, 13 nt, Mycobacterium avium subsp. paratuberculosis
cgggugacggcag

SEQ ID NO: 2904323 - RNA, 19 nt, Mycobacterium avium subsp. paratuberculosis
cgggugagaaagucgaucu

SEQ ID NO: 2904324 - RNA, 15 nt, Mycobacterium avium subsp. paratuberculosis
cgggugagacggcca

SEQ ID NO: 2904325 - RNA, 17 nt, Mycobacterium avium subsp. paratuberculosis
cgggugagacggccagc

SEQ ID NO: 2904326 - RNA, 22 nt, Mycobacterium avium subsp. paratuberculosis
cgggugagacggccagcagcac

SEQ ID NO: 2904327 - RNA, 16 nt, Mycobacterium avium subsp. paratuberculosis
cgggugagccggucga

SEQ ID NO: 2904328 - RNA, 21 nt, Mycobacterium avium subsp. paratuberculosis
cgggugagccggucgaacgcc

SEQ ID NO: 2904329 - RNA, 13 nt, Mycobacterium avium subsp. paratuberculosis
cgggugaggacgc

SEQ ID NO: 2904330 - RNA, 18 nt, Mycobacterium avium subsp. paratuberculosis
cgggugaggacgcccggc

SEQ ID NO: 2904331 - RNA, 19 nt, Mycobacterium avium subsp. paratuberculosis
cgggugaggacgcccggcg

SEQ ID NO: 2904332 - RNA, 14 nt, Mycobacterium avium subsp. paratuberculosis
cgggugaggccagg

SEQ ID NO: 2904333 - RNA, 18 nt, Mycobacterium avium subsp. paratuberculosis
cgggugaguaguccagca

SEQ ID NO: 2904334 - RNA, 20 nt, Mycobacterium avium subsp. paratuberculosis
cgggugaguaguccagcacc

SEQ ID NO: 2904335 - RNA, 15 nt, Mycobacterium avium subsp. paratuberculosis
cgggugauaccggcc

SEQ ID NO: 2904336 - RNA, 23 nt, Mycobacterium avium subsp. paratuberculosis
cgggugauaccggcccagcgcgg

SEQ ID NO: 2904337 - RNA, 14 nt, Mycobacterium avium subsp. paratuberculosis
cgggugaucaacgc

SEQ ID NO: 2904338 - RNA, 16 nt, Mycobacterium avium subsp. paratuberculosis
cgggugauccagcccu

SEQ ID NO: 2904339 - RNA, 17 nt, Mycobacterium avium subsp. paratuberculosis
cgggugauccagcccug

SEQ ID NO: 2904340 - RNA, 13 nt, Mycobacterium avium subsp. paratuberculosis
cgggugaucccga

SEQ ID NO: 2904341 - RNA, 21 nt, Mycobacterium avium subsp. paratuberculosis
cgggugaucccgaugccgcgc

SEQ ID NO: 2904342 - RNA, 15 nt, Mycobacterium avium subsp. paratuberculosis
cgggugauccggugc

SEQ ID NO: 2904343 - RNA, 22 nt, Mycobacterium avium subsp. paratuberculosis
cgggugaucuuggccuccaccg

SEQ ID NO: 2904344 - RNA, 14 nt, Mycobacterium avium subsp. paratuberculosis
cgggugauggccgc

SEQ ID NO: 2904345 - RNA, 15 nt, Mycobacterium avium subsp. paratuberculosis
cgggugauggccgcc

SEQ ID NO: 2904346 - RNA, 16 nt, Mycobacterium avium subsp. paratuberculosis
cgggugauggccgccg

SEQ ID NO: 2904347 - RNA, 17 nt, Mycobacterium avium subsp. paratuberculosis
cgggugauggccgccgc

SEQ ID NO: 2904348 - RNA, 16 nt, Mycobacterium avium subsp. paratuberculosis
cgggugaugucgccga

SEQ ID NO: 2904349 - RNA, 18 nt, Mycobacterium avium subsp. paratuberculosis
cgggugaugucgccgacc

SEQ ID NO: 2904350 - RNA, 19 nt, Mycobacterium avium subsp. paratuberculosis
cgggugaugucgccgacca

SEQ ID NO: 2904351 - RNA, 17 nt, Mycobacterium avium subsp. paratuberculosis
cgggugauuucggcuug

SEQ ID NO: 2904352 - RNA, 18 nt, Mycobacterium avium subsp. paratuberculosis
cgggugcaggcccagcug

SEQ ID NO: 2904353 - RNA, 13 nt, Mycobacterium avium subsp. paratuberculosis
cgggugcccgcgu

SEQ ID NO: 2904354 - RNA, 17 nt, Mycobacterium avium subsp. paratuberculosis
cgggugcccggcugggc

SEQ ID NO: 2904355 - RNA, 19 nt, Mycobacterium avium subsp. paratuberculosis
cgggugcccggcugggcgc

SEQ ID NO: 2904356 - RNA, 21 nt, Mycobacterium avium subsp. paratuberculosis
cgggugcccggcugggcgcgc

SEQ ID NO: 2904357 - RNA, 21 nt, Mycobacterium avium subsp. paratuberculosis
cgggugccgaacacguacagc

SEQ ID NO: 2904358 - RNA, 22 nt, Mycobacterium avium subsp. paratuberculosis
cgggugcgacggcaauccggcc

SEQ ID NO: 2904359 - RNA, 20 nt, Mycobacterium avium subsp. paratuberculosis
cgggugcgauggcaacgccg

SEQ ID NO: 2904360 - RNA, 21 nt, Mycobacterium avium subsp. paratuberculosis
cgggugcgauggcaacgccgg

SEQ ID NO: 2904361 - RNA, 16 nt, Mycobacterium avium subsp. paratuberculosis
cgggugcgcgucgcgg

SEQ ID NO: 2904362 - RNA, 16 nt, Mycobacterium avium subsp. paratuberculosis
cgggugcgcucgacgg

SEQ ID NO: 2904363 - RNA, 17 nt, Mycobacterium avium subsp. paratuberculosis
cgggugcgcucgacggc

SEQ ID NO: 2904364 - RNA, 20 nt, Mycobacterium avium subsp. paratuberculosis
cgggugcgcucgacggccug

SEQ ID NO: 2904365 - RNA, 16 nt, Mycobacterium avium subsp. paratuberculosis
cgggugcgcugcagcg

SEQ ID NO: 2904366 - RNA, 21 nt, Mycobacterium avium subsp. paratuberculosis
cgggugcgcuugucggcgugg

SEQ ID NO: 2904367 - RNA, 13 nt, Mycobacterium avium subsp. paratuberculosis
cgggugcggcacg

SEQ ID NO: 2904368 - RNA, 16 nt, Mycobacterium avium subsp. paratuberculosis
cgggugcggcacggca

SEQ ID NO: 2904369 - RNA, 15 nt, Mycobacterium avium subsp. paratuberculosis
cgggugcggccagcg

SEQ ID NO: 2904370 - RNA, 13 nt, Mycobacterium avium subsp. paratuberculosis
cgggugcggccgg

SEQ ID NO: 2904371 - RNA, 13 nt, Mycobacterium avium subsp. paratuberculosis
cgggugcggcgcu

SEQ ID NO: 2904372 - RNA, 15 nt, Mycobacterium avium subsp. paratuberculosis
cgggugcggcgcucg

SEQ ID NO: 2904373 - RNA, 14 nt, Mycobacterium avium subsp. paratuberculosis
cgggugcggcgcug

SEQ ID NO: 2904374 - RNA, 16 nt, Mycobacterium avium subsp. paratuberculosis
cgggugcggcgcugcc

SEQ ID NO: 2904375 - RNA, 17 nt, Mycobacterium avium subsp. paratuberculosis
cgggugcggcgcugccg

SEQ ID NO: 2904376 - RNA, 18 nt, Mycobacterium avium subsp. paratuberculosis
cgggugcggcgcugccgg

SEQ ID NO: 2904377 - RNA, 16 nt, Mycobacterium avium subsp. paratuberculosis
cgggugcggcgguguu

SEQ ID NO: 2904378 - RNA, 14 nt, Mycobacterium avium subsp. paratuberculosis
cgggugcggcgugc

SEQ ID NO: 2904379 - RNA, 22 nt, Mycobacterium avium subsp. paratuberculosis
cgggugcggcgugcggucgcgg

SEQ ID NO: 2904380 - RNA, 22 nt, Mycobacterium avium subsp. paratuberculosis
cgggugcgggccagcagccgcg

SEQ ID NO: 2904381 - RNA, 23 nt, Mycobacterium avium subsp. paratuberculosis
cgggugcgggccagcagccgcgc

SEQ ID NO: 2904382 - RNA, 13 nt, Mycobacterium avium subsp. paratuberculosis
cgggugcgggugc

SEQ ID NO: 2904383 - RNA, 15 nt, Mycobacterium avium subsp. paratuberculosis
cgggugcggugcagc

SEQ ID NO: 2904384 - RNA, 22 nt, Mycobacterium avium subsp. paratuberculosis
cgggugcggugcagccgcgguc

SEQ ID NO: 2904385 - RNA, 20 nt, Mycobacterium avium subsp. paratuberculosis
cgggugcguccagaccggcc

SEQ ID NO: 2904386 - RNA, 22 nt, Mycobacterium avium subsp. paratuberculosis
cgggugcguccagaccggccgg

SEQ ID NO: 2904387 - RNA, 14 nt, Mycobacterium avium subsp. paratuberculosis
cgggugcugaacgc

SEQ ID NO: 2904388 - RNA, 20 nt, Mycobacterium avium subsp. paratuberculosis
cgggugcugaacgccugccg

SEQ ID NO: 2904389 - RNA, 12 nt, Mycobacterium avium subsp. paratuberculosis
cgggugcugggc

SEQ ID NO: 2904390 - RNA, 16 nt, Mycobacterium avium subsp. paratuberculosis
cgggugcuggucagca

SEQ ID NO: 2904391 - RNA, 22 nt, Mycobacterium avium subsp. paratuberculosis
cgggugcuuucgcgucugcucg

SEQ ID NO: 2904392 - RNA, 21 nt, Mycobacterium avium subsp. paratuberculosis
cggguggaacuggacgccgug

SEQ ID NO: 2904393 - RNA, 23 nt, Mycobacterium avium subsp. paratuberculosis
cggguggaacuggacgccgugga

SEQ ID NO: 2904394 - RNA, 16 nt, Mycobacterium avium subsp. paratuberculosis
cggguggacaccgcga

SEQ ID NO: 2904395 - RNA, 18 nt, Mycobacterium avium subsp. paratuberculosis
cggguggacaccgcgauc

SEQ ID NO: 2904396 - RNA, 20 nt, Mycobacterium avium subsp. paratuberculosis
cggguggacaccgcgaucac

SEQ ID NO: 2904397 - RNA, 22 nt, Mycobacterium avium subsp. paratuberculosis
cggguggacaccgcgaucacca

SEQ ID NO: 2904398 - RNA, 17 nt, Mycobacterium avium subsp. paratuberculosis
cggguggacgcccgcga

SEQ ID NO: 2904399 - RNA, 20 nt, Mycobacterium avium subsp. paratuberculosis
cggguggaucuugacggcga

SEQ ID NO: 2904400 - RNA, 21 nt, Mycobacterium avium subsp. paratuberculosis
cggguggaucuugacggcgac

SEQ ID NO: 2904401 - RNA, 13 nt, Mycobacterium avium subsp. paratuberculosis
cggguggccagca

SEQ ID NO: 2904402 - RNA, 14 nt, Mycobacterium avium subsp. paratuberculosis
cggguggccagcac

SEQ ID NO: 2904403 - RNA, 15 nt, Mycobacterium avium subsp. paratuberculosis
cggguggccagcacc

SEQ ID NO: 2904404 - RNA, 17 nt, Mycobacterium avium subsp. paratuberculosis
cggguggccagcaccag

SEQ ID NO: 2904405 - RNA, 19 nt, Mycobacterium avium subsp. paratuberculosis
cggguggccagcaccagcc

SEQ ID NO: 2904406 - RNA, 14 nt, Mycobacterium avium subsp. paratuberculosis
cggguggccagcca

SEQ ID NO: 2904407 - RNA, 14 nt, Mycobacterium avium subsp. paratuberculosis
cggguggcccgcac

SEQ ID NO: 2904408 - RNA, 20 nt, Mycobacterium avium subsp. paratuberculosis
cggguggcccgcccgggcac

SEQ ID NO: 2904409 - RNA, 14 nt, Mycobacterium avium subsp. paratuberculosis
cggguggcccgcgc

SEQ ID NO: 2904410 - RNA, 13 nt, Mycobacterium avium subsp. paratuberculosis
cggguggccgcca

SEQ ID NO: 2904411 - RNA, 16 nt, Mycobacterium avium subsp. paratuberculosis
cggguggccgccacgu

SEQ ID NO: 2904412 - RNA, 12 nt, Mycobacterium avium subsp. paratuberculosis
cggguggccggg

SEQ ID NO: 2904413 - RNA, 14 nt, Mycobacterium avium subsp. paratuberculosis
cggguggccggguc

SEQ ID NO: 2904414 - RNA, 19 nt, Mycobacterium avium subsp. paratuberculosis
cggguggccgggucgccgu

SEQ ID NO: 2904415 - RNA, 20 nt, Mycobacterium avium subsp. paratuberculosis
cggguggccgggucgccguc

SEQ ID NO: 2904416 - RNA, 13 nt, Mycobacterium avium subsp. paratuberculosis
cggguggccuccg

SEQ ID NO: 2904417 - RNA, 18 nt, Mycobacterium avium subsp. paratuberculosis
cggguggccuucaucacc

SEQ ID NO: 2904418 - RNA, 20 nt, Mycobacterium avium subsp. paratuberculosis
cggguggccuucaucaccgc

SEQ ID NO: 2904419 - RNA, 21 nt, Mycobacterium avium subsp. paratuberculosis
cggguggccuucaucaccgcc

SEQ ID NO: 2904420 - RNA, 15 nt, Mycobacterium avium subsp. paratuberculosis
cggguggcgccacag

SEQ ID NO: 2904421 - RNA, 13 nt, Mycobacterium avium subsp. paratuberculosis
cggguggcggccg

SEQ ID NO: 2904422 - RNA, 14 nt, Mycobacterium avium subsp. paratuberculosis
cggguggcggccgg

SEQ ID NO: 2904423 - RNA, 16 nt, Mycobacterium avium subsp. paratuberculosis
cggguggcggccgggg

SEQ ID NO: 2904424 - RNA, 14 nt, Mycobacterium avium subsp. paratuberculosis
cggguggcggggcg

SEQ ID NO: 2904425 - RNA, 13 nt, Mycobacterium avium subsp. paratuberculosis
cggguggcgucgc

SEQ ID NO: 2904426 - RNA, 14 nt, Mycobacterium avium subsp. paratuberculosis
cggguggcgucgcc

SEQ ID NO: 2904427 - RNA, 15 nt, Mycobacterium avium subsp. paratuberculosis
cggguggcgucgccg

SEQ ID NO: 2904428 - RNA, 16 nt, Mycobacterium avium subsp. paratuberculosis
cggguggcgucgccgc

SEQ ID NO: 2904429 - RNA, 19 nt, Mycobacterium avium subsp. paratuberculosis
cggguggcgucgccgccgg

SEQ ID NO: 2904430 - RNA, 15 nt, Mycobacterium avium subsp. paratuberculosis
cgggugggcagcgcg

SEQ ID NO: 2904431 - RNA, 16 nt, Mycobacterium avium subsp. paratuberculosis
cgggugggcagcgcga

SEQ ID NO: 2904432 - RNA, 23 nt, Mycobacterium avium subsp. paratuberculosis
cgggugggcagcgcgauccgcgc

SEQ ID NO: 2904433 - RNA, 15 nt, Mycobacterium avium subsp. paratuberculosis
cgggugggccgaccu

SEQ ID NO: 2904434 - RNA, 14 nt, Mycobacterium avium subsp. paratuberculosis
cgggugggcggcac

SEQ ID NO: 2904435 - RNA, 16 nt, Mycobacterium avium subsp. paratuberculosis
cgggugggcggcacac

SEQ ID NO: 2904436 - RNA, 21 nt, Mycobacterium avium subsp. paratuberculosis
cggguggggaagacgugcacg

SEQ ID NO: 2904437 - RNA, 16 nt, Mycobacterium avium subsp. paratuberculosis
cgggugguccacccag

SEQ ID NO: 2904438 - RNA, 18 nt, Mycobacterium avium subsp. paratuberculosis
cgggugguguggcgucgg

SEQ ID NO: 2904439 - RNA, 19 nt, Mycobacterium avium subsp. paratuberculosis
cgggugguguggcgucggc

SEQ ID NO: 2904440 - RNA, 20 nt, Mycobacterium avium subsp. paratuberculosis
cgggugguguggcgucggcc

SEQ ID NO: 2904441 - RNA, 21 nt, Mycobacterium avium subsp. paratuberculosis
cgggugguguggcgucggccg

SEQ ID NO: 2904442 - RNA, 19 nt, Mycobacterium avium subsp. paratuberculosis
cggguguauucgcccaccc

SEQ ID NO: 2904443 - RNA, 22 nt, Mycobacterium avium subsp. paratuberculosis
cggguguauucgcccaccccgg

SEQ ID NO: 2904444 - RNA, 17 nt, Mycobacterium avium subsp. paratuberculosis
cgggugucaggucggcg

SEQ ID NO: 2904445 - RNA, 20 nt, Mycobacterium avium subsp. paratuberculosis
cgggugucaggucggcgaug

SEQ ID NO: 2904446 - RNA, 14 nt, Mycobacterium avium subsp. paratuberculosis
cggguguccgagcg

SEQ ID NO: 2904447 - RNA, 19 nt, Mycobacterium avium subsp. paratuberculosis
cggguguccgagcgggccg

SEQ ID NO: 2904448 - RNA, 13 nt, Mycobacterium avium subsp. paratuberculosis
cgggugucgacgc

SEQ ID NO: 2904449 - RNA, 13 nt, Mycobacterium avium subsp. paratuberculosis
cgggugucgcccu

SEQ ID NO: 2904450 - RNA, 13 nt, Mycobacterium avium subsp. paratuberculosis
cgggugucgccga

SEQ ID NO: 2904451 - RNA, 14 nt, Mycobacterium avium subsp. paratuberculosis
cgggugucgccgag

SEQ ID NO: 2904452 - RNA, 15 nt, Mycobacterium avium subsp. paratuberculosis
cgggugucgccgagc

SEQ ID NO: 2904453 - RNA, 13 nt, Mycobacterium avium subsp. paratuberculosis
cgggugucgccgg

SEQ ID NO: 2904454 - RNA, 13 nt, Mycobacterium avium subsp. paratuberculosis
cgggugugacauc

SEQ ID NO: 2904455 - RNA, 15 nt, Mycobacterium avium subsp. paratuberculosis
cggguguggcgccgu

SEQ ID NO: 2904456 - RNA, 15 nt, Mycobacterium avium subsp. paratuberculosis
cgggugugggcgccg

SEQ ID NO: 2904457 - RNA, 15 nt, Mycobacterium avium subsp. paratuberculosis
cggguguggugccgg

SEQ ID NO: 2904458 - RNA, 18 nt, Mycobacterium avium subsp. paratuberculosis
cggguguggugccggguc

SEQ ID NO: 2904459 - RNA, 19 nt, Mycobacterium avium subsp. paratuberculosis
cggguguggugccgggucg

SEQ ID NO: 2904460 - RNA, 15 nt, Mycobacterium avium subsp. paratuberculosis
cggguguucagcccc

SEQ ID NO: 2904461 - RNA, 19 nt, Mycobacterium avium subsp. paratuberculosis
cggguguugaccuugucga

SEQ ID NO: 2904462 - RNA, 22 nt, Mycobacterium avium subsp. paratuberculosis
cggguguugaccuugucgaagg

SEQ ID NO: 2904463 - RNA, 15 nt, Mycobacterium avium subsp. paratuberculosis
cggguguugcgcagc

SEQ ID NO: 2904464 - RNA, 16 nt, Mycobacterium avium subsp. paratuberculosis
cggguguugcgcagcg

SEQ ID NO: 2904465 - RNA, 20 nt, Mycobacterium avium subsp. paratuberculosis
cggguguugcggcagggcca

SEQ ID NO: 2904466 - RNA, 15 nt, Mycobacterium avium subsp. paratuberculosis
cggguguuggagccg

SEQ ID NO: 2904467 - RNA, 22 nt, Mycobacterium avium subsp. paratuberculosis
cggguguuucggucggcgucga

SEQ ID NO: 2904468 - RNA, 23 nt, Mycobacterium avium subsp. paratuberculosis
cggguuacguggacgcgcgcggc

SEQ ID NO: 2904469 - RNA, 18 nt, Mycobacterium avium subsp. paratuberculosis
cggguucacccuggcgaa

SEQ ID NO: 2904470 - RNA, 20 nt, Mycobacterium avium subsp. paratuberculosis
cggguuccgguuggccaggu

SEQ ID NO: 2904471 - RNA, 17 nt, Mycobacterium avium subsp. paratuberculosis
cggguucgacgccucgg

SEQ ID NO: 2904472 - RNA, 19 nt, Mycobacterium avium subsp. paratuberculosis
cggguucgacgccucggug

SEQ ID NO: 2904473 - RNA, 22 nt, Mycobacterium avium subsp. paratuberculosis
cggguucgacgccucggugcgg

SEQ ID NO: 2904474 - RNA, 22 nt, Mycobacterium avium subsp. paratuberculosis
cggguucgcccuccccggccag

SEQ ID NO: 2904475 - RNA, 23 nt, Mycobacterium avium subsp. paratuberculosis
cggguucgccggugaccgcgccg

SEQ ID NO: 2904476 - RNA, 16 nt, Mycobacterium avium subsp. paratuberculosis
cggguucgcgcagcca

SEQ ID NO: 2904477 - RNA, 21 nt, Mycobacterium avium subsp. paratuberculosis
cggguucgcgcagccaccgcc

SEQ ID NO: 2904478 - RNA, 19 nt, Mycobacterium avium subsp. paratuberculosis
cggguucggucucggcggc

SEQ ID NO: 2904479 - RNA, 23 nt, Mycobacterium avium subsp. paratuberculosis
cggguucugauacaccacccggu

SEQ ID NO: 2904480 - RNA, 20 nt, Mycobacterium avium subsp. paratuberculosis
cggguucuucagggcggugc

SEQ ID NO: 2904481 - RNA, 22 nt, Mycobacterium avium subsp. paratuberculosis
cggguucuucagggcggugcgg

SEQ ID NO: 2904482 - RNA, 23 nt, Mycobacterium avium subsp. paratuberculosis
cggguucuucagggcggugcggu

SEQ ID NO: 2904483 - RNA, 16 nt, Mycobacterium avium subsp. paratuberculosis
cggguugagcagguca

SEQ ID NO: 2904484 - RNA, 16 nt, Mycobacterium avium subsp. paratuberculosis
cggguugcacaggucg

SEQ ID NO: 2904485 - RNA, 17 nt, Mycobacterium avium subsp. paratuberculosis
cggguugcaggccacgc

SEQ ID NO: 2904486 - RNA, 13 nt, Mycobacterium avium subsp. paratuberculosis
cggguugcaggcg

SEQ ID NO: 2904487 - RNA, 13 nt, Mycobacterium avium subsp. paratuberculosis
cggguugccggcg

SEQ ID NO: 2904488 - RNA, 17 nt, Mycobacterium avium subsp. paratuberculosis
cggguugccggcggcca

SEQ ID NO: 2904489 - RNA, 16 nt, Mycobacterium avium subsp. paratuberculosis
cggguugccgucgacg

SEQ ID NO: 2904490 - RNA, 17 nt, Mycobacterium avium subsp. paratuberculosis
cggguugccgucgacga

SEQ ID NO: 2904491 - RNA, 18 nt, Mycobacterium avium subsp. paratuberculosis
cggguugcgaaagcccag

SEQ ID NO: 2904492 - RNA, 20 nt, Mycobacterium avium subsp. paratuberculosis
cggguugcgaaagcccaggc

SEQ ID NO: 2904493 - RNA, 22 nt, Mycobacterium avium subsp. paratuberculosis
cggguugcgaaagcccaggccc

SEQ ID NO: 2904494 - RNA, 23 nt, Mycobacterium avium subsp. paratuberculosis
cggguugcggaucggugcaggcc

SEQ ID NO: 2904495 - RNA, 20 nt, Mycobacterium avium subsp. paratuberculosis
cggguugcgggccaggcacg

SEQ ID NO: 2904496 - RNA, 14 nt, Mycobacterium avium subsp. paratuberculosis
cggguugcgguccc

SEQ ID NO: 2904497 - RNA, 18 nt, Mycobacterium avium subsp. paratuberculosis
cggguugcgguccccgga

SEQ ID NO: 2904498 - RNA, 15 nt, Mycobacterium avium subsp. paratuberculosis
cggguuggccagggc

SEQ ID NO: 2904499 - RNA, 15 nt, Mycobacterium avium subsp. paratuberculosis
cggguuggccgucga

SEQ ID NO: 2904500 - RNA, 17 nt, Mycobacterium avium subsp. paratuberculosis
cggguuggcgcgcacca

SEQ ID NO: 2904501 - RNA, 22 nt, Mycobacterium avium subsp. paratuberculosis
cggguuggcgcgcaccagcucg

SEQ ID NO: 2904502 - RNA, 18 nt, Mycobacterium avium subsp. paratuberculosis
cggguugggcgccagcag

SEQ ID NO: 2904503 - RNA, 19 nt, Mycobacterium avium subsp. paratuberculosis
cggguugggcgccagcagc

SEQ ID NO: 2904504 - RNA, 21 nt, Mycobacterium avium subsp. paratuberculosis
cggguugggcgccagcagcac

SEQ ID NO: 2904505 - RNA, 21 nt, Mycobacterium avium subsp. paratuberculosis
cggguugggcgccugcgguga

SEQ ID NO: 2904506 - RNA, 21 nt, Mycobacterium avium subsp. paratuberculosis
cggguugggcggcggccaccu

SEQ ID NO: 2904507 - RNA, 17 nt, Mycobacterium avium subsp. paratuberculosis
cggguuggggccgcgga

SEQ ID NO: 2904508 - RNA, 19 nt, Mycobacterium avium subsp. paratuberculosis
cggguuggucccgaucacc

SEQ ID NO: 2904509 - RNA, 14 nt, Mycobacterium avium subsp. paratuberculosis
cggguuggucggcg

SEQ ID NO: 2904510 - RNA, 16 nt, Mycobacterium avium subsp. paratuberculosis
cggguuggucggcgcg

SEQ ID NO: 2904511 - RNA, 14 nt, Mycobacterium avium subsp. paratuberculosis
cggguugucgacgu

SEQ ID NO: 2904512 - RNA, 14 nt, Mycobacterium avium subsp. paratuberculosis
cggguugucgucgu

SEQ ID NO: 2904513 - RNA, 19 nt, Mycobacterium avium subsp. paratuberculosis
cggguugucgucgucggcg

SEQ ID NO: 2904514 - RNA, 22 nt, Mycobacterium avium subsp. paratuberculosis
cggguuguucuccagcggccgc

SEQ ID NO: 2904515 - RNA, 19 nt, Mycobacterium avium subsp. paratuberculosis
cggguuguuguccgaccag

SEQ ID NO: 2904516 - RNA, 17 nt, Mycobacterium avium subsp. paratuberculosis
cggguuuggccgcgggc

SEQ ID NO: 2904517 - RNA, 18 nt, Mycobacterium avium subsp. paratuberculosis
cggguuuggccgcgggcg

SEQ ID NO: 2904518 - RNA, 15 nt, Mycobacterium avium subsp. paratuberculosis
cggguuuguccggcc

SEQ ID NO: 2904519 - RNA, 16 nt, Mycobacterium avium subsp. paratuberculosis
cggguuuguccggcca

SEQ ID NO: 2904520 - RNA, 18 nt, Mycobacterium avium subsp. paratuberculosis
cggguuuguccggccagg

SEQ ID NO: 2904521 - RNA, 15 nt, Mycobacterium avium subsp. paratuberculosis
cggguuuguccggcu

SEQ ID NO: 2904522 - RNA, 18 nt, Mycobacterium avium subsp. paratuberculosis
cgguaaagucuucggcga

SEQ ID NO: 2904523 - RNA, 12 nt, Mycobacterium avium subsp. paratuberculosis
cgguaauccggc

SEQ ID NO: 2904524 - RNA, 13 nt, Mycobacterium avium subsp. paratuberculosis
cgguaauccggcc

SEQ ID NO: 2904525 - RNA, 15 nt, Mycobacterium avium subsp. paratuberculosis
cgguaaucggcggug

SEQ ID NO: 2904526 - RNA, 21 nt, Mycobacterium avium subsp. paratuberculosis
cgguacagcgacuccagcgcg

SEQ ID NO: 2904527 - RNA, 20 nt, Mycobacterium avium subsp. paratuberculosis
cgguacagcgccgcggccag

SEQ ID NO: 2904528 - RNA, 23 nt, Mycobacterium avium subsp. paratuberculosis
cgguacagcgccgcggccagccg

SEQ ID NO: 2904529 - RNA, 18 nt, Mycobacterium avium subsp. paratuberculosis
cgguacaggccccacgcg

SEQ ID NO: 2904530 - RNA, 22 nt, Mycobacterium avium subsp. paratuberculosis
cgguacaggucgcugcccggcg

SEQ ID NO: 2904531 - RNA, 16 nt, Mycobacterium avium subsp. paratuberculosis
cgguacaucccgccgg

SEQ ID NO: 2904532 - RNA, 20 nt, Mycobacterium avium subsp. paratuberculosis
cgguacaucccgccgggcau

SEQ ID NO: 2904533 - RNA, 21 nt, Mycobacterium avium subsp. paratuberculosis
cgguacaucccgccgggcauc

SEQ ID NO: 2904534 - RNA, 20 nt, Mycobacterium avium subsp. paratuberculosis
cgguacaucgacgcgaccgg

SEQ ID NO: 2904535 - RNA, 21 nt, Mycobacterium avium subsp. paratuberculosis
cgguacaucgacgcgaccggc

SEQ ID NO: 2904536 - RNA, 22 nt, Mycobacterium avium subsp. paratuberculosis
cgguacaucgacgcgaccggcc

SEQ ID NO: 2904537 - RNA, 19 nt, Mycobacterium avium subsp. paratuberculosis
cgguaccagggcagcgccu

SEQ ID NO: 2904538 - RNA, 20 nt, Mycobacterium avium subsp. paratuberculosis
cgguacccccgccggggccg

SEQ ID NO: 2904539 - RNA, 21 nt, Mycobacterium avium subsp. paratuberculosis
cgguacccccgccggggccgg

SEQ ID NO: 2904540 - RNA, 14 nt, Mycobacterium avium subsp. paratuberculosis
cgguaccgaugacc

SEQ ID NO: 2904541 - RNA, 14 nt, Mycobacterium avium subsp. paratuberculosis
cgguaccgccgauc

SEQ ID NO: 2904542 - RNA, 13 nt, Mycobacterium avium subsp. paratuberculosis
cgguaccgccggc

SEQ ID NO: 2904543 - RNA, 14 nt, Mycobacterium avium subsp. paratuberculosis
cgguaccgccggcc

SEQ ID NO: 2904544 - RNA, 18 nt, Mycobacterium avium subsp. paratuberculosis
cgguaccgccggccaggc

SEQ ID NO: 2904545 - RNA, 20 nt, Mycobacterium avium subsp. paratuberculosis
cgguaccgccggccaggcga

SEQ ID NO: 2904546 - RNA, 22 nt, Mycobacterium avium subsp. paratuberculosis
cgguaccgccggccaggcgacu

SEQ ID NO: 2904547 - RNA, 17 nt, Mycobacterium avium subsp. paratuberculosis
cgguacgcgcaauccug

SEQ ID NO: 2904548 - RNA, 21 nt, Mycobacterium avium subsp. paratuberculosis
cgggccaccacaguggccgcc

SEQ ID NO: 2904549 - RNA, 13 nt, Mycobacterium avium subsp. paratuberculosis
cgggccaccacca

SEQ ID NO: 2904550 - RNA, 17 nt, Mycobacterium avium subsp. paratuberculosis
cgggccaccaccacggc

SEQ ID NO: 2904551 - RNA, 23 nt, Mycobacterium avium subsp. paratuberculosis
cgggccaccaccacggccgccga

SEQ ID NO: 2904552 - RNA, 13 nt, Mycobacterium avium subsp. paratuberculosis
cgggccaccagcg

SEQ ID NO: 2904553 - RNA, 18 nt, Mycobacterium avium subsp. paratuberculosis
cgggccaccagcgcaggu

SEQ ID NO: 2904554 - RNA, 18 nt, Mycobacterium avium subsp. paratuberculosis
cgggccacccgcgaucgg

SEQ ID NO: 2904555 - RNA, 15 nt, Mycobacterium avium subsp. paratuberculosis
cgggccaccgcggcg

SEQ ID NO: 2904556 - RNA, 22 nt, Mycobacterium avium subsp. paratuberculosis
cgggccaccgcggcguugcccg

SEQ ID NO: 2904557 - RNA, 16 nt, Mycobacterium avium subsp. paratuberculosis
cgggccaccggcgcca

SEQ ID NO: 2904558 - RNA, 17 nt, Mycobacterium avium subsp. paratuberculosis
cgggccaccgucccggu

SEQ ID NO: 2904559 - RNA, 22 nt, Mycobacterium avium subsp. paratuberculosis
cgggccaccgucccggugucgc

SEQ ID NO: 2904560 - RNA, 14 nt, Mycobacterium avium subsp. paratuberculosis
cgggccaccgucuu

SEQ ID NO: 2904561 - RNA, 17 nt, Mycobacterium avium subsp. paratuberculosis
cgggccacgcagucguc

SEQ ID NO: 2904562 - RNA, 19 nt, Mycobacterium avium subsp. paratuberculosis
cgggccacgcagucgucga

SEQ ID NO: 2904563 - RNA, 21 nt, Mycobacterium avium subsp. paratuberculosis
cgggccacgcagucgucgaug

SEQ ID NO: 2904564 - RNA, 23 nt, Mycobacterium avium subsp. paratuberculosis
cgggccagacugcgcaccgccag

SEQ ID NO: 2904565 - RNA, 18 nt, Mycobacterium avium subsp. paratuberculosis
cgggccagauggucgagg

SEQ ID NO: 2904566 - RNA, 15 nt, Mycobacterium avium subsp. paratuberculosis
cgggccagcaacagc

SEQ ID NO: 2904567 - RNA, 22 nt, Mycobacterium avium subsp. paratuberculosis
cgggccagcaacagcagcggca

SEQ ID NO: 2904568 - RNA, 24 nt, Mycobacterium avium subsp. paratuberculosis
cgggccagcaacagcagcggcaug

SEQ ID NO: 2904569 - RNA, 13 nt, Mycobacterium avium subsp. paratuberculosis
cgggccagcacga

SEQ ID NO: 2904570 - RNA, 16 nt, Mycobacterium avium subsp. paratuberculosis
cgggccagcacgaccc

SEQ ID NO: 2904571 - RNA, 13 nt, Mycobacterium avium subsp. paratuberculosis
cgggccagcagca

SEQ ID NO: 2904572 - RNA, 15 nt, Mycobacterium avium subsp. paratuberculosis
cgggccagcagcagc

SEQ ID NO: 2904573 - RNA, 17 nt, Mycobacterium avium subsp. paratuberculosis
cgggccagcagccgcgc

SEQ ID NO: 2904574 - RNA, 18 nt, Mycobacterium avium subsp. paratuberculosis
cgggccagcagccgcgcg

SEQ ID NO: 2904575 - RNA, 21 nt, Mycobacterium avium subsp. paratuberculosis
cgggccagcagccgcgcgagc

SEQ ID NO: 2904576 - RNA, 23 nt, Mycobacterium avium subsp. paratuberculosis
cgggccagcagccgcgcgagcau

SEQ ID NO: 2904577 - RNA, 22 nt, Mycobacterium avium subsp. paratuberculosis
cgggccagcagcuugacgucgg

SEQ ID NO: 2904578 - RNA, 21 nt, Mycobacterium avium subsp. paratuberculosis
cgggccagcaguucguccacg

SEQ ID NO: 2904579 - RNA, 12 nt, Mycobacterium avium subsp. paratuberculosis
cgggccagccca

SEQ ID NO: 2904580 - RNA, 14 nt, Mycobacterium avium subsp. paratuberculosis
cgggccagccggcc

SEQ ID NO: 2904581 - RNA, 15 nt, Mycobacterium avium subsp. paratuberculosis
cgggccagccguugu

SEQ ID NO: 2904582 - RNA, 15 nt, Mycobacterium avium subsp. paratuberculosis
cgggccagcgcaucg

SEQ ID NO: 2904583 - RNA, 16 nt, Mycobacterium avium subsp. paratuberculosis
cgggccagcgcaucgg

SEQ ID NO: 2904584 - RNA, 16 nt, Mycobacterium avium subsp. paratuberculosis
cgggccagcgccgagc

SEQ ID NO: 2904585 - RNA, 17 nt, Mycobacterium avium subsp. paratuberculosis
cgggccagcgccgagcc

SEQ ID NO: 2904586 - RNA, 17 nt, Mycobacterium avium subsp. paratuberculosis
cgggccagcgccuucgg

SEQ ID NO: 2904587 - RNA, 21 nt, Mycobacterium avium subsp. paratuberculosis
cgggccagcgccuucggcgcc

SEQ ID NO: 2904588 - RNA, 23 nt, Mycobacterium avium subsp. paratuberculosis
cgggccagcguuuccagcgccgg

SEQ ID NO: 2904589 - RNA, 19 nt, Mycobacterium avium subsp. paratuberculosis
cgggccagcucgaacaccg

SEQ ID NO: 2904590 - RNA, 22 nt, Mycobacterium avium subsp. paratuberculosis
cgggccagcucgaacaccgucg

SEQ ID NO: 2904591 - RNA, 23 nt, Mycobacterium avium subsp. paratuberculosis
cgggccagcucgaacaccgucga

SEQ ID NO: 2904592 - RNA, 20 nt, Mycobacterium avium subsp. paratuberculosis
cgggccagcucgaaccugga

SEQ ID NO: 2904593 - RNA, 13 nt, Mycobacterium avium subsp. paratuberculosis
cgggccagcucgu

SEQ ID NO: 2904594 - RNA, 13 nt, Mycobacterium avium subsp. paratuberculosis
cgggccagcugcu

SEQ ID NO: 2904595 - RNA, 14 nt, Mycobacterium avium subsp. paratuberculosis
cgggccagcugcuc

SEQ ID NO: 2904596 - RNA, 14 nt, Mycobacterium avium subsp. paratuberculosis
cgggccaggaugac

SEQ ID NO: 2904597 - RNA, 23 nt, Mycobacterium avium subsp. paratuberculosis
cgggccaggauguucaccccggc

SEQ ID NO: 2904598 - RNA, 14 nt, Mycobacterium avium subsp. paratuberculosis
cgggccaggcacgg

SEQ ID NO: 2904599 - RNA, 18 nt, Mycobacterium avium subsp. paratuberculosis
cgggccaggcacggcccg

SEQ ID NO: 2904600 - RNA, 14 nt, Mycobacterium avium subsp. paratuberculosis
cgggccaggcccac

SEQ ID NO: 2904601 - RNA, 12 nt, Mycobacterium avium subsp. paratuberculosis
cgggccaggcgc

SEQ ID NO: 2904602 - RNA, 14 nt, Mycobacterium avium subsp. paratuberculosis
cgggccaggcgcgc

SEQ ID NO: 2904603 - RNA, 16 nt, Mycobacterium avium subsp. paratuberculosis
cgggccaggcgcgcgc

SEQ ID NO: 2904604 - RNA, 17 nt, Mycobacterium avium subsp. paratuberculosis
cgggccaggcgcgcgcu

SEQ ID NO: 2904605 - RNA, 17 nt, Mycobacterium avium subsp. paratuberculosis
cgggccaggcgcgcgua

SEQ ID NO: 2904606 - RNA, 16 nt, Mycobacterium avium subsp. paratuberculosis
cgggccagggcgagga

SEQ ID NO: 2904607 - RNA, 17 nt, Mycobacterium avium subsp. paratuberculosis
cgggccaggucccaggc

SEQ ID NO: 2904608 - RNA, 21 nt, Mycobacterium avium subsp. paratuberculosis
cgggccaggucccaggcgugg

SEQ ID NO: 2904609 - RNA, 22 nt, Mycobacterium avium subsp. paratuberculosis
cgggccaggucccaggcguggu

SEQ ID NO: 2904610 - RNA, 13 nt, Mycobacterium avium subsp. paratuberculosis
cgggccaggucga

SEQ ID NO: 2904611 - RNA, 16 nt, Mycobacterium avium subsp. paratuberculosis
cgggccaggucgaagc

SEQ ID NO: 2904612 - RNA, 17 nt, Mycobacterium avium subsp. paratuberculosis
cgggccaggucggugac

SEQ ID NO: 2904613 - RNA, 18 nt, Mycobacterium avium subsp. paratuberculosis
cgggccagguucgcgccg

SEQ ID NO: 2904614 - RNA, 20 nt, Mycobacterium avium subsp. paratuberculosis
cgggccagguucgcgccgau

SEQ ID NO: 2904615 - RNA, 24 nt, Mycobacterium avium subsp. paratuberculosis
cgggccauauuucgugaagccggu

SEQ ID NO: 2904616 - RNA, 22 nt, Mycobacterium avium subsp. paratuberculosis
cgggccaucgacuccagcaccg

SEQ ID NO: 2904617 - RNA, 16 nt, Mycobacterium avium subsp. paratuberculosis
cgggccauguccccga

SEQ ID NO: 2904618 - RNA, 12 nt, Mycobacterium avium subsp. paratuberculosis
cgggcccaccag

SEQ ID NO: 2904619 - RNA, 14 nt, Mycobacterium avium subsp. paratuberculosis
cgggcccaccgcca

SEQ ID NO: 2904620 - RNA, 17 nt, Mycobacterium avium subsp. paratuberculosis
cgggcccaccgccacca

SEQ ID NO: 2904621 - RNA, 14 nt, Mycobacterium avium subsp. paratuberculosis
cgggcccaccgcgc

SEQ ID NO: 2904622 - RNA, 20 nt, Mycobacterium avium subsp. paratuberculosis
cgggcccaccgcgcgcugca

SEQ ID NO: 2904623 - RNA, 16 nt, Mycobacterium avium subsp. paratuberculosis
cgggcccagcaccacc

SEQ ID NO: 2904624 - RNA, 18 nt, Mycobacterium avium subsp. paratuberculosis
cgggcccagcaccaccac

SEQ ID NO: 2904625 - RNA, 20 nt, Mycobacterium avium subsp. paratuberculosis
cgggcccagcaccaccacgu

SEQ ID NO: 2904626 - RNA, 17 nt, Mycobacterium avium subsp. paratuberculosis
cgggcccagcagauagc

SEQ ID NO: 2904627 - RNA, 14 nt, Mycobacterium avium subsp. paratuberculosis
cgggcccagcagcc

SEQ ID NO: 2904628 - RNA, 15 nt, Mycobacterium avium subsp. paratuberculosis
cgggcccagcagccu

SEQ ID NO: 2904629 - RNA, 20 nt, Mycobacterium avium subsp. paratuberculosis
cgggcccagcagccugcccc

SEQ ID NO: 2904630 - RNA, 23 nt, Mycobacterium avium subsp. paratuberculosis
cgggcccagcgcgacgucgaccg

SEQ ID NO: 2904631 - RNA, 16 nt, Mycobacterium avium subsp. paratuberculosis
cgggcccagcucggug

SEQ ID NO: 2904632 - RNA, 17 nt, Mycobacterium avium subsp. paratuberculosis
cgggcccagcucggugc

SEQ ID NO: 2904633 - RNA, 20 nt, Mycobacterium avium subsp. paratuberculosis
cgggcccagcucggugcgca

SEQ ID NO: 2904634 - RNA, 15 nt, Mycobacterium avium subsp. paratuberculosis
cgggcccgacgacga

SEQ ID NO: 2904635 - RNA, 14 nt, Mycobacterium avium subsp. paratuberculosis
cgggcccgaggucc

SEQ ID NO: 2904636 - RNA, 19 nt, Mycobacterium avium subsp. paratuberculosis
cgggcccgagguccucgcg

SEQ ID NO: 2904637 - RNA, 23 nt, Mycobacterium avium subsp. paratuberculosis
cgggcccgagguccucgcgcaac

SEQ ID NO: 2904638 - RNA, 12 nt, Mycobacterium avium subsp. paratuberculosis
cgggcccgcagc

SEQ ID NO: 2904639 - RNA, 15 nt, Mycobacterium avium subsp. paratuberculosis
cgggcccgcagcucg

SEQ ID NO: 2904640 - RNA, 16 nt, Mycobacterium avium subsp. paratuberculosis
cgggcccgcccgcagc

SEQ ID NO: 2904641 - RNA, 13 nt, Mycobacterium avium subsp. paratuberculosis
cgggcccgccgua

SEQ ID NO: 2904642 - RNA, 15 nt, Mycobacterium avium subsp. paratuberculosis
cgggcccgccguagc

SEQ ID NO: 2904643 - RNA, 12 nt, Mycobacterium avium subsp. paratuberculosis
cgggcccgcgca

SEQ ID NO: 2904644 - RNA, 13 nt, Mycobacterium avium subsp. paratuberculosis
cgggcccgcgcac

SEQ ID NO: 2904645 - RNA, 13 nt, Mycobacterium avium subsp. paratuberculosis
cgggcccgcgcgg

SEQ ID NO: 2904646 - RNA, 14 nt, Mycobacterium avium subsp. paratuberculosis
cgggcccgcgcggc

SEQ ID NO: 2904647 - RNA, 12 nt, Mycobacterium avium subsp. paratuberculosis
cgggcccgcggg

SEQ ID NO: 2904648 - RNA, 13 nt, Mycobacterium avium subsp. paratuberculosis
cgggcccgcggga

SEQ ID NO: 2904649 - RNA, 20 nt, Mycobacterium avium subsp. paratuberculosis
cgggcccgcguaaccggcgg

SEQ ID NO: 2904650 - RNA, 22 nt, Mycobacterium avium subsp. paratuberculosis
cgggcccgcguaaccggcggcg

SEQ ID NO: 2904651 - RNA, 21 nt, Mycobacterium avium subsp. paratuberculosis
cgggcccgcucaccugcggcc

SEQ ID NO: 2904652 - RNA, 22 nt, Mycobacterium avium subsp. paratuberculosis
cgggcccgcucaccugcggccc

SEQ ID NO: 2904653 - RNA, 18 nt, Mycobacterium avium subsp. paratuberculosis
cgggcccgcugcagcgcc

SEQ ID NO: 2904654 - RNA, 21 nt, Mycobacterium avium subsp. paratuberculosis
cgggcccgcugcagcgccgag

SEQ ID NO: 2904655 - RNA, 13 nt, Mycobacterium avium subsp. paratuberculosis
cgggcccggccgc

SEQ ID NO: 2904656 - RNA, 14 nt, Mycobacterium avium subsp. paratuberculosis
cgggcccggccgcc

SEQ ID NO: 2904657 - RNA, 15 nt, Mycobacterium avium subsp. paratuberculosis
cgggcccggccgcca

SEQ ID NO: 2904658 - RNA, 13 nt, Mycobacterium avium subsp. paratuberculosis
cgggcccggcgau

SEQ ID NO: 2904659 - RNA, 15 nt, Mycobacterium avium subsp. paratuberculosis
cgggcccggcgaugc

SEQ ID NO: 2904660 - RNA, 23 nt, Mycobacterium avium subsp. paratuberculosis
cgggcccggcgaugcgcacgucg

SEQ ID NO: 2904661 - RNA, 13 nt, Mycobacterium avium subsp. paratuberculosis
cgggcccgggcca

SEQ ID NO: 2904662 - RNA, 18 nt, Mycobacterium avium subsp. paratuberculosis
cgggcccgggccacccgc

SEQ ID NO: 2904663 - RNA, 20 nt, Mycobacterium avium subsp. paratuberculosis
cgggcccgggcugcccgggc

SEQ ID NO: 2904664 - RNA, 13 nt, Mycobacterium avium subsp. paratuberculosis
cgggcccggggug

SEQ ID NO: 2904665 - RNA, 17 nt, Mycobacterium avium subsp. paratuberculosis
cgggcccggucgucgcc

SEQ ID NO: 2904666 - RNA, 20 nt, Mycobacterium avium subsp. paratuberculosis
cgggcccggucgucgccgga

SEQ ID NO: 2904667 - RNA, 22 nt, Mycobacterium avium subsp. paratuberculosis
cgggcccguagcucgcgccgac

SEQ ID NO: 2904668 - RNA, 20 nt, Mycobacterium avium subsp. paratuberculosis
cgggcccguagguugcccca

SEQ ID NO: 2904669 - RNA, 21 nt, Mycobacterium avium subsp. paratuberculosis
cgggcccguagguugccccac

SEQ ID NO: 2904670 - RNA, 22 nt, Mycobacterium avium subsp. paratuberculosis
cgggcccguagguugccccaca

SEQ ID NO: 2904671 - RNA, 16 nt, Mycobacterium avium subsp. paratuberculosis
cgggcccguccgcgaa

SEQ ID NO: 2904672 - RNA, 14 nt, Mycobacterium avium subsp. paratuberculosis
cgggcccgucgccg

SEQ ID NO: 2904673 - RNA, 18 nt, Mycobacterium avium subsp. paratuberculosis
cgggcccgucgccggcgc

SEQ ID NO: 2904674 - RNA, 18 nt, Mycobacterium avium subsp. paratuberculosis
cgggcccucggacgggag

SEQ ID NO: 2904675 - RNA, 19 nt, Mycobacterium avium subsp. paratuberculosis
cgggcccucguccgacagc

SEQ ID NO: 2904676 - RNA, 22 nt, Mycobacterium avium subsp. paratuberculosis
cgggcccucguccgacagcgcc

SEQ ID NO: 2904677 - RNA, 23 nt, Mycobacterium avium subsp. paratuberculosis
cgggcccucguccgacagcgccu

SEQ ID NO: 2904678 - RNA, 16 nt, Mycobacterium avium subsp. paratuberculosis
cgggccgaaccggaag

SEQ ID NO: 2904679 - RNA, 17 nt, Mycobacterium avium subsp. paratuberculosis
cgggccgaacugccgau

SEQ ID NO: 2904680 - RNA, 20 nt, Mycobacterium avium subsp. paratuberculosis
cgggccgaacugccgaugcu

SEQ ID NO: 2904681 - RNA, 21 nt, Mycobacterium avium subsp. paratuberculosis
cgggccgaacugccgaugcug

SEQ ID NO: 2904682 - RNA, 17 nt, Mycobacterium avium subsp. paratuberculosis
cgggccgaaggcggcgc

SEQ ID NO: 2904683 - RNA, 18 nt, Mycobacterium avium subsp. paratuberculosis
cgggccgaaggcggcgcc

SEQ ID NO: 2904684 - RNA, 19 nt, Mycobacterium avium subsp. paratuberculosis
cgggccgaaggcggcgccg

SEQ ID NO: 2904685 - RNA, 22 nt, Mycobacterium avium subsp. paratuberculosis
cgggccgaaggcggcgccggcc

SEQ ID NO: 2904686 - RNA, 17 nt, Mycobacterium avium subsp. paratuberculosis
cgggccgacagcacgcc

SEQ ID NO: 2904687 - RNA, 21 nt, Mycobacterium avium subsp. paratuberculosis
cgggccgacagcacgccgggc

SEQ ID NO: 2904688 - RNA, 15 nt, Mycobacterium avium subsp. paratuberculosis
cgggccgacccggcc

SEQ ID NO: 2904689 - RNA, 17 nt, Mycobacterium avium subsp. paratuberculosis
cgggccgacccggccga

SEQ ID NO: 2904690 - RNA, 22 nt, Mycobacterium avium subsp. paratuberculosis
cgggccgacccggccgauggug

SEQ ID NO: 2904691 - RNA, 12 nt, Mycobacterium avium subsp. paratuberculosis
cgggccgaccug

SEQ ID NO: 2904692 - RNA, 14 nt, Mycobacterium avium subsp. paratuberculosis
cgggccgaccuggc

SEQ ID NO: 2904693 - RNA, 15 nt, Mycobacterium avium subsp. paratuberculosis
cgggccgaccuggcg

SEQ ID NO: 2904694 - RNA, 16 nt, Mycobacterium avium subsp. paratuberculosis
cgggccgaccuggcgg

SEQ ID NO: 2904695 - RNA, 14 nt, Mycobacterium avium subsp. paratuberculosis
cgggccgagcgcgc

SEQ ID NO: 2904696 - RNA, 16 nt, Mycobacterium avium subsp. paratuberculosis
cgggccgagcgcgccg

SEQ ID NO: 2904697 - RNA, 16 nt, Mycobacterium avium subsp. paratuberculosis
cgggccgagcguucgg

SEQ ID NO: 2904698 - RNA, 18 nt, Mycobacterium avium subsp. paratuberculosis
cgggccgagcguucggcg

SEQ ID NO: 2904699 - RNA, 21 nt, Mycobacterium avium subsp. paratuberculosis
cgggccgagcguucggcgcgg

SEQ ID NO: 2904700 - RNA, 22 nt, Mycobacterium avium subsp. paratuberculosis
cgggccgagcguucggcgcgga

SEQ ID NO: 2904701 - RNA, 12 nt, Mycobacterium avium subsp. paratuberculosis
cgggccgaucac

SEQ ID NO: 2904702 - RNA, 13 nt, Mycobacterium avium subsp. paratuberculosis
cgggccgaucacg

SEQ ID NO: 2904703 - RNA, 17 nt, Mycobacterium avium subsp. paratuberculosis
cgggccgaucacgcgga

SEQ ID NO: 2904704 - RNA, 21 nt, Mycobacterium avium subsp. paratuberculosis
cgggccgaucagugccgcgcc

SEQ ID NO: 2904705 - RNA, 15 nt, Mycobacterium avium subsp. paratuberculosis
cgggccgaugaacau

SEQ ID NO: 2904706 - RNA, 15 nt, Mycobacterium avium subsp. paratuberculosis
cgggccgcacccccu

SEQ ID NO: 2904707 - RNA, 20 nt, Mycobacterium avium subsp. paratuberculosis
cgggccgcacccccuccaca

SEQ ID NO: 2904708 - RNA, 17 nt, Mycobacterium avium subsp. paratuberculosis
cgggccgcacuccgucg

SEQ ID NO: 2904709 - RNA, 19 nt, Mycobacterium avium subsp. paratuberculosis
cgggccgcacuccgucgcg

SEQ ID NO: 2904710 - RNA, 10 nt, Mycobacterium avium subsp. paratuberculosis
cgggccgcag

SEQ ID NO: 2904711 - RNA, 13 nt, Mycobacterium avium subsp. paratuberculosis
cgggccgcagcac

SEQ ID NO: 2904712 - RNA, 17 nt, Mycobacterium avium subsp. paratuberculosis
cgggccgcagcaccacc

SEQ ID NO: 2904713 - RNA, 18 nt, Mycobacterium avium subsp. paratuberculosis
cgggccgcagcaccaccu

SEQ ID NO: 2904714 - RNA, 14 nt, Mycobacterium avium subsp. paratuberculosis
cgggccgcagcacg

SEQ ID NO: 2904715 - RNA, 15 nt, Mycobacterium avium subsp. paratuberculosis
cgggccgcagcacgg

SEQ ID NO: 2904716 - RNA, 16 nt, Mycobacterium avium subsp. paratuberculosis
cgggccgcagccgcgc

SEQ ID NO: 2904717 - RNA, 18 nt, Mycobacterium avium subsp. paratuberculosis
cgggccgcagccgcgcgg

SEQ ID NO: 2904718 - RNA, 15 nt, Mycobacterium avium subsp. paratuberculosis
cgggccgcagcgcgc

SEQ ID NO: 2904719 - RNA, 16 nt, Mycobacterium avium subsp. paratuberculosis
cgggccgcaggguggc

SEQ ID NO: 2904720 - RNA, 22 nt, Mycobacterium avium subsp. paratuberculosis
cgggccgcaggguggccagcac

SEQ ID NO: 2904721 - RNA, 14 nt, Mycobacterium avium subsp. paratuberculosis
cgggccgcauccag

SEQ ID NO: 2904722 - RNA, 16 nt, Mycobacterium avium subsp. paratuberculosis
cgggccgcauccagcg

SEQ ID NO: 2904723 - RNA, 18 nt, Mycobacterium avium subsp. paratuberculosis
cgggccgcauccagcgcc

SEQ ID NO: 2904724 - RNA, 22 nt, Mycobacterium avium subsp. paratuberculosis
cgggccgcauccagcgccgcca

SEQ ID NO: 2904725 - RNA, 17 nt, Mycobacterium avium subsp. paratuberculosis
cgggccgcauccgcgag

SEQ ID NO: 2904726 - RNA, 12 nt, Mycobacterium avium subsp. paratuberculosis
cgggccgccacg

SEQ ID NO: 2904727 - RNA, 15 nt, Mycobacterium avium subsp. paratuberculosis
cgggccgccacggcg

SEQ ID NO: 2904728 - RNA, 17 nt, Mycobacterium avium subsp. paratuberculosis
cgggccgccaucaccgc

SEQ ID NO: 2904729 - RNA, 19 nt, Mycobacterium avium subsp. paratuberculosis
cgggccgcccgcgcguggu

SEQ ID NO: 2904730 - RNA, 14 nt, Mycobacterium avium subsp. paratuberculosis
cgggccgcccggcg

SEQ ID NO: 2904731 - RNA, 19 nt, Mycobacterium avium subsp. paratuberculosis
cgggccgcccggcgcgccg

SEQ ID NO: 2904732 - RNA, 20 nt, Mycobacterium avium subsp. paratuberculosis
cgggccgcccggcgcgccgc

SEQ ID NO: 2904733 - RNA, 14 nt, Mycobacterium avium subsp. paratuberculosis
cgggccgccgacgu

SEQ ID NO: 2904734 - RNA, 21 nt, Mycobacterium avium subsp. paratuberculosis
cgggccgccgacgucgugggc

SEQ ID NO: 2904735 - RNA, 15 nt, Mycobacterium avium subsp. paratuberculosis
cgggccgccgaugcg

SEQ ID NO: 2904736 - RNA, 16 nt, Mycobacterium avium subsp. paratuberculosis
cgggccgccgaugcgc

SEQ ID NO: 2904737 - RNA, 22 nt, Mycobacterium avium subsp. paratuberculosis
cgggccgccgaugcgcccgcug

SEQ ID NO: 2904738 - RNA, 23 nt, Mycobacterium avium subsp. paratuberculosis
cgggccgccgaugcgcccgcugc

SEQ ID NO: 2904739 - RNA, 13 nt, Mycobacterium avium subsp. paratuberculosis
cgggccgccgcgc

SEQ ID NO: 2904740 - RNA, 15 nt, Mycobacterium avium subsp. paratuberculosis
cgggccgccgcgcgg

SEQ ID NO: 2904741 - RNA, 16 nt, Mycobacterium avium subsp. paratuberculosis
cgggccgccgcgcggg

SEQ ID NO: 2904742 - RNA, 16 nt, Mycobacterium avium subsp. paratuberculosis
cgggccgccgcggcca

SEQ ID NO: 2904743 - RNA, 15 nt, Mycobacterium avium subsp. paratuberculosis
cgggccgccggccgc

SEQ ID NO: 2904744 - RNA, 17 nt, Mycobacterium avium subsp. paratuberculosis
cgggccgccggccgcgg

SEQ ID NO: 2904745 - RNA, 19 nt, Mycobacterium avium subsp. paratuberculosis
cgggccgccggccgcggcg

SEQ ID NO: 2904746 - RNA, 14 nt, Mycobacterium avium subsp. paratuberculosis
cgggccgccgggug

SEQ ID NO: 2904747 - RNA, 15 nt, Mycobacterium avium subsp. paratuberculosis
cgggccgccgggugg

SEQ ID NO: 2904748 - RNA, 11 nt, Mycobacterium avium subsp. paratuberculosis
cgggccgccuc

SEQ ID NO: 2904749 - RNA, 12 nt, Mycobacterium avium subsp. paratuberculosis
cgggccgccucg

SEQ ID NO: 2904750 - RNA, 22 nt, Mycobacterium avium subsp. paratuberculosis
cgggccgccucgaagucgccgg

SEQ ID NO: 2904751 - RNA, 16 nt, Mycobacterium avium subsp. paratuberculosis
cgggccgccuucuccg

SEQ ID NO: 2904752 - RNA, 13 nt, Mycobacterium avium subsp. paratuberculosis
cgggccgcgccga

SEQ ID NO: 2904753 - RNA, 13 nt, Mycobacterium avium subsp. paratuberculosis
cgggccgcggcca

SEQ ID NO: 2904754 - RNA, 14 nt, Mycobacterium avium subsp. paratuberculosis
cgggccgcggccag

SEQ ID NO: 2904755 - RNA, 15 nt, Mycobacterium avium subsp. paratuberculosis
cgggccgcggccagc

SEQ ID NO: 2904756 - RNA, 17 nt, Mycobacterium avium subsp. paratuberculosis
cgggccgcggccagcuc

SEQ ID NO: 2904757 - RNA, 18 nt, Mycobacterium avium subsp. paratuberculosis
cgggccgcggccagcucc

SEQ ID NO: 2904758 - RNA, 21 nt, Mycobacterium avium subsp. paratuberculosis
cgggccgcggccagcuccggg

SEQ ID NO: 2904759 - RNA, 12 nt, Mycobacterium avium subsp. paratuberculosis
cgggccgcgggc

SEQ ID NO: 2904760 - RNA, 18 nt, Mycobacterium avium subsp. paratuberculosis
cgggccgcgggcccaccg

SEQ ID NO: 2904761 - RNA, 21 nt, Mycobacterium avium subsp. paratuberculosis
cgggccgcgggcccaccgcca

SEQ ID NO: 2904762 - RNA, 16 nt, Mycobacterium avium subsp. paratuberculosis
cgggccgcgucggcca

SEQ ID NO: 2904763 - RNA, 13 nt, Mycobacterium avium subsp. paratuberculosis
cgggccgcuggcc

SEQ ID NO: 2904764 - RNA, 14 nt, Mycobacterium avium subsp. paratuberculosis
cgggccgcuggccg

SEQ ID NO: 2904765 - RNA, 15 nt, Mycobacterium avium subsp. paratuberculosis
cgggccgcuggccgc

SEQ ID NO: 2904766 - RNA, 16 nt, Mycobacterium avium subsp. paratuberculosis
cgggccgcuggccgcc

SEQ ID NO: 2904767 - RNA, 17 nt, Mycobacterium avium subsp. paratuberculosis
cgggccgcuggccgccc

SEQ ID NO: 2904768 - RNA, 14 nt, Mycobacterium avium subsp. paratuberculosis
cgggccgcugguga

SEQ ID NO: 2904769 - RNA, 13 nt, Mycobacterium avium subsp. paratuberculosis
cgggccggacacg

SEQ ID NO: 2904770 - RNA, 15 nt, Mycobacterium avium subsp. paratuberculosis
cgggccggacagcgg

SEQ ID NO: 2904771 - RNA, 16 nt, Mycobacterium avium subsp. paratuberculosis
cgggccggacagcggc

SEQ ID NO: 2904772 - RNA, 18 nt, Mycobacterium avium subsp. paratuberculosis
cgggccggacagcggccc

SEQ ID NO: 2904773 - RNA, 15 nt, Mycobacterium avium subsp. paratuberculosis
cgggccggaucgcgc

SEQ ID NO: 2904774 - RNA, 13 nt, Mycobacterium avium subsp. paratuberculosis
cgggccggcaccc

SEQ ID NO: 2904775 - RNA, 13 nt, Mycobacterium avium subsp. paratuberculosis
cgggccggcagcc

SEQ ID NO: 2904776 - RNA, 15 nt, Mycobacterium avium subsp. paratuberculosis
cgggccggcagccgg

SEQ ID NO: 2904777 - RNA, 17 nt, Mycobacterium avium subsp. paratuberculosis
cgggccggcagccggcc

SEQ ID NO: 2904778 - RNA, 22 nt, Mycobacterium avium subsp. paratuberculosis
cgggccggcagccggccaccuc

SEQ ID NO: 2904779 - RNA, 15 nt, Mycobacterium avium subsp. paratuberculosis
cgggccggccagacc

SEQ ID NO: 2904780 - RNA, 16 nt, Mycobacterium avium subsp. paratuberculosis
cgggccggccagaccg

SEQ ID NO: 2904781 - RNA, 11 nt, Mycobacterium avium subsp. paratuberculosis
cgggccggccc

SEQ ID NO: 2904782 - RNA, 13 nt, Mycobacterium avium subsp. paratuberculosis
cgggccggcgccg

SEQ ID NO: 2904783 - RNA, 23 nt, Mycobacterium avium subsp. paratuberculosis
cgggccggcgccgacgacgucgc

SEQ ID NO: 2904784 - RNA, 14 nt, Mycobacterium avium subsp. paratuberculosis
cgggccggcgccgg

SEQ ID NO: 2904785 - RNA, 15 nt, Mycobacterium avium subsp. paratuberculosis
cgggccggcgccggu

SEQ ID NO: 2904786 - RNA, 16 nt, Mycobacterium avium subsp. paratuberculosis
cgggccggcgccggug

SEQ ID NO: 2904787 - RNA, 17 nt, Mycobacterium avium subsp. paratuberculosis
cgggccggcgccggugc

SEQ ID NO: 2904788 - RNA, 23 nt, Mycobacterium avium subsp. paratuberculosis
cgggccggcgccggugccgcagc

SEQ ID NO: 2904789 - RNA, 16 nt, Mycobacterium avium subsp. paratuberculosis
cgggccggcggugauc

SEQ ID NO: 2904790 - RNA, 19 nt, Mycobacterium avium subsp. paratuberculosis
cgggccggcgucgcgguga

SEQ ID NO: 2904791 - RNA, 16 nt, Mycobacterium avium subsp. paratuberculosis
cgggccggcgucgucg

SEQ ID NO: 2904792 - RNA, 15 nt, Mycobacterium avium subsp. paratuberculosis
cgggccgggcaccgc

SEQ ID NO: 2904793 - RNA, 17 nt, Mycobacterium avium subsp. paratuberculosis
cgggccgggcaccgcgc

SEQ ID NO: 2904794 - RNA, 13 nt, Mycobacterium avium subsp. paratuberculosis
cgggccgggcacg

SEQ ID NO: 2904795 - RNA, 16 nt, Mycobacterium avium subsp. paratuberculosis
cgggccgggcacgucg

SEQ ID NO: 2904796 - RNA, 19 nt, Mycobacterium avium subsp. paratuberculosis
cgggccgggcacgucgacg

SEQ ID NO: 2904797 - RNA, 12 nt, Mycobacterium avium subsp. paratuberculosis
cgggccgggcgg

SEQ ID NO: 2904798 - RNA, 15 nt, Mycobacterium avium subsp. paratuberculosis
cgggccgggcgggca

SEQ ID NO: 2904799 - RNA, 17 nt, Mycobacterium avium subsp. paratuberculosis
cgggccgggcgggcacc

SEQ ID NO: 2904800 - RNA, 17 nt, Mycobacterium avium subsp. paratuberculosis
cgggccgggggcggcgg

SEQ ID NO: 2904801 - RNA, 18 nt, Mycobacterium avium subsp. paratuberculosis
cgggccgggggcggcggc

SEQ ID NO: 2904802 - RNA, 18 nt, Mycobacterium avium subsp. paratuberculosis
cgggccggguccacgccg

SEQ ID NO: 2904803 - RNA, 19 nt, Mycobacterium avium subsp. paratuberculosis
cgggccggguccacgccga

SEQ ID NO: 2904804 - RNA, 15 nt, Mycobacterium avium subsp. paratuberculosis
cgguccgaccgccac

SEQ ID NO: 2904805 - RNA, 20 nt, Mycobacterium avium subsp. paratuberculosis
cgguccgaccgccaccaccc

SEQ ID NO: 2904806 - RNA, 16 nt, Mycobacterium avium subsp. paratuberculosis
cgguccgacggcugcg

SEQ ID NO: 2904807 - RNA, 18 nt, Mycobacterium avium subsp. paratuberculosis
cgguccgaucguccggcg

SEQ ID NO: 2904808 - RNA, 19 nt, Mycobacterium avium subsp. paratuberculosis
cgguccgaucguccggcgc

SEQ ID NO: 2904809 - RNA, 19 nt, Mycobacterium avium subsp. paratuberculosis
cgguccgcccagacgcggg

SEQ ID NO: 2904810 - RNA, 13 nt, Mycobacterium avium subsp. paratuberculosis
cgguccgcccgga

SEQ ID NO: 2904811 - RNA, 14 nt, Mycobacterium avium subsp. paratuberculosis
cgguccgcccggac

SEQ ID NO: 2904812 - RNA, 17 nt, Mycobacterium avium subsp. paratuberculosis
cgguccgcccggaccag

SEQ ID NO: 2904813 - RNA, 16 nt, Mycobacterium avium subsp. paratuberculosis
cgguccgccgcagcgg

SEQ ID NO: 2904814 - RNA, 21 nt, Mycobacterium avium subsp. paratuberculosis
cgguccgccgcagcggcgccg

SEQ ID NO: 2904815 - RNA, 15 nt, Mycobacterium avium subsp. paratuberculosis
cgguccgccgucggg

SEQ ID NO: 2904816 - RNA, 17 nt, Mycobacterium avium subsp. paratuberculosis
cgguccgcuccaccagc

SEQ ID NO: 2904817 - RNA, 19 nt, Mycobacterium avium subsp. paratuberculosis
cgguccgcugugcggcccg

SEQ ID NO: 2904818 - RNA, 21 nt, Mycobacterium avium subsp. paratuberculosis
cgguccgcugugcggcccggc

SEQ ID NO: 2904819 - RNA, 13 nt, Mycobacterium avium subsp. paratuberculosis
cgguccggccgug

SEQ ID NO: 2904820 - RNA, 16 nt, Mycobacterium avium subsp. paratuberculosis
cgguccggccgugccg

SEQ ID NO: 2904821 - RNA, 13 nt, Mycobacterium avium subsp. paratuberculosis
cgguccggcgaau

SEQ ID NO: 2904822 - RNA, 21 nt, Mycobacterium avium subsp. paratuberculosis
cgguccggcgaauccgaccgg

SEQ ID NO: 2904823 - RNA, 14 nt, Mycobacterium avium subsp. paratuberculosis
cgguccggcggcac

SEQ ID NO: 2904824 - RNA, 15 nt, Mycobacterium avium subsp. paratuberculosis
cgguccggcugaacg

SEQ ID NO: 2904825 - RNA, 22 nt, Mycobacterium avium subsp. paratuberculosis
cgguccggcugaacgccagcag

SEQ ID NO: 2904826 - RNA, 22 nt, Mycobacterium avium subsp. paratuberculosis
cgguccggcuggucggccuggc

SEQ ID NO: 2904827 - RNA, 12 nt, Mycobacterium avium subsp. paratuberculosis
cgguccgugcca

SEQ ID NO: 2904828 - RNA, 16 nt, Mycobacterium avium subsp. paratuberculosis
cgguccgugccacggc

SEQ ID NO: 2904829 - RNA, 21 nt, Mycobacterium avium subsp. paratuberculosis
cgguccgugccacggccgcgg

SEQ ID NO: 2904830 - RNA, 22 nt, Mycobacterium avium subsp. paratuberculosis
cgguccgugccacggccgcggc

SEQ ID NO: 2904831 - RNA, 23 nt, Mycobacterium avium subsp. paratuberculosis
cgguccguuggaggugaucgcca

SEQ ID NO: 2904832 - RNA, 15 nt, Mycobacterium avium subsp. paratuberculosis
cgguccuccccgcug

SEQ ID NO: 2904833 - RNA, 14 nt, Mycobacterium avium subsp. paratuberculosis
cgguccucgaaccg

SEQ ID NO: 2904834 - RNA, 14 nt, Mycobacterium avium subsp. paratuberculosis
cgguccucgagcug

SEQ ID NO: 2904835 - RNA, 19 nt, Mycobacterium avium subsp. paratuberculosis
cgguccucgagcuggccgu

SEQ ID NO: 2904836 - RNA, 16 nt, Mycobacterium avium subsp. paratuberculosis
cgguccucucgaagcg

SEQ ID NO: 2904837 - RNA, 16 nt, Mycobacterium avium subsp. paratuberculosis
cgguccucugcgacca

SEQ ID NO: 2904838 - RNA, 16 nt, Mycobacterium avium subsp. paratuberculosis
cgguccugcggcgaca

SEQ ID NO: 2904839 - RNA, 21 nt, Mycobacterium avium subsp. paratuberculosis
cgguccugcggcgacaacgcg

SEQ ID NO: 2904840 - RNA, 16 nt, Mycobacterium avium subsp. paratuberculosis
cgguccugggccuccg

SEQ ID NO: 2904841 - RNA, 20 nt, Mycobacterium avium subsp. paratuberculosis
cgguccugggccuccggcgg

SEQ ID NO: 2904842 - RNA, 22 nt, Mycobacterium avium subsp. paratuberculosis
cgguccugggccuccggcggca

SEQ ID NO: 2904843 - RNA, 18 nt, Mycobacterium avium subsp. paratuberculosis
cgguccuucucgcacagc

SEQ ID NO: 2904844 - RNA, 21 nt, Mycobacterium avium subsp. paratuberculosis
cgguccuucucgcacagcacc

SEQ ID NO: 2904845 - RNA, 15 nt, Mycobacterium avium subsp. paratuberculosis
cgguccuuggccugc

SEQ ID NO: 2904846 - RNA, 14 nt, Mycobacterium avium subsp. paratuberculosis
cgguccuuggcgua

SEQ ID NO: 2904847 - RNA, 12 nt, Mycobacterium avium subsp. paratuberculosis
cggucgaacgcc

SEQ ID NO: 2904848 - RNA, 18 nt, Mycobacterium avium subsp. paratuberculosis
cggucgaacgccagcgcc

SEQ ID NO: 2904849 - RNA, 20 nt, Mycobacterium avium subsp. paratuberculosis
cggucgaacgccagcgccgc

SEQ ID NO: 2904850 - RNA, 16 nt, Mycobacterium avium subsp. paratuberculosis
cggucgaacgcggcgc

SEQ ID NO: 2904851 - RNA, 17 nt, Mycobacterium avium subsp. paratuberculosis
cggucgaacgcggcgcc

SEQ ID NO: 2904852 - RNA, 16 nt, Mycobacterium avium subsp. paratuberculosis
cggucgaaggccccgg

SEQ ID NO: 2904853 - RNA, 17 nt, Mycobacterium avium subsp. paratuberculosis
cggucgaaggccccggu

SEQ ID NO: 2904854 - RNA, 16 nt, Mycobacterium avium subsp. paratuberculosis
cggucgacacgaucgg

SEQ ID NO: 2904855 - RNA, 18 nt, Mycobacterium avium subsp. paratuberculosis
cggucgaccagcuccugg

SEQ ID NO: 2904856 - RNA, 19 nt, Mycobacterium avium subsp. paratuberculosis
cggucgaccucgagcguca

SEQ ID NO: 2904857 - RNA, 17 nt, Mycobacterium avium subsp. paratuberculosis
cggucgacgauggcccg

SEQ ID NO: 2904858 - RNA, 15 nt, Mycobacterium avium subsp. paratuberculosis
cggucgacgcggggc

SEQ ID NO: 2904859 - RNA, 16 nt, Mycobacterium avium subsp. paratuberculosis
cggucgacgcggggcg

SEQ ID NO: 2904860 - RNA, 19 nt, Mycobacterium avium subsp. paratuberculosis
cggucgacgcggggcggcg

SEQ ID NO: 2904861 - RNA, 20 nt, Mycobacterium avium subsp. paratuberculosis
cggucgacgcggggcggcgg

SEQ ID NO: 2904862 - RNA, 22 nt, Mycobacterium avium subsp. paratuberculosis
cggucgacgcggggcggcggcg

SEQ ID NO: 2904863 - RNA, 19 nt, Mycobacterium avium subsp. paratuberculosis
cggucgacuugggcggggg

SEQ ID NO: 2904864 - RNA, 24 nt, Mycobacterium avium subsp. paratuberculosis
cggucgagccuggcgcgcaacgcu

SEQ ID NO: 2904865 - RNA, 16 nt, Mycobacterium avium subsp. paratuberculosis
cggucgaggucgccga

SEQ ID NO: 2904866 - RNA, 17 nt, Mycobacterium avium subsp. paratuberculosis
cggucgaggucgccgac

SEQ ID NO: 2904867 - RNA, 18 nt, Mycobacterium avium subsp. paratuberculosis
cggucgaggucgccgaca

SEQ ID NO: 2904868 - RNA, 19 nt, Mycobacterium avium subsp. paratuberculosis
cggucgaggucgccgacag

SEQ ID NO: 2904869 - RNA, 20 nt, Mycobacterium avium subsp. paratuberculosis
cggucgaggucgccgacagc

SEQ ID NO: 2904870 - RNA, 15 nt, Mycobacterium avium subsp. paratuberculosis
cggucgaggucggcc

SEQ ID NO: 2904871 - RNA, 16 nt, Mycobacterium avium subsp. paratuberculosis
cggucgaggucggcca

SEQ ID NO: 2904872 - RNA, 18 nt, Mycobacterium avium subsp. paratuberculosis
cggucgaggucggccagc

SEQ ID NO: 2904873 - RNA, 20 nt, Mycobacterium avium subsp. paratuberculosis
cggucgaggucggccagcag

SEQ ID NO: 2904874 - RNA, 21 nt, Mycobacterium avium subsp. paratuberculosis
cggucgaggucggccagcagg

SEQ ID NO: 2904875 - RNA, 15 nt, Mycobacterium avium subsp. paratuberculosis
cggucgaucaacacc

SEQ ID NO: 2904876 - RNA, 17 nt, Mycobacterium avium subsp. paratuberculosis
cggucgaucaccucguc

SEQ ID NO: 2904877 - RNA, 18 nt, Mycobacterium avium subsp. paratuberculosis
cggucgaucaccucgucg

SEQ ID NO: 2904878 - RNA, 19 nt, Mycobacterium avium subsp. paratuberculosis
cggucgaucaccucgucga

SEQ ID NO: 2904879 - RNA, 20 nt, Mycobacterium avium subsp. paratuberculosis
cggucgaugacgccgcgccg

SEQ ID NO: 2904880 - RNA, 22 nt, Mycobacterium avium subsp. paratuberculosis
cggucgaugacgccgcgccgcc

SEQ ID NO: 2904881 - RNA, 18 nt, Mycobacterium avium subsp. paratuberculosis
cggucgaugagcuggugc

SEQ ID NO: 2904882 - RNA, 22 nt, Mycobacterium avium subsp. paratuberculosis
cggucgaugagcuggugcagcg

SEQ ID NO: 2904883 - RNA, 23 nt, Mycobacterium avium subsp. paratuberculosis
cggucgaugagcuggugcagcga

SEQ ID NO: 2904884 - RNA, 15 nt, Mycobacterium avium subsp. paratuberculosis
cggucgaugucggcg

SEQ ID NO: 2904885 - RNA, 17 nt, Mycobacterium avium subsp. paratuberculosis
cggucgaugucggcgaa

SEQ ID NO: 2904886 - RNA, 18 nt, Mycobacterium avium subsp. paratuberculosis
cggucgaugucggcgaac

SEQ ID NO: 2904887 - RNA, 17 nt, Mycobacterium avium subsp. paratuberculosis
cggucgaugugcgcgcu

SEQ ID NO: 2904888 - RNA, 18 nt, Mycobacterium avium subsp. paratuberculosis
cggucgaugugcgcgcug

SEQ ID NO: 2904889 - RNA, 19 nt, Mycobacterium avium subsp. paratuberculosis
cggucgaugugcgcgcugg

SEQ ID NO: 2904890 - RNA, 22 nt, Mycobacterium avium subsp. paratuberculosis
cggucgaugugcgcgcuggccg

SEQ ID NO: 2904891 - RNA, 22 nt, Mycobacterium avium subsp. paratuberculosis
cggucgauuugaugaacacggu

SEQ ID NO: 2904892 - RNA, 13 nt, Mycobacterium avium subsp. paratuberculosis
cggucgcaccgcg

SEQ ID NO: 2904893 - RNA, 15 nt, Mycobacterium avium subsp. paratuberculosis
cggucgcaccgcggc

SEQ ID NO: 2904894 - RNA, 23 nt, Mycobacterium avium subsp. paratuberculosis
cggucgcaccgcggcguggacgu

SEQ ID NO: 2904895 - RNA, 16 nt, Mycobacterium avium subsp. paratuberculosis
cggucgcaggccgccc

SEQ ID NO: 2904896 - RNA, 19 nt, Mycobacterium avium subsp. paratuberculosis
cggucgcaggccgcccggc

SEQ ID NO: 2904897 - RNA, 18 nt, Mycobacterium avium subsp. paratuberculosis
cggucgcaggcgagccgg

SEQ ID NO: 2904898 - RNA, 22 nt, Mycobacterium avium subsp. paratuberculosis
cggucgcaggcgagccgguugg

SEQ ID NO: 2904899 - RNA, 14 nt, Mycobacterium avium subsp. paratuberculosis
cggucgccaccacc

SEQ ID NO: 2904900 - RNA, 18 nt, Mycobacterium avium subsp. paratuberculosis
cggucgccaccaccagcg

SEQ ID NO: 2904901 - RNA, 20 nt, Mycobacterium avium subsp. paratuberculosis
cggucgccaccaccagcggg

SEQ ID NO: 2904902 - RNA, 16 nt, Mycobacterium avium subsp. paratuberculosis
cggucgccacggccgg

SEQ ID NO: 2904903 - RNA, 17 nt, Mycobacterium avium subsp. paratuberculosis
cggucgccacggccggc

SEQ ID NO: 2904904 - RNA, 19 nt, Mycobacterium avium subsp. paratuberculosis
cggucgccacggccggcag

SEQ ID NO: 2904905 - RNA, 20 nt, Mycobacterium avium subsp. paratuberculosis
cggucgccacggccggcagc

SEQ ID NO: 2904906 - RNA, 12 nt, Mycobacterium avium subsp. paratuberculosis
cggucgccagca

SEQ ID NO: 2904907 - RNA, 13 nt, Mycobacterium avium subsp. paratuberculosis
cggucgccagcac

SEQ ID NO: 2904908 - RNA, 14 nt, Mycobacterium avium subsp. paratuberculosis
cggucgccagcacc

SEQ ID NO: 2904909 - RNA, 16 nt, Mycobacterium avium subsp. paratuberculosis
cggucgccagcgccac

SEQ ID NO: 2904910 - RNA, 18 nt, Mycobacterium avium subsp. paratuberculosis
cggucgcccccucggccg

SEQ ID NO: 2904911 - RNA, 21 nt, Mycobacterium avium subsp. paratuberculosis
cggucgcccccucggccgguc

SEQ ID NO: 2904912 - RNA, 23 nt, Mycobacterium avium subsp. paratuberculosis
cggucgcccccucggccgguccg

SEQ ID NO: 2904913 - RNA, 24 nt, Mycobacterium avium subsp. paratuberculosis
cggucgcccccucggccgguccga

SEQ ID NO: 2904914 - RNA, 21 nt, Mycobacterium avium subsp. paratuberculosis
cggucgccccggccgcgguga

SEQ ID NO: 2904915 - RNA, 12 nt, Mycobacterium avium subsp. paratuberculosis
cggucgccgaau

SEQ ID NO: 2904916 - RNA, 20 nt, Mycobacterium avium subsp. paratuberculosis
cggucgccgaauccggcggg

SEQ ID NO: 2904917 - RNA, 21 nt, Mycobacterium avium subsp. paratuberculosis
cggucgccgaauccggcgggg

SEQ ID NO: 2904918 - RNA, 13 nt, Mycobacterium avium subsp. paratuberculosis
cggucgccgacgu

SEQ ID NO: 2904919 - RNA, 21 nt, Mycobacterium avium subsp. paratuberculosis
cggucgccgacucgcaggugc

SEQ ID NO: 2904920 - RNA, 13 nt, Mycobacterium avium subsp. paratuberculosis
cggucgccgaugg

SEQ ID NO: 2904921 - RNA, 14 nt, Mycobacterium avium subsp. paratuberculosis
cggucgccgcccac

SEQ ID NO: 2904922 - RNA, 23 nt, Mycobacterium avium subsp. paratuberculosis
cggucgccgcccacgccgugcag

SEQ ID NO: 2904923 - RNA, 15 nt, Mycobacterium avium subsp. paratuberculosis
cggucgccgcgccgc

SEQ ID NO: 2904924 - RNA, 13 nt, Mycobacterium avium subsp. paratuberculosis
cggucgccggcuu

SEQ ID NO: 2904925 - RNA, 14 nt, Mycobacterium avium subsp. paratuberculosis
cggucgccgggccg

SEQ ID NO: 2904926 - RNA, 15 nt, Mycobacterium avium subsp. paratuberculosis
cggucgccgggccgg

SEQ ID NO: 2904927 - RNA, 20 nt, Mycobacterium avium subsp. paratuberculosis
cggucgccgggccggccggu

SEQ ID NO: 2904928 - RNA, 15 nt, Mycobacterium avium subsp. paratuberculosis
cggucgccgguguga

SEQ ID NO: 2904929 - RNA, 21 nt, Mycobacterium avium subsp. paratuberculosis
cggucgccugcuucuggaugc

SEQ ID NO: 2904930 - RNA, 11 nt, Mycobacterium avium subsp. paratuberculosis
cggucgcgacc

SEQ ID NO: 2904931 - RNA, 12 nt, Mycobacterium avium subsp. paratuberculosis
cggucgcgaccc

SEQ ID NO: 2904932 - RNA, 12 nt, Mycobacterium avium subsp. paratuberculosis
cggucgcgcagc

SEQ ID NO: 2904933 - RNA, 13 nt, Mycobacterium avium subsp. paratuberculosis
cggucgcgcagcc

SEQ ID NO: 2904934 - RNA, 16 nt, Mycobacterium avium subsp. paratuberculosis
cggucgcgcagccgcc

SEQ ID NO: 2904935 - RNA, 15 nt, Mycobacterium avium subsp. paratuberculosis
cggucgcgcagccgg

SEQ ID NO: 2904936 - RNA, 19 nt, Mycobacterium avium subsp. paratuberculosis
cggucgcgcagccgggcgg

SEQ ID NO: 2904937 - RNA, 21 nt, Mycobacterium avium subsp. paratuberculosis
cggucgcgcagccgggcggcg

SEQ ID NO: 2904938 - RNA, 20 nt, Mycobacterium avium subsp. paratuberculosis
cggucgcgcaucgccucggc

SEQ ID NO: 2904939 - RNA, 23 nt, Mycobacterium avium subsp. paratuberculosis
cggucgcgcaucgccucggcggc

SEQ ID NO: 2904940 - RNA, 22 nt, Mycobacterium avium subsp. paratuberculosis
cggucgcgccagacguccagcg

SEQ ID NO: 2904941 - RNA, 21 nt, Mycobacterium avium subsp. paratuberculosis
cggucgcgccgaccuggucgc

SEQ ID NO: 2904942 - RNA, 12 nt, Mycobacterium avium subsp. paratuberculosis
cggucgcgcgcc

SEQ ID NO: 2904943 - RNA, 14 nt, Mycobacterium avium subsp. paratuberculosis
cggucgcgcgccgg

SEQ ID NO: 2904944 - RNA, 17 nt, Mycobacterium avium subsp. paratuberculosis
cggucgcgcgccggcgc

SEQ ID NO: 2904945 - RNA, 21 nt, Mycobacterium avium subsp. paratuberculosis
cggucgcgcgccggcgcagcg

SEQ ID NO: 2904946 - RNA, 17 nt, Mycobacterium avium subsp. paratuberculosis
cggucgcggaaccggcc

SEQ ID NO: 2904947 - RNA, 19 nt, Mycobacterium avium subsp. paratuberculosis
cggucgcggaaccggccgg

SEQ ID NO: 2904948 - RNA, 22 nt, Mycobacterium avium subsp. paratuberculosis
cggucgcggaaccggccggggc

SEQ ID NO: 2904949 - RNA, 21 nt, Mycobacterium avium subsp. paratuberculosis
cggucgcggcaucccugguga

SEQ ID NO: 2904950 - RNA, 12 nt, Mycobacterium avium subsp. paratuberculosis
cggucgcggccg

SEQ ID NO: 2904951 - RNA, 14 nt, Mycobacterium avium subsp. paratuberculosis
cggucgcggcgauc

SEQ ID NO: 2904952 - RNA, 13 nt, Mycobacterium avium subsp. paratuberculosis
cggucgcggcgcc

SEQ ID NO: 2904953 - RNA, 15 nt, Mycobacterium avium subsp. paratuberculosis
cggucgcggcgccgg

SEQ ID NO: 2904954 - RNA, 16 nt, Mycobacterium avium subsp. paratuberculosis
cggucgcggcgccggu

SEQ ID NO: 2904955 - RNA, 13 nt, Mycobacterium avium subsp. paratuberculosis
cggucgcggcguc

SEQ ID NO: 2904956 - RNA, 15 nt, Mycobacterium avium subsp. paratuberculosis
cggucgcggcgucgc

SEQ ID NO: 2904957 - RNA, 21 nt, Mycobacterium avium subsp. paratuberculosis
cggucgcggucggcgcccggc

SEQ ID NO: 2904958 - RNA, 22 nt, Mycobacterium avium subsp. paratuberculosis
cggucgcggugaucaggcccuc

SEQ ID NO: 2904959 - RNA, 17 nt, Mycobacterium avium subsp. paratuberculosis
cggucgcggugcccagc

SEQ ID NO: 2904960 - RNA, 19 nt, Mycobacterium avium subsp. paratuberculosis
cggucgcggugcccagccg

SEQ ID NO: 2904961 - RNA, 20 nt, Mycobacterium avium subsp. paratuberculosis
cggucgcggugucggcgucg

SEQ ID NO: 2904962 - RNA, 21 nt, Mycobacterium avium subsp. paratuberculosis
cggucgcggugucggcgucga

SEQ ID NO: 2904963 - RNA, 24 nt, Mycobacterium avium subsp. paratuberculosis
cggucgcggugucggcgucgaucg

SEQ ID NO: 2904964 - RNA, 14 nt, Mycobacterium avium subsp. paratuberculosis
cggucgcgucgucg

SEQ ID NO: 2904965 - RNA, 15 nt, Mycobacterium avium subsp. paratuberculosis
cggucgcgucgucgg

SEQ ID NO: 2904966 - RNA, 17 nt, Mycobacterium avium subsp. paratuberculosis
cggucgcgucgucggcg

SEQ ID NO: 2904967 - RNA, 20 nt, Mycobacterium avium subsp. paratuberculosis
cggucgcgucgugcggccgg

SEQ ID NO: 2904968 - RNA, 16 nt, Mycobacterium avium subsp. paratuberculosis
cggucgcgugaccggc

SEQ ID NO: 2904969 - RNA, 19 nt, Mycobacterium avium subsp. paratuberculosis
cggucgcgugaccggcggu

SEQ ID NO: 2904970 - RNA, 20 nt, Mycobacterium avium subsp. paratuberculosis
cggucgcgugaccggcggug

SEQ ID NO: 2904971 - RNA, 21 nt, Mycobacterium avium subsp. paratuberculosis
cggucgcgugaccggcggugc

SEQ ID NO: 2904972 - RNA, 23 nt, Mycobacterium avium subsp. paratuberculosis
cggucgcguugaaagccgcgaac

SEQ ID NO: 2904973 - RNA, 24 nt, Mycobacterium avium subsp. paratuberculosis
cggucgcguugaaagccgcgaacg

SEQ ID NO: 2904974 - RNA, 17 nt, Mycobacterium avium subsp. paratuberculosis
cggucgcugaccccgcu

SEQ ID NO: 2904975 - RNA, 14 nt, Mycobacterium avium subsp. paratuberculosis
cggucgcugacccg

SEQ ID NO: 2904976 - RNA, 15 nt, Mycobacterium avium subsp. paratuberculosis
cggucgcugacccgc

SEQ ID NO: 2904977 - RNA, 18 nt, Mycobacterium avium subsp. paratuberculosis
cggucgcugacccgccgc

SEQ ID NO: 2904978 - RNA, 16 nt, Mycobacterium avium subsp. paratuberculosis
cggucgcugcagcggc

SEQ ID NO: 2904979 - RNA, 20 nt, Mycobacterium avium subsp. paratuberculosis
cggucgcugcagcggcggcc

SEQ ID NO: 2904980 - RNA, 23 nt, Mycobacterium avium subsp. paratuberculosis
cggucgcugcagcggcggccagu

SEQ ID NO: 2904981 - RNA, 22 nt, Mycobacterium avium subsp. paratuberculosis
cggucgcugggcucgagugccg

SEQ ID NO: 2904982 - RNA, 13 nt, Mycobacterium avium subsp. paratuberculosis
cggucggacgcgg

SEQ ID NO: 2904983 - RNA, 14 nt, Mycobacterium avium subsp. paratuberculosis
cggucggacgcggg

SEQ ID NO: 2904984 - RNA, 13 nt, Mycobacterium avium subsp. paratuberculosis
cggucggagccca

SEQ ID NO: 2904985 - RNA, 17 nt, Mycobacterium avium subsp. paratuberculosis
cggucggagcccagcgu

SEQ ID NO: 2904986 - RNA, 13 nt, Mycobacterium avium subsp. paratuberculosis
cggucggaucgag

SEQ ID NO: 2904987 - RNA, 20 nt, Mycobacterium avium subsp. paratuberculosis
cggucggcaggauccggacg

SEQ ID NO: 2904988 - RNA, 17 nt, Mycobacterium avium subsp. paratuberculosis
cggucggcauagcgccg

SEQ ID NO: 2904989 - RNA, 18 nt, Mycobacterium avium subsp. paratuberculosis
cggucggcauagcgccgc

SEQ ID NO: 2904990 - RNA, 19 nt, Mycobacterium avium subsp. paratuberculosis
cggucggcauagcgccgcu

SEQ ID NO: 2904991 - RNA, 13 nt, Mycobacterium avium subsp. paratuberculosis
cggucggccccgc

SEQ ID NO: 2904992 - RNA, 15 nt, Mycobacterium avium subsp. paratuberculosis
cggucggccccgcgc

SEQ ID NO: 2904993 - RNA, 13 nt, Mycobacterium avium subsp. paratuberculosis
cggucggcccgcu

SEQ ID NO: 2904994 - RNA, 18 nt, Mycobacterium avium subsp. paratuberculosis
cggucggcccgcuccccg

SEQ ID NO: 2904995 - RNA, 15 nt, Mycobacterium avium subsp. paratuberculosis
cggucggcccgcugc

SEQ ID NO: 2904996 - RNA, 21 nt, Mycobacterium avium subsp. paratuberculosis
cggucggcccgcugcggcugg

SEQ ID NO: 2904997 - RNA, 23 nt, Mycobacterium avium subsp. paratuberculosis
cggucggcccgcugcggcuggga

SEQ ID NO: 2904998 - RNA, 13 nt, Mycobacterium avium subsp. paratuberculosis
cggucggccgcgu

SEQ ID NO: 2904999 - RNA, 15 nt, Mycobacterium avium subsp. paratuberculosis
cggucggccgcgugc

SEQ ID NO: 2905000 - RNA, 18 nt, Mycobacterium avium subsp. paratuberculosis
cggucggccgcgugcacc

SEQ ID NO: 2905001 - RNA, 15 nt, Mycobacterium avium subsp. paratuberculosis
cggucggccguacac

SEQ ID NO: 2905002 - RNA, 22 nt, Mycobacterium avium subsp. paratuberculosis
cggucggcgcccggcccagccg

SEQ ID NO: 2905003 - RNA, 23 nt, Mycobacterium avium subsp. paratuberculosis
cggucggcgcccggcccagccgc

SEQ ID NO: 2905004 - RNA, 15 nt, Mycobacterium avium subsp. paratuberculosis
cggucggcgccgauc

SEQ ID NO: 2905005 - RNA, 12 nt, Mycobacterium avium subsp. paratuberculosis
cggucggcgcgg

SEQ ID NO: 2905006 - RNA, 15 nt, Mycobacterium avium subsp. paratuberculosis
cggucggcgcggggc

SEQ ID NO: 2905007 - RNA, 12 nt, Mycobacterium avium subsp. paratuberculosis
cggucggcggcg

SEQ ID NO: 2905008 - RNA, 12 nt, Mycobacterium avium subsp. paratuberculosis
cggucggcgggu

SEQ ID NO: 2905009 - RNA, 15 nt, Mycobacterium avium subsp. paratuberculosis
cggucggcguccagc

SEQ ID NO: 2905010 - RNA, 12 nt, Mycobacterium avium subsp. paratuberculosis
cggucggcgucg

SEQ ID NO: 2905011 - RNA, 17 nt, Mycobacterium avium subsp. paratuberculosis
cggucggcgucguacag

SEQ ID NO: 2905012 - RNA, 18 nt, Mycobacterium avium subsp. paratuberculosis
cggucggcgucguacagc

SEQ ID NO: 2905013 - RNA, 18 nt, Mycobacterium avium subsp. paratuberculosis
cggucgggaucgaucccg

SEQ ID NO: 2905014 - RNA, 20 nt, Mycobacterium avium subsp. paratuberculosis
cggucgggaucugcggugag

SEQ ID NO: 2905015 - RNA, 12 nt, Mycobacterium avium subsp. paratuberculosis
cggucgggaugg

SEQ ID NO: 2905016 - RNA, 18 nt, Mycobacterium avium subsp. paratuberculosis
cggucgggauggcggcgu

SEQ ID NO: 2905017 - RNA, 12 nt, Mycobacterium avium subsp. paratuberculosis
cggucgggccca

SEQ ID NO: 2905018 - RNA, 21 nt, Mycobacterium avium subsp. paratuberculosis
cggucggggaauuccggcgcg

SEQ ID NO: 2905019 - RNA, 24 nt, Mycobacterium avium subsp. paratuberculosis
cggucggggaauuccggcgcgauc

SEQ ID NO: 2905020 - RNA, 17 nt, Mycobacterium avium subsp. paratuberculosis
cggucggggcggcgggc

SEQ ID NO: 2905021 - RNA, 19 nt, Mycobacterium avium subsp. paratuberculosis
cggucggggcggcgggcga

SEQ ID NO: 2905022 - RNA, 18 nt, Mycobacterium avium subsp. paratuberculosis
cggucggguugcgcggaa

SEQ ID NO: 2905023 - RNA, 15 nt, Mycobacterium avium subsp. paratuberculosis
cggucggucggccgc

SEQ ID NO: 2905024 - RNA, 23 nt, Mycobacterium avium subsp. paratuberculosis
cggucggugagcuggccgcgcag

SEQ ID NO: 2905025 - RNA, 17 nt, Mycobacterium avium subsp. paratuberculosis
cggucggugcccagcac

SEQ ID NO: 2905026 - RNA, 19 nt, Mycobacterium avium subsp. paratuberculosis
cggucggugcccagcaccg

SEQ ID NO: 2905027 - RNA, 16 nt, Mycobacterium avium subsp. paratuberculosis
cggucggugcgcagca

SEQ ID NO: 2905028 - RNA, 18 nt, Mycobacterium avium subsp. paratuberculosis
cggucgguggcggugccg

SEQ ID NO: 2905029 - RNA, 19 nt, Mycobacterium avium subsp. paratuberculosis
cggucgguggcggugccgc

SEQ ID NO: 2905030 - RNA, 20 nt, Mycobacterium avium subsp. paratuberculosis
cggucgguggcggugccgcg

SEQ ID NO: 2905031 - RNA, 17 nt, Mycobacterium avium subsp. paratuberculosis
cggucguaguaggugcg

SEQ ID NO: 2905032 - RNA, 20 nt, Mycobacterium avium subsp. paratuberculosis
cggucguaguaggugcgcga

SEQ ID NO: 2905033 - RNA, 21 nt, Mycobacterium avium subsp. paratuberculosis
cggucguagucggcccgccgg

SEQ ID NO: 2905034 - RNA, 15 nt, Mycobacterium avium subsp. paratuberculosis
cggucgucgagcacc

SEQ ID NO: 2905035 - RNA, 17 nt, Mycobacterium avium subsp. paratuberculosis
cggucgucgagcaccgg

SEQ ID NO: 2905036 - RNA, 18 nt, Mycobacterium avium subsp. paratuberculosis
cggucgucgagcaccggc

SEQ ID NO: 2905037 - RNA, 21 nt, Mycobacterium avium subsp. paratuberculosis
cggucgucgagcaccggcugg

SEQ ID NO: 2905038 - RNA, 13 nt, Mycobacterium avium subsp. paratuberculosis
cggucgucgccca

SEQ ID NO: 2905039 - RNA, 16 nt, Mycobacterium avium subsp. paratuberculosis
cggucgucgcccaccg

SEQ ID NO: 2905040 - RNA, 22 nt, Mycobacterium avium subsp. paratuberculosis
cggucgucgcccaccgacgcgg

SEQ ID NO: 2905041 - RNA, 12 nt, Mycobacterium avium subsp. paratuberculosis
cggucgucgccg

SEQ ID NO: 2905042 - RNA, 20 nt, Mycobacterium avium subsp. paratuberculosis
cggucgucuucuuggccgcg

SEQ ID NO: 2905043 - RNA, 19 nt, Mycobacterium avium subsp. paratuberculosis
cggucgugcgacuccuggg

SEQ ID NO: 2905044 - RNA, 15 nt, Mycobacterium avium subsp. paratuberculosis
cggucgugcggcugc

SEQ ID NO: 2905045 - RNA, 17 nt, Mycobacterium avium subsp. paratuberculosis
cggucgugcggcugccc

SEQ ID NO: 2905046 - RNA, 17 nt, Mycobacterium avium subsp. paratuberculosis
cggucgugcugggccgg

SEQ ID NO: 2905047 - RNA, 23 nt, Mycobacterium avium subsp. paratuberculosis
cggucgugucagggaugccccgu

SEQ ID NO: 2905048 - RNA, 21 nt, Mycobacterium avium subsp. paratuberculosis
cggucguuacgacucggccuc

SEQ ID NO: 2905049 - RNA, 15 nt, Mycobacterium avium subsp. paratuberculosis
cggucguuggccucc

SEQ ID NO: 2905050 - RNA, 20 nt, Mycobacterium avium subsp. paratuberculosis
cggucguuucggccggcccc

SEQ ID NO: 2905051 - RNA, 21 nt, Mycobacterium avium subsp. paratuberculosis
cggucguuucggccggccccg

SEQ ID NO: 2905052 - RNA, 22 nt, Mycobacterium avium subsp. paratuberculosis
cggucguuucggccggccccgc

SEQ ID NO: 2905053 - RNA, 20 nt, Mycobacterium avium subsp. paratuberculosis
cggucuccaugucgucggcg

SEQ ID NO: 2905054 - RNA, 22 nt, Mycobacterium avium subsp. paratuberculosis
cggucuccaugucgucggcgga

SEQ ID NO: 2905055 - RNA, 24 nt, Mycobacterium avium subsp. paratuberculosis
cggucuccaugucgucggcggacu

SEQ ID NO: 2905056 - RNA, 14 nt, Mycobacterium avium subsp. paratuberculosis
cggucucgacaccg

SEQ ID NO: 2905057 - RNA, 19 nt, Mycobacterium avium subsp. paratuberculosis
cggucucgacaccggcggu

SEQ ID NO: 2905058 - RNA, 21 nt, Mycobacterium avium subsp. paratuberculosis
cggucucgacaccggcgguca

SEQ ID NO: 2905059 - RNA, 16 nt, Mycobacterium avium subsp. paratuberculosis
cggucucgaccgcggc

SEQ ID NO: 2905060 - RNA, 20 nt, Mycobacterium avium subsp. paratuberculosis
cggucucgaccgcggcgccg

SEQ ID NO: 2905061 - RNA, 22 nt, Mycobacterium avium subsp. paratuberculosis
cggucucgaccgcggcgccgau

SEQ ID NO: 2905062 - RNA, 18 nt, Mycobacterium avium subsp. paratuberculosis
cggucucgacguuggaga

SEQ ID NO: 2905063 - RNA, 18 nt, Mycobacterium avium subsp. paratuberculosis
cggucucgaucugcacca

SEQ ID NO: 2905064 - RNA, 19 nt, Mycobacterium avium subsp. paratuberculosis
cggucucgaucugcaccag

SEQ ID NO: 2905065 - RNA, 20 nt, Mycobacterium avium subsp. paratuberculosis
cggucucgaucugcaccagc

SEQ ID NO: 2905066 - RNA, 15 nt, Mycobacterium avium subsp. paratuberculosis
cggucucgccccggc

SEQ ID NO: 2905067 - RNA, 17 nt, Mycobacterium avium subsp. paratuberculosis
cggucucgccccggccg

SEQ ID NO: 2905068 - RNA, 15 nt, Mycobacterium avium subsp. paratuberculosis
cggucucggcggcgc

SEQ ID NO: 2905069 - RNA, 16 nt, Mycobacterium avium subsp. paratuberculosis
cggucucggcggcgcc

SEQ ID NO: 2905070 - RNA, 17 nt, Mycobacterium avium subsp. paratuberculosis
cggucucggcggcgccc

SEQ ID NO: 2905071 - RNA, 18 nt, Mycobacterium avium subsp. paratuberculosis
cggucucggcggcgccca

SEQ ID NO: 2905072 - RNA, 19 nt, Mycobacterium avium subsp. paratuberculosis
cggucucggcggcgcccag

SEQ ID NO: 2905073 - RNA, 15 nt, Mycobacterium avium subsp. paratuberculosis
cggucucggucgcgg

SEQ ID NO: 2905074 - RNA, 14 nt, Mycobacterium avium subsp. paratuberculosis
cggucucuggccug

SEQ ID NO: 2905075 - RNA, 13 nt, Mycobacterium avium subsp. paratuberculosis
cggucucuucgac

SEQ ID NO: 2905076 - RNA, 15 nt, Mycobacterium avium subsp. paratuberculosis
cggucucuucgaccc

SEQ ID NO: 2905077 - RNA, 17 nt, Mycobacterium avium subsp. paratuberculosis
cggucucuucgacccgg

SEQ ID NO: 2905078 - RNA, 21 nt, Mycobacterium avium subsp. paratuberculosis
cggucucuucgacccgguagc

SEQ ID NO: 2905079 - RNA, 14 nt, Mycobacterium avium subsp. paratuberculosis
cggucugagcccgg

SEQ ID NO: 2905080 - RNA, 17 nt, Mycobacterium avium subsp. paratuberculosis
cggucugagcccggauu

SEQ ID NO: 2905081 - RNA, 15 nt, Mycobacterium avium subsp. paratuberculosis
cggucugaucgccca

SEQ ID NO: 2905082 - RNA, 22 nt, Mycobacterium avium subsp. paratuberculosis
cggucugcaccgggaugacaac

SEQ ID NO: 2905083 - RNA, 16 nt, Mycobacterium avium subsp. paratuberculosis
cggucugccuggcgaa

SEQ ID NO: 2905084 - RNA, 17 nt, Mycobacterium avium subsp. paratuberculosis
cggucugcgccagcucc

SEQ ID NO: 2905085 - RNA, 16 nt, Mycobacterium avium subsp. paratuberculosis
cggucugcgcccgauc

SEQ ID NO: 2905086 - RNA, 23 nt, Mycobacterium avium subsp. paratuberculosis
cggucugcgcccgaucggcguga

SEQ ID NO: 2905087 - RNA, 14 nt, Mycobacterium avium subsp. paratuberculosis
cggucugcggccgc

SEQ ID NO: 2905088 - RNA, 15 nt, Mycobacterium avium subsp. paratuberculosis
cggucugcggccgcg

SEQ ID NO: 2905089 - RNA, 18 nt, Mycobacterium avium subsp. paratuberculosis
cggucugcggccgcgacu

SEQ ID NO: 2905090 - RNA, 20 nt, Mycobacterium avium subsp. paratuberculosis
cggucugcggccgcgacugc

SEQ ID NO: 2905091 - RNA, 20 nt, Mycobacterium avium subsp. paratuberculosis
cggucugcuccccguugauc

SEQ ID NO: 2905092 - RNA, 20 nt, Mycobacterium avium subsp. paratuberculosis
cggucuggcuggugaccccg

SEQ ID NO: 2905093 - RNA, 18 nt, Mycobacterium avium subsp. paratuberculosis
cggucugggaggcggcgg

SEQ ID NO: 2905094 - RNA, 21 nt, Mycobacterium avium subsp. paratuberculosis
cggucugggcgaacggcaacg

SEQ ID NO: 2905095 - RNA, 18 nt, Mycobacterium avium subsp. paratuberculosis
cggucugggcgaccaugc

SEQ ID NO: 2905096 - RNA, 16 nt, Mycobacterium avium subsp. paratuberculosis
cggucugucgcgcgaa

SEQ ID NO: 2905097 - RNA, 17 nt, Mycobacterium avium subsp. paratuberculosis
cggucugucgcgcgaac

SEQ ID NO: 2905098 - RNA, 13 nt, Mycobacterium avium subsp. paratuberculosis
cggucuucgaaca

SEQ ID NO: 2905099 - RNA, 15 nt, Mycobacterium avium subsp. paratuberculosis
cggucuucucggcca

SEQ ID NO: 2905100 - RNA, 18 nt, Mycobacterium avium subsp. paratuberculosis
cggucuucucggccaggc

SEQ ID NO: 2905101 - RNA, 14 nt, Mycobacterium avium subsp. paratuberculosis
cggucuucuuggcc

SEQ ID NO: 2905102 - RNA, 16 nt, Mycobacterium avium subsp. paratuberculosis
cggucuucuuggccgc

SEQ ID NO: 2905103 - RNA, 21 nt, Mycobacterium avium subsp. paratuberculosis
cggucuucuuggccgcgccgc

SEQ ID NO: 2905104 - RNA, 20 nt, Mycobacterium avium subsp. paratuberculosis
cggucuucuuggcgggcgac

SEQ ID NO: 2905105 - RNA, 18 nt, Mycobacterium avium subsp. paratuberculosis
cggucuugaagucggugu

SEQ ID NO: 2905106 - RNA, 20 nt, Mycobacterium avium subsp. paratuberculosis
cggucuugaucaggucgccg

SEQ ID NO: 2905107 - RNA, 13 nt, Mycobacterium avium subsp. paratuberculosis
cggucuugcggcc

SEQ ID NO: 2905108 - RNA, 15 nt, Mycobacterium avium subsp. paratuberculosis
cggucuugcggccgu

SEQ ID NO: 2905109 - RNA, 16 nt, Mycobacterium avium subsp. paratuberculosis
cggucuugcggccguc

SEQ ID NO: 2905110 - RNA, 17 nt, Mycobacterium avium subsp. paratuberculosis
cggucuugcggccguca

SEQ ID NO: 2905111 - RNA, 15 nt, Mycobacterium avium subsp. paratuberculosis
cggucuuggacagca

SEQ ID NO: 2905112 - RNA, 16 nt, Mycobacterium avium subsp. paratuberculosis
cggucuuggacagcag

SEQ ID NO: 2905113 - RNA, 15 nt, Mycobacterium avium subsp. paratuberculosis
cggucuuggcggcca

SEQ ID NO: 2905114 - RNA, 16 nt, Mycobacterium avium subsp. paratuberculosis
cggucuuggcggccag

SEQ ID NO: 2905115 - RNA, 20 nt, Mycobacterium avium subsp. paratuberculosis
cggucuuggcggccagcgcc

SEQ ID NO: 2905116 - RNA, 22 nt, Mycobacterium avium subsp. paratuberculosis
cggucuuggcggccagcgccuu

SEQ ID NO: 2905117 - RNA, 18 nt, Mycobacterium avium subsp. paratuberculosis
cggucuuguagucgacca

SEQ ID NO: 2905118 - RNA, 23 nt, Mycobacterium avium subsp. paratuberculosis
cggucuuguagucgaccacccgc

SEQ ID NO: 2905119 - RNA, 20 nt, Mycobacterium avium subsp. paratuberculosis
cggucuuguugugcugcacc

SEQ ID NO: 2905120 - RNA, 21 nt, Mycobacterium avium subsp. paratuberculosis
cggucuuguugugcugcaccg

SEQ ID NO: 2905121 - RNA, 14 nt, Mycobacterium avium subsp. paratuberculosis
cggucuuuggcgua

SEQ ID NO: 2905122 - RNA, 15 nt, Mycobacterium avium subsp. paratuberculosis
cggugaaaccggcgc

SEQ ID NO: 2905123 - RNA, 18 nt, Mycobacterium avium subsp. paratuberculosis
cggugaaaccggcgccga

SEQ ID NO: 2905124 - RNA, 14 nt, Mycobacterium avium subsp. paratuberculosis
cggugaacacgaac

SEQ ID NO: 2905125 - RNA, 21 nt, Mycobacterium avium subsp. paratuberculosis
cggugaacacgaacggcgccu

SEQ ID NO: 2905126 - RNA, 15 nt, Mycobacterium avium subsp. paratuberculosis
cggugaacccgccgg

SEQ ID NO: 2905127 - RNA, 16 nt, Mycobacterium avium subsp. paratuberculosis
cggugaacccgccggc

SEQ ID NO: 2905128 - RNA, 19 nt, Mycobacterium avium subsp. paratuberculosis
cggugaacccgccggcgaa

SEQ ID NO: 2905129 - RNA, 15 nt, Mycobacterium avium subsp. paratuberculosis
cggugaaccgcugac

SEQ ID NO: 2905130 - RNA, 17 nt, Mycobacterium avium subsp. paratuberculosis
cggugaaccgcugacca

SEQ ID NO: 2905131 - RNA, 18 nt, Mycobacterium avium subsp. paratuberculosis
cggugaacgcgguaccga

SEQ ID NO: 2905132 - RNA, 14 nt, Mycobacterium avium subsp. paratuberculosis
cggugaacgggccg

SEQ ID NO: 2905133 - RNA, 15 nt, Mycobacterium avium subsp. paratuberculosis
cggugaacgggccgc

SEQ ID NO: 2905134 - RNA, 13 nt, Mycobacterium avium subsp. paratuberculosis
cggugaacggguc

SEQ ID NO: 2905135 - RNA, 22 nt, Mycobacterium avium subsp. paratuberculosis
cggugaacuccgggcccaccag

SEQ ID NO: 2905136 - RNA, 19 nt, Mycobacterium avium subsp. paratuberculosis
cggugaacucguccaugcu

SEQ ID NO: 2905137 - RNA, 14 nt, Mycobacterium avium subsp. paratuberculosis
cggugaagaucagc

SEQ ID NO: 2905138 - RNA, 18 nt, Mycobacterium avium subsp. paratuberculosis
cggugaagaucagcgcgu

SEQ ID NO: 2905139 - RNA, 20 nt, Mycobacterium avium subsp. paratuberculosis
cggugaagaucagcgcgucg

SEQ ID NO: 2905140 - RNA, 21 nt, Mycobacterium avium subsp. paratuberculosis
cggugaagaucagcgcgucgg

SEQ ID NO: 2905141 - RNA, 19 nt, Mycobacterium avium subsp. paratuberculosis
cggugaagaucgcccgccg

SEQ ID NO: 2905142 - RNA, 20 nt, Mycobacterium avium subsp. paratuberculosis
cggugaagaucgcccgccgc

SEQ ID NO: 2905143 - RNA, 22 nt, Mycobacterium avium subsp. paratuberculosis
cggugaagcggcgcgggucgcg

SEQ ID NO: 2905144 - RNA, 16 nt, Mycobacterium avium subsp. paratuberculosis
cggugaagucaacgca

SEQ ID NO: 2905145 - RNA, 21 nt, Mycobacterium avium subsp. paratuberculosis
cggugaaguccgagacgucgg

SEQ ID NO: 2905146 - RNA, 22 nt, Mycobacterium avium subsp. paratuberculosis
cggugaaguugccgccgccggg

SEQ ID NO: 2905147 - RNA, 19 nt, Mycobacterium avium subsp. paratuberculosis
cggugaaguuggcggcggu

SEQ ID NO: 2905148 - RNA, 20 nt, Mycobacterium avium subsp. paratuberculosis
cggugaaguuggcggcggug

SEQ ID NO: 2905149 - RNA, 20 nt, Mycobacterium avium subsp. paratuberculosis
cggugaaugucguagcgguc

SEQ ID NO: 2905150 - RNA, 22 nt, Mycobacterium avium subsp. paratuberculosis
cggugaaugucguagcggucgg

SEQ ID NO: 2905151 - RNA, 15 nt, Mycobacterium avium subsp. paratuberculosis
cggugaauugggcga

SEQ ID NO: 2905152 - RNA, 20 nt, Mycobacterium avium subsp. paratuberculosis
cggugacaaagaucacagcg

SEQ ID NO: 2905153 - RNA, 23 nt, Mycobacterium avium subsp. paratuberculosis
cggugacaaagaucacagcgccc

SEQ ID NO: 2905154 - RNA, 16 nt, Mycobacterium avium subsp. paratuberculosis
cggugacaucgccacc

SEQ ID NO: 2905155 - RNA, 21 nt, Mycobacterium avium subsp. paratuberculosis
cggugacaucgccaccuggaa

SEQ ID NO: 2905156 - RNA, 23 nt, Mycobacterium avium subsp. paratuberculosis
cggugacaucgccaccuggaagc

SEQ ID NO: 2905157 - RNA, 20 nt, Mycobacterium avium subsp. paratuberculosis
cggugacaugcccgggcucg

SEQ ID NO: 2905158 - RNA, 17 nt, Mycobacterium avium subsp. paratuberculosis
cggugaccaccugcacc

SEQ ID NO: 2905159 - RNA, 20 nt, Mycobacterium avium subsp. paratuberculosis
cggugaccaccugcaccugc

SEQ ID NO: 2905160 - RNA, 21 nt, Mycobacterium avium subsp. paratuberculosis
cggugaccaccugcaccugcg

SEQ ID NO: 2905161 - RNA, 23 nt, Mycobacterium avium subsp. paratuberculosis
cggugaccaccugcaccugcggc

SEQ ID NO: 2905162 - RNA, 19 nt, Mycobacterium avium subsp. paratuberculosis
cggugaccacgccgugccc

SEQ ID NO: 2905163 - RNA, 14 nt, Mycobacterium avium subsp. paratuberculosis
cggugaccacgcug

SEQ ID NO: 2905164 - RNA, 18 nt, Mycobacterium avium subsp. paratuberculosis
cggugaccacggucggcg

SEQ ID NO: 2905165 - RNA, 19 nt, Mycobacterium avium subsp. paratuberculosis
cggugaccacggucggcgg

SEQ ID NO: 2905166 - RNA, 14 nt, Mycobacterium avium subsp. paratuberculosis
cggugaccagaauc

SEQ ID NO: 2905167 - RNA, 23 nt, Mycobacterium avium subsp. paratuberculosis
cggugaccagaaucuucgccucc

SEQ ID NO: 2905168 - RNA, 16 nt, Mycobacterium avium subsp. paratuberculosis
cggugaccaucacgca

SEQ ID NO: 2905169 - RNA, 20 nt, Mycobacterium avium subsp. paratuberculosis
cggugaccgcccgcucgacg

SEQ ID NO: 2905170 - RNA, 22 nt, Mycobacterium avium subsp. paratuberculosis
cggugaccgccgccauccgcgc

SEQ ID NO: 2905171 - RNA, 21 nt, Mycobacterium avium subsp. paratuberculosis
cggugaccgccucgucgaagg

SEQ ID NO: 2905172 - RNA, 15 nt, Mycobacterium avium subsp. paratuberculosis
cggugaccgcgacgc

SEQ ID NO: 2905173 - RNA, 14 nt, Mycobacterium avium subsp. paratuberculosis
cggugaccgcgccg

SEQ ID NO: 2905174 - RNA, 15 nt, Mycobacterium avium subsp. paratuberculosis
cggugaccgcgccgc

SEQ ID NO: 2905175 - RNA, 18 nt, Mycobacterium avium subsp. paratuberculosis
cggugaccgcgccgcggg

SEQ ID NO: 2905176 - RNA, 16 nt, Mycobacterium avium subsp. paratuberculosis
cggugaccgcggccuc

SEQ ID NO: 2905177 - RNA, 19 nt, Mycobacterium avium subsp. paratuberculosis
cggugaccgcggccucguc

SEQ ID NO: 2905178 - RNA, 18 nt, Mycobacterium avium subsp. paratuberculosis
cggugaccggaucggcca

SEQ ID NO: 2905179 - RNA, 20 nt, Mycobacterium avium subsp. paratuberculosis
cggugaccggaucggccagc

SEQ ID NO: 2905180 - RNA, 13 nt, Mycobacterium avium subsp. paratuberculosis
cggugaccggcgc

SEQ ID NO: 2905181 - RNA, 14 nt, Mycobacterium avium subsp. paratuberculosis
cggugaccggcgcg

SEQ ID NO: 2905182 - RNA, 15 nt, Mycobacterium avium subsp. paratuberculosis
cggugaccggcgcgc

SEQ ID NO: 2905183 - RNA, 16 nt, Mycobacterium avium subsp. paratuberculosis
cggugaccggcgcgcc

SEQ ID NO: 2905184 - RNA, 15 nt, Mycobacterium avium subsp. paratuberculosis
cggugaccggcucga

SEQ ID NO: 2905185 - RNA, 14 nt, Mycobacterium avium subsp. paratuberculosis
cggugaccgucgcc

SEQ ID NO: 2905186 - RNA, 17 nt, Mycobacterium avium subsp. paratuberculosis
cggugaccgucgccgac

SEQ ID NO: 2905187 - RNA, 19 nt, Mycobacterium avium subsp. paratuberculosis
cggugaccgucgccgacca

SEQ ID NO: 2905188 - RNA, 21 nt, Mycobacterium avium subsp. paratuberculosis
cggugaccgucgccgaccagc

SEQ ID NO: 2905189 - RNA, 23 nt, Mycobacterium avium subsp. paratuberculosis
cggugaccgucgccgaccagccg

SEQ ID NO: 2905190 - RNA, 12 nt, Mycobacterium avium subsp. paratuberculosis
cggugaccucga

SEQ ID NO: 2905191 - RNA, 20 nt, Mycobacterium avium subsp. paratuberculosis
cggugaccucgagcaccggc

SEQ ID NO: 2905192 - RNA, 23 nt, Mycobacterium avium subsp. paratuberculosis
cggugaccucgagcaccggcggc

SEQ ID NO: 2905193 - RNA, 13 nt, Mycobacterium avium subsp. paratuberculosis
cggugaccugcag

SEQ ID NO: 2905194 - RNA, 15 nt, Mycobacterium avium subsp. paratuberculosis
cggugaccugcagcg

SEQ ID NO: 2905195 - RNA, 17 nt, Mycobacterium avium subsp. paratuberculosis
cggugaccugcagcgcc

SEQ ID NO: 2905196 - RNA, 17 nt, Mycobacterium avium subsp. paratuberculosis
cggugaccuugcgggcg

SEQ ID NO: 2905197 - RNA, 18 nt, Mycobacterium avium subsp. paratuberculosis
cggugaccuugcgggcgg

SEQ ID NO: 2905198 - RNA, 19 nt, Mycobacterium avium subsp. paratuberculosis
cggugaccuugcgggcggu

SEQ ID NO: 2905199 - RNA, 22 nt, Mycobacterium avium subsp. paratuberculosis
cggugacgaacaucgacgacgg

SEQ ID NO: 2905200 - RNA, 15 nt, Mycobacterium avium subsp. paratuberculosis
cggugacgaacccgc

SEQ ID NO: 2905201 - RNA, 13 nt, Mycobacterium avium subsp. paratuberculosis
cggugacgaccgg

SEQ ID NO: 2905202 - RNA, 14 nt, Mycobacterium avium subsp. paratuberculosis
cggugacgaccggc

SEQ ID NO: 2905203 - RNA, 17 nt, Mycobacterium avium subsp. paratuberculosis
cggugacgaccggcagc

SEQ ID NO: 2905204 - RNA, 18 nt, Mycobacterium avium subsp. paratuberculosis
cggugacgauccggucga

SEQ ID NO: 2905205 - RNA, 16 nt, Mycobacterium avium subsp. paratuberculosis
cggugacgaugauguc

SEQ ID NO: 2905206 - RNA, 19 nt, Mycobacterium avium subsp. paratuberculosis
cggugacgaugaugucggc

SEQ ID NO: 2905207 - RNA, 23 nt, Mycobacterium avium subsp. paratuberculosis
cggugacgaugaugucggccggc

SEQ ID NO: 2905208 - RNA, 14 nt, Mycobacterium avium subsp. paratuberculosis
cggugacgcgccgg

SEQ ID NO: 2905209 - RNA, 18 nt, Mycobacterium avium subsp. paratuberculosis
cggugacgcgccggccca

SEQ ID NO: 2905210 - RNA, 17 nt, Mycobacterium avium subsp. paratuberculosis
cggugacggcgucggcg

SEQ ID NO: 2905211 - RNA, 21 nt, Mycobacterium avium subsp. paratuberculosis
cggugacguuccagccgugcu

SEQ ID NO: 2905212 - RNA, 18 nt, Mycobacterium avium subsp. paratuberculosis
cggugagcaacaccggca

SEQ ID NO: 2905213 - RNA, 21 nt, Mycobacterium avium subsp. paratuberculosis
cggugagcaacaccggcacga

SEQ ID NO: 2905214 - RNA, 14 nt, Mycobacterium avium subsp. paratuberculosis
cggugagcaccgcc

SEQ ID NO: 2905215 - RNA, 16 nt, Mycobacterium avium subsp. paratuberculosis
cggugagcaccgccgu

SEQ ID NO: 2905216 - RNA, 17 nt, Mycobacterium avium subsp. paratuberculosis
cggugagcaccgccguc

SEQ ID NO: 2905217 - RNA, 14 nt, Mycobacterium avium subsp. paratuberculosis
cggugagcaccggg

SEQ ID NO: 2905218 - RNA, 13 nt, Mycobacterium avium subsp. paratuberculosis
cggugagcacgac

SEQ ID NO: 2905219 - RNA, 17 nt, Mycobacterium avium subsp. paratuberculosis
cggugagcacgaccgcc

SEQ ID NO: 2905220 - RNA, 18 nt, Mycobacterium avium subsp. paratuberculosis
cggugagcacgaccgcca

SEQ ID NO: 2905221 - RNA, 22 nt, Mycobacterium avium subsp. paratuberculosis
cggugagcacgaccgccagcag

SEQ ID NO: 2905222 - RNA, 21 nt, Mycobacterium avium subsp. paratuberculosis
cggugagcagcaugccgagca

SEQ ID NO: 2905223 - RNA, 22 nt, Mycobacterium avium subsp. paratuberculosis
cggugagcagcaugccgagcac

SEQ ID NO: 2905224 - RNA, 15 nt, Mycobacterium avium subsp. paratuberculosis
cggugagcagcucgg

SEQ ID NO: 2905225 - RNA, 19 nt, Mycobacterium avium subsp. paratuberculosis
cggugagcagcucggucac

SEQ ID NO: 2905226 - RNA, 23 nt, Mycobacterium avium subsp. paratuberculosis
cggugagcagcucggucaccagc

SEQ ID NO: 2905227 - RNA, 12 nt, Mycobacterium avium subsp. paratuberculosis
cggugagccgcc

SEQ ID NO: 2905228 - RNA, 18 nt, Mycobacterium avium subsp. paratuberculosis
cggugagccgccacagcg

SEQ ID NO: 2905229 - RNA, 19 nt, Mycobacterium avium subsp. paratuberculosis
cggugagccgccacagcgc

SEQ ID NO: 2905230 - RNA, 19 nt, Mycobacterium avium subsp. paratuberculosis
cggugagccgcuggauguc

SEQ ID NO: 2905231 - RNA, 20 nt, Mycobacterium avium subsp. paratuberculosis
cggugagccucagggcgcgc

SEQ ID NO: 2905232 - RNA, 12 nt, Mycobacterium avium subsp. paratuberculosis
cggugagcgcca

SEQ ID NO: 2905233 - RNA, 15 nt, Mycobacterium avium subsp. paratuberculosis
cggugagcgccaccc

SEQ ID NO: 2905234 - RNA, 13 nt, Mycobacterium avium subsp. paratuberculosis
cggugagcgcgcc

SEQ ID NO: 2905235 - RNA, 15 nt, Mycobacterium avium subsp. paratuberculosis
cggugagcgcgccgg

SEQ ID NO: 2905236 - RNA, 17 nt, Mycobacterium avium subsp. paratuberculosis
cggugagcgcgccggcc

SEQ ID NO: 2905237 - RNA, 19 nt, Mycobacterium avium subsp. paratuberculosis
cggugagcggauuggucgg

SEQ ID NO: 2905238 - RNA, 14 nt, Mycobacterium avium subsp. paratuberculosis
cggugagcggccgc

SEQ ID NO: 2905239 - RNA, 17 nt, Mycobacterium avium subsp. paratuberculosis
cggugagcggccgcagc

SEQ ID NO: 2905240 - RNA, 20 nt, Mycobacterium avium subsp. paratuberculosis
cggugagcggccgcagcgca

SEQ ID NO: 2905241 - RNA, 22 nt, Mycobacterium avium subsp. paratuberculosis
cggugagcguggucucguugug

SEQ ID NO: 2905242 - RNA, 16 nt, Mycobacterium avium subsp. paratuberculosis
cggugagcuggccgcg

SEQ ID NO: 2905243 - RNA, 17 nt, Mycobacterium avium subsp. paratuberculosis
cggugaggacaccacga

SEQ ID NO: 2905244 - RNA, 18 nt, Mycobacterium avium subsp. paratuberculosis
cggugaggacaccacgau

SEQ ID NO: 2905245 - RNA, 22 nt, Mycobacterium avium subsp. paratuberculosis
cggugaggacaccacgaucagc

SEQ ID NO: 2905246 - RNA, 17 nt, Mycobacterium avium subsp. paratuberculosis
cggugaggucgggcucg

SEQ ID NO: 2905247 - RNA, 23 nt, Mycobacterium avium subsp. paratuberculosis
cggugagguggcguagucgucga

SEQ ID NO: 2905248 - RNA, 17 nt, Mycobacterium avium subsp. paratuberculosis
cggugaggugggcggga

SEQ ID NO: 2905249 - RNA, 16 nt, Mycobacterium avium subsp. paratuberculosis
cggugaguucaucgac

SEQ ID NO: 2905250 - RNA, 18 nt, Mycobacterium avium subsp. paratuberculosis
cggugaguucaucgacgu

SEQ ID NO: 2905251 - RNA, 14 nt, Mycobacterium avium subsp. paratuberculosis
cggugaucaccaug

SEQ ID NO: 2905252 - RNA, 20 nt, Mycobacterium avium subsp. paratuberculosis
cggugaucaccaugaucagc

SEQ ID NO: 2905253 - RNA, 14 nt, Mycobacterium avium subsp. paratuberculosis
cggugaucacccgc

SEQ ID NO: 2905254 - RNA, 17 nt, Mycobacterium avium subsp. paratuberculosis
cggugaucacccgccgg

SEQ ID NO: 2905255 - RNA, 18 nt, Mycobacterium avium subsp. paratuberculosis
cggugaucacccgccggg

SEQ ID NO: 2905256 - RNA, 16 nt, Mycobacterium avium subsp. paratuberculosis
cggugaucagcagcag

SEQ ID NO: 2905257 - RNA, 23 nt, Mycobacterium avium subsp. paratuberculosis
cggugaucagggucccggucagc

SEQ ID NO: 2905258 - RNA, 19 nt, Mycobacterium avium subsp. paratuberculosis
cggugauccacuccagcac

SEQ ID NO: 2905259 - RNA, 21 nt, Mycobacterium avium subsp. paratuberculosis
cggugauccacuccagcaccg

SEQ ID NO: 2905260 - RNA, 16 nt, Mycobacterium avium subsp. paratuberculosis
cggugauccgcccggc

SEQ ID NO: 2905261 - RNA, 22 nt, Mycobacterium avium subsp. paratuberculosis
cggugauccgcccggcccgcau

SEQ ID NO: 2905262 - RNA, 20 nt, Mycobacterium avium subsp. paratuberculosis
cggugaucgccgcccacugg

SEQ ID NO: 2905263 - RNA, 13 nt, Mycobacterium avium subsp. paratuberculosis
cggugaucgccgg

SEQ ID NO: 2905264 - RNA, 14 nt, Mycobacterium avium subsp. paratuberculosis
cggugaucgccgga

SEQ ID NO: 2905265 - RNA, 21 nt, Mycobacterium avium subsp. paratuberculosis
cggugaucgcggcgcugccgc

SEQ ID NO: 2905266 - RNA, 15 nt, Mycobacterium avium subsp. paratuberculosis
cggugaucucaccgg

SEQ ID NO: 2905267 - RNA, 18 nt, Mycobacterium avium subsp. paratuberculosis
cggugaucucaccggcgg

SEQ ID NO: 2905268 - RNA, 19 nt, Mycobacterium avium subsp. paratuberculosis
cggugaucucaccggcggc

SEQ ID NO: 2905269 - RNA, 22 nt, Mycobacterium avium subsp. paratuberculosis
cggugaucucaccggcggcggc

SEQ ID NO: 2905270 - RNA, 23 nt, Mycobacterium avium subsp. paratuberculosis
cggugaucucaccggcggcggcc

SEQ ID NO: 2905271 - RNA, 17 nt, Mycobacterium avium subsp. paratuberculosis
cggugaucucccgugcg

SEQ ID NO: 2905272 - RNA, 20 nt, Mycobacterium avium subsp. paratuberculosis
cggugaucucccgugcgguc

SEQ ID NO: 2905273 - RNA, 15 nt, Mycobacterium avium subsp. paratuberculosis
cggugaucucgccga

SEQ ID NO: 2905274 - RNA, 19 nt, Mycobacterium avium subsp. paratuberculosis
cggugaucucgccgagcac

SEQ ID NO: 2905275 - RNA, 18 nt, Mycobacterium avium subsp. paratuberculosis
cggugaucucgucggcgg

SEQ ID NO: 2905276 - RNA, 22 nt, Mycobacterium avium subsp. paratuberculosis
cggugaucucgucggcggcggc

SEQ ID NO: 2905277 - RNA, 19 nt, Mycobacterium avium subsp. paratuberculosis
cggugaugaacgcgccguc

SEQ ID NO: 2905278 - RNA, 21 nt, Mycobacterium avium subsp. paratuberculosis
cggugaugaacgcgccgucgu

SEQ ID NO: 2905279 - RNA, 17 nt, Mycobacterium avium subsp. paratuberculosis
cggugaugaucgccggg

SEQ ID NO: 2905280 - RNA, 18 nt, Mycobacterium avium subsp. paratuberculosis
cggugaugaucgccgggu

SEQ ID NO: 2905281 - RNA, 17 nt, Mycobacterium avium subsp. paratuberculosis
cggugaugccgagcgcc

SEQ ID NO: 2905282 - RNA, 19 nt, Mycobacterium avium subsp. paratuberculosis
cggugaugccgagcgccgc

SEQ ID NO: 2905283 - RNA, 16 nt, Mycobacterium avium subsp. paratuberculosis
cggugaugccggacuu

SEQ ID NO: 2905284 - RNA, 15 nt, Mycobacterium avium subsp. paratuberculosis
cggugaugccggcca

SEQ ID NO: 2905285 - RNA, 17 nt, Mycobacterium avium subsp. paratuberculosis
cggugaugccggccagc

SEQ ID NO: 2905286 - RNA, 19 nt, Mycobacterium avium subsp. paratuberculosis
cggugaugccggccagccg

SEQ ID NO: 2905287 - RNA, 20 nt, Mycobacterium avium subsp. paratuberculosis
cggugaugccggccagccgc

SEQ ID NO: 2905288 - RNA, 15 nt, Mycobacterium avium subsp. paratuberculosis
cggugaugcgcgccg

SEQ ID NO: 2905289 - RNA, 17 nt, Mycobacterium avium subsp. paratuberculosis
cggugaugcgcgccgac

SEQ ID NO: 2905290 - RNA, 18 nt, Mycobacterium avium subsp. paratuberculosis
cggugaugcgcgccgacg

SEQ ID NO: 2905291 - RNA, 22 nt, Mycobacterium avium subsp. paratuberculosis
cggugaugcgcgccgacgacca

SEQ ID NO: 2905292 - RNA, 24 nt, Mycobacterium avium subsp. paratuberculosis
cggugaugcgcgccgacgaccagu

SEQ ID NO: 2905293 - RNA, 14 nt, Mycobacterium avium subsp. paratuberculosis
cggugaugcgcggc

SEQ ID NO: 2905294 - RNA, 16 nt, Mycobacterium avium subsp. paratuberculosis
cggugaugcgcggcga

SEQ ID NO: 2905295 - RNA, 19 nt, Mycobacterium avium subsp. paratuberculosis
cggugaugcgcggcgacgg

SEQ ID NO: 2905296 - RNA, 14 nt, Mycobacterium avium subsp. paratuberculosis
cggugaugcgggug

SEQ ID NO: 2905297 - RNA, 22 nt, Mycobacterium avium subsp. paratuberculosis
cggugauggacaucuccggcac

SEQ ID NO: 2905298 - RNA, 14 nt, Mycobacterium avium subsp. paratuberculosis
cggugauggccggc

SEQ ID NO: 2905299 - RNA, 18 nt, Mycobacterium avium subsp. paratuberculosis
cggugauggccggcuacc

SEQ ID NO: 2905300 - RNA, 19 nt, Mycobacterium avium subsp. paratuberculosis
cggugauggccggcuaccg

SEQ ID NO: 2905301 - RNA, 15 nt, Mycobacterium avium subsp. paratuberculosis
cggugauggcgaugc

SEQ ID NO: 2905302 - RNA, 16 nt, Mycobacterium avium subsp. paratuberculosis
cggugauggcgaugcc

SEQ ID NO: 2905303 - RNA, 22 nt, Mycobacterium avium subsp. paratuberculosis
cggugauggucaccgugucggc

SEQ ID NO: 2905304 - RNA, 16 nt, Mycobacterium avium subsp. paratuberculosis
cggugauggugaucuc

SEQ ID NO: 2905305 - RNA, 21 nt, Mycobacterium avium subsp. paratuberculosis
cggugauggugaucucgccgc

SEQ ID NO: 2905306 - RNA, 14 nt, Mycobacterium avium subsp. paratuberculosis
cggugaugucgacg

SEQ ID NO: 2905307 - RNA, 18 nt, Mycobacterium avium subsp. paratuberculosis
cggugaugucgacgucgu

SEQ ID NO: 2905308 - RNA, 16 nt, Mycobacterium avium subsp. paratuberculosis
cggugaugucgccggc

SEQ ID NO: 2905309 - RNA, 19 nt, Mycobacterium avium subsp. paratuberculosis
cggugaugucgccggcggc

SEQ ID NO: 2905310 - RNA, 14 nt, Mycobacterium avium subsp. paratuberculosis
cggugauguugucc

SEQ ID NO: 2905311 - RNA, 20 nt, Mycobacterium avium subsp. paratuberculosis
cggugauguugucgaacagc

SEQ ID NO: 2905312 - RNA, 20 nt, Mycobacterium avium subsp. paratuberculosis
cggugauuccggcacccgcc

SEQ ID NO: 2905313 - RNA, 23 nt, Mycobacterium avium subsp. paratuberculosis
cggugauuccggcacccgccagc

SEQ ID NO: 2905314 - RNA, 23 nt, Mycobacterium avium subsp. paratuberculosis
cggugauucgugcagugcgaucg

SEQ ID NO: 2905315 - RNA, 18 nt, Mycobacterium avium subsp. paratuberculosis
cggugcaacgccgccgac

SEQ ID NO: 2905316 - RNA, 21 nt, Mycobacterium avium subsp. paratuberculosis
cggugcaacgccgccgacagc

SEQ ID NO: 2905317 - RNA, 22 nt, Mycobacterium avium subsp. paratuberculosis
cggugcaacgccgccgacagca

SEQ ID NO: 2905318 - RNA, 20 nt, Mycobacterium avium subsp. paratuberculosis
cggugcacacgccgaggcgg

SEQ ID NO: 2905319 - RNA, 16 nt, Mycobacterium avium subsp. paratuberculosis
cggugcaccaccgugc

SEQ ID NO: 2905320 - RNA, 18 nt, Mycobacterium avium subsp. paratuberculosis
cggugcaccaccgugccg

SEQ ID NO: 2905321 - RNA, 20 nt, Mycobacterium avium subsp. paratuberculosis
cggugcaccaccgugccguc

SEQ ID NO: 2905322 - RNA, 15 nt, Mycobacterium avium subsp. paratuberculosis
cggugcaccaggacg

SEQ ID NO: 2905323 - RNA, 23 nt, Mycobacterium avium subsp. paratuberculosis
cggugcaccaggacgcgaccggc

SEQ ID NO: 2905324 - RNA, 12 nt, Mycobacterium avium subsp. paratuberculosis
cggugcaccgcg

SEQ ID NO: 2905325 - RNA, 13 nt, Mycobacterium avium subsp. paratuberculosis
cggugcaccgcgc

SEQ ID NO: 2905326 - RNA, 15 nt, Mycobacterium avium subsp. paratuberculosis
cggugcaccgcggcg

SEQ ID NO: 2905327 - RNA, 16 nt, Mycobacterium avium subsp. paratuberculosis
cggugcaccgcggcgc

SEQ ID NO: 2905328 - RNA, 17 nt, Mycobacterium avium subsp. paratuberculosis
cggugcaccgcggcgcg

SEQ ID NO: 2905329 - RNA, 20 nt, Mycobacterium avium subsp. paratuberculosis
cggugcacgagcgucgugcg

SEQ ID NO: 2905330 - RNA, 23 nt, Mycobacterium avium subsp. paratuberculosis
cggugcacgagcgucgugcgggc

SEQ ID NO: 2905331 - RNA, 18 nt, Mycobacterium avium subsp. paratuberculosis
cggugcacggcgccacca

SEQ ID NO: 2905332 - RNA, 15 nt, Mycobacterium avium subsp. paratuberculosis
cggugcacggucagc

SEQ ID NO: 2905333 - RNA, 18 nt, Mycobacterium avium subsp. paratuberculosis
cggugcacggucagcucg

SEQ ID NO: 2905334 - RNA, 19 nt, Mycobacterium avium subsp. paratuberculosis
cggugcacggucagcucgc

SEQ ID NO: 2905335 - RNA, 16 nt, Mycobacterium avium subsp. paratuberculosis
cggugcagaccccggc

SEQ ID NO: 2905336 - RNA, 24 nt, Mycobacterium avium subsp. paratuberculosis
cggugcagacgugacgugccccuc

SEQ ID NO: 2905337 - RNA, 17 nt, Mycobacterium avium subsp. paratuberculosis
cggugcagcacgugcgc

SEQ ID NO: 2905338 - RNA, 14 nt, Mycobacterium avium subsp. paratuberculosis
cggugcagcagcgc

SEQ ID NO: 2905339 - RNA, 15 nt, Mycobacterium avium subsp. paratuberculosis
cggugcagcagcgcc

SEQ ID NO: 2905340 - RNA, 16 nt, Mycobacterium avium subsp. paratuberculosis
cggugcagcagcgccg

SEQ ID NO: 2905341 - RNA, 17 nt, Mycobacterium avium subsp. paratuberculosis
cggugcagcagcgccgc

SEQ ID NO: 2905342 - RNA, 20 nt, Mycobacterium avium subsp. paratuberculosis
cggugcagcagcgccgcgac

SEQ ID NO: 2905343 - RNA, 21 nt, Mycobacterium avium subsp. paratuberculosis
cggugcagcagcgccgcgacg

SEQ ID NO: 2905344 - RNA, 12 nt, Mycobacterium avium subsp. paratuberculosis
cggugcagccgg

SEQ ID NO: 2905345 - RNA, 16 nt, Mycobacterium avium subsp. paratuberculosis
cggugcagccgggggc

SEQ ID NO: 2905346 - RNA, 16 nt, Mycobacterium avium subsp. paratuberculosis
cggugcagccgggugc

SEQ ID NO: 2905347 - RNA, 14 nt, Mycobacterium avium subsp. paratuberculosis
cggugcaggccgcg

SEQ ID NO: 2905348 - RNA, 16 nt, Mycobacterium avium subsp. paratuberculosis
cggugcaggccgcgac

SEQ ID NO: 2905349 - RNA, 18 nt, Mycobacterium avium subsp. paratuberculosis
cggugcaggccgcgacgg

SEQ ID NO: 2905350 - RNA, 18 nt, Mycobacterium avium subsp. paratuberculosis
cggugcagggucagcagc

SEQ ID NO: 2905351 - RNA, 22 nt, Mycobacterium avium subsp. paratuberculosis
cggugcaguacgcaucggcgcc

SEQ ID NO: 2905352 - RNA, 23 nt, Mycobacterium avium subsp. paratuberculosis
cggugcaguacgcaucggcgccg

SEQ ID NO: 2905353 - RNA, 13 nt, Mycobacterium avium subsp. paratuberculosis
cggugcaucgucg

SEQ ID NO: 2905354 - RNA, 14 nt, Mycobacterium avium subsp. paratuberculosis
cggugcaucgucgc

SEQ ID NO: 2905355 - RNA, 15 nt, Mycobacterium avium subsp. paratuberculosis
cggugcaucgucgcg

SEQ ID NO: 2905356 - RNA, 17 nt, Mycobacterium avium subsp. paratuberculosis
cggugcaucgucgcggc

SEQ ID NO: 2905357 - RNA, 21 nt, Mycobacterium avium subsp. paratuberculosis
cggugcaucgucgcggcgguc

SEQ ID NO: 2905358 - RNA, 22 nt, Mycobacterium avium subsp. paratuberculosis
cggugcaucgucgcggcgguca

SEQ ID NO: 2905359 - RNA, 23 nt, Mycobacterium avium subsp. paratuberculosis
cggugccacgaugaugcccccga

SEQ ID NO: 2905360 - RNA, 14 nt, Mycobacterium avium subsp. paratuberculosis
cggugccacgcggc

SEQ ID NO: 2905361 - RNA, 15 nt, Mycobacterium avium subsp. paratuberculosis
cggugccacggucag

SEQ ID NO: 2905362 - RNA, 16 nt, Mycobacterium avium subsp. paratuberculosis
cggugccaucgugggc

SEQ ID NO: 2905363 - RNA, 15 nt, Mycobacterium avium subsp. paratuberculosis
cggugcccagccagg

SEQ ID NO: 2905364 - RNA, 20 nt, Mycobacterium avium subsp. paratuberculosis
cggugcccagccaggccgcc

SEQ ID NO: 2905365 - RNA, 22 nt, Mycobacterium avium subsp. paratuberculosis
cggugcccagccaggccgccgg

SEQ ID NO: 2905366 - RNA, 14 nt, Mycobacterium avium subsp. paratuberculosis
cggugcccagccgc

SEQ ID NO: 2905367 - RNA, 16 nt, Mycobacterium avium subsp. paratuberculosis
cggugcccagccgcag

SEQ ID NO: 2905368 - RNA, 15 nt, Mycobacterium avium subsp. paratuberculosis
cggugcccagcgcga

SEQ ID NO: 2905369 - RNA, 23 nt, Mycobacterium avium subsp. paratuberculosis
cggugcccagcgcgaggucgacg

SEQ ID NO: 2905370 - RNA, 15 nt, Mycobacterium avium subsp. paratuberculosis
cggugcccaggucgc

SEQ ID NO: 2905371 - RNA, 19 nt, Mycobacterium avium subsp. paratuberculosis
cggugcccaggucgcccag

SEQ ID NO: 2905372 - RNA, 13 nt, Mycobacterium avium subsp. paratuberculosis
cggugcccgcagc

SEQ ID NO: 2905373 - RNA, 14 nt, Mycobacterium avium subsp. paratuberculosis
cggugcccgcagca

SEQ ID NO: 2905374 - RNA, 13 nt, Mycobacterium avium subsp. paratuberculosis
cggugcccgccga

SEQ ID NO: 2905375 - RNA, 16 nt, Mycobacterium avium subsp. paratuberculosis
cggugcccgccgcgac

SEQ ID NO: 2905376 - RNA, 19 nt, Mycobacterium avium subsp. paratuberculosis
cggugcccgccgcgaccgc

SEQ ID NO: 2905377 - RNA, 21 nt, Mycobacterium avium subsp. paratuberculosis
cggugcccgccgcgaccgcga

SEQ ID NO: 2905378 - RNA, 21 nt, Mycobacterium avium subsp. paratuberculosis
cggugcccgggguccaccggc

SEQ ID NO: 2905379 - RNA, 16 nt, Mycobacterium avium subsp. paratuberculosis
cggugccgaagcgcca

SEQ ID NO: 2905380 - RNA, 17 nt, Mycobacterium avium subsp. paratuberculosis
cggugccgaagcgccac

SEQ ID NO: 2905381 - RNA, 18 nt, Mycobacterium avium subsp. paratuberculosis
cggugccgaagcgccacg

SEQ ID NO: 2905382 - RNA, 19 nt, Mycobacterium avium subsp. paratuberculosis
cggugccgaagcgccacgg

SEQ ID NO: 2905383 - RNA, 23 nt, Mycobacterium avium subsp. paratuberculosis
cggugccgaagcgccacggggcg

SEQ ID NO: 2905384 - RNA, 13 nt, Mycobacterium avium subsp. paratuberculosis
cggugccgaccug

SEQ ID NO: 2905385 - RNA, 21 nt, Mycobacterium avium subsp. paratuberculosis
cggugccgaccugggcggcca

SEQ ID NO: 2905386 - RNA, 23 nt, Mycobacterium avium subsp. paratuberculosis
cggugccgacgauccgggcgccc

SEQ ID NO: 2905387 - RNA, 17 nt, Mycobacterium avium subsp. paratuberculosis
cggugccgacgaugagg

SEQ ID NO: 2905388 - RNA, 15 nt, Mycobacterium avium subsp. paratuberculosis
cggugccgacggugc

SEQ ID NO: 2905389 - RNA, 21 nt, Mycobacterium avium subsp. paratuberculosis
cggugccgagcacgcggccgc

SEQ ID NO: 2905390 - RNA, 23 nt, Mycobacterium avium subsp. paratuberculosis
cggugccgagcacgcggccgcgc

SEQ ID NO: 2905391 - RNA, 18 nt, Mycobacterium avium subsp. paratuberculosis
cggugccgagcccgccgg

SEQ ID NO: 2905392 - RNA, 14 nt, Mycobacterium avium subsp. paratuberculosis
cggugccgaguucg

SEQ ID NO: 2905393 - RNA, 20 nt, Mycobacterium avium subsp. paratuberculosis
cggugccgaguucgaccucg

SEQ ID NO: 2905394 - RNA, 17 nt, Mycobacterium avium subsp. paratuberculosis
cggugccgauccgcacc

SEQ ID NO: 2905395 - RNA, 18 nt, Mycobacterium avium subsp. paratuberculosis
cggugccgauccgcaccg

SEQ ID NO: 2905396 - RNA, 12 nt, Mycobacterium avium subsp. paratuberculosis
cggugccgcagc

SEQ ID NO: 2905397 - RNA, 13 nt, Mycobacterium avium subsp. paratuberculosis
cggugccgcagcc

SEQ ID NO: 2905398 - RNA, 14 nt, Mycobacterium avium subsp. paratuberculosis
cggugccgcagccg

SEQ ID NO: 2905399 - RNA, 19 nt, Mycobacterium avium subsp. paratuberculosis
cggugccgcagugccggcg

SEQ ID NO: 2905400 - RNA, 14 nt, Mycobacterium avium subsp. paratuberculosis
cggugccgcccgga

SEQ ID NO: 2905401 - RNA, 13 nt, Mycobacterium avium subsp. paratuberculosis
cggugccgccggc

SEQ ID NO: 2905402 - RNA, 15 nt, Mycobacterium avium subsp. paratuberculosis
cggugccgccggcgc

SEQ ID NO: 2905403 - RNA, 18 nt, Mycobacterium avium subsp. paratuberculosis
cggugccgccggcgcauc

SEQ ID NO: 2905404 - RNA, 17 nt, Mycobacterium avium subsp. paratuberculosis
cggugccgccguccaug

SEQ ID NO: 2905405 - RNA, 15 nt, Mycobacterium avium subsp. paratuberculosis
cggugccgccgugcg

SEQ ID NO: 2905406 - RNA, 16 nt, Mycobacterium avium subsp. paratuberculosis
cggugccgccgugcgc

SEQ ID NO: 2905407 - RNA, 14 nt, Mycobacterium avium subsp. paratuberculosis
cggugccgcggcgg

SEQ ID NO: 2905408 - RNA, 15 nt, Mycobacterium avium subsp. paratuberculosis
cggugccgcggcggc

SEQ ID NO: 2905409 - RNA, 16 nt, Mycobacterium avium subsp. paratuberculosis
cggugccgcggcggcg

SEQ ID NO: 2905410 - RNA, 17 nt, Mycobacterium avium subsp. paratuberculosis
cggugccgcggcggcgc

SEQ ID NO: 2905411 - RNA, 18 nt, Mycobacterium avium subsp. paratuberculosis
cggugccgcggcggcgcc

SEQ ID NO: 2905412 - RNA, 21 nt, Mycobacterium avium subsp. paratuberculosis
cggugccgcggcggcgccgac

SEQ ID NO: 2905413 - RNA, 22 nt, Mycobacterium avium subsp. paratuberculosis
cggugccgcggcggcgccgacg

SEQ ID NO: 2905414 - RNA, 23 nt, Mycobacterium avium subsp. paratuberculosis
cggugccgcggcggcgccgacgg

SEQ ID NO: 2905415 - RNA, 15 nt, Mycobacterium avium subsp. paratuberculosis
cggugccgcguucgg

SEQ ID NO: 2905416 - RNA, 22 nt, Mycobacterium avium subsp. paratuberculosis
cggugccgcuggauuccaccgu

SEQ ID NO: 2905417 - RNA, 22 nt, Mycobacterium avium subsp. paratuberculosis
cggugccggccagaucgacgcc

SEQ ID NO: 2905418 - RNA, 23 nt, Mycobacterium avium subsp. paratuberculosis
cggugccggccagaucgacgccg

SEQ ID NO: 2905419 - RNA, 13 nt, Mycobacterium avium subsp. paratuberculosis
cggugccggccgg

SEQ ID NO: 2905420 - RNA, 17 nt, Mycobacterium avium subsp. paratuberculosis
cggugccggccgggucg

SEQ ID NO: 2905421 - RNA, 18 nt, Mycobacterium avium subsp. paratuberculosis
cggugccggccgggucga

SEQ ID NO: 2905422 - RNA, 16 nt, Mycobacterium avium subsp. paratuberculosis
cggugccgggccaggu

SEQ ID NO: 2905423 - RNA, 21 nt, Mycobacterium avium subsp. paratuberculosis
cggugccgguguugccgacgg

SEQ ID NO: 2905424 - RNA, 15 nt, Mycobacterium avium subsp. paratuberculosis
cggugccguccucgg

SEQ ID NO: 2905425 - RNA, 22 nt, Mycobacterium avium subsp. paratuberculosis
cggugccguccucggccgccac

SEQ ID NO: 2905426 - RNA, 14 nt, Mycobacterium avium subsp. paratuberculosis
cggugccgucgauc

SEQ ID NO: 2905427 - RNA, 18 nt, Mycobacterium avium subsp. paratuberculosis
cggugccguugaucaggg

SEQ ID NO: 2905428 - RNA, 23 nt, Mycobacterium avium subsp. paratuberculosis
cggugccguugaucagggcggcg

SEQ ID NO: 2905429 - RNA, 17 nt, Mycobacterium avium subsp. paratuberculosis
cggugccucuucgucgg

SEQ ID NO: 2905430 - RNA, 20 nt, Mycobacterium avium subsp. paratuberculosis
cggugccucuucgucggccg

SEQ ID NO: 2905431 - RNA, 21 nt, Mycobacterium avium subsp. paratuberculosis
cggugccucuucgucggccgg

SEQ ID NO: 2905432 - RNA, 22 nt, Mycobacterium avium subsp. paratuberculosis
cggugccucuucgucggccggc

SEQ ID NO: 2905433 - RNA, 23 nt, Mycobacterium avium subsp. paratuberculosis
cggugcgaaaauggcugcccggc

SEQ ID NO: 2905434 - RNA, 14 nt, Mycobacterium avium subsp. paratuberculosis
cggugcgacgccgc

SEQ ID NO: 2905435 - RNA, 20 nt, Mycobacterium avium subsp. paratuberculosis
cggugcgaugguggucgccg

SEQ ID NO: 2905436 - RNA, 22 nt, Mycobacterium avium subsp. paratuberculosis
cggugcgaugguggucgccguc

SEQ ID NO: 2905437 - RNA, 12 nt, Mycobacterium avium subsp. paratuberculosis
cggugcgcaccg

SEQ ID NO: 2905438 - RNA, 13 nt, Mycobacterium avium subsp. paratuberculosis
cggugcgcaccga

SEQ ID NO: 2905439 - RNA, 14 nt, Mycobacterium avium subsp. paratuberculosis
cggugcgcagcacg

SEQ ID NO: 2905440 - RNA, 15 nt, Mycobacterium avium subsp. paratuberculosis
cggugcgcagcacgu

SEQ ID NO: 2905441 - RNA, 17 nt, Mycobacterium avium subsp. paratuberculosis
cggugcgcagccgcugc

SEQ ID NO: 2905442 - RNA, 20 nt, Mycobacterium avium subsp. paratuberculosis
cggugcgcagccgcugcagc

SEQ ID NO: 2905443 - RNA, 13 nt, Mycobacterium avium subsp. paratuberculosis
cggugcgccacgc

SEQ ID NO: 2905444 - RNA, 19 nt, Mycobacterium avium subsp. paratuberculosis
cggugcgccagaucagcgu

SEQ ID NO: 2905445 - RNA, 21 nt, Mycobacterium avium subsp. paratuberculosis
cggugcgccagaucagcgugg

SEQ ID NO: 2905446 - RNA, 22 nt, Mycobacterium avium subsp. paratuberculosis
cggugcgccagaucagcguggu

SEQ ID NO: 2905447 - RNA, 14 nt, Mycobacterium avium subsp. paratuberculosis
cggugcgcccaggu

SEQ ID NO: 2905448 - RNA, 15 nt, Mycobacterium avium subsp. paratuberculosis
cggugcgcccgucgu

SEQ ID NO: 2905449 - RNA, 20 nt, Mycobacterium avium subsp. paratuberculosis
cggugcgcccgucgucgccg

SEQ ID NO: 2905450 - RNA, 23 nt, Mycobacterium avium subsp. paratuberculosis
cggugcgcccgucgucgccgaug

SEQ ID NO: 2905451 - RNA, 15 nt, Mycobacterium avium subsp. paratuberculosis
cggugcgccgacagc

SEQ ID NO: 2905452 - RNA, 18 nt, Mycobacterium avium subsp. paratuberculosis
cggugcgccgacagcuga

SEQ ID NO: 2905453 - RNA, 13 nt, Mycobacterium avium subsp. paratuberculosis
cggugcgccgacc

SEQ ID NO: 2905454 - RNA, 22 nt, Mycobacterium avium subsp. paratuberculosis
cggugcgccgcauuggugccgg

SEQ ID NO: 2905455 - RNA, 23 nt, Mycobacterium avium subsp. paratuberculosis
cggugcgccgcauuggugccggc

SEQ ID NO: 2905456 - RNA, 14 nt, Mycobacterium avium subsp. paratuberculosis
cggugcgccggcag

SEQ ID NO: 2905457 - RNA, 15 nt, Mycobacterium avium subsp. paratuberculosis
cggugcgccggcagc

SEQ ID NO: 2905458 - RNA, 17 nt, Mycobacterium avium subsp. paratuberculosis
cggugcgccggcagcgg

SEQ ID NO: 2905459 - RNA, 18 nt, Mycobacterium avium subsp. paratuberculosis
cggugcgccggcagcggc

SEQ ID NO: 2905460 - RNA, 21 nt, Mycobacterium avium subsp. paratuberculosis
cggugcgccggcagcggccgc

SEQ ID NO: 2905461 - RNA, 13 nt, Mycobacterium avium subsp. paratuberculosis
cggugcgccggua

SEQ ID NO: 2905462 - RNA, 15 nt, Mycobacterium avium subsp. paratuberculosis
cggugcgccgguagc

SEQ ID NO: 2905463 - RNA, 23 nt, Mycobacterium avium subsp. paratuberculosis
cggugcgccgguagcgacacgga

SEQ ID NO: 2905464 - RNA, 16 nt, Mycobacterium avium subsp. paratuberculosis
cggugcgcgcaccagg

SEQ ID NO: 2905465 - RNA, 13 nt, Mycobacterium avium subsp. paratuberculosis
cggugcgcgccgc

SEQ ID NO: 2905466 - RNA, 18 nt, Mycobacterium avium subsp. paratuberculosis
cggugcgcgcgcgcucgg

SEQ ID NO: 2905467 - RNA, 13 nt, Mycobacterium avium subsp. paratuberculosis
cggugcgcggcga

SEQ ID NO: 2905468 - RNA, 18 nt, Mycobacterium avium subsp. paratuberculosis
cggugcgcgggguggcgc

SEQ ID NO: 2905469 - RNA, 20 nt, Mycobacterium avium subsp. paratuberculosis
cggugcgcgggguggcgccg

SEQ ID NO: 2905470 - RNA, 21 nt, Mycobacterium avium subsp. paratuberculosis
cggugcgcgggguggcgccgg

SEQ ID NO: 2905471 - RNA, 22 nt, Mycobacterium avium subsp. paratuberculosis
cggugcgcgggguggcgccggc

SEQ ID NO: 2905472 - RNA, 23 nt, Mycobacterium avium subsp. paratuberculosis
cggugcgcgggguggcgccggcc

SEQ ID NO: 2905473 - RNA, 18 nt, Mycobacterium avium subsp. paratuberculosis
cggugcgcgucagccguc

SEQ ID NO: 2905474 - RNA, 23 nt, Mycobacterium avium subsp. paratuberculosis
cggugcgcgucagccgucgucgu

SEQ ID NO: 2905475 - RNA, 17 nt, Mycobacterium avium subsp. paratuberculosis
cggugcgcuccucgacg

SEQ ID NO: 2905476 - RNA, 21 nt, Mycobacterium avium subsp. paratuberculosis
cggugcgcucgugaccggcgg

SEQ ID NO: 2905477 - RNA, 14 nt, Mycobacterium avium subsp. paratuberculosis
cggugcggaacacc

SEQ ID NO: 2905478 - RNA, 16 nt, Mycobacterium avium subsp. paratuberculosis
cggugcggaacaccgc

SEQ ID NO: 2905479 - RNA, 18 nt, Mycobacterium avium subsp. paratuberculosis
cggugcggaacaccgccu

SEQ ID NO: 2905480 - RNA, 20 nt, Mycobacterium avium subsp. paratuberculosis
cggugcggaaggcccccggc

SEQ ID NO: 2905481 - RNA, 14 nt, Mycobacterium avium subsp. paratuberculosis
cggugcggacccgu

SEQ ID NO: 2905482 - RNA, 12 nt, Mycobacterium avium subsp. paratuberculosis
cggugcggcccg

SEQ ID NO: 2905483 - RNA, 15 nt, Mycobacterium avium subsp. paratuberculosis
cggugcggcccgcgg

SEQ ID NO: 2905484 - RNA, 16 nt, Mycobacterium avium subsp. paratuberculosis
cggugcggcccgcggc

SEQ ID NO: 2905485 - RNA, 22 nt, Mycobacterium avium subsp. paratuberculosis
cggugcggcccgcggcaucguc

SEQ ID NO: 2905486 - RNA, 14 nt, Mycobacterium avium subsp. paratuberculosis
cggugcggccgcga

SEQ ID NO: 2905487 - RNA, 14 nt, Mycobacterium avium subsp. paratuberculosis
cggugcggccgcgc

SEQ ID NO: 2905488 - RNA, 16 nt, Mycobacterium avium subsp. paratuberculosis
cggugcggccgcgcag

SEQ ID NO: 2905489 - RNA, 21 nt, Mycobacterium avium subsp. paratuberculosis
cggugcggccgcgcagcucga

SEQ ID NO: 2905490 - RNA, 12 nt, Mycobacterium avium subsp. paratuberculosis
cggugcggccuc

SEQ ID NO: 2905491 - RNA, 14 nt, Mycobacterium avium subsp. paratuberculosis
cggugcggccucga

SEQ ID NO: 2905492 - RNA, 13 nt, Mycobacterium avium subsp. paratuberculosis
cggugcggcgggc

SEQ ID NO: 2905493 - RNA, 17 nt, Mycobacterium avium subsp. paratuberculosis
cggugcggcgggcucgg

SEQ ID NO: 2905494 - RNA, 22 nt, Mycobacterium avium subsp. paratuberculosis
cggugcggcgggcucggacgac

SEQ ID NO: 2905495 - RNA, 16 nt, Mycobacterium avium subsp. paratuberculosis
cggugcggcggugacg

SEQ ID NO: 2905496 - RNA, 13 nt, Mycobacterium avium subsp. paratuberculosis
cggugcggcucgg

SEQ ID NO: 2905497 - RNA, 20 nt, Mycobacterium avium subsp. paratuberculosis
cggugcggcuuugcugccaa

SEQ ID NO: 2905498 - RNA, 15 nt, Mycobacterium avium subsp. paratuberculosis
cggugcggggccgcg

SEQ ID NO: 2905499 - RNA, 16 nt, Mycobacterium avium subsp. paratuberculosis
cggugcggggccgcgg

SEQ ID NO: 2905500 - RNA, 21 nt, Mycobacterium avium subsp. paratuberculosis
cggugcggggccgcggccggc

SEQ ID NO: 2905501 - RNA, 21 nt, Mycobacterium avium subsp. paratuberculosis
cggugcgggucacacccucgg

SEQ ID NO: 2905502 - RNA, 18 nt, Mycobacterium avium subsp. paratuberculosis
cggugcgggugguguggc

SEQ ID NO: 2905503 - RNA, 18 nt, Mycobacterium avium subsp. paratuberculosis
cggugcgguaggugccgg

SEQ ID NO: 2905504 - RNA, 21 nt, Mycobacterium avium subsp. paratuberculosis
cggugcgguaggugccggccg

SEQ ID NO: 2905505 - RNA, 22 nt, Mycobacterium avium subsp. paratuberculosis
cggugcgguaggugccggccgc

SEQ ID NO: 2905506 - RNA, 23 nt, Mycobacterium avium subsp. paratuberculosis
cggugcgguaggugccggccgcg

SEQ ID NO: 2905507 - RNA, 18 nt, Mycobacterium avium subsp. paratuberculosis
cggugcggucggcgucgu

SEQ ID NO: 2905508 - RNA, 14 nt, Mycobacterium avium subsp. paratuberculosis
cggugcguccgccg

SEQ ID NO: 2905509 - RNA, 16 nt, Mycobacterium avium subsp. paratuberculosis
cggugcguccgccggc

SEQ ID NO: 2905510 - RNA, 17 nt, Mycobacterium avium subsp. paratuberculosis
cggugcguccgccggcg

SEQ ID NO: 2905511 - RNA, 19 nt, Mycobacterium avium subsp. paratuberculosis
cggugcguccgccggcggu

SEQ ID NO: 2905512 - RNA, 20 nt, Mycobacterium avium subsp. paratuberculosis
cggugcguccgccggcggug

SEQ ID NO: 2905513 - RNA, 17 nt, Mycobacterium avium subsp. paratuberculosis
cggugcgucgggcgccg

SEQ ID NO: 2905514 - RNA, 18 nt, Mycobacterium avium subsp. paratuberculosis
cggugcgucgggcgccgg

SEQ ID NO: 2905515 - RNA, 19 nt, Mycobacterium avium subsp. paratuberculosis
cggugcgucgggcgccggc

SEQ ID NO: 2905516 - RNA, 24 nt, Mycobacterium avium subsp. paratuberculosis
cggugcgucgggcgccggcgcguc

SEQ ID NO: 2905517 - RNA, 16 nt, Mycobacterium avium subsp. paratuberculosis
cggugcgugaugacca

SEQ ID NO: 2905518 - RNA, 16 nt, Mycobacterium avium subsp. paratuberculosis
cggugcgugccagcag

SEQ ID NO: 2905519 - RNA, 23 nt, Mycobacterium avium subsp. paratuberculosis
cggugcguucgcguucgggcagc

SEQ ID NO: 2905520 - RNA, 18 nt, Mycobacterium avium subsp. paratuberculosis
cggugcguuuucggucgu

SEQ ID NO: 2905521 - RNA, 14 nt, Mycobacterium avium subsp. paratuberculosis
cggugcucgcgccg

SEQ ID NO: 2905522 - RNA, 16 nt, Mycobacterium avium subsp. paratuberculosis
cggugcucgcgccggg

SEQ ID NO: 2905523 - RNA, 20 nt, Mycobacterium avium subsp. paratuberculosis
cggugcucgcgccgggcggc

SEQ ID NO: 2905524 - RNA, 21 nt, Mycobacterium avium subsp. paratuberculosis
cggugcucgcgccgggcggcc

SEQ ID NO: 2905525 - RNA, 14 nt, Mycobacterium avium subsp. paratuberculosis
cggugcucggcgcg

SEQ ID NO: 2905526 - RNA, 20 nt, Mycobacterium avium subsp. paratuberculosis
cggugcucggcgcgcggggc

SEQ ID NO: 2905527 - RNA, 22 nt, Mycobacterium avium subsp. paratuberculosis
cggugcucgucgagcauccggc

SEQ ID NO: 2905528 - RNA, 23 nt, Mycobacterium avium subsp. paratuberculosis
cggugcucgucgagcauccggcg

SEQ ID NO: 2905529 - RNA, 18 nt, Mycobacterium avium subsp. paratuberculosis
cggugcucucgucgucgg

SEQ ID NO: 2905530 - RNA, 20 nt, Mycobacterium avium subsp. paratuberculosis
cggugcucucgucgucggcg

SEQ ID NO: 2905531 - RNA, 19 nt, Mycobacterium avium subsp. paratuberculosis
cggugcucuugacggccgc

SEQ ID NO: 2905532 - RNA, 21 nt, Mycobacterium avium subsp. paratuberculosis
cggugcucuugacggccgcgg

SEQ ID NO: 2905533 - RNA, 23 nt, Mycobacterium avium subsp. paratuberculosis
cggugcucuugacggccgcggcg

SEQ ID NO: 2905534 - RNA, 16 nt, Mycobacterium avium subsp. paratuberculosis
cggugcugacccgguc

SEQ ID NO: 2905535 - RNA, 18 nt, Mycobacterium avium subsp. paratuberculosis
cggugcugacccggucgc

SEQ ID NO: 2905536 - RNA, 20 nt, Mycobacterium avium subsp. paratuberculosis
cggugcugacccggucgcgg

SEQ ID NO: 2905537 - RNA, 21 nt, Mycobacterium avium subsp. paratuberculosis
cggugcugacccggucgcggc

SEQ ID NO: 2905538 - RNA, 22 nt, Mycobacterium avium subsp. paratuberculosis
cggugcugacccggucgcggcc

SEQ ID NO: 2905539 - RNA, 23 nt, Mycobacterium avium subsp. paratuberculosis
cggugcugcagauccgcucgccg

SEQ ID NO: 2905540 - RNA, 13 nt, Mycobacterium avium subsp. paratuberculosis
cggugcuggcgau

SEQ ID NO: 2905541 - RNA, 16 nt, Mycobacterium avium subsp. paratuberculosis
cggugcuggcgaugug

SEQ ID NO: 2905542 - RNA, 21 nt, Mycobacterium avium subsp. paratuberculosis
cggugcuggucaugccgucga

SEQ ID NO: 2905543 - RNA, 23 nt, Mycobacterium avium subsp. paratuberculosis
cggugcuggucaugccgucgacg

SEQ ID NO: 2905544 - RNA, 21 nt, Mycobacterium avium subsp. paratuberculosis
cggugcuuaccggccggccgc

SEQ ID NO: 2905545 - RNA, 23 nt, Mycobacterium avium subsp. paratuberculosis
cggugcuuaccggccggccgccu

SEQ ID NO: 2905546 - RNA, 15 nt, Mycobacterium avium subsp. paratuberculosis
cggugcuucaucccg

SEQ ID NO: 2905547 - RNA, 19 nt, Mycobacterium avium subsp. paratuberculosis
cggugcuucaucccgucgu

SEQ ID NO: 2905548 - RNA, 22 nt, Mycobacterium avium subsp. paratuberculosis
cggugcuucaucccgucguuga

SEQ ID NO: 2905549 - RNA, 17 nt, Mycobacterium avium subsp. paratuberculosis
cgguggaacccagcacc

SEQ ID NO: 2905550 - RNA, 12 nt, Mycobacterium avium subsp. paratuberculosis
cgguggacagcg

SEQ ID NO: 2905551 - RNA, 14 nt, Mycobacterium avium subsp. paratuberculosis
cgguggacagcgcg

SEQ ID NO: 2905552 - RNA, 18 nt, Mycobacterium avium subsp. paratuberculosis
cgguggacagcgcgacgg

SEQ ID NO: 2905553 - RNA, 21 nt, Mycobacterium avium subsp. paratuberculosis
cgguggacagcgcgacgggca

SEQ ID NO: 2905554 - RNA, 13 nt, Mycobacterium avium subsp. paratuberculosis
cgguggacccgac

SEQ ID NO: 2905555 - RNA, 13 nt, Mycobacterium avium subsp. paratuberculosis
cgguggacgccgc

SEQ ID NO: 2905556 - RNA, 18 nt, Mycobacterium avium subsp. paratuberculosis
cgguggacgccgcgcacg

SEQ ID NO: 2905557 - RNA, 20 nt, Mycobacterium avium subsp. paratuberculosis
cgguggacgccgcgcacgac

SEQ ID NO: 2905558 - RNA, 15 nt, Mycobacterium avium subsp. paratuberculosis
cgguggacgcggucg

SEQ ID NO: 2905559 - RNA, 18 nt, Mycobacterium avium subsp. paratuberculosis
cgguggacgcggucgccg

SEQ ID NO: 2905560 - RNA, 20 nt, Mycobacterium avium subsp. paratuberculosis
cgguggacgcggucgccgcc

SEQ ID NO: 2905561 - RNA, 22 nt, Mycobacterium avium subsp. paratuberculosis
cgguggacgcggucgccgccca

SEQ ID NO: 2905562 - RNA, 15 nt, Mycobacterium avium subsp. paratuberculosis
cgguggacuccagca

SEQ ID NO: 2905563 - RNA, 24 nt, Mycobacterium avium subsp. paratuberculosis
cgguggacuccagcaccagcacgg

SEQ ID NO: 2905564 - RNA, 18 nt, Mycobacterium avium subsp. paratuberculosis
cgguggagauggccagca

SEQ ID NO: 2905565 - RNA, 20 nt, Mycobacterium avium subsp. paratuberculosis
cgguggagauggccagcacc

SEQ ID NO: 2905566 - RNA, 23 nt, Mycobacterium avium subsp. paratuberculosis
cgguggagcacagcacggcaucg

SEQ ID NO: 2905567 - RNA, 14 nt, Mycobacterium avium subsp. paratuberculosis
cgguggagcggccc

SEQ ID NO: 2905568 - RNA, 21 nt, Mycobacterium avium subsp. paratuberculosis
cgguggagcggcccagcucgg

SEQ ID NO: 2905569 - RNA, 15 nt, Mycobacterium avium subsp. paratuberculosis
cgguggauccgguga

SEQ ID NO: 2905570 - RNA, 20 nt, Mycobacterium avium subsp. paratuberculosis
cgguggauccggugaccgcg

SEQ ID NO: 2905571 - RNA, 19 nt, Mycobacterium avium subsp. paratuberculosis
cgguggaugggcucgacca

SEQ ID NO: 2905572 - RNA, 13 nt, Mycobacterium avium subsp. paratuberculosis
cgguggcaccccg

SEQ ID NO: 2905573 - RNA, 14 nt, Mycobacterium avium subsp. paratuberculosis
cgguggcaccccgc

SEQ ID NO: 2905574 - RNA, 16 nt, Mycobacterium avium subsp. paratuberculosis
cgguggcaccccgcgc

SEQ ID NO: 2905575 - RNA, 20 nt, Mycobacterium avium subsp. paratuberculosis
cgguggcaccccgcgccggg

SEQ ID NO: 2905576 - RNA, 12 nt, Mycobacterium avium subsp. paratuberculosis
cgguggcagccc

SEQ ID NO: 2905577 - RNA, 12 nt, Mycobacterium avium subsp. paratuberculosis
cgguggccacca

SEQ ID NO: 2905578 - RNA, 14 nt, Mycobacterium avium subsp. paratuberculosis
cgguggccaccgcg

SEQ ID NO: 2905579 - RNA, 18 nt, Mycobacterium avium subsp. paratuberculosis
cgguggccaccgcgacgc

SEQ ID NO: 2905580 - RNA, 19 nt, Mycobacterium avium subsp. paratuberculosis
cgguggccaccgcgacgcc

SEQ ID NO: 2905581 - RNA, 12 nt, Mycobacterium avium subsp. paratuberculosis
cgguggccaccu

SEQ ID NO: 2905582 - RNA, 17 nt, Mycobacterium avium subsp. paratuberculosis
cgguggccacggcguug

SEQ ID NO: 2905583 - RNA, 13 nt, Mycobacterium avium subsp. paratuberculosis
cgguggccagcag

SEQ ID NO: 2905584 - RNA, 12 nt, Mycobacterium avium subsp. paratuberculosis
cgguggccaugc

SEQ ID NO: 2905585 - RNA, 14 nt, Mycobacterium avium subsp. paratuberculosis
cgguggcccagccg

SEQ ID NO: 2905586 - RNA, 15 nt, Mycobacterium avium subsp. paratuberculosis
cgguggcccagccgg

SEQ ID NO: 2905587 - RNA, 18 nt, Mycobacterium avium subsp. paratuberculosis
cgguggcccagccggccg

SEQ ID NO: 2905588 - RNA, 21 nt, Mycobacterium avium subsp. paratuberculosis
cgguggcccagccggccgacg

SEQ ID NO: 2905589 - RNA, 16 nt, Mycobacterium avium subsp. paratuberculosis
cgguggcccccaccac

SEQ ID NO: 2905590 - RNA, 12 nt, Mycobacterium avium subsp. paratuberculosis
cgguggccccgg

SEQ ID NO: 2905591 - RNA, 13 nt, Mycobacterium avium subsp. paratuberculosis
cgguggccccggg

SEQ ID NO: 2905592 - RNA, 14 nt, Mycobacterium avium subsp. paratuberculosis
cgguggccccgggc

SEQ ID NO: 2905593 - RNA, 17 nt, Mycobacterium avium subsp. paratuberculosis
cgguggccccgggccgc

SEQ ID NO: 2905594 - RNA, 18 nt, Mycobacterium avium subsp. paratuberculosis
cgguggccccgggccgca

SEQ ID NO: 2905595 - RNA, 13 nt, Mycobacterium avium subsp. paratuberculosis
cgguggcccggua

SEQ ID NO: 2905596 - RNA, 18 nt, Mycobacterium avium subsp. paratuberculosis
cgguggcccgguacagcg

SEQ ID NO: 2905597 - RNA, 15 nt, Mycobacterium avium subsp. paratuberculosis
cgguggcccggucgu

SEQ ID NO: 2905598 - RNA, 16 nt, Mycobacterium avium subsp. paratuberculosis
cgguggcccggucguc

SEQ ID NO: 2905599 - RNA, 19 nt, Mycobacterium avium subsp. paratuberculosis
cgguggcccggucgucgag

SEQ ID NO: 2905600 - RNA, 20 nt, Mycobacterium avium subsp. paratuberculosis
cgguggccgaaccgcucguc

SEQ ID NO: 2905601 - RNA, 21 nt, Mycobacterium avium subsp. paratuberculosis
cgguggccgaaccgcucgucg

SEQ ID NO: 2905602 - RNA, 22 nt, Mycobacterium avium subsp. paratuberculosis
cgguggccgaaccgcucgucgg

SEQ ID NO: 2905603 - RNA, 12 nt, Mycobacterium avium subsp. paratuberculosis
cgguggccgauc

SEQ ID NO: 2905604 - RNA, 15 nt, Mycobacterium avium subsp. paratuberculosis
cgguggccgccacca

SEQ ID NO: 2905605 - RNA, 12 nt, Mycobacterium avium subsp. paratuberculosis
cgguggccgccg

SEQ ID NO: 2905606 - RNA, 15 nt, Mycobacterium avium subsp. paratuberculosis
cgguggccgcgaacg

SEQ ID NO: 2905607 - RNA, 19 nt, Mycobacterium avium subsp. paratuberculosis
cgguggccgcgaagauguc

SEQ ID NO: 2905608 - RNA, 12 nt, Mycobacterium avium subsp. paratuberculosis
cgguggccgcgc

SEQ ID NO: 2905609 - RNA, 15 nt, Mycobacterium avium subsp. paratuberculosis
cgguggccgcgcugg

SEQ ID NO: 2905610 - RNA, 15 nt, Mycobacterium avium subsp. paratuberculosis
cgguggccgcgucga

SEQ ID NO: 2905611 - RNA, 16 nt, Mycobacterium avium subsp. paratuberculosis
cgguggccgcgucgac

SEQ ID NO: 2905612 - RNA, 20 nt, Mycobacterium avium subsp. paratuberculosis
cgguggccgcgucgaccagc

SEQ ID NO: 2905613 - RNA, 18 nt, Mycobacterium avium subsp. paratuberculosis
cgguggccguaaccgccg

SEQ ID NO: 2905614 - RNA, 21 nt, Mycobacterium avium subsp. paratuberculosis
cgguggccgucucgucggccg

SEQ ID NO: 2905615 - RNA, 16 nt, Mycobacterium avium subsp. paratuberculosis
cgguggccucgcgcaa

SEQ ID NO: 2905616 - RNA, 21 nt, Mycobacterium avium subsp. paratuberculosis
cgguggccucgcgcaaugccg

SEQ ID NO: 2905617 - RNA, 14 nt, Mycobacterium avium subsp. paratuberculosis
cgguggccucggcg

SEQ ID NO: 2905618 - RNA, 18 nt, Mycobacterium avium subsp. paratuberculosis
cgguggccucggcgcugc

SEQ ID NO: 2905619 - RNA, 19 nt, Mycobacterium avium subsp. paratuberculosis
cgguggccucggcgcugcc

SEQ ID NO: 2905620 - RNA, 22 nt, Mycobacterium avium subsp. paratuberculosis
cgguggccucggcgcugcccgc

SEQ ID NO: 2905621 - RNA, 19 nt, Mycobacterium avium subsp. paratuberculosis
cgguggccugcccggcggu

SEQ ID NO: 2905622 - RNA, 20 nt, Mycobacterium avium subsp. paratuberculosis
cgguggccugcccggcggug

SEQ ID NO: 2905623 - RNA, 23 nt, Mycobacterium avium subsp. paratuberculosis
cgguggccugcccggcggugccg

SEQ ID NO: 2905624 - RNA, 15 nt, Mycobacterium avium subsp. paratuberculosis
cgguggccuggucgg

SEQ ID NO: 2905625 - RNA, 17 nt, Mycobacterium avium subsp. paratuberculosis
cgguggcgaacugcacc

SEQ ID NO: 2905626 - RNA, 18 nt, Mycobacterium avium subsp. paratuberculosis
cgguggcgaacugcacca

SEQ ID NO: 2905627 - RNA, 19 nt, Mycobacterium avium subsp. paratuberculosis
cgguggcgaacugcaccag

SEQ ID NO: 2905628 - RNA, 20 nt, Mycobacterium avium subsp. paratuberculosis
cgguggcgaacugcaccagc

SEQ ID NO: 2905629 - RNA, 21 nt, Mycobacterium avium subsp. paratuberculosis
cgguggcgaacugcaccagca

SEQ ID NO: 2905630 - RNA, 22 nt, Mycobacterium avium subsp. paratuberculosis
cgguggcgaacugcaccagcac

SEQ ID NO: 2905631 - RNA, 13 nt, Mycobacterium avium subsp. paratuberculosis
cgguggcgaagca

SEQ ID NO: 2905632 - RNA, 20 nt, Mycobacterium avium subsp. paratuberculosis
cgguggcgacaacaggcgac

SEQ ID NO: 2905633 - RNA, 21 nt, Mycobacterium avium subsp. paratuberculosis
cgguggcgaugaucaccucgg

SEQ ID NO: 2905634 - RNA, 16 nt, Mycobacterium avium subsp. paratuberculosis
cgguggcgauggugcu

SEQ ID NO: 2905635 - RNA, 19 nt, Mycobacterium avium subsp. paratuberculosis
cgguggcgauggugcugcc

SEQ ID NO: 2905636 - RNA, 16 nt, Mycobacterium avium subsp. paratuberculosis
cgguggcgcacaaccc

SEQ ID NO: 2905637 - RNA, 18 nt, Mycobacterium avium subsp. paratuberculosis
cgguggcgcacaacccgg

SEQ ID NO: 2905638 - RNA, 20 nt, Mycobacterium avium subsp. paratuberculosis
cgguggcgcccagcgagcug

SEQ ID NO: 2905639 - RNA, 21 nt, Mycobacterium avium subsp. paratuberculosis
cgguggcgcccgcgguggaac

SEQ ID NO: 2905640 - RNA, 14 nt, Mycobacterium avium subsp. paratuberculosis
cgguggcgccgcgg

SEQ ID NO: 2905641 - RNA, 17 nt, Mycobacterium avium subsp. paratuberculosis
cgguggcgccggggcgg

SEQ ID NO: 2905642 - RNA, 19 nt, Mycobacterium avium subsp. paratuberculosis
cgguggcgccggggcgggc

SEQ ID NO: 2905643 - RNA, 15 nt, Mycobacterium avium subsp. paratuberculosis
cgguggcgcggguga

SEQ ID NO: 2905644 - RNA, 13 nt, Mycobacterium avium subsp. paratuberculosis
cgguggcggccac

SEQ ID NO: 2905645 - RNA, 19 nt, Mycobacterium avium subsp. paratuberculosis
cgguggcggccacgaucgc

SEQ ID NO: 2905646 - RNA, 19 nt, Mycobacterium avium subsp. paratuberculosis
cgguggcggccaggccggc

SEQ ID NO: 2905647 - RNA, 22 nt, Mycobacterium avium subsp. paratuberculosis
cgguggcggccaggccggcgac

SEQ ID NO: 2905648 - RNA, 12 nt, Mycobacterium avium subsp. paratuberculosis
cgguggcggcga

SEQ ID NO: 2905649 - RNA, 13 nt, Mycobacterium avium subsp. paratuberculosis
cgguggcggcgaa

SEQ ID NO: 2905650 - RNA, 17 nt, Mycobacterium avium subsp. paratuberculosis
cgguggcggcgaacgcg

SEQ ID NO: 2905651 - RNA, 15 nt, Mycobacterium avium subsp. paratuberculosis
cgguggcggcgagga

SEQ ID NO: 2905652 - RNA, 15 nt, Mycobacterium avium subsp. paratuberculosis
cgguggcggcgaugu

SEQ ID NO: 2905653 - RNA, 13 nt, Mycobacterium avium subsp. paratuberculosis
cgguggcgggccg

SEQ ID NO: 2905654 - RNA, 14 nt, Mycobacterium avium subsp. paratuberculosis
cgguggcgggccgc

SEQ ID NO: 2905655 - RNA, 17 nt, Mycobacterium avium subsp. paratuberculosis
cgguggcgggccgccgg

SEQ ID NO: 2905656 - RNA, 19 nt, Mycobacterium avium subsp. paratuberculosis
cgguggcggucagggucag

SEQ ID NO: 2905657 - RNA, 23 nt, Mycobacterium avium subsp. paratuberculosis
cgguggcggugccgcggcggcgc

SEQ ID NO: 2905658 - RNA, 14 nt, Mycobacterium avium subsp. paratuberculosis
cgguggcggugcgg

SEQ ID NO: 2905659 - RNA, 15 nt, Mycobacterium avium subsp. paratuberculosis
cgguggcggugcggu

SEQ ID NO: 2905660 - RNA, 14 nt, Mycobacterium avium subsp. paratuberculosis
cgguggcguccagc

SEQ ID NO: 2905661 - RNA, 18 nt, Mycobacterium avium subsp. paratuberculosis
cgguggcguccucgacgg

SEQ ID NO: 2905662 - RNA, 16 nt, Mycobacterium avium subsp. paratuberculosis
cgguggcgucggcggc

SEQ ID NO: 2905663 - RNA, 16 nt, Mycobacterium avium subsp. paratuberculosis
cgguggcgucggugau

SEQ ID NO: 2905664 - RNA, 21 nt, Mycobacterium avium subsp. paratuberculosis
cgguggcgucggugaugccgg

SEQ ID NO: 2905665 - RNA, 17 nt, Mycobacterium avium subsp. paratuberculosis
cgguggcgugcagcgcg

SEQ ID NO: 2905666 - RNA, 18 nt, Mycobacterium avium subsp. paratuberculosis
cgguggcgugcagcgcgg

SEQ ID NO: 2905667 - RNA, 17 nt, Mycobacterium avium subsp. paratuberculosis
cgguggcguugcgggcg

SEQ ID NO: 2905668 - RNA, 16 nt, Mycobacterium avium subsp. paratuberculosis
cgguggcuuccagccc

SEQ ID NO: 2905669 - RNA, 17 nt, Mycobacterium avium subsp. paratuberculosis
cgguggcuuccagcccg

SEQ ID NO: 2905670 - RNA, 23 nt, Mycobacterium avium subsp. paratuberculosis
cggugggacugggcgccgccggc

SEQ ID NO: 2905671 - RNA, 23 nt, Mycobacterium avium subsp. paratuberculosis
cggugggauagauguugcggccg

SEQ ID NO: 2905672 - RNA, 13 nt, Mycobacterium avium subsp. paratuberculosis
cggugggcaccag

SEQ ID NO: 2905673 - RNA, 16 nt, Mycobacterium avium subsp. paratuberculosis
cggugggcaccagcag

SEQ ID NO: 2905674 - RNA, 17 nt, Mycobacterium avium subsp. paratuberculosis
cggugggcaccagcagc

SEQ ID NO: 2905675 - RNA, 19 nt, Mycobacterium avium subsp. paratuberculosis
cggugggcaccagcagcgc

SEQ ID NO: 2905676 - RNA, 22 nt, Mycobacterium avium subsp. paratuberculosis
cggugggcagcucgucggcgcg

SEQ ID NO: 2905677 - RNA, 12 nt, Mycobacterium avium subsp. paratuberculosis
cggugggcccgc

SEQ ID NO: 2905678 - RNA, 14 nt, Mycobacterium avium subsp. paratuberculosis
cggugggcccgccg

SEQ ID NO: 2905679 - RNA, 13 nt, Mycobacterium avium subsp. paratuberculosis
cggugggccgcac

SEQ ID NO: 2905680 - RNA, 14 nt, Mycobacterium avium subsp. paratuberculosis
cggugggccgcacc

SEQ ID NO: 2905681 - RNA, 21 nt, Mycobacterium avium subsp. paratuberculosis
cggugggccgccgcggcggca

SEQ ID NO: 2905682 - RNA, 17 nt, Mycobacterium avium subsp. paratuberculosis
cggugggcgcgggccgc

SEQ ID NO: 2905683 - RNA, 18 nt, Mycobacterium avium subsp. paratuberculosis
cggugggcgcgggccgcg

SEQ ID NO: 2905684 - RNA, 13 nt, Mycobacterium avium subsp. paratuberculosis
cggugggcggcgc

SEQ ID NO: 2905685 - RNA, 15 nt, Mycobacterium avium subsp. paratuberculosis
cggugggcggcgccc

SEQ ID NO: 2905686 - RNA, 17 nt, Mycobacterium avium subsp. paratuberculosis
cggugggcggcgcccga

SEQ ID NO: 2905687 - RNA, 23 nt, Mycobacterium avium subsp. paratuberculosis
cggugggcggcgggagcuaggcg

SEQ ID NO: 2905688 - RNA, 14 nt, Mycobacterium avium subsp. paratuberculosis
cggugggcucggcg

SEQ ID NO: 2905689 - RNA, 17 nt, Mycobacterium avium subsp. paratuberculosis
cggugggcucggcgccg

SEQ ID NO: 2905690 - RNA, 19 nt, Mycobacterium avium subsp. paratuberculosis
cggugggcucggcgccgac

SEQ ID NO: 2905691 - RNA, 20 nt, Mycobacterium avium subsp. paratuberculosis
cggugggcucggcgccgacc

SEQ ID NO: 2905692 - RNA, 15 nt, Mycobacterium avium subsp. paratuberculosis
cggugggcucgucga

SEQ ID NO: 2905693 - RNA, 16 nt, Mycobacterium avium subsp. paratuberculosis
cggugggcucgucgaa

SEQ ID NO: 2905694 - RNA, 13 nt, Mycobacterium avium subsp. paratuberculosis
cggugggcugggc

SEQ ID NO: 2905695 - RNA, 16 nt, Mycobacterium avium subsp. paratuberculosis
cggugggcugggcgaa

SEQ ID NO: 2905696 - RNA, 21 nt, Mycobacterium avium subsp. paratuberculosis
cgguggggacgugcacgcguu

SEQ ID NO: 2905697 - RNA, 17 nt, Mycobacterium avium subsp. paratuberculosis
cgguggggccgaagccg

SEQ ID NO: 2905698 - RNA, 19 nt, Mycobacterium avium subsp. paratuberculosis
cgguggggccgaagccgac

SEQ ID NO: 2905699 - RNA, 13 nt, Mycobacterium avium subsp. paratuberculosis
cgguggggccgcc

SEQ ID NO: 2905700 - RNA, 14 nt, Mycobacterium avium subsp. paratuberculosis
cgguggggccgccg

SEQ ID NO: 2905701 - RNA, 16 nt, Mycobacterium avium subsp. paratuberculosis
cgguggggccgccguc

SEQ ID NO: 2905702 - RNA, 16 nt, Mycobacterium avium subsp. paratuberculosis
cgguggggcuggccgc

SEQ ID NO: 2905703 - RNA, 19 nt, Mycobacterium avium subsp. paratuberculosis
cgguggggcuggccgcacg

SEQ ID NO: 2905704 - RNA, 17 nt, Mycobacterium avium subsp. paratuberculosis
cggugggggccaggcgg

SEQ ID NO: 2905705 - RNA, 17 nt, Mycobacterium avium subsp. paratuberculosis
cgguggggugaggcacc

SEQ ID NO: 2905706 - RNA, 21 nt, Mycobacterium avium subsp. paratuberculosis
cgguggggugaggcacccgcu

SEQ ID NO: 2905707 - RNA, 22 nt, Mycobacterium avium subsp. paratuberculosis
cgguggggugaugaggucgcga

SEQ ID NO: 2905708 - RNA, 19 nt, Mycobacterium avium subsp. paratuberculosis
cggugggguuagggcguca

SEQ ID NO: 2905709 - RNA, 22 nt, Mycobacterium avium subsp. paratuberculosis
cggugggucaauugacguaacc

SEQ ID NO: 2905710 - RNA, 16 nt, Mycobacterium avium subsp. paratuberculosis
cgguggguccgccggg

SEQ ID NO: 2905711 - RNA, 15 nt, Mycobacterium avium subsp. paratuberculosis
cgguggucaacgcgc

SEQ ID NO: 2905712 - RNA, 15 nt, Mycobacterium avium subsp. paratuberculosis
cgguggucagcaccg

SEQ ID NO: 2905713 - RNA, 17 nt, Mycobacterium avium subsp. paratuberculosis
cgguggucagcggcgcc

SEQ ID NO: 2905714 - RNA, 21 nt, Mycobacterium avium subsp. paratuberculosis
cgguggucagcggcgccaccg

SEQ ID NO: 2905715 - RNA, 22 nt, Mycobacterium avium subsp. paratuberculosis
cggugguccgcgcgaccaucag

SEQ ID NO: 2905716 - RNA, 18 nt, Mycobacterium avium subsp. paratuberculosis
cgguggucgaacacggcg

SEQ ID NO: 2905717 - RNA, 19 nt, Mycobacterium avium subsp. paratuberculosis
cgguggucgaacacggcgc

SEQ ID NO: 2905718 - RNA, 20 nt, Mycobacterium avium subsp. paratuberculosis
cgguggucgaacacggcgcu

SEQ ID NO: 2905719 - RNA, 13 nt, Mycobacterium avium subsp. paratuberculosis
cgguggucgacga

SEQ ID NO: 2905720 - RNA, 20 nt, Mycobacterium avium subsp. paratuberculosis
cgguggucgacgagcccgcg

SEQ ID NO: 2905721 - RNA, 21 nt, Mycobacterium avium subsp. paratuberculosis
cgguggucgacgagcccgcgc

SEQ ID NO: 2905722 - RNA, 15 nt, Mycobacterium avium subsp. paratuberculosis
cgguggucggcguca

SEQ ID NO: 2905723 - RNA, 17 nt, Mycobacterium avium subsp. paratuberculosis
cgguggucggcgucacc

SEQ ID NO: 2905724 - RNA, 14 nt, Mycobacterium avium subsp. paratuberculosis
cgguggugauaggg

SEQ ID NO: 2905725 - RNA, 18 nt, Mycobacterium avium subsp. paratuberculosis
cgguggugaucgcggcgg

SEQ ID NO: 2905726 - RNA, 19 nt, Mycobacterium avium subsp. paratuberculosis
cgguggugaucgcggcggc

SEQ ID NO: 2905727 - RNA, 16 nt, Mycobacterium avium subsp. paratuberculosis
cgguggugauggacgg

SEQ ID NO: 2905728 - RNA, 18 nt, Mycobacterium avium subsp. paratuberculosis
cgguggugccgccgucga

SEQ ID NO: 2905729 - RNA, 12 nt, Mycobacterium avium subsp. paratuberculosis
cgguggugcggc

SEQ ID NO: 2905730 - RNA, 18 nt, Mycobacterium avium subsp. paratuberculosis
cgguggugcucgccccgc

SEQ ID NO: 2905731 - RNA, 22 nt, Mycobacterium avium subsp. paratuberculosis
cgguggugcucgccccgcccga

SEQ ID NO: 2905732 - RNA, 16 nt, Mycobacterium avium subsp. paratuberculosis
cggugguggccaucgc

SEQ ID NO: 2905733 - RNA, 21 nt, Mycobacterium avium subsp. paratuberculosis
cggugguggccaucgcggccc

SEQ ID NO: 2905734 - RNA, 17 nt, Mycobacterium avium subsp. paratuberculosis
cggugguggccuugacg

SEQ ID NO: 2905735 - RNA, 15 nt, Mycobacterium avium subsp. paratuberculosis
cggugguggcgaaca

SEQ ID NO: 2905736 - RNA, 15 nt, Mycobacterium avium subsp. paratuberculosis
cgguggugggaucca

SEQ ID NO: 2905737 - RNA, 16 nt, Mycobacterium avium subsp. paratuberculosis
cgguggugggcgcggu

SEQ ID NO: 2905738 - RNA, 17 nt, Mycobacterium avium subsp. paratuberculosis
cgguggugggcgcggug

SEQ ID NO: 2905739 - RNA, 15 nt, Mycobacterium avium subsp. paratuberculosis
cggugguggggccgg

SEQ ID NO: 2905740 - RNA, 16 nt, Mycobacterium avium subsp. paratuberculosis
cggugguggggccggc

SEQ ID NO: 2905741 - RNA, 21 nt, Mycobacterium avium subsp. paratuberculosis
cgguggugggguccgcaggcg

SEQ ID NO: 2905742 - RNA, 18 nt, Mycobacterium avium subsp. paratuberculosis
cgguggugguggucucga

SEQ ID NO: 2905743 - RNA, 24 nt, Mycobacterium avium subsp. paratuberculosis
cgguggugguggucucgaugcacg

SEQ ID NO: 2905744 - RNA, 19 nt, Mycobacterium avium subsp. paratuberculosis
cgguggugucgucgggccg

SEQ ID NO: 2905745 - RNA, 11 nt, Mycobacterium avium subsp. paratuberculosis
cgguggugugg

SEQ ID NO: 2905746 - RNA, 22 nt, Mycobacterium avium subsp. paratuberculosis
cggugguguggcagguggcgua

SEQ ID NO: 2905747 - RNA, 19 nt, Mycobacterium avium subsp. paratuberculosis
cggugguuuugcggcccug

SEQ ID NO: 2905748 - RNA, 23 nt, Mycobacterium avium subsp. paratuberculosis
cggugguuuugcggcccugcagg

SEQ ID NO: 2905749 - RNA, 18 nt, Mycobacterium avium subsp. paratuberculosis
cgguguacagcgccaugu

SEQ ID NO: 2905750 - RNA, 14 nt, Mycobacterium avium subsp. paratuberculosis
cgguguacagcgcg

SEQ ID NO: 2905751 - RNA, 15 nt, Mycobacterium avium subsp. paratuberculosis
cgguguacagcgcgc

SEQ ID NO: 2905752 - RNA, 16 nt, Mycobacterium avium subsp. paratuberculosis
cgguguacagcgcgcc

SEQ ID NO: 2905753 - RNA, 18 nt, Mycobacterium avium subsp. paratuberculosis
cgguguagacgcgggccg

SEQ ID NO: 2905754 - RNA, 20 nt, Mycobacterium avium subsp. paratuberculosis
cgguguagacgcgggccggc

SEQ ID NO: 2905755 - RNA, 22 nt, Mycobacterium avium subsp. paratuberculosis
cgguguagacgcgggccggcac

SEQ ID NO: 2905756 - RNA, 15 nt, Mycobacterium avium subsp. paratuberculosis
cgguguagagcaccu

SEQ ID NO: 2905757 - RNA, 17 nt, Mycobacterium avium subsp. paratuberculosis
cgguguagaucggcuca

SEQ ID NO: 2905758 - RNA, 19 nt, Mycobacterium avium subsp. paratuberculosis
cgguguagaucggcucacc

SEQ ID NO: 2905759 - RNA, 15 nt, Mycobacterium avium subsp. paratuberculosis
cgguguagcccggug

SEQ ID NO: 2905760 - RNA, 15 nt, Mycobacterium avium subsp. paratuberculosis
cgguguagcgagugc

SEQ ID NO: 2905761 - RNA, 21 nt, Mycobacterium avium subsp. paratuberculosis
cgguguagcgagugccggcca

SEQ ID NO: 2905762 - RNA, 14 nt, Mycobacterium avium subsp. paratuberculosis
cgguguagcggcgg

SEQ ID NO: 2905763 - RNA, 20 nt, Mycobacterium avium subsp. paratuberculosis
cgguguagcggcggcugaag

SEQ ID NO: 2905764 - RNA, 17 nt, Mycobacterium avium subsp. paratuberculosis
cgguguaggacgccgug

SEQ ID NO: 2905765 - RNA, 20 nt, Mycobacterium avium subsp. paratuberculosis
cgguguaggacgccgugcag

SEQ ID NO: 2905766 - RNA, 22 nt, Mycobacterium avium subsp. paratuberculosis
cgguguaggacgccgugcagga

SEQ ID NO: 2905767 - RNA, 15 nt, Mycobacterium avium subsp. paratuberculosis
cgguguagucggcga

SEQ ID NO: 2905768 - RNA, 16 nt, Mycobacterium avium subsp. paratuberculosis
cgguguagucggcgau

SEQ ID NO: 2905769 - RNA, 21 nt, Mycobacterium avium subsp. paratuberculosis
cgguguaucccaucagugcgg

SEQ ID NO: 2905770 - RNA, 13 nt, Mycobacterium avium subsp. paratuberculosis
cggugucaccgac

SEQ ID NO: 2905771 - RNA, 16 nt, Mycobacterium avium subsp. paratuberculosis
cggugucaccgacgcc

SEQ ID NO: 2905772 - RNA, 21 nt, Mycobacterium avium subsp. paratuberculosis
cggugucaccgacgccagcgg

SEQ ID NO: 2905773 - RNA, 16 nt, Mycobacterium avium subsp. paratuberculosis
cggugucacgcuggcg

SEQ ID NO: 2905774 - RNA, 19 nt, Mycobacterium avium subsp. paratuberculosis
cggugucacgcuggcguga

SEQ ID NO: 2905775 - RNA, 18 nt, Mycobacterium avium subsp. paratuberculosis
cggugucacguccacgcc

SEQ ID NO: 2905776 - RNA, 20 nt, Mycobacterium avium subsp. paratuberculosis
cggugucacguccacgccgc

SEQ ID NO: 2905777 - RNA, 18 nt, Mycobacterium avium subsp. paratuberculosis
cggugucauaccagccgu

SEQ ID NO: 2905778 - RNA, 17 nt, Mycobacterium avium subsp. paratuberculosis
cgguguccacgucgccc

SEQ ID NO: 2905779 - RNA, 18 nt, Mycobacterium avium subsp. paratuberculosis
cgguguccacgucgccca

SEQ ID NO: 2905780 - RNA, 22 nt, Mycobacterium avium subsp. paratuberculosis
cgguguccacgucgcccagcgu

SEQ ID NO: 2905781 - RNA, 14 nt, Mycobacterium avium subsp. paratuberculosis
cgguguccaggucg

SEQ ID NO: 2905782 - RNA, 20 nt, Mycobacterium avium subsp. paratuberculosis
cggugucccaguucccggcg

SEQ ID NO: 2905783 - RNA, 22 nt, Mycobacterium avium subsp. paratuberculosis
cggugucccaguucccggcggg

SEQ ID NO: 2905784 - RNA, 17 nt, Mycobacterium avium subsp. paratuberculosis
cggugucccgcgcccgc

SEQ ID NO: 2905785 - RNA, 23 nt, Mycobacterium avium subsp. paratuberculosis
cggugucccgcgcccgcgaacac

SEQ ID NO: 2905786 - RNA, 15 nt, Mycobacterium avium subsp. paratuberculosis
cgguguccgcggcgu

SEQ ID NO: 2905787 - RNA, 16 nt, Mycobacterium avium subsp. paratuberculosis
cgguguccgcggcguc

SEQ ID NO: 2905788 - RNA, 23 nt, Mycobacterium avium subsp. paratuberculosis
cggugucgaagaccggugcgcgc

SEQ ID NO: 2905789 - RNA, 18 nt, Mycobacterium avium subsp. paratuberculosis
cggugucgaaggccgggg

SEQ ID NO: 2905790 - RNA, 19 nt, Mycobacterium avium subsp. paratuberculosis
cggugucgaaguacgccgu

SEQ ID NO: 2905791 - RNA, 12 nt, Mycobacterium avium subsp. paratuberculosis
cggugucgacgu

SEQ ID NO: 2905792 - RNA, 13 nt, Mycobacterium avium subsp. paratuberculosis
cggugucgagccg

SEQ ID NO: 2905793 - RNA, 14 nt, Mycobacterium avium subsp. paratuberculosis
cggugucgagccgg

SEQ ID NO: 2905794 - RNA, 19 nt, Mycobacterium avium subsp. paratuberculosis
cggugucgagccggugccg

SEQ ID NO: 2905795 - RNA, 17 nt, Mycobacterium avium subsp. paratuberculosis
cggugucgagggccauc

SEQ ID NO: 2905796 - RNA, 18 nt, Mycobacterium avium subsp. paratuberculosis
cggugucgaggucgucgg

SEQ ID NO: 2905797 - RNA, 14 nt, Mycobacterium avium subsp. paratuberculosis
cggugucgcacagc

SEQ ID NO: 2905798 - RNA, 17 nt, Mycobacterium avium subsp. paratuberculosis
cggugucgccgucgccg

SEQ ID NO: 2905799 - RNA, 22 nt, Mycobacterium avium subsp. paratuberculosis
cggugucgcuguaggccagccc

SEQ ID NO: 2905800 - RNA, 14 nt, Mycobacterium avium subsp. paratuberculosis
cggugucggcgacc

SEQ ID NO: 2905801 - RNA, 21 nt, Mycobacterium avium subsp. paratuberculosis
cggugucggcgccccggcgcu

SEQ ID NO: 2905802 - RNA, 21 nt, Mycobacterium avium subsp. paratuberculosis
cggugucggcgucgaucgccg

SEQ ID NO: 2905803 - RNA, 16 nt, Mycobacterium avium subsp. paratuberculosis
cggugucggggucguc

SEQ ID NO: 2905804 - RNA, 18 nt, Mycobacterium avium subsp. paratuberculosis
cggugucggggucgucga

SEQ ID NO: 2905805 - RNA, 20 nt, Mycobacterium avium subsp. paratuberculosis
cggugucggggucgucgacg

SEQ ID NO: 2905806 - RNA, 15 nt, Mycobacterium avium subsp. paratuberculosis
cggugucggugccca

SEQ ID NO: 2905807 - RNA, 18 nt, Mycobacterium avium subsp. paratuberculosis
cggugucggugcccaggu

SEQ ID NO: 2905808 - RNA, 20 nt, Mycobacterium avium subsp. paratuberculosis
cggugucggugcccaggucg

SEQ ID NO: 2905809 - RNA, 15 nt, Mycobacterium avium subsp. paratuberculosis
cggugucggugccga

SEQ ID NO: 2905810 - RNA, 18 nt, Mycobacterium avium subsp. paratuberculosis
cggugucggugccgagca

SEQ ID NO: 2905811 - RNA, 16 nt, Mycobacterium avium subsp. paratuberculosis
cggugucggugcgacc

SEQ ID NO: 2905812 - RNA, 17 nt, Mycobacterium avium subsp. paratuberculosis
cggugucguagacgacg

SEQ ID NO: 2905813 - RNA, 22 nt, Mycobacterium avium subsp. paratuberculosis
cggugucguaguugcgcgccga

SEQ ID NO: 2905814 - RNA, 17 nt, Mycobacterium avium subsp. paratuberculosis
cggugucugaccucgcg

SEQ ID NO: 2905815 - RNA, 18 nt, Mycobacterium avium subsp. paratuberculosis
cggugucugaccucgcgc

SEQ ID NO: 2905816 - RNA, 19 nt, Mycobacterium avium subsp. paratuberculosis
cggugucugaccucgcgcc

SEQ ID NO: 2905817 - RNA, 16 nt, Mycobacterium avium subsp. paratuberculosis
cggugugaucgagcac

SEQ ID NO: 2905818 - RNA, 20 nt, Mycobacterium avium subsp. paratuberculosis
cggugugaucgagcaccagc

SEQ ID NO: 2905819 - RNA, 12 nt, Mycobacterium avium subsp. paratuberculosis
cggugugcagca

SEQ ID NO: 2905820 - RNA, 13 nt, Mycobacterium avium subsp. paratuberculosis
cggugugcagcag

SEQ ID NO: 2905821 - RNA, 17 nt, Mycobacterium avium subsp. paratuberculosis
cggugugcagcagcucg

SEQ ID NO: 2905822 - RNA, 23 nt, Mycobacterium avium subsp. paratuberculosis
cggugugcagcagcucggcgauc

SEQ ID NO: 2905823 - RNA, 17 nt, Mycobacterium avium subsp. paratuberculosis
cggugugccgaagggca

SEQ ID NO: 2905824 - RNA, 14 nt, Mycobacterium avium subsp. paratuberculosis
cggugugccgcugc

SEQ ID NO: 2905825 - RNA, 17 nt, Mycobacterium avium subsp. paratuberculosis
cggugugccuggcuccc

SEQ ID NO: 2905826 - RNA, 22 nt, Mycobacterium avium subsp. paratuberculosis
cggugugccuggcuccccggcg

SEQ ID NO: 2905827 - RNA, 14 nt, Mycobacterium avium subsp. paratuberculosis
cggugugcggcagc

SEQ ID NO: 2905828 - RNA, 13 nt, Mycobacterium avium subsp. paratuberculosis
cggugugcggguc

SEQ ID NO: 2905829 - RNA, 15 nt, Mycobacterium avium subsp. paratuberculosis
cggugugcgggucgg

SEQ ID NO: 2905830 - RNA, 17 nt, Mycobacterium avium subsp. paratuberculosis
cggugugcgggucggug

SEQ ID NO: 2905831 - RNA, 19 nt, Mycobacterium avium subsp. paratuberculosis
cggugugcugacccagcgc

SEQ ID NO: 2905832 - RNA, 20 nt, Mycobacterium avium subsp. paratuberculosis
cggugugcugacccagcgcg

SEQ ID NO: 2905833 - RNA, 18 nt, Mycobacterium avium subsp. paratuberculosis
cggugugcuggccagcac

SEQ ID NO: 2905834 - RNA, 23 nt, Mycobacterium avium subsp. paratuberculosis
cggugugcuggccagcaccagcg

SEQ ID NO: 2905835 - RNA, 15 nt, Mycobacterium avium subsp. paratuberculosis
cgguguggaccgcgc

SEQ ID NO: 2905836 - RNA, 21 nt, Mycobacterium avium subsp. paratuberculosis
cgguguggagauagugauauc

SEQ ID NO: 2905837 - RNA, 15 nt, Mycobacterium avium subsp. paratuberculosis
cgguguggcccaacc

SEQ ID NO: 2905838 - RNA, 12 nt, Mycobacterium avium subsp. paratuberculosis
cgguguggccgc

SEQ ID NO: 2905839 - RNA, 13 nt, Mycobacterium avium subsp. paratuberculosis
cgguguggccgcg

SEQ ID NO: 2905840 - RNA, 14 nt, Mycobacterium avium subsp. paratuberculosis
cgguguggccgcgg

SEQ ID NO: 2905841 - RNA, 15 nt, Mycobacterium avium subsp. paratuberculosis
cggugugggcagcca

SEQ ID NO: 2905842 - RNA, 15 nt, Mycobacterium avium subsp. paratuberculosis
cggugugggcgaugg

SEQ ID NO: 2905843 - RNA, 18 nt, Mycobacterium avium subsp. paratuberculosis
cggugugggcgauggcgg

SEQ ID NO: 2905844 - RNA, 15 nt, Mycobacterium avium subsp. paratuberculosis
cggugugggucagcg

SEQ ID NO: 2905845 - RNA, 18 nt, Mycobacterium avium subsp. paratuberculosis
cggugugggucagcgagg

SEQ ID NO: 2905846 - RNA, 18 nt, Mycobacterium avium subsp. paratuberculosis
cgguguucgagggcgcgg

SEQ ID NO: 2905847 - RNA, 22 nt, Mycobacterium avium subsp. paratuberculosis
cgguguucggcgccagccgcac

SEQ ID NO: 2905848 - RNA, 23 nt, Mycobacterium avium subsp. paratuberculosis
cgguguucggcgccagccgcacc

SEQ ID NO: 2905849 - RNA, 14 nt, Mycobacterium avium subsp. paratuberculosis
cgguguucgggucg

SEQ ID NO: 2905850 - RNA, 17 nt, Mycobacterium avium subsp. paratuberculosis
cgguguucgggucggug

SEQ ID NO: 2905851 - RNA, 15 nt, Mycobacterium avium subsp. paratuberculosis
cgguguucuugaacg

SEQ ID NO: 2905852 - RNA, 21 nt, Mycobacterium avium subsp. paratuberculosis
cgguguucuugaacggcgcgu

SEQ ID NO: 2905853 - RNA, 16 nt, Mycobacterium avium subsp. paratuberculosis
cgguguugccgacggc

SEQ ID NO: 2905854 - RNA, 18 nt, Mycobacterium avium subsp. paratuberculosis
cgguguugccgacggcgc

SEQ ID NO: 2905855 - RNA, 14 nt, Mycobacterium avium subsp. paratuberculosis
cgguguugcgcacc

SEQ ID NO: 2905856 - RNA, 18 nt, Mycobacterium avium subsp. paratuberculosis
cgguguuggcggcgucgu

SEQ ID NO: 2905857 - RNA, 14 nt, Mycobacterium avium subsp. paratuberculosis
cgguguuuggccgc

SEQ ID NO: 2905858 - RNA, 19 nt, Mycobacterium avium subsp. paratuberculosis
cgguuaagugcccgccuca

SEQ ID NO: 2905859 - RNA, 15 nt, Mycobacterium avium subsp. paratuberculosis
cgguuaccggugcac

SEQ ID NO: 2905860 - RNA, 20 nt, Mycobacterium avium subsp. paratuberculosis
cgguucacaaaggccgaaga

SEQ ID NO: 2905861 - RNA, 13 nt, Mycobacterium avium subsp. paratuberculosis
cgguucacgcggc

SEQ ID NO: 2905862 - RNA, 16 nt, Mycobacterium avium subsp. paratuberculosis
cgguucacgcggcugg

SEQ ID NO: 2905863 - RNA, 17 nt, Mycobacterium avium subsp. paratuberculosis
cgguucacgcggcuggc

SEQ ID NO: 2905864 - RNA, 22 nt, Mycobacterium avium subsp. paratuberculosis
cgguucacgcggcuggcccggc

SEQ ID NO: 2905865 - RNA, 23 nt, Mycobacterium avium subsp. paratuberculosis
cgguucacgcggcuggcccggcg

SEQ ID NO: 2905866 - RNA, 21 nt, Mycobacterium avium subsp. paratuberculosis
cgguucagguggcgucggcgu

SEQ ID NO: 2905867 - RNA, 23 nt, Mycobacterium avium subsp. paratuberculosis
cgguucagguggcgucggcgucg

SEQ ID NO: 2905868 - RNA, 22 nt, Mycobacterium avium subsp. paratuberculosis
cgguucauccacucggccacca

SEQ ID NO: 2905869 - RNA, 16 nt, Mycobacterium avium subsp. paratuberculosis
cgguuccaaccaccgu

SEQ ID NO: 2905870 - RNA, 21 nt, Mycobacterium avium subsp. paratuberculosis
cgguuccaccgggccgccauc

SEQ ID NO: 2905871 - RNA, 17 nt, Mycobacterium avium subsp. paratuberculosis
cgguuccaccggucgga

SEQ ID NO: 2905872 - RNA, 13 nt, Mycobacterium avium subsp. paratuberculosis
cgguuccagaccg

SEQ ID NO: 2905873 - RNA, 15 nt, Mycobacterium avium subsp. paratuberculosis
cgguuccagaccggc

SEQ ID NO: 2905874 - RNA, 18 nt, Mycobacterium avium subsp. paratuberculosis
cgguuccagaccggcggc

SEQ ID NO: 2905875 - RNA, 20 nt, Mycobacterium avium subsp. paratuberculosis
cgguuccagaccggcggcga

SEQ ID NO: 2905876 - RNA, 22 nt, Mycobacterium avium subsp. paratuberculosis
cgguuccagaccggcggcgauc

SEQ ID NO: 2905877 - RNA, 23 nt, Mycobacterium avium subsp. paratuberculosis
cgguuccagaccggcggcgaucg

SEQ ID NO: 2905878 - RNA, 16 nt, Mycobacterium avium subsp. paratuberculosis
cgguuccagcggcacc

SEQ ID NO: 2905879 - RNA, 17 nt, Mycobacterium avium subsp. paratuberculosis
cgguuccagcggcaccg

SEQ ID NO: 2905880 - RNA, 18 nt, Mycobacterium avium subsp. paratuberculosis
cgguuccagcggcaccgc

SEQ ID NO: 2905881 - RNA, 23 nt, Mycobacterium avium subsp. paratuberculosis
cgguuccagcggcaccgccaucg

SEQ ID NO: 2905882 - RNA, 13 nt, Mycobacterium avium subsp. paratuberculosis
cgguucccggcac

SEQ ID NO: 2905883 - RNA, 16 nt, Mycobacterium avium subsp. paratuberculosis
cgguucccgugcuggc

SEQ ID NO: 2905884 - RNA, 16 nt, Mycobacterium avium subsp. paratuberculosis
cgguuccgcgacaucg

SEQ ID NO: 2905885 - RNA, 14 nt, Mycobacterium avium subsp. paratuberculosis
cgguuccggcgugc

SEQ ID NO: 2905886 - RNA, 18 nt, Mycobacterium avium subsp. paratuberculosis
cgguuccggcgugcagca

SEQ ID NO: 2905887 - RNA, 17 nt, Mycobacterium avium subsp. paratuberculosis
cgguuccgggcgacccc

SEQ ID NO: 2905888 - RNA, 13 nt, Mycobacterium avium subsp. paratuberculosis
cgguuccgguggc

SEQ ID NO: 2905889 - RNA, 16 nt, Mycobacterium avium subsp. paratuberculosis
cgguuccucggcgugu

SEQ ID NO: 2905890 - RNA, 21 nt, Mycobacterium avium subsp. paratuberculosis
cgguuccugcgcuaccaggcg

SEQ ID NO: 2905891 - RNA, 21 nt, Mycobacterium avium subsp. paratuberculosis
cgguucgaagcgcagcgucuc

SEQ ID NO: 2905892 - RNA, 16 nt, Mycobacterium avium subsp. paratuberculosis
cgguucgaccggcguc

SEQ ID NO: 2905893 - RNA, 17 nt, Mycobacterium avium subsp. paratuberculosis
cgguucgaccggcguca

SEQ ID NO: 2905894 - RNA, 21 nt, Mycobacterium avium subsp. paratuberculosis
cgguucgauaccguccgcgcc

SEQ ID NO: 2905895 - RNA, 22 nt, Mycobacterium avium subsp. paratuberculosis
cgguucgauaccguccgcgccc

SEQ ID NO: 2905896 - RNA, 23 nt, Mycobacterium avium subsp. paratuberculosis
cgguucgauaccguccgcgccca

SEQ ID NO: 2905897 - RNA, 18 nt, Mycobacterium avium subsp. paratuberculosis
cgguucgaucuccucggc

SEQ ID NO: 2905898 - RNA, 15 nt, Mycobacterium avium subsp. paratuberculosis
cgguucgcuggcggc

SEQ ID NO: 2905899 - RNA, 18 nt, Mycobacterium avium subsp. paratuberculosis
cgguucgcuggcggccag

SEQ ID NO: 2905900 - RNA, 19 nt, Mycobacterium avium subsp. paratuberculosis
cgguucgcuggcggccagc

SEQ ID NO: 2905901 - RNA, 15 nt, Mycobacterium avium subsp. paratuberculosis
cgguucggacacggc

SEQ ID NO: 2905902 - RNA, 19 nt, Mycobacterium avium subsp. paratuberculosis
cgguucggacacggcgccg

SEQ ID NO: 2905903 - RNA, 21 nt, Mycobacterium avium subsp. paratuberculosis
cgguucggaguccaccggcgg

SEQ ID NO: 2905904 - RNA, 22 nt, Mycobacterium avium subsp. paratuberculosis
cgguucggaguccaccggcgga

SEQ ID NO: 2905905 - RNA, 13 nt, Mycobacterium avium subsp. paratuberculosis
cgguucggccaga

SEQ ID NO: 2905906 - RNA, 12 nt, Mycobacterium avium subsp. paratuberculosis
cgguucggcgac

SEQ ID NO: 2905907 - RNA, 15 nt, Mycobacterium avium subsp. paratuberculosis
cgguucggcgacgcu

SEQ ID NO: 2905908 - RNA, 16 nt, Mycobacterium avium subsp. paratuberculosis
cgguucggcggcauag

SEQ ID NO: 2905909 - RNA, 14 nt, Mycobacterium avium subsp. paratuberculosis
cgguucggcgucgg

SEQ ID NO: 2905910 - RNA, 14 nt, Mycobacterium avium subsp. paratuberculosis
cgguucgggcccca

SEQ ID NO: 2905911 - RNA, 16 nt, Mycobacterium avium subsp. paratuberculosis
cgguucgucgcggcgg

SEQ ID NO: 2905912 - RNA, 20 nt, Mycobacterium avium subsp. paratuberculosis
cgguucgucgcggcggcccg

SEQ ID NO: 2905913 - RNA, 16 nt, Mycobacterium avium subsp. paratuberculosis
cgguucgugcgcaacg

SEQ ID NO: 2905914 - RNA, 14 nt, Mycobacterium avium subsp. paratuberculosis
cgguucugcagcga

SEQ ID NO: 2905915 - RNA, 14 nt, Mycobacterium avium subsp. paratuberculosis
cgguugaacaggcu

SEQ ID NO: 2905916 - RNA, 16 nt, Mycobacterium avium subsp. paratuberculosis
cgguugaacaggcugc

SEQ ID NO: 2905917 - RNA, 17 nt, Mycobacterium avium subsp. paratuberculosis
cgguugaccccggcccc

SEQ ID NO: 2905918 - RNA, 19 nt, Mycobacterium avium subsp. paratuberculosis
cgguugaccccggccccgg

SEQ ID NO: 2905919 - RNA, 15 nt, Mycobacterium avium subsp. paratuberculosis
cgguugaccgccgac

SEQ ID NO: 2905920 - RNA, 17 nt, Mycobacterium avium subsp. paratuberculosis
cgguugaccgccgacac

SEQ ID NO: 2905921 - RNA, 14 nt, Mycobacterium avium subsp. paratuberculosis
cgguugacgcucug

SEQ ID NO: 2905922 - RNA, 15 nt, Mycobacterium avium subsp. paratuberculosis
cgguugacguagauc

SEQ ID NO: 2905923 - RNA, 17 nt, Mycobacterium avium subsp. paratuberculosis
cgguugacguccgcggg

SEQ ID NO: 2905924 - RNA, 18 nt, Mycobacterium avium subsp. paratuberculosis
cgguugacguccgcggga

SEQ ID NO: 2905925 - RNA, 15 nt, Mycobacterium avium subsp. paratuberculosis
cgguugagcaccagc

SEQ ID NO: 2905926 - RNA, 18 nt, Mycobacterium avium subsp. paratuberculosis
cgguugagcaccagcccg

SEQ ID NO: 2905927 - RNA, 19 nt, Mycobacterium avium subsp. paratuberculosis
cgguugagcaccagcccgg

SEQ ID NO: 2905928 - RNA, 13 nt, Mycobacterium avium subsp. paratuberculosis
cgguugagcaccg

SEQ ID NO: 2905929 - RNA, 15 nt, Mycobacterium avium subsp. paratuberculosis
cgguugagugcgccg

SEQ ID NO: 2905930 - RNA, 23 nt, Mycobacterium avium subsp. paratuberculosis
cgguugaucacaccgucggcgau

SEQ ID NO: 2905931 - RNA, 15 nt, Mycobacterium avium subsp. paratuberculosis
cgguugaucacccgg

SEQ ID NO: 2905932 - RNA, 21 nt, Mycobacterium avium subsp. paratuberculosis
cgguugaugaucuuggugaag

SEQ ID NO: 2905933 - RNA, 22 nt, Mycobacterium avium subsp. paratuberculosis
cgguugccccaccccggacggc

SEQ ID NO: 2905934 - RNA, 14 nt, Mycobacterium avium subsp. paratuberculosis
cgguugcccgcacc

SEQ ID NO: 2905935 - RNA, 17 nt, Mycobacterium avium subsp. paratuberculosis
cgguugccucggccagc

SEQ ID NO: 2905936 - RNA, 19 nt, Mycobacterium avium subsp. paratuberculosis
cgguugccucggccagcac

SEQ ID NO: 2905937 - RNA, 20 nt, Mycobacterium avium subsp. paratuberculosis
cgguugccucggccagcacc

SEQ ID NO: 2905938 - RNA, 22 nt, Mycobacterium avium subsp. paratuberculosis
cgguugcgcgaaucgcaagcag

SEQ ID NO: 2905939 - RNA, 14 nt, Mycobacterium avium subsp. paratuberculosis
cgguugcggcagca

SEQ ID NO: 2905940 - RNA, 21 nt, Mycobacterium avium subsp. paratuberculosis
cgguugcggcagcacaccuuc

SEQ ID NO: 2905941 - RNA, 17 nt, Mycobacterium avium subsp. paratuberculosis
cgguugcggcgaacgcg

SEQ ID NO: 2905942 - RNA, 14 nt, Mycobacterium avium subsp. paratuberculosis
cgguugcgggccga

SEQ ID NO: 2905943 - RNA, 18 nt, Mycobacterium avium subsp. paratuberculosis
cgguugcuccggcgucga

SEQ ID NO: 2905944 - RNA, 20 nt, Mycobacterium avium subsp. paratuberculosis
cgguugcucgucggccgacu

SEQ ID NO: 2905945 - RNA, 18 nt, Mycobacterium avium subsp. paratuberculosis
cgguuggacaggccggcg

SEQ ID NO: 2905946 - RNA, 22 nt, Mycobacterium avium subsp. paratuberculosis
cgguuggacaggccggcgacgg

SEQ ID NO: 2905947 - RNA, 18 nt, Mycobacterium avium subsp. paratuberculosis
cgguuggacaugaagccc

SEQ ID NO: 2905948 - RNA, 19 nt, Mycobacterium avium subsp. paratuberculosis
cgguuggacaugaagcccc

SEQ ID NO: 2905949 - RNA, 16 nt, Mycobacterium avium subsp. paratuberculosis
cgguuggcccgcggcg

SEQ ID NO: 2905950 - RNA, 18 nt, Mycobacterium avium subsp. paratuberculosis
cgguuggcccgcggcgcc

SEQ ID NO: 2905951 - RNA, 20 nt, Mycobacterium avium subsp. paratuberculosis
cgguuggcccgcggcgcccg

SEQ ID NO: 2905952 - RNA, 21 nt, Mycobacterium avium subsp. paratuberculosis
cgguuggccggaaucgcggga

SEQ ID NO: 2905953 - RNA, 13 nt, Mycobacterium avium subsp. paratuberculosis
cgguuggccggcc

SEQ ID NO: 2905954 - RNA, 17 nt, Mycobacterium avium subsp. paratuberculosis
cgguuggccggccgggc

SEQ ID NO: 2905955 - RNA, 13 nt, Mycobacterium avium subsp. paratuberculosis
cgguuggcggccg

SEQ ID NO: 2905956 - RNA, 14 nt, Mycobacterium avium subsp. paratuberculosis
cgguugggccgccg

SEQ ID NO: 2905957 - RNA, 15 nt, Mycobacterium avium subsp. paratuberculosis
cgguugggccgccgg

SEQ ID NO: 2905958 - RNA, 19 nt, Mycobacterium avium subsp. paratuberculosis
cgguugggccgccggccgc

SEQ ID NO: 2905959 - RNA, 15 nt, Mycobacterium avium subsp. paratuberculosis
cgguugggccggcgc

SEQ ID NO: 2905960 - RNA, 18 nt, Mycobacterium avium subsp. paratuberculosis
cgguugggccggcgcccg

SEQ ID NO: 2905961 - RNA, 15 nt, Mycobacterium avium subsp. paratuberculosis
cgguugucgcggugc

SEQ ID NO: 2905962 - RNA, 15 nt, Mycobacterium avium subsp. paratuberculosis
cgguugucggucagg

SEQ ID NO: 2905963 - RNA, 18 nt, Mycobacterium avium subsp. paratuberculosis
cgguuguugcgguccagg

SEQ ID NO: 2905964 - RNA, 19 nt, Mycobacterium avium subsp. paratuberculosis
cgguuguugcgguccagga

SEQ ID NO: 2905965 - RNA, 16 nt, Mycobacterium avium subsp. paratuberculosis
cgguuucaccgaggcg

SEQ ID NO: 2905966 - RNA, 17 nt, Mycobacterium avium subsp. paratuberculosis
cgguuuccaccaccacc

SEQ ID NO: 2905967 - RNA, 22 nt, Mycobacterium avium subsp. paratuberculosis
cgguuuccaguccggcgcccgg

SEQ ID NO: 2905968 - RNA, 14 nt, Mycobacterium avium subsp. paratuberculosis
cgguuuccggcgau

SEQ ID NO: 2905969 - RNA, 17 nt, Mycobacterium avium subsp. paratuberculosis
cgguuucgaccugcggg

SEQ ID NO: 2905970 - RNA, 20 nt, Mycobacterium avium subsp. paratuberculosis
cgguuucgaccugcgggugc

SEQ ID NO: 2905971 - RNA, 18 nt, Mycobacterium avium subsp. paratuberculosis
cgguuucggucgcgguga

SEQ ID NO: 2905972 - RNA, 17 nt, Mycobacterium avium subsp. paratuberculosis
cgguuucugccggccgc

SEQ ID NO: 2905973 - RNA, 19 nt, Mycobacterium avium subsp. paratuberculosis
cgguuucugccggccgccg

SEQ ID NO: 2905974 - RNA, 14 nt, Mycobacterium avium subsp. paratuberculosis
cgguuugcccggcg

SEQ ID NO: 2905975 - RNA, 17 nt, Mycobacterium avium subsp. paratuberculosis
cgguuugcgccggcucc

SEQ ID NO: 2905976 - RNA, 20 nt, Mycobacterium avium subsp. paratuberculosis
cgguuugcgccggcuccacc

SEQ ID NO: 2905977 - RNA, 16 nt, Mycobacterium avium subsp. paratuberculosis
cgguuugucggcgccc

SEQ ID NO: 2905978 - RNA, 23 nt, Mycobacterium avium subsp. paratuberculosis
cgguuuucccgcgagcugccccu

SEQ ID NO: 2905979 - RNA, 23 nt, Mycobacterium avium subsp. paratuberculosis
cgguuuuggucugcgccggcggu

SEQ ID NO: 2905980 - RNA, 17 nt, Mycobacterium avium subsp. paratuberculosis
cgguuuuucccagcggc

SEQ ID NO: 2905981 - RNA, 20 nt, Mycobacterium avium subsp. paratuberculosis
cgguuuuucccagcggccga

SEQ ID NO: 2905982 - RNA, 22 nt, Mycobacterium avium subsp. paratuberculosis
cgguuuuucccagcggccgagg

SEQ ID NO: 2905983 - RNA, 23 nt, Mycobacterium avium subsp. paratuberculosis
cgguuuuucccagcggccgaggg

SEQ ID NO: 2905984 - RNA, 20 nt, Mycobacterium avium subsp. paratuberculosis
cguaaaggaugucgccgcag

SEQ ID NO: 2905985 - RNA, 20 nt, Mycobacterium avium subsp. paratuberculosis
cguaacacccucggucgggc

SEQ ID NO: 2905986 - RNA, 18 nt, Mycobacterium avium subsp. paratuberculosis
cguaacacccugcgccac

SEQ ID NO: 2905987 - RNA, 15 nt, Mycobacterium avium subsp. paratuberculosis
cguaaccggcggcgg

SEQ ID NO: 2905988 - RNA, 18 nt, Mycobacterium avium subsp. paratuberculosis
cguaaccguacggcccga

SEQ ID NO: 2905989 - RNA, 18 nt, Mycobacterium avium subsp. paratuberculosis
cguaacgccacggcggcc

SEQ ID NO: 2905990 - RNA, 20 nt, Mycobacterium avium subsp. paratuberculosis
cguaacgccacggcggccga

SEQ ID NO: 2905991 - RNA, 23 nt, Mycobacterium avium subsp. paratuberculosis
cguaacgccacggcggccgaauc

SEQ ID NO: 2905992 - RNA, 21 nt, Mycobacterium avium subsp. paratuberculosis
cguaacgguaggcgcggucgg

SEQ ID NO: 2905993 - RNA, 21 nt, Mycobacterium avium subsp. paratuberculosis
cguaaguggcgccgcggucgc

SEQ ID NO: 2905994 - RNA, 14 nt, Mycobacterium avium subsp. paratuberculosis
cguaagugucgugg

SEQ ID NO: 2905995 - RNA, 20 nt, Mycobacterium avium subsp. paratuberculosis
cguaagugucguggcgugcc

SEQ ID NO: 2905996 - RNA, 23 nt, Mycobacterium avium subsp. paratuberculosis
cguacaaggugauggcccgcuug

SEQ ID NO: 2905997 - RNA, 20 nt, Mycobacterium avium subsp. paratuberculosis
cguacaccagggugccgccg

SEQ ID NO: 2905998 - RNA, 20 nt, Mycobacterium avium subsp. paratuberculosis
cguacaccggcugaccggcg

SEQ ID NO: 2905999 - RNA, 23 nt, Mycobacterium avium subsp. paratuberculosis
cguacaccggcugaccggcggug

SEQ ID NO: 2906000 - RNA, 21 nt, Mycobacterium avium subsp. paratuberculosis
cguacaccgugcccgagccga

SEQ ID NO: 2906001 - RNA, 18 nt, Mycobacterium avium subsp. paratuberculosis
cguacacggcccgcggca

SEQ ID NO: 2906002 - RNA, 19 nt, Mycobacterium avium subsp. paratuberculosis
cguacacggcccgcggcac

SEQ ID NO: 2906003 - RNA, 14 nt, Mycobacterium avium subsp. paratuberculosis
cguacacggcggcg

SEQ ID NO: 2906004 - RNA, 15 nt, Mycobacterium avium subsp. paratuberculosis
cguacacggcggcga

SEQ ID NO: 2906005 - RNA, 12 nt, Mycobacterium avium subsp. paratuberculosis
cguacagcagcu

SEQ ID NO: 2906006 - RNA, 15 nt, Mycobacterium avium subsp. paratuberculosis
cguacagccagcccg

SEQ ID NO: 2906007 - RNA, 16 nt, Mycobacterium avium subsp. paratuberculosis
cguacagccagcccgu

SEQ ID NO: 2906008 - RNA, 18 nt, Mycobacterium avium subsp. paratuberculosis
cguacagcgagccgucga

SEQ ID NO: 2906009 - RNA, 19 nt, Mycobacterium avium subsp. paratuberculosis
cguacagcgagccgucgac

SEQ ID NO: 2906010 - RNA, 15 nt, Mycobacterium avium subsp. paratuberculosis
cguacagcgcccgga

SEQ ID NO: 2906011 - RNA, 15 nt, Mycobacterium avium subsp. paratuberculosis
cguacagcggcgcca

SEQ ID NO: 2906012 - RNA, 13 nt, Mycobacterium avium subsp. paratuberculosis
cguacagcggcgg

SEQ ID NO: 2906013 - RNA, 23 nt, Mycobacterium avium subsp. paratuberculosis
cguacagcgggucguuggcggcg

SEQ ID NO: 2906014 - RNA, 19 nt, Mycobacterium avium subsp. paratuberculosis
cguacagcugguccggccg

SEQ ID NO: 2906015 - RNA, 21 nt, Mycobacterium avium subsp. paratuberculosis
cguacagcugguccggccggc

SEQ ID NO: 2906016 - RNA, 13 nt, Mycobacterium avium subsp. paratuberculosis
cguacaggccguc

SEQ ID NO: 2906017 - RNA, 16 nt, Mycobacterium avium subsp. paratuberculosis
cguacaggucgcacag

SEQ ID NO: 2906018 - RNA, 22 nt, Mycobacterium avium subsp. paratuberculosis
cguacaucagcucgucagcgcg

SEQ ID NO: 2906019 - RNA, 15 nt, Mycobacterium avium subsp. paratuberculosis
cguacauggugacca

SEQ ID NO: 2906020 - RNA, 22 nt, Mycobacterium avium subsp. paratuberculosis
cguaccaccaccagucggcgcg

SEQ ID NO: 2906021 - RNA, 13 nt, Mycobacterium avium subsp. paratuberculosis
cguaccagcgcca

SEQ ID NO: 2906022 - RNA, 14 nt, Mycobacterium avium subsp. paratuberculosis
cguaccagcgccac

SEQ ID NO: 2906023 - RNA, 15 nt, Mycobacterium avium subsp. paratuberculosis
cguaccagcgcucga

SEQ ID NO: 2906024 - RNA, 18 nt, Mycobacterium avium subsp. paratuberculosis
cguaccagcugcccacca

SEQ ID NO: 2906025 - RNA, 16 nt, Mycobacterium avium subsp. paratuberculosis
cguacccaggucggcg

SEQ ID NO: 2906026 - RNA, 18 nt, Mycobacterium avium subsp. paratuberculosis
cguacccaggucggcgug

SEQ ID NO: 2906027 - RNA, 19 nt, Mycobacterium avium subsp. paratuberculosis
cguacccaggucggcguga

SEQ ID NO: 2906028 - RNA, 13 nt, Mycobacterium avium subsp. paratuberculosis
cguacccgcgcgg

SEQ ID NO: 2906029 - RNA, 14 nt, Mycobacterium avium subsp. paratuberculosis
cguacccgcgcggc

SEQ ID NO: 2906030 - RNA, 15 nt, Mycobacterium avium subsp. paratuberculosis
cguacccgcgcggcg

SEQ ID NO: 2906031 - RNA, 18 nt, Mycobacterium avium subsp. paratuberculosis
cguacccgcgcggcgucg

SEQ ID NO: 2906032 - RNA, 23 nt, Mycobacterium avium subsp. paratuberculosis
cguacccgcgcggcgucggccug

SEQ ID NO: 2906033 - RNA, 23 nt, Mycobacterium avium subsp. paratuberculosis
cguaccgaggaugaccgcggcga

SEQ ID NO: 2906034 - RNA, 16 nt, Mycobacterium avium subsp. paratuberculosis
cguaccgcaacaccga

SEQ ID NO: 2906035 - RNA, 17 nt, Mycobacterium avium subsp. paratuberculosis
cguaccgcaacaccgaa

SEQ ID NO: 2906036 - RNA, 15 nt, Mycobacterium avium subsp. paratuberculosis
cguaccgcggcggcg

SEQ ID NO: 2906037 - RNA, 13 nt, Mycobacterium avium subsp. paratuberculosis
cguaccugcccca

SEQ ID NO: 2906038 - RNA, 24 nt, Mycobacterium avium subsp. paratuberculosis
cguaccugccccacacgcucggcg

SEQ ID NO: 2906039 - RNA, 14 nt, Mycobacterium avium subsp. paratuberculosis
cguacgcgauggcg

SEQ ID NO: 2906040 - RNA, 13 nt, Mycobacterium avium subsp. paratuberculosis
cguacgcgccggc

SEQ ID NO: 2906041 - RNA, 16 nt, Mycobacterium avium subsp. paratuberculosis
cguacgcgccggccag

SEQ ID NO: 2906042 - RNA, 19 nt, Mycobacterium avium subsp. paratuberculosis
cguacgcgguucgugcgca

SEQ ID NO: 2906043 - RNA, 12 nt, Mycobacterium avium subsp. paratuberculosis
cguacgggcggg

SEQ ID NO: 2906044 - RNA, 17 nt, Mycobacterium avium subsp. paratuberculosis
cguacggguugccgucg

SEQ ID NO: 2906045 - RNA, 23 nt, Mycobacterium avium subsp. paratuberculosis
cguacuccaccgcgccgucgucg

SEQ ID NO: 2906046 - RNA, 20 nt, Mycobacterium avium subsp. paratuberculosis
cguacucccaggccgcggcc

SEQ ID NO: 2906047 - RNA, 17 nt, Mycobacterium avium subsp. paratuberculosis
cguacucgaccgcgacu

SEQ ID NO: 2906048 - RNA, 18 nt, Mycobacterium avium subsp. paratuberculosis
cguacucgaugccguugu

SEQ ID NO: 2906049 - RNA, 13 nt, Mycobacterium avium subsp. paratuberculosis
cguacucgcacag

SEQ ID NO: 2906050 - RNA, 20 nt, Mycobacterium avium subsp. paratuberculosis
cguacucgcacagccggcgc

SEQ ID NO: 2906051 - RNA, 17 nt, Mycobacterium avium subsp. paratuberculosis
cguacucgugggccacc

SEQ ID NO: 2906052 - RNA, 22 nt, Mycobacterium avium subsp. paratuberculosis
cguacucgugggccaccacgua

SEQ ID NO: 2906053 - RNA, 14 nt, Mycobacterium avium subsp. paratuberculosis
cguacugcgcgagc

SEQ ID NO: 2906054 - RNA, 14 nt, Mycobacterium avium subsp. paratuberculosis
cguacugcucggcg

SEQ ID NO: 2906055 - RNA, 16 nt, Mycobacterium avium subsp. paratuberculosis
cguacugcucggcgcg

SEQ ID NO: 2906056 - RNA, 19 nt, Mycobacterium avium subsp. paratuberculosis
cguacugcucggcgcggcu

SEQ ID NO: 2906057 - RNA, 16 nt, Mycobacterium avium subsp. paratuberculosis
cguagaacauccacgg

SEQ ID NO: 2906058 - RNA, 17 nt, Mycobacterium avium subsp. paratuberculosis
cguagaacauccacggc

SEQ ID NO: 2906059 - RNA, 21 nt, Mycobacterium avium subsp. paratuberculosis
cguagaaccggcccagcagcg

SEQ ID NO: 2906060 - RNA, 17 nt, Mycobacterium avium subsp. paratuberculosis
cguagaacucgccgugg

SEQ ID NO: 2906061 - RNA, 18 nt, Mycobacterium avium subsp. paratuberculosis
cguagaaggcgccgucgg

SEQ ID NO: 2906062 - RNA, 14 nt, Mycobacterium avium subsp. paratuberculosis
cguagaauccgccg

SEQ ID NO: 2906063 - RNA, 18 nt, Mycobacterium avium subsp. paratuberculosis
cguagaauccgccguuga

SEQ ID NO: 2906064 - RNA, 18 nt, Mycobacterium avium subsp. paratuberculosis
cguagaccagcgacgcca

SEQ ID NO: 2906065 - RNA, 20 nt, Mycobacterium avium subsp. paratuberculosis
cguagacccacagcugccgg

SEQ ID NO: 2906066 - RNA, 22 nt, Mycobacterium avium subsp. paratuberculosis
cguagacccacagcugccggcc

SEQ ID NO: 2906067 - RNA, 16 nt, Mycobacterium avium subsp. paratuberculosis
cguagacgacgucgac

SEQ ID NO: 2906068 - RNA, 20 nt, Mycobacterium avium subsp. paratuberculosis
cguagacgacgucgaccgcg

SEQ ID NO: 2906069 - RNA, 21 nt, Mycobacterium avium subsp. paratuberculosis
cguagacgacgucgaccgcgc

SEQ ID NO: 2906070 - RNA, 22 nt, Mycobacterium avium subsp. paratuberculosis
cguagacgacgucgaccgcgcc

SEQ ID NO: 2906071 - RNA, 14 nt, Mycobacterium avium subsp. paratuberculosis
cguagacgagccgg

SEQ ID NO: 2906072 - RNA, 21 nt, Mycobacterium avium subsp. paratuberculosis
cguagacgagccgguugaccc

SEQ ID NO: 2906073 - RNA, 21 nt, Mycobacterium avium subsp. paratuberculosis
cguagacggugucgcccucgc

SEQ ID NO: 2906074 - RNA, 15 nt, Mycobacterium avium subsp. paratuberculosis
cguagagcaggaccg

SEQ ID NO: 2906075 - RNA, 22 nt, Mycobacterium avium subsp. paratuberculosis
cguagagcaggaccgagccgcg

SEQ ID NO: 2906076 - RNA, 20 nt, Mycobacterium avium subsp. paratuberculosis
cguagagccguuuggcgccg

SEQ ID NO: 2906077 - RNA, 22 nt, Mycobacterium avium subsp. paratuberculosis
cguagagccguuuggcgccgcc

SEQ ID NO: 2906078 - RNA, 18 nt, Mycobacterium avium subsp. paratuberculosis
cguagagcgcgaagcccu

SEQ ID NO: 2906079 - RNA, 20 nt, Mycobacterium avium subsp. paratuberculosis
cguagaggggccggacggug

SEQ ID NO: 2906080 - RNA, 17 nt, Mycobacterium avium subsp. paratuberculosis
cguagaggugcagcggg

SEQ ID NO: 2906081 - RNA, 22 nt, Mycobacterium avium subsp. paratuberculosis
cguagaucacgccggugagcac

SEQ ID NO: 2906082 - RNA, 17 nt, Mycobacterium avium subsp. paratuberculosis
cguagaucacggcguug

SEQ ID NO: 2906083 - RNA, 15 nt, Mycobacterium avium subsp. paratuberculosis
cguagaucaucuggc

SEQ ID NO: 2906084 - RNA, 19 nt, Mycobacterium avium subsp. paratuberculosis
cguagaucauuugaccgca

SEQ ID NO: 2906085 - RNA, 13 nt, Mycobacterium avium subsp. paratuberculosis
cguagaucgucga

SEQ ID NO: 2906086 - RNA, 15 nt, Mycobacterium avium subsp. paratuberculosis
cguagaucgucgagu

SEQ ID NO: 2906087 - RNA, 18 nt, Mycobacterium avium subsp. paratuberculosis
cguagaucucgcgccgcg

SEQ ID NO: 2906088 - RNA, 15 nt, Mycobacterium avium subsp. paratuberculosis
cguagaugccgguac

SEQ ID NO: 2906089 - RNA, 22 nt, Mycobacterium avium subsp. paratuberculosis
cguagaugccgguacggccgac

SEQ ID NO: 2906090 - RNA, 23 nt, Mycobacterium avium subsp. paratuberculosis
cguagaugccgguacggccgacg

SEQ ID NO: 2906091 - RNA, 22 nt, Mycobacterium avium subsp. paratuberculosis
cguagaugcggcccagcccggc

SEQ ID NO: 2906092 - RNA, 17 nt, Mycobacterium avium subsp. paratuberculosis
cguagcccaccucgagc

SEQ ID NO: 2906093 - RNA, 17 nt, Mycobacterium avium subsp. paratuberculosis
cguagcccagcgcguug

SEQ ID NO: 2906094 - RNA, 14 nt, Mycobacterium avium subsp. paratuberculosis
cguagccgccgguu

SEQ ID NO: 2906095 - RNA, 15 nt, Mycobacterium avium subsp. paratuberculosis
cguagccgccgguug

SEQ ID NO: 2906096 - RNA, 18 nt, Mycobacterium avium subsp. paratuberculosis
cguagccgcgguucggcg

SEQ ID NO: 2906097 - RNA, 22 nt, Mycobacterium avium subsp. paratuberculosis
cguagccggaccgcuugacgcc

SEQ ID NO: 2906098 - RNA, 16 nt, Mycobacterium avium subsp. paratuberculosis
cguagccggcacgcac

SEQ ID NO: 2906099 - RNA, 13 nt, Mycobacterium avium subsp. paratuberculosis
cguagccggcggu

SEQ ID NO: 2906100 - RNA, 22 nt, Mycobacterium avium subsp. paratuberculosis
cguagccgguauccauccgcca

SEQ ID NO: 2906101 - RNA, 20 nt, Mycobacterium avium subsp. paratuberculosis
cguagccguagaucgucgag

SEQ ID NO: 2906102 - RNA, 12 nt, Mycobacterium avium subsp. paratuberculosis
cguagccgucga

SEQ ID NO: 2906103 - RNA, 18 nt, Mycobacterium avium subsp. paratuberculosis
cguagcgaggugugagga

SEQ ID NO: 2906104 - RNA, 15 nt, Mycobacterium avium subsp. paratuberculosis
cguagcgcaacaccg

SEQ ID NO: 2906105 - RNA, 17 nt, Mycobacterium avium subsp. paratuberculosis
cguagcgcaacaccgaa

SEQ ID NO: 2906106 - RNA, 17 nt, Mycobacterium avium subsp. paratuberculosis
cguagcgcagcuccagg

SEQ ID NO: 2906107 - RNA, 17 nt, Mycobacterium avium subsp. paratuberculosis
cguagcgccagucgcgg

SEQ ID NO: 2906108 - RNA, 16 nt, Mycobacterium avium subsp. paratuberculosis
cguagcgccgcccguc

SEQ ID NO: 2906109 - RNA, 16 nt, Mycobacterium avium subsp. paratuberculosis
cguagcgcggccgccc

SEQ ID NO: 2906110 - RNA, 15 nt, Mycobacterium avium subsp. paratuberculosis
cguagcgcuggguga

SEQ ID NO: 2906111 - RNA, 13 nt, Mycobacterium avium subsp. paratuberculosis
cguagcggaagcu

SEQ ID NO: 2906112 - RNA, 16 nt, Mycobacterium avium subsp. paratuberculosis
cguagcggaagcugcc

SEQ ID NO: 2906113 - RNA, 23 nt, Mycobacterium avium subsp. paratuberculosis
cguagcggacgacggccagcuga

SEQ ID NO: 2906114 - RNA, 14 nt, Mycobacterium avium subsp. paratuberculosis
cguagcggcccagg

SEQ ID NO: 2906115 - RNA, 12 nt, Mycobacterium avium subsp. paratuberculosis
cguagcggccgc

SEQ ID NO: 2906116 - RNA, 13 nt, Mycobacterium avium subsp. paratuberculosis
cguagcggcgcca

SEQ ID NO: 2906117 - RNA, 15 nt, Mycobacterium avium subsp. paratuberculosis
cguagcggcgccacc

SEQ ID NO: 2906118 - RNA, 17 nt, Mycobacterium avium subsp. paratuberculosis
cguagcggcgccaccgg

SEQ ID NO: 2906119 - RNA, 21 nt, Mycobacterium avium subsp. paratuberculosis
cguagcggcgccaccggcugg

SEQ ID NO: 2906120 - RNA, 17 nt, Mycobacterium avium subsp. paratuberculosis
cguagcggcucgccacc

SEQ ID NO: 2906121 - RNA, 15 nt, Mycobacterium avium subsp. paratuberculosis
cguagcgggucagcu

SEQ ID NO: 2906122 - RNA, 21 nt, Mycobacterium avium subsp. paratuberculosis
cguagcgggucagcuccaccu

SEQ ID NO: 2906123 - RNA, 19 nt, Mycobacterium avium subsp. paratuberculosis
cguagcggucgccccagaa

SEQ ID NO: 2906124 - RNA, 23 nt, Mycobacterium avium subsp. paratuberculosis
cguagcggugaaacgccugcacc

SEQ ID NO: 2906125 - RNA, 16 nt, Mycobacterium avium subsp. paratuberculosis
cguagcgucgggggcg

SEQ ID NO: 2906126 - RNA, 16 nt, Mycobacterium avium subsp. paratuberculosis
cguagcguugccggcc

SEQ ID NO: 2906127 - RNA, 13 nt, Mycobacterium avium subsp. paratuberculosis
cguagcucagcgg

SEQ ID NO: 2906128 - RNA, 15 nt, Mycobacterium avium subsp. paratuberculosis
cguagcucgccgcgg

SEQ ID NO: 2906129 - RNA, 19 nt, Mycobacterium avium subsp. paratuberculosis
cguagcucgccgcggccac

SEQ ID NO: 2906130 - RNA, 15 nt, Mycobacterium avium subsp. paratuberculosis
cguagcucgcgccga

SEQ ID NO: 2906131 - RNA, 16 nt, Mycobacterium avium subsp. paratuberculosis
cguagcucgcgccgac

SEQ ID NO: 2906132 - RNA, 17 nt, Mycobacterium avium subsp. paratuberculosis
cguagcucgcgccgacc

SEQ ID NO: 2906133 - RNA, 17 nt, Mycobacterium avium subsp. paratuberculosis
cguagcugcaggcgacg

SEQ ID NO: 2906134 - RNA, 15 nt, Mycobacterium avium subsp. paratuberculosis
cguagcuggugcgca

SEQ ID NO: 2906135 - RNA, 22 nt, Mycobacterium avium subsp. paratuberculosis
cguagcuggugcgcagcccgcc

SEQ ID NO: 2906136 - RNA, 18 nt, Mycobacterium avium subsp. paratuberculosis
cguaggacaccacggugg

SEQ ID NO: 2906137 - RNA, 16 nt, Mycobacterium avium subsp. paratuberculosis
cguaggacagcaccac

SEQ ID NO: 2906138 - RNA, 15 nt, Mycobacterium avium subsp. paratuberculosis
cguaggacagcagcc

SEQ ID NO: 2906139 - RNA, 17 nt, Mycobacterium avium subsp. paratuberculosis
cguaggacagcagccgc

SEQ ID NO: 2906140 - RNA, 18 nt, Mycobacterium avium subsp. paratuberculosis
cguaggacccuucgaacg

SEQ ID NO: 2906141 - RNA, 22 nt, Mycobacterium avium subsp. paratuberculosis
cguaggacccuucgaacgcgac

SEQ ID NO: 2906142 - RNA, 14 nt, Mycobacterium avium subsp. paratuberculosis
cguaggaguagcag

SEQ ID NO: 2906143 - RNA, 15 nt, Mycobacterium avium subsp. paratuberculosis
cguaggccaggaccg

SEQ ID NO: 2906144 - RNA, 22 nt, Mycobacterium avium subsp. paratuberculosis
cguaggccaggaccgggacgac

SEQ ID NO: 2906145 - RNA, 22 nt, Mycobacterium avium subsp. paratuberculosis
cguaggccuugcugagccggcc

SEQ ID NO: 2906146 - RNA, 18 nt, Mycobacterium avium subsp. paratuberculosis
cguaggcgaggaccgaga

SEQ ID NO: 2906147 - RNA, 17 nt, Mycobacterium avium subsp. paratuberculosis
cguaggcgaucagcgcg

SEQ ID NO: 2906148 - RNA, 22 nt, Mycobacterium avium subsp. paratuberculosis
cguaggcgaucagcgcgcacag

SEQ ID NO: 2906149 - RNA, 12 nt, Mycobacterium avium subsp. paratuberculosis
cguaggcgaugu

SEQ ID NO: 2906150 - RNA, 15 nt, Mycobacterium avium subsp. paratuberculosis
cguaggcggccagca

SEQ ID NO: 2906151 - RNA, 18 nt, Mycobacterium avium subsp. paratuberculosis
cguaggcggccagcagca

SEQ ID NO: 2906152 - RNA, 22 nt, Mycobacterium avium subsp. paratuberculosis
cguaggcggccagcagcaccag

SEQ ID NO: 2906153 - RNA, 14 nt, Mycobacterium avium subsp. paratuberculosis
cguaggcggccaua

SEQ ID NO: 2906154 - RNA, 14 nt, Mycobacterium avium subsp. paratuberculosis
cguaggcggcgagc

SEQ ID NO: 2906155 - RNA, 23 nt, Mycobacterium avium subsp. paratuberculosis
cguaggcggcgagcugaucggcg

SEQ ID NO: 2906156 - RNA, 16 nt, Mycobacterium avium subsp. paratuberculosis
cguagggcagcccgag

SEQ ID NO: 2906157 - RNA, 14 nt, Mycobacterium avium subsp. paratuberculosis
cguagggcucggcg

SEQ ID NO: 2906158 - RNA, 13 nt, Mycobacterium avium subsp. paratuberculosis
cguaggggcccgg

SEQ ID NO: 2906159 - RNA, 15 nt, Mycobacterium avium subsp. paratuberculosis
cguaggugcacagcc

SEQ ID NO: 2906160 - RNA, 16 nt, Mycobacterium avium subsp. paratuberculosis
cguaggugcacagccc

SEQ ID NO: 2906161 - RNA, 18 nt, Mycobacterium avium subsp. paratuberculosis
cguagguggccagcacga

SEQ ID NO: 2906162 - RNA, 22 nt, Mycobacterium avium subsp. paratuberculosis
cguaguaggugcgcgaggaggg

SEQ ID NO: 2906163 - RNA, 15 nt, Mycobacterium avium subsp. paratuberculosis
cguaguccagcacgg

SEQ ID NO: 2906164 - RNA, 18 nt, Mycobacterium avium subsp. paratuberculosis
cguagucgauggccucgu

SEQ ID NO: 2906165 - RNA, 14 nt, Mycobacterium avium subsp. paratuberculosis
cguagucgccgaug

SEQ ID NO: 2906166 - RNA, 17 nt, Mycobacterium avium subsp. paratuberculosis
cguagucgccgguguag

SEQ ID NO: 2906167 - RNA, 18 nt, Mycobacterium avium subsp. paratuberculosis
cguagucgcucggcggcg

SEQ ID NO: 2906168 - RNA, 19 nt, Mycobacterium avium subsp. paratuberculosis
cguagucgcugagcgggaa

SEQ ID NO: 2906169 - RNA, 17 nt, Mycobacterium avium subsp. paratuberculosis
cguagucggcccgccgg

SEQ ID NO: 2906170 - RNA, 18 nt, Mycobacterium avium subsp. paratuberculosis
cguagucggcccgccggg

SEQ ID NO: 2906171 - RNA, 18 nt, Mycobacterium avium subsp. paratuberculosis
cguagucggcgcagcgca

SEQ ID NO: 2906172 - RNA, 14 nt, Mycobacterium avium subsp. paratuberculosis
cguagucggcggcg

SEQ ID NO: 2906173 - RNA, 16 nt, Mycobacterium avium subsp. paratuberculosis
cguagucggcgucggc

SEQ ID NO: 2906174 - RNA, 19 nt, Mycobacterium avium subsp. paratuberculosis
cguagucggcgucggccac

SEQ ID NO: 2906175 - RNA, 14 nt, Mycobacterium avium subsp. paratuberculosis
cguagucggugcag

SEQ ID NO: 2906176 - RNA, 12 nt, Mycobacterium avium subsp. paratuberculosis
cguagucgucga

SEQ ID NO: 2906177 - RNA, 14 nt, Mycobacterium avium subsp. paratuberculosis
cguagucgucgauc

SEQ ID NO: 2906178 - RNA, 20 nt, Mycobacterium avium subsp. paratuberculosis
cguagucguugucggcgguc

SEQ ID NO: 2906179 - RNA, 18 nt, Mycobacterium avium subsp. paratuberculosis
cguagugcagccgcccgu

SEQ ID NO: 2906180 - RNA, 13 nt, Mycobacterium avium subsp. paratuberculosis
cguagugcucggc

SEQ ID NO: 2906181 - RNA, 15 nt, Mycobacterium avium subsp. paratuberculosis
cguagugcucggcgu

SEQ ID NO: 2906182 - RNA, 15 nt, Mycobacterium avium subsp. paratuberculosis
cguagugcuucuuga

SEQ ID NO: 2906183 - RNA, 19 nt, Mycobacterium avium subsp. paratuberculosis
cguagugggucggcggcug

SEQ ID NO: 2906184 - RNA, 20 nt, Mycobacterium avium subsp. paratuberculosis
cguagugggucggcggcuga

SEQ ID NO: 2906185 - RNA, 13 nt, Mycobacterium avium subsp. paratuberculosis
cguaguucgucga

SEQ ID NO: 2906186 - RNA, 15 nt, Mycobacterium avium subsp. paratuberculosis
cguaguugcgcgccg

SEQ ID NO: 2906187 - RNA, 18 nt, Mycobacterium avium subsp. paratuberculosis
cguaguugcgcgccgaug

SEQ ID NO: 2906188 - RNA, 13 nt, Mycobacterium avium subsp. paratuberculosis
cguaguugcggcc

SEQ ID NO: 2906189 - RNA, 16 nt, Mycobacterium avium subsp. paratuberculosis
cguaguugcggccggc

SEQ ID NO: 2906190 - RNA, 20 nt, Mycobacterium avium subsp. paratuberculosis
cguaguuggggccggccgcc

SEQ ID NO: 2906191 - RNA, 20 nt, Mycobacterium avium subsp. paratuberculosis
cguauacgccagaugcgccg

SEQ ID NO: 2906192 - RNA, 16 nt, Mycobacterium avium subsp. paratuberculosis
cguaucccaccacgaa

SEQ ID NO: 2906193 - RNA, 12 nt, Mycobacterium avium subsp. paratuberculosis
cguaucccugcc

SEQ ID NO: 2906194 - RNA, 13 nt, Mycobacterium avium subsp. paratuberculosis
cguauccgcgguc

SEQ ID NO: 2906195 - RNA, 15 nt, Mycobacterium avium subsp. paratuberculosis
cguauccgcggucga

SEQ ID NO: 2906196 - RNA, 17 nt, Mycobacterium avium subsp. paratuberculosis
cguauccggccagccgg

SEQ ID NO: 2906197 - RNA, 17 nt, Mycobacterium avium subsp. paratuberculosis
cguaucgcgccugcacc

SEQ ID NO: 2906198 - RNA, 21 nt, Mycobacterium avium subsp. paratuberculosis
cguaucgcgccugcaccggcg

SEQ ID NO: 2906199 - RNA, 20 nt, Mycobacterium avium subsp. paratuberculosis
cguaucuccaccgucgaugg

SEQ ID NO: 2906200 - RNA, 14 nt, Mycobacterium avium subsp. paratuberculosis
cguaugcgccaacg

SEQ ID NO: 2906201 - RNA, 15 nt, Mycobacterium avium subsp. paratuberculosis
cguauuccagcgcca

SEQ ID NO: 2906202 - RNA, 18 nt, Mycobacterium avium subsp. paratuberculosis
cguauucgacggcgacca

SEQ ID NO: 2906203 - RNA, 18 nt, Mycobacterium avium subsp. paratuberculosis
cguauucgucgucggccu

SEQ ID NO: 2906204 - RNA, 16 nt, Mycobacterium avium subsp. paratuberculosis
cguauugccgucggcg

SEQ ID NO: 2906205 - RNA, 23 nt, Mycobacterium avium subsp. paratuberculosis
cgucaaaccguuuucggcgcgca

SEQ ID NO: 2906206 - RNA, 21 nt, Mycobacterium avium subsp. paratuberculosis
cgucaaagccguucgcgccga

SEQ ID NO: 2906207 - RNA, 22 nt, Mycobacterium avium subsp. paratuberculosis
cgucaaagccguucgcgccgag

SEQ ID NO: 2906208 - RNA, 13 nt, Mycobacterium avium subsp. paratuberculosis
cgucaacaccgug

SEQ ID NO: 2906209 - RNA, 13 nt, Mycobacterium avium subsp. paratuberculosis
cgucaacccguuc

SEQ ID NO: 2906210 - RNA, 14 nt, Mycobacterium avium subsp. paratuberculosis
cgucaacgacccgg

SEQ ID NO: 2906211 - RNA, 15 nt, Mycobacterium avium subsp. paratuberculosis
cgucaacgccccggu

SEQ ID NO: 2906212 - RNA, 15 nt, Mycobacterium avium subsp. paratuberculosis
cgucaacucgucggc

SEQ ID NO: 2906213 - RNA, 20 nt, Mycobacterium avium subsp. paratuberculosis
cgucaaugauggucagccgc

SEQ ID NO: 2906214 - RNA, 23 nt, Mycobacterium avium subsp. paratuberculosis
cgucaaugauggucagccgcacc

SEQ ID NO: 2906215 - RNA, 16 nt, Mycobacterium avium subsp. paratuberculosis
cgucacaccgcggcca

SEQ ID NO: 2906216 - RNA, 17 nt, Mycobacterium avium subsp. paratuberculosis
cgucacaccgcggccag

SEQ ID NO: 2906217 - RNA, 21 nt, Mycobacterium avium subsp. paratuberculosis
cgucacaccgcggccagcgcg

SEQ ID NO: 2906218 - RNA, 22 nt, Mycobacterium avium subsp. paratuberculosis
cgucacaccgcggccagcgcgc

SEQ ID NO: 2906219 - RNA, 15 nt, Mycobacterium avium subsp. paratuberculosis
cgucacaggccgccu

SEQ ID NO: 2906220 - RNA, 23 nt, Mycobacterium avium subsp. paratuberculosis
cgucaccaacaugaucggcgcga

SEQ ID NO: 2906221 - RNA, 13 nt, Mycobacterium avium subsp. paratuberculosis
cgucaccaaugcg

SEQ ID NO: 2906222 - RNA, 19 nt, Mycobacterium avium subsp. paratuberculosis
cgucaccaaugcgccggcg

SEQ ID NO: 2906223 - RNA, 20 nt, Mycobacterium avium subsp. paratuberculosis
cgucaccaaugcgccggcgg

SEQ ID NO: 2906224 - RNA, 22 nt, Mycobacterium avium subsp. paratuberculosis
cgucaccaaugcgccggcggcc

SEQ ID NO: 2906225 - RNA, 17 nt, Mycobacterium avium subsp. paratuberculosis
cgucaccaccgggucgu

SEQ ID NO: 2906226 - RNA, 19 nt, Mycobacterium avium subsp. paratuberculosis
cgucaccaccgggucgucg

SEQ ID NO: 2906227 - RNA, 20 nt, Mycobacterium avium subsp. paratuberculosis
cgucaccaccgggucgucgc

SEQ ID NO: 2906228 - RNA, 21 nt, Mycobacterium avium subsp. paratuberculosis
cgucaccaggcugcucggcgg

SEQ ID NO: 2906229 - RNA, 22 nt, Mycobacterium avium subsp. paratuberculosis
cgucaccaggcugcucggcggg

SEQ ID NO: 2906230 - RNA, 18 nt, Mycobacterium avium subsp. paratuberculosis
cgucacccagaucgcccg

SEQ ID NO: 2906231 - RNA, 18 nt, Mycobacterium avium subsp. paratuberculosis
cgucaccccaccgagcag

SEQ ID NO: 2906232 - RNA, 15 nt, Mycobacterium avium subsp. paratuberculosis
cgucacccccggcgc

SEQ ID NO: 2906233 - RNA, 17 nt, Mycobacterium avium subsp. paratuberculosis
cgucacccccggcgcga

SEQ ID NO: 2906234 - RNA, 18 nt, Mycobacterium avium subsp. paratuberculosis
cgucacccccggcgcgac

SEQ ID NO: 2906235 - RNA, 21 nt, Mycobacterium avium subsp. paratuberculosis
cgucacccccggcgcgacggc

SEQ ID NO: 2906236 - RNA, 17 nt, Mycobacterium avium subsp. paratuberculosis
cgucaccgaccccucgg

SEQ ID NO: 2906237 - RNA, 20 nt, Mycobacterium avium subsp. paratuberculosis
cgucaccgaccccucggcgg

SEQ ID NO: 2906238 - RNA, 21 nt, Mycobacterium avium subsp. paratuberculosis
cgucaccgaccccucggcggc

SEQ ID NO: 2906239 - RNA, 22 nt, Mycobacterium avium subsp. paratuberculosis
cgucaccgaccccucggcggcc

SEQ ID NO: 2906240 - RNA, 23 nt, Mycobacterium avium subsp. paratuberculosis
cgucaccgaccccucggcggccg

SEQ ID NO: 2906241 - RNA, 21 nt, Mycobacterium avium subsp. paratuberculosis
cgucaccgccaggaccaccca

SEQ ID NO: 2906242 - RNA, 15 nt, Mycobacterium avium subsp. paratuberculosis
cgucaccgccgcacc

SEQ ID NO: 2906243 - RNA, 18 nt, Mycobacterium avium subsp. paratuberculosis
cgggccggucagcgcgac

SEQ ID NO: 2906244 - RNA, 19 nt, Mycobacterium avium subsp. paratuberculosis
cgggccgguccccggcgac

SEQ ID NO: 2906245 - RNA, 15 nt, Mycobacterium avium subsp. paratuberculosis
cgggccggucgguca

SEQ ID NO: 2906246 - RNA, 21 nt, Mycobacterium avium subsp. paratuberculosis
cgggccguaucggccccggcc

SEQ ID NO: 2906247 - RNA, 13 nt, Mycobacterium avium subsp. paratuberculosis
cgggccgucaucg

SEQ ID NO: 2906248 - RNA, 18 nt, Mycobacterium avium subsp. paratuberculosis
cgggccgucaucgccgac

SEQ ID NO: 2906249 - RNA, 20 nt, Mycobacterium avium subsp. paratuberculosis
cgggccgucaucgccgacgg

SEQ ID NO: 2906250 - RNA, 22 nt, Mycobacterium avium subsp. paratuberculosis
cgggccgucaucgccgacggug

SEQ ID NO: 2906251 - RNA, 17 nt, Mycobacterium avium subsp. paratuberculosis
cgggccguccaucccga

SEQ ID NO: 2906252 - RNA, 15 nt, Mycobacterium avium subsp. paratuberculosis
cgggccguccgccgg

SEQ ID NO: 2906253 - RNA, 18 nt, Mycobacterium avium subsp. paratuberculosis
cgggccguccgccggcug

SEQ ID NO: 2906254 - RNA, 15 nt, Mycobacterium avium subsp. paratuberculosis
cgggccguccgggug

SEQ ID NO: 2906255 - RNA, 16 nt, Mycobacterium avium subsp. paratuberculosis
cgggccguccgggugc

SEQ ID NO: 2906256 - RNA, 17 nt, Mycobacterium avium subsp. paratuberculosis
cgggccguccgggugcg

SEQ ID NO: 2906257 - RNA, 20 nt, Mycobacterium avium subsp. paratuberculosis
cgggccguccgggugcgggc

SEQ ID NO: 2906258 - RNA, 15 nt, Mycobacterium avium subsp. paratuberculosis
cgggccguggcaccg

SEQ ID NO: 2906259 - RNA, 17 nt, Mycobacterium avium subsp. paratuberculosis
cgggccguggcaccggg

SEQ ID NO: 2906260 - RNA, 19 nt, Mycobacterium avium subsp. paratuberculosis
cgggccguggcaccgggug

SEQ ID NO: 2906261 - RNA, 16 nt, Mycobacterium avium subsp. paratuberculosis
cgggccguucagcggg

SEQ ID NO: 2906262 - RNA, 17 nt, Mycobacterium avium subsp. paratuberculosis
cgggccguucagcgggc

SEQ ID NO: 2906263 - RNA, 22 nt, Mycobacterium avium subsp. paratuberculosis
cgggccguucagcgggcgguug

SEQ ID NO: 2906264 - RNA, 17 nt, Mycobacterium avium subsp. paratuberculosis
cgggccuaggaccccgg

SEQ ID NO: 2906265 - RNA, 22 nt, Mycobacterium avium subsp. paratuberculosis
cgggccuccuguuggcccugcu

SEQ ID NO: 2906266 - RNA, 13 nt, Mycobacterium avium subsp. paratuberculosis
cgggccucgccgc

SEQ ID NO: 2906267 - RNA, 16 nt, Mycobacterium avium subsp. paratuberculosis
cgggccucgccgcuuc

SEQ ID NO: 2906268 - RNA, 16 nt, Mycobacterium avium subsp. paratuberculosis
cgggccugcgcgccga

SEQ ID NO: 2906269 - RNA, 17 nt, Mycobacterium avium subsp. paratuberculosis
cgggccugcgcgccgau

SEQ ID NO: 2906270 - RNA, 19 nt, Mycobacterium avium subsp. paratuberculosis
cgggccugcgcgccgaugu

SEQ ID NO: 2906271 - RNA, 21 nt, Mycobacterium avium subsp. paratuberculosis
cgggccugcggcgcggccacc

SEQ ID NO: 2906272 - RNA, 16 nt, Mycobacterium avium subsp. paratuberculosis
cgggccugcggcggcc

SEQ ID NO: 2906273 - RNA, 17 nt, Mycobacterium avium subsp. paratuberculosis
cgggccugcggcggccg

SEQ ID NO: 2906274 - RNA, 18 nt, Mycobacterium avium subsp. paratuberculosis
cgggccugcggcggccgc

SEQ ID NO: 2906275 - RNA, 21 nt, Mycobacterium avium subsp. paratuberculosis
cgggccugcggcggccgcagc

SEQ ID NO: 2906276 - RNA, 13 nt, Mycobacterium avium subsp. paratuberculosis
cgggccugcucgu

SEQ ID NO: 2906277 - RNA, 16 nt, Mycobacterium avium subsp. paratuberculosis
cgggccugcucgucgg

SEQ ID NO: 2906278 - RNA, 22 nt, Mycobacterium avium subsp. paratuberculosis
cgggccugcucgucggggcagc

SEQ ID NO: 2906279 - RNA, 19 nt, Mycobacterium avium subsp. paratuberculosis
cgggccuguccagccgguc

SEQ ID NO: 2906280 - RNA, 18 nt, Mycobacterium avium subsp. paratuberculosis
cgggccuugacggccugg

SEQ ID NO: 2906281 - RNA, 19 nt, Mycobacterium avium subsp. paratuberculosis
cgggccuugagcaccgcgu

SEQ ID NO: 2906282 - RNA, 22 nt, Mycobacterium avium subsp. paratuberculosis
cgggccuugagcaccgcgucgu

SEQ ID NO: 2906283 - RNA, 17 nt, Mycobacterium avium subsp. paratuberculosis
cgggccuuggccaacgc

SEQ ID NO: 2906284 - RNA, 17 nt, Mycobacterium avium subsp. paratuberculosis
cgggccuuguugcggcg

SEQ ID NO: 2906285 - RNA, 20 nt, Mycobacterium avium subsp. paratuberculosis
cgggccuuguugcggcgcac

SEQ ID NO: 2906286 - RNA, 19 nt, Mycobacterium avium subsp. paratuberculosis
cgggcgaaaucgcgggccu

SEQ ID NO: 2906287 - RNA, 16 nt, Mycobacterium avium subsp. paratuberculosis
cgggcgaaccacgggu

SEQ ID NO: 2906288 - RNA, 20 nt, Mycobacterium avium subsp. paratuberculosis
cgggcgaaccacgggucgcu

SEQ ID NO: 2906289 - RNA, 22 nt, Mycobacterium avium subsp. paratuberculosis
cgggcgaaccacgggucgcugu

SEQ ID NO: 2906290 - RNA, 13 nt, Mycobacterium avium subsp. paratuberculosis
cgggcgaacgacc

SEQ ID NO: 2906291 - RNA, 15 nt, Mycobacterium avium subsp. paratuberculosis
cgggcgaacgaccgg

SEQ ID NO: 2906292 - RNA, 16 nt, Mycobacterium avium subsp. paratuberculosis
cgggcgaacgaccggg

SEQ ID NO: 2906293 - RNA, 18 nt, Mycobacterium avium subsp. paratuberculosis
cgggcgaacgaccgggug

SEQ ID NO: 2906294 - RNA, 23 nt, Mycobacterium avium subsp. paratuberculosis
cgggcgaacgaccgggugaacga

SEQ ID NO: 2906295 - RNA, 14 nt, Mycobacterium avium subsp. paratuberculosis
cgggcgaacgucgg

SEQ ID NO: 2906296 - RNA, 15 nt, Mycobacterium avium subsp. paratuberculosis
cgggcgaacgucggg

SEQ ID NO: 2906297 - RNA, 18 nt, Mycobacterium avium subsp. paratuberculosis
cgggcgaacgucgggucg

SEQ ID NO: 2906298 - RNA, 16 nt, Mycobacterium avium subsp. paratuberculosis
cgggcgaaguagccgg

SEQ ID NO: 2906299 - RNA, 18 nt, Mycobacterium avium subsp. paratuberculosis
cgggcgaaguagccggcg

SEQ ID NO: 2906300 - RNA, 15 nt, Mycobacterium avium subsp. paratuberculosis
cgggcgaagucgccg

SEQ ID NO: 2906301 - RNA, 19 nt, Mycobacterium avium subsp. paratuberculosis
cgggcgaagucgccggcca

SEQ ID NO: 2906302 - RNA, 20 nt, Mycobacterium avium subsp. paratuberculosis
cgggcgaagucgccggccag

SEQ ID NO: 2906303 - RNA, 14 nt, Mycobacterium avium subsp. paratuberculosis
cgggcgacaucucg

SEQ ID NO: 2906304 - RNA, 19 nt, Mycobacterium avium subsp. paratuberculosis
cgggcgacaucucggugag

SEQ ID NO: 2906305 - RNA, 17 nt, Mycobacterium avium subsp. paratuberculosis
cgggcgacaugcccgcg

SEQ ID NO: 2906306 - RNA, 14 nt, Mycobacterium avium subsp. paratuberculosis
cgggcgaccccggc

SEQ ID NO: 2906307 - RNA, 17 nt, Mycobacterium avium subsp. paratuberculosis
cgggcgaccccggccag

SEQ ID NO: 2906308 - RNA, 19 nt, Mycobacterium avium subsp. paratuberculosis
cgggcgaccccggccagga

SEQ ID NO: 2906309 - RNA, 12 nt, Mycobacterium avium subsp. paratuberculosis
cgggcgacccgc

SEQ ID NO: 2906310 - RNA, 19 nt, Mycobacterium avium subsp. paratuberculosis
cgggcgacccgcuggaaca

SEQ ID NO: 2906311 - RNA, 15 nt, Mycobacterium avium subsp. paratuberculosis
cgggcgaccugcggg

SEQ ID NO: 2906312 - RNA, 22 nt, Mycobacterium avium subsp. paratuberculosis
cgggcgaccugcgggcccaccg

SEQ ID NO: 2906313 - RNA, 13 nt, Mycobacterium avium subsp. paratuberculosis
cgggcgaccuggu

SEQ ID NO: 2906314 - RNA, 20 nt, Mycobacterium avium subsp. paratuberculosis
cgggcgaccuggugcucgau

SEQ ID NO: 2906315 - RNA, 13 nt, Mycobacterium avium subsp. paratuberculosis
cgggcgacgacgc

SEQ ID NO: 2906316 - RNA, 16 nt, Mycobacterium avium subsp. paratuberculosis
cgggcgacgacgcggu

SEQ ID NO: 2906317 - RNA, 18 nt, Mycobacterium avium subsp. paratuberculosis
cgggcgacgacgcggucg

SEQ ID NO: 2906318 - RNA, 20 nt, Mycobacterium avium subsp. paratuberculosis
cgggcgacgacgcggucguc

SEQ ID NO: 2906319 - RNA, 14 nt, Mycobacterium avium subsp. paratuberculosis
cgggcgacgucggg

SEQ ID NO: 2906320 - RNA, 18 nt, Mycobacterium avium subsp. paratuberculosis
cgggcgacuucguuggug

SEQ ID NO: 2906321 - RNA, 23 nt, Mycobacterium avium subsp. paratuberculosis
cgggcgacuucguugguggucga

SEQ ID NO: 2906322 - RNA, 15 nt, Mycobacterium avium subsp. paratuberculosis
cgggcgacuucuucg

SEQ ID NO: 2906323 - RNA, 18 nt, Mycobacterium avium subsp. paratuberculosis
cgggcgacuucuucgccg

SEQ ID NO: 2906324 - RNA, 19 nt, Mycobacterium avium subsp. paratuberculosis
cgggcgacuucuucgccgg

SEQ ID NO: 2906325 - RNA, 16 nt, Mycobacterium avium subsp. paratuberculosis
cgggcgagcagcgccc

SEQ ID NO: 2906326 - RNA, 15 nt, Mycobacterium avium subsp. paratuberculosis
cgggcgagccgaagc

SEQ ID NO: 2906327 - RNA, 13 nt, Mycobacterium avium subsp. paratuberculosis
cgggcgagccgac

SEQ ID NO: 2906328 - RNA, 15 nt, Mycobacterium avium subsp. paratuberculosis
cgggcgagccgacag

SEQ ID NO: 2906329 - RNA, 16 nt, Mycobacterium avium subsp. paratuberculosis
cgggcgagcgucgccg

SEQ ID NO: 2906330 - RNA, 17 nt, Mycobacterium avium subsp. paratuberculosis
cgggcgagcgucgccgc

SEQ ID NO: 2906331 - RNA, 14 nt, Mycobacterium avium subsp. paratuberculosis
cgggcgaucagccc

SEQ ID NO: 2906332 - RNA, 15 nt, Mycobacterium avium subsp. paratuberculosis
cgggcgaucagcccg

SEQ ID NO: 2906333 - RNA, 18 nt, Mycobacterium avium subsp. paratuberculosis
cgggcgaucagcccgccc

SEQ ID NO: 2906334 - RNA, 19 nt, Mycobacterium avium subsp. paratuberculosis
cgggcgaucagcccgccca

SEQ ID NO: 2906335 - RNA, 22 nt, Mycobacterium avium subsp. paratuberculosis
cgggcgaucagcccgcccacca

SEQ ID NO: 2906336 - RNA, 16 nt, Mycobacterium avium subsp. paratuberculosis
cgggcgaucgccucgg

SEQ ID NO: 2906337 - RNA, 17 nt, Mycobacterium avium subsp. paratuberculosis
cgggcgaucgccucggc

SEQ ID NO: 2906338 - RNA, 17 nt, Mycobacterium avium subsp. paratuberculosis
cgggcgaucuccagcgg

SEQ ID NO: 2906339 - RNA, 18 nt, Mycobacterium avium subsp. paratuberculosis
cgggcgaucuccagcggc

SEQ ID NO: 2906340 - RNA, 19 nt, Mycobacterium avium subsp. paratuberculosis
cgggcgaucuccagcggcc

SEQ ID NO: 2906341 - RNA, 22 nt, Mycobacterium avium subsp. paratuberculosis
cgggcgaucucgauggccacgc

SEQ ID NO: 2906342 - RNA, 17 nt, Mycobacterium avium subsp. paratuberculosis
cgggcgaucucgaugua

SEQ ID NO: 2906343 - RNA, 20 nt, Mycobacterium avium subsp. paratuberculosis
cgggcgaucucuucgaugcc

SEQ ID NO: 2906344 - RNA, 17 nt, Mycobacterium avium subsp. paratuberculosis
cgggcgaugcggcccgg

SEQ ID NO: 2906345 - RNA, 18 nt, Mycobacterium avium subsp. paratuberculosis
cgggcgaugcggcccggc

SEQ ID NO: 2906346 - RNA, 20 nt, Mycobacterium avium subsp. paratuberculosis
cgggcgaugcggcccggcca

SEQ ID NO: 2906347 - RNA, 17 nt, Mycobacterium avium subsp. paratuberculosis
cgggcgauggcgggccg

SEQ ID NO: 2906348 - RNA, 16 nt, Mycobacterium avium subsp. paratuberculosis
cgggcgauggugccgc

SEQ ID NO: 2906349 - RNA, 18 nt, Mycobacterium avium subsp. paratuberculosis
cgggcgauggugccgccg

SEQ ID NO: 2906350 - RNA, 21 nt, Mycobacterium avium subsp. paratuberculosis
cgggcgauucgucgucguugg

SEQ ID NO: 2906351 - RNA, 18 nt, Mycobacterium avium subsp. paratuberculosis
cgggcgauuucgucggcg

SEQ ID NO: 2906352 - RNA, 20 nt, Mycobacterium avium subsp. paratuberculosis
cgggcgauuucgucggcggu

SEQ ID NO: 2906353 - RNA, 12 nt, Mycobacterium avium subsp. paratuberculosis
cgggcgcaccac

SEQ ID NO: 2906354 - RNA, 13 nt, Mycobacterium avium subsp. paratuberculosis
cgggcgcaccacg

SEQ ID NO: 2906355 - RNA, 14 nt, Mycobacterium avium subsp. paratuberculosis
cgggcgcaccacga

SEQ ID NO: 2906356 - RNA, 12 nt, Mycobacterium avium subsp. paratuberculosis
cgggcgcaccgc

SEQ ID NO: 2906357 - RNA, 15 nt, Mycobacterium avium subsp. paratuberculosis
cgggcgcaccgcgcg

SEQ ID NO: 2906358 - RNA, 17 nt, Mycobacterium avium subsp. paratuberculosis
cgggcgcaccgcgcgcc

SEQ ID NO: 2906359 - RNA, 19 nt, Mycobacterium avium subsp. paratuberculosis
cgggcgcaccgcgcgccag

SEQ ID NO: 2906360 - RNA, 23 nt, Mycobacterium avium subsp. paratuberculosis
cgggcgcagaaaaaggccgccgc

SEQ ID NO: 2906361 - RNA, 22 nt, Mycobacterium avium subsp. paratuberculosis
cgggcgcagaaaugggccaugc

SEQ ID NO: 2906362 - RNA, 16 nt, Mycobacterium avium subsp. paratuberculosis
cgggcgcagcgccguc

SEQ ID NO: 2906363 - RNA, 17 nt, Mycobacterium avium subsp. paratuberculosis
cgggcgcagcgccgucu

SEQ ID NO: 2906364 - RNA, 16 nt, Mycobacterium avium subsp. paratuberculosis
cgggcgcagcucgucg

SEQ ID NO: 2906365 - RNA, 18 nt, Mycobacterium avium subsp. paratuberculosis
cgggcgcagcucgucgug

SEQ ID NO: 2906366 - RNA, 13 nt, Mycobacterium avium subsp. paratuberculosis
cgggcgcaggucc

SEQ ID NO: 2906367 - RNA, 19 nt, Mycobacterium avium subsp. paratuberculosis
cgggcgcagguccacccgc

SEQ ID NO: 2906368 - RNA, 21 nt, Mycobacterium avium subsp. paratuberculosis
cgggcgcaggugggcggugcg

SEQ ID NO: 2906369 - RNA, 16 nt, Mycobacterium avium subsp. paratuberculosis
cgggcgcauaccagcg

SEQ ID NO: 2906370 - RNA, 17 nt, Mycobacterium avium subsp. paratuberculosis
cgggcgcauaccagcgc

SEQ ID NO: 2906371 - RNA, 15 nt, Mycobacterium avium subsp. paratuberculosis
cgggcgccacgcugg

SEQ ID NO: 2906372 - RNA, 22 nt, Mycobacterium avium subsp. paratuberculosis
cgggcgccacgcuggcgugacg

SEQ ID NO: 2906373 - RNA, 14 nt, Mycobacterium avium subsp. paratuberculosis
cgggcgccagcccg

SEQ ID NO: 2906374 - RNA, 17 nt, Mycobacterium avium subsp. paratuberculosis
cgggcgccagcccgccc

SEQ ID NO: 2906375 - RNA, 14 nt, Mycobacterium avium subsp. paratuberculosis
cgggcgccauccgc

SEQ ID NO: 2906376 - RNA, 16 nt, Mycobacterium avium subsp. paratuberculosis
cgggcgccauccgcag

SEQ ID NO: 2906377 - RNA, 21 nt, Mycobacterium avium subsp. paratuberculosis
cgggcgccauccgcagcccgu

SEQ ID NO: 2906378 - RNA, 16 nt, Mycobacterium avium subsp. paratuberculosis
cgggcgccauccgcca

SEQ ID NO: 2906379 - RNA, 20 nt, Mycobacterium avium subsp. paratuberculosis
cgggcgccauccgccacccg

SEQ ID NO: 2906380 - RNA, 21 nt, Mycobacterium avium subsp. paratuberculosis
cgggcgccauccgccacccgc

SEQ ID NO: 2906381 - RNA, 16 nt, Mycobacterium avium subsp. paratuberculosis
cgggcgcccagcaaac

SEQ ID NO: 2906382 - RNA, 17 nt, Mycobacterium avium subsp. paratuberculosis
cgggcgcccagcaaacc

SEQ ID NO: 2906383 - RNA, 21 nt, Mycobacterium avium subsp. paratuberculosis
cgggcgcccagcaaacccagc

SEQ ID NO: 2906384 - RNA, 14 nt, Mycobacterium avium subsp. paratuberculosis
cgggcgccccgaca

SEQ ID NO: 2906385 - RNA, 12 nt, Mycobacterium avium subsp. paratuberculosis
cgggcgcccgcg

SEQ ID NO: 2906386 - RNA, 18 nt, Mycobacterium avium subsp. paratuberculosis
cgggcgcccguagaacag

SEQ ID NO: 2906387 - RNA, 22 nt, Mycobacterium avium subsp. paratuberculosis
cgggcgcccuccacgucgucgg

SEQ ID NO: 2906388 - RNA, 16 nt, Mycobacterium avium subsp. paratuberculosis
cgggcgcccuugaucg

SEQ ID NO: 2906389 - RNA, 23 nt, Mycobacterium avium subsp. paratuberculosis
cgggcgccgaacgucgagcgcgg

SEQ ID NO: 2906390 - RNA, 14 nt, Mycobacterium avium subsp. paratuberculosis
cgggcgccgagaac

SEQ ID NO: 2906391 - RNA, 14 nt, Mycobacterium avium subsp. paratuberculosis
cgggcgccgagucc

SEQ ID NO: 2906392 - RNA, 12 nt, Mycobacterium avium subsp. paratuberculosis
cgggcgccggcc

SEQ ID NO: 2906393 - RNA, 15 nt, Mycobacterium avium subsp. paratuberculosis
cgggcgccggccggc

SEQ ID NO: 2906394 - RNA, 21 nt, Mycobacterium avium subsp. paratuberculosis
cgggcgccggccggcgcgugc

SEQ ID NO: 2906395 - RNA, 13 nt, Mycobacterium avium subsp. paratuberculosis
cgggcgccggcga

SEQ ID NO: 2906396 - RNA, 14 nt, Mycobacterium avium subsp. paratuberculosis
cgggcgccggcgau

SEQ ID NO: 2906397 - RNA, 16 nt, Mycobacterium avium subsp. paratuberculosis
cgggcgccggcgauga

SEQ ID NO: 2906398 - RNA, 17 nt, Mycobacterium avium subsp. paratuberculosis
cgggcgccggcgaugaa

SEQ ID NO: 2906399 - RNA, 15 nt, Mycobacterium avium subsp. paratuberculosis
cgggcgccggcgcgu

SEQ ID NO: 2906400 - RNA, 17 nt, Mycobacterium avium subsp. paratuberculosis
cgggcgccggcgcgucc

SEQ ID NO: 2906401 - RNA, 12 nt, Mycobacterium avium subsp. paratuberculosis
cgggcgccggua

SEQ ID NO: 2906402 - RNA, 12 nt, Mycobacterium avium subsp. paratuberculosis
cgggcgccgguc

SEQ ID NO: 2906403 - RNA, 14 nt, Mycobacterium avium subsp. paratuberculosis
cgggcgccggucgg

SEQ ID NO: 2906404 - RNA, 16 nt, Mycobacterium avium subsp. paratuberculosis
cgggcgccggucggcg

SEQ ID NO: 2906405 - RNA, 12 nt, Mycobacterium avium subsp. paratuberculosis
cgggcgccgguu

SEQ ID NO: 2906406 - RNA, 17 nt, Mycobacterium avium subsp. paratuberculosis
cgggcgccguaggccgc

SEQ ID NO: 2906407 - RNA, 18 nt, Mycobacterium avium subsp. paratuberculosis
cgggcgccgucggggcug

SEQ ID NO: 2906408 - RNA, 23 nt, Mycobacterium avium subsp. paratuberculosis
cgggcgccuucuuggcggcgguc

SEQ ID NO: 2906409 - RNA, 17 nt, Mycobacterium avium subsp. paratuberculosis
cgggcgcgaacagcgcc

SEQ ID NO: 2906410 - RNA, 19 nt, Mycobacterium avium subsp. paratuberculosis
cgggcgcgaacagcgccga

SEQ ID NO: 2906411 - RNA, 22 nt, Mycobacterium avium subsp. paratuberculosis
cgggcgcgaauuccucagcgcc

SEQ ID NO: 2906412 - RNA, 12 nt, Mycobacterium avium subsp. paratuberculosis
cgggcgcgacgg

SEQ ID NO: 2906413 - RNA, 15 nt, Mycobacterium avium subsp. paratuberculosis
cgggcgcgacgguca

SEQ ID NO: 2906414 - RNA, 13 nt, Mycobacterium avium subsp. paratuberculosis
cgggcgcgcccac

SEQ ID NO: 2906415 - RNA, 15 nt, Mycobacterium avium subsp. paratuberculosis
cgggcgcgcccaccc

SEQ ID NO: 2906416 - RNA, 16 nt, Mycobacterium avium subsp. paratuberculosis
cgggcgcgcccacccg

SEQ ID NO: 2906417 - RNA, 17 nt, Mycobacterium avium subsp. paratuberculosis
cgggcgcgcccacccgc

SEQ ID NO: 2906418 - RNA, 19 nt, Mycobacterium avium subsp. paratuberculosis
cgggcgcgcccacccgcgc

SEQ ID NO: 2906419 - RNA, 11 nt, Mycobacterium avium subsp. paratuberculosis
cgggcgcgccg

SEQ ID NO: 2906420 - RNA, 13 nt, Mycobacterium avium subsp. paratuberculosis
cgggcgcgccggc

SEQ ID NO: 2906421 - RNA, 16 nt, Mycobacterium avium subsp. paratuberculosis
cgggcgcgccggcgcg

SEQ ID NO: 2906422 - RNA, 18 nt, Mycobacterium avium subsp. paratuberculosis
cgggcgcgccgucccagc

SEQ ID NO: 2906423 - RNA, 13 nt, Mycobacterium avium subsp. paratuberculosis
cgggcgcgcgccg

SEQ ID NO: 2906424 - RNA, 14 nt, Mycobacterium avium subsp. paratuberculosis
cgggcgcgcgccgc

SEQ ID NO: 2906425 - RNA, 16 nt, Mycobacterium avium subsp. paratuberculosis
cgggcgcgcgccgccc

SEQ ID NO: 2906426 - RNA, 18 nt, Mycobacterium avium subsp. paratuberculosis
cgggcgcgcgccgccccc

SEQ ID NO: 2906427 - RNA, 22 nt, Mycobacterium avium subsp. paratuberculosis
cgggcgcgcgccgcccccgcgg

SEQ ID NO: 2906428 - RNA, 14 nt, Mycobacterium avium subsp. paratuberculosis
cgggcgcgcgccuc

SEQ ID NO: 2906429 - RNA, 13 nt, Mycobacterium avium subsp. paratuberculosis
cgggcgcgcgcgc

SEQ ID NO: 2906430 - RNA, 14 nt, Mycobacterium avium subsp. paratuberculosis
cgggcgcggacagc

SEQ ID NO: 2906431 - RNA, 23 nt, Mycobacterium avium subsp. paratuberculosis
cgggcgcggacagcugcgcgggc

SEQ ID NO: 2906432 - RNA, 18 nt, Mycobacterium avium subsp. paratuberculosis
cgggcgcggauggguggc

SEQ ID NO: 2906433 - RNA, 14 nt, Mycobacterium avium subsp. paratuberculosis
cgggcgcggccagc

SEQ ID NO: 2906434 - RNA, 14 nt, Mycobacterium avium subsp. paratuberculosis
cgggcgcggcggca

SEQ ID NO: 2906435 - RNA, 13 nt, Mycobacterium avium subsp. paratuberculosis
cgggcgcggugug

SEQ ID NO: 2906436 - RNA, 20 nt, Mycobacterium avium subsp. paratuberculosis
cgggcgcggugugggcgaug

SEQ ID NO: 2906437 - RNA, 19 nt, Mycobacterium avium subsp. paratuberculosis
cgggcgcgugcacaccggc

SEQ ID NO: 2906438 - RNA, 17 nt, Mycobacterium avium subsp. paratuberculosis
cgggcgcguugaugccg

SEQ ID NO: 2906439 - RNA, 20 nt, Mycobacterium avium subsp. paratuberculosis
cgggcgcguugaugccgugc

SEQ ID NO: 2906440 - RNA, 14 nt, Mycobacterium avium subsp. paratuberculosis
cgggcgcucgaugg

SEQ ID NO: 2906441 - RNA, 13 nt, Mycobacterium avium subsp. paratuberculosis
cgggcgcucggcc

SEQ ID NO: 2906442 - RNA, 14 nt, Mycobacterium avium subsp. paratuberculosis
cgggcgcucggcca

SEQ ID NO: 2906443 - RNA, 18 nt, Mycobacterium avium subsp. paratuberculosis
cgggcgcucggccagcag

SEQ ID NO: 2906444 - RNA, 16 nt, Mycobacterium avium subsp. paratuberculosis
cgggcgcucuucgggc

SEQ ID NO: 2906445 - RNA, 19 nt, Mycobacterium avium subsp. paratuberculosis
cgggcgcucuucgggcugc

SEQ ID NO: 2906446 - RNA, 20 nt, Mycobacterium avium subsp. paratuberculosis
cgggcgcucuucgggcugcg

SEQ ID NO: 2906447 - RNA, 20 nt, Mycobacterium avium subsp. paratuberculosis
cgggcgcugagcacgguggg

SEQ ID NO: 2906448 - RNA, 23 nt, Mycobacterium avium subsp. paratuberculosis
cgggcgcugagcacggugggcgc

SEQ ID NO: 2906449 - RNA, 14 nt, Mycobacterium avium subsp. paratuberculosis
cgggcgcugccguc

SEQ ID NO: 2906450 - RNA, 15 nt, Mycobacterium avium subsp. paratuberculosis
cgggcgcugccgucc

SEQ ID NO: 2906451 - RNA, 14 nt, Mycobacterium avium subsp. paratuberculosis
cgggcgcugcgcgg

SEQ ID NO: 2906452 - RNA, 15 nt, Mycobacterium avium subsp. paratuberculosis
cgggcgcugcgcggu

SEQ ID NO: 2906453 - RNA, 20 nt, Mycobacterium avium subsp. paratuberculosis
cgggcgcugcgcgguggcgc

SEQ ID NO: 2906454 - RNA, 12 nt, Mycobacterium avium subsp. paratuberculosis
cgggcgcuggcc

SEQ ID NO: 2906455 - RNA, 17 nt, Mycobacterium avium subsp. paratuberculosis
cgggcgcuggccguggc

SEQ ID NO: 2906456 - RNA, 16 nt, Mycobacterium avium subsp. paratuberculosis
cgggcgcuggcgaugg

SEQ ID NO: 2906457 - RNA, 15 nt, Mycobacterium avium subsp. paratuberculosis
cgggcggaagucggu

SEQ ID NO: 2906458 - RNA, 15 nt, Mycobacterium avium subsp. paratuberculosis
cgggcggacggcacc

SEQ ID NO: 2906459 - RNA, 17 nt, Mycobacterium avium subsp. paratuberculosis
cgggcggacggcaccga

SEQ ID NO: 2906460 - RNA, 18 nt, Mycobacterium avium subsp. paratuberculosis
cgggcggacggcaccgac

SEQ ID NO: 2906461 - RNA, 17 nt, Mycobacterium avium subsp. paratuberculosis
cgggcggaugucggugu

SEQ ID NO: 2906462 - RNA, 11 nt, Mycobacterium avium subsp. paratuberculosis
cgggcggcacc

SEQ ID NO: 2906463 - RNA, 16 nt, Mycobacterium avium subsp. paratuberculosis
cgggcggcaccgcugc

SEQ ID NO: 2906464 - RNA, 18 nt, Mycobacterium avium subsp. paratuberculosis
cgggcggcaccgcugccg

SEQ ID NO: 2906465 - RNA, 23 nt, Mycobacterium avium subsp. paratuberculosis
cgggcggcaccgcugccggccga

SEQ ID NO: 2906466 - RNA, 15 nt, Mycobacterium avium subsp. paratuberculosis
cgggcggcagcagcu

SEQ ID NO: 2906467 - RNA, 23 nt, Mycobacterium avium subsp. paratuberculosis
cgggcggcagcagcugcgucggc

SEQ ID NO: 2906468 - RNA, 13 nt, Mycobacterium avium subsp. paratuberculosis
cgggcggcagcca

SEQ ID NO: 2906469 - RNA, 14 nt, Mycobacterium avium subsp. paratuberculosis
cgggcggcaggucg

SEQ ID NO: 2906470 - RNA, 15 nt, Mycobacterium avium subsp. paratuberculosis
cgggcggcaggucgg

SEQ ID NO: 2906471 - RNA, 15 nt, Mycobacterium avium subsp. paratuberculosis
cgggcggcaucgcgc

SEQ ID NO: 2906472 - RNA, 17 nt, Mycobacterium avium subsp. paratuberculosis
cgggcggcaucgcgccg

SEQ ID NO: 2906473 - RNA, 18 nt, Mycobacterium avium subsp. paratuberculosis
cgggcggcaucgcgccgc

SEQ ID NO: 2906474 - RNA, 17 nt, Mycobacterium avium subsp. paratuberculosis
cgggcggcaucgcgcgc

SEQ ID NO: 2906475 - RNA, 20 nt, Mycobacterium avium subsp. paratuberculosis
cgggcggcaucgcgcgcggc

SEQ ID NO: 2906476 - RNA, 12 nt, Mycobacterium avium subsp. paratuberculosis
cgggcggccagc

SEQ ID NO: 2906477 - RNA, 14 nt, Mycobacterium avium subsp. paratuberculosis
cgggcggccagccg

SEQ ID NO: 2906478 - RNA, 13 nt, Mycobacterium avium subsp. paratuberculosis
cgggcggccagcg

SEQ ID NO: 2906479 - RNA, 14 nt, Mycobacterium avium subsp. paratuberculosis
cgggcggccagcgu

SEQ ID NO: 2906480 - RNA, 15 nt, Mycobacterium avium subsp. paratuberculosis
cgggcggccagcgug

SEQ ID NO: 2906481 - RNA, 19 nt, Mycobacterium avium subsp. paratuberculosis
cgggcggccagcguggcgc

SEQ ID NO: 2906482 - RNA, 21 nt, Mycobacterium avium subsp. paratuberculosis
cgggcggccagcguggcgcgc

SEQ ID NO: 2906483 - RNA, 18 nt, Mycobacterium avium subsp. paratuberculosis
cgggcggccccgggcgcu

SEQ ID NO: 2906484 - RNA, 17 nt, Mycobacterium avium subsp. paratuberculosis
cgggcggcccgccucgg

SEQ ID NO: 2906485 - RNA, 18 nt, Mycobacterium avium subsp. paratuberculosis
cgggcggcccgccucggc

SEQ ID NO: 2906486 - RNA, 13 nt, Mycobacterium avium subsp. paratuberculosis
cgggcggccgauc

SEQ ID NO: 2906487 - RNA, 13 nt, Mycobacterium avium subsp. paratuberculosis
cgggcggccgcgg

SEQ ID NO: 2906488 - RNA, 14 nt, Mycobacterium avium subsp. paratuberculosis
cgggcggccgcgga

SEQ ID NO: 2906489 - RNA, 14 nt, Mycobacterium avium subsp. paratuberculosis
cgggcggccggagc

SEQ ID NO: 2906490 - RNA, 14 nt, Mycobacterium avium subsp. paratuberculosis
cgggcggccgggcc

SEQ ID NO: 2906491 - RNA, 15 nt, Mycobacterium avium subsp. paratuberculosis
cgggcggccgggccg

SEQ ID NO: 2906492 - RNA, 13 nt, Mycobacterium avium subsp. paratuberculosis
cgggcggccgugg

SEQ ID NO: 2906493 - RNA, 14 nt, Mycobacterium avium subsp. paratuberculosis
cgggcggccguggu

SEQ ID NO: 2906494 - RNA, 15 nt, Mycobacterium avium subsp. paratuberculosis
cgggcggccucggcg

SEQ ID NO: 2906495 - RNA, 13 nt, Mycobacterium avium subsp. paratuberculosis
cgggcggccucgu

SEQ ID NO: 2906496 - RNA, 20 nt, Mycobacterium avium subsp. paratuberculosis
cgggcggccugccggccgcc

SEQ ID NO: 2906497 - RNA, 13 nt, Mycobacterium avium subsp. paratuberculosis
cgggcggccugcu

SEQ ID NO: 2906498 - RNA, 15 nt, Mycobacterium avium subsp. paratuberculosis
cgggcggccugcugc

SEQ ID NO: 2906499 - RNA, 16 nt, Mycobacterium avium subsp. paratuberculosis
cgggcggccugcugca

SEQ ID NO: 2906500 - RNA, 21 nt, Mycobacterium avium subsp. paratuberculosis
cgggcggcgaacaccagcacc

SEQ ID NO: 2906501 - RNA, 12 nt, Mycobacterium avium subsp. paratuberculosis
cgggcggcgacg

SEQ ID NO: 2906502 - RNA, 16 nt, Mycobacterium avium subsp. paratuberculosis
cgggcggcgacgucgu

SEQ ID NO: 2906503 - RNA, 15 nt, Mycobacterium avium subsp. paratuberculosis
cgggcggcgaguccg

SEQ ID NO: 2906504 - RNA, 20 nt, Mycobacterium avium subsp. paratuberculosis
cgggcggcgcagucggccgg

SEQ ID NO: 2906505 - RNA, 13 nt, Mycobacterium avium subsp. paratuberculosis
cgggcggcgccga

SEQ ID NO: 2906506 - RNA, 15 nt, Mycobacterium avium subsp. paratuberculosis
cgggcggcgccgaac

SEQ ID NO: 2906507 - RNA, 11 nt, Mycobacterium avium subsp. paratuberculosis
cgggcggcgcg

SEQ ID NO: 2906508 - RNA, 13 nt, Mycobacterium avium subsp. paratuberculosis
cgggcggcgcggc

SEQ ID NO: 2906509 - RNA, 15 nt, Mycobacterium avium subsp. paratuberculosis
cgggcggcgcggcgc

SEQ ID NO: 2906510 - RNA, 19 nt, Mycobacterium avium subsp. paratuberculosis
cgggcggcgcggcgcagcg

SEQ ID NO: 2906511 - RNA, 21 nt, Mycobacterium avium subsp. paratuberculosis
cgggcggcggaucagcaccga

SEQ ID NO: 2906512 - RNA, 14 nt, Mycobacterium avium subsp. paratuberculosis
cgggcggcggccuc

SEQ ID NO: 2906513 - RNA, 21 nt, Mycobacterium avium subsp. paratuberculosis
cgggcggcggcguuggccgcc

SEQ ID NO: 2906514 - RNA, 23 nt, Mycobacterium avium subsp. paratuberculosis
cgggcggcggcguuggccgccgc

SEQ ID NO: 2906515 - RNA, 13 nt, Mycobacterium avium subsp. paratuberculosis
cgggcggcggcug

SEQ ID NO: 2906516 - RNA, 13 nt, Mycobacterium avium subsp. paratuberculosis
cgggcggcggggc

SEQ ID NO: 2906517 - RNA, 21 nt, Mycobacterium avium subsp. paratuberculosis
cgggcggcguccucgaccacc

SEQ ID NO: 2906518 - RNA, 16 nt, Mycobacterium avium subsp. paratuberculosis
cgggcggcgucggcga

SEQ ID NO: 2906519 - RNA, 19 nt, Mycobacterium avium subsp. paratuberculosis
cgggcggcgucggcgacgg

SEQ ID NO: 2906520 - RNA, 20 nt, Mycobacterium avium subsp. paratuberculosis
cgggcggcgucggcgacggc

SEQ ID NO: 2906521 - RNA, 21 nt, Mycobacterium avium subsp. paratuberculosis
cgggcggcgucggcgacggcg

SEQ ID NO: 2906522 - RNA, 13 nt, Mycobacterium avium subsp. paratuberculosis
cgggcggcgucgu

SEQ ID NO: 2906523 - RNA, 22 nt, Mycobacterium avium subsp. paratuberculosis
cgggcggcgucguagacgcugc

SEQ ID NO: 2906524 - RNA, 14 nt, Mycobacterium avium subsp. paratuberculosis
cgggcgggccgaac

SEQ ID NO: 2906525 - RNA, 13 nt, Mycobacterium avium subsp. paratuberculosis
cgggcgggccgca

SEQ ID NO: 2906526 - RNA, 17 nt, Mycobacterium avium subsp. paratuberculosis
cgggcgggccgcagcac

SEQ ID NO: 2906527 - RNA, 14 nt, Mycobacterium avium subsp. paratuberculosis
cgggcgggccgcca

SEQ ID NO: 2906528 - RNA, 17 nt, Mycobacterium avium subsp. paratuberculosis
cgggcggggccugcggg

SEQ ID NO: 2906529 - RNA, 15 nt, Mycobacterium avium subsp. paratuberculosis
cgggcggggcgccga

SEQ ID NO: 2906530 - RNA, 23 nt, Mycobacterium avium subsp. paratuberculosis
cgggcggggggcgagccggcccg

SEQ ID NO: 2906531 - RNA, 18 nt, Mycobacterium avium subsp. paratuberculosis
cgggcgggguggccacca

SEQ ID NO: 2906532 - RNA, 20 nt, Mycobacterium avium subsp. paratuberculosis
cgggcgggguggccaccaca

SEQ ID NO: 2906533 - RNA, 21 nt, Mycobacterium avium subsp. paratuberculosis
cgggcgggguggccaccacau

SEQ ID NO: 2906534 - RNA, 16 nt, Mycobacterium avium subsp. paratuberculosis
cgggcgggguggugga

SEQ ID NO: 2906535 - RNA, 21 nt, Mycobacterium avium subsp. paratuberculosis
cgggcggggugguggacguca

SEQ ID NO: 2906536 - RNA, 20 nt, Mycobacterium avium subsp. paratuberculosis
cgggcggggugugcggcacg

SEQ ID NO: 2906537 - RNA, 22 nt, Mycobacterium avium subsp. paratuberculosis
cgggcggggugugcggcacggc

SEQ ID NO: 2906538 - RNA, 20 nt, Mycobacterium avium subsp. paratuberculosis
cgggcggguggaucuugacg

SEQ ID NO: 2906539 - RNA, 19 nt, Mycobacterium avium subsp. paratuberculosis
cgggcgguacgcgccgcgc

SEQ ID NO: 2906540 - RNA, 13 nt, Mycobacterium avium subsp. paratuberculosis
cgggcggucagca

SEQ ID NO: 2906541 - RNA, 18 nt, Mycobacterium avium subsp. paratuberculosis
cgggcggucagcauggcg

SEQ ID NO: 2906542 - RNA, 15 nt, Mycobacterium avium subsp. paratuberculosis
cgggcgguccaccga

SEQ ID NO: 2906543 - RNA, 16 nt, Mycobacterium avium subsp. paratuberculosis
cgggcggucgcgcagc

SEQ ID NO: 2906544 - RNA, 22 nt, Mycobacterium avium subsp. paratuberculosis
cgggcggucgcgcagccgccgg

SEQ ID NO: 2906545 - RNA, 16 nt, Mycobacterium avium subsp. paratuberculosis
cgggcggucgcgucgu

SEQ ID NO: 2906546 - RNA, 18 nt, Mycobacterium avium subsp. paratuberculosis
cgggcggucgcgucgucg

SEQ ID NO: 2906547 - RNA, 23 nt, Mycobacterium avium subsp. paratuberculosis
cgggcggucgcgucgucggcggg

SEQ ID NO: 2906548 - RNA, 14 nt, Mycobacterium avium subsp. paratuberculosis
cgggcggucggacg

SEQ ID NO: 2906549 - RNA, 15 nt, Mycobacterium avium subsp. paratuberculosis
cgggcggucggacgc

SEQ ID NO: 2906550 - RNA, 17 nt, Mycobacterium avium subsp. paratuberculosis
cgggcggugaccacgcc

SEQ ID NO: 2906551 - RNA, 18 nt, Mycobacterium avium subsp. paratuberculosis
cgggcggugaccacgccg

SEQ ID NO: 2906552 - RNA, 21 nt, Mycobacterium avium subsp. paratuberculosis
cgggcggugaccacgccgugc

SEQ ID NO: 2906553 - RNA, 13 nt, Mycobacterium avium subsp. paratuberculosis
cgggcggugaugg

SEQ ID NO: 2906554 - RNA, 20 nt, Mycobacterium avium subsp. paratuberculosis
cgggcggugauggucaccgu

SEQ ID NO: 2906555 - RNA, 17 nt, Mycobacterium avium subsp. paratuberculosis
cgggcgguggcgccggg

SEQ ID NO: 2906556 - RNA, 21 nt, Mycobacterium avium subsp. paratuberculosis
cgggcgguggcgccggggcgg

SEQ ID NO: 2906557 - RNA, 15 nt, Mycobacterium avium subsp. paratuberculosis
cgggcgguuuccacg

SEQ ID NO: 2906558 - RNA, 22 nt, Mycobacterium avium subsp. paratuberculosis
cgggcgguuuccacgaugacgg

SEQ ID NO: 2906559 - RNA, 22 nt, Mycobacterium avium subsp. paratuberculosis
cgggcguagucgauggccucgu

SEQ ID NO: 2906560 - RNA, 17 nt, Mycobacterium avium subsp. paratuberculosis
cgggcgucacgccagcg

SEQ ID NO: 2906561 - RNA, 20 nt, Mycobacterium avium subsp. paratuberculosis
cgggcgucacgccagcguga

SEQ ID NO: 2906562 - RNA, 23 nt, Mycobacterium avium subsp. paratuberculosis
cgggcgucacguccaucauggcg

SEQ ID NO: 2906563 - RNA, 15 nt, Mycobacterium avium subsp. paratuberculosis
cgggcguccucgucg

SEQ ID NO: 2906564 - RNA, 16 nt, Mycobacterium avium subsp. paratuberculosis
cgggcguccucgucgg

SEQ ID NO: 2906565 - RNA, 19 nt, Mycobacterium avium subsp. paratuberculosis
cgggcguccucgucggcga

SEQ ID NO: 2906566 - RNA, 13 nt, Mycobacterium avium subsp. paratuberculosis
cgggcguccugcg

SEQ ID NO: 2906567 - RNA, 18 nt, Mycobacterium avium subsp. paratuberculosis
cgggcguccuugaccagc

SEQ ID NO: 2906568 - RNA, 20 nt, Mycobacterium avium subsp. paratuberculosis
cgggcguccuugaccagcug

SEQ ID NO: 2906569 - RNA, 21 nt, Mycobacterium avium subsp. paratuberculosis
cgggcguccuugaccagcugc

SEQ ID NO: 2906570 - RNA, 13 nt, Mycobacterium avium subsp. paratuberculosis
cgggcgucgcaga

SEQ ID NO: 2906571 - RNA, 21 nt, Mycobacterium avium subsp. paratuberculosis
cgggcgucgcagaucccgccg

SEQ ID NO: 2906572 - RNA, 16 nt, Mycobacterium avium subsp. paratuberculosis
cgggcgucgcgcucau

SEQ ID NO: 2906573 - RNA, 12 nt, Mycobacterium avium subsp. paratuberculosis
cgggcgucggcg

SEQ ID NO: 2906574 - RNA, 13 nt, Mycobacterium avium subsp. paratuberculosis
cgggcgucggcgg

SEQ ID NO: 2906575 - RNA, 14 nt, Mycobacterium avium subsp. paratuberculosis
cgggcgucggcggg

SEQ ID NO: 2906576 - RNA, 19 nt, Mycobacterium avium subsp. paratuberculosis
cgggcgucgggcagcagcu

SEQ ID NO: 2906577 - RNA, 14 nt, Mycobacterium avium subsp. paratuberculosis
cgggcgugcccggc

SEQ ID NO: 2906578 - RNA, 16 nt, Mycobacterium avium subsp. paratuberculosis
cgggcgugcccggcgc

SEQ ID NO: 2906579 - RNA, 18 nt, Mycobacterium avium subsp. paratuberculosis
cgggcgugccgaacggcg

SEQ ID NO: 2906580 - RNA, 14 nt, Mycobacterium avium subsp. paratuberculosis
cgggcgugccggac

SEQ ID NO: 2906581 - RNA, 16 nt, Mycobacterium avium subsp. paratuberculosis
cgggcgugccggacac

SEQ ID NO: 2906582 - RNA, 20 nt, Mycobacterium avium subsp. paratuberculosis
cgggcgugccggacaccggc

SEQ ID NO: 2906583 - RNA, 22 nt, Mycobacterium avium subsp. paratuberculosis
cgggcgugccggacaccggcac

SEQ ID NO: 2906584 - RNA, 16 nt, Mycobacterium avium subsp. paratuberculosis
cgggcgugccggcggc

SEQ ID NO: 2906585 - RNA, 18 nt, Mycobacterium avium subsp. paratuberculosis
cgggcgugccggcggcgg

SEQ ID NO: 2906586 - RNA, 23 nt, Mycobacterium avium subsp. paratuberculosis
cgggcgugcgaaugacgcgcauc

SEQ ID NO: 2906587 - RNA, 12 nt, Mycobacterium avium subsp. paratuberculosis
cgggcgugcggu

SEQ ID NO: 2906588 - RNA, 23 nt, Mycobacterium avium subsp. paratuberculosis
cgggcgugcgguuggcccgcggc

SEQ ID NO: 2906589 - RNA, 16 nt, Mycobacterium avium subsp. paratuberculosis
cgggcguggcggucgg

SEQ ID NO: 2906590 - RNA, 15 nt, Mycobacterium avium subsp. paratuberculosis
cgggcguggcgucgg

SEQ ID NO: 2906591 - RNA, 14 nt, Mycobacterium avium subsp. paratuberculosis
cgggcguggcuuga

SEQ ID NO: 2906592 - RNA, 18 nt, Mycobacterium avium subsp. paratuberculosis
cgggcguguaguccaggu

SEQ ID NO: 2906593 - RNA, 21 nt, Mycobacterium avium subsp. paratuberculosis
cgggcguguaguccaggucga

SEQ ID NO: 2906594 - RNA, 14 nt, Mycobacterium avium subsp. paratuberculosis
cgggcguucaucac

SEQ ID NO: 2906595 - RNA, 17 nt, Mycobacterium avium subsp. paratuberculosis
cgggcguucaucaccug

SEQ ID NO: 2906596 - RNA, 22 nt, Mycobacterium avium subsp. paratuberculosis
cgggcguucaucaccuggucgg

SEQ ID NO: 2906597 - RNA, 16 nt, Mycobacterium avium subsp. paratuberculosis
cgggcguugcccgccg

SEQ ID NO: 2906598 - RNA, 18 nt, Mycobacterium avium subsp. paratuberculosis
cgggcguugcccgccgcg

SEQ ID NO: 2906599 - RNA, 16 nt, Mycobacterium avium subsp. paratuberculosis
cgggcguugcgccgcg

SEQ ID NO: 2906600 - RNA, 17 nt, Mycobacterium avium subsp. paratuberculosis
cgggcguugcgccgcga

SEQ ID NO: 2906601 - RNA, 19 nt, Mycobacterium avium subsp. paratuberculosis
cgggcguugcgccgcgagc

SEQ ID NO: 2906602 - RNA, 22 nt, Mycobacterium avium subsp. paratuberculosis
cgggcuaagucguugcccgcca

SEQ ID NO: 2906603 - RNA, 23 nt, Mycobacterium avium subsp. paratuberculosis
cgggcuaaugcaucgaugccggc

SEQ ID NO: 2906604 - RNA, 16 nt, Mycobacterium avium subsp. paratuberculosis
cgggcuagacgcgcac

SEQ ID NO: 2906605 - RNA, 17 nt, Mycobacterium avium subsp. paratuberculosis
cgggcuagacgcgcacc

SEQ ID NO: 2906606 - RNA, 19 nt, Mycobacterium avium subsp. paratuberculosis
cgggcuagacgcgcaccag

SEQ ID NO: 2906607 - RNA, 20 nt, Mycobacterium avium subsp. paratuberculosis
cgggcuagacgcgcaccagg

SEQ ID NO: 2906608 - RNA, 16 nt, Mycobacterium avium subsp. paratuberculosis
cgggcuaggcucggca

SEQ ID NO: 2906609 - RNA, 16 nt, Mycobacterium avium subsp. paratuberculosis
cgggcuaucgcccggc

SEQ ID NO: 2906610 - RNA, 18 nt, Mycobacterium avium subsp. paratuberculosis
cgggcuaucgcccggcgc

SEQ ID NO: 2906611 - RNA, 13 nt, Mycobacterium avium subsp. paratuberculosis
cgggcucagcacc

SEQ ID NO: 2906612 - RNA, 15 nt, Mycobacterium avium subsp. paratuberculosis
cgggcucagcaccac

SEQ ID NO: 2906613 - RNA, 13 nt, Mycobacterium avium subsp. paratuberculosis
cgggcuccagcgg

SEQ ID NO: 2906614 - RNA, 14 nt, Mycobacterium avium subsp. paratuberculosis
cgggcuccagcggg

SEQ ID NO: 2906615 - RNA, 15 nt, Mycobacterium avium subsp. paratuberculosis
cgggcuccagcgggu

SEQ ID NO: 2906616 - RNA, 17 nt, Mycobacterium avium subsp. paratuberculosis
cgggcuccagcgggucc

SEQ ID NO: 2906617 - RNA, 22 nt, Mycobacterium avium subsp. paratuberculosis
cgggcuccagcggguccagccg

SEQ ID NO: 2906618 - RNA, 15 nt, Mycobacterium avium subsp. paratuberculosis
cgggcucccgcucgc

SEQ ID NO: 2906619 - RNA, 15 nt, Mycobacterium avium subsp. paratuberculosis
cgggcuccgcacgac

SEQ ID NO: 2906620 - RNA, 16 nt, Mycobacterium avium subsp. paratuberculosis
cgggcuccgcacgacc

SEQ ID NO: 2906621 - RNA, 18 nt, Mycobacterium avium subsp. paratuberculosis
cgggcuccgcacgaccug

SEQ ID NO: 2906622 - RNA, 22 nt, Mycobacterium avium subsp. paratuberculosis
cgggcucgaacaacccggccgc

SEQ ID NO: 2906623 - RNA, 14 nt, Mycobacterium avium subsp. paratuberculosis
cgggcucgagcacc

SEQ ID NO: 2906624 - RNA, 16 nt, Mycobacterium avium subsp. paratuberculosis
cgggcucgagcaccga

SEQ ID NO: 2906625 - RNA, 17 nt, Mycobacterium avium subsp. paratuberculosis
cgggcucgagcaccgaa

SEQ ID NO: 2906626 - RNA, 16 nt, Mycobacterium avium subsp. paratuberculosis
cgggcucgagccccag

SEQ ID NO: 2906627 - RNA, 20 nt, Mycobacterium avium subsp. paratuberculosis
cgggcucgagccccaguucg

SEQ ID NO: 2906628 - RNA, 18 nt, Mycobacterium avium subsp. paratuberculosis
cgggcucgagggcggcga

SEQ ID NO: 2906629 - RNA, 19 nt, Mycobacterium avium subsp. paratuberculosis
cgggcucgagggcggcgac

SEQ ID NO: 2906630 - RNA, 22 nt, Mycobacterium avium subsp. paratuberculosis
cgggcucgagggcggcgaccug

SEQ ID NO: 2906631 - RNA, 18 nt, Mycobacterium avium subsp. paratuberculosis
cgggcucgccggcccgac

SEQ ID NO: 2906632 - RNA, 18 nt, Mycobacterium avium subsp. paratuberculosis
cgggcucgccucggggau

SEQ ID NO: 2906633 - RNA, 14 nt, Mycobacterium avium subsp. paratuberculosis
cgggcucgcgcacc

SEQ ID NO: 2906634 - RNA, 16 nt, Mycobacterium avium subsp. paratuberculosis
cgggcucgcgcacccg

SEQ ID NO: 2906635 - RNA, 18 nt, Mycobacterium avium subsp. paratuberculosis
cgggcucgcgcuggcggc

SEQ ID NO: 2906636 - RNA, 20 nt, Mycobacterium avium subsp. paratuberculosis
cgggcucgcgcuggcggcca

SEQ ID NO: 2906637 - RNA, 19 nt, Mycobacterium avium subsp. paratuberculosis
cgggcucgcggccugcggg

SEQ ID NO: 2906638 - RNA, 12 nt, Mycobacterium avium subsp. paratuberculosis
cgggcucgcggu

SEQ ID NO: 2906639 - RNA, 15 nt, Mycobacterium avium subsp. paratuberculosis
cgggcucgcggucgg

SEQ ID NO: 2906640 - RNA, 19 nt, Mycobacterium avium subsp. paratuberculosis
cgggcucgcggucggggaa

SEQ ID NO: 2906641 - RNA, 22 nt, Mycobacterium avium subsp. paratuberculosis
cgggcucggacgacucguucga

SEQ ID NO: 2906642 - RNA, 24 nt, Mycobacterium avium subsp. paratuberculosis
cgggcucggacgacucguucgacg

SEQ ID NO: 2906643 - RNA, 20 nt, Mycobacterium avium subsp. paratuberculosis
cgggcucggaguugcgcagc

SEQ ID NO: 2906644 - RNA, 22 nt, Mycobacterium avium subsp. paratuberculosis
cgggcucggaguugcgcagccg

SEQ ID NO: 2906645 - RNA, 16 nt, Mycobacterium avium subsp. paratuberculosis
cgggcucggccgccga

SEQ ID NO: 2906646 - RNA, 23 nt, Mycobacterium avium subsp. paratuberculosis
cgggcucggccgccgacaccacc

SEQ ID NO: 2906647 - RNA, 14 nt, Mycobacterium avium subsp. paratuberculosis
cgggcucgucguga

SEQ ID NO: 2906648 - RNA, 21 nt, Mycobacterium avium subsp. paratuberculosis
cgggcucgucgugauggcgaa

SEQ ID NO: 2906649 - RNA, 20 nt, Mycobacterium avium subsp. paratuberculosis
cgggcucgucguugcgcagc

SEQ ID NO: 2906650 - RNA, 22 nt, Mycobacterium avium subsp. paratuberculosis
cgggcugaacucgacgucgacg

SEQ ID NO: 2906651 - RNA, 16 nt, Mycobacterium avium subsp. paratuberculosis
cgggcugaccgccagg

SEQ ID NO: 2906652 - RNA, 17 nt, Mycobacterium avium subsp. paratuberculosis
cgggcugaccgccagga

SEQ ID NO: 2906653 - RNA, 16 nt, Mycobacterium avium subsp. paratuberculosis
cgggcugaccgucgac

SEQ ID NO: 2906654 - RNA, 17 nt, Mycobacterium avium subsp. paratuberculosis
cgggcugaccgucgacc

SEQ ID NO: 2906655 - RNA, 18 nt, Mycobacterium avium subsp. paratuberculosis
cgggcugaccgucgacca

SEQ ID NO: 2906656 - RNA, 19 nt, Mycobacterium avium subsp. paratuberculosis
cgggcugaccucgcgcacc

SEQ ID NO: 2906657 - RNA, 20 nt, Mycobacterium avium subsp. paratuberculosis
cgggcugaccucgcgcaccg

SEQ ID NO: 2906658 - RNA, 22 nt, Mycobacterium avium subsp. paratuberculosis
cgggcugaccucgcgcaccggc

SEQ ID NO: 2906659 - RNA, 23 nt, Mycobacterium avium subsp. paratuberculosis
cgggcugaccucgcgcaccggcu

SEQ ID NO: 2906660 - RNA, 14 nt, Mycobacterium avium subsp. paratuberculosis
cgggcugacgucga

SEQ ID NO: 2906661 - RNA, 20 nt, Mycobacterium avium subsp. paratuberculosis
cgggcugagcugugccgcgg

SEQ ID NO: 2906662 - RNA, 21 nt, Mycobacterium avium subsp. paratuberculosis
cgggcugagcugugccgcggu

SEQ ID NO: 2906663 - RNA, 23 nt, Mycobacterium avium subsp. paratuberculosis
cgggcugagcugugccgcggugc

SEQ ID NO: 2906664 - RNA, 22 nt, Mycobacterium avium subsp. paratuberculosis
cgggcugauccgcgacgccaac

SEQ ID NO: 2906665 - RNA, 22 nt, Mycobacterium avium subsp. paratuberculosis
cgggcugcaccagggcgucgag

SEQ ID NO: 2906666 - RNA, 20 nt, Mycobacterium avium subsp. paratuberculosis
cgggcugcacgcugcgcacc

SEQ ID NO: 2906667 - RNA, 13 nt, Mycobacterium avium subsp. paratuberculosis
cgggcugcagcag

SEQ ID NO: 2906668 - RNA, 14 nt, Mycobacterium avium subsp. paratuberculosis
cgggcugcagcgac

SEQ ID NO: 2906669 - RNA, 15 nt, Mycobacterium avium subsp. paratuberculosis
cgggcugcagcgacu

SEQ ID NO: 2906670 - RNA, 14 nt, Mycobacterium avium subsp. paratuberculosis
cgggcugcccacca

SEQ ID NO: 2906671 - RNA, 20 nt, Mycobacterium avium subsp. paratuberculosis
cgggcugcccggcgccgguc

SEQ ID NO: 2906672 - RNA, 22 nt, Mycobacterium avium subsp. paratuberculosis
cgggcugcccggcgccggucgu

SEQ ID NO: 2906673 - RNA, 16 nt, Mycobacterium avium subsp. paratuberculosis
cgggcugcgcagcacc

SEQ ID NO: 2906674 - RNA, 19 nt, Mycobacterium avium subsp. paratuberculosis
cgggcugcgcuugcggcgc

SEQ ID NO: 2906675 - RNA, 20 nt, Mycobacterium avium subsp. paratuberculosis
cgggcugcgcuugcggcgca

SEQ ID NO: 2906676 - RNA, 21 nt, Mycobacterium avium subsp. paratuberculosis
cgggcugcgcuugcggcgcag

SEQ ID NO: 2906677 - RNA, 22 nt, Mycobacterium avium subsp. paratuberculosis
cgggcugcgcuugcggcgcagc

SEQ ID NO: 2906678 - RNA, 16 nt, Mycobacterium avium subsp. paratuberculosis
cgggcugcgggcaucg

SEQ ID NO: 2906679 - RNA, 17 nt, Mycobacterium avium subsp. paratuberculosis
cgggcugcugcacgucg

SEQ ID NO: 2906680 - RNA, 20 nt, Mycobacterium avium subsp. paratuberculosis
cgggcugcugcacgucgccg

SEQ ID NO: 2906681 - RNA, 12 nt, Mycobacterium avium subsp. paratuberculosis
cgggcuggccag

SEQ ID NO: 2906682 - RNA, 14 nt, Mycobacterium avium subsp. paratuberculosis
cgggcuggccgucg

SEQ ID NO: 2906683 - RNA, 17 nt, Mycobacterium avium subsp. paratuberculosis
cgggcuggccgucggcg

SEQ ID NO: 2906684 - RNA, 18 nt, Mycobacterium avium subsp. paratuberculosis
cgggcuggccgucggcga

SEQ ID NO: 2906685 - RNA, 21 nt, Mycobacterium avium subsp. paratuberculosis
cgggcuggccgucggcgaugg

SEQ ID NO: 2906686 - RNA, 15 nt, Mycobacterium avium subsp. paratuberculosis
cgggcuggcgcugga

SEQ ID NO: 2906687 - RNA, 21 nt, Mycobacterium avium subsp. paratuberculosis
cgggcugggcgggguuguaga

SEQ ID NO: 2906688 - RNA, 19 nt, Mycobacterium avium subsp. paratuberculosis
cgggcuggguccgauugcc

SEQ ID NO: 2906689 - RNA, 14 nt, Mycobacterium avium subsp. paratuberculosis
cgggcugucccggc

SEQ ID NO: 2906690 - RNA, 16 nt, Mycobacterium avium subsp. paratuberculosis
cgggcugucccggccg

SEQ ID NO: 2906691 - RNA, 23 nt, Mycobacterium avium subsp. paratuberculosis
cgggcugucccggccgcgacagc

SEQ ID NO: 2906692 - RNA, 12 nt, Mycobacterium avium subsp. paratuberculosis
cgggcuguccgc

SEQ ID NO: 2906693 - RNA, 13 nt, Mycobacterium avium subsp. paratuberculosis
cgggcuguccgcg

SEQ ID NO: 2906694 - RNA, 17 nt, Mycobacterium avium subsp. paratuberculosis
cgggcuguccgcguggc

SEQ ID NO: 2906695 - RNA, 16 nt, Mycobacterium avium subsp. paratuberculosis
cgggcugucgggcagg

SEQ ID NO: 2906696 - RNA, 15 nt, Mycobacterium avium subsp. paratuberculosis
cgggcugugccggcg

SEQ ID NO: 2906697 - RNA, 16 nt, Mycobacterium avium subsp. paratuberculosis
cgggcugugccggcgg

SEQ ID NO: 2906698 - RNA, 17 nt, Mycobacterium avium subsp. paratuberculosis
cgggcugugccggcggg

SEQ ID NO: 2906699 - RNA, 17 nt, Mycobacterium avium subsp. paratuberculosis
cgggcuguugaccacgg

SEQ ID NO: 2906700 - RNA, 20 nt, Mycobacterium avium subsp. paratuberculosis
cgggcuguugaccacggccu

SEQ ID NO: 2906701 - RNA, 22 nt, Mycobacterium avium subsp. paratuberculosis
cgggcuuccccaaccuggacgg

SEQ ID NO: 2906702 - RNA, 13 nt, Mycobacterium avium subsp. paratuberculosis
cgggcuucggcgu

SEQ ID NO: 2906703 - RNA, 20 nt, Mycobacterium avium subsp. paratuberculosis
cgggcuugcgcaacagcgug

SEQ ID NO: 2906704 - RNA, 21 nt, Mycobacterium avium subsp. paratuberculosis
cgggcuugcgcaacagcgugc

SEQ ID NO: 2906705 - RNA, 13 nt, Mycobacterium avium subsp. paratuberculosis
cggggaacaccgg

SEQ ID NO: 2906706 - RNA, 16 nt, Mycobacterium avium subsp. paratuberculosis
cggggaacaccggcga

SEQ ID NO: 2906707 - RNA, 23 nt, Mycobacterium avium subsp. paratuberculosis
cggggaaggugcgggcggggccc

SEQ ID NO: 2906708 - RNA, 19 nt, Mycobacterium avium subsp. paratuberculosis
cggggaaguaguaccccgg

SEQ ID NO: 2906709 - RNA, 16 nt, Mycobacterium avium subsp. paratuberculosis
cggggaauccuggccg

SEQ ID NO: 2906710 - RNA, 17 nt, Mycobacterium avium subsp. paratuberculosis
cggggaauccuggccga

SEQ ID NO: 2906711 - RNA, 17 nt, Mycobacterium avium subsp. paratuberculosis
cggggaauuccggcgcg

SEQ ID NO: 2906712 - RNA, 19 nt, Mycobacterium avium subsp. paratuberculosis
cggggaauuccggcgcgau

SEQ ID NO: 2906713 - RNA, 22 nt, Mycobacterium avium subsp. paratuberculosis
cggggaauuccggcgcgaucgg

SEQ ID NO: 2906714 - RNA, 18 nt, Mycobacterium avium subsp. paratuberculosis
cggggacacccucggggu

SEQ ID NO: 2906715 - RNA, 20 nt, Mycobacterium avium subsp. paratuberculosis
cggggacaccgggcaccgac

SEQ ID NO: 2906716 - RNA, 13 nt, Mycobacterium avium subsp. paratuberculosis
cggggacccgcac

SEQ ID NO: 2906717 - RNA, 16 nt, Mycobacterium avium subsp. paratuberculosis
cggggacccgcaccgg

SEQ ID NO: 2906718 - RNA, 13 nt, Mycobacterium avium subsp. paratuberculosis
cggggaccguccc

SEQ ID NO: 2906719 - RNA, 15 nt, Mycobacterium avium subsp. paratuberculosis
cggggaccguccccg

SEQ ID NO: 2906720 - RNA, 19 nt, Mycobacterium avium subsp. paratuberculosis
cggggaccguccccguccg

SEQ ID NO: 2906721 - RNA, 19 nt, Mycobacterium avium subsp. paratuberculosis
cggggacgacggcggggau

SEQ ID NO: 2906722 - RNA, 16 nt, Mycobacterium avium subsp. paratuberculosis
cggggacggugcagcc

SEQ ID NO: 2906723 - RNA, 18 nt, Mycobacterium avium subsp. paratuberculosis
cggggacggugcagccgg

SEQ ID NO: 2906724 - RNA, 18 nt, Mycobacterium avium subsp. paratuberculosis
cggggacgucgucguccc

SEQ ID NO: 2906725 - RNA, 14 nt, Mycobacterium avium subsp. paratuberculosis
cggggaggcccagc

SEQ ID NO: 2906726 - RNA, 17 nt, Mycobacterium avium subsp. paratuberculosis
cggggaggcccagcccg

SEQ ID NO: 2906727 - RNA, 20 nt, Mycobacterium avium subsp. paratuberculosis
cggggaggcccagcccgccg

SEQ ID NO: 2906728 - RNA, 15 nt, Mycobacterium avium subsp. paratuberculosis
cggggaggucgucgc

SEQ ID NO: 2906729 - RNA, 19 nt, Mycobacterium avium subsp. paratuberculosis
cggggaucaccucgcugac

SEQ ID NO: 2906730 - RNA, 15 nt, Mycobacterium avium subsp. paratuberculosis
cggggaucagcgucg

SEQ ID NO: 2906731 - RNA, 17 nt, Mycobacterium avium subsp. paratuberculosis
cggggaucgcgcagccg

SEQ ID NO: 2906732 - RNA, 20 nt, Mycobacterium avium subsp. paratuberculosis
cggggaucgcgcagccgcgg

SEQ ID NO: 2906733 - RNA, 14 nt, Mycobacterium avium subsp. paratuberculosis
cggggaugcccggg

SEQ ID NO: 2906734 - RNA, 20 nt, Mycobacterium avium subsp. paratuberculosis
cggggaugccgaaccgcugc

SEQ ID NO: 2906735 - RNA, 19 nt, Mycobacterium avium subsp. paratuberculosis
cggggaugguuuccacugc

SEQ ID NO: 2906736 - RNA, 20 nt, Mycobacterium avium subsp. paratuberculosis
cggggaugguuuccacugcc

SEQ ID NO: 2906737 - RNA, 18 nt, Mycobacterium avium subsp. paratuberculosis
cggggauguagccgccgg

SEQ ID NO: 2906738 - RNA, 22 nt, Mycobacterium avium subsp. paratuberculosis
cggggauguagccgccgguggc

SEQ ID NO: 2906739 - RNA, 14 nt, Mycobacterium avium subsp. paratuberculosis
cggggaugucgucg

SEQ ID NO: 2906740 - RNA, 18 nt, Mycobacterium avium subsp. paratuberculosis
cggggaugucgucgggcg

SEQ ID NO: 2906741 - RNA, 15 nt, Mycobacterium avium subsp. paratuberculosis
cggggcaagcagcgg

SEQ ID NO: 2906742 - RNA, 20 nt, Mycobacterium avium subsp. paratuberculosis
cggggcaagcagcggcagcc

SEQ ID NO: 2906743 - RNA, 21 nt, Mycobacterium avium subsp. paratuberculosis
cggggcaagcagcggcagcca

SEQ ID NO: 2906744 - RNA, 23 nt, Mycobacterium avium subsp. paratuberculosis
cggggcaccacguccaccagcac

SEQ ID NO: 2906745 - RNA, 21 nt, Mycobacterium avium subsp. paratuberculosis
cggggcacgcgcgcccggcac

SEQ ID NO: 2906746 - RNA, 20 nt, Mycobacterium avium subsp. paratuberculosis
cggggcacggugggacggcg

SEQ ID NO: 2906747 - RNA, 14 nt, Mycobacterium avium subsp. paratuberculosis
cggggcagacccgc

SEQ ID NO: 2906748 - RNA, 12 nt, Mycobacterium avium subsp. paratuberculosis
cggggcagaccg

SEQ ID NO: 2906749 - RNA, 16 nt, Mycobacterium avium subsp. paratuberculosis
cggggcagcagcaucg

SEQ ID NO: 2906750 - RNA, 12 nt, Mycobacterium avium subsp. paratuberculosis
cggggcagccgu

SEQ ID NO: 2906751 - RNA, 15 nt, Mycobacterium avium subsp. paratuberculosis
cggggcagccgucga

SEQ ID NO: 2906752 - RNA, 19 nt, Mycobacterium avium subsp. paratuberculosis
cggggcagccgucgaugcc

SEQ ID NO: 2906753 - RNA, 12 nt, Mycobacterium avium subsp. paratuberculosis
cggggcaucgca

SEQ ID NO: 2906754 - RNA, 24 nt, Mycobacterium avium subsp. paratuberculosis
cggggcaucgcagcgcgcggcgca

SEQ ID NO: 2906755 - RNA, 17 nt, Mycobacterium avium subsp. paratuberculosis
cggggccaacuccggcg

SEQ ID NO: 2906756 - RNA, 18 nt, Mycobacterium avium subsp. paratuberculosis
cggggccaacuccggcgg

SEQ ID NO: 2906757 - RNA, 22 nt, Mycobacterium avium subsp. paratuberculosis
cggggccaacuccggcggcagc

SEQ ID NO: 2906758 - RNA, 23 nt, Mycobacterium avium subsp. paratuberculosis
cggggccaacuccggcggcagcc

SEQ ID NO: 2906759 - RNA, 15 nt, Mycobacterium avium subsp. paratuberculosis
cggggccaccaggcc

SEQ ID NO: 2906760 - RNA, 16 nt, Mycobacterium avium subsp. paratuberculosis
cggggccaccaggccg

SEQ ID NO: 2906761 - RNA, 21 nt, Mycobacterium avium subsp. paratuberculosis
cggggccaccaggcgccgucg

SEQ ID NO: 2906762 - RNA, 16 nt, Mycobacterium avium subsp. paratuberculosis
cggggccagcacgccc

SEQ ID NO: 2906763 - RNA, 22 nt, Mycobacterium avium subsp. paratuberculosis
cggggccaggaugccgaacgcg

SEQ ID NO: 2906764 - RNA, 18 nt, Mycobacterium avium subsp. paratuberculosis
cggggccagguacuccuc

SEQ ID NO: 2906765 - RNA, 15 nt, Mycobacterium avium subsp. paratuberculosis
cggggcccaccccgg

SEQ ID NO: 2906766 - RNA, 19 nt, Mycobacterium avium subsp. paratuberculosis
cggggcccaccccggacaa

SEQ ID NO: 2906767 - RNA, 19 nt, Mycobacterium avium subsp. paratuberculosis
cggggcccggcccggcgau

SEQ ID NO: 2906768 - RNA, 22 nt, Mycobacterium avium subsp. paratuberculosis
cggggcccggcccggcgaugcc

SEQ ID NO: 2906769 - RNA, 15 nt, Mycobacterium avium subsp. paratuberculosis
cggggcccgggccgg

SEQ ID NO: 2906770 - RNA, 17 nt, Mycobacterium avium subsp. paratuberculosis
cggggcccgggccggag

SEQ ID NO: 2906771 - RNA, 16 nt, Mycobacterium avium subsp. paratuberculosis
cggggcccguccccac

SEQ ID NO: 2906772 - RNA, 18 nt, Mycobacterium avium subsp. paratuberculosis
cggggcccguccccacca

SEQ ID NO: 2906773 - RNA, 19 nt, Mycobacterium avium subsp. paratuberculosis
cggggcccguccccaccac

SEQ ID NO: 2906774 - RNA, 21 nt, Mycobacterium avium subsp. paratuberculosis
cggggcccguccccaccaccg

SEQ ID NO: 2906775 - RNA, 20 nt, Mycobacterium avium subsp. paratuberculosis
cggggcccuccgcggcgccg

SEQ ID NO: 2906776 - RNA, 14 nt, Mycobacterium avium subsp. paratuberculosis
cggggccgacccgc

SEQ ID NO: 2906777 - RNA, 14 nt, Mycobacterium avium subsp. paratuberculosis
cggggccgcggccg

SEQ ID NO: 2906778 - RNA, 15 nt, Mycobacterium avium subsp. paratuberculosis
cggggccgcggccgg

SEQ ID NO: 2906779 - RNA, 18 nt, Mycobacterium avium subsp. paratuberculosis
cggggccgcggccggcac

SEQ ID NO: 2906780 - RNA, 17 nt, Mycobacterium avium subsp. paratuberculosis
cggggccgcggcucgcg

SEQ ID NO: 2906781 - RNA, 19 nt, Mycobacterium avium subsp. paratuberculosis
cggggccggcgaugcccgu

SEQ ID NO: 2906782 - RNA, 12 nt, Mycobacterium avium subsp. paratuberculosis
cggggccggcgc

SEQ ID NO: 2906783 - RNA, 17 nt, Mycobacterium avium subsp. paratuberculosis
cggggccggcgcggugg

SEQ ID NO: 2906784 - RNA, 13 nt, Mycobacterium avium subsp. paratuberculosis
cggggccggcgcu

SEQ ID NO: 2906785 - RNA, 14 nt, Mycobacterium avium subsp. paratuberculosis
cggggccggcgcug

SEQ ID NO: 2906786 - RNA, 13 nt, Mycobacterium avium subsp. paratuberculosis
cggggccggcggg

SEQ ID NO: 2906787 - RNA, 16 nt, Mycobacterium avium subsp. paratuberculosis
cggggccggcgggggc

SEQ ID NO: 2906788 - RNA, 21 nt, Mycobacterium avium subsp. paratuberculosis
cggggccggcgugcugggcca

SEQ ID NO: 2906789 - RNA, 12 nt, Mycobacterium avium subsp. paratuberculosis
cggggccggugc

SEQ ID NO: 2906790 - RNA, 15 nt, Mycobacterium avium subsp. paratuberculosis
cggggccguccggga

SEQ ID NO: 2906791 - RNA, 16 nt, Mycobacterium avium subsp. paratuberculosis
cggggccuccaccagc

SEQ ID NO: 2906792 - RNA, 18 nt, Mycobacterium avium subsp. paratuberculosis
cggggccuccaccagcgg

SEQ ID NO: 2906793 - RNA, 19 nt, Mycobacterium avium subsp. paratuberculosis
cggggccuccaccagcggc

SEQ ID NO: 2906794 - RNA, 20 nt, Mycobacterium avium subsp. paratuberculosis
cggggccuccagccagcgcg

SEQ ID NO: 2906795 - RNA, 22 nt, Mycobacterium avium subsp. paratuberculosis
cggggccucgaugcggccgucg

SEQ ID NO: 2906796 - RNA, 15 nt, Mycobacterium avium subsp. paratuberculosis
cggggccucgucgcc

SEQ ID NO: 2906797 - RNA, 20 nt, Mycobacterium avium subsp. paratuberculosis
cggggccugcgggacgccgu

SEQ ID NO: 2906798 - RNA, 22 nt, Mycobacterium avium subsp. paratuberculosis
cggggccugcgggacgccguug

SEQ ID NO: 2906799 - RNA, 20 nt, Mycobacterium avium subsp. paratuberculosis
cggggccuucuuggcggcgg

SEQ ID NO: 2906800 - RNA, 21 nt, Mycobacterium avium subsp. paratuberculosis
cggggccuucuuggcggcggc

SEQ ID NO: 2906801 - RNA, 22 nt, Mycobacterium avium subsp. paratuberculosis
cggggcgaacccggcgcccggc

SEQ ID NO: 2906802 - RNA, 16 nt, Mycobacterium avium subsp. paratuberculosis
cggggcgaccuggacg

SEQ ID NO: 2906803 - RNA, 15 nt, Mycobacterium avium subsp. paratuberculosis
cggggcgaccuugcg

SEQ ID NO: 2906804 - RNA, 18 nt, Mycobacterium avium subsp. paratuberculosis
cggggcgaccuugcgcag

SEQ ID NO: 2906805 - RNA, 17 nt, Mycobacterium avium subsp. paratuberculosis
cggggcgagcuggccgc

SEQ ID NO: 2906806 - RNA, 18 nt, Mycobacterium avium subsp. paratuberculosis
cggggcgagcuggccgcc

SEQ ID NO: 2906807 - RNA, 19 nt, Mycobacterium avium subsp. paratuberculosis
cggggcgagcuggccgccc

SEQ ID NO: 2906808 - RNA, 17 nt, Mycobacterium avium subsp. paratuberculosis
cggggcgcagaugggga

SEQ ID NO: 2906809 - RNA, 16 nt, Mycobacterium avium subsp. paratuberculosis
cggggcgcagcccggc

SEQ ID NO: 2906810 - RNA, 18 nt, Mycobacterium avium subsp. paratuberculosis
cggggcgcagcccggcgg

SEQ ID NO: 2906811 - RNA, 21 nt, Mycobacterium avium subsp. paratuberculosis
cggggcgccacuucuccacgc

SEQ ID NO: 2906812 - RNA, 11 nt, Mycobacterium avium subsp. paratuberculosis
cggggcgcccc

SEQ ID NO: 2906813 - RNA, 15 nt, Mycobacterium avium subsp. paratuberculosis
cggggcgccgacagu

SEQ ID NO: 2906814 - RNA, 18 nt, Mycobacterium avium subsp. paratuberculosis
cggggcgccgacagucgc

SEQ ID NO: 2906815 - RNA, 20 nt, Mycobacterium avium subsp. paratuberculosis
cggggcgccgacagucgcgg

SEQ ID NO: 2906816 - RNA, 21 nt, Mycobacterium avium subsp. paratuberculosis
cggggcgccgacagucgcggg

SEQ ID NO: 2906817 - RNA, 22 nt, Mycobacterium avium subsp. paratuberculosis
cggggcgccgacagucgcgggc

SEQ ID NO: 2906818 - RNA, 20 nt, Mycobacterium avium subsp. paratuberculosis
cggggcgccgcugcgggcca

SEQ ID NO: 2906819 - RNA, 21 nt, Mycobacterium avium subsp. paratuberculosis
cggggcgccgcugcgggccau

SEQ ID NO: 2906820 - RNA, 24 nt, Mycobacterium avium subsp. paratuberculosis
cggggcgccuaccggguggccagc

SEQ ID NO: 2906821 - RNA, 13 nt, Mycobacterium avium subsp. paratuberculosis
cggggcgcgcagg

SEQ ID NO: 2906822 - RNA, 14 nt, Mycobacterium avium subsp. paratuberculosis
cggggcgcgcaggc

SEQ ID NO: 2906823 - RNA, 12 nt, Mycobacterium avium subsp. paratuberculosis
cggggcgcgcug

SEQ ID NO: 2906824 - RNA, 13 nt, Mycobacterium avium subsp. paratuberculosis
cggggcgcgcugg

SEQ ID NO: 2906825 - RNA, 18 nt, Mycobacterium avium subsp. paratuberculosis
cggggcggauccccgcgc

SEQ ID NO: 2906826 - RNA, 14 nt, Mycobacterium avium subsp. paratuberculosis
cggggcggaugcgc

SEQ ID NO: 2906827 - RNA, 18 nt, Mycobacterium avium subsp. paratuberculosis
cggggcggaugcgcuggu

SEQ ID NO: 2906828 - RNA, 12 nt, Mycobacterium avium subsp. paratuberculosis
cggggcggccgc

SEQ ID NO: 2906829 - RNA, 16 nt, Mycobacterium avium subsp. paratuberculosis
cggggcggcggcgccg

SEQ ID NO: 2906830 - RNA, 18 nt, Mycobacterium avium subsp. paratuberculosis
cggggcggcggcgccggg

SEQ ID NO: 2906831 - RNA, 12 nt, Mycobacterium avium subsp. paratuberculosis
cggggcggcggg

SEQ ID NO: 2906832 - RNA, 13 nt, Mycobacterium avium subsp. paratuberculosis
cggggcggcggga

SEQ ID NO: 2906833 - RNA, 14 nt, Mycobacterium avium subsp. paratuberculosis
cggggcggcgggcg

SEQ ID NO: 2906834 - RNA, 15 nt, Mycobacterium avium subsp. paratuberculosis
cggggcggcgggcga

SEQ ID NO: 2906835 - RNA, 16 nt, Mycobacterium avium subsp. paratuberculosis
cggggcggcgggcgaa

SEQ ID NO: 2906836 - RNA, 16 nt, Mycobacterium avium subsp. paratuberculosis
cggggcgggcacgucg

SEQ ID NO: 2906837 - RNA, 14 nt, Mycobacterium avium subsp. paratuberculosis
cggggcgggcagca

SEQ ID NO: 2906838 - RNA, 15 nt, Mycobacterium avium subsp. paratuberculosis
cggggcgggcagcac

SEQ ID NO: 2906839 - RNA, 22 nt, Mycobacterium avium subsp. paratuberculosis
cggggcgggcagcaccagcggc

SEQ ID NO: 2906840 - RNA, 23 nt, Mycobacterium avium subsp. paratuberculosis
cggggcgggcagcaccagcggca

SEQ ID NO: 2906841 - RNA, 14 nt, Mycobacterium avium subsp. paratuberculosis
cggggcgggcggcg

SEQ ID NO: 2906842 - RNA, 16 nt, Mycobacterium avium subsp. paratuberculosis
cggggcguacgcgcug

SEQ ID NO: 2906843 - RNA, 21 nt, Mycobacterium avium subsp. paratuberculosis
cggggcguacgcgcugccgac

SEQ ID NO: 2906844 - RNA, 14 nt, Mycobacterium avium subsp. paratuberculosis
cggggcguccagcg

SEQ ID NO: 2906845 - RNA, 11 nt, Mycobacterium avium subsp. paratuberculosis
cggggcgucga

SEQ ID NO: 2906846 - RNA, 18 nt, Mycobacterium avium subsp. paratuberculosis
cggggcgucgaugcguga

SEQ ID NO: 2906847 - RNA, 17 nt, Mycobacterium avium subsp. paratuberculosis
cggggcgucgcccgccg

SEQ ID NO: 2906848 - RNA, 19 nt, Mycobacterium avium subsp. paratuberculosis
cggggcgucgcccgccgac

SEQ ID NO: 2906849 - RNA, 22 nt, Mycobacterium avium subsp. paratuberculosis
cggggcgucggacgccaguggc

SEQ ID NO: 2906850 - RNA, 17 nt, Mycobacterium avium subsp. paratuberculosis
cggggcgucggcggccu

SEQ ID NO: 2906851 - RNA, 18 nt, Mycobacterium avium subsp. paratuberculosis
cggggcgucucgaaccgu

SEQ ID NO: 2906852 - RNA, 16 nt, Mycobacterium avium subsp. paratuberculosis
cggggcgugcccggcg

SEQ ID NO: 2906853 - RNA, 17 nt, Mycobacterium avium subsp. paratuberculosis
cggggcgugcccggcgc

SEQ ID NO: 2906854 - RNA, 23 nt, Mycobacterium avium subsp. paratuberculosis
cggggcgugcccggcgccgacca

SEQ ID NO: 2906855 - RNA, 17 nt, Mycobacterium avium subsp. paratuberculosis
cggggcguugcccgucg

SEQ ID NO: 2906856 - RNA, 20 nt, Mycobacterium avium subsp. paratuberculosis
cggggcguugguugcggccc

SEQ ID NO: 2906857 - RNA, 12 nt, Mycobacterium avium subsp. paratuberculosis
cggggcucacca

SEQ ID NO: 2906858 - RNA, 18 nt, Mycobacterium avium subsp. paratuberculosis
cggggcucauacggcggc

SEQ ID NO: 2906859 - RNA, 19 nt, Mycobacterium avium subsp. paratuberculosis
cggggcucauacggcggcu

SEQ ID NO: 2906860 - RNA, 20 nt, Mycobacterium avium subsp. paratuberculosis
cggggcucauacggcggcuc

SEQ ID NO: 2906861 - RNA, 18 nt, Mycobacterium avium subsp. paratuberculosis
cggggcucgacaggcagc

SEQ ID NO: 2906862 - RNA, 20 nt, Mycobacterium avium subsp. paratuberculosis
cggggcucgacaggcagccc

SEQ ID NO: 2906863 - RNA, 13 nt, Mycobacterium avium subsp. paratuberculosis
cggggcucgcggu

SEQ ID NO: 2906864 - RNA, 15 nt, Mycobacterium avium subsp. paratuberculosis
cggggcucgcggugu

SEQ ID NO: 2906865 - RNA, 18 nt, Mycobacterium avium subsp. paratuberculosis
cggggcugaguucgguga

SEQ ID NO: 2906866 - RNA, 15 nt, Mycobacterium avium subsp. paratuberculosis
cggggcugcccaggu

SEQ ID NO: 2906867 - RNA, 13 nt, Mycobacterium avium subsp. paratuberculosis
cggggcugcgcgg

SEQ ID NO: 2906868 - RNA, 15 nt, Mycobacterium avium subsp. paratuberculosis
cggggcugcgcggcu

SEQ ID NO: 2906869 - RNA, 19 nt, Mycobacterium avium subsp. paratuberculosis
cggggcugcgggccaggcg

SEQ ID NO: 2906870 - RNA, 15 nt, Mycobacterium avium subsp. paratuberculosis
cggggcuggcggcga

SEQ ID NO: 2906871 - RNA, 18 nt, Mycobacterium avium subsp. paratuberculosis
cggggcugggcgccaugg

SEQ ID NO: 2906872 - RNA, 19 nt, Mycobacterium avium subsp. paratuberculosis
cggggcuucgaacgcccgc

SEQ ID NO: 2906873 - RNA, 22 nt, Mycobacterium avium subsp. paratuberculosis
cggggcuucgaacgcccgcacc

SEQ ID NO: 2906874 - RNA, 18 nt, Mycobacterium avium subsp. paratuberculosis
cgggggaagcccagcacc

SEQ ID NO: 2906875 - RNA, 15 nt, Mycobacterium avium subsp. paratuberculosis
cgggggaccagcgca

SEQ ID NO: 2906876 - RNA, 12 nt, Mycobacterium avium subsp. paratuberculosis
cgggggaggcgu

SEQ ID NO: 2906877 - RNA, 15 nt, Mycobacterium avium subsp. paratuberculosis
cgggggauccgccug

SEQ ID NO: 2906878 - RNA, 23 nt, Mycobacterium avium subsp. paratuberculosis
cgggggaucggcgggacccgcga

SEQ ID NO: 2906879 - RNA, 13 nt, Mycobacterium avium subsp. paratuberculosis
cgggggccgccgc

SEQ ID NO: 2906880 - RNA, 16 nt, Mycobacterium avium subsp. paratuberculosis
cgggggccgccgcgau

SEQ ID NO: 2906881 - RNA, 18 nt, Mycobacterium avium subsp. paratuberculosis
cgggggcgagaccgucgg

SEQ ID NO: 2906882 - RNA, 21 nt, Mycobacterium avium subsp. paratuberculosis
cgggggcgagaccgucggugc

SEQ ID NO: 2906883 - RNA, 14 nt, Mycobacterium avium subsp. paratuberculosis
cgggggcgcgggcg

SEQ ID NO: 2906884 - RNA, 17 nt, Mycobacterium avium subsp. paratuberculosis
cgggggcgcgggcggca

SEQ ID NO: 2906885 - RNA, 20 nt, Mycobacterium avium subsp. paratuberculosis
cgggggcgcguccgcgggcg

SEQ ID NO: 2906886 - RNA, 15 nt, Mycobacterium avium subsp. paratuberculosis
cgggggcggccgggc

SEQ ID NO: 2906887 - RNA, 21 nt, Mycobacterium avium subsp. paratuberculosis
cgggggcggccgggccgcggc

SEQ ID NO: 2906888 - RNA, 12 nt, Mycobacterium avium subsp. paratuberculosis
cgggggcggccu

SEQ ID NO: 2906889 - RNA, 19 nt, Mycobacterium avium subsp. paratuberculosis
cgggggcggcggcgcgugc

SEQ ID NO: 2906890 - RNA, 18 nt, Mycobacterium avium subsp. paratuberculosis
cgggggcggugcagccgg

SEQ ID NO: 2906891 - RNA, 20 nt, Mycobacterium avium subsp. paratuberculosis
cgggggcuguccaccugcac

SEQ ID NO: 2906892 - RNA, 17 nt, Mycobacterium avium subsp. paratuberculosis
cggggggagaggcgcgg

SEQ ID NO: 2906893 - RNA, 23 nt, Mycobacterium avium subsp. paratuberculosis
cggggggcacguccccgugcagc

SEQ ID NO: 2906894 - RNA, 15 nt, Mycobacterium avium subsp. paratuberculosis
cggggggcgagccgg

SEQ ID NO: 2906895 - RNA, 17 nt, Mycobacterium avium subsp. paratuberculosis
cggggggcgagccggcc

SEQ ID NO: 2906896 - RNA, 20 nt, Mycobacterium avium subsp. paratuberculosis
cggggggcgagccggcccgg

SEQ ID NO: 2906897 - RNA, 18 nt, Mycobacterium avium subsp. paratuberculosis
cggggguaaaccgccagc

SEQ ID NO: 2906898 - RNA, 18 nt, Mycobacterium avium subsp. paratuberculosis
cgggggugaaggcggcca

SEQ ID NO: 2906899 - RNA, 15 nt, Mycobacterium avium subsp. paratuberculosis
cgggggugccgaccg

SEQ ID NO: 2906900 - RNA, 16 nt, Mycobacterium avium subsp. paratuberculosis
cgggggugccgaccgc

SEQ ID NO: 2906901 - RNA, 12 nt, Mycobacterium avium subsp. paratuberculosis
cgggggugccgc

SEQ ID NO: 2906902 - RNA, 17 nt, Mycobacterium avium subsp. paratuberculosis
cgggggugccgcuccgg

SEQ ID NO: 2906903 - RNA, 14 nt, Mycobacterium avium subsp. paratuberculosis
cggggguggccagc

SEQ ID NO: 2906904 - RNA, 13 nt, Mycobacterium avium subsp. paratuberculosis
cggggguggcggu

SEQ ID NO: 2906905 - RNA, 22 nt, Mycobacterium avium subsp. paratuberculosis
cggggguggcggucccggcgga

SEQ ID NO: 2906906 - RNA, 15 nt, Mycobacterium avium subsp. paratuberculosis
cgggggugggcuccc

SEQ ID NO: 2906907 - RNA, 20 nt, Mycobacterium avium subsp. paratuberculosis
cggggguucguugcgccgcc

SEQ ID NO: 2906908 - RNA, 21 nt, Mycobacterium avium subsp. paratuberculosis
cggggguucguugcgccgcca

SEQ ID NO: 2906909 - RNA, 22 nt, Mycobacterium avium subsp. paratuberculosis
cggggguuucgugugcucagcu

SEQ ID NO: 2906910 - RNA, 15 nt, Mycobacterium avium subsp. paratuberculosis
cgggguagaggccgc

SEQ ID NO: 2906911 - RNA, 17 nt, Mycobacterium avium subsp. paratuberculosis
cgggguagaggccgcgg

SEQ ID NO: 2906912 - RNA, 21 nt, Mycobacterium avium subsp. paratuberculosis
cgggguagaggccgcggaucg

SEQ ID NO: 2906913 - RNA, 22 nt, Mycobacterium avium subsp. paratuberculosis
cgggguagccggcccgcagcca

SEQ ID NO: 2906914 - RNA, 16 nt, Mycobacterium avium subsp. paratuberculosis
cgggguagggcggcgg

SEQ ID NO: 2906915 - RNA, 24 nt, Mycobacterium avium subsp. paratuberculosis
cgggguaguccgacuucgcgugcc

SEQ ID NO: 2906916 - RNA, 18 nt, Mycobacterium avium subsp. paratuberculosis
cgggguaguucagcgcgc

SEQ ID NO: 2906917 - RNA, 19 nt, Mycobacterium avium subsp. paratuberculosis
cgggguaguucagcgcgcg

SEQ ID NO: 2906918 - RNA, 20 nt, Mycobacterium avium subsp. paratuberculosis
cgggguaguucagcgcgcgg

SEQ ID NO: 2906919 - RNA, 24 nt, Mycobacterium avium subsp. paratuberculosis
cgggguaguucagcgcgcgggagc

SEQ ID NO: 2906920 - RNA, 21 nt, Mycobacterium avium subsp. paratuberculosis
cgggguaguucuugacgccga

SEQ ID NO: 2906921 - RNA, 22 nt, Mycobacterium avium subsp. paratuberculosis
cgggguaguucuugacgccgau

SEQ ID NO: 2906922 - RNA, 17 nt, Mycobacterium avium subsp. paratuberculosis
cggggucaagcggcaga

SEQ ID NO: 2906923 - RNA, 20 nt, Mycobacterium avium subsp. paratuberculosis
cggggucaagcggcagaccg

SEQ ID NO: 2906924 - RNA, 14 nt, Mycobacterium avium subsp. paratuberculosis
cggggucagggcgc

SEQ ID NO: 2906925 - RNA, 17 nt, Mycobacterium avium subsp. paratuberculosis
cggggucagggcgcuca

SEQ ID NO: 2906926 - RNA, 13 nt, Mycobacterium avium subsp. paratuberculosis
cgggguccaccgg

SEQ ID NO: 2906927 - RNA, 14 nt, Mycobacterium avium subsp. paratuberculosis
cgggguccaccggc

SEQ ID NO: 2906928 - RNA, 17 nt, Mycobacterium avium subsp. paratuberculosis
cgggguccaccggccga

SEQ ID NO: 2906929 - RNA, 15 nt, Mycobacterium avium subsp. paratuberculosis
cgggguccacgcagu

SEQ ID NO: 2906930 - RNA, 13 nt, Mycobacterium avium subsp. paratuberculosis
cgggguccaggcc

SEQ ID NO: 2906931 - RNA, 19 nt, Mycobacterium avium subsp. paratuberculosis
cgggguccaggccgcgccg

SEQ ID NO: 2906932 - RNA, 22 nt, Mycobacterium avium subsp. paratuberculosis
cggggucccaauccucgccgag

SEQ ID NO: 2906933 - RNA, 17 nt, Mycobacterium avium subsp. paratuberculosis
cgggguccgcaacgccg

SEQ ID NO: 2906934 - RNA, 19 nt, Mycobacterium avium subsp. paratuberculosis
cgggguccgcaacgccggc

SEQ ID NO: 2906935 - RNA, 23 nt, Mycobacterium avium subsp. paratuberculosis
cgggguccgcaacgccggcgugc

SEQ ID NO: 2906936 - RNA, 15 nt, Mycobacterium avium subsp. paratuberculosis
cgggguccucucggc

SEQ ID NO: 2906937 - RNA, 17 nt, Mycobacterium avium subsp. paratuberculosis
cgggguccucucggcgc

SEQ ID NO: 2906938 - RNA, 21 nt, Mycobacterium avium subsp. paratuberculosis
cggggucgaacaucacccggc

SEQ ID NO: 2906939 - RNA, 12 nt, Mycobacterium avium subsp. paratuberculosis
cggggucgaagu

SEQ ID NO: 2906940 - RNA, 16 nt, Mycobacterium avium subsp. paratuberculosis
cggggucgagaagccc

SEQ ID NO: 2906941 - RNA, 24 nt, Mycobacterium avium subsp. paratuberculosis
cggggucgagaagcccgugcgacg

SEQ ID NO: 2906942 - RNA, 15 nt, Mycobacterium avium subsp. paratuberculosis
cggggucgccgucgu

SEQ ID NO: 2906943 - RNA, 20 nt, Mycobacterium avium subsp. paratuberculosis
cggggucgccgucgugcucg

SEQ ID NO: 2906944 - RNA, 13 nt, Mycobacterium avium subsp. paratuberculosis
cggggucgcgccg

SEQ ID NO: 2906945 - RNA, 12 nt, Mycobacterium avium subsp. paratuberculosis
cggggucgcggc

SEQ ID NO: 2906946 - RNA, 13 nt, Mycobacterium avium subsp. paratuberculosis
cggggucgcggcc

SEQ ID NO: 2906947 - RNA, 14 nt, Mycobacterium avium subsp. paratuberculosis
cggggucgcggccc

SEQ ID NO: 2906948 - RNA, 14 nt, Mycobacterium avium subsp. paratuberculosis
cggggucggccgag

SEQ ID NO: 2906949 - RNA, 21 nt, Mycobacterium avium subsp. paratuberculosis
cggggucggccgagguccgcg

SEQ ID NO: 2906950 - RNA, 13 nt, Mycobacterium avium subsp. paratuberculosis
cggggucggccgg

SEQ ID NO: 2906951 - RNA, 17 nt, Mycobacterium avium subsp. paratuberculosis
cggggucggccggaucg

SEQ ID NO: 2906952 - RNA, 22 nt, Mycobacterium avium subsp. paratuberculosis
cggggucggcgcccucggcgau

SEQ ID NO: 2906953 - RNA, 14 nt, Mycobacterium avium subsp. paratuberculosis
cggggucggcgccg

SEQ ID NO: 2906954 - RNA, 15 nt, Mycobacterium avium subsp. paratuberculosis
cggggucggcgccgc

SEQ ID NO: 2906955 - RNA, 17 nt, Mycobacterium avium subsp. paratuberculosis
cggggucggcgccgcgc

SEQ ID NO: 2906956 - RNA, 15 nt, Mycobacterium avium subsp. paratuberculosis
cggggucggcgucgg

SEQ ID NO: 2906957 - RNA, 13 nt, Mycobacterium avium subsp. paratuberculosis
cggggucgggccg

SEQ ID NO: 2906958 - RNA, 14 nt, Mycobacterium avium subsp. paratuberculosis
cggggucgggccgg

SEQ ID NO: 2906959 - RNA, 22 nt, Mycobacterium avium subsp. paratuberculosis
cggggucgggccggacagcggc

SEQ ID NO: 2906960 - RNA, 14 nt, Mycobacterium avium subsp. paratuberculosis
cggggucgucgacg

SEQ ID NO: 2906961 - RNA, 16 nt, Mycobacterium avium subsp. paratuberculosis
cggggucgucgacggc

SEQ ID NO: 2906962 - RNA, 17 nt, Mycobacterium avium subsp. paratuberculosis
cggggucgucgacggcc

SEQ ID NO: 2906963 - RNA, 19 nt, Mycobacterium avium subsp. paratuberculosis
cggggucgucgacggccgc

SEQ ID NO: 2906964 - RNA, 22 nt, Mycobacterium avium subsp. paratuberculosis
cggggucgucgacggccgcgcc

SEQ ID NO: 2906965 - RNA, 14 nt, Mycobacterium avium subsp. paratuberculosis
cggggucgucgcgg

SEQ ID NO: 2906966 - RNA, 18 nt, Mycobacterium avium subsp. paratuberculosis
cggggucgucgcggucca

SEQ ID NO: 2906967 - RNA, 23 nt, Mycobacterium avium subsp. paratuberculosis
cggggucgucgcgguccacgccg

SEQ ID NO: 2906968 - RNA, 19 nt, Mycobacterium avium subsp. paratuberculosis
cggggucguugcacaccac

SEQ ID NO: 2906969 - RNA, 22 nt, Mycobacterium avium subsp. paratuberculosis
cggggucguugcacaccaccag

SEQ ID NO: 2906970 - RNA, 23 nt, Mycobacterium avium subsp. paratuberculosis
cggggucguugcacaccaccagc

SEQ ID NO: 2906971 - RNA, 18 nt, Mycobacterium avium subsp. paratuberculosis
cggggucugacccaugcc

SEQ ID NO: 2906972 - RNA, 14 nt, Mycobacterium avium subsp. paratuberculosis
cggggucugcacga

SEQ ID NO: 2906973 - RNA, 18 nt, Mycobacterium avium subsp. paratuberculosis
cggggucugcacgaugcc

SEQ ID NO: 2906974 - RNA, 23 nt, Mycobacterium avium subsp. paratuberculosis
cggggucugcacgaugccgacca

SEQ ID NO: 2906975 - RNA, 12 nt, Mycobacterium avium subsp. paratuberculosis
cggggugaccgu

SEQ ID NO: 2906976 - RNA, 18 nt, Mycobacterium avium subsp. paratuberculosis
cggggugacgcccguccc

SEQ ID NO: 2906977 - RNA, 18 nt, Mycobacterium avium subsp. paratuberculosis
cggggugacuucgagccg

SEQ ID NO: 2906978 - RNA, 13 nt, Mycobacterium avium subsp. paratuberculosis
cggggugagcacc

SEQ ID NO: 2906979 - RNA, 19 nt, Mycobacterium avium subsp. paratuberculosis
cggggugagcaccgcgacc

SEQ ID NO: 2906980 - RNA, 17 nt, Mycobacterium avium subsp. paratuberculosis
cggggugagcagggcca

SEQ ID NO: 2906981 - RNA, 20 nt, Mycobacterium avium subsp. paratuberculosis
cggggugagcagggccagcg

SEQ ID NO: 2906982 - RNA, 21 nt, Mycobacterium avium subsp. paratuberculosis
cggggugagcagggccagcgg

SEQ ID NO: 2906983 - RNA, 22 nt, Mycobacterium avium subsp. paratuberculosis
cggggugagcagggccagcggc

SEQ ID NO: 2906984 - RNA, 19 nt, Mycobacterium avium subsp. paratuberculosis
cggggugaugccggcggua

SEQ ID NO: 2906985 - RNA, 21 nt, Mycobacterium avium subsp. paratuberculosis
cggggugaugccggcgguacc

SEQ ID NO: 2906986 - RNA, 14 nt, Mycobacterium avium subsp. paratuberculosis
cggggugcaccgug

SEQ ID NO: 2906987 - RNA, 15 nt, Mycobacterium avium subsp. paratuberculosis
cggggugcaccgugg

SEQ ID NO: 2906988 - RNA, 13 nt, Mycobacterium avium subsp. paratuberculosis
cggggugcagcac

SEQ ID NO: 2906989 - RNA, 18 nt, Mycobacterium avium subsp. paratuberculosis
cggggugcagcaccacga

SEQ ID NO: 2906990 - RNA, 16 nt, Mycobacterium avium subsp. paratuberculosis
cggggugcccaccacc

SEQ ID NO: 2906991 - RNA, 16 nt, Mycobacterium avium subsp. paratuberculosis
cggggugcccggcgag

SEQ ID NO: 2906992 - RNA, 17 nt, Mycobacterium avium subsp. paratuberculosis
cggggugcccggcgagg

SEQ ID NO: 2906993 - RNA, 16 nt, Mycobacterium avium subsp. paratuberculosis
cggggugcccgggccg

SEQ ID NO: 2906994 - RNA, 17 nt, Mycobacterium avium subsp. paratuberculosis
cggggugcccgggccgc

SEQ ID NO: 2906995 - RNA, 19 nt, Mycobacterium avium subsp. paratuberculosis
cggggugcccgggccgcag

SEQ ID NO: 2906996 - RNA, 13 nt, Mycobacterium avium subsp. paratuberculosis
cggggugccgccc

SEQ ID NO: 2906997 - RNA, 14 nt, Mycobacterium avium subsp. paratuberculosis
cggggugccgccca

SEQ ID NO: 2906998 - RNA, 14 nt, Mycobacterium avium subsp. paratuberculosis
cggggugccgccgg

SEQ ID NO: 2906999 - RNA, 14 nt, Mycobacterium avium subsp. paratuberculosis
cggggugcgccagg

SEQ ID NO: 2907000 - RNA, 22 nt, Mycobacterium avium subsp. paratuberculosis
cggggugcgccaggcaggcggc

SEQ ID NO: 2907001 - RNA, 19 nt, Mycobacterium avium subsp. paratuberculosis
cggggugcgcggcgagcgc

SEQ ID NO: 2907002 - RNA, 16 nt, Mycobacterium avium subsp. paratuberculosis
cggggugcggucggcg

SEQ ID NO: 2907003 - RNA, 17 nt, Mycobacterium avium subsp. paratuberculosis
cggggugcggucggcga

SEQ ID NO: 2907004 - RNA, 19 nt, Mycobacterium avium subsp. paratuberculosis
cggggugcggucggcgacg

SEQ ID NO: 2907005 - RNA, 21 nt, Mycobacterium avium subsp. paratuberculosis
cggggugcgugacgggcugau

SEQ ID NO: 2907006 - RNA, 17 nt, Mycobacterium avium subsp. paratuberculosis
cggggugcucgaucggc

SEQ ID NO: 2907007 - RNA, 22 nt, Mycobacterium avium subsp. paratuberculosis
cggggugcucgaucggcgcgcc

SEQ ID NO: 2907008 - RNA, 23 nt, Mycobacterium avium subsp. paratuberculosis
cggggugcucgaucggcgcgccg

SEQ ID NO: 2907009 - RNA, 22 nt, Mycobacterium avium subsp. paratuberculosis
cggggugcuggcguagagccgc

SEQ ID NO: 2907010 - RNA, 20 nt, Mycobacterium avium subsp. paratuberculosis
cgggguggacgcgaccaggc

SEQ ID NO: 2907011 - RNA, 14 nt, Mycobacterium avium subsp. paratuberculosis
cgggguggaucgcc

SEQ ID NO: 2907012 - RNA, 16 nt, Mycobacterium avium subsp. paratuberculosis
cgggguggaucgccca

SEQ ID NO: 2907013 - RNA, 15 nt, Mycobacterium avium subsp. paratuberculosis
cgggguggccggcca

SEQ ID NO: 2907014 - RNA, 16 nt, Mycobacterium avium subsp. paratuberculosis
cgggguggccggccag

SEQ ID NO: 2907015 - RNA, 17 nt, Mycobacterium avium subsp. paratuberculosis
cgggguggccggccagc

SEQ ID NO: 2907016 - RNA, 18 nt, Mycobacterium avium subsp. paratuberculosis
cgggguggccggccagca

SEQ ID NO: 2907017 - RNA, 23 nt, Mycobacterium avium subsp. paratuberculosis
cgggguggccuuguggucgaucc

SEQ ID NO: 2907018 - RNA, 20 nt, Mycobacterium avium subsp. paratuberculosis
cgggguggcgccggccagca

SEQ ID NO: 2907019 - RNA, 23 nt, Mycobacterium avium subsp. paratuberculosis
cggggugggcaccuggccgucgg

SEQ ID NO: 2907020 - RNA, 16 nt, Mycobacterium avium subsp. paratuberculosis
cggggugggcacgucg

SEQ ID NO: 2907021 - RNA, 14 nt, Mycobacterium avium subsp. paratuberculosis
cggggugggccauc

SEQ ID NO: 2907022 - RNA, 17 nt, Mycobacterium avium subsp. paratuberculosis
cggggugggccaucggc

SEQ ID NO: 2907023 - RNA, 15 nt, Mycobacterium avium subsp. paratuberculosis
cggggugggcugcau

SEQ ID NO: 2907024 - RNA, 17 nt, Mycobacterium avium subsp. paratuberculosis
cggggugggcugcaucu

SEQ ID NO: 2907025 - RNA, 17 nt, Mycobacterium avium subsp. paratuberculosis
cgggguggggacgacgc

SEQ ID NO: 2907026 - RNA, 17 nt, Mycobacterium avium subsp. paratuberculosis
cgggguggucaccggca

SEQ ID NO: 2907027 - RNA, 15 nt, Mycobacterium avium subsp. paratuberculosis
cggggugguggaagg

SEQ ID NO: 2907028 - RNA, 19 nt, Mycobacterium avium subsp. paratuberculosis
cggggugguggacgucagg

SEQ ID NO: 2907029 - RNA, 18 nt, Mycobacterium avium subsp. paratuberculosis
cgggguggugugcaaggc

SEQ ID NO: 2907030 - RNA, 21 nt, Mycobacterium avium subsp. paratuberculosis
cggggugguugaucacgggca

SEQ ID NO: 2907031 - RNA, 22 nt, Mycobacterium avium subsp. paratuberculosis
cgggguguagcggauggcgacg

SEQ ID NO: 2907032 - RNA, 21 nt, Mycobacterium avium subsp. paratuberculosis
cgggguguaggcgucggcgga

SEQ ID NO: 2907033 - RNA, 13 nt, Mycobacterium avium subsp. paratuberculosis
cgggguguccagc

SEQ ID NO: 2907034 - RNA, 16 nt, Mycobacterium avium subsp. paratuberculosis
cgggguguccagcggg

SEQ ID NO: 2907035 - RNA, 19 nt, Mycobacterium avium subsp. paratuberculosis
cggggugucgcggcugcgc

SEQ ID NO: 2907036 - RNA, 13 nt, Mycobacterium avium subsp. paratuberculosis
cggggugugcagc

SEQ ID NO: 2907037 - RNA, 14 nt, Mycobacterium avium subsp. paratuberculosis
cggggugugcaggc

SEQ ID NO: 2907038 - RNA, 16 nt, Mycobacterium avium subsp. paratuberculosis
cggggugugcaggccg

SEQ ID NO: 2907039 - RNA, 14 nt, Mycobacterium avium subsp. paratuberculosis
cggggugugcggca

SEQ ID NO: 2907040 - RNA, 15 nt, Mycobacterium avium subsp. paratuberculosis
cggggugugcggcac

SEQ ID NO: 2907041 - RNA, 16 nt, Mycobacterium avium subsp. paratuberculosis
cggggugugcggcacg

SEQ ID NO: 2907042 - RNA, 18 nt, Mycobacterium avium subsp. paratuberculosis
cggggugugcggcacggc

SEQ ID NO: 2907043 - RNA, 20 nt, Mycobacterium avium subsp. paratuberculosis
cggggugugcggcacggcga

SEQ ID NO: 2907044 - RNA, 22 nt, Mycobacterium avium subsp. paratuberculosis
cggggugugcggcacggcgagg

SEQ ID NO: 2907045 - RNA, 16 nt, Mycobacterium avium subsp. paratuberculosis
cggggugugcucggcg

SEQ ID NO: 2907046 - RNA, 19 nt, Mycobacterium avium subsp. paratuberculosis
cggggugugcucggcggcg

SEQ ID NO: 2907047 - RNA, 20 nt, Mycobacterium avium subsp. paratuberculosis
cggggugugcucggcggcgc

SEQ ID NO: 2907048 - RNA, 20 nt, Mycobacterium avium subsp. paratuberculosis
cgggguguggcugucgggga

SEQ ID NO: 2907049 - RNA, 15 nt, Mycobacterium avium subsp. paratuberculosis
cgggguguucaccgc

SEQ ID NO: 2907050 - RNA, 17 nt, Mycobacterium avium subsp. paratuberculosis
cgggguguucaccgcgc

SEQ ID NO: 2907051 - RNA, 23 nt, Mycobacterium avium subsp. paratuberculosis
cgggguguucaccgcgccgggca

SEQ ID NO: 2907052 - RNA, 20 nt, Mycobacterium avium subsp. paratuberculosis
cgggguucaguagcagcguc

SEQ ID NO: 2907053 - RNA, 19 nt, Mycobacterium avium subsp. paratuberculosis
cgggguuccgucgaacagc

SEQ ID NO: 2907054 - RNA, 19 nt, Mycobacterium avium subsp. paratuberculosis
cgggguugaagucuucggc

SEQ ID NO: 2907055 - RNA, 21 nt, Mycobacterium avium subsp. paratuberculosis
cgggguugaagucuucggcca

SEQ ID NO: 2907056 - RNA, 23 nt, Mycobacterium avium subsp. paratuberculosis
cgggguugacccggccggucgcc

SEQ ID NO: 2907057 - RNA, 16 nt, Mycobacterium avium subsp. paratuberculosis
cgggguugguuucggu

SEQ ID NO: 2907058 - RNA, 21 nt, Mycobacterium avium subsp. paratuberculosis
cgggguugguuucgguccagg

SEQ ID NO: 2907059 - RNA, 20 nt, Mycobacterium avium subsp. paratuberculosis
cgggguuguagaacgacgac

SEQ ID NO: 2907060 - RNA, 18 nt, Mycobacterium avium subsp. paratuberculosis
cgggguuuugaucagccc

SEQ ID NO: 2907061 - RNA, 20 nt, Mycobacterium avium subsp. paratuberculosis
cgggguuuugaucagcccgg

SEQ ID NO: 2907062 - RNA, 19 nt, Mycobacterium avium subsp. paratuberculosis
cgggguuuuugauugcgcu

SEQ ID NO: 2907063 - RNA, 18 nt, Mycobacterium avium subsp. paratuberculosis
cggguaacccuccggcgc

SEQ ID NO: 2907064 - RNA, 14 nt, Mycobacterium avium subsp. paratuberculosis
cggguaaccgcagc

SEQ ID NO: 2907065 - RNA, 17 nt, Mycobacterium avium subsp. paratuberculosis
cggguaaccgcagccgg

SEQ ID NO: 2907066 - RNA, 21 nt, Mycobacterium avium subsp. paratuberculosis
cggguaaccgcagccgggugc

SEQ ID NO: 2907067 - RNA, 11 nt, Mycobacterium avium subsp. paratuberculosis
cggguacaccg

SEQ ID NO: 2907068 - RNA, 15 nt, Mycobacterium avium subsp. paratuberculosis
cggguacaccgagcc

SEQ ID NO: 2907069 - RNA, 20 nt, Mycobacterium avium subsp. paratuberculosis
cggguacaccgagccggggc

SEQ ID NO: 2907070 - RNA, 13 nt, Mycobacterium avium subsp. paratuberculosis
cggguacagccgc

SEQ ID NO: 2907071 - RNA, 15 nt, Mycobacterium avium subsp. paratuberculosis
cggguacagccgcag

SEQ ID NO: 2907072 - RNA, 15 nt, Mycobacterium avium subsp. paratuberculosis
cggguaccacuugaa

SEQ ID NO: 2907073 - RNA, 23 nt, Mycobacterium avium subsp. paratuberculosis
cggguaccacuugaaggaggcgg

SEQ ID NO: 2907074 - RNA, 16 nt, Mycobacterium avium subsp. paratuberculosis
cggguagaaccagccc

SEQ ID NO: 2907075 - RNA, 17 nt, Mycobacterium avium subsp. paratuberculosis
cggguagaaccagcccg

SEQ ID NO: 2907076 - RNA, 19 nt, Mycobacterium avium subsp. paratuberculosis
cggguagaaccagcccggc

SEQ ID NO: 2907077 - RNA, 19 nt, Mycobacterium avium subsp. paratuberculosis
cggguagacgaucaccggc

SEQ ID NO: 2907078 - RNA, 16 nt, Mycobacterium avium subsp. paratuberculosis
cggguagacgucgggc

SEQ ID NO: 2907079 - RNA, 23 nt, Mycobacterium avium subsp. paratuberculosis
cggguagacguucuccccgccgg

SEQ ID NO: 2907080 - RNA, 13 nt, Mycobacterium avium subsp. paratuberculosis
cggguagcccgcg

SEQ ID NO: 2907081 - RNA, 16 nt, Mycobacterium avium subsp. paratuberculosis
cggguagcccgcgugc

SEQ ID NO: 2907082 - RNA, 21 nt, Mycobacterium avium subsp. paratuberculosis
cggguagcccgcgugcacacc

SEQ ID NO: 2907083 - RNA, 14 nt, Mycobacterium avium subsp. paratuberculosis
cggguagcccgucg

SEQ ID NO: 2907084 - RNA, 20 nt, Mycobacterium avium subsp. paratuberculosis
cggguagcccgucgacgggc

SEQ ID NO: 2907085 - RNA, 21 nt, Mycobacterium avium subsp. paratuberculosis
cggguagcgccgccggggcgg

SEQ ID NO: 2907086 - RNA, 16 nt, Mycobacterium avium subsp. paratuberculosis
cggguaggacaccguc

SEQ ID NO: 2907087 - RNA, 18 nt, Mycobacterium avium subsp. paratuberculosis
cggguaggcgccgaugcc

SEQ ID NO: 2907088 - RNA, 16 nt, Mycobacterium avium subsp. paratuberculosis
cggguaggcgucgcgc

SEQ ID NO: 2907089 - RNA, 17 nt, Mycobacterium avium subsp. paratuberculosis
cggguaggcgucgcgca

SEQ ID NO: 2907090 - RNA, 20 nt, Mycobacterium avium subsp. paratuberculosis
cggguagggcagccacaucu

SEQ ID NO: 2907091 - RNA, 21 nt, Mycobacterium avium subsp. paratuberculosis
cggguagggcagccacaucug

SEQ ID NO: 2907092 - RNA, 18 nt, Mycobacterium avium subsp. paratuberculosis
cggguagggcgccgucgg

SEQ ID NO: 2907093 - RNA, 20 nt, Mycobacterium avium subsp. paratuberculosis
cggguagggcgccgucggcg

SEQ ID NO: 2907094 - RNA, 19 nt, Mycobacterium avium subsp. paratuberculosis
cggguagugcacggacagc

SEQ ID NO: 2907095 - RNA, 20 nt, Mycobacterium avium subsp. paratuberculosis
cggguaucgacagucccgcg

SEQ ID NO: 2907096 - RNA, 17 nt, Mycobacterium avium subsp. paratuberculosis
cggguaugucggcgacc

SEQ ID NO: 2907097 - RNA, 15 nt, Mycobacterium avium subsp. paratuberculosis
cgggucacacccucg

SEQ ID NO: 2907098 - RNA, 12 nt, Mycobacterium avium subsp. paratuberculosis
cgggucaccgga

SEQ ID NO: 2907099 - RNA, 20 nt, Mycobacterium avium subsp. paratuberculosis
cgggucaccggaugcaccgg

SEQ ID NO: 2907100 - RNA, 21 nt, Mycobacterium avium subsp. paratuberculosis
cgggucaccggaugcaccggc

SEQ ID NO: 2907101 - RNA, 15 nt, Mycobacterium avium subsp. paratuberculosis
cgggucaccggccga

SEQ ID NO: 2907102 - RNA, 23 nt, Mycobacterium avium subsp. paratuberculosis
cgggucaccgugcgggucgcgcu

SEQ ID NO: 2907103 - RNA, 23 nt, Mycobacterium avium subsp. paratuberculosis
cgggucacgaacuccuugacccg

SEQ ID NO: 2907104 - RNA, 14 nt, Mycobacterium avium subsp. paratuberculosis
cgggucacggucag

SEQ ID NO: 2907105 - RNA, 15 nt, Mycobacterium avium subsp. paratuberculosis
cgggucacggucagg

SEQ ID NO: 2907106 - RNA, 13 nt, Mycobacterium avium subsp. paratuberculosis
cgggucacgugca

SEQ ID NO: 2907107 - RNA, 21 nt, Mycobacterium avium subsp. paratuberculosis
cgggucacgugcacccacgcc

SEQ ID NO: 2907108 - RNA, 14 nt, Mycobacterium avium subsp. paratuberculosis
cgggucagaccgcg

SEQ ID NO: 2907109 - RNA, 12 nt, Mycobacterium avium subsp. paratuberculosis
cgggucagcacc

SEQ ID NO: 2907110 - RNA, 14 nt, Mycobacterium avium subsp. paratuberculosis
cgggucagcaccac

SEQ ID NO: 2907111 - RNA, 15 nt, Mycobacterium avium subsp. paratuberculosis
cgggucagcaccacc

SEQ ID NO: 2907112 - RNA, 20 nt, Mycobacterium avium subsp. paratuberculosis
cgggucagcaccaccaacag

SEQ ID NO: 2907113 - RNA, 13 nt, Mycobacterium avium subsp. paratuberculosis
cgggucagcagcg

SEQ ID NO: 2907114 - RNA, 19 nt, Mycobacterium avium subsp. paratuberculosis
cgggucagcagcgucugcg

SEQ ID NO: 2907115 - RNA, 14 nt, Mycobacterium avium subsp. paratuberculosis
cgggucagcgucgc

SEQ ID NO: 2907116 - RNA, 16 nt, Mycobacterium avium subsp. paratuberculosis
cgggucagcgucgcca

SEQ ID NO: 2907117 - RNA, 13 nt, Mycobacterium avium subsp. paratuberculosis
cgggucagcgugc

SEQ ID NO: 2907118 - RNA, 21 nt, Mycobacterium avium subsp. paratuberculosis
cgggucagcuccaccugcggc

SEQ ID NO: 2907119 - RNA, 16 nt, Mycobacterium avium subsp. paratuberculosis
cgggucaggucgaagc

SEQ ID NO: 2907120 - RNA, 22 nt, Mycobacterium avium subsp. paratuberculosis
cgggucaggucgaagcccgccg

SEQ ID NO: 2907121 - RNA, 18 nt, Mycobacterium avium subsp. paratuberculosis
cgggucauccagccgugg

SEQ ID NO: 2907122 - RNA, 22 nt, Mycobacterium avium subsp. paratuberculosis
cggguccacgccgagggcggcg

SEQ ID NO: 2907123 - RNA, 14 nt, Mycobacterium avium subsp. paratuberculosis
cggguccagccgcg

SEQ ID NO: 2907124 - RNA, 15 nt, Mycobacterium avium subsp. paratuberculosis
cggguccagccgcgg

SEQ ID NO: 2907125 - RNA, 13 nt, Mycobacterium avium subsp. paratuberculosis
cggguccagcgcc

SEQ ID NO: 2907126 - RNA, 15 nt, Mycobacterium avium subsp. paratuberculosis
cggguccagcgccga

SEQ ID NO: 2907127 - RNA, 16 nt, Mycobacterium avium subsp. paratuberculosis
cggguccaucgccucg

SEQ ID NO: 2907128 - RNA, 21 nt, Mycobacterium avium subsp. paratuberculosis
cgggucccagaugcgcgacgg

SEQ ID NO: 2907129 - RNA, 22 nt, Mycobacterium avium subsp. paratuberculosis
cgggucccagaugcgcgacggc

SEQ ID NO: 2907130 - RNA, 14 nt, Mycobacterium avium subsp. paratuberculosis
cgggucccagugcc

SEQ ID NO: 2907131 - RNA, 16 nt, Mycobacterium avium subsp. paratuberculosis
cgggucccccgccgac

SEQ ID NO: 2907132 - RNA, 18 nt, Mycobacterium avium subsp. paratuberculosis
cgggucccccgccgaccg

SEQ ID NO: 2907133 - RNA, 22 nt, Mycobacterium avium subsp. paratuberculosis
cgggucccccgccgaccggucc

SEQ ID NO: 2907134 - RNA, 14 nt, Mycobacterium avium subsp. paratuberculosis
cggguccccgccgc

SEQ ID NO: 2907135 - RNA, 16 nt, Mycobacterium avium subsp. paratuberculosis
cggguccccgccgccg

SEQ ID NO: 2907136 - RNA, 17 nt, Mycobacterium avium subsp. paratuberculosis
cggguccccgccgccgu

SEQ ID NO: 2907137 - RNA, 13 nt, Mycobacterium avium subsp. paratuberculosis
cggguccgaccag

SEQ ID NO: 2907138 - RNA, 14 nt, Mycobacterium avium subsp. paratuberculosis
cggguccgaccagc

SEQ ID NO: 2907139 - RNA, 17 nt, Mycobacterium avium subsp. paratuberculosis
cggguccgaccagcacc

SEQ ID NO: 2907140 - RNA, 12 nt, Mycobacterium avium subsp. paratuberculosis
cggguccgcacc

SEQ ID NO: 2907141 - RNA, 19 nt, Mycobacterium avium subsp. paratuberculosis
cggguccgcacccgggccc

SEQ ID NO: 2907142 - RNA, 21 nt, Mycobacterium avium subsp. paratuberculosis
cggguccgcacccgggcccgg

SEQ ID NO: 2907143 - RNA, 22 nt, Mycobacterium avium subsp. paratuberculosis
cggguccgcacccgggcccggu

SEQ ID NO: 2907144 - RNA, 12 nt, Mycobacterium avium subsp. paratuberculosis
cggguccgcccc

SEQ ID NO: 2907145 - RNA, 14 nt, Mycobacterium avium subsp. paratuberculosis
cggguccgccccga

SEQ ID NO: 2907146 - RNA, 13 nt, Mycobacterium avium subsp. paratuberculosis
cggguccgcggug

SEQ ID NO: 2907147 - RNA, 14 nt, Mycobacterium avium subsp. paratuberculosis
cggguccgcgguga

SEQ ID NO: 2907148 - RNA, 24 nt, Mycobacterium avium subsp. paratuberculosis
cggguccgcggugaugccgaguuc

SEQ ID NO: 2907149 - RNA, 14 nt, Mycobacterium avium subsp. paratuberculosis
cggguccuggcccc

SEQ ID NO: 2907150 - RNA, 17 nt, Mycobacterium avium subsp. paratuberculosis
cggguccuugccggcgg

SEQ ID NO: 2907151 - RNA, 18 nt, Mycobacterium avium subsp. paratuberculosis
cggguccuugccggcggc

SEQ ID NO: 2907152 - RNA, 20 nt, Mycobacterium avium subsp. paratuberculosis
cggguccuugccggcggcgg

SEQ ID NO: 2907153 - RNA, 17 nt, Mycobacterium avium subsp. paratuberculosis
cggguccuugcgccccg

SEQ ID NO: 2907154 - RNA, 19 nt, Mycobacterium avium subsp. paratuberculosis
cggguccuugcgccccggc

SEQ ID NO: 2907155 - RNA, 21 nt, Mycobacterium avium subsp. paratuberculosis
cggguccuugcgccccggcgg

SEQ ID NO: 2907156 - RNA, 22 nt, Mycobacterium avium subsp. paratuberculosis
cggguccuugcgccccggcggg

SEQ ID NO: 2907157 - RNA, 16 nt, Mycobacterium avium subsp. paratuberculosis
cgggucgaacggcaac

SEQ ID NO: 2907158 - RNA, 21 nt, Mycobacterium avium subsp. paratuberculosis
cgggucgaagugcucgagcac

SEQ ID NO: 2907159 - RNA, 14 nt, Mycobacterium avium subsp. paratuberculosis
cgggucgaccgccg

SEQ ID NO: 2907160 - RNA, 15 nt, Mycobacterium avium subsp. paratuberculosis
cgggucgaccgccuc

SEQ ID NO: 2907161 - RNA, 16 nt, Mycobacterium avium subsp. paratuberculosis
cgggucgaccgccucg

SEQ ID NO: 2907162 - RNA, 15 nt, Mycobacterium avium subsp. paratuberculosis
cgggucgacgagcag

SEQ ID NO: 2907163 - RNA, 16 nt, Mycobacterium avium subsp. paratuberculosis
cgggucgacgagcagg

SEQ ID NO: 2907164 - RNA, 14 nt, Mycobacterium avium subsp. paratuberculosis
cgggucgagagccg

SEQ ID NO: 2907165 - RNA, 19 nt, Mycobacterium avium subsp. paratuberculosis
cgggucgagagccgcaucg

SEQ ID NO: 2907166 - RNA, 16 nt, Mycobacterium avium subsp. paratuberculosis
cgggucgagcagcagc

SEQ ID NO: 2907167 - RNA, 15 nt, Mycobacterium avium subsp. paratuberculosis
cgggucgagcgcgcc

SEQ ID NO: 2907168 - RNA, 13 nt, Mycobacterium avium subsp. paratuberculosis
cgggucgagcggc

SEQ ID NO: 2907169 - RNA, 18 nt, Mycobacterium avium subsp. paratuberculosis
cgggucgagcggcccgca

SEQ ID NO: 2907170 - RNA, 20 nt, Mycobacterium avium subsp. paratuberculosis
cgggucgagcggcccgcacc

SEQ ID NO: 2907171 - RNA, 22 nt, Mycobacterium avium subsp. paratuberculosis
cgggucgagggucgccaggcca

SEQ ID NO: 2907172 - RNA, 23 nt, Mycobacterium avium subsp. paratuberculosis
cgggucgauaugcugcaacggcu

SEQ ID NO: 2907173 - RNA, 21 nt, Mycobacterium avium subsp. paratuberculosis
cgggucgaucucggcgcaggu

SEQ ID NO: 2907174 - RNA, 13 nt, Mycobacterium avium subsp. paratuberculosis
cgggucgcacagc

SEQ ID NO: 2907175 - RNA, 23 nt, Mycobacterium avium subsp. paratuberculosis
cgggucgcacagccgcagcagcc

SEQ ID NO: 2907176 - RNA, 17 nt, Mycobacterium avium subsp. paratuberculosis
cgggucgcagcggcacg

SEQ ID NO: 2907177 - RNA, 23 nt, Mycobacterium avium subsp. paratuberculosis
cgggucgcagcggcacgucgccg

SEQ ID NO: 2907178 - RNA, 20 nt, Mycobacterium avium subsp. paratuberculosis
cgggucgcaggcagcagcac

SEQ ID NO: 2907179 - RNA, 13 nt, Mycobacterium avium subsp. paratuberculosis
cgggucgcccggg

SEQ ID NO: 2907180 - RNA, 14 nt, Mycobacterium avium subsp. paratuberculosis
cgggucgccgauca

SEQ ID NO: 2907181 - RNA, 20 nt, Mycobacterium avium subsp. paratuberculosis
cgggucgccgaucucggcca

SEQ ID NO: 2907182 - RNA, 21 nt, Mycobacterium avium subsp. paratuberculosis
cgggucgccgaucucggccaa

SEQ ID NO: 2907183 - RNA, 15 nt, Mycobacterium avium subsp. paratuberculosis
cgggucgccgucgag

SEQ ID NO: 2907184 - RNA, 16 nt, Mycobacterium avium subsp. paratuberculosis
cgggucgccgucgagg

SEQ ID NO: 2907185 - RNA, 16 nt, Mycobacterium avium subsp. paratuberculosis
cgggucgccguggccg

SEQ ID NO: 2907186 - RNA, 17 nt, Mycobacterium avium subsp. paratuberculosis
cgggucgccguggccga

SEQ ID NO: 2907187 - RNA, 19 nt, Mycobacterium avium subsp. paratuberculosis
cgggucgccguggccgaac

SEQ ID NO: 2907188 - RNA, 15 nt, Mycobacterium avium subsp. paratuberculosis
cgggucgcgcugcgg

SEQ ID NO: 2907189 - RNA, 13 nt, Mycobacterium avium subsp. paratuberculosis
cgggucgcggccc

SEQ ID NO: 2907190 - RNA, 14 nt, Mycobacterium avium subsp. paratuberculosis
cgggucgcggccca

SEQ ID NO: 2907191 - RNA, 15 nt, Mycobacterium avium subsp. paratuberculosis
cgggucgcggcccac

SEQ ID NO: 2907192 - RNA, 20 nt, Mycobacterium avium subsp. paratuberculosis
cgggucgcggcccaccgcgu

SEQ ID NO: 2907193 - RNA, 24 nt, Mycobacterium avium subsp. paratuberculosis
cgggucgcggcccaccgcgucgca

SEQ ID NO: 2907194 - RNA, 13 nt, Mycobacterium avium subsp. paratuberculosis
cgggucgcggugg

SEQ ID NO: 2907195 - RNA, 15 nt, Mycobacterium avium subsp. paratuberculosis
cgggucgcggugggc

SEQ ID NO: 2907196 - RNA, 18 nt, Mycobacterium avium subsp. paratuberculosis
cgggucgcggugggcucg

SEQ ID NO: 2907197 - RNA, 22 nt, Mycobacterium avium subsp. paratuberculosis
cgggucgcggugggcucggcgc

SEQ ID NO: 2907198 - RNA, 23 nt, Mycobacterium avium subsp. paratuberculosis
cgggucgcggugggcucggcgcc

SEQ ID NO: 2907199 - RNA, 13 nt, Mycobacterium avium subsp. paratuberculosis
cgggucgcgguuc

SEQ ID NO: 2907200 - RNA, 23 nt, Mycobacterium avium subsp. paratuberculosis
cgggucgcugagcaauucgguga

SEQ ID NO: 2907201 - RNA, 16 nt, Mycobacterium avium subsp. paratuberculosis
cgggucgcuggccgcg

SEQ ID NO: 2907202 - RNA, 17 nt, Mycobacterium avium subsp. paratuberculosis
cgggucgcuggccgcga

SEQ ID NO: 2907203 - RNA, 19 nt, Mycobacterium avium subsp. paratuberculosis
cgggucgcuggccgcgacg

SEQ ID NO: 2907204 - RNA, 13 nt, Mycobacterium avium subsp. paratuberculosis
cgggucgcugugc

SEQ ID NO: 2907205 - RNA, 15 nt, Mycobacterium avium subsp. paratuberculosis
cgggucgcugugcag

SEQ ID NO: 2907206 - RNA, 12 nt, Mycobacterium avium subsp. paratuberculosis
cgggucggccgg

SEQ ID NO: 2907207 - RNA, 16 nt, Mycobacterium avium subsp. paratuberculosis
cgggucggccggcggg

SEQ ID NO: 2907208 - RNA, 14 nt, Mycobacterium avium subsp. paratuberculosis
cgggucggcgacgg

SEQ ID NO: 2907209 - RNA, 15 nt, Mycobacterium avium subsp. paratuberculosis
cgggucggcgacggc

SEQ ID NO: 2907210 - RNA, 19 nt, Mycobacterium avium subsp. paratuberculosis
cgggucggcgacggcgcuc

SEQ ID NO: 2907211 - RNA, 20 nt, Mycobacterium avium subsp. paratuberculosis
cgggucggcgacggcgcuca

SEQ ID NO: 2907212 - RNA, 14 nt, Mycobacterium avium subsp. paratuberculosis
cgggucggcgagca

SEQ ID NO: 2907213 - RNA, 16 nt, Mycobacterium avium subsp. paratuberculosis
cgggucggcgagcagc

SEQ ID NO: 2907214 - RNA, 17 nt, Mycobacterium avium subsp. paratuberculosis
cgggucggcgagcagcc

SEQ ID NO: 2907215 - RNA, 21 nt, Mycobacterium avium subsp. paratuberculosis
cgggucggcgagcagccgcgc

SEQ ID NO: 2907216 - RNA, 15 nt, Mycobacterium avium subsp. paratuberculosis
cgggucggcgccggc

SEQ ID NO: 2907217 - RNA, 16 nt, Mycobacterium avium subsp. paratuberculosis
cgggucggcgccggcc

SEQ ID NO: 2907218 - RNA, 13 nt, Mycobacterium avium subsp. paratuberculosis
cgggucggcggcg

SEQ ID NO: 2907219 - RNA, 18 nt, Mycobacterium avium subsp. paratuberculosis
cgggucggcggcgaacgg

SEQ ID NO: 2907220 - RNA, 15 nt, Mycobacterium avium subsp. paratuberculosis
cgggucggcgucacc

SEQ ID NO: 2907221 - RNA, 20 nt, Mycobacterium avium subsp. paratuberculosis
cgggucgggaccgaugccgc

SEQ ID NO: 2907222 - RNA, 20 nt, Mycobacterium avium subsp. paratuberculosis
cgggucgggaggcagcgcgg

SEQ ID NO: 2907223 - RNA, 21 nt, Mycobacterium avium subsp. paratuberculosis
cgggucgggggugggcuccca

SEQ ID NO: 2907224 - RNA, 22 nt, Mycobacterium avium subsp. paratuberculosis
cgggucgggggugggcucccag

SEQ ID NO: 2907225 - RNA, 15 nt, Mycobacterium avium subsp. paratuberculosis
cgggucggucggccc

SEQ ID NO: 2907226 - RNA, 17 nt, Mycobacterium avium subsp. paratuberculosis
cgggucgguggcgauga

SEQ ID NO: 2907227 - RNA, 18 nt, Mycobacterium avium subsp. paratuberculosis
cgggucggugggcagcuc

SEQ ID NO: 2907228 - RNA, 23 nt, Mycobacterium avium subsp. paratuberculosis
cgggucgguggugaucgcggcgg

SEQ ID NO: 2907229 - RNA, 15 nt, Mycobacterium avium subsp. paratuberculosis
cgggucguagagcgc

SEQ ID NO: 2907230 - RNA, 17 nt, Mycobacterium avium subsp. paratuberculosis
cgggucguagagcgcga

SEQ ID NO: 2907231 - RNA, 17 nt, Mycobacterium avium subsp. paratuberculosis
cgggucguagccgaagc

SEQ ID NO: 2907232 - RNA, 23 nt, Mycobacterium avium subsp. paratuberculosis
cgggucguagccgaagccgccgu

SEQ ID NO: 2907233 - RNA, 17 nt, Mycobacterium avium subsp. paratuberculosis
cgggucguagccgucga

SEQ ID NO: 2907234 - RNA, 20 nt, Mycobacterium avium subsp. paratuberculosis
cgggucguagcuuccgccuu

SEQ ID NO: 2907235 - RNA, 16 nt, Mycobacterium avium subsp. paratuberculosis
cgggucguaggccgga

SEQ ID NO: 2907236 - RNA, 18 nt, Mycobacterium avium subsp. paratuberculosis
cgggucguaggccggauc

SEQ ID NO: 2907237 - RNA, 16 nt, Mycobacterium avium subsp. paratuberculosis
cgggucguccgcgacg

SEQ ID NO: 2907238 - RNA, 18 nt, Mycobacterium avium subsp. paratuberculosis
cgggucguccgcgacgcu

SEQ ID NO: 2907239 - RNA, 14 nt, Mycobacterium avium subsp. paratuberculosis
cgggucgucgacgu

SEQ ID NO: 2907240 - RNA, 12 nt, Mycobacterium avium subsp. paratuberculosis
cgggucgucgau

SEQ ID NO: 2907241 - RNA, 11 nt, Mycobacterium avium subsp. paratuberculosis
cgggucgucgc

SEQ ID NO: 2907242 - RNA, 18 nt, Mycobacterium avium subsp. paratuberculosis
cgggucgucgcggaaccg

SEQ ID NO: 2907243 - RNA, 21 nt, Mycobacterium avium subsp. paratuberculosis
cgggucgucggccuguccggu

SEQ ID NO: 2907244 - RNA, 16 nt, Mycobacterium avium subsp. paratuberculosis
cgggucgucggcgucg

SEQ ID NO: 2907245 - RNA, 17 nt, Mycobacterium avium subsp. paratuberculosis
cgggucgucggcgucgg

SEQ ID NO: 2907246 - RNA, 15 nt, Mycobacterium avium subsp. paratuberculosis
cgggucgucgggccg

SEQ ID NO: 2907247 - RNA, 19 nt, Mycobacterium avium subsp. paratuberculosis
cgggucgucgggcggcagg

SEQ ID NO: 2907248 - RNA, 16 nt, Mycobacterium avium subsp. paratuberculosis
cgggucgucggugccg

SEQ ID NO: 2907249 - RNA, 17 nt, Mycobacterium avium subsp. paratuberculosis
cgggucgucggugccga

SEQ ID NO: 2907250 - RNA, 20 nt, Mycobacterium avium subsp. paratuberculosis
cgggucgucggugccgaagc

SEQ ID NO: 2907251 - RNA, 16 nt, Mycobacterium avium subsp. paratuberculosis
cgggucgugcaucggc

SEQ ID NO: 2907252 - RNA, 21 nt, Mycobacterium avium subsp. paratuberculosis
cgggucgugcaucggcgccug

SEQ ID NO: 2907253 - RNA, 14 nt, Mycobacterium avium subsp. paratuberculosis
cgggucgugcggcg

SEQ ID NO: 2907254 - RNA, 16 nt, Mycobacterium avium subsp. paratuberculosis
cgggucguuggcggcg

SEQ ID NO: 2907255 - RNA, 17 nt, Mycobacterium avium subsp. paratuberculosis
cgggucguuggcggcgg

SEQ ID NO: 2907256 - RNA, 20 nt, Mycobacterium avium subsp. paratuberculosis
cgggucguuggcggcggugg

SEQ ID NO: 2907257 - RNA, 23 nt, Mycobacterium avium subsp. paratuberculosis
cgggucguuuggugguggcgugg

SEQ ID NO: 2907258 - RNA, 19 nt, Mycobacterium avium subsp. paratuberculosis
cgggucuagaucuccaggc

SEQ ID NO: 2907259 - RNA, 22 nt, Mycobacterium avium subsp. paratuberculosis
cgggucuagaucuccaggcucg

SEQ ID NO: 2907260 - RNA, 16 nt, Mycobacterium avium subsp. paratuberculosis
cgggucucgaaccggg

SEQ ID NO: 2907261 - RNA, 17 nt, Mycobacterium avium subsp. paratuberculosis
cggcucagaaggcguca

SEQ ID NO: 2907262 - RNA, 22 nt, Mycobacterium avium subsp. paratuberculosis
cggcucagaaggcgucaucgug

SEQ ID NO: 2907263 - RNA, 19 nt, Mycobacterium avium subsp. paratuberculosis
cggcucagcaacccgccga

SEQ ID NO: 2907264 - RNA, 21 nt, Mycobacterium avium subsp. paratuberculosis
cggcucagcaacccgccgagc

SEQ ID NO: 2907265 - RNA, 23 nt, Mycobacterium avium subsp. paratuberculosis
cggcucagcaacccgccgagcgu

SEQ ID NO: 2907266 - RNA, 16 nt, Mycobacterium avium subsp. paratuberculosis
cggcucagcccggcgc

SEQ ID NO: 2907267 - RNA, 18 nt, Mycobacterium avium subsp. paratuberculosis
cggcucagcccggcgcuc

SEQ ID NO: 2907268 - RNA, 19 nt, Mycobacterium avium subsp. paratuberculosis
cggcucagcccggcgcuca

SEQ ID NO: 2907269 - RNA, 13 nt, Mycobacterium avium subsp. paratuberculosis
cggcucagcggca

SEQ ID NO: 2907270 - RNA, 15 nt, Mycobacterium avium subsp. paratuberculosis
cggcucagcggcaac

SEQ ID NO: 2907271 - RNA, 16 nt, Mycobacterium avium subsp. paratuberculosis
cggcucaggggaucuc

SEQ ID NO: 2907272 - RNA, 21 nt, Mycobacterium avium subsp. paratuberculosis
cggcucagggugcgcuggccg

SEQ ID NO: 2907273 - RNA, 23 nt, Mycobacterium avium subsp. paratuberculosis
cggcucagggugcgcuggccgac

SEQ ID NO: 2907274 - RNA, 14 nt, Mycobacterium avium subsp. paratuberculosis
cggcuccacagcag

SEQ ID NO: 2907275 - RNA, 19 nt, Mycobacterium avium subsp. paratuberculosis
cggcuccaccgcgccggcg

SEQ ID NO: 2907276 - RNA, 21 nt, Mycobacterium avium subsp. paratuberculosis
cggcuccaccgcgccggcggc

SEQ ID NO: 2907277 - RNA, 23 nt, Mycobacterium avium subsp. paratuberculosis
cggcuccaccgcgccggcggcgg

SEQ ID NO: 2907278 - RNA, 22 nt, Mycobacterium avium subsp. paratuberculosis
cggcuccacgaugcccgucacg

SEQ ID NO: 2907279 - RNA, 14 nt, Mycobacterium avium subsp. paratuberculosis
cggcuccagcagcg

SEQ ID NO: 2907280 - RNA, 16 nt, Mycobacterium avium subsp. paratuberculosis
cggcuccagcagcggc

SEQ ID NO: 2907281 - RNA, 13 nt, Mycobacterium avium subsp. paratuberculosis
cggcuccagcgcc

SEQ ID NO: 2907282 - RNA, 16 nt, Mycobacterium avium subsp. paratuberculosis
cggcuccagcgcccgc

SEQ ID NO: 2907283 - RNA, 19 nt, Mycobacterium avium subsp. paratuberculosis
cggcuccagcgcccgccgc

SEQ ID NO: 2907284 - RNA, 19 nt, Mycobacterium avium subsp. paratuberculosis
cggcuccagguagggcaca

SEQ ID NO: 2907285 - RNA, 14 nt, Mycobacterium avium subsp. paratuberculosis
cggcucccaggccc

SEQ ID NO: 2907286 - RNA, 23 nt, Mycobacterium avium subsp. paratuberculosis
cggcucccaggcccaucgcgguc

SEQ ID NO: 2907287 - RNA, 18 nt, Mycobacterium avium subsp. paratuberculosis
cggcuccccgaccacacc

SEQ ID NO: 2907288 - RNA, 22 nt, Mycobacterium avium subsp. paratuberculosis
cggcuccccgaccacaccggcg

SEQ ID NO: 2907289 - RNA, 14 nt, Mycobacterium avium subsp. paratuberculosis
cggcuccgaucucc

SEQ ID NO: 2907290 - RNA, 17 nt, Mycobacterium avium subsp. paratuberculosis
cggcuccgaucuccugg

SEQ ID NO: 2907291 - RNA, 20 nt, Mycobacterium avium subsp. paratuberculosis
cggcuccgcaugcccgggcg

SEQ ID NO: 2907292 - RNA, 12 nt, Mycobacterium avium subsp. paratuberculosis
cggcuccggccg

SEQ ID NO: 2907293 - RNA, 13 nt, Mycobacterium avium subsp. paratuberculosis
cggcuccggccgc

SEQ ID NO: 2907294 - RNA, 14 nt, Mycobacterium avium subsp. paratuberculosis
cggcuccggccgcg

SEQ ID NO: 2907295 - RNA, 21 nt, Mycobacterium avium subsp. paratuberculosis
cggcuccggccgcgccggccu

SEQ ID NO: 2907296 - RNA, 20 nt, Mycobacterium avium subsp. paratuberculosis
cggcuccuaugucggugcgg

SEQ ID NO: 2907297 - RNA, 22 nt, Mycobacterium avium subsp. paratuberculosis
cggcuccuaugucggugcggcg

SEQ ID NO: 2907298 - RNA, 23 nt, Mycobacterium avium subsp. paratuberculosis
cggcuccuaugucggugcggcgg

SEQ ID NO: 2907299 - RNA, 21 nt, Mycobacterium avium subsp. paratuberculosis
cggcuccugccguucggccag

SEQ ID NO: 2907300 - RNA, 17 nt, Mycobacterium avium subsp. paratuberculosis
cggcuccuugcgccgca

SEQ ID NO: 2907301 - RNA, 18 nt, Mycobacterium avium subsp. paratuberculosis
cggcucgaccucaccccg

SEQ ID NO: 2907302 - RNA, 17 nt, Mycobacterium avium subsp. paratuberculosis
cggcucgagcucgucgg

SEQ ID NO: 2907303 - RNA, 20 nt, Mycobacterium avium subsp. paratuberculosis
cggcucgagcucgucgggug

SEQ ID NO: 2907304 - RNA, 16 nt, Mycobacterium avium subsp. paratuberculosis
cggcucgaucgcgguc

SEQ ID NO: 2907305 - RNA, 17 nt, Mycobacterium avium subsp. paratuberculosis
cggcucgauggacgcca

SEQ ID NO: 2907306 - RNA, 21 nt, Mycobacterium avium subsp. paratuberculosis
cggcucgauggacgccagcau

SEQ ID NO: 2907307 - RNA, 14 nt, Mycobacterium avium subsp. paratuberculosis
cggcucgccaccuc

SEQ ID NO: 2907308 - RNA, 13 nt, Mycobacterium avium subsp. paratuberculosis
cggcucgcccgcg

SEQ ID NO: 2907309 - RNA, 15 nt, Mycobacterium avium subsp. paratuberculosis
cggcucgcccgcgac

SEQ ID NO: 2907310 - RNA, 21 nt, Mycobacterium avium subsp. paratuberculosis
cggcucgcccgcgacugucgg

SEQ ID NO: 2907311 - RNA, 12 nt, Mycobacterium avium subsp. paratuberculosis
cggcucgccgau

SEQ ID NO: 2907312 - RNA, 14 nt, Mycobacterium avium subsp. paratuberculosis
cggcucgccgaucc

SEQ ID NO: 2907313 - RNA, 13 nt, Mycobacterium avium subsp. paratuberculosis
cggcucgccgcgc

SEQ ID NO: 2907314 - RNA, 23 nt, Mycobacterium avium subsp. paratuberculosis
cggcucgccgcgcaucaucgccc

SEQ ID NO: 2907315 - RNA, 15 nt, Mycobacterium avium subsp. paratuberculosis
cggcucgccgcucgu

SEQ ID NO: 2907316 - RNA, 14 nt, Mycobacterium avium subsp. paratuberculosis
cggcucgccggcgc

SEQ ID NO: 2907317 - RNA, 15 nt, Mycobacterium avium subsp. paratuberculosis
cggcucgccggcgcg

SEQ ID NO: 2907318 - RNA, 22 nt, Mycobacterium avium subsp. paratuberculosis
cggcucgccggcgcgcaccccg

SEQ ID NO: 2907319 - RNA, 21 nt, Mycobacterium avium subsp. paratuberculosis
cggcugaccggcggugccggc

SEQ ID NO: 2907320 - RNA, 17 nt, Mycobacterium avium subsp. paratuberculosis
cggcugacugccggcga

SEQ ID NO: 2907321 - RNA, 19 nt, Mycobacterium avium subsp. paratuberculosis
cggcugacugccggcgacg

SEQ ID NO: 2907322 - RNA, 20 nt, Mycobacterium avium subsp. paratuberculosis
cggcugacugccggcgacgg

SEQ ID NO: 2907323 - RNA, 15 nt, Mycobacterium avium subsp. paratuberculosis
cggcugagcagcucg

SEQ ID NO: 2907324 - RNA, 23 nt, Mycobacterium avium subsp. paratuberculosis
cggcugagcagcucgcggauccg

SEQ ID NO: 2907325 - RNA, 13 nt, Mycobacterium avium subsp. paratuberculosis
cggcugagcgucg

SEQ ID NO: 2907326 - RNA, 14 nt, Mycobacterium avium subsp. paratuberculosis
cggcugaucagccg

SEQ ID NO: 2907327 - RNA, 15 nt, Mycobacterium avium subsp. paratuberculosis
cggcugaucagccgg

SEQ ID NO: 2907328 - RNA, 18 nt, Mycobacterium avium subsp. paratuberculosis
cggcugaucagccggcga

SEQ ID NO: 2907329 - RNA, 20 nt, Mycobacterium avium subsp. paratuberculosis
cggcugaucagccggcgagc

SEQ ID NO: 2907330 - RNA, 21 nt, Mycobacterium avium subsp. paratuberculosis
cggcugaucagccggcgagcg

SEQ ID NO: 2907331 - RNA, 22 nt, Mycobacterium avium subsp. paratuberculosis
cggcugaucagccggcgagcgc

SEQ ID NO: 2907332 - RNA, 23 nt, Mycobacterium avium subsp. paratuberculosis
cggcugcacccucugccacggcg

SEQ ID NO: 2907333 - RNA, 13 nt, Mycobacterium avium subsp. paratuberculosis
cggcugcagccgg

SEQ ID NO: 2907334 - RNA, 14 nt, Mycobacterium avium subsp. paratuberculosis
cggcugcaggcagc

SEQ ID NO: 2907335 - RNA, 15 nt, Mycobacterium avium subsp. paratuberculosis
cggcugcccaggauc

SEQ ID NO: 2907336 - RNA, 16 nt, Mycobacterium avium subsp. paratuberculosis
cggcugcccgacccgc

SEQ ID NO: 2907337 - RNA, 18 nt, Mycobacterium avium subsp. paratuberculosis
cggcugcccgacccgcac

SEQ ID NO: 2907338 - RNA, 19 nt, Mycobacterium avium subsp. paratuberculosis
cggcugcccgacccgcacc

SEQ ID NO: 2907339 - RNA, 16 nt, Mycobacterium avium subsp. paratuberculosis
cggcugcccggcccgc

SEQ ID NO: 2907340 - RNA, 19 nt, Mycobacterium avium subsp. paratuberculosis
cggcugcccggcccgccgc

SEQ ID NO: 2907341 - RNA, 23 nt, Mycobacterium avium subsp. paratuberculosis
cggcugcccggcccgccgcugca

SEQ ID NO: 2907342 - RNA, 13 nt, Mycobacterium avium subsp. paratuberculosis
cggcugcccuggg

SEQ ID NO: 2907343 - RNA, 14 nt, Mycobacterium avium subsp. paratuberculosis
cggcugcccuggga

SEQ ID NO: 2907344 - RNA, 21 nt, Mycobacterium avium subsp. paratuberculosis
cggcugcccugggaggaagug

SEQ ID NO: 2907345 - RNA, 23 nt, Mycobacterium avium subsp. paratuberculosis
cggcugccgaccucgauggcgac

SEQ ID NO: 2907346 - RNA, 17 nt, Mycobacterium avium subsp. paratuberculosis
cggcugccggccaaggc

SEQ ID NO: 2907347 - RNA, 14 nt, Mycobacterium avium subsp. paratuberculosis
cggcugccucgacg

SEQ ID NO: 2907348 - RNA, 17 nt, Mycobacterium avium subsp. paratuberculosis
cggcugccucgacgaug

SEQ ID NO: 2907349 - RNA, 18 nt, Mycobacterium avium subsp. paratuberculosis
cggcugccucgacgaugg

SEQ ID NO: 2907350 - RNA, 21 nt, Mycobacterium avium subsp. paratuberculosis
cggcugcgcacguagcccagc

SEQ ID NO: 2907351 - RNA, 15 nt, Mycobacterium avium subsp. paratuberculosis
cggcugcgcagcgca

SEQ ID NO: 2907352 - RNA, 18 nt, Mycobacterium avium subsp. paratuberculosis
cggcugcgcagcgcagca

SEQ ID NO: 2907353 - RNA, 21 nt, Mycobacterium avium subsp. paratuberculosis
cggcugcgcagcgcagcacca

SEQ ID NO: 2907354 - RNA, 15 nt, Mycobacterium avium subsp. paratuberculosis
cggcugcgccgcgcu

SEQ ID NO: 2907355 - RNA, 16 nt, Mycobacterium avium subsp. paratuberculosis
cggcugcgccgcgcuu

SEQ ID NO: 2907356 - RNA, 19 nt, Mycobacterium avium subsp. paratuberculosis
cggcugcgcguucggcgcc

SEQ ID NO: 2907357 - RNA, 14 nt, Mycobacterium avium subsp. paratuberculosis
cggcugcgggccag

SEQ ID NO: 2907358 - RNA, 15 nt, Mycobacterium avium subsp. paratuberculosis
cggcugcgggccagc

SEQ ID NO: 2907359 - RNA, 17 nt, Mycobacterium avium subsp. paratuberculosis
cggcugcgggccagcgc

SEQ ID NO: 2907360 - RNA, 18 nt, Mycobacterium avium subsp. paratuberculosis
cggcugcgggccagcgca

SEQ ID NO: 2907361 - RNA, 19 nt, Mycobacterium avium subsp. paratuberculosis
cggcugcgguuggccggcc

SEQ ID NO: 2907362 - RNA, 21 nt, Mycobacterium avium subsp. paratuberculosis
cggcugcgguuggccggccgg

SEQ ID NO: 2907363 - RNA, 12 nt, Mycobacterium avium subsp. paratuberculosis
cggcugcucgaa

SEQ ID NO: 2907364 - RNA, 17 nt, Mycobacterium avium subsp. paratuberculosis
cggcugcucgcgcugcc

SEQ ID NO: 2907365 - RNA, 18 nt, Mycobacterium avium subsp. paratuberculosis
cggcugcucgcgcugccg

SEQ ID NO: 2907366 - RNA, 20 nt, Mycobacterium avium subsp. paratuberculosis
cggcugcugcacgacgaccg

SEQ ID NO: 2907367 - RNA, 23 nt, Mycobacterium avium subsp. paratuberculosis
cggcugcugcacgacgaccgcga

SEQ ID NO: 2907368 - RNA, 19 nt, Mycobacterium avium subsp. paratuberculosis
cggcugcugcagcgcccgg

SEQ ID NO: 2907369 - RNA, 18 nt, Mycobacterium avium subsp. paratuberculosis
cggcugcugcgcggcacg

SEQ ID NO: 2907370 - RNA, 19 nt, Mycobacterium avium subsp. paratuberculosis
cggcugcugcgcggcacgg

SEQ ID NO: 2907371 - RNA, 14 nt, Mycobacterium avium subsp. paratuberculosis
cggcugcuggucga

SEQ ID NO: 2907372 - RNA, 15 nt, Mycobacterium avium subsp. paratuberculosis
cggcugcuggucgac

SEQ ID NO: 2907373 - RNA, 16 nt, Mycobacterium avium subsp. paratuberculosis
cggcugcuggucgacg

SEQ ID NO: 2907374 - RNA, 21 nt, Mycobacterium avium subsp. paratuberculosis
cggcugcuggucgacgucauc

SEQ ID NO: 2907375 - RNA, 23 nt, Mycobacterium avium subsp. paratuberculosis
cggcugcuguucguccgugcugc

SEQ ID NO: 2907376 - RNA, 22 nt, Mycobacterium avium subsp. paratuberculosis
cggcuggaacaucccggagccg

SEQ ID NO: 2907377 - RNA, 16 nt, Mycobacterium avium subsp. paratuberculosis
cggcuggaaucccgcc

SEQ ID NO: 2907378 - RNA, 23 nt, Mycobacterium avium subsp. paratuberculosis
cggcuggaaucccgccucggcgg

SEQ ID NO: 2907379 - RNA, 16 nt, Mycobacterium avium subsp. paratuberculosis
cggcuggacacccccg

SEQ ID NO: 2907380 - RNA, 18 nt, Mycobacterium avium subsp. paratuberculosis
cggcuggcaggucgcgcc

SEQ ID NO: 2907381 - RNA, 22 nt, Mycobacterium avium subsp. paratuberculosis
cggcuggcaggucgcgccggag

SEQ ID NO: 2907382 - RNA, 18 nt, Mycobacterium avium subsp. paratuberculosis
cggcuggcccggcgcggc

SEQ ID NO: 2907383 - RNA, 19 nt, Mycobacterium avium subsp. paratuberculosis
cggcuggcccggcgcggcg

SEQ ID NO: 2907384 - RNA, 23 nt, Mycobacterium avium subsp. paratuberculosis
cggcuggcccggcgcggcggcgc

SEQ ID NO: 2907385 - RNA, 15 nt, Mycobacterium avium subsp. paratuberculosis
cggcuggccgagcgg

SEQ ID NO: 2907386 - RNA, 16 nt, Mycobacterium avium subsp. paratuberculosis
cggcuggccgagcggc

SEQ ID NO: 2907387 - RNA, 12 nt, Mycobacterium avium subsp. paratuberculosis
cggcuggccgca

SEQ ID NO: 2907388 - RNA, 12 nt, Mycobacterium avium subsp. paratuberculosis
cggcuggccgcg

SEQ ID NO: 2907389 - RNA, 13 nt, Mycobacterium avium subsp. paratuberculosis
cggcuggccgcgg

SEQ ID NO: 2907390 - RNA, 18 nt, Mycobacterium avium subsp. paratuberculosis
cggcuggccgcggcgauc

SEQ ID NO: 2907391 - RNA, 15 nt, Mycobacterium avium subsp. paratuberculosis
cggcuggccggaaag

SEQ ID NO: 2907392 - RNA, 21 nt, Mycobacterium avium subsp. paratuberculosis
cggcuggccggaaaggcguga

SEQ ID NO: 2907393 - RNA, 16 nt, Mycobacterium avium subsp. paratuberculosis
cggcuggccgucgucg

SEQ ID NO: 2907394 - RNA, 22 nt, Mycobacterium avium subsp. paratuberculosis
cggcuggccgucgucgaggccg

SEQ ID NO: 2907395 - RNA, 19 nt, Mycobacterium avium subsp. paratuberculosis
cggcuggcgggcgaucgcc

SEQ ID NO: 2907396 - RNA, 18 nt, Mycobacterium avium subsp. paratuberculosis
cggcuggcgugcggcgcg

SEQ ID NO: 2907397 - RNA, 14 nt, Mycobacterium avium subsp. paratuberculosis
cggcugggcagccg

SEQ ID NO: 2907398 - RNA, 20 nt, Mycobacterium avium subsp. paratuberculosis
cggcugggcagccgcgcgug

SEQ ID NO: 2907399 - RNA, 21 nt, Mycobacterium avium subsp. paratuberculosis
cggcugggcagccgcgcgugc

SEQ ID NO: 2907400 - RNA, 18 nt, Mycobacterium avium subsp. paratuberculosis
cggcugggccgcggcgcc

SEQ ID NO: 2907401 - RNA, 19 nt, Mycobacterium avium subsp. paratuberculosis
cggcugggccgcggcgccg

SEQ ID NO: 2907402 - RNA, 20 nt, Mycobacterium avium subsp. paratuberculosis
cggcuggguggacaccuugg

SEQ ID NO: 2907403 - RNA, 20 nt, Mycobacterium avium subsp. paratuberculosis
cgggaaaucggacccagccc

SEQ ID NO: 2907404 - RNA, 16 nt, Mycobacterium avium subsp. paratuberculosis
cgggaaaugcgucgcc

SEQ ID NO: 2907405 - RNA, 16 nt, Mycobacterium avium subsp. paratuberculosis
cgggaacacguagcga

SEQ ID NO: 2907406 - RNA, 20 nt, Mycobacterium avium subsp. paratuberculosis
cgggaacacguagcgaucgg

SEQ ID NO: 2907407 - RNA, 14 nt, Mycobacterium avium subsp. paratuberculosis
cgggaacagccagg

SEQ ID NO: 2907408 - RNA, 15 nt, Mycobacterium avium subsp. paratuberculosis
cgggaacagccaggc

SEQ ID NO: 2907409 - RNA, 17 nt, Mycobacterium avium subsp. paratuberculosis
cgggaacagccaggcga

SEQ ID NO: 2907410 - RNA, 15 nt, Mycobacterium avium subsp. paratuberculosis
cgggaacagcccgcc

SEQ ID NO: 2907411 - RNA, 20 nt, Mycobacterium avium subsp. paratuberculosis
cgggaacagcccgcccuggc

SEQ ID NO: 2907412 - RNA, 22 nt, Mycobacterium avium subsp. paratuberculosis
cgggaacagcccgcccuggcug

SEQ ID NO: 2907413 - RNA, 12 nt, Mycobacterium avium subsp. paratuberculosis
cgggaacagcga

SEQ ID NO: 2907414 - RNA, 14 nt, Mycobacterium avium subsp. paratuberculosis
cgggaacagcgacu

SEQ ID NO: 2907415 - RNA, 14 nt, Mycobacterium avium subsp. paratuberculosis
cgggaacagcggga

SEQ ID NO: 2907416 - RNA, 14 nt, Mycobacterium avium subsp. paratuberculosis
cgggaaccagccca

SEQ ID NO: 2907417 - RNA, 22 nt, Mycobacterium avium subsp. paratuberculosis
cgggaacccauucggucaucgg

SEQ ID NO: 2907418 - RNA, 15 nt, Mycobacterium avium subsp. paratuberculosis
cgggaacgacggugc

SEQ ID NO: 2907419 - RNA, 16 nt, Mycobacterium avium subsp. paratuberculosis
cgggaacgacggugcg

SEQ ID NO: 2907420 - RNA, 23 nt, Mycobacterium avium subsp. paratuberculosis
cgggaacgacggugcgcccgucg

SEQ ID NO: 2907421 - RNA, 19 nt, Mycobacterium avium subsp. paratuberculosis
cgggaacgaucggcuccag

SEQ ID NO: 2907422 - RNA, 21 nt, Mycobacterium avium subsp. paratuberculosis
cgggaacgaucggcuccagcg

SEQ ID NO: 2907423 - RNA, 15 nt, Mycobacterium avium subsp. paratuberculosis
cgggaacgccgauca

SEQ ID NO: 2907424 - RNA, 17 nt, Mycobacterium avium subsp. paratuberculosis
cgggaacgccgaucacc

SEQ ID NO: 2907425 - RNA, 13 nt, Mycobacterium avium subsp. paratuberculosis
cgggaacgcggcg

SEQ ID NO: 2907426 - RNA, 15 nt, Mycobacterium avium subsp. paratuberculosis
cgggaacgcggcgaa

SEQ ID NO: 2907427 - RNA, 14 nt, Mycobacterium avium subsp. paratuberculosis
cgggaacgucaugg

SEQ ID NO: 2907428 - RNA, 17 nt, Mycobacterium avium subsp. paratuberculosis
cgggaagagcggcguga

SEQ ID NO: 2907429 - RNA, 14 nt, Mycobacterium avium subsp. paratuberculosis
cgggaagcccaccg

SEQ ID NO: 2907430 - RNA, 15 nt, Mycobacterium avium subsp. paratuberculosis
cgggaagcccaccgc

SEQ ID NO: 2907431 - RNA, 15 nt, Mycobacterium avium subsp. paratuberculosis
cgggaagccgccgcc

SEQ ID NO: 2907432 - RNA, 23 nt, Mycobacterium avium subsp. paratuberculosis
cgggaagcugcuggcuucgcgga

SEQ ID NO: 2907433 - RNA, 14 nt, Mycobacterium avium subsp. paratuberculosis
cgggaaggcggccg

SEQ ID NO: 2907434 - RNA, 15 nt, Mycobacterium avium subsp. paratuberculosis
cgggaagggcccggg

SEQ ID NO: 2907435 - RNA, 18 nt, Mycobacterium avium subsp. paratuberculosis
cgggaagggcccgggaug

SEQ ID NO: 2907436 - RNA, 21 nt, Mycobacterium avium subsp. paratuberculosis
cgggaaggugguccuggcggu

SEQ ID NO: 2907437 - RNA, 20 nt, Mycobacterium avium subsp. paratuberculosis
cgggaaguagugcaucggca

SEQ ID NO: 2907438 - RNA, 22 nt, Mycobacterium avium subsp. paratuberculosis
cgggaaguccuccgucgagucg

SEQ ID NO: 2907439 - RNA, 14 nt, Mycobacterium avium subsp. paratuberculosis
cgggaaguucacgu

SEQ ID NO: 2907440 - RNA, 22 nt, Mycobacterium avium subsp. paratuberculosis
cgggaauauccaucgauggcgg

SEQ ID NO: 2907441 - RNA, 24 nt, Mycobacterium avium subsp. paratuberculosis
cgggaaucccacccgcaacgcuga

SEQ ID NO: 2907442 - RNA, 23 nt, Mycobacterium avium subsp. paratuberculosis
cgggaauggggcccgguccgcug

SEQ ID NO: 2907443 - RNA, 20 nt, Mycobacterium avium subsp. paratuberculosis
cgggaaugucgcgcagcauc

SEQ ID NO: 2907444 - RNA, 15 nt, Mycobacterium avium subsp. paratuberculosis
cgggaaugucggcgu

SEQ ID NO: 2907445 - RNA, 20 nt, Mycobacterium avium subsp. paratuberculosis
cgggaauuggcaccggaccg

SEQ ID NO: 2907446 - RNA, 21 nt, Mycobacterium avium subsp. paratuberculosis
cgggaauuggcaccggaccgc

SEQ ID NO: 2907447 - RNA, 16 nt, Mycobacterium avium subsp. paratuberculosis
cgggacaacaccaccu

SEQ ID NO: 2907448 - RNA, 16 nt, Mycobacterium avium subsp. paratuberculosis
cgggacaccgcuggcc

SEQ ID NO: 2907449 - RNA, 12 nt, Mycobacterium avium subsp. paratuberculosis
cgggacacggcg

SEQ ID NO: 2907450 - RNA, 14 nt, Mycobacterium avium subsp. paratuberculosis
cgggacacggcggc

SEQ ID NO: 2907451 - RNA, 15 nt, Mycobacterium avium subsp. paratuberculosis
cgggacacggcggcg

SEQ ID NO: 2907452 - RNA, 17 nt, Mycobacterium avium subsp. paratuberculosis
cgggacacggcggcgcg

SEQ ID NO: 2907453 - RNA, 18 nt, Mycobacterium avium subsp. paratuberculosis
cgggacacggcggcgcgg

SEQ ID NO: 2907454 - RNA, 21 nt, Mycobacterium avium subsp. paratuberculosis
cgggacacggcggcgcgggcg

SEQ ID NO: 2907455 - RNA, 17 nt, Mycobacterium avium subsp. paratuberculosis
cgggacagccgcgccga

SEQ ID NO: 2907456 - RNA, 19 nt, Mycobacterium avium subsp. paratuberculosis
cgggacagguagcgcagcc

SEQ ID NO: 2907457 - RNA, 13 nt, Mycobacterium avium subsp. paratuberculosis
cgggacaucgucg

SEQ ID NO: 2907458 - RNA, 14 nt, Mycobacterium avium subsp. paratuberculosis
cgggacaucgucgc

SEQ ID NO: 2907459 - RNA, 17 nt, Mycobacterium avium subsp. paratuberculosis
cgggacaucgucgcgcc

SEQ ID NO: 2907460 - RNA, 19 nt, Mycobacterium avium subsp. paratuberculosis
cgggacaucgucgcgccca

SEQ ID NO: 2907461 - RNA, 22 nt, Mycobacterium avium subsp. paratuberculosis
cgggacaucgucgcgcccagga

SEQ ID NO: 2907462 - RNA, 23 nt, Mycobacterium avium subsp. paratuberculosis
cgggacaucgucgcgcccaggaa

SEQ ID NO: 2907463 - RNA, 17 nt, Mycobacterium avium subsp. paratuberculosis
cgggaccacccgcagcg

SEQ ID NO: 2907464 - RNA, 20 nt, Mycobacterium avium subsp. paratuberculosis
cgggaccacccgcagcgcgg

SEQ ID NO: 2907465 - RNA, 16 nt, Mycobacterium avium subsp. paratuberculosis
cgggaccagcgccucg

SEQ ID NO: 2907466 - RNA, 13 nt, Mycobacterium avium subsp. paratuberculosis
cgggaccagcgcg

SEQ ID NO: 2907467 - RNA, 14 nt, Mycobacterium avium subsp. paratuberculosis
cgggaccagcgcgg

SEQ ID NO: 2907468 - RNA, 17 nt, Mycobacterium avium subsp. paratuberculosis
cgggacccgcgaccccu

SEQ ID NO: 2907469 - RNA, 19 nt, Mycobacterium avium subsp. paratuberculosis
cgggaccgaggugccgcgg

SEQ ID NO: 2907470 - RNA, 17 nt, Mycobacterium avium subsp. paratuberculosis
cgggaccgaugccgcug

SEQ ID NO: 2907471 - RNA, 18 nt, Mycobacterium avium subsp. paratuberculosis
cgggaccgaugccgcuga

SEQ ID NO: 2907472 - RNA, 16 nt, Mycobacterium avium subsp. paratuberculosis
cgggaccgcacgccgg

SEQ ID NO: 2907473 - RNA, 13 nt, Mycobacterium avium subsp. paratuberculosis
cgggaccgcgggc

SEQ ID NO: 2907474 - RNA, 16 nt, Mycobacterium avium subsp. paratuberculosis
cgggaccgcgggcgca

SEQ ID NO: 2907475 - RNA, 20 nt, Mycobacterium avium subsp. paratuberculosis
cgggaccgcgggcgcauacc

SEQ ID NO: 2907476 - RNA, 14 nt, Mycobacterium avium subsp. paratuberculosis
cgggaccggcguca

SEQ ID NO: 2907477 - RNA, 18 nt, Mycobacterium avium subsp. paratuberculosis
cgggaccgggcccggcgc

SEQ ID NO: 2907478 - RNA, 19 nt, Mycobacterium avium subsp. paratuberculosis
cgggaccgucaccguggcg

SEQ ID NO: 2907479 - RNA, 19 nt, Mycobacterium avium subsp. paratuberculosis
cgggaccgucgcgcagccc

SEQ ID NO: 2907480 - RNA, 21 nt, Mycobacterium avium subsp. paratuberculosis
cgggaccgucgcgcagcccga

SEQ ID NO: 2907481 - RNA, 15 nt, Mycobacterium avium subsp. paratuberculosis
cgggaccgugcgacu

SEQ ID NO: 2907482 - RNA, 23 nt, Mycobacterium avium subsp. paratuberculosis
cgggaccugcugcucgucgcggg

SEQ ID NO: 2907483 - RNA, 21 nt, Mycobacterium avium subsp. paratuberculosis
cgggaccugggucugcggccg

SEQ ID NO: 2907484 - RNA, 22 nt, Mycobacterium avium subsp. paratuberculosis
cgggaccugggucugcggccgg

SEQ ID NO: 2907485 - RNA, 22 nt, Mycobacterium avium subsp. paratuberculosis
cgggacgaaggugcgcacgaac

SEQ ID NO: 2907486 - RNA, 14 nt, Mycobacterium avium subsp. paratuberculosis
cgggacgacggcgc

SEQ ID NO: 2907487 - RNA, 16 nt, Mycobacterium avium subsp. paratuberculosis
cgggacgacggcgccg

SEQ ID NO: 2907488 - RNA, 15 nt, Mycobacterium avium subsp. paratuberculosis
cgggauauucgccca

SEQ ID NO: 2907489 - RNA, 20 nt, Mycobacterium avium subsp. paratuberculosis
cgggauauucgcccagcggc

SEQ ID NO: 2907490 - RNA, 18 nt, Mycobacterium avium subsp. paratuberculosis
cgggaucagccguaccga

SEQ ID NO: 2907491 - RNA, 23 nt, Mycobacterium avium subsp. paratuberculosis
cgggaucagguagaggcugucca

SEQ ID NO: 2907492 - RNA, 21 nt, Mycobacterium avium subsp. paratuberculosis
cgggauccaggaacggcaccc

SEQ ID NO: 2907493 - RNA, 22 nt, Mycobacterium avium subsp. paratuberculosis
cgggauccaggaauucgggcac

SEQ ID NO: 2907494 - RNA, 15 nt, Mycobacterium avium subsp. paratuberculosis
cgggaucccgcagcc

SEQ ID NO: 2907495 - RNA, 17 nt, Mycobacterium avium subsp. paratuberculosis
cgggaucccgcagccgc

SEQ ID NO: 2907496 - RNA, 18 nt, Mycobacterium avium subsp. paratuberculosis
cgggaucccgcagccgcg

SEQ ID NO: 2907497 - RNA, 19 nt, Mycobacterium avium subsp. paratuberculosis
cgggaucccgcagccgcga

SEQ ID NO: 2907498 - RNA, 20 nt, Mycobacterium avium subsp. paratuberculosis
cgggaucccgcagccgcgac

SEQ ID NO: 2907499 - RNA, 21 nt, Mycobacterium avium subsp. paratuberculosis
cgggaucccgcagccgcgacg

SEQ ID NO: 2907500 - RNA, 14 nt, Mycobacterium avium subsp. paratuberculosis
cgggauccgaggcg

SEQ ID NO: 2907501 - RNA, 15 nt, Mycobacterium avium subsp. paratuberculosis
cgggauccgaggcgu

SEQ ID NO: 2907502 - RNA, 14 nt, Mycobacterium avium subsp. paratuberculosis
cgggauccggcgcg

SEQ ID NO: 2907503 - RNA, 15 nt, Mycobacterium avium subsp. paratuberculosis
cgggauccggcgcgc

SEQ ID NO: 2907504 - RNA, 18 nt, Mycobacterium avium subsp. paratuberculosis
cgggauccggcgcgccgc

SEQ ID NO: 2907505 - RNA, 15 nt, Mycobacterium avium subsp. paratuberculosis
cgggauccucgccgc

SEQ ID NO: 2907506 - RNA, 21 nt, Mycobacterium avium subsp. paratuberculosis
cgggauccucgccgcgggcca

SEQ ID NO: 2907507 - RNA, 22 nt, Mycobacterium avium subsp. paratuberculosis
cgggauccucgccgcgggccag

SEQ ID NO: 2907508 - RNA, 17 nt, Mycobacterium avium subsp. paratuberculosis
cgggaucgaucccgucg

SEQ ID NO: 2907509 - RNA, 13 nt, Mycobacterium avium subsp. paratuberculosis
cgggaucgccgaa

SEQ ID NO: 2907510 - RNA, 14 nt, Mycobacterium avium subsp. paratuberculosis
cgggaucgccgaag

SEQ ID NO: 2907511 - RNA, 14 nt, Mycobacterium avium subsp. paratuberculosis
cgggaucgcggcgg

SEQ ID NO: 2907512 - RNA, 16 nt, Mycobacterium avium subsp. paratuberculosis
cgggaucgcggcgguc

SEQ ID NO: 2907513 - RNA, 17 nt, Mycobacterium avium subsp. paratuberculosis
cgggaucgcggcgguca

SEQ ID NO: 2907514 - RNA, 15 nt, Mycobacterium avium subsp. paratuberculosis
cgggaucggaccgca

SEQ ID NO: 2907515 - RNA, 16 nt, Mycobacterium avium subsp. paratuberculosis
cgggaucggaccgcac

SEQ ID NO: 2907516 - RNA, 20 nt, Mycobacterium avium subsp. paratuberculosis
cggcggugcgucgggcgccg

SEQ ID NO: 2907517 - RNA, 22 nt, Mycobacterium avium subsp. paratuberculosis
cggcggugcgucgggcgccggc

SEQ ID NO: 2907518 - RNA, 16 nt, Mycobacterium avium subsp. paratuberculosis
cggcggugcucgcgcc

SEQ ID NO: 2907519 - RNA, 17 nt, Mycobacterium avium subsp. paratuberculosis
cggcggugcucgcgccg

SEQ ID NO: 2907520 - RNA, 21 nt, Mycobacterium avium subsp. paratuberculosis
cggcggugcucgcgccgggcg

SEQ ID NO: 2907521 - RNA, 19 nt, Mycobacterium avium subsp. paratuberculosis
cggcggugcucucgucguc

SEQ ID NO: 2907522 - RNA, 20 nt, Mycobacterium avium subsp. paratuberculosis
cggcggugcucucgucgucg

SEQ ID NO: 2907523 - RNA, 22 nt, Mycobacterium avium subsp. paratuberculosis
cggcggugcucucgucgucggc

SEQ ID NO: 2907524 - RNA, 22 nt, Mycobacterium avium subsp. paratuberculosis
cggcgguggccuggucgaacag

SEQ ID NO: 2907525 - RNA, 23 nt, Mycobacterium avium subsp. paratuberculosis
cggcgguggccuggucgaacagc

SEQ ID NO: 2907526 - RNA, 15 nt, Mycobacterium avium subsp. paratuberculosis
cggcgguggcgauga

SEQ ID NO: 2907527 - RNA, 14 nt, Mycobacterium avium subsp. paratuberculosis
cggcggugggcgca

SEQ ID NO: 2907528 - RNA, 16 nt, Mycobacterium avium subsp. paratuberculosis
cggcggugggcucggc

SEQ ID NO: 2907529 - RNA, 18 nt, Mycobacterium avium subsp. paratuberculosis
cggcggugggcucggcca

SEQ ID NO: 2907530 - RNA, 16 nt, Mycobacterium avium subsp. paratuberculosis
cggcggugggcugggc

SEQ ID NO: 2907531 - RNA, 23 nt, Mycobacterium avium subsp. paratuberculosis
cggcggugggcugggcgaagccg

SEQ ID NO: 2907532 - RNA, 20 nt, Mycobacterium avium subsp. paratuberculosis
cggcggugguccgcgcgacc

SEQ ID NO: 2907533 - RNA, 21 nt, Mycobacterium avium subsp. paratuberculosis
cggcggugguccgcgcgacca

SEQ ID NO: 2907534 - RNA, 17 nt, Mycobacterium avium subsp. paratuberculosis
cggcgguggugccgccg

SEQ ID NO: 2907535 - RNA, 20 nt, Mycobacterium avium subsp. paratuberculosis
cggcgguggugccgccgucg

SEQ ID NO: 2907536 - RNA, 22 nt, Mycobacterium avium subsp. paratuberculosis
cggcggugguuaccagcucacc

SEQ ID NO: 2907537 - RNA, 19 nt, Mycobacterium avium subsp. paratuberculosis
cggcgguguccacgaugcg

SEQ ID NO: 2907538 - RNA, 15 nt, Mycobacterium avium subsp. paratuberculosis
cggcggugucgaagg

SEQ ID NO: 2907539 - RNA, 17 nt, Mycobacterium avium subsp. paratuberculosis
cggcggugucgcccagc

SEQ ID NO: 2907540 - RNA, 18 nt, Mycobacterium avium subsp. paratuberculosis
cggcggugucgcccagcu

SEQ ID NO: 2907541 - RNA, 19 nt, Mycobacterium avium subsp. paratuberculosis
cggcggugucgcccagcug

SEQ ID NO: 2907542 - RNA, 20 nt, Mycobacterium avium subsp. paratuberculosis
cggcggugucgcccagcugg

SEQ ID NO: 2907543 - RNA, 13 nt, Mycobacterium avium subsp. paratuberculosis
cggcggugucggc

SEQ ID NO: 2907544 - RNA, 15 nt, Mycobacterium avium subsp. paratuberculosis
cggcggugucggcgc

SEQ ID NO: 2907545 - RNA, 16 nt, Mycobacterium avium subsp. paratuberculosis
cggcggugucggcgcc

SEQ ID NO: 2907546 - RNA, 14 nt, Mycobacterium avium subsp. paratuberculosis
cggcggugucggug

SEQ ID NO: 2907547 - RNA, 15 nt, Mycobacterium avium subsp. paratuberculosis
cggcggugucggugc

SEQ ID NO: 2907548 - RNA, 18 nt, Mycobacterium avium subsp. paratuberculosis
cggcggugucggugccga

SEQ ID NO: 2907549 - RNA, 22 nt, Mycobacterium avium subsp. paratuberculosis
cggcggugucggugccgagcac

SEQ ID NO: 2907550 - RNA, 19 nt, Mycobacterium avium subsp. paratuberculosis
cggcgguucgaagcgcagc

SEQ ID NO: 2907551 - RNA, 21 nt, Mycobacterium avium subsp. paratuberculosis
cggcgguucgaagcgcagcgu

SEQ ID NO: 2907552 - RNA, 16 nt, Mycobacterium avium subsp. paratuberculosis
cggcgguucgauaccg

SEQ ID NO: 2907553 - RNA, 23 nt, Mycobacterium avium subsp. paratuberculosis
cggcgguucgauaccguccgcgc

SEQ ID NO: 2907554 - RNA, 17 nt, Mycobacterium avium subsp. paratuberculosis
cggcgguugcucgucgg

SEQ ID NO: 2907555 - RNA, 19 nt, Mycobacterium avium subsp. paratuberculosis
cggcgguugcucgucggcc

SEQ ID NO: 2907556 - RNA, 20 nt, Mycobacterium avium subsp. paratuberculosis
cggcgguugcucgucggccg

SEQ ID NO: 2907557 - RNA, 22 nt, Mycobacterium avium subsp. paratuberculosis
cggcgguugcucgucggccgac

SEQ ID NO: 2907558 - RNA, 18 nt, Mycobacterium avium subsp. paratuberculosis
cggcgguuucggugccgg

SEQ ID NO: 2907559 - RNA, 22 nt, Mycobacterium avium subsp. paratuberculosis
cggcgguuucggugccggccca

SEQ ID NO: 2907560 - RNA, 17 nt, Mycobacterium avium subsp. paratuberculosis
cggcgguuuuggucggc

SEQ ID NO: 2907561 - RNA, 18 nt, Mycobacterium avium subsp. paratuberculosis
cggcgguuuuggucggca

SEQ ID NO: 2907562 - RNA, 20 nt, Mycobacterium avium subsp. paratuberculosis
cggcgguuuuggucggcacc

SEQ ID NO: 2907563 - RNA, 21 nt, Mycobacterium avium subsp. paratuberculosis
cggcgguuuuggucggcaccu

SEQ ID NO: 2907564 - RNA, 21 nt, Mycobacterium avium subsp. paratuberculosis
cggcguacagcaauccgcuga

SEQ ID NO: 2907565 - RNA, 13 nt, Mycobacterium avium subsp. paratuberculosis
cggcguacagccc

SEQ ID NO: 2907566 - RNA, 17 nt, Mycobacterium avium subsp. paratuberculosis
cggcguacaggccgucg

SEQ ID NO: 2907567 - RNA, 13 nt, Mycobacterium avium subsp. paratuberculosis
cggcguacccgcc

SEQ ID NO: 2907568 - RNA, 18 nt, Mycobacterium avium subsp. paratuberculosis
cggcguacccgcccaugc

SEQ ID NO: 2907569 - RNA, 22 nt, Mycobacterium avium subsp. paratuberculosis
cggcguacccgcccaugcacga

SEQ ID NO: 2907570 - RNA, 13 nt, Mycobacterium avium subsp. paratuberculosis
cggcguaccgcgg

SEQ ID NO: 2907571 - RNA, 16 nt, Mycobacterium avium subsp. paratuberculosis
cggcguaccgcggcgg

SEQ ID NO: 2907572 - RNA, 17 nt, Mycobacterium avium subsp. paratuberculosis
cggcguaccgcggcggc

SEQ ID NO: 2907573 - RNA, 18 nt, Mycobacterium avium subsp. paratuberculosis
cggcguacgacaucucga

SEQ ID NO: 2907574 - RNA, 21 nt, Mycobacterium avium subsp. paratuberculosis
cggcguacgacaucucgacgg

SEQ ID NO: 2907575 - RNA, 14 nt, Mycobacterium avium subsp. paratuberculosis
cggcguacgcgaug

SEQ ID NO: 2907576 - RNA, 16 nt, Mycobacterium avium subsp. paratuberculosis
cggcguccgugccguc

SEQ ID NO: 2907577 - RNA, 20 nt, Mycobacterium avium subsp. paratuberculosis
cggcguccucgaccacccgc

SEQ ID NO: 2907578 - RNA, 23 nt, Mycobacterium avium subsp. paratuberculosis
cggcguccucgaccacccgcugg

SEQ ID NO: 2907579 - RNA, 14 nt, Mycobacterium avium subsp. paratuberculosis
cggcguccucgacg

SEQ ID NO: 2907580 - RNA, 16 nt, Mycobacterium avium subsp. paratuberculosis
cggcguccucgacgcc

SEQ ID NO: 2907581 - RNA, 20 nt, Mycobacterium avium subsp. paratuberculosis
cggcguccucgacgccgcgc

SEQ ID NO: 2907582 - RNA, 17 nt, Mycobacterium avium subsp. paratuberculosis
cggcguccucgaugacg

SEQ ID NO: 2907583 - RNA, 18 nt, Mycobacterium avium subsp. paratuberculosis
cggcguccugcagcagcc

SEQ ID NO: 2907584 - RNA, 20 nt, Mycobacterium avium subsp. paratuberculosis
cggcguccugcagcagccgg

SEQ ID NO: 2907585 - RNA, 22 nt, Mycobacterium avium subsp. paratuberculosis
cggcguccugcagcagccggac

SEQ ID NO: 2907586 - RNA, 23 nt, Mycobacterium avium subsp. paratuberculosis
cggcguccugcagcagccggacc

SEQ ID NO: 2907587 - RNA, 17 nt, Mycobacterium avium subsp. paratuberculosis
cggcguccuugcccgag

SEQ ID NO: 2907588 - RNA, 20 nt, Mycobacterium avium subsp. paratuberculosis
cggcguccuugcccgagguc

SEQ ID NO: 2907589 - RNA, 21 nt, Mycobacterium avium subsp. paratuberculosis
cggcguccuugcccgagguca

SEQ ID NO: 2907590 - RNA, 21 nt, Mycobacterium avium subsp. paratuberculosis
cggcgucgaaauagcggcgca

SEQ ID NO: 2907591 - RNA, 22 nt, Mycobacterium avium subsp. paratuberculosis
cggcgucgaaauagcggcgcac

SEQ ID NO: 2907592 - RNA, 22 nt, Mycobacterium avium subsp. paratuberculosis
cggcgucgaaauccacgaugcc

SEQ ID NO: 2907593 - RNA, 18 nt, Mycobacterium avium subsp. paratuberculosis
cggcgucgaacggcgucu

SEQ ID NO: 2907594 - RNA, 19 nt, Mycobacterium avium subsp. paratuberculosis
cggcgucgaacggcgucug

SEQ ID NO: 2907595 - RNA, 17 nt, Mycobacterium avium subsp. paratuberculosis
cggcgucgaagcgcaug

SEQ ID NO: 2907596 - RNA, 20 nt, Mycobacterium avium subsp. paratuberculosis
cggcgucgaagcgcaugccg

SEQ ID NO: 2907597 - RNA, 12 nt, Mycobacterium avium subsp. paratuberculosis
cggcgucgacag

SEQ ID NO: 2907598 - RNA, 17 nt, Mycobacterium avium subsp. paratuberculosis
cggcgucgaccgccccg

SEQ ID NO: 2907599 - RNA, 18 nt, Mycobacterium avium subsp. paratuberculosis
cggcgucgaccgccccgc

SEQ ID NO: 2907600 - RNA, 12 nt, Mycobacterium avium subsp. paratuberculosis
cggcgucgacga

SEQ ID NO: 2907601 - RNA, 14 nt, Mycobacterium avium subsp. paratuberculosis
cggcgucgacgacg

SEQ ID NO: 2907602 - RNA, 18 nt, Mycobacterium avium subsp. paratuberculosis
cggcgucgacgacggcgc

SEQ ID NO: 2907603 - RNA, 20 nt, Mycobacterium avium subsp. paratuberculosis
cggcgucgacgacggcgccg

SEQ ID NO: 2907604 - RNA, 15 nt, Mycobacterium avium subsp. paratuberculosis
cggcgucgacgucgg

SEQ ID NO: 2907605 - RNA, 16 nt, Mycobacterium avium subsp. paratuberculosis
cggcgucgacgucggg

SEQ ID NO: 2907606 - RNA, 14 nt, Mycobacterium avium subsp. paratuberculosis
cggcgucgagcacc

SEQ ID NO: 2907607 - RNA, 15 nt, Mycobacterium avium subsp. paratuberculosis
cggcgucgagcaccu

SEQ ID NO: 2907608 - RNA, 16 nt, Mycobacterium avium subsp. paratuberculosis
cggcgucgagcaccuc

SEQ ID NO: 2907609 - RNA, 15 nt, Mycobacterium avium subsp. paratuberculosis
cggcgucgaguucgc

SEQ ID NO: 2907610 - RNA, 21 nt, Mycobacterium avium subsp. paratuberculosis
cggcgucgaguucgccgucga

SEQ ID NO: 2907611 - RNA, 14 nt, Mycobacterium avium subsp. paratuberculosis
cggcgucgaucgcc

SEQ ID NO: 2907612 - RNA, 18 nt, Mycobacterium avium subsp. paratuberculosis
cggcgucgaucgccguca

SEQ ID NO: 2907613 - RNA, 17 nt, Mycobacterium avium subsp. paratuberculosis
cggcgucgaugaccucg

SEQ ID NO: 2907614 - RNA, 19 nt, Mycobacterium avium subsp. paratuberculosis
cggcgucgaugaccucgcg

SEQ ID NO: 2907615 - RNA, 20 nt, Mycobacterium avium subsp. paratuberculosis
cggcgucgaugaccucgcgc

SEQ ID NO: 2907616 - RNA, 22 nt, Mycobacterium avium subsp. paratuberculosis
cggcgucgaugaccucgcgcag

SEQ ID NO: 2907617 - RNA, 23 nt, Mycobacterium avium subsp. paratuberculosis
cggcgucgaugaccucgcgcagc

SEQ ID NO: 2907618 - RNA, 21 nt, Mycobacterium avium subsp. paratuberculosis
cggcgucgaugaugccggcgg

SEQ ID NO: 2907619 - RNA, 23 nt, Mycobacterium avium subsp. paratuberculosis
cggcgucgaugaugccggcggac

SEQ ID NO: 2907620 - RNA, 20 nt, Mycobacterium avium subsp. paratuberculosis
cggcgucgaugucgcccggc

SEQ ID NO: 2907621 - RNA, 23 nt, Mycobacterium avium subsp. paratuberculosis
cggcgucgaugucgcccggcgcg

SEQ ID NO: 2907622 - RNA, 18 nt, Mycobacterium avium subsp. paratuberculosis
cggcgucgaugucgucgu

SEQ ID NO: 2907623 - RNA, 21 nt, Mycobacterium avium subsp. paratuberculosis
cggcgucgaugucgucgucga

SEQ ID NO: 2907624 - RNA, 15 nt, Mycobacterium avium subsp. paratuberculosis
cggcgucgcacgugg

SEQ ID NO: 2907625 - RNA, 18 nt, Mycobacterium avium subsp. paratuberculosis
cggcgucgcacguggugu

SEQ ID NO: 2907626 - RNA, 14 nt, Mycobacterium avium subsp. paratuberculosis
cggcgucgccgagc

SEQ ID NO: 2907627 - RNA, 16 nt, Mycobacterium avium subsp. paratuberculosis
cggcgucgccgagccg

SEQ ID NO: 2907628 - RNA, 17 nt, Mycobacterium avium subsp. paratuberculosis
cggcgucgccgagccgc

SEQ ID NO: 2907629 - RNA, 16 nt, Mycobacterium avium subsp. paratuberculosis
cggcgucgccgagcuc

SEQ ID NO: 2907630 - RNA, 12 nt, Mycobacterium avium subsp. paratuberculosis
cggcgucgccgc

SEQ ID NO: 2907631 - RNA, 15 nt, Mycobacterium avium subsp. paratuberculosis
cggcgucgccgcucu

SEQ ID NO: 2907632 - RNA, 15 nt, Mycobacterium avium subsp. paratuberculosis
cggcgucgccgcugg

SEQ ID NO: 2907633 - RNA, 16 nt, Mycobacterium avium subsp. paratuberculosis
cggcgucgccgcuggu

SEQ ID NO: 2907634 - RNA, 17 nt, Mycobacterium avium subsp. paratuberculosis
cggcgucgcggcgcacc

SEQ ID NO: 2907635 - RNA, 22 nt, Mycobacterium avium subsp. paratuberculosis
cggcgucgcucauguugugcag

SEQ ID NO: 2907636 - RNA, 17 nt, Mycobacterium avium subsp. paratuberculosis
cggcgucgcugaacgcg

SEQ ID NO: 2907637 - RNA, 21 nt, Mycobacterium avium subsp. paratuberculosis
cggcgucggagaugcgggcca

SEQ ID NO: 2907638 - RNA, 14 nt, Mycobacterium avium subsp. paratuberculosis
cggcgucggaggcg

SEQ ID NO: 2907639 - RNA, 17 nt, Mycobacterium avium subsp. paratuberculosis
cggcgucggaggcggcg

SEQ ID NO: 2907640 - RNA, 19 nt, Mycobacterium avium subsp. paratuberculosis
cggcgucggaggcggcgua

SEQ ID NO: 2907641 - RNA, 15 nt, Mycobacterium avium subsp. paratuberculosis
cggcgucggagucgc

SEQ ID NO: 2907642 - RNA, 22 nt, Mycobacterium avium subsp. paratuberculosis
cggcgucggagucgcuguuggc

SEQ ID NO: 2907643 - RNA, 14 nt, Mycobacterium avium subsp. paratuberculosis
cggcgucggccacc

SEQ ID NO: 2907644 - RNA, 16 nt, Mycobacterium avium subsp. paratuberculosis
cggcgucggccaccgc

SEQ ID NO: 2907645 - RNA, 19 nt, Mycobacterium avium subsp. paratuberculosis
cggcgucggccaccgcgcc

SEQ ID NO: 2907646 - RNA, 18 nt, Mycobacterium avium subsp. paratuberculosis
cggcgucggccgggcugc

SEQ ID NO: 2907647 - RNA, 13 nt, Mycobacterium avium subsp. paratuberculosis
cggcgucggcgac

SEQ ID NO: 2907648 - RNA, 14 nt, Mycobacterium avium subsp. paratuberculosis
cggcgucggcgacg

SEQ ID NO: 2907649 - RNA, 15 nt, Mycobacterium avium subsp. paratuberculosis
cggcgucggcgacgg

SEQ ID NO: 2907650 - RNA, 15 nt, Mycobacterium avium subsp. paratuberculosis
cggcgucggcgagcg

SEQ ID NO: 2907651 - RNA, 24 nt, Mycobacterium avium subsp. paratuberculosis
cggcgucggcgaucucggucaccg

SEQ ID NO: 2907652 - RNA, 16 nt, Mycobacterium avium subsp. paratuberculosis
cggcgucggcggccug

SEQ ID NO: 2907653 - RNA, 20 nt, Mycobacterium avium subsp. paratuberculosis
cggcgucggcguagggcagc

SEQ ID NO: 2907654 - RNA, 22 nt, Mycobacterium avium subsp. paratuberculosis
cggcgucggcguagggcagccc

SEQ ID NO: 2907655 - RNA, 14 nt, Mycobacterium avium subsp. paratuberculosis
cggcgucggcgucg

SEQ ID NO: 2907656 - RNA, 17 nt, Mycobacterium avium subsp. paratuberculosis
cggcgucggcgucgggc

SEQ ID NO: 2907657 - RNA, 14 nt, Mycobacterium avium subsp. paratuberculosis
cggcgucgggaccg

SEQ ID NO: 2907658 - RNA, 21 nt, Mycobacterium avium subsp. paratuberculosis
cggcgucgggaccgucgcgca

SEQ ID NO: 2907659 - RNA, 14 nt, Mycobacterium avium subsp. paratuberculosis
cggcgucgggaugg

SEQ ID NO: 2907660 - RNA, 20 nt, Mycobacterium avium subsp. paratuberculosis
cggcgucgggauggucgauc

SEQ ID NO: 2907661 - RNA, 21 nt, Mycobacterium avium subsp. paratuberculosis
cggcgucgggccgggggcggc

SEQ ID NO: 2907662 - RNA, 22 nt, Mycobacterium avium subsp. paratuberculosis
cggcgucgggccgggggcggcg

SEQ ID NO: 2907663 - RNA, 23 nt, Mycobacterium avium subsp. paratuberculosis
cggcgucgggccgggggcggcgg

SEQ ID NO: 2907664 - RNA, 13 nt, Mycobacterium avium subsp. paratuberculosis
cggcgucgggcgg

SEQ ID NO: 2907665 - RNA, 14 nt, Mycobacterium avium subsp. paratuberculosis
cggcgucgggcggg

SEQ ID NO: 2907666 - RNA, 20 nt, Mycobacterium avium subsp. paratuberculosis
cggcgucggggggucagacc

SEQ ID NO: 2907667 - RNA, 20 nt, Mycobacterium avium subsp. paratuberculosis
cggcgucggguagggcgccg

SEQ ID NO: 2907668 - RNA, 21 nt, Mycobacterium avium subsp. paratuberculosis
cggcgucggguagggcgccgu

SEQ ID NO: 2907669 - RNA, 19 nt, Mycobacterium avium subsp. paratuberculosis
cggcgucggugucccgcgc

SEQ ID NO: 2907670 - RNA, 15 nt, Mycobacterium avium subsp. paratuberculosis
cggcgucguacagca

SEQ ID NO: 2907671 - RNA, 16 nt, Mycobacterium avium subsp. paratuberculosis
cggcgucguagacgcu

SEQ ID NO: 2907672 - RNA, 17 nt, Mycobacterium avium subsp. paratuberculosis
cggcgucguagacgcug

SEQ ID NO: 2907673 - RNA, 18 nt, Mycobacterium avium subsp. paratuberculosis
cggcgucguagacgcugc

SEQ ID NO: 2907674 - RNA, 21 nt, Mycobacterium avium subsp. paratuberculosis
cggcgucguagacgcugccgc

SEQ ID NO: 2907675 - RNA, 23 nt, Mycobacterium avium subsp. paratuberculosis
cggcgucguagacgcugccgcug

SEQ ID NO: 2907676 - RNA, 20 nt, Mycobacterium avium subsp. paratuberculosis
cggcgucguaguugcggccg

SEQ ID NO: 2907677 - RNA, 16 nt, Mycobacterium avium subsp. paratuberculosis
cggcgucgucgagcac

SEQ ID NO: 2907678 - RNA, 19 nt, Mycobacterium avium subsp. paratuberculosis
cggcgucgucgagcaccgg

SEQ ID NO: 2907679 - RNA, 23 nt, Mycobacterium avium subsp. paratuberculosis
cggcgucgucgagcaccggcagc

SEQ ID NO: 2907680 - RNA, 17 nt, Mycobacterium avium subsp. paratuberculosis
cggcgucgucgccgugg

SEQ ID NO: 2907681 - RNA, 18 nt, Mycobacterium avium subsp. paratuberculosis
cggcgucgucgccguggc

SEQ ID NO: 2907682 - RNA, 15 nt, Mycobacterium avium subsp. paratuberculosis
cggcgucgucgucga

SEQ ID NO: 2907683 - RNA, 22 nt, Mycobacterium avium subsp. paratuberculosis
cggcgucgucgucgagaagacc

SEQ ID NO: 2907684 - RNA, 16 nt, Mycobacterium avium subsp. paratuberculosis
cggcgucgucgucgca

SEQ ID NO: 2907685 - RNA, 21 nt, Mycobacterium avium subsp. paratuberculosis
cggcgucgucuuggccugcug

SEQ ID NO: 2907686 - RNA, 20 nt, Mycobacterium avium subsp. paratuberculosis
cggcgucguugagcaggcug

SEQ ID NO: 2907687 - RNA, 21 nt, Mycobacterium avium subsp. paratuberculosis
cggcgucguugagcaggcugg

SEQ ID NO: 2907688 - RNA, 18 nt, Mycobacterium avium subsp. paratuberculosis
cggcgucucagucggcca

SEQ ID NO: 2907689 - RNA, 19 nt, Mycobacterium avium subsp. paratuberculosis
cggcgucucagucggccac

SEQ ID NO: 2907690 - RNA, 22 nt, Mycobacterium avium subsp. paratuberculosis
cggcgucucagucggccaccgc

SEQ ID NO: 2907691 - RNA, 23 nt, Mycobacterium avium subsp. paratuberculosis
cggcgucucagucggccaccgcg

SEQ ID NO: 2907692 - RNA, 15 nt, Mycobacterium avium subsp. paratuberculosis
cggcgucucggcccg

SEQ ID NO: 2907693 - RNA, 17 nt, Mycobacterium avium subsp. paratuberculosis
cggcgucucggcccgag

SEQ ID NO: 2907694 - RNA, 14 nt, Mycobacterium avium subsp. paratuberculosis
cggcgucucggcgu

SEQ ID NO: 2907695 - RNA, 15 nt, Mycobacterium avium subsp. paratuberculosis
cggcgucucggcguc

SEQ ID NO: 2907696 - RNA, 16 nt, Mycobacterium avium subsp. paratuberculosis
cggcgucucggcgucu

SEQ ID NO: 2907697 - RNA, 17 nt, Mycobacterium avium subsp. paratuberculosis
cggcgucuggccggagc

SEQ ID NO: 2907698 - RNA, 18 nt, Mycobacterium avium subsp. paratuberculosis
cggcgucuggccggagcg

SEQ ID NO: 2907699 - RNA, 15 nt, Mycobacterium avium subsp. paratuberculosis
cggcgucuugaucuc

SEQ ID NO: 2907700 - RNA, 21 nt, Mycobacterium avium subsp. paratuberculosis
cggcgucuugaucucggcggc

SEQ ID NO: 2907701 - RNA, 22 nt, Mycobacterium avium subsp. paratuberculosis
cggcgucuugaucucggcggcg

SEQ ID NO: 2907702 - RNA, 13 nt, Mycobacterium avium subsp. paratuberculosis
cggcgucuugcug

SEQ ID NO: 2907703 - RNA, 16 nt, Mycobacterium avium subsp. paratuberculosis
cggcgucuugcugcgg

SEQ ID NO: 2907704 - RNA, 20 nt, Mycobacterium avium subsp. paratuberculosis
cggcgucuugcugcggaacc

SEQ ID NO: 2907705 - RNA, 14 nt, Mycobacterium avium subsp. paratuberculosis
cggcgucuugggga

SEQ ID NO: 2907706 - RNA, 17 nt, Mycobacterium avium subsp. paratuberculosis
cggcgucuuggggaugg

SEQ ID NO: 2907707 - RNA, 22 nt, Mycobacterium avium subsp. paratuberculosis
cggcgucuuggggauggucccc

SEQ ID NO: 2907708 - RNA, 19 nt, Mycobacterium avium subsp. paratuberculosis
cggcgugaauccucagcac

SEQ ID NO: 2907709 - RNA, 20 nt, Mycobacterium avium subsp. paratuberculosis
cggcgugaauccucagcacg

SEQ ID NO: 2907710 - RNA, 21 nt, Mycobacterium avium subsp. paratuberculosis
cggcgugaauccucagcacgg

SEQ ID NO: 2907711 - RNA, 15 nt, Mycobacterium avium subsp. paratuberculosis
cggcgugaccggcug

SEQ ID NO: 2907712 - RNA, 16 nt, Mycobacterium avium subsp. paratuberculosis
cggcgugaccgggaag

SEQ ID NO: 2907713 - RNA, 21 nt, Mycobacterium avium subsp. paratuberculosis
cggcgugagcgagccggcacg

SEQ ID NO: 2907714 - RNA, 18 nt, Mycobacterium avium subsp. paratuberculosis
cggcgugauaggccucgu

SEQ ID NO: 2907715 - RNA, 19 nt, Mycobacterium avium subsp. paratuberculosis
cggcgugauaggccucgug

SEQ ID NO: 2907716 - RNA, 21 nt, Mycobacterium avium subsp. paratuberculosis
cggcgugauaggccucgugga

SEQ ID NO: 2907717 - RNA, 22 nt, Mycobacterium avium subsp. paratuberculosis
cggcgugaucccgauccucgcc

SEQ ID NO: 2907718 - RNA, 16 nt, Mycobacterium avium subsp. paratuberculosis
cggcgugaugacggcg

SEQ ID NO: 2907719 - RNA, 17 nt, Mycobacterium avium subsp. paratuberculosis
cggcgugaugacggcgg

SEQ ID NO: 2907720 - RNA, 22 nt, Mycobacterium avium subsp. paratuberculosis
cggcgugcaacugcguggccgu

SEQ ID NO: 2907721 - RNA, 17 nt, Mycobacterium avium subsp. paratuberculosis
cggcgugcaccgcccgc

SEQ ID NO: 2907722 - RNA, 15 nt, Mycobacterium avium subsp. paratuberculosis
cggcgugcagcacgc

SEQ ID NO: 2907723 - RNA, 16 nt, Mycobacterium avium subsp. paratuberculosis
cggcgugcagcacgcc

SEQ ID NO: 2907724 - RNA, 17 nt, Mycobacterium avium subsp. paratuberculosis
cggcgugcagcacgccc

SEQ ID NO: 2907725 - RNA, 18 nt, Mycobacterium avium subsp. paratuberculosis
cggcgugcagcacgggga

SEQ ID NO: 2907726 - RNA, 12 nt, Mycobacterium avium subsp. paratuberculosis
cggcgugcagcc

SEQ ID NO: 2907727 - RNA, 13 nt, Mycobacterium avium subsp. paratuberculosis
cggcgugcagccg

SEQ ID NO: 2907728 - RNA, 14 nt, Mycobacterium avium subsp. paratuberculosis
cggcgugcagccga

SEQ ID NO: 2907729 - RNA, 22 nt, Mycobacterium avium subsp. paratuberculosis
cggcgugcaggauccgcucgac

SEQ ID NO: 2907730 - RNA, 14 nt, Mycobacterium avium subsp. paratuberculosis
cggcgugccaccgc

SEQ ID NO: 2907731 - RNA, 17 nt, Mycobacterium avium subsp. paratuberculosis
cggcgugccaccgcugg

SEQ ID NO: 2907732 - RNA, 18 nt, Mycobacterium avium subsp. paratuberculosis
cggcgugccaccgcuggg

SEQ ID NO: 2907733 - RNA, 19 nt, Mycobacterium avium subsp. paratuberculosis
cggcgugccaccgcugggc

SEQ ID NO: 2907734 - RNA, 16 nt, Mycobacterium avium subsp. paratuberculosis
cggcgugccagggcag

SEQ ID NO: 2907735 - RNA, 20 nt, Mycobacterium avium subsp. paratuberculosis
cggcgugccagggcagcgcg

SEQ ID NO: 2907736 - RNA, 24 nt, Mycobacterium avium subsp. paratuberculosis
cggcgugccagggcagcgcgacca

SEQ ID NO: 2907737 - RNA, 16 nt, Mycobacterium avium subsp. paratuberculosis
cggcgugcccgccgaa

SEQ ID NO: 2907738 - RNA, 14 nt, Mycobacterium avium subsp. paratuberculosis
cggcgugcccgcuc

SEQ ID NO: 2907739 - RNA, 16 nt, Mycobacterium avium subsp. paratuberculosis
cggcgugcccgcucgc

SEQ ID NO: 2907740 - RNA, 12 nt, Mycobacterium avium subsp. paratuberculosis
cggcgugccgcc

SEQ ID NO: 2907741 - RNA, 13 nt, Mycobacterium avium subsp. paratuberculosis
cggcgugccggac

SEQ ID NO: 2907742 - RNA, 12 nt, Mycobacterium avium subsp. paratuberculosis
cggcgugcgcca

SEQ ID NO: 2907743 - RNA, 17 nt, Mycobacterium avium subsp. paratuberculosis
cggcgugcuccagcagg

SEQ ID NO: 2907744 - RNA, 24 nt, Mycobacterium avium subsp. paratuberculosis
cggcgugcuccagcaggcgcgccg

SEQ ID NO: 2907745 - RNA, 13 nt, Mycobacterium avium subsp. paratuberculosis
cggcgugcucggc

SEQ ID NO: 2907746 - RNA, 13 nt, Mycobacterium avium subsp. paratuberculosis
cggcgugcugggc

SEQ ID NO: 2907747 - RNA, 14 nt, Mycobacterium avium subsp. paratuberculosis
cggcguggaacacg

SEQ ID NO: 2907748 - RNA, 20 nt, Mycobacterium avium subsp. paratuberculosis
cggcguggaacacgcccagc

SEQ ID NO: 2907749 - RNA, 21 nt, Mycobacterium avium subsp. paratuberculosis
cggcguggaacacgcccagcg

SEQ ID NO: 2907750 - RNA, 13 nt, Mycobacterium avium subsp. paratuberculosis
cggcguggcaggc

SEQ ID NO: 2907751 - RNA, 15 nt, Mycobacterium avium subsp. paratuberculosis
cggcguggcaggcga

SEQ ID NO: 2907752 - RNA, 20 nt, Mycobacterium avium subsp. paratuberculosis
cggcguggcaggcgauggcg

SEQ ID NO: 2907753 - RNA, 20 nt, Mycobacterium avium subsp. paratuberculosis
cggcguggcgguggcggcga

SEQ ID NO: 2907754 - RNA, 20 nt, Mycobacterium avium subsp. paratuberculosis
cggcguggcugaggccgccc

SEQ ID NO: 2907755 - RNA, 21 nt, Mycobacterium avium subsp. paratuberculosis
cggcguggcugaggccgcccc

SEQ ID NO: 2907756 - RNA, 23 nt, Mycobacterium avium subsp. paratuberculosis
cggcguggcugaggccgccccgg

SEQ ID NO: 2907757 - RNA, 15 nt, Mycobacterium avium subsp. paratuberculosis
cggcgugggccgcag

SEQ ID NO: 2907758 - RNA, 16 nt, Mycobacterium avium subsp. paratuberculosis
cggcgugggccgcagc

SEQ ID NO: 2907759 - RNA, 22 nt, Mycobacterium avium subsp. paratuberculosis
cggcgugggccgcagcgcggcg

SEQ ID NO: 2907760 - RNA, 23 nt, Mycobacterium avium subsp. paratuberculosis
cggcgugggccgcagcgcggcga

SEQ ID NO: 2907761 - RNA, 22 nt, Mycobacterium avium subsp. paratuberculosis
cggcgugggguucccggccggu

SEQ ID NO: 2907762 - RNA, 18 nt, Mycobacterium avium subsp. paratuberculosis
cggcgugguagccgccgu

SEQ ID NO: 2907763 - RNA, 14 nt, Mycobacterium avium subsp. paratuberculosis
cggcguggucgagg

SEQ ID NO: 2907764 - RNA, 16 nt, Mycobacterium avium subsp. paratuberculosis
cggcguggucggcgaa

SEQ ID NO: 2907765 - RNA, 17 nt, Mycobacterium avium subsp. paratuberculosis
cggcguggucggcgaag

SEQ ID NO: 2907766 - RNA, 18 nt, Mycobacterium avium subsp. paratuberculosis
cggcguggucggcgaagc

SEQ ID NO: 2907767 - RNA, 20 nt, Mycobacterium avium subsp. paratuberculosis
cggcguguagccguaacgau

SEQ ID NO: 2907768 - RNA, 16 nt, Mycobacterium avium subsp. paratuberculosis
cggcguguaguacugc

SEQ ID NO: 2907769 - RNA, 21 nt, Mycobacterium avium subsp. paratuberculosis
cggcguguaguacugcucgac

SEQ ID NO: 2907770 - RNA, 15 nt, Mycobacterium avium subsp. paratuberculosis
cggcgugucgcgugc

SEQ ID NO: 2907771 - RNA, 16 nt, Mycobacterium avium subsp. paratuberculosis
cggcgugucggcgcca

SEQ ID NO: 2907772 - RNA, 14 nt, Mycobacterium avium subsp. paratuberculosis
cggcgugucgggug

SEQ ID NO: 2907773 - RNA, 15 nt, Mycobacterium avium subsp. paratuberculosis
cggcgugucgggugc

SEQ ID NO: 2907774 - RNA, 22 nt, Mycobacterium avium subsp. paratuberculosis
cggcguguuccuugcggccgcc

SEQ ID NO: 2907775 - RNA, 23 nt, Mycobacterium avium subsp. paratuberculosis
cggcguguuccuugcggccgccg

SEQ ID NO: 2907776 - RNA, 24 nt, Mycobacterium avium subsp. paratuberculosis
cggcguguuccuugcggccgccga

SEQ ID NO: 2907777 - RNA, 22 nt, Mycobacterium avium subsp. paratuberculosis
cggcguuacccgaacccagcgc

SEQ ID NO: 2907778 - RNA, 18 nt, Mycobacterium avium subsp. paratuberculosis
cggcguuauuugugcgcu

SEQ ID NO: 2907779 - RNA, 19 nt, Mycobacterium avium subsp. paratuberculosis
cggcguucagcagcgcggu

SEQ ID NO: 2907780 - RNA, 17 nt, Mycobacterium avium subsp. paratuberculosis
cggcguucagccggagc

SEQ ID NO: 2907781 - RNA, 23 nt, Mycobacterium avium subsp. paratuberculosis
cggcguucagccggagccggccu

SEQ ID NO: 2907782 - RNA, 22 nt, Mycobacterium avium subsp. paratuberculosis
cggcguucagcggcaccgucac

SEQ ID NO: 2907783 - RNA, 14 nt, Mycobacterium avium subsp. paratuberculosis
cggcguucaucgug

SEQ ID NO: 2907784 - RNA, 17 nt, Mycobacterium avium subsp. paratuberculosis
cggcguucaucgugccg

SEQ ID NO: 2907785 - RNA, 18 nt, Mycobacterium avium subsp. paratuberculosis
cggcguucaucgugccga

SEQ ID NO: 2907786 - RNA, 15 nt, Mycobacterium avium subsp. paratuberculosis
cggcguuccagcgca

SEQ ID NO: 2907787 - RNA, 21 nt, Mycobacterium avium subsp. paratuberculosis
cggcguucggugcccgggguc

SEQ ID NO: 2907788 - RNA, 20 nt, Mycobacterium avium subsp. paratuberculosis
cggcguugaccaacgccgcc

SEQ ID NO: 2907789 - RNA, 21 nt, Mycobacterium avium subsp. paratuberculosis
cggcguugaccgggccgcugg

SEQ ID NO: 2907790 - RNA, 20 nt, Mycobacterium avium subsp. paratuberculosis
cggcguugacgaugacgcgg

SEQ ID NO: 2907791 - RNA, 15 nt, Mycobacterium avium subsp. paratuberculosis
cggcguugagccggc

SEQ ID NO: 2907792 - RNA, 17 nt, Mycobacterium avium subsp. paratuberculosis
cggcguugagccggcgc

SEQ ID NO: 2907793 - RNA, 19 nt, Mycobacterium avium subsp. paratuberculosis
cggcguugagccggcgcac

SEQ ID NO: 2907794 - RNA, 21 nt, Mycobacterium avium subsp. paratuberculosis
cggcguugagccggcgcaccg

SEQ ID NO: 2907795 - RNA, 20 nt, Mycobacterium avium subsp. paratuberculosis
cggcguugaggcguugcgga

SEQ ID NO: 2907796 - RNA, 20 nt, Mycobacterium avium subsp. paratuberculosis
cggcguugcauuucggcguc

SEQ ID NO: 2907797 - RNA, 21 nt, Mycobacterium avium subsp. paratuberculosis
cggcguugcauuucggcgucc

SEQ ID NO: 2907798 - RNA, 16 nt, Mycobacterium avium subsp. paratuberculosis
cggcguugcccggguc

SEQ ID NO: 2907799 - RNA, 13 nt, Mycobacterium avium subsp. paratuberculosis
cggcguugccgcc

SEQ ID NO: 2907800 - RNA, 14 nt, Mycobacterium avium subsp. paratuberculosis
cggcguugccgccg

SEQ ID NO: 2907801 - RNA, 15 nt, Mycobacterium avium subsp. paratuberculosis
cggcguugccgccgg

SEQ ID NO: 2907802 - RNA, 21 nt, Mycobacterium avium subsp. paratuberculosis
cggcguugccgccggcgcggu

SEQ ID NO: 2907803 - RNA, 21 nt, Mycobacterium avium subsp. paratuberculosis
cggcguugcgcaacacguuga

SEQ ID NO: 2907804 - RNA, 14 nt, Mycobacterium avium subsp. paratuberculosis
cggcguugcuggcg

SEQ ID NO: 2907805 - RNA, 15 nt, Mycobacterium avium subsp. paratuberculosis
cggcguugcuggcgc

SEQ ID NO: 2907806 - RNA, 17 nt, Mycobacterium avium subsp. paratuberculosis
cggcguugcuggcgcga

SEQ ID NO: 2907807 - RNA, 15 nt, Mycobacterium avium subsp. paratuberculosis
cggcguuggccgccg

SEQ ID NO: 2907808 - RNA, 17 nt, Mycobacterium avium subsp. paratuberculosis
cggcguuggccgccgcc

SEQ ID NO: 2907809 - RNA, 19 nt, Mycobacterium avium subsp. paratuberculosis
cggcguuggccgccgccug

SEQ ID NO: 2907810 - RNA, 15 nt, Mycobacterium avium subsp. paratuberculosis
cggcguuggcggcgu

SEQ ID NO: 2907811 - RNA, 16 nt, Mycobacterium avium subsp. paratuberculosis
cggcguuggcggcguc

SEQ ID NO: 2907812 - RNA, 20 nt, Mycobacterium avium subsp. paratuberculosis
cggcguuggcguagucgacu

SEQ ID NO: 2907813 - RNA, 14 nt, Mycobacterium avium subsp. paratuberculosis
cggcguugguccac

SEQ ID NO: 2907814 - RNA, 18 nt, Mycobacterium avium subsp. paratuberculosis
cggcguugguccacacgu

SEQ ID NO: 2907815 - RNA, 19 nt, Mycobacterium avium subsp. paratuberculosis
cggcguugguccacacguc

SEQ ID NO: 2907816 - RNA, 14 nt, Mycobacterium avium subsp. paratuberculosis
cggcguuguggcca

SEQ ID NO: 2907817 - RNA, 16 nt, Mycobacterium avium subsp. paratuberculosis
cggcguuguggccacc

SEQ ID NO: 2907818 - RNA, 13 nt, Mycobacterium avium subsp. paratuberculosis
cggcuaagccggc

SEQ ID NO: 2907819 - RNA, 15 nt, Mycobacterium avium subsp. paratuberculosis
cggcuaagccggcgu

SEQ ID NO: 2907820 - RNA, 16 nt, Mycobacterium avium subsp. paratuberculosis
cggcuaauucgggccg

SEQ ID NO: 2907821 - RNA, 19 nt, Mycobacterium avium subsp. paratuberculosis
cggcuaauucgggccgccg

SEQ ID NO: 2907822 - RNA, 20 nt, Mycobacterium avium subsp. paratuberculosis
cggcuaauucgggccgccgc

SEQ ID NO: 2907823 - RNA, 13 nt, Mycobacterium avium subsp. paratuberculosis
cggcuaccggcgc

SEQ ID NO: 2907824 - RNA, 14 nt, Mycobacterium avium subsp. paratuberculosis
cggcuaccggcgcu

SEQ ID NO: 2907825 - RNA, 17 nt, Mycobacterium avium subsp. paratuberculosis
cggcuaccuaggcgucg

SEQ ID NO: 2907826 - RNA, 20 nt, Mycobacterium avium subsp. paratuberculosis
cggcuaccuaggcgucgucg

SEQ ID NO: 2907827 - RNA, 21 nt, Mycobacterium avium subsp. paratuberculosis
cggcuaccuaggcgucgucgg

SEQ ID NO: 2907828 - RNA, 21 nt, Mycobacterium avium subsp. paratuberculosis
cggcgggcccgucgccggcgc

SEQ ID NO: 2907829 - RNA, 24 nt, Mycobacterium avium subsp. paratuberculosis
cggcgggcccgucgccggcgcgca

SEQ ID NO: 2907830 - RNA, 12 nt, Mycobacterium avium subsp. paratuberculosis
cggcgggccgca

SEQ ID NO: 2907831 - RNA, 13 nt, Mycobacterium avium subsp. paratuberculosis
cggcgggccgcaa

SEQ ID NO: 2907832 - RNA, 13 nt, Mycobacterium avium subsp. paratuberculosis
cggcgggccgccc

SEQ ID NO: 2907833 - RNA, 15 nt, Mycobacterium avium subsp. paratuberculosis
cggcgggccgcccgg

SEQ ID NO: 2907834 - RNA, 16 nt, Mycobacterium avium subsp. paratuberculosis
cggcgggccgcccggc

SEQ ID NO: 2907835 - RNA, 22 nt, Mycobacterium avium subsp. paratuberculosis
cggcgggccgcccggcgcgccg

SEQ ID NO: 2907836 - RNA, 13 nt, Mycobacterium avium subsp. paratuberculosis
cggcgggccggcg

SEQ ID NO: 2907837 - RNA, 14 nt, Mycobacterium avium subsp. paratuberculosis
cggcgggccggcgc

SEQ ID NO: 2907838 - RNA, 16 nt, Mycobacterium avium subsp. paratuberculosis
cggcgggccggcgccg

SEQ ID NO: 2907839 - RNA, 20 nt, Mycobacterium avium subsp. paratuberculosis
cggcgggcgaaaucgcgggc

SEQ ID NO: 2907840 - RNA, 13 nt, Mycobacterium avium subsp. paratuberculosis
cggcgggcgagcc

SEQ ID NO: 2907841 - RNA, 14 nt, Mycobacterium avium subsp. paratuberculosis
cggcgggcgagccg

SEQ ID NO: 2907842 - RNA, 17 nt, Mycobacterium avium subsp. paratuberculosis
cggcgggcgccggucgg

SEQ ID NO: 2907843 - RNA, 18 nt, Mycobacterium avium subsp. paratuberculosis
cggcgggcgccggucggc

SEQ ID NO: 2907844 - RNA, 21 nt, Mycobacterium avium subsp. paratuberculosis
cggcgggcgccggucggcgga

SEQ ID NO: 2907845 - RNA, 20 nt, Mycobacterium avium subsp. paratuberculosis
cggcgggcgcgcgccucgcg

SEQ ID NO: 2907846 - RNA, 14 nt, Mycobacterium avium subsp. paratuberculosis
cggcgggcgcgucg

SEQ ID NO: 2907847 - RNA, 14 nt, Mycobacterium avium subsp. paratuberculosis
cggcgggcgcucga

SEQ ID NO: 2907848 - RNA, 15 nt, Mycobacterium avium subsp. paratuberculosis
cggcgggcggccgau

SEQ ID NO: 2907849 - RNA, 14 nt, Mycobacterium avium subsp. paratuberculosis
cggcgggcggcggc

SEQ ID NO: 2907850 - RNA, 13 nt, Mycobacterium avium subsp. paratuberculosis
cggcgggcgggcg

SEQ ID NO: 2907851 - RNA, 14 nt, Mycobacterium avium subsp. paratuberculosis
cggcgggcgggcgg

SEQ ID NO: 2907852 - RNA, 15 nt, Mycobacterium avium subsp. paratuberculosis
cggcgggcgggcggg

SEQ ID NO: 2907853 - RNA, 18 nt, Mycobacterium avium subsp. paratuberculosis
cggcgggcucccucgucg

SEQ ID NO: 2907854 - RNA, 23 nt, Mycobacterium avium subsp. paratuberculosis
cggcgggcucccucgucgcuacc

SEQ ID NO: 2907855 - RNA, 20 nt, Mycobacterium avium subsp. paratuberculosis
cggcgggcucgccggcccga

SEQ ID NO: 2907856 - RNA, 16 nt, Mycobacterium avium subsp. paratuberculosis
cggcgggcucgcgcug

SEQ ID NO: 2907857 - RNA, 17 nt, Mycobacterium avium subsp. paratuberculosis
cggcgggcucgcgcugg

SEQ ID NO: 2907858 - RNA, 18 nt, Mycobacterium avium subsp. paratuberculosis
cggcgggcucgcgcuggc

SEQ ID NO: 2907859 - RNA, 21 nt, Mycobacterium avium subsp. paratuberculosis
cggcgggcuggugcgcagccg

SEQ ID NO: 2907860 - RNA, 13 nt, Mycobacterium avium subsp. paratuberculosis
cggcggggaaggg

SEQ ID NO: 2907861 - RNA, 18 nt, Mycobacterium avium subsp. paratuberculosis
cggcggggaaggugcggg

SEQ ID NO: 2907862 - RNA, 19 nt, Mycobacterium avium subsp. paratuberculosis
cggcggggaaggugcgggc

SEQ ID NO: 2907863 - RNA, 14 nt, Mycobacterium avium subsp. paratuberculosis
cggcggggccucca

SEQ ID NO: 2907864 - RNA, 20 nt, Mycobacterium avium subsp. paratuberculosis
cggcggggccuccaccagcg

SEQ ID NO: 2907865 - RNA, 18 nt, Mycobacterium avium subsp. paratuberculosis
cggcggggccucgaugcg

SEQ ID NO: 2907866 - RNA, 21 nt, Mycobacterium avium subsp. paratuberculosis
cggcggggccucgaugcggcc

SEQ ID NO: 2907867 - RNA, 22 nt, Mycobacterium avium subsp. paratuberculosis
cggcggggccucgaugcggccg

SEQ ID NO: 2907868 - RNA, 18 nt, Mycobacterium avium subsp. paratuberculosis
cggcggggcgcguucggg

SEQ ID NO: 2907869 - RNA, 17 nt, Mycobacterium avium subsp. paratuberculosis
cggcggggcggaugcgc

SEQ ID NO: 2907870 - RNA, 16 nt, Mycobacterium avium subsp. paratuberculosis
cggcggggcgucgccc

SEQ ID NO: 2907871 - RNA, 17 nt, Mycobacterium avium subsp. paratuberculosis
cggcggggcgucgcccg

SEQ ID NO: 2907872 - RNA, 20 nt, Mycobacterium avium subsp. paratuberculosis
cggcggggcgucgcccgccg

SEQ ID NO: 2907873 - RNA, 21 nt, Mycobacterium avium subsp. paratuberculosis
cggcggggcgucgcccgccga

SEQ ID NO: 2907874 - RNA, 19 nt, Mycobacterium avium subsp. paratuberculosis
cggcgggggauccgccugc

SEQ ID NO: 2907875 - RNA, 15 nt, Mycobacterium avium subsp. paratuberculosis
cggcgggggaucggg

SEQ ID NO: 2907876 - RNA, 15 nt, Mycobacterium avium subsp. paratuberculosis
cggcgggggcaggga

SEQ ID NO: 2907877 - RNA, 16 nt, Mycobacterium avium subsp. paratuberculosis
cggcgggggcgagacc

SEQ ID NO: 2907878 - RNA, 17 nt, Mycobacterium avium subsp. paratuberculosis
cggcgggggcgagaccg

SEQ ID NO: 2907879 - RNA, 20 nt, Mycobacterium avium subsp. paratuberculosis
cggcgggggcgagaccgucg

SEQ ID NO: 2907880 - RNA, 13 nt, Mycobacterium avium subsp. paratuberculosis
cggcgggggcgcg

SEQ ID NO: 2907881 - RNA, 16 nt, Mycobacterium avium subsp. paratuberculosis
cggcgggggcgcgucc

SEQ ID NO: 2907882 - RNA, 14 nt, Mycobacterium avium subsp. paratuberculosis
cggcgggggcgggc

SEQ ID NO: 2907883 - RNA, 16 nt, Mycobacterium avium subsp. paratuberculosis
cggcgggggcgggccc

SEQ ID NO: 2907884 - RNA, 21 nt, Mycobacterium avium subsp. paratuberculosis
cggcgggggcgggccccacgc

SEQ ID NO: 2907885 - RNA, 19 nt, Mycobacterium avium subsp. paratuberculosis
cggcggggggagaggcgcg

SEQ ID NO: 2907886 - RNA, 21 nt, Mycobacterium avium subsp. paratuberculosis
cggcggggggagaggcgcggc

SEQ ID NO: 2907887 - RNA, 23 nt, Mycobacterium avium subsp. paratuberculosis
cggcggggggagaggcgcggcgc

SEQ ID NO: 2907888 - RNA, 14 nt, Mycobacterium avium subsp. paratuberculosis
cggcgggggucgga

SEQ ID NO: 2907889 - RNA, 16 nt, Mycobacterium avium subsp. paratuberculosis
cggcgggggucggagc

SEQ ID NO: 2907890 - RNA, 22 nt, Mycobacterium avium subsp. paratuberculosis
cggcggggguucgacgucacga

SEQ ID NO: 2907891 - RNA, 17 nt, Mycobacterium avium subsp. paratuberculosis
cggcgggguccacgcag

SEQ ID NO: 2907892 - RNA, 15 nt, Mycobacterium avium subsp. paratuberculosis
cggcggggucguugc

SEQ ID NO: 2907893 - RNA, 16 nt, Mycobacterium avium subsp. paratuberculosis
cggcggggugcgcggc

SEQ ID NO: 2907894 - RNA, 18 nt, Mycobacterium avium subsp. paratuberculosis
cggcggggugcgcggcga

SEQ ID NO: 2907895 - RNA, 20 nt, Mycobacterium avium subsp. paratuberculosis
cggcggggugggcaccuggc

SEQ ID NO: 2907896 - RNA, 20 nt, Mycobacterium avium subsp. paratuberculosis
cggcgggguuccgucgaaca

SEQ ID NO: 2907897 - RNA, 20 nt, Mycobacterium avium subsp. paratuberculosis
cggcggguagaaccagcccg

SEQ ID NO: 2907898 - RNA, 22 nt, Mycobacterium avium subsp. paratuberculosis
cggcggguagaaccagcccggc

SEQ ID NO: 2907899 - RNA, 14 nt, Mycobacterium avium subsp. paratuberculosis
cggcgggucagcag

SEQ ID NO: 2907900 - RNA, 15 nt, Mycobacterium avium subsp. paratuberculosis
cggcgggucagcagc

SEQ ID NO: 2907901 - RNA, 16 nt, Mycobacterium avium subsp. paratuberculosis
cggcgggucguagccg

SEQ ID NO: 2907902 - RNA, 19 nt, Mycobacterium avium subsp. paratuberculosis
cggcgggucguagccgucg

SEQ ID NO: 2907903 - RNA, 20 nt, Mycobacterium avium subsp. paratuberculosis
cggcgggucugugaccacgg

SEQ ID NO: 2907904 - RNA, 23 nt, Mycobacterium avium subsp. paratuberculosis
cggcgggucugugaccacgguca

SEQ ID NO: 2907905 - RNA, 15 nt, Mycobacterium avium subsp. paratuberculosis
cggcgggugagccgg

SEQ ID NO: 2907906 - RNA, 17 nt, Mycobacterium avium subsp. paratuberculosis
cggcgggugagccgguc

SEQ ID NO: 2907907 - RNA, 15 nt, Mycobacterium avium subsp. paratuberculosis
cggcgggugcgacgg

SEQ ID NO: 2907908 - RNA, 16 nt, Mycobacterium avium subsp. paratuberculosis
cggcgggugcgggcgc

SEQ ID NO: 2907909 - RNA, 19 nt, Mycobacterium avium subsp. paratuberculosis
cggcgggugcgggcgcugc

SEQ ID NO: 2907910 - RNA, 16 nt, Mycobacterium avium subsp. paratuberculosis
cggcggguugcugagc

SEQ ID NO: 2907911 - RNA, 23 nt, Mycobacterium avium subsp. paratuberculosis
cggcggguugcugagccgccgag

SEQ ID NO: 2907912 - RNA, 14 nt, Mycobacterium avium subsp. paratuberculosis
cggcggguuggccg

SEQ ID NO: 2907913 - RNA, 17 nt, Mycobacterium avium subsp. paratuberculosis
cggcggguuggccgucg

SEQ ID NO: 2907914 - RNA, 18 nt, Mycobacterium avium subsp. paratuberculosis
cggcggguuggucccgau

SEQ ID NO: 2907915 - RNA, 13 nt, Mycobacterium avium subsp. paratuberculosis
cggcgguaccgcc

SEQ ID NO: 2907916 - RNA, 14 nt, Mycobacterium avium subsp. paratuberculosis
cggcgguaccgccg

SEQ ID NO: 2907917 - RNA, 19 nt, Mycobacterium avium subsp. paratuberculosis
cggcgguaccgccgaucgu

SEQ ID NO: 2907918 - RNA, 17 nt, Mycobacterium avium subsp. paratuberculosis
cggcgguaugcccgggc

SEQ ID NO: 2907919 - RNA, 23 nt, Mycobacterium avium subsp. paratuberculosis
cggcgguauucgucaccccacca

SEQ ID NO: 2907920 - RNA, 18 nt, Mycobacterium avium subsp. paratuberculosis
cggcggucaccaaggcga

SEQ ID NO: 2907921 - RNA, 14 nt, Mycobacterium avium subsp. paratuberculosis
cggcggucacgccc

SEQ ID NO: 2907922 - RNA, 16 nt, Mycobacterium avium subsp. paratuberculosis
cggcggucacgcccgg

SEQ ID NO: 2907923 - RNA, 13 nt, Mycobacterium avium subsp. paratuberculosis
cggcggucagcac

SEQ ID NO: 2907924 - RNA, 15 nt, Mycobacterium avium subsp. paratuberculosis
cggcggucagcaccg

SEQ ID NO: 2907925 - RNA, 16 nt, Mycobacterium avium subsp. paratuberculosis
cggcggucagcaccgu

SEQ ID NO: 2907926 - RNA, 20 nt, Mycobacterium avium subsp. paratuberculosis
cggcggucagcaccgucacc

SEQ ID NO: 2907927 - RNA, 23 nt, Mycobacterium avium subsp. paratuberculosis
cggcggucagcaccgucaccgcc

SEQ ID NO: 2907928 - RNA, 17 nt, Mycobacterium avium subsp. paratuberculosis
cggcggucaggccgucu

SEQ ID NO: 2907929 - RNA, 20 nt, Mycobacterium avium subsp. paratuberculosis
cggcggucagguucgccacg

SEQ ID NO: 2907930 - RNA, 22 nt, Mycobacterium avium subsp. paratuberculosis
cggcggucagguucgccacgau

SEQ ID NO: 2907931 - RNA, 22 nt, Mycobacterium avium subsp. paratuberculosis
cggcggucauugaucuccgcgg

SEQ ID NO: 2907932 - RNA, 23 nt, Mycobacterium avium subsp. paratuberculosis
cggcggucauugaucuccgcggc

SEQ ID NO: 2907933 - RNA, 15 nt, Mycobacterium avium subsp. paratuberculosis
cggcgguccagcgag

SEQ ID NO: 2907934 - RNA, 16 nt, Mycobacterium avium subsp. paratuberculosis
cggcgguccagcgagc

SEQ ID NO: 2907935 - RNA, 17 nt, Mycobacterium avium subsp. paratuberculosis
cggcgguccagcgagcc

SEQ ID NO: 2907936 - RNA, 18 nt, Mycobacterium avium subsp. paratuberculosis
cggcgguccagcgagccc

SEQ ID NO: 2907937 - RNA, 16 nt, Mycobacterium avium subsp. paratuberculosis
cggcgguccccgaagc

SEQ ID NO: 2907938 - RNA, 18 nt, Mycobacterium avium subsp. paratuberculosis
cggcggucccgugcgccg

SEQ ID NO: 2907939 - RNA, 16 nt, Mycobacterium avium subsp. paratuberculosis
cggcgguccgcccgga

SEQ ID NO: 2907940 - RNA, 16 nt, Mycobacterium avium subsp. paratuberculosis
cggcgguccgccgcag

SEQ ID NO: 2907941 - RNA, 24 nt, Mycobacterium avium subsp. paratuberculosis
cggcgguccgccgcagcggcgccg

SEQ ID NO: 2907942 - RNA, 15 nt, Mycobacterium avium subsp. paratuberculosis
cggcgguccugcggc

SEQ ID NO: 2907943 - RNA, 11 nt, Mycobacterium avium subsp. paratuberculosis
cggcggucgcc

SEQ ID NO: 2907944 - RNA, 16 nt, Mycobacterium avium subsp. paratuberculosis
cggcggucgccagcgc

SEQ ID NO: 2907945 - RNA, 22 nt, Mycobacterium avium subsp. paratuberculosis
cggcggucgccagcgccacgcu

SEQ ID NO: 2907946 - RNA, 12 nt, Mycobacterium avium subsp. paratuberculosis
cggcggucgcgc

SEQ ID NO: 2907947 - RNA, 14 nt, Mycobacterium avium subsp. paratuberculosis
cggcggucgcgcgc

SEQ ID NO: 2907948 - RNA, 17 nt, Mycobacterium avium subsp. paratuberculosis
cggcggucgcgcgccgg

SEQ ID NO: 2907949 - RNA, 18 nt, Mycobacterium avium subsp. paratuberculosis
cggcggucgcgcgccggc

SEQ ID NO: 2907950 - RNA, 15 nt, Mycobacterium avium subsp. paratuberculosis
cggcggucgcggugc

SEQ ID NO: 2907951 - RNA, 21 nt, Mycobacterium avium subsp. paratuberculosis
cggcggucgcggugcccagcc

SEQ ID NO: 2907952 - RNA, 11 nt, Mycobacterium avium subsp. paratuberculosis
cggcggucgcu

SEQ ID NO: 2907953 - RNA, 15 nt, Mycobacterium avium subsp. paratuberculosis
cggcggucgcugcag

SEQ ID NO: 2907954 - RNA, 16 nt, Mycobacterium avium subsp. paratuberculosis
cggcggucgcugcagc

SEQ ID NO: 2907955 - RNA, 14 nt, Mycobacterium avium subsp. paratuberculosis
cggcggucggaucg

SEQ ID NO: 2907956 - RNA, 17 nt, Mycobacterium avium subsp. paratuberculosis
cggcggucggaucgagc

SEQ ID NO: 2907957 - RNA, 12 nt, Mycobacterium avium subsp. paratuberculosis
cggcggucggca

SEQ ID NO: 2907958 - RNA, 14 nt, Mycobacterium avium subsp. paratuberculosis
cggcggucggcgcc

SEQ ID NO: 2907959 - RNA, 16 nt, Mycobacterium avium subsp. paratuberculosis
cggcggucggcgccga

SEQ ID NO: 2907960 - RNA, 13 nt, Mycobacterium avium subsp. paratuberculosis
cggcggucugucg

SEQ ID NO: 2907961 - RNA, 23 nt, Mycobacterium avium subsp. paratuberculosis
cggcggucuucuuggccgcgccg

SEQ ID NO: 2907962 - RNA, 20 nt, Mycobacterium avium subsp. paratuberculosis
cggcggucuucuuggcgggc

SEQ ID NO: 2907963 - RNA, 23 nt, Mycobacterium avium subsp. paratuberculosis
cggcggucuucuuggcgggcgac

SEQ ID NO: 2907964 - RNA, 23 nt, Mycobacterium avium subsp. paratuberculosis
cggcggucuuggcggccagcgcc

SEQ ID NO: 2907965 - RNA, 24 nt, Mycobacterium avium subsp. paratuberculosis
cggcggugaccggaucggccagca

SEQ ID NO: 2907966 - RNA, 16 nt, Mycobacterium avium subsp. paratuberculosis
cggcggugacgaaccc

SEQ ID NO: 2907967 - RNA, 21 nt, Mycobacterium avium subsp. paratuberculosis
cggcggugacgaugucgauga

SEQ ID NO: 2907968 - RNA, 22 nt, Mycobacterium avium subsp. paratuberculosis
cggcggugacguuccagccgug

SEQ ID NO: 2907969 - RNA, 19 nt, Mycobacterium avium subsp. paratuberculosis
cggcggugagccgccacag

SEQ ID NO: 2907970 - RNA, 20 nt, Mycobacterium avium subsp. paratuberculosis
cggcggugagcgcgucgagc

SEQ ID NO: 2907971 - RNA, 22 nt, Mycobacterium avium subsp. paratuberculosis
cggcggugagcgcgucgagcac

SEQ ID NO: 2907972 - RNA, 19 nt, Mycobacterium avium subsp. paratuberculosis
cggcggugauccgcccggc

SEQ ID NO: 2907973 - RNA, 16 nt, Mycobacterium avium subsp. paratuberculosis
cggcggugaucgccgg

SEQ ID NO: 2907974 - RNA, 18 nt, Mycobacterium avium subsp. paratuberculosis
cggcggugaucucgucgg

SEQ ID NO: 2907975 - RNA, 19 nt, Mycobacterium avium subsp. paratuberculosis
cggcggugaucucgucggc

SEQ ID NO: 2907976 - RNA, 20 nt, Mycobacterium avium subsp. paratuberculosis
cggcggugaucucgucggcg

SEQ ID NO: 2907977 - RNA, 21 nt, Mycobacterium avium subsp. paratuberculosis
cggcggugaucucgucggcgg

SEQ ID NO: 2907978 - RNA, 23 nt, Mycobacterium avium subsp. paratuberculosis
cggcggugaucucgucggcggcg

SEQ ID NO: 2907979 - RNA, 16 nt, Mycobacterium avium subsp. paratuberculosis
cggcggugaugcgcgc

SEQ ID NO: 2907980 - RNA, 18 nt, Mycobacterium avium subsp. paratuberculosis
cggcggugaugcgcgccg

SEQ ID NO: 2907981 - RNA, 23 nt, Mycobacterium avium subsp. paratuberculosis
cggcggugaugcgcgccgacgac

SEQ ID NO: 2907982 - RNA, 16 nt, Mycobacterium avium subsp. paratuberculosis
cggcggugcaggguca

SEQ ID NO: 2907983 - RNA, 22 nt, Mycobacterium avium subsp. paratuberculosis
cggcggugcagggucagcagca

SEQ ID NO: 2907984 - RNA, 12 nt, Mycobacterium avium subsp. paratuberculosis
cggcggugccga

SEQ ID NO: 2907985 - RNA, 14 nt, Mycobacterium avium subsp. paratuberculosis
cggcggugccgagc

SEQ ID NO: 2907986 - RNA, 21 nt, Mycobacterium avium subsp. paratuberculosis
cggcggugccgagcccgccgg

SEQ ID NO: 2907987 - RNA, 14 nt, Mycobacterium avium subsp. paratuberculosis
cggcggugccgcag

SEQ ID NO: 2907988 - RNA, 22 nt, Mycobacterium avium subsp. paratuberculosis
cggcggugccgcaggcgaacac

SEQ ID NO: 2907989 - RNA, 15 nt, Mycobacterium avium subsp. paratuberculosis
cggcggugccggcca

SEQ ID NO: 2907990 - RNA, 16 nt, Mycobacterium avium subsp. paratuberculosis
cggcggugccggccag

SEQ ID NO: 2907991 - RNA, 19 nt, Mycobacterium avium subsp. paratuberculosis
cggcggugccggccagauc

SEQ ID NO: 2907992 - RNA, 15 nt, Mycobacterium avium subsp. paratuberculosis
cggcggugccguccu

SEQ ID NO: 2907993 - RNA, 18 nt, Mycobacterium avium subsp. paratuberculosis
cggcggugccguccucgg

SEQ ID NO: 2907994 - RNA, 19 nt, Mycobacterium avium subsp. paratuberculosis
cggcggugcgcagccgcug

SEQ ID NO: 2907995 - RNA, 12 nt, Mycobacterium avium subsp. paratuberculosis
cggcggugcggc

SEQ ID NO: 2907996 - RNA, 21 nt, Mycobacterium avium subsp. paratuberculosis
cggcggugcgggugguguggc

SEQ ID NO: 2907997 - RNA, 18 nt, Mycobacterium avium subsp. paratuberculosis
cggcggugcgucgggcgc

SEQ ID NO: 2907998 - RNA, 20 nt, Mycobacterium avium subsp. paratuberculosis
cggcggcgcuggucggcggg

SEQ ID NO: 2907999 - RNA, 15 nt, Mycobacterium avium subsp. paratuberculosis
cggcggcggaaucgc

SEQ ID NO: 2908000 - RNA, 22 nt, Mycobacterium avium subsp. paratuberculosis
cggcggcggaccgucggugucg

SEQ ID NO: 2908001 - RNA, 23 nt, Mycobacterium avium subsp. paratuberculosis
cggcggcggaccgucggugucga

SEQ ID NO: 2908002 - RNA, 13 nt, Mycobacterium avium subsp. paratuberculosis
cggcggcggcacc

SEQ ID NO: 2908003 - RNA, 14 nt, Mycobacterium avium subsp. paratuberculosis
cggcggcggcaggu

SEQ ID NO: 2908004 - RNA, 14 nt, Mycobacterium avium subsp. paratuberculosis
cggcggcggcccgu

SEQ ID NO: 2908005 - RNA, 15 nt, Mycobacterium avium subsp. paratuberculosis
cggcggcggcccguc

SEQ ID NO: 2908006 - RNA, 17 nt, Mycobacterium avium subsp. paratuberculosis
cggcggcggcccguccg

SEQ ID NO: 2908007 - RNA, 12 nt, Mycobacterium avium subsp. paratuberculosis
cggcggcggccg

SEQ ID NO: 2908008 - RNA, 13 nt, Mycobacterium avium subsp. paratuberculosis
cggcggcggccgc

SEQ ID NO: 2908009 - RNA, 12 nt, Mycobacterium avium subsp. paratuberculosis
cggcggcggccu

SEQ ID NO: 2908010 - RNA, 14 nt, Mycobacterium avium subsp. paratuberculosis
cggcggcggccugc

SEQ ID NO: 2908011 - RNA, 13 nt, Mycobacterium avium subsp. paratuberculosis
cggcggcggcgcg

SEQ ID NO: 2908012 - RNA, 14 nt, Mycobacterium avium subsp. paratuberculosis
cggcggcggcgcgc

SEQ ID NO: 2908013 - RNA, 15 nt, Mycobacterium avium subsp. paratuberculosis
cggcggcggcgcgcc

SEQ ID NO: 2908014 - RNA, 14 nt, Mycobacterium avium subsp. paratuberculosis
cggcggcggcggca

SEQ ID NO: 2908015 - RNA, 17 nt, Mycobacterium avium subsp. paratuberculosis
cggcggcggcggcaggu

SEQ ID NO: 2908016 - RNA, 16 nt, Mycobacterium avium subsp. paratuberculosis
cggcggcggcgguccg

SEQ ID NO: 2908017 - RNA, 12 nt, Mycobacterium avium subsp. paratuberculosis
cggcggcgggca

SEQ ID NO: 2908018 - RNA, 13 nt, Mycobacterium avium subsp. paratuberculosis
cggcggcgggcag

SEQ ID NO: 2908019 - RNA, 14 nt, Mycobacterium avium subsp. paratuberculosis
cggcggcgggcagg

SEQ ID NO: 2908020 - RNA, 14 nt, Mycobacterium avium subsp. paratuberculosis
cggcggcgggcucg

SEQ ID NO: 2908021 - RNA, 15 nt, Mycobacterium avium subsp. paratuberculosis
cggcggcgggcucgg

SEQ ID NO: 2908022 - RNA, 18 nt, Mycobacterium avium subsp. paratuberculosis
cggcggcgggcucggagu

SEQ ID NO: 2908023 - RNA, 13 nt, Mycobacterium avium subsp. paratuberculosis
cggcggcgguccg

SEQ ID NO: 2908024 - RNA, 14 nt, Mycobacterium avium subsp. paratuberculosis
cggcggcgguccgc

SEQ ID NO: 2908025 - RNA, 17 nt, Mycobacterium avium subsp. paratuberculosis
cggcggcgguccgcccg

SEQ ID NO: 2908026 - RNA, 12 nt, Mycobacterium avium subsp. paratuberculosis
cggcggcggucg

SEQ ID NO: 2908027 - RNA, 13 nt, Mycobacterium avium subsp. paratuberculosis
cggcggcggucgg

SEQ ID NO: 2908028 - RNA, 15 nt, Mycobacterium avium subsp. paratuberculosis
cggcggcggucggca

SEQ ID NO: 2908029 - RNA, 12 nt, Mycobacterium avium subsp. paratuberculosis
cggcggcggugc

SEQ ID NO: 2908030 - RNA, 15 nt, Mycobacterium avium subsp. paratuberculosis
cggcggcggugccgc

SEQ ID NO: 2908031 - RNA, 19 nt, Mycobacterium avium subsp. paratuberculosis
cggcggcggugccgcaggc

SEQ ID NO: 2908032 - RNA, 19 nt, Mycobacterium avium subsp. paratuberculosis
cggcggcgguuuuggucgg

SEQ ID NO: 2908033 - RNA, 20 nt, Mycobacterium avium subsp. paratuberculosis
cggcggcguauucccggggg

SEQ ID NO: 2908034 - RNA, 15 nt, Mycobacterium avium subsp. paratuberculosis
cggcggcguccgcgg

SEQ ID NO: 2908035 - RNA, 19 nt, Mycobacterium avium subsp. paratuberculosis
cggcggcguccgcggccgc

SEQ ID NO: 2908036 - RNA, 21 nt, Mycobacterium avium subsp. paratuberculosis
cggcggcguccgcggccgcgg

SEQ ID NO: 2908037 - RNA, 16 nt, Mycobacterium avium subsp. paratuberculosis
cggcggcgucgaccgc

SEQ ID NO: 2908038 - RNA, 15 nt, Mycobacterium avium subsp. paratuberculosis
cggcggcgucggcgu

SEQ ID NO: 2908039 - RNA, 18 nt, Mycobacterium avium subsp. paratuberculosis
cggcggcgucggcgucca

SEQ ID NO: 2908040 - RNA, 13 nt, Mycobacterium avium subsp. paratuberculosis
cggcggcgucgua

SEQ ID NO: 2908041 - RNA, 12 nt, Mycobacterium avium subsp. paratuberculosis
cggcggcgugca

SEQ ID NO: 2908042 - RNA, 14 nt, Mycobacterium avium subsp. paratuberculosis
cggcggcgugcacc

SEQ ID NO: 2908043 - RNA, 16 nt, Mycobacterium avium subsp. paratuberculosis
cggcggcgugcaccgc

SEQ ID NO: 2908044 - RNA, 22 nt, Mycobacterium avium subsp. paratuberculosis
cggcggcgugcaccgcccgcgc

SEQ ID NO: 2908045 - RNA, 14 nt, Mycobacterium avium subsp. paratuberculosis
cggcggcgugccgc

SEQ ID NO: 2908046 - RNA, 22 nt, Mycobacterium avium subsp. paratuberculosis
cggcggcgugccgcccggaccg

SEQ ID NO: 2908047 - RNA, 17 nt, Mycobacterium avium subsp. paratuberculosis
cggcggcguuggccgcc

SEQ ID NO: 2908048 - RNA, 20 nt, Mycobacterium avium subsp. paratuberculosis
cggcggcguuggccgccgcc

SEQ ID NO: 2908049 - RNA, 21 nt, Mycobacterium avium subsp. paratuberculosis
cggcggcucaggggaucucgg

SEQ ID NO: 2908050 - RNA, 14 nt, Mycobacterium avium subsp. paratuberculosis
cggcggcucgccgg

SEQ ID NO: 2908051 - RNA, 17 nt, Mycobacterium avium subsp. paratuberculosis
cggcggcucggcggcgu

SEQ ID NO: 2908052 - RNA, 18 nt, Mycobacterium avium subsp. paratuberculosis
cggcggcucggcggcguc

SEQ ID NO: 2908053 - RNA, 13 nt, Mycobacterium avium subsp. paratuberculosis
cggcggcucgggg

SEQ ID NO: 2908054 - RNA, 19 nt, Mycobacterium avium subsp. paratuberculosis
cggcggcucgggggugucg

SEQ ID NO: 2908055 - RNA, 18 nt, Mycobacterium avium subsp. paratuberculosis
cggcggcugaaccaccgc

SEQ ID NO: 2908056 - RNA, 22 nt, Mycobacterium avium subsp. paratuberculosis
cggcggcugaaccaccgcgccc

SEQ ID NO: 2908057 - RNA, 13 nt, Mycobacterium avium subsp. paratuberculosis
cggcggcugccuc

SEQ ID NO: 2908058 - RNA, 17 nt, Mycobacterium avium subsp. paratuberculosis
cggcggcugccucgacg

SEQ ID NO: 2908059 - RNA, 15 nt, Mycobacterium avium subsp. paratuberculosis
cggcggcugggcagc

SEQ ID NO: 2908060 - RNA, 22 nt, Mycobacterium avium subsp. paratuberculosis
cggcggcugggcagccgcgcgu

SEQ ID NO: 2908061 - RNA, 24 nt, Mycobacterium avium subsp. paratuberculosis
cggcggcugggcagccgcgcgugc

SEQ ID NO: 2908062 - RNA, 15 nt, Mycobacterium avium subsp. paratuberculosis
cggcggcugggccgc

SEQ ID NO: 2908063 - RNA, 18 nt, Mycobacterium avium subsp. paratuberculosis
cggcggcugggccgcggc

SEQ ID NO: 2908064 - RNA, 20 nt, Mycobacterium avium subsp. paratuberculosis
cggcggcugggccgcggcgc

SEQ ID NO: 2908065 - RNA, 23 nt, Mycobacterium avium subsp. paratuberculosis
cggcggcugggccgcggcgccgu

SEQ ID NO: 2908066 - RNA, 15 nt, Mycobacterium avium subsp. paratuberculosis
cggcggcugugaucg

SEQ ID NO: 2908067 - RNA, 21 nt, Mycobacterium avium subsp. paratuberculosis
cggcggcugugaucgcugacg

SEQ ID NO: 2908068 - RNA, 17 nt, Mycobacterium avium subsp. paratuberculosis
cggcgggaaaccaccug

SEQ ID NO: 2908069 - RNA, 20 nt, Mycobacterium avium subsp. paratuberculosis
cggcgggaaaccaccugccg

SEQ ID NO: 2908070 - RNA, 18 nt, Mycobacterium avium subsp. paratuberculosis
cggcgggaaguagugcau

SEQ ID NO: 2908071 - RNA, 22 nt, Mycobacterium avium subsp. paratuberculosis
cggcgggaaguagugcaucggc

SEQ ID NO: 2908072 - RNA, 14 nt, Mycobacterium avium subsp. paratuberculosis
cggcgggacccgcg

SEQ ID NO: 2908073 - RNA, 21 nt, Mycobacterium avium subsp. paratuberculosis
cggcgggacggaaucacgcac

SEQ ID NO: 2908074 - RNA, 16 nt, Mycobacterium avium subsp. paratuberculosis
cggcgggagccggcgg

SEQ ID NO: 2908075 - RNA, 17 nt, Mycobacterium avium subsp. paratuberculosis
cggcgggagccggcggc

SEQ ID NO: 2908076 - RNA, 18 nt, Mycobacterium avium subsp. paratuberculosis
cggcgggagccggcggcg

SEQ ID NO: 2908077 - RNA, 18 nt, Mycobacterium avium subsp. paratuberculosis
cggcgggagcuaggcggc

SEQ ID NO: 2908078 - RNA, 21 nt, Mycobacterium avium subsp. paratuberculosis
cggcgggagcuaggcggccgg

SEQ ID NO: 2908079 - RNA, 16 nt, Mycobacterium avium subsp. paratuberculosis
cggcgggaucggaccg

SEQ ID NO: 2908080 - RNA, 20 nt, Mycobacterium avium subsp. paratuberculosis
cggcgggaucggaccgcacc

SEQ ID NO: 2908081 - RNA, 23 nt, Mycobacterium avium subsp. paratuberculosis
cggcgggauguggcaucaccgcc

SEQ ID NO: 2908082 - RNA, 12 nt, Mycobacterium avium subsp. paratuberculosis
cggcgggcaccu

SEQ ID NO: 2908083 - RNA, 20 nt, Mycobacterium avium subsp. paratuberculosis
cggcgcgcagcgugugcacc

SEQ ID NO: 2908084 - RNA, 15 nt, Mycobacterium avium subsp. paratuberculosis
cggcgcgcagcucgc

SEQ ID NO: 2908085 - RNA, 19 nt, Mycobacterium avium subsp. paratuberculosis
cggcgcgcagcucgcgcag

SEQ ID NO: 2908086 - RNA, 22 nt, Mycobacterium avium subsp. paratuberculosis
cggcgcgcagcucgcgcagccg

SEQ ID NO: 2908087 - RNA, 23 nt, Mycobacterium avium subsp. paratuberculosis
cggcgcgcagcucgcgcagccgg

SEQ ID NO: 2908088 - RNA, 15 nt, Mycobacterium avium subsp. paratuberculosis
cggcgcgcaggcgcg

SEQ ID NO: 2908089 - RNA, 16 nt, Mycobacterium avium subsp. paratuberculosis
cggcgcgcaggcgcgc

SEQ ID NO: 2908090 - RNA, 19 nt, Mycobacterium avium subsp. paratuberculosis
cggcgcgcaggcgcgcggc

SEQ ID NO: 2908091 - RNA, 20 nt, Mycobacterium avium subsp. paratuberculosis
cggcgcgcaggcgcgcggcc

SEQ ID NO: 2908092 - RNA, 21 nt, Mycobacterium avium subsp. paratuberculosis
cggcgcgcaggcgcgcggcca

SEQ ID NO: 2908093 - RNA, 22 nt, Mycobacterium avium subsp. paratuberculosis
cggcgcgcaggcgcgcggccag

SEQ ID NO: 2908094 - RNA, 15 nt, Mycobacterium avium subsp. paratuberculosis
cggcgcgcaggcugg

SEQ ID NO: 2908095 - RNA, 16 nt, Mycobacterium avium subsp. paratuberculosis
cggcgcgcaggcuggc

SEQ ID NO: 2908096 - RNA, 18 nt, Mycobacterium avium subsp. paratuberculosis
cggcgcgcaggucguccg

SEQ ID NO: 2908097 - RNA, 15 nt, Mycobacterium avium subsp. paratuberculosis
cggcgcgcaucccga

SEQ ID NO: 2908098 - RNA, 14 nt, Mycobacterium avium subsp. paratuberculosis
cggcgcgcaucgcc

SEQ ID NO: 2908099 - RNA, 15 nt, Mycobacterium avium subsp. paratuberculosis
cggcgcgcaucgccg

SEQ ID NO: 2908100 - RNA, 17 nt, Mycobacterium avium subsp. paratuberculosis
cggcgcgcaucgccguc

SEQ ID NO: 2908101 - RNA, 19 nt, Mycobacterium avium subsp. paratuberculosis
cggcgcgcaucgccgucca

SEQ ID NO: 2908102 - RNA, 22 nt, Mycobacterium avium subsp. paratuberculosis
cggcgcgcaucgccguccacgg

SEQ ID NO: 2908103 - RNA, 15 nt, Mycobacterium avium subsp. paratuberculosis
cggcgcgcaucgucg

SEQ ID NO: 2908104 - RNA, 17 nt, Mycobacterium avium subsp. paratuberculosis
cggcgcgcaucgucgcg

SEQ ID NO: 2908105 - RNA, 18 nt, Mycobacterium avium subsp. paratuberculosis
cggcgcgcaucgucgcgg

SEQ ID NO: 2908106 - RNA, 13 nt, Mycobacterium avium subsp. paratuberculosis
cggcgcgccaccc

SEQ ID NO: 2908107 - RNA, 14 nt, Mycobacterium avium subsp. paratuberculosis
cggcgcgccacccg

SEQ ID NO: 2908108 - RNA, 16 nt, Mycobacterium avium subsp. paratuberculosis
cggcgcgccagcgugg

SEQ ID NO: 2908109 - RNA, 18 nt, Mycobacterium avium subsp. paratuberculosis
cggcgcgcccgacgaugc

SEQ ID NO: 2908110 - RNA, 23 nt, Mycobacterium avium subsp. paratuberculosis
cggcgcgcccgacgaugcggggc

SEQ ID NO: 2908111 - RNA, 14 nt, Mycobacterium avium subsp. paratuberculosis
cggcgcgccgcguu

SEQ ID NO: 2908112 - RNA, 12 nt, Mycobacterium avium subsp. paratuberculosis
cggcgcgccggc

SEQ ID NO: 2908113 - RNA, 16 nt, Mycobacterium avium subsp. paratuberculosis
cggcgcgccggccgga

SEQ ID NO: 2908114 - RNA, 18 nt, Mycobacterium avium subsp. paratuberculosis
cggcgcgccggccggagc

SEQ ID NO: 2908115 - RNA, 21 nt, Mycobacterium avium subsp. paratuberculosis
cggcgcgccggccggagcgga

SEQ ID NO: 2908116 - RNA, 13 nt, Mycobacterium avium subsp. paratuberculosis
cggcgcgccggcg

SEQ ID NO: 2908117 - RNA, 14 nt, Mycobacterium avium subsp. paratuberculosis
cggcgcgccggcga

SEQ ID NO: 2908118 - RNA, 13 nt, Mycobacterium avium subsp. paratuberculosis
cggcgcgccgggc

SEQ ID NO: 2908119 - RNA, 16 nt, Mycobacterium avium subsp. paratuberculosis
cggcgcgccgggcagc

SEQ ID NO: 2908120 - RNA, 22 nt, Mycobacterium avium subsp. paratuberculosis
cggcgcgccgggcagcccgccg

SEQ ID NO: 2908121 - RNA, 13 nt, Mycobacterium avium subsp. paratuberculosis
cggcgcgccgucc

SEQ ID NO: 2908122 - RNA, 17 nt, Mycobacterium avium subsp. paratuberculosis
cggcgcgccugcgcggc

SEQ ID NO: 2908123 - RNA, 19 nt, Mycobacterium avium subsp. paratuberculosis
cggcgcgccugcgcggcgg

SEQ ID NO: 2908124 - RNA, 21 nt, Mycobacterium avium subsp. paratuberculosis
cggcgcgccugcgcggcggcg

SEQ ID NO: 2908125 - RNA, 16 nt, Mycobacterium avium subsp. paratuberculosis
cggcgcgcgagcguca

SEQ ID NO: 2908126 - RNA, 18 nt, Mycobacterium avium subsp. paratuberculosis
cggcgcgcgagcgucacg

SEQ ID NO: 2908127 - RNA, 20 nt, Mycobacterium avium subsp. paratuberculosis
cggcgcgcgagcgucacgcu

SEQ ID NO: 2908128 - RNA, 23 nt, Mycobacterium avium subsp. paratuberculosis
cggcgcgcgagcgucacgcuggc

SEQ ID NO: 2908129 - RNA, 13 nt, Mycobacterium avium subsp. paratuberculosis
cggcgcgcgaugg

SEQ ID NO: 2908130 - RNA, 13 nt, Mycobacterium avium subsp. paratuberculosis
cggcgcgcgccag

SEQ ID NO: 2908131 - RNA, 14 nt, Mycobacterium avium subsp. paratuberculosis
cggcgcgcgccagc

SEQ ID NO: 2908132 - RNA, 18 nt, Mycobacterium avium subsp. paratuberculosis
cggcgcgcgccagcgucu

SEQ ID NO: 2908133 - RNA, 15 nt, Mycobacterium avium subsp. paratuberculosis
cggcgcgcgccgauc

SEQ ID NO: 2908134 - RNA, 13 nt, Mycobacterium avium subsp. paratuberculosis
cggcgcgcgccgc

SEQ ID NO: 2908135 - RNA, 14 nt, Mycobacterium avium subsp. paratuberculosis
cggcgcgcgccgca

SEQ ID NO: 2908136 - RNA, 15 nt, Mycobacterium avium subsp. paratuberculosis
cggcgcgcgccgcag

SEQ ID NO: 2908137 - RNA, 16 nt, Mycobacterium avium subsp. paratuberculosis
cggcgcgcgccgcagc

SEQ ID NO: 2908138 - RNA, 19 nt, Mycobacterium avium subsp. paratuberculosis
cggcgcgcgcgccccagcc

SEQ ID NO: 2908139 - RNA, 21 nt, Mycobacterium avium subsp. paratuberculosis
cggcgcgcgcgccccagcccc

SEQ ID NO: 2908140 - RNA, 14 nt, Mycobacterium avium subsp. paratuberculosis
cggcgcgcggccgc

SEQ ID NO: 2908141 - RNA, 15 nt, Mycobacterium avium subsp. paratuberculosis
cggcgcgcggccgcg

SEQ ID NO: 2908142 - RNA, 16 nt, Mycobacterium avium subsp. paratuberculosis
cggcgcgcggccgcga

SEQ ID NO: 2908143 - RNA, 17 nt, Mycobacterium avium subsp. paratuberculosis
cggcgcgcggccgcgac

SEQ ID NO: 2908144 - RNA, 15 nt, Mycobacterium avium subsp. paratuberculosis
cggcgcgcggggccg

SEQ ID NO: 2908145 - RNA, 17 nt, Mycobacterium avium subsp. paratuberculosis
cggcgcgcggggccggc

SEQ ID NO: 2908146 - RNA, 18 nt, Mycobacterium avium subsp. paratuberculosis
cggcgcgcggggccggcg

SEQ ID NO: 2908147 - RNA, 19 nt, Mycobacterium avium subsp. paratuberculosis
cggcgcgcggggccggcgc

SEQ ID NO: 2908148 - RNA, 13 nt, Mycobacterium avium subsp. paratuberculosis
cggcgcgcggggu

SEQ ID NO: 2908149 - RNA, 14 nt, Mycobacterium avium subsp. paratuberculosis
cggcgcgcggggug

SEQ ID NO: 2908150 - RNA, 18 nt, Mycobacterium avium subsp. paratuberculosis
cggcgcgcggggugucgc

SEQ ID NO: 2908151 - RNA, 20 nt, Mycobacterium avium subsp. paratuberculosis
cggcgcgcggggugucgcgg

SEQ ID NO: 2908152 - RNA, 14 nt, Mycobacterium avium subsp. paratuberculosis
cggcgcgcgguggu

SEQ ID NO: 2908153 - RNA, 19 nt, Mycobacterium avium subsp. paratuberculosis
cggcgcgcggugguguugc

SEQ ID NO: 2908154 - RNA, 22 nt, Mycobacterium avium subsp. paratuberculosis
cggcgcgcggugguguugcggu

SEQ ID NO: 2908155 - RNA, 19 nt, Mycobacterium avium subsp. paratuberculosis
cggcgcgcguauuccagcg

SEQ ID NO: 2908156 - RNA, 14 nt, Mycobacterium avium subsp. paratuberculosis
cggcgcgcucgucg

SEQ ID NO: 2908157 - RNA, 17 nt, Mycobacterium avium subsp. paratuberculosis
cggcgcgcucgucgucg

SEQ ID NO: 2908158 - RNA, 18 nt, Mycobacterium avium subsp. paratuberculosis
cggcgcgcucgucgucgg

SEQ ID NO: 2908159 - RNA, 16 nt, Mycobacterium avium subsp. paratuberculosis
cggcgcgcugaagcgc

SEQ ID NO: 2908160 - RNA, 18 nt, Mycobacterium avium subsp. paratuberculosis
cggcgcgcugaagcgcga

SEQ ID NO: 2908161 - RNA, 13 nt, Mycobacterium avium subsp. paratuberculosis
cggcgcgcugcag

SEQ ID NO: 2908162 - RNA, 17 nt, Mycobacterium avium subsp. paratuberculosis
cggcgcgcugcaggccc

SEQ ID NO: 2908163 - RNA, 20 nt, Mycobacterium avium subsp. paratuberculosis
cggcgcgcugcaggcccggg

SEQ ID NO: 2908164 - RNA, 14 nt, Mycobacterium avium subsp. paratuberculosis
cggcgcgcugcggc

SEQ ID NO: 2908165 - RNA, 16 nt, Mycobacterium avium subsp. paratuberculosis
cggcgcgcugcggcgu

SEQ ID NO: 2908166 - RNA, 19 nt, Mycobacterium avium subsp. paratuberculosis
cggcgcgcugcggcgucgu

SEQ ID NO: 2908167 - RNA, 14 nt, Mycobacterium avium subsp. paratuberculosis
cggcgcggaacgcg

SEQ ID NO: 2908168 - RNA, 16 nt, Mycobacterium avium subsp. paratuberculosis
cggcgcggugcucggc

SEQ ID NO: 2908169 - RNA, 22 nt, Mycobacterium avium subsp. paratuberculosis
cggcgcggugcucggcgcgcgg

SEQ ID NO: 2908170 - RNA, 17 nt, Mycobacterium avium subsp. paratuberculosis
cggcgcggugggcggcg

SEQ ID NO: 2908171 - RNA, 20 nt, Mycobacterium avium subsp. paratuberculosis
cggcgcggugggcggcggga

SEQ ID NO: 2908172 - RNA, 15 nt, Mycobacterium avium subsp. paratuberculosis
cggcgcgguugaccg

SEQ ID NO: 2908173 - RNA, 16 nt, Mycobacterium avium subsp. paratuberculosis
cggcgcgguugaccgc

SEQ ID NO: 2908174 - RNA, 23 nt, Mycobacterium avium subsp. paratuberculosis
cggcgcgguugaccgccgacacc

SEQ ID NO: 2908175 - RNA, 19 nt, Mycobacterium avium subsp. paratuberculosis
cggcgcgguugcccgcacc

SEQ ID NO: 2908176 - RNA, 18 nt, Mycobacterium avium subsp. paratuberculosis
cggcgcgguugucguuga

SEQ ID NO: 2908177 - RNA, 18 nt, Mycobacterium avium subsp. paratuberculosis
cggcgcgguuucggcguc

SEQ ID NO: 2908178 - RNA, 19 nt, Mycobacterium avium subsp. paratuberculosis
cggcgcgguuucggcgucg

SEQ ID NO: 2908179 - RNA, 14 nt, Mycobacterium avium subsp. paratuberculosis
cggcgcguccaugg

SEQ ID NO: 2908180 - RNA, 14 nt, Mycobacterium avium subsp. paratuberculosis
cggcgcgucgcugg

SEQ ID NO: 2908181 - RNA, 21 nt, Mycobacterium avium subsp. paratuberculosis
cggcgcgucgcugggcagccg

SEQ ID NO: 2908182 - RNA, 12 nt, Mycobacterium avium subsp. paratuberculosis
cggcgcgucggc

SEQ ID NO: 2908183 - RNA, 12 nt, Mycobacterium avium subsp. paratuberculosis
cggcgcgucgua

SEQ ID NO: 2908184 - RNA, 15 nt, Mycobacterium avium subsp. paratuberculosis
cggcgcgucguacac

SEQ ID NO: 2908185 - RNA, 20 nt, Mycobacterium avium subsp. paratuberculosis
cggcgcgucguacaccucgg

SEQ ID NO: 2908186 - RNA, 21 nt, Mycobacterium avium subsp. paratuberculosis
cggcgcgucguacaccucggu

SEQ ID NO: 2908187 - RNA, 19 nt, Mycobacterium avium subsp. paratuberculosis
cggcgcgucguagucgcuc

SEQ ID NO: 2908188 - RNA, 23 nt, Mycobacterium avium subsp. paratuberculosis
cggcgcgucguagucgcucggcg

SEQ ID NO: 2908189 - RNA, 14 nt, Mycobacterium avium subsp. paratuberculosis
cggcgcgucguccg

SEQ ID NO: 2908190 - RNA, 20 nt, Mycobacterium avium subsp. paratuberculosis
cggcgcgucguccgacacca

SEQ ID NO: 2908191 - RNA, 16 nt, Mycobacterium avium subsp. paratuberculosis
cggcgcgugccaacca

SEQ ID NO: 2908192 - RNA, 17 nt, Mycobacterium avium subsp. paratuberculosis
cggcgcgugccaaccac

SEQ ID NO: 2908193 - RNA, 15 nt, Mycobacterium avium subsp. paratuberculosis
cggcgcgugcgccgc

SEQ ID NO: 2908194 - RNA, 16 nt, Mycobacterium avium subsp. paratuberculosis
cggcgcgugcgccgcg

SEQ ID NO: 2908195 - RNA, 17 nt, Mycobacterium avium subsp. paratuberculosis
cggcgcgugcgccgcgg

SEQ ID NO: 2908196 - RNA, 18 nt, Mycobacterium avium subsp. paratuberculosis
cggcgcgugcgccgcggc

SEQ ID NO: 2908197 - RNA, 19 nt, Mycobacterium avium subsp. paratuberculosis
cggcgcgugcgccgcggcg

SEQ ID NO: 2908198 - RNA, 21 nt, Mycobacterium avium subsp. paratuberculosis
cggcgcgugcgccgcggcggc

SEQ ID NO: 2908199 - RNA, 17 nt, Mycobacterium avium subsp. paratuberculosis
cggcgcgugcgcgacga

SEQ ID NO: 2908200 - RNA, 22 nt, Mycobacterium avium subsp. paratuberculosis
cggcgcgugcuguugcaggugc

SEQ ID NO: 2908201 - RNA, 21 nt, Mycobacterium avium subsp. paratuberculosis
cggcgcguuccaucagcgccc

SEQ ID NO: 2908202 - RNA, 22 nt, Mycobacterium avium subsp. paratuberculosis
cggcgcguuccaucagcgcccg

SEQ ID NO: 2908203 - RNA, 20 nt, Mycobacterium avium subsp. paratuberculosis
cggcgcguuggcccgugucg

SEQ ID NO: 2908204 - RNA, 17 nt, Mycobacterium avium subsp. paratuberculosis
cggcgcuaaagccacca

SEQ ID NO: 2908205 - RNA, 18 nt, Mycobacterium avium subsp. paratuberculosis
cggcgcuaaagccaccag

SEQ ID NO: 2908206 - RNA, 19 nt, Mycobacterium avium subsp. paratuberculosis
cggcgcuaaagccaccagc

SEQ ID NO: 2908207 - RNA, 20 nt, Mycobacterium avium subsp. paratuberculosis
cggcgcuaaagccaccagcg

SEQ ID NO: 2908208 - RNA, 21 nt, Mycobacterium avium subsp. paratuberculosis
cggcgcuaaagccaccagcgu

SEQ ID NO: 2908209 - RNA, 17 nt, Mycobacterium avium subsp. paratuberculosis
cggcgcuaaagccgacc

SEQ ID NO: 2908210 - RNA, 23 nt, Mycobacterium avium subsp. paratuberculosis
cggcgcuaaagccgaccgccccg

SEQ ID NO: 2908211 - RNA, 17 nt, Mycobacterium avium subsp. paratuberculosis
cggcgcuacgccggcuc

SEQ ID NO: 2908212 - RNA, 13 nt, Mycobacterium avium subsp. paratuberculosis
cggcgcucaccgc

SEQ ID NO: 2908213 - RNA, 16 nt, Mycobacterium avium subsp. paratuberculosis
cggcgcucagcgcggc

SEQ ID NO: 2908214 - RNA, 13 nt, Mycobacterium avium subsp. paratuberculosis
cggcgcuccagcg

SEQ ID NO: 2908215 - RNA, 14 nt, Mycobacterium avium subsp. paratuberculosis
cggcgcuccagcgg

SEQ ID NO: 2908216 - RNA, 18 nt, Mycobacterium avium subsp. paratuberculosis
cggcgcuccagcgggcgg

SEQ ID NO: 2908217 - RNA, 21 nt, Mycobacterium avium subsp. paratuberculosis
cggcgcuccagcgggcggcgg

SEQ ID NO: 2908218 - RNA, 13 nt, Mycobacterium avium subsp. paratuberculosis
cggcgcucgccgc

SEQ ID NO: 2908219 - RNA, 16 nt, Mycobacterium avium subsp. paratuberculosis
cggcgcucgccgcgcg

SEQ ID NO: 2908220 - RNA, 18 nt, Mycobacterium avium subsp. paratuberculosis
cggcgcucgccgcgcggc

SEQ ID NO: 2908221 - RNA, 21 nt, Mycobacterium avium subsp. paratuberculosis
cggcgcucgccgcgcggcccg

SEQ ID NO: 2908222 - RNA, 16 nt, Mycobacterium avium subsp. paratuberculosis
cggcgcucgcgggugc

SEQ ID NO: 2908223 - RNA, 24 nt, Mycobacterium avium subsp. paratuberculosis
cggcgcucgcgggugcgcugcagc

SEQ ID NO: 2908224 - RNA, 18 nt, Mycobacterium avium subsp. paratuberculosis
cggcgcucggugugcggu

SEQ ID NO: 2908225 - RNA, 15 nt, Mycobacterium avium subsp. paratuberculosis
cggcgcucgucgucg

SEQ ID NO: 2908226 - RNA, 18 nt, Mycobacterium avium subsp. paratuberculosis
cggcgcucgucgucgccg

SEQ ID NO: 2908227 - RNA, 22 nt, Mycobacterium avium subsp. paratuberculosis
cggcgcucgucgucgccgaugc

SEQ ID NO: 2908228 - RNA, 20 nt, Mycobacterium avium subsp. paratuberculosis
cggcgcugaacugcucgacc

SEQ ID NO: 2908229 - RNA, 21 nt, Mycobacterium avium subsp. paratuberculosis
cggcgcugaacugcucgacca

SEQ ID NO: 2908230 - RNA, 22 nt, Mycobacterium avium subsp. paratuberculosis
cggcgcugaacugcucgaccag

SEQ ID NO: 2908231 - RNA, 19 nt, Mycobacterium avium subsp. paratuberculosis
cggcgcugaagugcagcgc

SEQ ID NO: 2908232 - RNA, 20 nt, Mycobacterium avium subsp. paratuberculosis
cggcgcugaagugcagcgca

SEQ ID NO: 2908233 - RNA, 14 nt, Mycobacterium avium subsp. paratuberculosis
cggcgcugaugccg

SEQ ID NO: 2908234 - RNA, 16 nt, Mycobacterium avium subsp. paratuberculosis
cggcgcugaugccguc

SEQ ID NO: 2908235 - RNA, 18 nt, Mycobacterium avium subsp. paratuberculosis
cggcgcugaugccguccu

SEQ ID NO: 2908236 - RNA, 14 nt, Mycobacterium avium subsp. paratuberculosis
cggcgcugcagcag

SEQ ID NO: 2908237 - RNA, 15 nt, Mycobacterium avium subsp. paratuberculosis
cggcgcugcagcagc

SEQ ID NO: 2908238 - RNA, 13 nt, Mycobacterium avium subsp. paratuberculosis
cggcgcugcccca

SEQ ID NO: 2908239 - RNA, 14 nt, Mycobacterium avium subsp. paratuberculosis
cggcgcugccccag

SEQ ID NO: 2908240 - RNA, 18 nt, Mycobacterium avium subsp. paratuberculosis
cggcgcugccccagccac

SEQ ID NO: 2908241 - RNA, 14 nt, Mycobacterium avium subsp. paratuberculosis
cggcgcugcccgcc

SEQ ID NO: 2908242 - RNA, 18 nt, Mycobacterium avium subsp. paratuberculosis
cggcgcugcccgccgcgg

SEQ ID NO: 2908243 - RNA, 21 nt, Mycobacterium avium subsp. paratuberculosis
cggcgcugcccgccgcggugc

SEQ ID NO: 2908244 - RNA, 15 nt, Mycobacterium avium subsp. paratuberculosis
cggcgcugcccgcga

SEQ ID NO: 2908245 - RNA, 16 nt, Mycobacterium avium subsp. paratuberculosis
cggcgcugcccgcgau

SEQ ID NO: 2908246 - RNA, 17 nt, Mycobacterium avium subsp. paratuberculosis
cggcgcugcccgcgauc

SEQ ID NO: 2908247 - RNA, 18 nt, Mycobacterium avium subsp. paratuberculosis
cggcgcugcccgcgaucg

SEQ ID NO: 2908248 - RNA, 19 nt, Mycobacterium avium subsp. paratuberculosis
cggcgcugcccgcgaucgc

SEQ ID NO: 2908249 - RNA, 14 nt, Mycobacterium avium subsp. paratuberculosis
cggcgcugcccguc

SEQ ID NO: 2908250 - RNA, 17 nt, Mycobacterium avium subsp. paratuberculosis
cggcgcugcccgucgac

SEQ ID NO: 2908251 - RNA, 16 nt, Mycobacterium avium subsp. paratuberculosis
cggcgcugccgccggc

SEQ ID NO: 2908252 - RNA, 12 nt, Mycobacterium avium subsp. paratuberculosis
cggcggcaccca

SEQ ID NO: 2908253 - RNA, 13 nt, Mycobacterium avium subsp. paratuberculosis
cggcggcacccag

SEQ ID NO: 2908254 - RNA, 21 nt, Mycobacterium avium subsp. paratuberculosis
cggcggcacccaggucaccga

SEQ ID NO: 2908255 - RNA, 23 nt, Mycobacterium avium subsp. paratuberculosis
cggcggcacccaggucaccgagg

SEQ ID NO: 2908256 - RNA, 13 nt, Mycobacterium avium subsp. paratuberculosis
cggcggcaccgau

SEQ ID NO: 2908257 - RNA, 16 nt, Mycobacterium avium subsp. paratuberculosis
cggcggcaccgcccgg

SEQ ID NO: 2908258 - RNA, 17 nt, Mycobacterium avium subsp. paratuberculosis
cggcggcaccgcccggg

SEQ ID NO: 2908259 - RNA, 17 nt, Mycobacterium avium subsp. paratuberculosis
cggcggcaccgccgcgg

SEQ ID NO: 2908260 - RNA, 20 nt, Mycobacterium avium subsp. paratuberculosis
cggcggcaccgccgcggugg

SEQ ID NO: 2908261 - RNA, 14 nt, Mycobacterium avium subsp. paratuberculosis
cggcggcaccgcgg

SEQ ID NO: 2908262 - RNA, 15 nt, Mycobacterium avium subsp. paratuberculosis
cggcggcaccgcggc

SEQ ID NO: 2908263 - RNA, 16 nt, Mycobacterium avium subsp. paratuberculosis
cggcggcaccgcggcu

SEQ ID NO: 2908264 - RNA, 19 nt, Mycobacterium avium subsp. paratuberculosis
cggcggcaccgcggcucgg

SEQ ID NO: 2908265 - RNA, 13 nt, Mycobacterium avium subsp. paratuberculosis
cggcggcacgguu

SEQ ID NO: 2908266 - RNA, 20 nt, Mycobacterium avium subsp. paratuberculosis
cggcggcacgguuggccggc

SEQ ID NO: 2908267 - RNA, 22 nt, Mycobacterium avium subsp. paratuberculosis
cggcggcagauagaucagcagg

SEQ ID NO: 2908268 - RNA, 16 nt, Mycobacterium avium subsp. paratuberculosis
cggcggcagcacccgc

SEQ ID NO: 2908269 - RNA, 21 nt, Mycobacterium avium subsp. paratuberculosis
cggcggcagcgaggcgcgcag

SEQ ID NO: 2908270 - RNA, 17 nt, Mycobacterium avium subsp. paratuberculosis
cggcggcagcgcggcgu

SEQ ID NO: 2908271 - RNA, 23 nt, Mycobacterium avium subsp. paratuberculosis
cggcggcagcgcggcguucagca

SEQ ID NO: 2908272 - RNA, 13 nt, Mycobacterium avium subsp. paratuberculosis
cggcggcaggugg

SEQ ID NO: 2908273 - RNA, 19 nt, Mycobacterium avium subsp. paratuberculosis
cggcggcaguccggcgagu

SEQ ID NO: 2908274 - RNA, 21 nt, Mycobacterium avium subsp. paratuberculosis
cggcggcaguccggcgaguac

SEQ ID NO: 2908275 - RNA, 16 nt, Mycobacterium avium subsp. paratuberculosis
cggcggcagucgcagc

SEQ ID NO: 2908276 - RNA, 16 nt, Mycobacterium avium subsp. paratuberculosis
cggcggcagugcgccg

SEQ ID NO: 2908277 - RNA, 20 nt, Mycobacterium avium subsp. paratuberculosis
cggcggcagugcgccguccc

SEQ ID NO: 2908278 - RNA, 20 nt, Mycobacterium avium subsp. paratuberculosis
cggcggcauaguccagcucg

SEQ ID NO: 2908279 - RNA, 21 nt, Mycobacterium avium subsp. paratuberculosis
cggcggcauaguccagcucgc

SEQ ID NO: 2908280 - RNA, 23 nt, Mycobacterium avium subsp. paratuberculosis
cggcggcauaguccagcucgcga

SEQ ID NO: 2908281 - RNA, 15 nt, Mycobacterium avium subsp. paratuberculosis
cggcggccaacgcga

SEQ ID NO: 2908282 - RNA, 16 nt, Mycobacterium avium subsp. paratuberculosis
cggcggccaacgcgac

SEQ ID NO: 2908283 - RNA, 19 nt, Mycobacterium avium subsp. paratuberculosis
cggcggccaacgcgacgaa

SEQ ID NO: 2908284 - RNA, 20 nt, Mycobacterium avium subsp. paratuberculosis
cggcggccaacgcgacgaag

SEQ ID NO: 2908285 - RNA, 23 nt, Mycobacterium avium subsp. paratuberculosis
cggcggccaacgcgacgaagccg

SEQ ID NO: 2908286 - RNA, 16 nt, Mycobacterium avium subsp. paratuberculosis
cggcggccaaucccac

SEQ ID NO: 2908287 - RNA, 18 nt, Mycobacterium avium subsp. paratuberculosis
cggcggccaaucccacca

SEQ ID NO: 2908288 - RNA, 19 nt, Mycobacterium avium subsp. paratuberculosis
cggcggccaaucgcugugc

SEQ ID NO: 2908289 - RNA, 12 nt, Mycobacterium avium subsp. paratuberculosis
cggcggccacca

SEQ ID NO: 2908290 - RNA, 13 nt, Mycobacterium avium subsp. paratuberculosis
cggcggccaccag

SEQ ID NO: 2908291 - RNA, 22 nt, Mycobacterium avium subsp. paratuberculosis
cggcggccaccagccggccggc

SEQ ID NO: 2908292 - RNA, 24 nt, Mycobacterium avium subsp. paratuberculosis
cggcggccaccagccggccggccg

SEQ ID NO: 2908293 - RNA, 14 nt, Mycobacterium avium subsp. paratuberculosis
cggcggccaccaug

SEQ ID NO: 2908294 - RNA, 13 nt, Mycobacterium avium subsp. paratuberculosis
cggcggccaccgc

SEQ ID NO: 2908295 - RNA, 14 nt, Mycobacterium avium subsp. paratuberculosis
cggcggccaccgcg

SEQ ID NO: 2908296 - RNA, 15 nt, Mycobacterium avium subsp. paratuberculosis
cggcggccaccgcgc

SEQ ID NO: 2908297 - RNA, 17 nt, Mycobacterium avium subsp. paratuberculosis
cggcggccaccgcgccg

SEQ ID NO: 2908298 - RNA, 19 nt, Mycobacterium avium subsp. paratuberculosis
cggcggccaccgcgccgug

SEQ ID NO: 2908299 - RNA, 12 nt, Mycobacterium avium subsp. paratuberculosis
cggcggccaccu

SEQ ID NO: 2908300 - RNA, 15 nt, Mycobacterium avium subsp. paratuberculosis
cggcggccaccucgc

SEQ ID NO: 2908301 - RNA, 16 nt, Mycobacterium avium subsp. paratuberculosis
cggcggccaccucgcc

SEQ ID NO: 2908302 - RNA, 17 nt, Mycobacterium avium subsp. paratuberculosis
cggcggccaccucggcg

SEQ ID NO: 2908303 - RNA, 19 nt, Mycobacterium avium subsp. paratuberculosis
cggcggccaccucggcggc

SEQ ID NO: 2908304 - RNA, 20 nt, Mycobacterium avium subsp. paratuberculosis
cggcggccaccucggcggca

SEQ ID NO: 2908305 - RNA, 21 nt, Mycobacterium avium subsp. paratuberculosis
cggcggccaccucggcggcac

SEQ ID NO: 2908306 - RNA, 16 nt, Mycobacterium avium subsp. paratuberculosis
cggcggccacgaucgc

SEQ ID NO: 2908307 - RNA, 20 nt, Mycobacterium avium subsp. paratuberculosis
cggcggccacgaucgcggcc

SEQ ID NO: 2908308 - RNA, 23 nt, Mycobacterium avium subsp. paratuberculosis
cggcggccacgaucgcggccagc

SEQ ID NO: 2908309 - RNA, 19 nt, Mycobacterium avium subsp. paratuberculosis
cggcggccacgcaggcguc

SEQ ID NO: 2908310 - RNA, 14 nt, Mycobacterium avium subsp. paratuberculosis
cggcggccagcauc

SEQ ID NO: 2908311 - RNA, 15 nt, Mycobacterium avium subsp. paratuberculosis
cggcggccagcaucg

SEQ ID NO: 2908312 - RNA, 16 nt, Mycobacterium avium subsp. paratuberculosis
cggcggccagcaucgg

SEQ ID NO: 2908313 - RNA, 12 nt, Mycobacterium avium subsp. paratuberculosis
cggcggccagcg

SEQ ID NO: 2908314 - RNA, 13 nt, Mycobacterium avium subsp. paratuberculosis
cggcggccagcga

SEQ ID NO: 2908315 - RNA, 18 nt, Mycobacterium avium subsp. paratuberculosis
cggcggccagcgagucga

SEQ ID NO: 2908316 - RNA, 13 nt, Mycobacterium avium subsp. paratuberculosis
cggcggccagcgc

SEQ ID NO: 2908317 - RNA, 14 nt, Mycobacterium avium subsp. paratuberculosis
cggcggccagcgcg

SEQ ID NO: 2908318 - RNA, 15 nt, Mycobacterium avium subsp. paratuberculosis
cggcggccagcgcga

SEQ ID NO: 2908319 - RNA, 20 nt, Mycobacterium avium subsp. paratuberculosis
cggcggccagcgcgacgcgc

SEQ ID NO: 2908320 - RNA, 24 nt, Mycobacterium avium subsp. paratuberculosis
cggcggccagcgcgacgcgcaugc

SEQ ID NO: 2908321 - RNA, 16 nt, Mycobacterium avium subsp. paratuberculosis
cggcggccagcucggc

SEQ ID NO: 2908322 - RNA, 23 nt, Mycobacterium avium subsp. paratuberculosis
cggcggccagcucggcccgcugc

SEQ ID NO: 2908323 - RNA, 11 nt, Mycobacterium avium subsp. paratuberculosis
cggcggccagg

SEQ ID NO: 2908324 - RNA, 13 nt, Mycobacterium avium subsp. paratuberculosis
cggcggccagggu

SEQ ID NO: 2908325 - RNA, 14 nt, Mycobacterium avium subsp. paratuberculosis
cggcggccagggug

SEQ ID NO: 2908326 - RNA, 14 nt, Mycobacterium avium subsp. paratuberculosis
cggcggccaucucg

SEQ ID NO: 2908327 - RNA, 19 nt, Mycobacterium avium subsp. paratuberculosis
cggcggccauggucgcggc

SEQ ID NO: 2908328 - RNA, 12 nt, Mycobacterium avium subsp. paratuberculosis
cggcggccaugu

SEQ ID NO: 2908329 - RNA, 13 nt, Mycobacterium avium subsp. paratuberculosis
cggcggccauguc

SEQ ID NO: 2908330 - RNA, 21 nt, Mycobacterium avium subsp. paratuberculosis
cggcggccaugucggagcugc

SEQ ID NO: 2908331 - RNA, 19 nt, Mycobacterium avium subsp. paratuberculosis
cggcggccauucaucgcgc

SEQ ID NO: 2908332 - RNA, 21 nt, Mycobacterium avium subsp. paratuberculosis
cggcggccauucaucgcgcac

SEQ ID NO: 2908333 - RNA, 15 nt, Mycobacterium avium subsp. paratuberculosis
cggcggccccgguag

SEQ ID NO: 2908334 - RNA, 19 nt, Mycobacterium avium subsp. paratuberculosis
cggcggccccuucgauguc

SEQ ID NO: 2908335 - RNA, 13 nt, Mycobacterium avium subsp. paratuberculosis
cggcggcccgcag

SEQ ID NO: 2908336 - RNA, 13 nt, Mycobacterium avium subsp. paratuberculosis
cggcggcccgccg

SEQ ID NO: 2908337 - RNA, 14 nt, Mycobacterium avium subsp. paratuberculosis
cggcggccucgccg

SEQ ID NO: 2908338 - RNA, 21 nt, Mycobacterium avium subsp. paratuberculosis
cggcggccucgccgucgaagg

SEQ ID NO: 2908339 - RNA, 23 nt, Mycobacterium avium subsp. paratuberculosis
cggcggccucgguggucgcguag

SEQ ID NO: 2908340 - RNA, 17 nt, Mycobacterium avium subsp. paratuberculosis
cggcggccugcaccucg

SEQ ID NO: 2908341 - RNA, 20 nt, Mycobacterium avium subsp. paratuberculosis
cggcggccugcgcgucgucg

SEQ ID NO: 2908342 - RNA, 22 nt, Mycobacterium avium subsp. paratuberculosis
cggcggccugcgcgucgucgcc

SEQ ID NO: 2908343 - RNA, 14 nt, Mycobacterium avium subsp. paratuberculosis
cggcggccugcggc

SEQ ID NO: 2908344 - RNA, 18 nt, Mycobacterium avium subsp. paratuberculosis
cggcggccugcggcggca

SEQ ID NO: 2908345 - RNA, 13 nt, Mycobacterium avium subsp. paratuberculosis
cggcggccugcuc

SEQ ID NO: 2908346 - RNA, 15 nt, Mycobacterium avium subsp. paratuberculosis
cggcggccugcucca

SEQ ID NO: 2908347 - RNA, 20 nt, Mycobacterium avium subsp. paratuberculosis
cggcggccugcuucucgccg

SEQ ID NO: 2908348 - RNA, 18 nt, Mycobacterium avium subsp. paratuberculosis
cggcggccugcuugaccg

SEQ ID NO: 2908349 - RNA, 20 nt, Mycobacterium avium subsp. paratuberculosis
cggcggccugcuugaccgcc

SEQ ID NO: 2908350 - RNA, 17 nt, Mycobacterium avium subsp. paratuberculosis
cggcggccuggccgucg

SEQ ID NO: 2908351 - RNA, 21 nt, Mycobacterium avium subsp. paratuberculosis
cggcggccuggccgucgcggc

SEQ ID NO: 2908352 - RNA, 20 nt, Mycobacterium avium subsp. paratuberculosis
cggcggccuucuuggccgga

SEQ ID NO: 2908353 - RNA, 22 nt, Mycobacterium avium subsp. paratuberculosis
cggcggccuucuuggccggagc

SEQ ID NO: 2908354 - RNA, 17 nt, Mycobacterium avium subsp. paratuberculosis
cggccggcugcagccgg

SEQ ID NO: 2908355 - RNA, 23 nt, Mycobacterium avium subsp. paratuberculosis
cggccggcugcagccgggcggcg

SEQ ID NO: 2908356 - RNA, 20 nt, Mycobacterium avium subsp. paratuberculosis
cggccgggaaacccucgacg

SEQ ID NO: 2908357 - RNA, 21 nt, Mycobacterium avium subsp. paratuberculosis
cggccgggaaacccucgacgc

SEQ ID NO: 2908358 - RNA, 23 nt, Mycobacterium avium subsp. paratuberculosis
cggccgggaaacccucgacgccg

SEQ ID NO: 2908359 - RNA, 13 nt, Mycobacterium avium subsp. paratuberculosis
cggccgggaucug

SEQ ID NO: 2908360 - RNA, 14 nt, Mycobacterium avium subsp. paratuberculosis
cggccgggaucugg

SEQ ID NO: 2908361 - RNA, 18 nt, Mycobacterium avium subsp. paratuberculosis
cggccgggaucuggccgg

SEQ ID NO: 2908362 - RNA, 22 nt, Mycobacterium avium subsp. paratuberculosis
cggccgggaucuggccggugag

SEQ ID NO: 2908363 - RNA, 17 nt, Mycobacterium avium subsp. paratuberculosis
cggccgggaugccgccg

SEQ ID NO: 2908364 - RNA, 20 nt, Mycobacterium avium subsp. paratuberculosis
cggccgggaugccgccgguc

SEQ ID NO: 2908365 - RNA, 22 nt, Mycobacterium avium subsp. paratuberculosis
cggccgggaugccgccggucac

SEQ ID NO: 2908366 - RNA, 14 nt, Mycobacterium avium subsp. paratuberculosis
cggaccgcaccccc

SEQ ID NO: 2908367 - RNA, 21 nt, Mycobacterium avium subsp. paratuberculosis
cggaccgcacccccagcucga

SEQ ID NO: 2908368 - RNA, 14 nt, Mycobacterium avium subsp. paratuberculosis
cggaccgccgcggc

SEQ ID NO: 2908369 - RNA, 16 nt, Mycobacterium avium subsp. paratuberculosis
cggaccgccgcggcgc

SEQ ID NO: 2908370 - RNA, 17 nt, Mycobacterium avium subsp. paratuberculosis
cggaccgccgcggcgcc

SEQ ID NO: 2908371 - RNA, 18 nt, Mycobacterium avium subsp. paratuberculosis
cggaccgccgcggcgccc

SEQ ID NO: 2908372 - RNA, 20 nt, Mycobacterium avium subsp. paratuberculosis
cggaccgccgcggcgcccgg

SEQ ID NO: 2908373 - RNA, 21 nt, Mycobacterium avium subsp. paratuberculosis
cggaccgccgcggcgcccggc

SEQ ID NO: 2908374 - RNA, 16 nt, Mycobacterium avium subsp. paratuberculosis
cggaccgccgcggcgg

SEQ ID NO: 2908375 - RNA, 17 nt, Mycobacterium avium subsp. paratuberculosis
cggaccgcgcgggccag

SEQ ID NO: 2908376 - RNA, 19 nt, Mycobacterium avium subsp. paratuberculosis
cggaccgcgcgggccagcg

SEQ ID NO: 2908377 - RNA, 21 nt, Mycobacterium avium subsp. paratuberculosis
cggaccgcgcgggccagcgcc

SEQ ID NO: 2908378 - RNA, 15 nt, Mycobacterium avium subsp. paratuberculosis
cggaccgcggaaccg

SEQ ID NO: 2908379 - RNA, 14 nt, Mycobacterium avium subsp. paratuberculosis
cggaccgcggucgg

SEQ ID NO: 2908380 - RNA, 16 nt, Mycobacterium avium subsp. paratuberculosis
cggaccgcggucgggu

SEQ ID NO: 2908381 - RNA, 18 nt, Mycobacterium avium subsp. paratuberculosis
cggaccgcggucgggucc

SEQ ID NO: 2908382 - RNA, 22 nt, Mycobacterium avium subsp. paratuberculosis
cggaccgcggucgggucccggc

SEQ ID NO: 2908383 - RNA, 20 nt, Mycobacterium avium subsp. paratuberculosis
cggaccgcuugacgccgccg

SEQ ID NO: 2908384 - RNA, 23 nt, Mycobacterium avium subsp. paratuberculosis
cggaccgcuugacgccgccgaac

SEQ ID NO: 2908385 - RNA, 15 nt, Mycobacterium avium subsp. paratuberculosis
cggaccggccagcag

SEQ ID NO: 2908386 - RNA, 12 nt, Mycobacterium avium subsp. paratuberculosis
cggaccggccgu

SEQ ID NO: 2908387 - RNA, 20 nt, Mycobacterium avium subsp. paratuberculosis
cggaccggccgugcgcgucg

SEQ ID NO: 2908388 - RNA, 13 nt, Mycobacterium avium subsp. paratuberculosis
cggaccggcggcc

SEQ ID NO: 2908389 - RNA, 15 nt, Mycobacterium avium subsp. paratuberculosis
cggaccggcggccgc

SEQ ID NO: 2908390 - RNA, 18 nt, Mycobacterium avium subsp. paratuberculosis
cggaccggcggccgccau

SEQ ID NO: 2908391 - RNA, 11 nt, Mycobacterium avium subsp. paratuberculosis
cggaccggcuc

SEQ ID NO: 2908392 - RNA, 18 nt, Mycobacterium avium subsp. paratuberculosis
cggaccggcucguagcug

SEQ ID NO: 2908393 - RNA, 14 nt, Mycobacterium avium subsp. paratuberculosis
cggaccgggcgggc

SEQ ID NO: 2908394 - RNA, 20 nt, Mycobacterium avium subsp. paratuberculosis
cggaccgggcgggcugcggg

SEQ ID NO: 2908395 - RNA, 21 nt, Mycobacterium avium subsp. paratuberculosis
cggaccgggcgggcugcgggc

SEQ ID NO: 2908396 - RNA, 20 nt, Mycobacterium avium subsp. paratuberculosis
cggaccgggugaccggcgcg

SEQ ID NO: 2908397 - RNA, 21 nt, Mycobacterium avium subsp. paratuberculosis
cggaccgggugaccggcgcgc

SEQ ID NO: 2908398 - RNA, 20 nt, Mycobacterium avium subsp. paratuberculosis
cggaccgguaggcgcaccgc

SEQ ID NO: 2908399 - RNA, 13 nt, Mycobacterium avium subsp. paratuberculosis
cggaccgucggug

SEQ ID NO: 2908400 - RNA, 14 nt, Mycobacterium avium subsp. paratuberculosis
cggaccgucggugu

SEQ ID NO: 2908401 - RNA, 15 nt, Mycobacterium avium subsp. paratuberculosis
cggaccucgaccagc

SEQ ID NO: 2908402 - RNA, 16 nt, Mycobacterium avium subsp. paratuberculosis
cggaccucgaccagcc

SEQ ID NO: 2908403 - RNA, 18 nt, Mycobacterium avium subsp. paratuberculosis
cggaccugggugcgccac

SEQ ID NO: 2908404 - RNA, 21 nt, Mycobacterium avium subsp. paratuberculosis
cggaccugggugcgccacugc

SEQ ID NO: 2908405 - RNA, 18 nt, Mycobacterium avium subsp. paratuberculosis
cggaccuuggugucggcg

SEQ ID NO: 2908406 - RNA, 16 nt, Mycobacterium avium subsp. paratuberculosis
cggacgaacaucgagc

SEQ ID NO: 2908407 - RNA, 17 nt, Mycobacterium avium subsp. paratuberculosis
cggacgaacaucgagcc

SEQ ID NO: 2908408 - RNA, 22 nt, Mycobacterium avium subsp. paratuberculosis
cggacgaacaucgagcccaccg

SEQ ID NO: 2908409 - RNA, 21 nt, Mycobacterium avium subsp. paratuberculosis
cggacgaacgaguugccccgu

SEQ ID NO: 2908410 - RNA, 13 nt, Mycobacterium avium subsp. paratuberculosis
cggacgaccuggg

SEQ ID NO: 2908411 - RNA, 19 nt, Mycobacterium avium subsp. paratuberculosis
cggacgaccugggcgccgu

SEQ ID NO: 2908412 - RNA, 20 nt, Mycobacterium avium subsp. paratuberculosis
cggacgaccugggcgccguc

SEQ ID NO: 2908413 - RNA, 12 nt, Mycobacterium avium subsp. paratuberculosis
cggacgacggcc

SEQ ID NO: 2908414 - RNA, 15 nt, Mycobacterium avium subsp. paratuberculosis
cggacgacggccagc

SEQ ID NO: 2908415 - RNA, 16 nt, Mycobacterium avium subsp. paratuberculosis
cggacgacggccagcu

SEQ ID NO: 2908416 - RNA, 17 nt, Mycobacterium avium subsp. paratuberculosis
cggacgacggccagcug

SEQ ID NO: 2908417 - RNA, 20 nt, Mycobacterium avium subsp. paratuberculosis
cggacgacucguucgacgcc

SEQ ID NO: 2908418 - RNA, 21 nt, Mycobacterium avium subsp. paratuberculosis
cggacgacucguucgacgccg

SEQ ID NO: 2908419 - RNA, 19 nt, Mycobacterium avium subsp. paratuberculosis
cggacgaugacccagccca

SEQ ID NO: 2908420 - RNA, 12 nt, Mycobacterium avium subsp. paratuberculosis
cggacgaugccg

SEQ ID NO: 2908421 - RNA, 17 nt, Mycobacterium avium subsp. paratuberculosis
cggacgaugccgcggcg

SEQ ID NO: 2908422 - RNA, 20 nt, Mycobacterium avium subsp. paratuberculosis
cggacgaugccgcggcgucc

SEQ ID NO: 2908423 - RNA, 16 nt, Mycobacterium avium subsp. paratuberculosis
cggacgaugcgcaccc

SEQ ID NO: 2908424 - RNA, 18 nt, Mycobacterium avium subsp. paratuberculosis
cggacgaugcgcaccccc

SEQ ID NO: 2908425 - RNA, 16 nt, Mycobacterium avium subsp. paratuberculosis
cggacgauguccgccg

SEQ ID NO: 2908426 - RNA, 18 nt, Mycobacterium avium subsp. paratuberculosis
cggacgauguccgccggc

SEQ ID NO: 2908427 - RNA, 19 nt, Mycobacterium avium subsp. paratuberculosis
cggacgauguccgccggcc

SEQ ID NO: 2908428 - RNA, 20 nt, Mycobacterium avium subsp. paratuberculosis
cggacgauguccgccggccg

SEQ ID NO: 2908429 - RNA, 17 nt, Mycobacterium avium subsp. paratuberculosis
cggacgauucgcgauca

SEQ ID NO: 2908430 - RNA, 12 nt, Mycobacterium avium subsp. paratuberculosis
cggacgcagcga

SEQ ID NO: 2908431 - RNA, 21 nt, Mycobacterium avium subsp. paratuberculosis
cggacgcagcgaucggcggcu

SEQ ID NO: 2908432 - RNA, 22 nt, Mycobacterium avium subsp. paratuberculosis
cggacgcauccacggccgguuc

SEQ ID NO: 2908433 - RNA, 17 nt, Mycobacterium avium subsp. paratuberculosis
cggacgccaguggcugc

SEQ ID NO: 2908434 - RNA, 14 nt, Mycobacterium avium subsp. paratuberculosis
cggacgcccgucgc

SEQ ID NO: 2908435 - RNA, 15 nt, Mycobacterium avium subsp. paratuberculosis
cggacgcccgucgcg

SEQ ID NO: 2908436 - RNA, 16 nt, Mycobacterium avium subsp. paratuberculosis
cggacgcccgucgcgc

SEQ ID NO: 2908437 - RNA, 16 nt, Mycobacterium avium subsp. paratuberculosis
cggacgccggcagccg

SEQ ID NO: 2908438 - RNA, 19 nt, Mycobacterium avium subsp. paratuberculosis
cggacgccggcagccgcuc

SEQ ID NO: 2908439 - RNA, 16 nt, Mycobacterium avium subsp. paratuberculosis
cggacgccucccccac

SEQ ID NO: 2908440 - RNA, 18 nt, Mycobacterium avium subsp. paratuberculosis
cggacgccucccccaccc

SEQ ID NO: 2908441 - RNA, 13 nt, Mycobacterium avium subsp. paratuberculosis
cggacgccucgcc

SEQ ID NO: 2908442 - RNA, 19 nt, Mycobacterium avium subsp. paratuberculosis
cggacgcgcacacggccuc

SEQ ID NO: 2908443 - RNA, 23 nt, Mycobacterium avium subsp. paratuberculosis
cggacgcgcacacggccucgccc

SEQ ID NO: 2908444 - RNA, 13 nt, Mycobacterium avium subsp. paratuberculosis
cggacgcggccag

SEQ ID NO: 2908445 - RNA, 13 nt, Mycobacterium avium subsp. paratuberculosis
cggacgcggccga

SEQ ID NO: 2908446 - RNA, 14 nt, Mycobacterium avium subsp. paratuberculosis
cggaggugccgcgc

SEQ ID NO: 2908447 - RNA, 15 nt, Mycobacterium avium subsp. paratuberculosis
cggaggugccgcgcg

SEQ ID NO: 2908448 - RNA, 16 nt, Mycobacterium avium subsp. paratuberculosis
cggaggugccgcgcgg

SEQ ID NO: 2908449 - RNA, 20 nt, Mycobacterium avium subsp. paratuberculosis
cggaggugccgcgcggcagg

SEQ ID NO: 2908450 - RNA, 17 nt, Mycobacterium avium subsp. paratuberculosis
cggaggugccggccggu

SEQ ID NO: 2908451 - RNA, 21 nt, Mycobacterium avium subsp. paratuberculosis
cggccgccagcgcggcgauca

SEQ ID NO: 2908452 - RNA, 14 nt, Mycobacterium avium subsp. paratuberculosis
cggccgccagggcc

SEQ ID NO: 2908453 - RNA, 15 nt, Mycobacterium avium subsp. paratuberculosis
cggccgccagggcca

SEQ ID NO: 2908454 - RNA, 16 nt, Mycobacterium avium subsp. paratuberculosis
cggccgccaucgaucg

SEQ ID NO: 2908455 - RNA, 17 nt, Mycobacterium avium subsp. paratuberculosis
cggccgccaucgaucgg

SEQ ID NO: 2908456 - RNA, 12 nt, Mycobacterium avium subsp. paratuberculosis
cggccgcccagc

SEQ ID NO: 2908457 - RNA, 13 nt, Mycobacterium avium subsp. paratuberculosis
cggccgcccaguc

SEQ ID NO: 2908458 - RNA, 14 nt, Mycobacterium avium subsp. paratuberculosis
cggccgcccagucg

SEQ ID NO: 2908459 - RNA, 15 nt, Mycobacterium avium subsp. paratuberculosis
cggccgcccagucgc

SEQ ID NO: 2908460 - RNA, 11 nt, Mycobacterium avium subsp. paratuberculosis
cggccgcccgc

SEQ ID NO: 2908461 - RNA, 16 nt, Mycobacterium avium subsp. paratuberculosis
cggccgcccgcaccag

SEQ ID NO: 2908462 - RNA, 17 nt, Mycobacterium avium subsp. paratuberculosis
cggccgcccgcaccagc

SEQ ID NO: 2908463 - RNA, 18 nt, Mycobacterium avium subsp. paratuberculosis
cggccgcccgcaccagca

SEQ ID NO: 2908464 - RNA, 21 nt, Mycobacterium avium subsp. paratuberculosis
cggccgcccgcaccagcaggu

SEQ ID NO: 2908465 - RNA, 16 nt, Mycobacterium avium subsp. paratuberculosis
cggccgcccggcgagc

SEQ ID NO: 2908466 - RNA, 18 nt, Mycobacterium avium subsp. paratuberculosis
cggccgcccggcgagcag

SEQ ID NO: 2908467 - RNA, 19 nt, Mycobacterium avium subsp. paratuberculosis
cggccgcccggcgagcagc

SEQ ID NO: 2908468 - RNA, 13 nt, Mycobacterium avium subsp. paratuberculosis
cggccgcccgggc

SEQ ID NO: 2908469 - RNA, 18 nt, Mycobacterium avium subsp. paratuberculosis
cggccgcccgggcggccc

SEQ ID NO: 2908470 - RNA, 19 nt, Mycobacterium avium subsp. paratuberculosis
cggccgcccgggcggcccg

SEQ ID NO: 2908471 - RNA, 20 nt, Mycobacterium avium subsp. paratuberculosis
cggccgcccgggcggcccgc

SEQ ID NO: 2908472 - RNA, 13 nt, Mycobacterium avium subsp. paratuberculosis
cggccgcccgucc

SEQ ID NO: 2908473 - RNA, 14 nt, Mycobacterium avium subsp. paratuberculosis
cggccgcccguccg

SEQ ID NO: 2908474 - RNA, 18 nt, Mycobacterium avium subsp. paratuberculosis
cggccgcccguccgggcc

SEQ ID NO: 2908475 - RNA, 20 nt, Mycobacterium avium subsp. paratuberculosis
cggccgcccguccgggccgg

SEQ ID NO: 2908476 - RNA, 14 nt, Mycobacterium avium subsp. paratuberculosis
cggccgcccgucgg

SEQ ID NO: 2908477 - RNA, 15 nt, Mycobacterium avium subsp. paratuberculosis
cggccgcccgucggg

SEQ ID NO: 2908478 - RNA, 17 nt, Mycobacterium avium subsp. paratuberculosis
cggccgcccgucggggc

SEQ ID NO: 2908479 - RNA, 15 nt, Mycobacterium avium subsp. paratuberculosis
cggccgccgaagccg

SEQ ID NO: 2908480 - RNA, 18 nt, Mycobacterium avium subsp. paratuberculosis
cggccgccgaagccggcu

SEQ ID NO: 2908481 - RNA, 21 nt, Mycobacterium avium subsp. paratuberculosis
cggccgccgaagccggcucga

SEQ ID NO: 2908482 - RNA, 14 nt, Mycobacterium avium subsp. paratuberculosis
cggccgccgacacc

SEQ ID NO: 2908483 - RNA, 15 nt, Mycobacterium avium subsp. paratuberculosis
cggccgccgacacca

SEQ ID NO: 2908484 - RNA, 22 nt, Mycobacterium avium subsp. paratuberculosis
cggccgccgacaccaccacgaa

SEQ ID NO: 2908485 - RNA, 15 nt, Mycobacterium avium subsp. paratuberculosis
cggccgccgaggaca

SEQ ID NO: 2908486 - RNA, 13 nt, Mycobacterium avium subsp. paratuberculosis
cggccgccgaggc

SEQ ID NO: 2908487 - RNA, 14 nt, Mycobacterium avium subsp. paratuberculosis
cggccgccgaggcg

SEQ ID NO: 2908488 - RNA, 22 nt, Mycobacterium avium subsp. paratuberculosis
cggccgccgaggcgaugccgug

SEQ ID NO: 2908489 - RNA, 13 nt, Mycobacterium avium subsp. paratuberculosis
cggccgccgauca

SEQ ID NO: 2908490 - RNA, 17 nt, Mycobacterium avium subsp. paratuberculosis
cggccgccgaucaacag

SEQ ID NO: 2908491 - RNA, 20 nt, Mycobacterium avium subsp. paratuberculosis
cggccgccgaucaacaggcc

SEQ ID NO: 2908492 - RNA, 13 nt, Mycobacterium avium subsp. paratuberculosis
cggccgccgcccg

SEQ ID NO: 2908493 - RNA, 21 nt, Mycobacterium avium subsp. paratuberculosis
cggccgccgcccgcgcggcgg

SEQ ID NO: 2908494 - RNA, 14 nt, Mycobacterium avium subsp. paratuberculosis
cggccgccgccgcg

SEQ ID NO: 2908495 - RNA, 15 nt, Mycobacterium avium subsp. paratuberculosis
cggccgccgccgcgg

SEQ ID NO: 2908496 - RNA, 16 nt, Mycobacterium avium subsp. paratuberculosis
cggccgccgccgcggc

SEQ ID NO: 2908497 - RNA, 18 nt, Mycobacterium avium subsp. paratuberculosis
cggccgccgccgcggccg

SEQ ID NO: 2908498 - RNA, 14 nt, Mycobacterium avium subsp. paratuberculosis
cggccgccgcgacg

SEQ ID NO: 2908499 - RNA, 19 nt, Mycobacterium avium subsp. paratuberculosis
cggccgccgcgacgccgug

SEQ ID NO: 2908500 - RNA, 16 nt, Mycobacterium avium subsp. paratuberculosis
cggccgccgcgacggc

SEQ ID NO: 2908501 - RNA, 22 nt, Mycobacterium avium subsp. paratuberculosis
cggccgccgcgacggccgccga

SEQ ID NO: 2908502 - RNA, 14 nt, Mycobacterium avium subsp. paratuberculosis
cggccgccgcgauc

SEQ ID NO: 2908503 - RNA, 15 nt, Mycobacterium avium subsp. paratuberculosis
cggccgccgcgauca

SEQ ID NO: 2908504 - RNA, 15 nt, Mycobacterium avium subsp. paratuberculosis
cggccgccgcgcauc

SEQ ID NO: 2908505 - RNA, 23 nt, Mycobacterium avium subsp. paratuberculosis
cggccgccggaucgugucccggc

SEQ ID NO: 2908506 - RNA, 23 nt, Mycobacterium avium subsp. paratuberculosis
cggccgccggauuacucgccggc

SEQ ID NO: 2908507 - RNA, 13 nt, Mycobacterium avium subsp. paratuberculosis
cggccgccggcac

SEQ ID NO: 2908508 - RNA, 14 nt, Mycobacterium avium subsp. paratuberculosis
cggccgccggcacc

SEQ ID NO: 2908509 - RNA, 13 nt, Mycobacterium avium subsp. paratuberculosis
cggccgccggcca

SEQ ID NO: 2908510 - RNA, 15 nt, Mycobacterium avium subsp. paratuberculosis
cggccgccggccagc

SEQ ID NO: 2908511 - RNA, 16 nt, Mycobacterium avium subsp. paratuberculosis
cggccgccggccagcu

SEQ ID NO: 2908512 - RNA, 17 nt, Mycobacterium avium subsp. paratuberculosis
cggccgccggccagcuc

SEQ ID NO: 2908513 - RNA, 14 nt, Mycobacterium avium subsp. paratuberculosis
cggccgccggcggc

SEQ ID NO: 2908514 - RNA, 15 nt, Mycobacterium avium subsp. paratuberculosis
cggccgccggcggcc

SEQ ID NO: 2908515 - RNA, 22 nt, Mycobacterium avium subsp. paratuberculosis
cggccgccggcggccaauccca

SEQ ID NO: 2908516 - RNA, 16 nt, Mycobacterium avium subsp. paratuberculosis
cggccgccgggacggg

SEQ ID NO: 2908517 - RNA, 12 nt, Mycobacterium avium subsp. paratuberculosis
cggccgccgggc

SEQ ID NO: 2908518 - RNA, 18 nt, Mycobacterium avium subsp. paratuberculosis
cggccgccgggccggcgg

SEQ ID NO: 2908519 - RNA, 19 nt, Mycobacterium avium subsp. paratuberculosis
cggccgccgggccggcggc

SEQ ID NO: 2908520 - RNA, 21 nt, Mycobacterium avium subsp. paratuberculosis
cggccgccggggccccaaccc

SEQ ID NO: 2908521 - RNA, 19 nt, Mycobacterium avium subsp. paratuberculosis
cggccgccguaucccugcc

SEQ ID NO: 2908522 - RNA, 21 nt, Mycobacterium avium subsp. paratuberculosis
cggccgccguaucccugccag

SEQ ID NO: 2908523 - RNA, 19 nt, Mycobacterium avium subsp. paratuberculosis
cggccgccguggcccacgc

SEQ ID NO: 2908524 - RNA, 16 nt, Mycobacterium avium subsp. paratuberculosis
cggccgccuccagcac

SEQ ID NO: 2908525 - RNA, 18 nt, Mycobacterium avium subsp. paratuberculosis
cggccgccucccgcagcg

SEQ ID NO: 2908526 - RNA, 23 nt, Mycobacterium avium subsp. paratuberculosis
cggccgccucccgcagcgccagc

SEQ ID NO: 2908527 - RNA, 22 nt, Mycobacterium avium subsp. paratuberculosis
cggccgccuccgguuugcgccg

SEQ ID NO: 2908528 - RNA, 13 nt, Mycobacterium avium subsp. paratuberculosis
cggccgccuggac

SEQ ID NO: 2908529 - RNA, 16 nt, Mycobacterium avium subsp. paratuberculosis
cggccgccuggacgac

SEQ ID NO: 2908530 - RNA, 18 nt, Mycobacterium avium subsp. paratuberculosis
cggccgccuucacgaccg

SEQ ID NO: 2908531 - RNA, 20 nt, Mycobacterium avium subsp. paratuberculosis
cggccgccuucacgaccggc

SEQ ID NO: 2908532 - RNA, 21 nt, Mycobacterium avium subsp. paratuberculosis
cggccgccuucacgaccggca

SEQ ID NO: 2908533 - RNA, 18 nt, Mycobacterium avium subsp. paratuberculosis
cggccgccuuggugaucc

SEQ ID NO: 2908534 - RNA, 21 nt, Mycobacterium avium subsp. paratuberculosis
cggccgcgaaggcggcgucga

SEQ ID NO: 2908535 - RNA, 23 nt, Mycobacterium avium subsp. paratuberculosis
cggccgcgaaggcggcgucgaug

SEQ ID NO: 2908536 - RNA, 14 nt, Mycobacterium avium subsp. paratuberculosis
cggccgcgacagcc

SEQ ID NO: 2908537 - RNA, 15 nt, Mycobacterium avium subsp. paratuberculosis
cggccgcgacagccg

SEQ ID NO: 2908538 - RNA, 16 nt, Mycobacterium avium subsp. paratuberculosis
cggccgcgacagccgg

SEQ ID NO: 2908539 - RNA, 14 nt, Mycobacterium avium subsp. paratuberculosis
cggccgcgacgacc

SEQ ID NO: 2908540 - RNA, 20 nt, Mycobacterium avium subsp. paratuberculosis
cggccgcgacgaccgccugc

SEQ ID NO: 2908541 - RNA, 22 nt, Mycobacterium avium subsp. paratuberculosis
cggccgcgacgaccgccugcuu

SEQ ID NO: 2908542 - RNA, 14 nt, Mycobacterium avium subsp. paratuberculosis
cggccgcgacgcgc

SEQ ID NO: 2908543 - RNA, 16 nt, Mycobacterium avium subsp. paratuberculosis
cggccgcgacugcacc

SEQ ID NO: 2908544 - RNA, 21 nt, Mycobacterium avium subsp. paratuberculosis
cggccgcgacugcaggugacg

SEQ ID NO: 2908545 - RNA, 15 nt, Mycobacterium avium subsp. paratuberculosis
cggccgcgagcccgg

SEQ ID NO: 2908546 - RNA, 16 nt, Mycobacterium avium subsp. paratuberculosis
cggccgcgagcccggc

SEQ ID NO: 2908547 - RNA, 17 nt, Mycobacterium avium subsp. paratuberculosis
cggccgcgagcccggcg

SEQ ID NO: 2908548 - RNA, 19 nt, Mycobacterium avium subsp. paratuberculosis
cggccgcgagcccggcgac

SEQ ID NO: 2908549 - RNA, 20 nt, Mycobacterium avium subsp. paratuberculosis
cggccgcgagcccggcgacg

SEQ ID NO: 2908550 - RNA, 15 nt, Mycobacterium avium subsp. paratuberculosis
cggccgcgauccagc

SEQ ID NO: 2908551 - RNA, 17 nt, Mycobacterium avium subsp. paratuberculosis
cggccgcgauccagcgc

SEQ ID NO: 2908552 - RNA, 20 nt, Mycobacterium avium subsp. paratuberculosis
cggccgcgaucgccaacgcg

SEQ ID NO: 2908553 - RNA, 15 nt, Mycobacterium avium subsp. paratuberculosis
cggccgcgauguagc

SEQ ID NO: 2908554 - RNA, 15 nt, Mycobacterium avium subsp. paratuberculosis
cggccgcgaugucgg

SEQ ID NO: 2908555 - RNA, 19 nt, Mycobacterium avium subsp. paratuberculosis
cggccgcgaugucgguggg

SEQ ID NO: 2908556 - RNA, 13 nt, Mycobacterium avium subsp. paratuberculosis
cggccgcgcaccg

SEQ ID NO: 2908557 - RNA, 22 nt, Mycobacterium avium subsp. paratuberculosis
cggccgcgcaccgccccgcccu

SEQ ID NO: 2908558 - RNA, 12 nt, Mycobacterium avium subsp. paratuberculosis
cggccgcgcaga

SEQ ID NO: 2908559 - RNA, 21 nt, Mycobacterium avium subsp. paratuberculosis
cggccgcgcagaucgccagca

SEQ ID NO: 2908560 - RNA, 12 nt, Mycobacterium avium subsp. paratuberculosis
cggccgcgcagc

SEQ ID NO: 2908561 - RNA, 13 nt, Mycobacterium avium subsp. paratuberculosis
cggccgcgcagcu

SEQ ID NO: 2908562 - RNA, 16 nt, Mycobacterium avium subsp. paratuberculosis
cggccgcgcagcucga

SEQ ID NO: 2908563 - RNA, 17 nt, Mycobacterium avium subsp. paratuberculosis
cggccgcgcccaucgcg

SEQ ID NO: 2908564 - RNA, 21 nt, Mycobacterium avium subsp. paratuberculosis
cggccgcgcccaucgcggccg

SEQ ID NO: 2908565 - RNA, 20 nt, Mycobacterium avium subsp. paratuberculosis
cggccgcgccgaacaccacg

SEQ ID NO: 2908566 - RNA, 23 nt, Mycobacterium avium subsp. paratuberculosis
cggccgcgccgaacaccacgccg

SEQ ID NO: 2908567 - RNA, 16 nt, Mycobacterium avium subsp. paratuberculosis
cggccgcgccggccgg

SEQ ID NO: 2908568 - RNA, 15 nt, Mycobacterium avium subsp. paratuberculosis
cggccgcgccggccu

SEQ ID NO: 2908569 - RNA, 22 nt, Mycobacterium avium subsp. paratuberculosis
cggccgcgccguugaccgcggc

SEQ ID NO: 2908570 - RNA, 13 nt, Mycobacterium avium subsp. paratuberculosis
cggccgcgcgccc

SEQ ID NO: 2908571 - RNA, 17 nt, Mycobacterium avium subsp. paratuberculosis
cggccgcgcgcccgucg

SEQ ID NO: 2908572 - RNA, 20 nt, Mycobacterium avium subsp. paratuberculosis
cggccgcgcgcccgucgucg

SEQ ID NO: 2908573 - RNA, 21 nt, Mycobacterium avium subsp. paratuberculosis
cggccgcgcgcccgucgucgg

SEQ ID NO: 2908574 - RNA, 14 nt, Mycobacterium avium subsp. paratuberculosis
cggccgcgcgcggc

SEQ ID NO: 2908575 - RNA, 15 nt, Mycobacterium avium subsp. paratuberculosis
cggccgcgcgcggcg

SEQ ID NO: 2908576 - RNA, 17 nt, Mycobacterium avium subsp. paratuberculosis
cggccgcgcgcggcgcg

SEQ ID NO: 2908577 - RNA, 18 nt, Mycobacterium avium subsp. paratuberculosis
cggccgcgcgugcccgcg

SEQ ID NO: 2908578 - RNA, 22 nt, Mycobacterium avium subsp. paratuberculosis
cggccgcgcgugcccgcgguca

SEQ ID NO: 2908579 - RNA, 17 nt, Mycobacterium avium subsp. paratuberculosis
cggccgcgcgugcgcaa

SEQ ID NO: 2908580 - RNA, 17 nt, Mycobacterium avium subsp. paratuberculosis
cggccgcggacccgacg

SEQ ID NO: 2908581 - RNA, 12 nt, Mycobacterium avium subsp. paratuberculosis
cggccgcggaug

SEQ ID NO: 2908582 - RNA, 21 nt, Mycobacterium avium subsp. paratuberculosis
cggccgcggauuccggcaucg

SEQ ID NO: 2908583 - RNA, 22 nt, Mycobacterium avium subsp. paratuberculosis
cggccgcggauuccggcaucgg

SEQ ID NO: 2908584 - RNA, 12 nt, Mycobacterium avium subsp. paratuberculosis
cggccgcggcca

SEQ ID NO: 2908585 - RNA, 13 nt, Mycobacterium avium subsp. paratuberculosis
cggccgcggccag

SEQ ID NO: 2908586 - RNA, 15 nt, Mycobacterium avium subsp. paratuberculosis
cggccgcggccagcg

SEQ ID NO: 2908587 - RNA, 19 nt, Mycobacterium avium subsp. paratuberculosis
cggccgcggccagcgaggu

SEQ ID NO: 2908588 - RNA, 13 nt, Mycobacterium avium subsp. paratuberculosis
cggccgcggcccg

SEQ ID NO: 2908589 - RNA, 17 nt, Mycobacterium avium subsp. paratuberculosis
cggccgcggcccggcca

SEQ ID NO: 2908590 - RNA, 13 nt, Mycobacterium avium subsp. paratuberculosis
cggccgcggccgg

SEQ ID NO: 2908591 - RNA, 14 nt, Mycobacterium avium subsp. paratuberculosis
cggccgcggccggc

SEQ ID NO: 2908592 - RNA, 16 nt, Mycobacterium avium subsp. paratuberculosis
cggccgcggccggcgg

SEQ ID NO: 2908593 - RNA, 14 nt, Mycobacterium avium subsp. paratuberculosis
cggccgcggcgcgg

SEQ ID NO: 2908594 - RNA, 20 nt, Mycobacterium avium subsp. paratuberculosis
cggccgcggcgcggcccggc

SEQ ID NO: 2908595 - RNA, 14 nt, Mycobacterium avium subsp. paratuberculosis
cggccgcggcgggc

SEQ ID NO: 2908596 - RNA, 17 nt, Mycobacterium avium subsp. paratuberculosis
cggccgcggcgggcgcg

SEQ ID NO: 2908597 - RNA, 19 nt, Mycobacterium avium subsp. paratuberculosis
cggccgcggcgggcgcguc

SEQ ID NO: 2908598 - RNA, 15 nt, Mycobacterium avium subsp. paratuberculosis
cggccgcggcggugc

SEQ ID NO: 2908599 - RNA, 16 nt, Mycobacterium avium subsp. paratuberculosis
cggccgcggcggugcc

SEQ ID NO: 2908600 - RNA, 16 nt, Mycobacterium avium subsp. paratuberculosis
cggccgcggggccggc

SEQ ID NO: 2908601 - RNA, 17 nt, Mycobacterium avium subsp. paratuberculosis
cggccgcggggccggcg

SEQ ID NO: 2908602 - RNA, 18 nt, Mycobacterium avium subsp. paratuberculosis
cggccgcggggccggcgc

SEQ ID NO: 2908603 - RNA, 21 nt, Mycobacterium avium subsp. paratuberculosis
cggccgcggggccggcgcugg

SEQ ID NO: 2908604 - RNA, 15 nt, Mycobacterium avium subsp. paratuberculosis
cggccgcggucucga

SEQ ID NO: 2908605 - RNA, 13 nt, Mycobacterium avium subsp. paratuberculosis
cggccgcggugac

SEQ ID NO: 2908606 - RNA, 19 nt, Mycobacterium avium subsp. paratuberculosis
cggccgcggugaccgcgcc

SEQ ID NO: 2908607 - RNA, 20 nt, Mycobacterium avium subsp. paratuberculosis
cggccgcggugaccgcgccg

SEQ ID NO: 2908608 - RNA, 12 nt, Mycobacterium avium subsp. paratuberculosis
cggccgcggugu

SEQ ID NO: 2908609 - RNA, 20 nt, Mycobacterium avium subsp. paratuberculosis
cggccgcguacuucgcgccc

SEQ ID NO: 2908610 - RNA, 16 nt, Mycobacterium avium subsp. paratuberculosis
cggccggccagcagcc

SEQ ID NO: 2908611 - RNA, 13 nt, Mycobacterium avium subsp. paratuberculosis
cggccggccagcg

SEQ ID NO: 2908612 - RNA, 13 nt, Mycobacterium avium subsp. paratuberculosis
cggccggcccagc

SEQ ID NO: 2908613 - RNA, 13 nt, Mycobacterium avium subsp. paratuberculosis
cggccggccccgc

SEQ ID NO: 2908614 - RNA, 17 nt, Mycobacterium avium subsp. paratuberculosis
cggccggccccgcccgg

SEQ ID NO: 2908615 - RNA, 18 nt, Mycobacterium avium subsp. paratuberculosis
cggccggccccgcccggc

SEQ ID NO: 2908616 - RNA, 16 nt, Mycobacterium avium subsp. paratuberculosis
cggccggccccggccg

SEQ ID NO: 2908617 - RNA, 17 nt, Mycobacterium avium subsp. paratuberculosis
cggccggccccggccgg

SEQ ID NO: 2908618 - RNA, 14 nt, Mycobacterium avium subsp. paratuberculosis
cggccggccccggg

SEQ ID NO: 2908619 - RNA, 16 nt, Mycobacterium avium subsp. paratuberculosis
cggccggccccggggg

SEQ ID NO: 2908620 - RNA, 23 nt, Mycobacterium avium subsp. paratuberculosis
cggccggccccgggggaccagcg

SEQ ID NO: 2908621 - RNA, 16 nt, Mycobacterium avium subsp. paratuberculosis
cggccgacgcccagca

SEQ ID NO: 2908622 - RNA, 12 nt, Mycobacterium avium subsp. paratuberculosis
cggccgacgcgc

SEQ ID NO: 2908623 - RNA, 14 nt, Mycobacterium avium subsp. paratuberculosis
cggccgacgcgccg

SEQ ID NO: 2908624 - RNA, 16 nt, Mycobacterium avium subsp. paratuberculosis
cggccgacgcgccguc

SEQ ID NO: 2908625 - RNA, 17 nt, Mycobacterium avium subsp. paratuberculosis
cggccgacgcgccgucg

SEQ ID NO: 2908626 - RNA, 20 nt, Mycobacterium avium subsp. paratuberculosis
cggccgacgcgccgucggcc

SEQ ID NO: 2908627 - RNA, 13 nt, Mycobacterium avium subsp. paratuberculosis
cggccgacgcggc

SEQ ID NO: 2908628 - RNA, 15 nt, Mycobacterium avium subsp. paratuberculosis
cggccgacgcggccu

SEQ ID NO: 2908629 - RNA, 15 nt, Mycobacterium avium subsp. paratuberculosis
cggccgacgggcgug

SEQ ID NO: 2908630 - RNA, 16 nt, Mycobacterium avium subsp. paratuberculosis
cggccgacgggcgugu

SEQ ID NO: 2908631 - RNA, 17 nt, Mycobacterium avium subsp. paratuberculosis
cggccgacucgaugcgc

SEQ ID NO: 2908632 - RNA, 21 nt, Mycobacterium avium subsp. paratuberculosis
cggccgacucgaugcgcguga

SEQ ID NO: 2908633 - RNA, 17 nt, Mycobacterium avium subsp. paratuberculosis
cggccgacuuggucagc

SEQ ID NO: 2908634 - RNA, 19 nt, Mycobacterium avium subsp. paratuberculosis
cggccgacuuggucagccc

SEQ ID NO: 2908635 - RNA, 20 nt, Mycobacterium avium subsp. paratuberculosis
cggccgagccgagccgaccc

SEQ ID NO: 2908636 - RNA, 22 nt, Mycobacterium avium subsp. paratuberculosis
cggccgagccgagccgacccgg

SEQ ID NO: 2908637 - RNA, 16 nt, Mycobacterium avium subsp. paratuberculosis
cggccgagccgaugcc

SEQ ID NO: 2908638 - RNA, 22 nt, Mycobacterium avium subsp. paratuberculosis
cggccgagccgaugcccagcag

SEQ ID NO: 2908639 - RNA, 13 nt, Mycobacterium avium subsp. paratuberculosis
cggccgagcgcac

SEQ ID NO: 2908640 - RNA, 15 nt, Mycobacterium avium subsp. paratuberculosis
cggccgagcgcaccg

SEQ ID NO: 2908641 - RNA, 17 nt, Mycobacterium avium subsp. paratuberculosis
cggccgagcgcaccgcg

SEQ ID NO: 2908642 - RNA, 19 nt, Mycobacterium avium subsp. paratuberculosis
cggccgagcgcaccgcgga

SEQ ID NO: 2908643 - RNA, 16 nt, Mycobacterium avium subsp. paratuberculosis
cggccgagcgcagcgg

SEQ ID NO: 2908644 - RNA, 19 nt, Mycobacterium avium subsp. paratuberculosis
cggccgagcgcgccgagca

SEQ ID NO: 2908645 - RNA, 20 nt, Mycobacterium avium subsp. paratuberculosis
cggccgagcgcgccgagcag

SEQ ID NO: 2908646 - RNA, 21 nt, Mycobacterium avium subsp. paratuberculosis
cggccgagcgcgccgagcagc

SEQ ID NO: 2908647 - RNA, 20 nt, Mycobacterium avium subsp. paratuberculosis
cggccgagggcuucccacgc

SEQ ID NO: 2908648 - RNA, 21 nt, Mycobacterium avium subsp. paratuberculosis
cggccgaggucaccaccgagc

SEQ ID NO: 2908649 - RNA, 18 nt, Mycobacterium avium subsp. paratuberculosis
cggccgagguccgcgguu

SEQ ID NO: 2908650 - RNA, 22 nt, Mycobacterium avium subsp. paratuberculosis
cggccgagucgacgugcucggc

SEQ ID NO: 2908651 - RNA, 19 nt, Mycobacterium avium subsp. paratuberculosis
cggccgaucaccucgaugg

SEQ ID NO: 2908652 - RNA, 17 nt, Mycobacterium avium subsp. paratuberculosis
cggccgaucauggucgg

SEQ ID NO: 2908653 - RNA, 22 nt, Mycobacterium avium subsp. paratuberculosis
cggccgaucauggucggcgacg

SEQ ID NO: 2908654 - RNA, 16 nt, Mycobacterium avium subsp. paratuberculosis
cggccgaucccgaugc

SEQ ID NO: 2908655 - RNA, 21 nt, Mycobacterium avium subsp. paratuberculosis
cggccgaugaccucgcacagc

SEQ ID NO: 2908656 - RNA, 17 nt, Mycobacterium avium subsp. paratuberculosis
cggccgaugagccucag

SEQ ID NO: 2908657 - RNA, 22 nt, Mycobacterium avium subsp. paratuberculosis
cggccgaugagccucagcgcgc

SEQ ID NO: 2908658 - RNA, 15 nt, Mycobacterium avium subsp. paratuberculosis
cggccgauggcccag

SEQ ID NO: 2908659 - RNA, 17 nt, Mycobacterium avium subsp. paratuberculosis
cggccgauggcccaggc

SEQ ID NO: 2908660 - RNA, 18 nt, Mycobacterium avium subsp. paratuberculosis
cggccgauggcccaggcc

SEQ ID NO: 2908661 - RNA, 14 nt, Mycobacterium avium subsp. paratuberculosis
cggccgauucggcg

SEQ ID NO: 2908662 - RNA, 19 nt, Mycobacterium avium subsp. paratuberculosis
cggccgauucggcgccgcg

SEQ ID NO: 2908663 - RNA, 16 nt, Mycobacterium avium subsp. paratuberculosis
cggccgcaacggcggu

SEQ ID NO: 2908664 - RNA, 17 nt, Mycobacterium avium subsp. paratuberculosis
cggccgcaacggcgguc

SEQ ID NO: 2908665 - RNA, 18 nt, Mycobacterium avium subsp. paratuberculosis
cggccgcaacggcggucg

SEQ ID NO: 2908666 - RNA, 16 nt, Mycobacterium avium subsp. paratuberculosis
cggccgcaagcgaagc

SEQ ID NO: 2908667 - RNA, 18 nt, Mycobacterium avium subsp. paratuberculosis
cggccgcaagcgaagccg

SEQ ID NO: 2908668 - RNA, 23 nt, Mycobacterium avium subsp. paratuberculosis
cggccgcaagcgaagccgugacc

SEQ ID NO: 2908669 - RNA, 19 nt, Mycobacterium avium subsp. paratuberculosis
cggccgcaaucggcgccgg

SEQ ID NO: 2908670 - RNA, 20 nt, Mycobacterium avium subsp. paratuberculosis
cggccgcaaucggcgccggc

SEQ ID NO: 2908671 - RNA, 22 nt, Mycobacterium avium subsp. paratuberculosis
cggccgcacaacagacgaucac

SEQ ID NO: 2908672 - RNA, 14 nt, Mycobacterium avium subsp. paratuberculosis
cggccgcacaccac

SEQ ID NO: 2908673 - RNA, 15 nt, Mycobacterium avium subsp. paratuberculosis
cggccgcacaccacc

SEQ ID NO: 2908674 - RNA, 17 nt, Mycobacterium avium subsp. paratuberculosis
cggccgcacaccaccac

SEQ ID NO: 2908675 - RNA, 16 nt, Mycobacterium avium subsp. paratuberculosis
cggccgcaccccaccc

SEQ ID NO: 2908676 - RNA, 17 nt, Mycobacterium avium subsp. paratuberculosis
cggccgcaccccacccg

SEQ ID NO: 2908677 - RNA, 18 nt, Mycobacterium avium subsp. paratuberculosis
cggccgcaccccacccgc

SEQ ID NO: 2908678 - RNA, 22 nt, Mycobacterium avium subsp. paratuberculosis
cggccgcaccccacccgcgcga

SEQ ID NO: 2908679 - RNA, 19 nt, Mycobacterium avium subsp. paratuberculosis
cggccgcacgucccgcccg

SEQ ID NO: 2908680 - RNA, 19 nt, Mycobacterium avium subsp. paratuberculosis
cggccgcagcgcaucgccg

SEQ ID NO: 2908681 - RNA, 22 nt, Mycobacterium avium subsp. paratuberculosis
cggccgcagcgcaucgccggcg

SEQ ID NO: 2908682 - RNA, 14 nt, Mycobacterium avium subsp. paratuberculosis
cggccgcagcgccc

SEQ ID NO: 2908683 - RNA, 17 nt, Mycobacterium avium subsp. paratuberculosis
cggccgcagcgcccggc

SEQ ID NO: 2908684 - RNA, 22 nt, Mycobacterium avium subsp. paratuberculosis
cggccgcagcgcccggcagcgg

SEQ ID NO: 2908685 - RNA, 13 nt, Mycobacterium avium subsp. paratuberculosis
cggccgcagcgcg

SEQ ID NO: 2908686 - RNA, 18 nt, Mycobacterium avium subsp. paratuberculosis
cggccgcagcgcgacgaa

SEQ ID NO: 2908687 - RNA, 16 nt, Mycobacterium avium subsp. paratuberculosis
cggccgcagcggcagg

SEQ ID NO: 2908688 - RNA, 19 nt, Mycobacterium avium subsp. paratuberculosis
cggccgcagcggcaggucg

SEQ ID NO: 2908689 - RNA, 14 nt, Mycobacterium avium subsp. paratuberculosis
cggccgcagcggga

SEQ ID NO: 2908690 - RNA, 19 nt, Mycobacterium avium subsp. paratuberculosis
cggccgcagcgugggcacc

SEQ ID NO: 2908691 - RNA, 21 nt, Mycobacterium avium subsp. paratuberculosis
cggccgcagcgugggcaccgg

SEQ ID NO: 2908692 - RNA, 22 nt, Mycobacterium avium subsp. paratuberculosis
cggccgcagcgugggcaccggc

SEQ ID NO: 2908693 - RNA, 23 nt, Mycobacterium avium subsp. paratuberculosis
cggccgcagcgugggcaccggca

SEQ ID NO: 2908694 - RNA, 13 nt, Mycobacterium avium subsp. paratuberculosis
cggccgcagcugc

SEQ ID NO: 2908695 - RNA, 14 nt, Mycobacterium avium subsp. paratuberculosis
cggccgcagcugcu

SEQ ID NO: 2908696 - RNA, 21 nt, Mycobacterium avium subsp. paratuberculosis
cggccgcagcugcugcggccg

SEQ ID NO: 2908697 - RNA, 22 nt, Mycobacterium avium subsp. paratuberculosis
cggccgcaucguugguccaggc

SEQ ID NO: 2908698 - RNA, 23 nt, Mycobacterium avium subsp. paratuberculosis
cggccgcaucguugguccaggcg

SEQ ID NO: 2908699 - RNA, 23 nt, Mycobacterium avium subsp. paratuberculosis
cggccgcaugucgaccucggcca

SEQ ID NO: 2908700 - RNA, 17 nt, Mycobacterium avium subsp. paratuberculosis
cggccgcauuuggcgua

SEQ ID NO: 2908701 - RNA, 12 nt, Mycobacterium avium subsp. paratuberculosis
cggccgccaccg

SEQ ID NO: 2908702 - RNA, 13 nt, Mycobacterium avium subsp. paratuberculosis
cggccgccaccga

SEQ ID NO: 2908703 - RNA, 15 nt, Mycobacterium avium subsp. paratuberculosis
cggccgccaccgagg

SEQ ID NO: 2908704 - RNA, 15 nt, Mycobacterium avium subsp. paratuberculosis
cggccgccaccgcca

SEQ ID NO: 2908705 - RNA, 19 nt, Mycobacterium avium subsp. paratuberculosis
cgcuuucgaagugacgccg

SEQ ID NO: 2908706 - RNA, 20 nt, Mycobacterium avium subsp. paratuberculosis
cgcuuucgaagugacgccgc

SEQ ID NO: 2908707 - RNA, 13 nt, Mycobacterium avium subsp. paratuberculosis
cgcuuucgccggg

SEQ ID NO: 2908708 - RNA, 16 nt, Mycobacterium avium subsp. paratuberculosis
cgcuuucgccgggcgu

SEQ ID NO: 2908709 - RNA, 21 nt, Mycobacterium avium subsp. paratuberculosis
cgcuuucgcgcacgccaucgc

SEQ ID NO: 2908710 - RNA, 20 nt, Mycobacterium avium subsp. paratuberculosis
cgcuuucgucgaccgucacg

SEQ ID NO: 2908711 - RNA, 21 nt, Mycobacterium avium subsp. paratuberculosis
cggaaaaagcguugcgccagc

SEQ ID NO: 2908712 - RNA, 23 nt, Mycobacterium avium subsp. paratuberculosis
cggaaaaagcguugcgccagcag

SEQ ID NO: 2908713 - RNA, 15 nt, Mycobacterium avium subsp. paratuberculosis
cggaaaaccccaccc

SEQ ID NO: 2908714 - RNA, 22 nt, Mycobacterium avium subsp. paratuberculosis
cggaaaccgcugcggcacacca

SEQ ID NO: 2908715 - RNA, 19 nt, Mycobacterium avium subsp. paratuberculosis
cggaaacgacgucgccacc

SEQ ID NO: 2908716 - RNA, 13 nt, Mycobacterium avium subsp. paratuberculosis
cggaacagccggc

SEQ ID NO: 2908717 - RNA, 21 nt, Mycobacterium avium subsp. paratuberculosis
cggaacagccggcucagggug

SEQ ID NO: 2908718 - RNA, 22 nt, Mycobacterium avium subsp. paratuberculosis
cggaacagcgucgccgacgggc

SEQ ID NO: 2908719 - RNA, 14 nt, Mycobacterium avium subsp. paratuberculosis
cggaacagcugguc

SEQ ID NO: 2908720 - RNA, 22 nt, Mycobacterium avium subsp. paratuberculosis
cggaacagcuggucccacagcg

SEQ ID NO: 2908721 - RNA, 19 nt, Mycobacterium avium subsp. paratuberculosis
cggaacccacgugcggcgc

SEQ ID NO: 2908722 - RNA, 21 nt, Mycobacterium avium subsp. paratuberculosis
cggaacccacgugcggcgccc

SEQ ID NO: 2908723 - RNA, 15 nt, Mycobacterium avium subsp. paratuberculosis
cggaacccggguggc

SEQ ID NO: 2908724 - RNA, 14 nt, Mycobacterium avium subsp. paratuberculosis
cggaaccgacaccu

SEQ ID NO: 2908725 - RNA, 18 nt, Mycobacterium avium subsp. paratuberculosis
cggaaccgcugcaugccg

SEQ ID NO: 2908726 - RNA, 13 nt, Mycobacterium avium subsp. paratuberculosis
cggaaccggccgg

SEQ ID NO: 2908727 - RNA, 18 nt, Mycobacterium avium subsp. paratuberculosis
cggaaccggccggggcgc

SEQ ID NO: 2908728 - RNA, 18 nt, Mycobacterium avium subsp. paratuberculosis
cggaaccgggcacccggc

SEQ ID NO: 2908729 - RNA, 21 nt, Mycobacterium avium subsp. paratuberculosis
cggaaccgggcacccggcgcg

SEQ ID NO: 2908730 - RNA, 15 nt, Mycobacterium avium subsp. paratuberculosis
cggaaccgggccgcu

SEQ ID NO: 2908731 - RNA, 20 nt, Mycobacterium avium subsp. paratuberculosis
cggaaccguugcagcacagc

SEQ ID NO: 2908732 - RNA, 23 nt, Mycobacterium avium subsp. paratuberculosis
cggaaccguugcagcacagcggg

SEQ ID NO: 2908733 - RNA, 15 nt, Mycobacterium avium subsp. paratuberculosis
cggaacgacgcgucc

SEQ ID NO: 2908734 - RNA, 13 nt, Mycobacterium avium subsp. paratuberculosis
cggaacgcgccgg

SEQ ID NO: 2908735 - RNA, 23 nt, Mycobacterium avium subsp. paratuberculosis
cggaacgcgccgggcaacagcgc

SEQ ID NO: 2908736 - RNA, 13 nt, Mycobacterium avium subsp. paratuberculosis
cggaacgcgucgc

SEQ ID NO: 2908737 - RNA, 12 nt, Mycobacterium avium subsp. paratuberculosis
cggaacggcggg

SEQ ID NO: 2908738 - RNA, 19 nt, Mycobacterium avium subsp. paratuberculosis
cggaacggcuugcgcucgg

SEQ ID NO: 2908739 - RNA, 23 nt, Mycobacterium avium subsp. paratuberculosis
cggaacggcuugcgcucggccgg

SEQ ID NO: 2908740 - RNA, 13 nt, Mycobacterium avium subsp. paratuberculosis
cggaacgggucga

SEQ ID NO: 2908741 - RNA, 21 nt, Mycobacterium avium subsp. paratuberculosis
cggaacgggucgaucucggcg

SEQ ID NO: 2908742 - RNA, 19 nt, Mycobacterium avium subsp. paratuberculosis
cggaacggucggggcggcg

SEQ ID NO: 2908743 - RNA, 20 nt, Mycobacterium avium subsp. paratuberculosis
cggaacggucggggcggcgg

SEQ ID NO: 2908744 - RNA, 14 nt, Mycobacterium avium subsp. paratuberculosis
cggaacucggccgg

SEQ ID NO: 2908745 - RNA, 16 nt, Mycobacterium avium subsp. paratuberculosis
cggaacugcucccagg

SEQ ID NO: 2908746 - RNA, 21 nt, Mycobacterium avium subsp. paratuberculosis
cggaacugcucccaggcgucg

SEQ ID NO: 2908747 - RNA, 15 nt, Mycobacterium avium subsp. paratuberculosis
cggaagaucagcagg

SEQ ID NO: 2908748 - RNA, 16 nt, Mycobacterium avium subsp. paratuberculosis
cggaagaucagcaggc

SEQ ID NO: 2908749 - RNA, 17 nt, Mycobacterium avium subsp. paratuberculosis
cggaagcccacgaucac

SEQ ID NO: 2908750 - RNA, 14 nt, Mycobacterium avium subsp. paratuberculosis
cggaagccccaggc

SEQ ID NO: 2908751 - RNA, 13 nt, Mycobacterium avium subsp. paratuberculosis
cggaagcccuugc

SEQ ID NO: 2908752 - RNA, 18 nt, Mycobacterium avium subsp. paratuberculosis
cggaagccgagcggucca

SEQ ID NO: 2908753 - RNA, 13 nt, Mycobacterium avium subsp. paratuberculosis
cggaagccgucgg

SEQ ID NO: 2908754 - RNA, 15 nt, Mycobacterium avium subsp. paratuberculosis
cggaagccgucggug

SEQ ID NO: 2908755 - RNA, 17 nt, Mycobacterium avium subsp. paratuberculosis
cggaagcgcgcaucgcg

SEQ ID NO: 2908756 - RNA, 12 nt, Mycobacterium avium subsp. paratuberculosis
cggaagcggcgg

SEQ ID NO: 2908757 - RNA, 13 nt, Mycobacterium avium subsp. paratuberculosis
cggaagcgggguu

SEQ ID NO: 2908758 - RNA, 13 nt, Mycobacterium avium subsp. paratuberculosis
cggaagcgguuga

SEQ ID NO: 2908759 - RNA, 20 nt, Mycobacterium avium subsp. paratuberculosis
cggaagcgguugagccacaa

SEQ ID NO: 2908760 - RNA, 15 nt, Mycobacterium avium subsp. paratuberculosis
cggaagcucaucgag

SEQ ID NO: 2908761 - RNA, 22 nt, Mycobacterium avium subsp. paratuberculosis
cggaagcugccguugcgccagc

SEQ ID NO: 2908762 - RNA, 18 nt, Mycobacterium avium subsp. paratuberculosis
cggaaggccaaggccagc

SEQ ID NO: 2908763 - RNA, 19 nt, Mycobacterium avium subsp. paratuberculosis
cggaaggccaaggccagca

SEQ ID NO: 2908764 - RNA, 15 nt, Mycobacterium avium subsp. paratuberculosis
cggaaggccgcgcgg

SEQ ID NO: 2908765 - RNA, 19 nt, Mycobacterium avium subsp. paratuberculosis
cggaaggccgcgcgggcgg

SEQ ID NO: 2908766 - RNA, 17 nt, Mycobacterium avium subsp. paratuberculosis
cggaagugccggcgaac

SEQ ID NO: 2908767 - RNA, 16 nt, Mycobacterium avium subsp. paratuberculosis
cggaaguucucgccgu

SEQ ID NO: 2908768 - RNA, 22 nt, Mycobacterium avium subsp. paratuberculosis
cggaaguucucgccgugcagca

SEQ ID NO: 2908769 - RNA, 15 nt, Mycobacterium avium subsp. paratuberculosis
cggaauacagcagcu

SEQ ID NO: 2908770 - RNA, 16 nt, Mycobacterium avium subsp. paratuberculosis
cggaauagcgcuccau

SEQ ID NO: 2908771 - RNA, 15 nt, Mycobacterium avium subsp. paratuberculosis
cggaaucacuuccgc

SEQ ID NO: 2908772 - RNA, 20 nt, Mycobacterium avium subsp. paratuberculosis
cggaaucgcccgggccaggu

SEQ ID NO: 2908773 - RNA, 13 nt, Mycobacterium avium subsp. paratuberculosis
cggaaucgcggga

SEQ ID NO: 2908774 - RNA, 21 nt, Mycobacterium avium subsp. paratuberculosis
cggaaucgcgggaucggccgg

SEQ ID NO: 2908775 - RNA, 14 nt, Mycobacterium avium subsp. paratuberculosis
cggaaucggcgccg

SEQ ID NO: 2908776 - RNA, 15 nt, Mycobacterium avium subsp. paratuberculosis
cggaaugaacgcggc

SEQ ID NO: 2908777 - RNA, 19 nt, Mycobacterium avium subsp. paratuberculosis
cggaaugaacgcggccagg

SEQ ID NO: 2908778 - RNA, 21 nt, Mycobacterium avium subsp. paratuberculosis
cggaaugaacugccgcggcac

SEQ ID NO: 2908779 - RNA, 13 nt, Mycobacterium avium subsp. paratuberculosis
cggaaugcucgac

SEQ ID NO: 2908780 - RNA, 15 nt, Mycobacterium avium subsp. paratuberculosis
cggaaugcucgacac

SEQ ID NO: 2908781 - RNA, 17 nt, Mycobacterium avium subsp. paratuberculosis
cggaauggcaaggccag

SEQ ID NO: 2908782 - RNA, 18 nt, Mycobacterium avium subsp. paratuberculosis
cggaauggcaaggccagc

SEQ ID NO: 2908783 - RNA, 15 nt, Mycobacterium avium subsp. paratuberculosis
cggaauggcagcagc

SEQ ID NO: 2908784 - RNA, 16 nt, Mycobacterium avium subsp. paratuberculosis
cggaauggcagcagcc

SEQ ID NO: 2908785 - RNA, 23 nt, Mycobacterium avium subsp. paratuberculosis
cggaaugugcuugaucagcgggc

SEQ ID NO: 2908786 - RNA, 20 nt, Mycobacterium avium subsp. paratuberculosis
cggaauucagugaggccagc

SEQ ID NO: 2908787 - RNA, 13 nt, Mycobacterium avium subsp. paratuberculosis
cgcgucgagcagc

SEQ ID NO: 2908788 - RNA, 14 nt, Mycobacterium avium subsp. paratuberculosis
cgcgucgagcagca

SEQ ID NO: 2908789 - RNA, 15 nt, Mycobacterium avium subsp. paratuberculosis
cgcgucgagcagcac

SEQ ID NO: 2908790 - RNA, 22 nt, Mycobacterium avium subsp. paratuberculosis
cgcgucgagcagcaccacccgc

SEQ ID NO: 2908791 - RNA, 16 nt, Mycobacterium avium subsp. paratuberculosis
cgcgucgaggucgcgc

SEQ ID NO: 2908792 - RNA, 17 nt, Mycobacterium avium subsp. paratuberculosis
cgcgucgaggucgucgg

SEQ ID NO: 2908793 - RNA, 13 nt, Mycobacterium avium subsp. paratuberculosis
cgcgucgaucgcg

SEQ ID NO: 2908794 - RNA, 15 nt, Mycobacterium avium subsp. paratuberculosis
cgcgucgaucgcguc

SEQ ID NO: 2908795 - RNA, 16 nt, Mycobacterium avium subsp. paratuberculosis
cgcgucgaugccggcg

SEQ ID NO: 2908796 - RNA, 14 nt, Mycobacterium avium subsp. paratuberculosis
cgcgucgaugcggg

SEQ ID NO: 2908797 - RNA, 21 nt, Mycobacterium avium subsp. paratuberculosis
cgcgucgaugucgucguugug

SEQ ID NO: 2908798 - RNA, 15 nt, Mycobacterium avium subsp. paratuberculosis
cgcgucgcacagcgc

SEQ ID NO: 2908799 - RNA, 18 nt, Mycobacterium avium subsp. paratuberculosis
cgcgucgcacagcgccgc

SEQ ID NO: 2908800 - RNA, 19 nt, Mycobacterium avium subsp. paratuberculosis
cgcgucgcacagcgccgcg

SEQ ID NO: 2908801 - RNA, 14 nt, Mycobacterium avium subsp. paratuberculosis
cgcgucgcagugcc

SEQ ID NO: 2908802 - RNA, 21 nt, Mycobacterium avium subsp. paratuberculosis
cgcgucgcagugccggugcag

SEQ ID NO: 2908803 - RNA, 16 nt, Mycobacterium avium subsp. paratuberculosis
cgcgucgcccacgccg

SEQ ID NO: 2908804 - RNA, 17 nt, Mycobacterium avium subsp. paratuberculosis
cgcgucgcccacgccgg

SEQ ID NO: 2908805 - RNA, 18 nt, Mycobacterium avium subsp. paratuberculosis
cgcgucgccgaccagcag

SEQ ID NO: 2908806 - RNA, 23 nt, Mycobacterium avium subsp. paratuberculosis
cgcgucgccgaccagcaggacgc

SEQ ID NO: 2908807 - RNA, 13 nt, Mycobacterium avium subsp. paratuberculosis
cgcgucgccgauc

SEQ ID NO: 2908808 - RNA, 19 nt, Mycobacterium avium subsp. paratuberculosis
cgcgucgccgaucgcccgg

SEQ ID NO: 2908809 - RNA, 12 nt, Mycobacterium avium subsp. paratuberculosis
cgcgucgccgcc

SEQ ID NO: 2908810 - RNA, 14 nt, Mycobacterium avium subsp. paratuberculosis
cgcgucgccgccgg

SEQ ID NO: 2908811 - RNA, 16 nt, Mycobacterium avium subsp. paratuberculosis
cgcgucgccgccgggc

SEQ ID NO: 2908812 - RNA, 13 nt, Mycobacterium avium subsp. paratuberculosis
cgcgucgccgugc

SEQ ID NO: 2908813 - RNA, 15 nt, Mycobacterium avium subsp. paratuberculosis
cgcgucgccgugccg

SEQ ID NO: 2908814 - RNA, 18 nt, Mycobacterium avium subsp. paratuberculosis
cgcgucgccgugccggac

SEQ ID NO: 2908815 - RNA, 18 nt, Mycobacterium avium subsp. paratuberculosis
cgcgucgcgcagcgaagc

SEQ ID NO: 2908816 - RNA, 14 nt, Mycobacterium avium subsp. paratuberculosis
cgcgucgcgccagc

SEQ ID NO: 2908817 - RNA, 16 nt, Mycobacterium avium subsp. paratuberculosis
cgcgucgcgccagcgg

SEQ ID NO: 2908818 - RNA, 15 nt, Mycobacterium avium subsp. paratuberculosis
cgcgucgcgcccggc

SEQ ID NO: 2908819 - RNA, 19 nt, Mycobacterium avium subsp. paratuberculosis
cgcgucgcgcccggcgucg

SEQ ID NO: 2908820 - RNA, 23 nt, Mycobacterium avium subsp. paratuberculosis
cgcgucgcgccgccgcgucgugc

SEQ ID NO: 2908821 - RNA, 24 nt, Mycobacterium avium subsp. paratuberculosis
cgcgucgcgcgguuccggcgugca

SEQ ID NO: 2908822 - RNA, 13 nt, Mycobacterium avium subsp. paratuberculosis
cgcgucgcggcgc

SEQ ID NO: 2908823 - RNA, 15 nt, Mycobacterium avium subsp. paratuberculosis
cgcgucgcggcgggg

SEQ ID NO: 2908824 - RNA, 12 nt, Mycobacterium avium subsp. paratuberculosis
cgcgucgcgggc

SEQ ID NO: 2908825 - RNA, 13 nt, Mycobacterium avium subsp. paratuberculosis
cgcgucgcgggcc

SEQ ID NO: 2908826 - RNA, 23 nt, Mycobacterium avium subsp. paratuberculosis
cgcgucgcgggcccgggccaccc

SEQ ID NO: 2908827 - RNA, 14 nt, Mycobacterium avium subsp. paratuberculosis
cgcgucgcugccgu

SEQ ID NO: 2908828 - RNA, 21 nt, Mycobacterium avium subsp. paratuberculosis
cgcgucgcugccguagcgcug

SEQ ID NO: 2908829 - RNA, 13 nt, Mycobacterium avium subsp. paratuberculosis
cgcgucgcugggc

SEQ ID NO: 2908830 - RNA, 20 nt, Mycobacterium avium subsp. paratuberculosis
cgcgucgcugggcagccguc

SEQ ID NO: 2908831 - RNA, 20 nt, Mycobacterium avium subsp. paratuberculosis
cgcgucggaauacagcagcu

SEQ ID NO: 2908832 - RNA, 22 nt, Mycobacterium avium subsp. paratuberculosis
cgcgucggaauacagcagcugc

SEQ ID NO: 2908833 - RNA, 22 nt, Mycobacterium avium subsp. paratuberculosis
cgcgucggaccccgaugcgcuc

SEQ ID NO: 2908834 - RNA, 22 nt, Mycobacterium avium subsp. paratuberculosis
cgcgucggagaucaccggcacc

SEQ ID NO: 2908835 - RNA, 20 nt, Mycobacterium avium subsp. paratuberculosis
cgcgucggaggccaugagcu

SEQ ID NO: 2908836 - RNA, 15 nt, Mycobacterium avium subsp. paratuberculosis
cgcgucggccagcac

SEQ ID NO: 2908837 - RNA, 16 nt, Mycobacterium avium subsp. paratuberculosis
cgcgucggccagcacc

SEQ ID NO: 2908838 - RNA, 15 nt, Mycobacterium avium subsp. paratuberculosis
cgcgucggccagcgc

SEQ ID NO: 2908839 - RNA, 18 nt, Mycobacterium avium subsp. paratuberculosis
cgcgucggccagcgcgcg

SEQ ID NO: 2908840 - RNA, 14 nt, Mycobacterium avium subsp. paratuberculosis
cgcgucggccccca

SEQ ID NO: 2908841 - RNA, 20 nt, Mycobacterium avium subsp. paratuberculosis
cgcgucggcccccagcgagg

SEQ ID NO: 2908842 - RNA, 12 nt, Mycobacterium avium subsp. paratuberculosis
cgcgucggccgc

SEQ ID NO: 2908843 - RNA, 13 nt, Mycobacterium avium subsp. paratuberculosis
cgcgucggccgca

SEQ ID NO: 2908844 - RNA, 12 nt, Mycobacterium avium subsp. paratuberculosis
cgcgucggcgac

SEQ ID NO: 2908845 - RNA, 16 nt, Mycobacterium avium subsp. paratuberculosis
cgcgucggcgaccgcg

SEQ ID NO: 2908846 - RNA, 17 nt, Mycobacterium avium subsp. paratuberculosis
cgcgucggcgaccgcgc

SEQ ID NO: 2908847 - RNA, 19 nt, Mycobacterium avium subsp. paratuberculosis
cgcgucggcgaccgcgcgc

SEQ ID NO: 2908848 - RNA, 13 nt, Mycobacterium avium subsp. paratuberculosis
cgcgucggcgccg

SEQ ID NO: 2908849 - RNA, 15 nt, Mycobacterium avium subsp. paratuberculosis
cgcgucggcgccggc

SEQ ID NO: 2908850 - RNA, 16 nt, Mycobacterium avium subsp. paratuberculosis
cgcgucggcgccggcc

SEQ ID NO: 2908851 - RNA, 17 nt, Mycobacterium avium subsp. paratuberculosis
cgcgucggcgccggcca

SEQ ID NO: 2908852 - RNA, 19 nt, Mycobacterium avium subsp. paratuberculosis
cgcgucggcgcuggccagc

SEQ ID NO: 2908853 - RNA, 20 nt, Mycobacterium avium subsp. paratuberculosis
cgcgucggcgcuggccagcg

SEQ ID NO: 2908854 - RNA, 21 nt, Mycobacterium avium subsp. paratuberculosis
cgcgucggcgcuggccagcgc

SEQ ID NO: 2908855 - RNA, 14 nt, Mycobacterium avium subsp. paratuberculosis
cgcgucggcggcgg

SEQ ID NO: 2908856 - RNA, 15 nt, Mycobacterium avium subsp. paratuberculosis
cgcgucggcggcggc

SEQ ID NO: 2908857 - RNA, 21 nt, Mycobacterium avium subsp. paratuberculosis
cgcgucggcggcggcggccgc

SEQ ID NO: 2908858 - RNA, 15 nt, Mycobacterium avium subsp. paratuberculosis
cgcgucggcggucgc

SEQ ID NO: 2908859 - RNA, 16 nt, Mycobacterium avium subsp. paratuberculosis
cgcgucggcggucgcc

SEQ ID NO: 2908860 - RNA, 19 nt, Mycobacterium avium subsp. paratuberculosis
cgcgucggcggucgccagc

SEQ ID NO: 2908861 - RNA, 21 nt, Mycobacterium avium subsp. paratuberculosis
cgcgucggcggucgccagcgc

SEQ ID NO: 2908862 - RNA, 22 nt, Mycobacterium avium subsp. paratuberculosis
cgcgucggcggucgccagcgcc

SEQ ID NO: 2908863 - RNA, 19 nt, Mycobacterium avium subsp. paratuberculosis
cgcgucggcgucuugcugc

SEQ ID NO: 2908864 - RNA, 22 nt, Mycobacterium avium subsp. paratuberculosis
cgcgucgggcagguucaucccc

SEQ ID NO: 2908865 - RNA, 15 nt, Mycobacterium avium subsp. paratuberculosis
cgcgucgggcucgcg

SEQ ID NO: 2908866 - RNA, 18 nt, Mycobacterium avium subsp. paratuberculosis
cgcgucgggcucggccgc

SEQ ID NO: 2908867 - RNA, 20 nt, Mycobacterium avium subsp. paratuberculosis
cgcgucgggcucggccgccg

SEQ ID NO: 2908868 - RNA, 18 nt, Mycobacterium avium subsp. paratuberculosis
cgcgucgguaaucggcgg

SEQ ID NO: 2908869 - RNA, 22 nt, Mycobacterium avium subsp. paratuberculosis
cgcgucgguaaucggcgguggu

SEQ ID NO: 2908870 - RNA, 18 nt, Mycobacterium avium subsp. paratuberculosis
cgcuagucgcccagcagc

SEQ ID NO: 2908871 - RNA, 19 nt, Mycobacterium avium subsp. paratuberculosis
cgcuagucgcccagcagcc

SEQ ID NO: 2908872 - RNA, 19 nt, Mycobacterium avium subsp. paratuberculosis
cgcuauuggccgagccggg

SEQ ID NO: 2908873 - RNA, 21 nt, Mycobacterium avium subsp. paratuberculosis
cgcuauuggccgagccgggcg

SEQ ID NO: 2908874 - RNA, 23 nt, Mycobacterium avium subsp. paratuberculosis
cgcuauuggccgagccgggcggc

SEQ ID NO: 2908875 - RNA, 13 nt, Mycobacterium avium subsp. paratuberculosis
cgcucaaaggcgg

SEQ ID NO: 2908876 - RNA, 18 nt, Mycobacterium avium subsp. paratuberculosis
cgcucaaaggcgggcacu

SEQ ID NO: 2908877 - RNA, 15 nt, Mycobacterium avium subsp. paratuberculosis
cgcucaacccgggcc

SEQ ID NO: 2908878 - RNA, 16 nt, Mycobacterium avium subsp. paratuberculosis
cgcucaacccgucgcg

SEQ ID NO: 2908879 - RNA, 20 nt, Mycobacterium avium subsp. paratuberculosis
cgcucaacccgucgcggguc

SEQ ID NO: 2908880 - RNA, 16 nt, Mycobacterium avium subsp. paratuberculosis
cgcucaaccgcccagc

SEQ ID NO: 2908881 - RNA, 21 nt, Mycobacterium avium subsp. paratuberculosis
cgcucaaccgcccagcggcuu

SEQ ID NO: 2908882 - RNA, 22 nt, Mycobacterium avium subsp. paratuberculosis
cgcucaacuugaucagcucgcg

SEQ ID NO: 2908883 - RNA, 17 nt, Mycobacterium avium subsp. paratuberculosis
cgcucaaggcaacucag

SEQ ID NO: 2908884 - RNA, 14 nt, Mycobacterium avium subsp. paratuberculosis
cgcucacacagccg

SEQ ID NO: 2908885 - RNA, 16 nt, Mycobacterium avium subsp. paratuberculosis
cgcucacacagccgcu

SEQ ID NO: 2908886 - RNA, 21 nt, Mycobacterium avium subsp. paratuberculosis
cgcucacccaaaaaggcgcgg

SEQ ID NO: 2908887 - RNA, 19 nt, Mycobacterium avium subsp. paratuberculosis
cgcucacccagcgagaccg

SEQ ID NO: 2908888 - RNA, 12 nt, Mycobacterium avium subsp. paratuberculosis
cgcucacccggc

SEQ ID NO: 2908889 - RNA, 15 nt, Mycobacterium avium subsp. paratuberculosis
cgcucacccggccca

SEQ ID NO: 2908890 - RNA, 15 nt, Mycobacterium avium subsp. paratuberculosis
cgcucaccgccgagc

SEQ ID NO: 2908891 - RNA, 20 nt, Mycobacterium avium subsp. paratuberculosis
cgcucaccgccgagccgcuc

SEQ ID NO: 2908892 - RNA, 14 nt, Mycobacterium avium subsp. paratuberculosis
cgcucaccgcgggg

SEQ ID NO: 2908893 - RNA, 18 nt, Mycobacterium avium subsp. paratuberculosis
cgcucaccugcggcccgu

SEQ ID NO: 2908894 - RNA, 14 nt, Mycobacterium avium subsp. paratuberculosis
cgcucacgcucggc

SEQ ID NO: 2908895 - RNA, 15 nt, Mycobacterium avium subsp. paratuberculosis
cgcucacgcucggcc

SEQ ID NO: 2908896 - RNA, 23 nt, Mycobacterium avium subsp. paratuberculosis
cgcucacucgucuugcagccggg

SEQ ID NO: 2908897 - RNA, 17 nt, Mycobacterium avium subsp. paratuberculosis
cgcucagagcugcaccg

SEQ ID NO: 2908898 - RNA, 17 nt, Mycobacterium avium subsp. paratuberculosis
cgcucagaggcgggcac

SEQ ID NO: 2908899 - RNA, 16 nt, Mycobacterium avium subsp. paratuberculosis
cgcucagccccagcgg

SEQ ID NO: 2908900 - RNA, 18 nt, Mycobacterium avium subsp. paratuberculosis
cgcucagcgauugcggcc

SEQ ID NO: 2908901 - RNA, 19 nt, Mycobacterium avium subsp. paratuberculosis
cgcucagcgauugcggccg

SEQ ID NO: 2908902 - RNA, 13 nt, Mycobacterium avium subsp. paratuberculosis
cgcucagcgcggc

SEQ ID NO: 2908903 - RNA, 16 nt, Mycobacterium avium subsp. paratuberculosis
cgcucagcgcggccac

SEQ ID NO: 2908904 - RNA, 14 nt, Mycobacterium avium subsp. paratuberculosis
cgcucagcgcggcg

SEQ ID NO: 2908905 - RNA, 17 nt, Mycobacterium avium subsp. paratuberculosis
cgcucagcgcggcgggc

SEQ ID NO: 2908906 - RNA, 19 nt, Mycobacterium avium subsp. paratuberculosis
cgcucagcgcggcgggcca

SEQ ID NO: 2908907 - RNA, 17 nt, Mycobacterium avium subsp. paratuberculosis
cgcucagcggcagcguc

SEQ ID NO: 2908908 - RNA, 14 nt, Mycobacterium avium subsp. paratuberculosis
cgcucagcgggcgg

SEQ ID NO: 2908909 - RNA, 15 nt, Mycobacterium avium subsp. paratuberculosis
cgcucagcgggcggc

SEQ ID NO: 2908910 - RNA, 17 nt, Mycobacterium avium subsp. paratuberculosis
cgcucagcgggcggcca

SEQ ID NO: 2908911 - RNA, 19 nt, Mycobacterium avium subsp. paratuberculosis
cgcucagcgggcggccagc

SEQ ID NO: 2908912 - RNA, 23 nt, Mycobacterium avium subsp. paratuberculosis
cgcucagcgggcggccagccgcu

SEQ ID NO: 2908913 - RNA, 15 nt, Mycobacterium avium subsp. paratuberculosis
cgcucaggcguccag

SEQ ID NO: 2908914 - RNA, 20 nt, Mycobacterium avium subsp. paratuberculosis
cgcucaggcguccagccagc

SEQ ID NO: 2908915 - RNA, 15 nt, Mycobacterium avium subsp. paratuberculosis
cgcucaggucggccg

SEQ ID NO: 2908916 - RNA, 17 nt, Mycobacterium avium subsp. paratuberculosis
cgcucaggucggccgcg

SEQ ID NO: 2908917 - RNA, 21 nt, Mycobacterium avium subsp. paratuberculosis
cgcucaggucggccgcggccg

SEQ ID NO: 2908918 - RNA, 22 nt, Mycobacterium avium subsp. paratuberculosis
cgcucaguccagcucccaggac

SEQ ID NO: 2908919 - RNA, 19 nt, Mycobacterium avium subsp. paratuberculosis
cgcucagugcacgcucggc

SEQ ID NO: 2908920 - RNA, 20 nt, Mycobacterium avium subsp. paratuberculosis
cgcucagugcacgcucggcg

SEQ ID NO: 2908921 - RNA, 15 nt, Mycobacterium avium subsp. paratuberculosis
cgcucaucaggcggc

SEQ ID NO: 2908922 - RNA, 21 nt, Mycobacterium avium subsp. paratuberculosis
cgcucaucaggcggccggccc

SEQ ID NO: 2908923 - RNA, 18 nt, Mycobacterium avium subsp. paratuberculosis
cgcucaucccgaugucgg

SEQ ID NO: 2908924 - RNA, 16 nt, Mycobacterium avium subsp. paratuberculosis
cgcucaugcccgccac

SEQ ID NO: 2908925 - RNA, 18 nt, Mycobacterium avium subsp. paratuberculosis
cgcucauguugugcaggc

SEQ ID NO: 2908926 - RNA, 21 nt, Mycobacterium avium subsp. paratuberculosis
cgcucauguugugcaggcagc

SEQ ID NO: 2908927 - RNA, 21 nt, Mycobacterium avium subsp. paratuberculosis
cgcuccacaucugccggcaga

SEQ ID NO: 2908928 - RNA, 15 nt, Mycobacterium avium subsp. paratuberculosis
cgcuccaccagcgcg

SEQ ID NO: 2908929 - RNA, 16 nt, Mycobacterium avium subsp. paratuberculosis
cgcuccaccagcgcgg

SEQ ID NO: 2908930 - RNA, 17 nt, Mycobacterium avium subsp. paratuberculosis
cgcuccaccagcgcggu

SEQ ID NO: 2908931 - RNA, 18 nt, Mycobacterium avium subsp. paratuberculosis
cgcuccaccagcgcggug

SEQ ID NO: 2908932 - RNA, 16 nt, Mycobacterium avium subsp. paratuberculosis
cgcuccaccgcguccu

SEQ ID NO: 2908933 - RNA, 19 nt, Mycobacterium avium subsp. paratuberculosis
cgcuccagaugcgguggug

SEQ ID NO: 2908934 - RNA, 22 nt, Mycobacterium avium subsp. paratuberculosis
cgcuccagaugcggugguggga

SEQ ID NO: 2908935 - RNA, 12 nt, Mycobacterium avium subsp. paratuberculosis
cgcuccagcagg

SEQ ID NO: 2908936 - RNA, 12 nt, Mycobacterium avium subsp. paratuberculosis
cgcuccagccac

SEQ ID NO: 2908937 - RNA, 19 nt, Mycobacterium avium subsp. paratuberculosis
cgcuccagcggccacaccg

SEQ ID NO: 2908938 - RNA, 20 nt, Mycobacterium avium subsp. paratuberculosis
cgcuccagcggccacaccgg

SEQ ID NO: 2908939 - RNA, 15 nt, Mycobacterium avium subsp. paratuberculosis
cgcuccagcgggcgg

SEQ ID NO: 2908940 - RNA, 16 nt, Mycobacterium avium subsp. paratuberculosis
cgcuccagcgggcggc

SEQ ID NO: 2908941 - RNA, 18 nt, Mycobacterium avium subsp. paratuberculosis
cgcuccagcgggcggcgg

SEQ ID NO: 2908942 - RNA, 21 nt, Mycobacterium avium subsp. paratuberculosis
cgcuccagcgggcggcggugg

SEQ ID NO: 2908943 - RNA, 16 nt, Mycobacterium avium subsp. paratuberculosis
cgcuccaugaaccggu

SEQ ID NO: 2908944 - RNA, 18 nt, Mycobacterium avium subsp. paratuberculosis
cgcuccauggcggcgacc

SEQ ID NO: 2908945 - RNA, 17 nt, Mycobacterium avium subsp. paratuberculosis
cgcucccauccggaagc

SEQ ID NO: 2908946 - RNA, 20 nt, Mycobacterium avium subsp. paratuberculosis
cgcuccccgagcacgucgag

SEQ ID NO: 2908947 - RNA, 24 nt, Mycobacterium avium subsp. paratuberculosis
cgcuccccgagcacgucgagcacc

SEQ ID NO: 2908948 - RNA, 13 nt, Mycobacterium avium subsp. paratuberculosis
cgcucccgcgcgg

SEQ ID NO: 2908949 - RNA, 16 nt, Mycobacterium avium subsp. paratuberculosis
cgcucccgcgcgggca

SEQ ID NO: 2908950 - RNA, 12 nt, Mycobacterium avium subsp. paratuberculosis
cgcucccggcgc

SEQ ID NO: 2908951 - RNA, 15 nt, Mycobacterium avium subsp. paratuberculosis
cgcucccggcgcagc

SEQ ID NO: 2908952 - RNA, 13 nt, Mycobacterium avium subsp. paratuberculosis
cgcucccggcgcc

SEQ ID NO: 2908953 - RNA, 14 nt, Mycobacterium avium subsp. paratuberculosis
cgcucccggcgccg

SEQ ID NO: 2908954 - RNA, 18 nt, Mycobacterium avium subsp. paratuberculosis
cgcucccgggacagcccg

SEQ ID NO: 2908955 - RNA, 19 nt, Mycobacterium avium subsp. paratuberculosis
cgcucgcgggcccgcgccg

SEQ ID NO: 2908956 - RNA, 22 nt, Mycobacterium avium subsp. paratuberculosis
cgcucgcgggcccgcgccgcgu

SEQ ID NO: 2908957 - RNA, 13 nt, Mycobacterium avium subsp. paratuberculosis
cgcucgcgggugc

SEQ ID NO: 2908958 - RNA, 16 nt, Mycobacterium avium subsp. paratuberculosis
cgcucgcgggugcgcu

SEQ ID NO: 2908959 - RNA, 18 nt, Mycobacterium avium subsp. paratuberculosis
cgcucgcgguugggccgc

SEQ ID NO: 2908960 - RNA, 22 nt, Mycobacterium avium subsp. paratuberculosis
cgcucgcgguugggccgccggc

SEQ ID NO: 2908961 - RNA, 23 nt, Mycobacterium avium subsp. paratuberculosis
cgcucgcgguugggccgccggcc

SEQ ID NO: 2908962 - RNA, 19 nt, Mycobacterium avium subsp. paratuberculosis
cgcucgcuauaucgcaccg

SEQ ID NO: 2908963 - RNA, 22 nt, Mycobacterium avium subsp. paratuberculosis
cgcucgcuauaucgcaccggcg

SEQ ID NO: 2908964 - RNA, 20 nt, Mycobacterium avium subsp. paratuberculosis
cgcucggaaugaacugccgc

SEQ ID NO: 2908965 - RNA, 23 nt, Mycobacterium avium subsp. paratuberculosis
cgcucggacucaggagugguagg

SEQ ID NO: 2908966 - RNA, 21 nt, Mycobacterium avium subsp. paratuberculosis
cgcucggaguucgcccgcagc

SEQ ID NO: 2908967 - RNA, 18 nt, Mycobacterium avium subsp. paratuberculosis
cgcucggcaggcggggaa

SEQ ID NO: 2908968 - RNA, 13 nt, Mycobacterium avium subsp. paratuberculosis
cgcucggccagca

SEQ ID NO: 2908969 - RNA, 14 nt, Mycobacterium avium subsp. paratuberculosis
cgcucggccagcag

SEQ ID NO: 2908970 - RNA, 15 nt, Mycobacterium avium subsp. paratuberculosis
cgcucggccagcagc

SEQ ID NO: 2908971 - RNA, 18 nt, Mycobacterium avium subsp. paratuberculosis
cgcucggccagcagcacc

SEQ ID NO: 2908972 - RNA, 21 nt, Mycobacterium avium subsp. paratuberculosis
cgcucggccagcagcaccagg

SEQ ID NO: 2908973 - RNA, 15 nt, Mycobacterium avium subsp. paratuberculosis
cgcucggccagcagu

SEQ ID NO: 2908974 - RNA, 18 nt, Mycobacterium avium subsp. paratuberculosis
cgcucggccagcagugcc

SEQ ID NO: 2908975 - RNA, 13 nt, Mycobacterium avium subsp. paratuberculosis
cgcucggccgggu

SEQ ID NO: 2908976 - RNA, 18 nt, Mycobacterium avium subsp. paratuberculosis
cgcucggccguggccguc

SEQ ID NO: 2908977 - RNA, 21 nt, Mycobacterium avium subsp. paratuberculosis
cgcucggcgaccugcggcucg

SEQ ID NO: 2908978 - RNA, 14 nt, Mycobacterium avium subsp. paratuberculosis
cgcucggcgacgaa

SEQ ID NO: 2908979 - RNA, 13 nt, Mycobacterium avium subsp. paratuberculosis
cgcucggcgagcu

SEQ ID NO: 2908980 - RNA, 15 nt, Mycobacterium avium subsp. paratuberculosis
cgcucggcgagcugc

SEQ ID NO: 2908981 - RNA, 23 nt, Mycobacterium avium subsp. paratuberculosis
cgcucggcgagcugcgggugcuc

SEQ ID NO: 2908982 - RNA, 12 nt, Mycobacterium avium subsp. paratuberculosis
cgcucggcgauc

SEQ ID NO: 2908983 - RNA, 17 nt, Mycobacterium avium subsp. paratuberculosis
cgcucggcgaucuggcg

SEQ ID NO: 2908984 - RNA, 12 nt, Mycobacterium avium subsp. paratuberculosis
cgcucggcgccg

SEQ ID NO: 2908985 - RNA, 13 nt, Mycobacterium avium subsp. paratuberculosis
cgcucggcgccgg

SEQ ID NO: 2908986 - RNA, 16 nt, Mycobacterium avium subsp. paratuberculosis
cgcucggcgccggccg

SEQ ID NO: 2908987 - RNA, 21 nt, Mycobacterium avium subsp. paratuberculosis
cgcucggcgccggccgucacg

SEQ ID NO: 2908988 - RNA, 14 nt, Mycobacterium avium subsp. paratuberculosis
cgcucggcgcgacg

SEQ ID NO: 2908989 - RNA, 17 nt, Mycobacterium avium subsp. paratuberculosis
cgcucggcgcgacguug

SEQ ID NO: 2908990 - RNA, 12 nt, Mycobacterium avium subsp. paratuberculosis
cgcucggcgcgc

SEQ ID NO: 2908991 - RNA, 14 nt, Mycobacterium avium subsp. paratuberculosis
cgcucggcgcgucg

SEQ ID NO: 2908992 - RNA, 16 nt, Mycobacterium avium subsp. paratuberculosis
cgcucggcgcuccagc

SEQ ID NO: 2908993 - RNA, 16 nt, Mycobacterium avium subsp. paratuberculosis
cgcucggcggccgagg

SEQ ID NO: 2908994 - RNA, 14 nt, Mycobacterium avium subsp. paratuberculosis
cgcucggcggcgac

SEQ ID NO: 2908995 - RNA, 13 nt, Mycobacterium avium subsp. paratuberculosis
cgcucggcggcgc

SEQ ID NO: 2908996 - RNA, 16 nt, Mycobacterium avium subsp. paratuberculosis
cgcucggcggcgccgu

SEQ ID NO: 2908997 - RNA, 22 nt, Mycobacterium avium subsp. paratuberculosis
cgcucggcggggggagaggcgc

SEQ ID NO: 2908998 - RNA, 14 nt, Mycobacterium avium subsp. paratuberculosis
cgcucggcgggucg

SEQ ID NO: 2908999 - RNA, 23 nt, Mycobacterium avium subsp. paratuberculosis
cgcucggcggguugcugagccgc

SEQ ID NO: 2909000 - RNA, 13 nt, Mycobacterium avium subsp. paratuberculosis
cgcucggcguugg

SEQ ID NO: 2909001 - RNA, 14 nt, Mycobacterium avium subsp. paratuberculosis
cgcucggcucgauc

SEQ ID NO: 2909002 - RNA, 12 nt, Mycobacterium avium subsp. paratuberculosis
cgcucgggccau

SEQ ID NO: 2909003 - RNA, 15 nt, Mycobacterium avium subsp. paratuberculosis
cgcucgggcccgcgc

SEQ ID NO: 2909004 - RNA, 12 nt, Mycobacterium avium subsp. paratuberculosis
cgcucgggccgg

SEQ ID NO: 2909005 - RNA, 17 nt, Mycobacterium avium subsp. paratuberculosis
cgcucgggccggcgccg

SEQ ID NO: 2909006 - RNA, 19 nt, Mycobacterium avium subsp. paratuberculosis
cgcucgggcuucggcguca

SEQ ID NO: 2909007 - RNA, 14 nt, Mycobacterium avium subsp. paratuberculosis
cgcucggggccggu

SEQ ID NO: 2909008 - RNA, 18 nt, Mycobacterium avium subsp. paratuberculosis
cgcucgggggugcccggc

SEQ ID NO: 2909009 - RNA, 14 nt, Mycobacterium avium subsp. paratuberculosis
cgcucgggugucgc

SEQ ID NO: 2909010 - RNA, 22 nt, Mycobacterium avium subsp. paratuberculosis
cgcucgggugucgccgagccgc

SEQ ID NO: 2909011 - RNA, 23 nt, Mycobacterium avium subsp. paratuberculosis
cgcucgggugucgccgagccgca

SEQ ID NO: 2909012 - RNA, 16 nt, Mycobacterium avium subsp. paratuberculosis
cgcucggucagcaccg

SEQ ID NO: 2909013 - RNA, 18 nt, Mycobacterium avium subsp. paratuberculosis
cgcucggucaggcccagg

SEQ ID NO: 2909014 - RNA, 17 nt, Mycobacterium avium subsp. paratuberculosis
cgcucggucgccacggc

SEQ ID NO: 2909015 - RNA, 19 nt, Mycobacterium avium subsp. paratuberculosis
cgcucggucgccacggccg

SEQ ID NO: 2909016 - RNA, 20 nt, Mycobacterium avium subsp. paratuberculosis
cgcucggucgccacggccgg

SEQ ID NO: 2909017 - RNA, 16 nt, Mycobacterium avium subsp. paratuberculosis
cgcucggucgcggcga

SEQ ID NO: 2909018 - RNA, 18 nt, Mycobacterium avium subsp. paratuberculosis
cgcucggucgcggcgauc

SEQ ID NO: 2909019 - RNA, 20 nt, Mycobacterium avium subsp. paratuberculosis
cgcucggucgcggcgaucgg

SEQ ID NO: 2909020 - RNA, 16 nt, Mycobacterium avium subsp. paratuberculosis
cgcucgguggacaggu

SEQ ID NO: 2909021 - RNA, 18 nt, Mycobacterium avium subsp. paratuberculosis
cgcucguaacgccacggc

SEQ ID NO: 2909022 - RNA, 22 nt, Mycobacterium avium subsp. paratuberculosis
cgcucguaacgccacggcggcc

SEQ ID NO: 2909023 - RNA, 19 nt, Mycobacterium avium subsp. paratuberculosis
cgcucguaguuggggccgg

SEQ ID NO: 2909024 - RNA, 21 nt, Mycobacterium avium subsp. paratuberculosis
cgcucguaguuggggccggcc

SEQ ID NO: 2909025 - RNA, 23 nt, Mycobacterium avium subsp. paratuberculosis
cgcucguaguuggggccggccgc

SEQ ID NO: 2909026 - RNA, 16 nt, Mycobacterium avium subsp. paratuberculosis
cgcucguccagggugg

SEQ ID NO: 2909027 - RNA, 12 nt, Mycobacterium avium subsp. paratuberculosis
cgcucgucgauc

SEQ ID NO: 2909028 - RNA, 15 nt, Mycobacterium avium subsp. paratuberculosis
cgcucgucggccagc

SEQ ID NO: 2909029 - RNA, 17 nt, Mycobacterium avium subsp. paratuberculosis
cgcucgucggccagcga

SEQ ID NO: 2909030 - RNA, 12 nt, Mycobacterium avium subsp. paratuberculosis
cgcucgucggcg

SEQ ID NO: 2909031 - RNA, 14 nt, Mycobacterium avium subsp. paratuberculosis
cgcucgucggcgcg

SEQ ID NO: 2909032 - RNA, 21 nt, Mycobacterium avium subsp. paratuberculosis
cgcucgucggcgcgggccagc

SEQ ID NO: 2909033 - RNA, 13 nt, Mycobacterium avium subsp. paratuberculosis
cgcucgucgucgc

SEQ ID NO: 2909034 - RNA, 18 nt, Mycobacterium avium subsp. paratuberculosis
cgcucgucgucgccgaug

SEQ ID NO: 2909035 - RNA, 15 nt, Mycobacterium avium subsp. paratuberculosis
cgcucgucgucggug

SEQ ID NO: 2909036 - RNA, 22 nt, Mycobacterium avium subsp. paratuberculosis
cgcucgucuuuauucggcuucg

SEQ ID NO: 2909037 - RNA, 15 nt, Mycobacterium avium subsp. paratuberculosis
cgcucgugaccggcg

SEQ ID NO: 2909038 - RNA, 16 nt, Mycobacterium avium subsp. paratuberculosis
cgcucgugaccggcgg

SEQ ID NO: 2909039 - RNA, 17 nt, Mycobacterium avium subsp. paratuberculosis
cgcucgugaccggcggu

SEQ ID NO: 2909040 - RNA, 19 nt, Mycobacterium avium subsp. paratuberculosis
cgcugagcgggacgcgcag

SEQ ID NO: 2909041 - RNA, 24 nt, Mycobacterium avium subsp. paratuberculosis
cgcugagcggguaaccgcagccgg

SEQ ID NO: 2909042 - RNA, 19 nt, Mycobacterium avium subsp. paratuberculosis
cgcugagcuucugcccggc

SEQ ID NO: 2909043 - RNA, 20 nt, Mycobacterium avium subsp. paratuberculosis
cgcugagcuucugcccggcc

SEQ ID NO: 2909044 - RNA, 22 nt, Mycobacterium avium subsp. paratuberculosis
cgcugagcuucugcccggccag

SEQ ID NO: 2909045 - RNA, 21 nt, Mycobacterium avium subsp. paratuberculosis
cgcugagguagucccgcgccu

SEQ ID NO: 2909046 - RNA, 23 nt, Mycobacterium avium subsp. paratuberculosis
cgcugagucuacuuggccagcug

SEQ ID NO: 2909047 - RNA, 22 nt, Mycobacterium avium subsp. paratuberculosis
cgcugaucaccaaauagccguc

SEQ ID NO: 2909048 - RNA, 15 nt, Mycobacterium avium subsp. paratuberculosis
cgcugaucaccacgg

SEQ ID NO: 2909049 - RNA, 19 nt, Mycobacterium avium subsp. paratuberculosis
cgcugaucaccacggucag

SEQ ID NO: 2909050 - RNA, 14 nt, Mycobacterium avium subsp. paratuberculosis
cgcugaucagcucu

SEQ ID NO: 2909051 - RNA, 14 nt, Mycobacterium avium subsp. paratuberculosis
cgcugaucaugaag

SEQ ID NO: 2909052 - RNA, 16 nt, Mycobacterium avium subsp. paratuberculosis
cgcugauccagcagcg

SEQ ID NO: 2909053 - RNA, 18 nt, Mycobacterium avium subsp. paratuberculosis
cgcugaucgaccgguucg

SEQ ID NO: 2909054 - RNA, 14 nt, Mycobacterium avium subsp. paratuberculosis
cgcugaucgcgauc

SEQ ID NO: 2909055 - RNA, 23 nt, Mycobacterium avium subsp. paratuberculosis
cgcugaucgcgauccgggcgccg

SEQ ID NO: 2909056 - RNA, 17 nt, Mycobacterium avium subsp. paratuberculosis
cgcugaucuacgucggc

SEQ ID NO: 2909057 - RNA, 18 nt, Mycobacterium avium subsp. paratuberculosis
cgcugaucuacgucggcu

SEQ ID NO: 2909058 - RNA, 18 nt, Mycobacterium avium subsp. paratuberculosis
cgcugaucucgacggugg

SEQ ID NO: 2909059 - RNA, 20 nt, Mycobacterium avium subsp. paratuberculosis
cgcugaucucgacgguggcc

SEQ ID NO: 2909060 - RNA, 21 nt, Mycobacterium avium subsp. paratuberculosis
cgcugaucucgacgguggccu

SEQ ID NO: 2909061 - RNA, 16 nt, Mycobacterium avium subsp. paratuberculosis
cgcugaucugcggcac

SEQ ID NO: 2909062 - RNA, 19 nt, Mycobacterium avium subsp. paratuberculosis
cgcugaucugcggcaccac

SEQ ID NO: 2909063 - RNA, 14 nt, Mycobacterium avium subsp. paratuberculosis
cgcugaugccgccg

SEQ ID NO: 2909064 - RNA, 16 nt, Mycobacterium avium subsp. paratuberculosis
cgcugaugccgccgaa

SEQ ID NO: 2909065 - RNA, 18 nt, Mycobacterium avium subsp. paratuberculosis
cgcugaugccgccgaagc

SEQ ID NO: 2909066 - RNA, 15 nt, Mycobacterium avium subsp. paratuberculosis
cgcugaugccguccu

SEQ ID NO: 2909067 - RNA, 13 nt, Mycobacterium avium subsp. paratuberculosis
cgcugaugcggcc

SEQ ID NO: 2909068 - RNA, 16 nt, Mycobacterium avium subsp. paratuberculosis
cgcugaugcggccgga

SEQ ID NO: 2909069 - RNA, 23 nt, Mycobacterium avium subsp. paratuberculosis
cgcugauggcgaggaaguccggc

SEQ ID NO: 2909070 - RNA, 16 nt, Mycobacterium avium subsp. paratuberculosis
cgcugcaaccgguagc

SEQ ID NO: 2909071 - RNA, 20 nt, Mycobacterium avium subsp. paratuberculosis
cgcugcaaccgguccgccgu

SEQ ID NO: 2909072 - RNA, 12 nt, Mycobacterium avium subsp. paratuberculosis
cgcugcaccagc

SEQ ID NO: 2909073 - RNA, 15 nt, Mycobacterium avium subsp. paratuberculosis
cgcugcaccagcccg

SEQ ID NO: 2909074 - RNA, 16 nt, Mycobacterium avium subsp. paratuberculosis
cgcugcaccagcccgu

SEQ ID NO: 2909075 - RNA, 19 nt, Mycobacterium avium subsp. paratuberculosis
cgcugcaccagcccgucgg

SEQ ID NO: 2909076 - RNA, 13 nt, Mycobacterium avium subsp. paratuberculosis
cgcugcaccgcag

SEQ ID NO: 2909077 - RNA, 18 nt, Mycobacterium avium subsp. paratuberculosis
cgcugcaccgcagucuug

SEQ ID NO: 2909078 - RNA, 22 nt, Mycobacterium avium subsp. paratuberculosis
cgcugcacgcguugcagcgccg

SEQ ID NO: 2909079 - RNA, 15 nt, Mycobacterium avium subsp. paratuberculosis
cgcugcagcagcccg

SEQ ID NO: 2909080 - RNA, 19 nt, Mycobacterium avium subsp. paratuberculosis
cgcugcagcauccaggugg

SEQ ID NO: 2909081 - RNA, 17 nt, Mycobacterium avium subsp. paratuberculosis
cgcugcagccgguccgg

SEQ ID NO: 2909082 - RNA, 20 nt, Mycobacterium avium subsp. paratuberculosis
cgcugcagcgagaccucccg

SEQ ID NO: 2909083 - RNA, 22 nt, Mycobacterium avium subsp. paratuberculosis
cgcugcagcgagaccucccggc

SEQ ID NO: 2909084 - RNA, 12 nt, Mycobacterium avium subsp. paratuberculosis
cgcugcagcgcc

SEQ ID NO: 2909085 - RNA, 13 nt, Mycobacterium avium subsp. paratuberculosis
cgcugcagcgccg

SEQ ID NO: 2909086 - RNA, 16 nt, Mycobacterium avium subsp. paratuberculosis
cgcugcagcgccgagg

SEQ ID NO: 2909087 - RNA, 14 nt, Mycobacterium avium subsp. paratuberculosis
cgcugcagcgccgc

SEQ ID NO: 2909088 - RNA, 15 nt, Mycobacterium avium subsp. paratuberculosis
cgcugcagcgccgcc

SEQ ID NO: 2909089 - RNA, 18 nt, Mycobacterium avium subsp. paratuberculosis
cgcugcagcgccgcccgc

SEQ ID NO: 2909090 - RNA, 21 nt, Mycobacterium avium subsp. paratuberculosis
cgcugcagcgccgcccgcacc

SEQ ID NO: 2909091 - RNA, 14 nt, Mycobacterium avium subsp. paratuberculosis
cgcugcagcggcgg

SEQ ID NO: 2909092 - RNA, 17 nt, Mycobacterium avium subsp. paratuberculosis
cgcugcagcggcggcca

SEQ ID NO: 2909093 - RNA, 21 nt, Mycobacterium avium subsp. paratuberculosis
cgcugcagcggcggccaguug

SEQ ID NO: 2909094 - RNA, 23 nt, Mycobacterium avium subsp. paratuberculosis
cgcugcagcugcucguccuggcg

SEQ ID NO: 2909095 - RNA, 16 nt, Mycobacterium avium subsp. paratuberculosis
cgcugcaggcccgggu

SEQ ID NO: 2909096 - RNA, 21 nt, Mycobacterium avium subsp. paratuberculosis
cgcugcaggcccggguagcgc

SEQ ID NO: 2909097 - RNA, 15 nt, Mycobacterium avium subsp. paratuberculosis
cgcugcaguagccgg

SEQ ID NO: 2909098 - RNA, 18 nt, Mycobacterium avium subsp. paratuberculosis
cgcugcaguagccggcca

SEQ ID NO: 2909099 - RNA, 22 nt, Mycobacterium avium subsp. paratuberculosis
cgcugcauagucggcccgaucg

SEQ ID NO: 2909100 - RNA, 18 nt, Mycobacterium avium subsp. paratuberculosis
cgcugcauccgcagcacc

SEQ ID NO: 2909101 - RNA, 20 nt, Mycobacterium avium subsp. paratuberculosis
cgcugcauccgcagcaccag

SEQ ID NO: 2909102 - RNA, 21 nt, Mycobacterium avium subsp. paratuberculosis
cgcugcauccgcagcaccagg

SEQ ID NO: 2909103 - RNA, 14 nt, Mycobacterium avium subsp. paratuberculosis
cgcugcaugccggu

SEQ ID NO: 2909104 - RNA, 15 nt, Mycobacterium avium subsp. paratuberculosis
cgcugcaugccggug

SEQ ID NO: 2909105 - RNA, 23 nt, Mycobacterium avium subsp. paratuberculosis
cgcugcaugccggugucggugcg

SEQ ID NO: 2909106 - RNA, 23 nt, Mycobacterium avium subsp. paratuberculosis
cgcugccacgguuucgccguaca

SEQ ID NO: 2909107 - RNA, 22 nt, Mycobacterium avium subsp. paratuberculosis
cgcugccaggcgguggccgaac

SEQ ID NO: 2909108 - RNA, 15 nt, Mycobacterium avium subsp. paratuberculosis
cgcugccagggccgg

SEQ ID NO: 2909109 - RNA, 17 nt, Mycobacterium avium subsp. paratuberculosis
cgcugccagggccgggc

SEQ ID NO: 2909110 - RNA, 18 nt, Mycobacterium avium subsp. paratuberculosis
cgcugccagggccgggcg

SEQ ID NO: 2909111 - RNA, 19 nt, Mycobacterium avium subsp. paratuberculosis
cgcugccagggccgggcgu

SEQ ID NO: 2909112 - RNA, 18 nt, Mycobacterium avium subsp. paratuberculosis
cgcugcccaacgucgacu

SEQ ID NO: 2909113 - RNA, 23 nt, Mycobacterium avium subsp. paratuberculosis
cgcugcccagauacgccgcgacg

SEQ ID NO: 2909114 - RNA, 17 nt, Mycobacterium avium subsp. paratuberculosis
cgcugcccagcgcgguc

SEQ ID NO: 2909115 - RNA, 12 nt, Mycobacterium avium subsp. paratuberculosis
cgcugccccggc

SEQ ID NO: 2909116 - RNA, 16 nt, Mycobacterium avium subsp. paratuberculosis
cgcugcccgaugguga

SEQ ID NO: 2909117 - RNA, 12 nt, Mycobacterium avium subsp. paratuberculosis
cgcugcccgccg

SEQ ID NO: 2909118 - RNA, 13 nt, Mycobacterium avium subsp. paratuberculosis
cgcugcccgccgc

SEQ ID NO: 2909119 - RNA, 16 nt, Mycobacterium avium subsp. paratuberculosis
cgcugcccgccgcggu

SEQ ID NO: 2909120 - RNA, 17 nt, Mycobacterium avium subsp. paratuberculosis
cgcugcccgccgcggug

SEQ ID NO: 2909121 - RNA, 15 nt, Mycobacterium avium subsp. paratuberculosis
cgcugcccgccgcgu

SEQ ID NO: 2909122 - RNA, 20 nt, Mycobacterium avium subsp. paratuberculosis
cgcugcccgccgcguacagc

SEQ ID NO: 2909123 - RNA, 21 nt, Mycobacterium avium subsp. paratuberculosis
cgcugcccgccgcguacagca

SEQ ID NO: 2909124 - RNA, 24 nt, Mycobacterium avium subsp. paratuberculosis
cgcugcggcacaccagcguucguc

SEQ ID NO: 2909125 - RNA, 14 nt, Mycobacterium avium subsp. paratuberculosis
cgcugcggcgcagu

SEQ ID NO: 2909126 - RNA, 15 nt, Mycobacterium avium subsp. paratuberculosis
cgcugcggcgccggg

SEQ ID NO: 2909127 - RNA, 16 nt, Mycobacterium avium subsp. paratuberculosis
cgcugcgggccaucga

SEQ ID NO: 2909128 - RNA, 19 nt, Mycobacterium avium subsp. paratuberculosis
cgcugcgggcgggccgcca

SEQ ID NO: 2909129 - RNA, 22 nt, Mycobacterium avium subsp. paratuberculosis
cgcugcgggcgggccgccaggu

SEQ ID NO: 2909130 - RNA, 19 nt, Mycobacterium avium subsp. paratuberculosis
cgcugcgguacacguggcc

SEQ ID NO: 2909131 - RNA, 22 nt, Mycobacterium avium subsp. paratuberculosis
cgcugcgguacacguggccgau

SEQ ID NO: 2909132 - RNA, 20 nt, Mycobacterium avium subsp. paratuberculosis
cgcugcucaugagcccucca

SEQ ID NO: 2909133 - RNA, 13 nt, Mycobacterium avium subsp. paratuberculosis
cgcugcuccgggu

SEQ ID NO: 2909134 - RNA, 15 nt, Mycobacterium avium subsp. paratuberculosis
cgcugcuccgggucc

SEQ ID NO: 2909135 - RNA, 19 nt, Mycobacterium avium subsp. paratuberculosis
cgcugcuccggguccgcgg

SEQ ID NO: 2909136 - RNA, 21 nt, Mycobacterium avium subsp. paratuberculosis
cgcugcuccggguccgcggug

SEQ ID NO: 2909137 - RNA, 17 nt, Mycobacterium avium subsp. paratuberculosis
cgcugcucgaccucggc

SEQ ID NO: 2909138 - RNA, 18 nt, Mycobacterium avium subsp. paratuberculosis
cgcugcucgaccucggcg

SEQ ID NO: 2909139 - RNA, 20 nt, Mycobacterium avium subsp. paratuberculosis
cgcugcucgaccucggcgac

SEQ ID NO: 2909140 - RNA, 22 nt, Mycobacterium avium subsp. paratuberculosis
cgcugcucgaccucggcgacca

SEQ ID NO: 2909141 - RNA, 22 nt, Mycobacterium avium subsp. paratuberculosis
cgcugcucggaggaaccgugcg

SEQ ID NO: 2909142 - RNA, 18 nt, Mycobacterium avium subsp. paratuberculosis
cgcugcucugcgcgcggu

SEQ ID NO: 2909143 - RNA, 20 nt, Mycobacterium avium subsp. paratuberculosis
cgcugcucugcgcgcggugc

SEQ ID NO: 2909144 - RNA, 18 nt, Mycobacterium avium subsp. paratuberculosis
cgcugcucuuguccgcgu

SEQ ID NO: 2909145 - RNA, 21 nt, Mycobacterium avium subsp. paratuberculosis
cgcugcucuuguccgcguugg

SEQ ID NO: 2909146 - RNA, 13 nt, Mycobacterium avium subsp. paratuberculosis
cgcugcugcucgg

SEQ ID NO: 2909147 - RNA, 16 nt, Mycobacterium avium subsp. paratuberculosis
cgcugcugcugcccgc

SEQ ID NO: 2909148 - RNA, 19 nt, Mycobacterium avium subsp. paratuberculosis
cgcugcugggugccgcguu

SEQ ID NO: 2909149 - RNA, 17 nt, Mycobacterium avium subsp. paratuberculosis
cgcugcuggucuugccg

SEQ ID NO: 2909150 - RNA, 22 nt, Mycobacterium avium subsp. paratuberculosis
cgcugcuggucuugccgugcag

SEQ ID NO: 2909151 - RNA, 23 nt, Mycobacterium avium subsp. paratuberculosis
cgcugcuggucuugccgugcagc

SEQ ID NO: 2909152 - RNA, 16 nt, Mycobacterium avium subsp. paratuberculosis
cgcugcuugacccgcu

SEQ ID NO: 2909153 - RNA, 22 nt, Mycobacterium avium subsp. paratuberculosis
cgcuggaaaccucuugcggcgc

SEQ ID NO: 2909154 - RNA, 19 nt, Mycobacterium avium subsp. paratuberculosis
cgcuggaacagcgggccgg

SEQ ID NO: 2909155 - RNA, 17 nt, Mycobacterium avium subsp. paratuberculosis
cgcuggaacgccgagga

SEQ ID NO: 2909156 - RNA, 17 nt, Mycobacterium avium subsp. paratuberculosis
cgcuggaagucggucug

SEQ ID NO: 2909157 - RNA, 23 nt, Mycobacterium avium subsp. paratuberculosis
cgcuggaagucggucugcggaga

SEQ ID NO: 2909158 - RNA, 20 nt, Mycobacterium avium subsp. paratuberculosis
cgcuggagauguugaucacg

SEQ ID NO: 2909159 - RNA, 12 nt, Mycobacterium avium subsp. paratuberculosis
cgcuggaucccc

SEQ ID NO: 2909160 - RNA, 15 nt, Mycobacterium avium subsp. paratuberculosis
cgcuggaucccggug

SEQ ID NO: 2909161 - RNA, 16 nt, Mycobacterium avium subsp. paratuberculosis
cgcuggaucccgguga

SEQ ID NO: 2909162 - RNA, 22 nt, Mycobacterium avium subsp. paratuberculosis
cgcuggauguccaggccgucga

SEQ ID NO: 2909163 - RNA, 18 nt, Mycobacterium avium subsp. paratuberculosis
cgcuggauuccaccgugg

SEQ ID NO: 2909164 - RNA, 22 nt, Mycobacterium avium subsp. paratuberculosis
cgcuggccacgauccggggcag

SEQ ID NO: 2909165 - RNA, 23 nt, Mycobacterium avium subsp. paratuberculosis
cgcuggccagcgcgacggccucg

SEQ ID NO: 2909166 - RNA, 15 nt, Mycobacterium avium subsp. paratuberculosis
cgcuggccagcguca

SEQ ID NO: 2909167 - RNA, 17 nt, Mycobacterium avium subsp. paratuberculosis
cgcuggccagcgucagg

SEQ ID NO: 2909168 - RNA, 21 nt, Mycobacterium avium subsp. paratuberculosis
cgcuggccagguacaccacca

SEQ ID NO: 2909169 - RNA, 13 nt, Mycobacterium avium subsp. paratuberculosis
cgcuggccccggu

SEQ ID NO: 2909170 - RNA, 13 nt, Mycobacterium avium subsp. paratuberculosis
cgcuggcccggcg

SEQ ID NO: 2909171 - RNA, 14 nt, Mycobacterium avium subsp. paratuberculosis
cgcuggccgacccc

SEQ ID NO: 2909172 - RNA, 14 nt, Mycobacterium avium subsp. paratuberculosis
cgcuggccgagagc

SEQ ID NO: 2909173 - RNA, 15 nt, Mycobacterium avium subsp. paratuberculosis
cgcuggccgagagcc

SEQ ID NO: 2909174 - RNA, 18 nt, Mycobacterium avium subsp. paratuberculosis
cgcuggccgaggccucca

SEQ ID NO: 2909175 - RNA, 13 nt, Mycobacterium avium subsp. paratuberculosis
cgcuggccgcccc

SEQ ID NO: 2909176 - RNA, 21 nt, Mycobacterium avium subsp. paratuberculosis
cgcuggccgcgaacggcccgc

SEQ ID NO: 2909177 - RNA, 17 nt, Mycobacterium avium subsp. paratuberculosis
cgcuggccgcgccacag

SEQ ID NO: 2909178 - RNA, 18 nt, Mycobacterium avium subsp. paratuberculosis
cgcuggccgcgccacagc

SEQ ID NO: 2909179 - RNA, 15 nt, Mycobacterium avium subsp. paratuberculosis
cgcuggccgcggcca

SEQ ID NO: 2909180 - RNA, 14 nt, Mycobacterium avium subsp. paratuberculosis
cgcuggccggcagc

SEQ ID NO: 2909181 - RNA, 15 nt, Mycobacterium avium subsp. paratuberculosis
cgcuggccggcagcg

SEQ ID NO: 2909182 - RNA, 18 nt, Mycobacterium avium subsp. paratuberculosis
cgcuggccggcagcgucu

SEQ ID NO: 2909183 - RNA, 13 nt, Mycobacterium avium subsp. paratuberculosis
cgcuggccggcca

SEQ ID NO: 2909184 - RNA, 18 nt, Mycobacterium avium subsp. paratuberculosis
cgcuggccggccaccagc

SEQ ID NO: 2909185 - RNA, 19 nt, Mycobacterium avium subsp. paratuberculosis
cgcuggccggccaccagcg

SEQ ID NO: 2909186 - RNA, 20 nt, Mycobacterium avium subsp. paratuberculosis
cgcuggccggccaccagcgg

SEQ ID NO: 2909187 - RNA, 14 nt, Mycobacterium avium subsp. paratuberculosis
cgcuggccguggcc

SEQ ID NO: 2909188 - RNA, 17 nt, Mycobacterium avium subsp. paratuberculosis
cgcuggccguggccgug

SEQ ID NO: 2909189 - RNA, 14 nt, Mycobacterium avium subsp. paratuberculosis
cgcuggccuccagc

SEQ ID NO: 2909190 - RNA, 17 nt, Mycobacterium avium subsp. paratuberculosis
cgcuggccuugaucggg

SEQ ID NO: 2909191 - RNA, 22 nt, Mycobacterium avium subsp. paratuberculosis
cgcuggcgaccaucagccugcg

SEQ ID NO: 2909192 - RNA, 16 nt, Mycobacterium avium subsp. paratuberculosis
cgcuggcgaucaccuu

SEQ ID NO: 2909193 - RNA, 21 nt, Mycobacterium avium subsp. paratuberculosis
cgcuggcgauggugccgaagc

SEQ ID NO: 2909194 - RNA, 20 nt, Mycobacterium avium subsp. paratuberculosis
cgcuggcgcaggcgcugggu

SEQ ID NO: 2909195 - RNA, 17 nt, Mycobacterium avium subsp. paratuberculosis
cgcuggcgcgccguacc

SEQ ID NO: 2909196 - RNA, 12 nt, Mycobacterium avium subsp. paratuberculosis
cgcuggcgcgcu

SEQ ID NO: 2909197 - RNA, 13 nt, Mycobacterium avium subsp. paratuberculosis
cgcuggcggccag

SEQ ID NO: 2909198 - RNA, 18 nt, Mycobacterium avium subsp. paratuberculosis
cgcuggcggccagcgucu

SEQ ID NO: 2909199 - RNA, 22 nt, Mycobacterium avium subsp. paratuberculosis
cgcuggcggccaucgccgcggu

SEQ ID NO: 2909200 - RNA, 15 nt, Mycobacterium avium subsp. paratuberculosis
cgcuggcggcgcggu

SEQ ID NO: 2909201 - RNA, 13 nt, Mycobacterium avium subsp. paratuberculosis
cgcuggcggggcg

SEQ ID NO: 2909202 - RNA, 17 nt, Mycobacterium avium subsp. paratuberculosis
cgcuggcggggcgugcc

SEQ ID NO: 2909203 - RNA, 23 nt, Mycobacterium avium subsp. paratuberculosis
cgcuggcggggcgugcccggcgc

SEQ ID NO: 2909204 - RNA, 12 nt, Mycobacterium avium subsp. paratuberculosis
cgcuggcggugu

SEQ ID NO: 2909205 - RNA, 23 nt, Mycobacterium avium subsp. paratuberculosis
cgcuggcggugucgaagaccggu

SEQ ID NO: 2909206 - RNA, 13 nt, Mycobacterium avium subsp. paratuberculosis
cgcuggcguacgc

SEQ ID NO: 2909207 - RNA, 16 nt, Mycobacterium avium subsp. paratuberculosis
cgcuggcguagaucug

SEQ ID NO: 2909208 - RNA, 17 nt, Mycobacterium avium subsp. paratuberculosis
cgcuguaggcggcgugc

SEQ ID NO: 2909209 - RNA, 23 nt, Mycobacterium avium subsp. paratuberculosis
cgcuguaggcggcgugccagggc

SEQ ID NO: 2909210 - RNA, 22 nt, Mycobacterium avium subsp. paratuberculosis
cgcuguagggccaccacgccag

SEQ ID NO: 2909211 - RNA, 15 nt, Mycobacterium avium subsp. paratuberculosis
cgcugucaauccccg

SEQ ID NO: 2909212 - RNA, 20 nt, Mycobacterium avium subsp. paratuberculosis
cgcugucaauccccgcgguu

SEQ ID NO: 2909213 - RNA, 12 nt, Mycobacterium avium subsp. paratuberculosis
cgcuguccacgu

SEQ ID NO: 2909214 - RNA, 21 nt, Mycobacterium avium subsp. paratuberculosis
cgcuguccucgagcgcgucga

SEQ ID NO: 2909215 - RNA, 23 nt, Mycobacterium avium subsp. paratuberculosis
cgcuguccucgagcgcgucgacc

SEQ ID NO: 2909216 - RNA, 13 nt, Mycobacterium avium subsp. paratuberculosis
cgcuguccucguc

SEQ ID NO: 2909217 - RNA, 20 nt, Mycobacterium avium subsp. paratuberculosis
cgcuguccucgucggaggcg

SEQ ID NO: 2909218 - RNA, 23 nt, Mycobacterium avium subsp. paratuberculosis
cgcuguccucgucggaggcgucg

SEQ ID NO: 2909219 - RNA, 16 nt, Mycobacterium avium subsp. paratuberculosis
cgcuguccugccgggc

SEQ ID NO: 2909220 - RNA, 17 nt, Mycobacterium avium subsp. paratuberculosis
cgcugucgcccucgauc

SEQ ID NO: 2909221 - RNA, 21 nt, Mycobacterium avium subsp. paratuberculosis
cgcugucgcccucgaucgcga

SEQ ID NO: 2909222 - RNA, 21 nt, Mycobacterium avium subsp. paratuberculosis
cgcugucggcggggaaggugc

SEQ ID NO: 2909223 - RNA, 16 nt, Mycobacterium avium subsp. paratuberculosis
cgcugucggggucgcg

SEQ ID NO: 2909224 - RNA, 18 nt, Mycobacterium avium subsp. paratuberculosis
cgcugugauagcggcgua

SEQ ID NO: 2909225 - RNA, 20 nt, Mycobacterium avium subsp. paratuberculosis
cgcugugaugggugagcggg

SEQ ID NO: 2909226 - RNA, 19 nt, Mycobacterium avium subsp. paratuberculosis
cgcugugcgaacuccggug

SEQ ID NO: 2909227 - RNA, 22 nt, Mycobacterium avium subsp. paratuberculosis
cgcugugcgccauguccggcag

SEQ ID NO: 2909228 - RNA, 13 nt, Mycobacterium avium subsp. paratuberculosis
cgcugugcgccuu

SEQ ID NO: 2909229 - RNA, 15 nt, Mycobacterium avium subsp. paratuberculosis
cgcugugcgccuugc

SEQ ID NO: 2909230 - RNA, 17 nt, Mycobacterium avium subsp. paratuberculosis
cgcugugcgccuugccg

SEQ ID NO: 2909231 - RNA, 23 nt, Mycobacterium avium subsp. paratuberculosis
cgcugugcgccuugccgucgagc

SEQ ID NO: 2909232 - RNA, 17 nt, Mycobacterium avium subsp. paratuberculosis
cgcugugcgggugaggc

SEQ ID NO: 2909233 - RNA, 18 nt, Mycobacterium avium subsp. paratuberculosis
cgcugugcucgacgaaga

SEQ ID NO: 2909234 - RNA, 16 nt, Mycobacterium avium subsp. paratuberculosis
cgcuguggacaggucg

SEQ ID NO: 2909235 - RNA, 17 nt, Mycobacterium avium subsp. paratuberculosis
cgcuguggacaggucga

SEQ ID NO: 2909236 - RNA, 23 nt, Mycobacterium avium subsp. paratuberculosis
cgcuguggacaggucgaugaugu

SEQ ID NO: 2909237 - RNA, 22 nt, Mycobacterium avium subsp. paratuberculosis
cgcuguggccguugaucgagca

SEQ ID NO: 2909238 - RNA, 18 nt, Mycobacterium avium subsp. paratuberculosis
cgcugugguccucgucac

SEQ ID NO: 2909239 - RNA, 22 nt, Mycobacterium avium subsp. paratuberculosis
cgcugugguccucgucaccgug

SEQ ID NO: 2909240 - RNA, 16 nt, Mycobacterium avium subsp. paratuberculosis
cgcuguuagccucgcc

SEQ ID NO: 2909241 - RNA, 17 nt, Mycobacterium avium subsp. paratuberculosis
cgcuguuagccucgcca

SEQ ID NO: 2909242 - RNA, 19 nt, Mycobacterium avium subsp. paratuberculosis
cgcuguuggaaccggccac

SEQ ID NO: 2909243 - RNA, 14 nt, Mycobacterium avium subsp. paratuberculosis
cgcuguuggcgacg

SEQ ID NO: 2909244 - RNA, 20 nt, Mycobacterium avium subsp. paratuberculosis
cgcuguuggcgacggcgcug

SEQ ID NO: 2909245 - RNA, 21 nt, Mycobacterium avium subsp. paratuberculosis
cgcuuccagcaccacccgguc

SEQ ID NO: 2909246 - RNA, 16 nt, Mycobacterium avium subsp. paratuberculosis
cgcuuccagcgcggcg

SEQ ID NO: 2909247 - RNA, 12 nt, Mycobacterium avium subsp. paratuberculosis
cgcuucccacag

SEQ ID NO: 2909248 - RNA, 23 nt, Mycobacterium avium subsp. paratuberculosis
cgcuucccacagucgcugggugu

SEQ ID NO: 2909249 - RNA, 14 nt, Mycobacterium avium subsp. paratuberculosis
cgcuucccacccgg

SEQ ID NO: 2909250 - RNA, 16 nt, Mycobacterium avium subsp. paratuberculosis
cgcuucgcccggcugc

SEQ ID NO: 2909251 - RNA, 19 nt, Mycobacterium avium subsp. paratuberculosis
cgcuucgcccggcugcgcc

SEQ ID NO: 2909252 - RNA, 13 nt, Mycobacterium avium subsp. paratuberculosis
cgcuucgcgcugu

SEQ ID NO: 2909253 - RNA, 17 nt, Mycobacterium avium subsp. paratuberculosis
cgcuucggccagcgcgu

SEQ ID NO: 2909254 - RNA, 20 nt, Mycobacterium avium subsp. paratuberculosis
cgcuucggccagcgcgucgg

SEQ ID NO: 2909255 - RNA, 12 nt, Mycobacterium avium subsp. paratuberculosis
cgcuucggcucg

SEQ ID NO: 2909256 - RNA, 14 nt, Mycobacterium avium subsp. paratuberculosis
cgcuucggcucggg

SEQ ID NO: 2909257 - RNA, 19 nt, Mycobacterium avium subsp. paratuberculosis
cgcuucgggagcaaggucg

SEQ ID NO: 2909258 - RNA, 23 nt, Mycobacterium avium subsp. paratuberculosis
cgcuucguggacgaacgcggcga

SEQ ID NO: 2909259 - RNA, 15 nt, Mycobacterium avium subsp. paratuberculosis
cgcuucuccgccuuc

SEQ ID NO: 2909260 - RNA, 13 nt, Mycobacterium avium subsp. paratuberculosis
cgcuucugcgccg

SEQ ID NO: 2909261 - RNA, 16 nt, Mycobacterium avium subsp. paratuberculosis
cgcuugaccagcaaca

SEQ ID NO: 2909262 - RNA, 13 nt, Mycobacterium avium subsp. paratuberculosis
cgcuugacgccgc

SEQ ID NO: 2909263 - RNA, 15 nt, Mycobacterium avium subsp. paratuberculosis
cgcuugacgccgccg

SEQ ID NO: 2909264 - RNA, 19 nt, Mycobacterium avium subsp. paratuberculosis
cgcuugauggcggcgcgga

SEQ ID NO: 2909265 - RNA, 14 nt, Mycobacterium avium subsp. paratuberculosis
cgcuugcagcuugg

SEQ ID NO: 2909266 - RNA, 16 nt, Mycobacterium avium subsp. paratuberculosis
cgcuugcagcuuggcg

SEQ ID NO: 2909267 - RNA, 16 nt, Mycobacterium avium subsp. paratuberculosis
cgcuugccagccgggc

SEQ ID NO: 2909268 - RNA, 18 nt, Mycobacterium avium subsp. paratuberculosis
cgcuugccagccgggccg

SEQ ID NO: 2909269 - RNA, 19 nt, Mycobacterium avium subsp. paratuberculosis
cgcuugccagccgggccga

SEQ ID NO: 2909270 - RNA, 17 nt, Mycobacterium avium subsp. paratuberculosis
cgcuugcccagccccuu

SEQ ID NO: 2909271 - RNA, 17 nt, Mycobacterium avium subsp. paratuberculosis
cgcuugccgaaguccuu

SEQ ID NO: 2909272 - RNA, 17 nt, Mycobacterium avium subsp. paratuberculosis
cgcuugccgacgugaug

SEQ ID NO: 2909273 - RNA, 16 nt, Mycobacterium avium subsp. paratuberculosis
cgcuugcgaccgccgc

SEQ ID NO: 2909274 - RNA, 12 nt, Mycobacterium avium subsp. paratuberculosis
cgcuugcgaucg

SEQ ID NO: 2909275 - RNA, 13 nt, Mycobacterium avium subsp. paratuberculosis
cgcuugcgaucgc

SEQ ID NO: 2909276 - RNA, 18 nt, Mycobacterium avium subsp. paratuberculosis
cgcuugcgcagcgucgug

SEQ ID NO: 2909277 - RNA, 15 nt, Mycobacterium avium subsp. paratuberculosis
cgcuugcgccgcagc

SEQ ID NO: 2909278 - RNA, 18 nt, Mycobacterium avium subsp. paratuberculosis
cgcuugcgccgcagcggu

SEQ ID NO: 2909279 - RNA, 19 nt, Mycobacterium avium subsp. paratuberculosis
cgcuugcggcgcagccagc

SEQ ID NO: 2909280 - RNA, 19 nt, Mycobacterium avium subsp. paratuberculosis
cgcuugcguucccagcccg

SEQ ID NO: 2909281 - RNA, 21 nt, Mycobacterium avium subsp. paratuberculosis
cgcuugcguucccagcccggc

SEQ ID NO: 2909282 - RNA, 22 nt, Mycobacterium avium subsp. paratuberculosis
cgcuugcguucccagcccggcc

SEQ ID NO: 2909283 - RNA, 14 nt, Mycobacterium avium subsp. paratuberculosis
cgcuuggcgcgccg

SEQ ID NO: 2909284 - RNA, 14 nt, Mycobacterium avium subsp. paratuberculosis
cgcuugggucgccg

SEQ ID NO: 2909285 - RNA, 15 nt, Mycobacterium avium subsp. paratuberculosis
cgcuugggucgccgg

SEQ ID NO: 2909286 - RNA, 16 nt, Mycobacterium avium subsp. paratuberculosis
cgcuugggucgccggg

SEQ ID NO: 2909287 - RNA, 15 nt, Mycobacterium avium subsp. paratuberculosis
cgcuugguggcgccg

SEQ ID NO: 2909288 - RNA, 18 nt, Mycobacterium avium subsp. paratuberculosis
cgcuugucagcggccucg

SEQ ID NO: 2909289 - RNA, 19 nt, Mycobacterium avium subsp. paratuberculosis
cgcuugucagcggccucgg

SEQ ID NO: 2909290 - RNA, 14 nt, Mycobacterium avium subsp. paratuberculosis
cgcuugucggcgug

SEQ ID NO: 2909291 - RNA, 18 nt, Mycobacterium avium subsp. paratuberculosis
cgcuugugccggaagcgg

SEQ ID NO: 2909292 - RNA, 19 nt, Mycobacterium avium subsp. paratuberculosis
cgcuuuccaccccggcggu

SEQ ID NO: 2909293 - RNA, 23 nt, Mycobacterium avium subsp. paratuberculosis
cgcguccagcaugcccacgccgu

SEQ ID NO: 2909294 - RNA, 16 nt, Mycobacterium avium subsp. paratuberculosis
cgcguccaggugcgcc

SEQ ID NO: 2909295 - RNA, 18 nt, Mycobacterium avium subsp. paratuberculosis
cgcguccaggugcgccgc

SEQ ID NO: 2909296 - RNA, 19 nt, Mycobacterium avium subsp. paratuberculosis
cgcguccaggugcgccgcc

SEQ ID NO: 2909297 - RNA, 21 nt, Mycobacterium avium subsp. paratuberculosis
cgcguccaggugcgccgccgc

SEQ ID NO: 2909298 - RNA, 20 nt, Mycobacterium avium subsp. paratuberculosis
cgcguccauggucgagccgc

SEQ ID NO: 2909299 - RNA, 21 nt, Mycobacterium avium subsp. paratuberculosis
cgcguccauggucgagccgca

SEQ ID NO: 2909300 - RNA, 14 nt, Mycobacterium avium subsp. paratuberculosis
cgcgucccacaucu

SEQ ID NO: 2909301 - RNA, 14 nt, Mycobacterium avium subsp. paratuberculosis
cgcguccccgcgcc

SEQ ID NO: 2909302 - RNA, 15 nt, Mycobacterium avium subsp. paratuberculosis
cgcguccccgcgccg

SEQ ID NO: 2909303 - RNA, 16 nt, Mycobacterium avium subsp. paratuberculosis
cgcguccccgcgccgg

SEQ ID NO: 2909304 - RNA, 18 nt, Mycobacterium avium subsp. paratuberculosis
cgcguccccgcgccgggc

SEQ ID NO: 2909305 - RNA, 20 nt, Mycobacterium avium subsp. paratuberculosis
cgcguccccgcgccgggcaa

SEQ ID NO: 2909306 - RNA, 14 nt, Mycobacterium avium subsp. paratuberculosis
cgcgucccgggccu

SEQ ID NO: 2909307 - RNA, 20 nt, Mycobacterium avium subsp. paratuberculosis
cgcgucccgggccuuggcca

SEQ ID NO: 2909308 - RNA, 23 nt, Mycobacterium avium subsp. paratuberculosis
cgcgucccgggccuuggccaacg

SEQ ID NO: 2909309 - RNA, 17 nt, Mycobacterium avium subsp. paratuberculosis
cgcgucccuggcgauga

SEQ ID NO: 2909310 - RNA, 19 nt, Mycobacterium avium subsp. paratuberculosis
cgcgucccuggcgaugauc

SEQ ID NO: 2909311 - RNA, 17 nt, Mycobacterium avium subsp. paratuberculosis
cgcguccgacggcuggg

SEQ ID NO: 2909312 - RNA, 14 nt, Mycobacterium avium subsp. paratuberculosis
cgcguccgagcagc

SEQ ID NO: 2909313 - RNA, 18 nt, Mycobacterium avium subsp. paratuberculosis
cgcguccgagcagcagcc

SEQ ID NO: 2909314 - RNA, 19 nt, Mycobacterium avium subsp. paratuberculosis
cgcguccgagcagcagccg

SEQ ID NO: 2909315 - RNA, 21 nt, Mycobacterium avium subsp. paratuberculosis
cgcguccgagcagcagccgca

SEQ ID NO: 2909316 - RNA, 22 nt, Mycobacterium avium subsp. paratuberculosis
cgcguccgagcagcagccgcag

SEQ ID NO: 2909317 - RNA, 16 nt, Mycobacterium avium subsp. paratuberculosis
cgcguccgaggcgguu

SEQ ID NO: 2909318 - RNA, 12 nt, Mycobacterium avium subsp. paratuberculosis
cgcguccgcgau

SEQ ID NO: 2909319 - RNA, 16 nt, Mycobacterium avium subsp. paratuberculosis
cgcguccgcgaucguc

SEQ ID NO: 2909320 - RNA, 20 nt, Mycobacterium avium subsp. paratuberculosis
cgcguccgcgaucgucucgu

SEQ ID NO: 2909321 - RNA, 21 nt, Mycobacterium avium subsp. paratuberculosis
cgcguccgcgguuucaccgug

SEQ ID NO: 2909322 - RNA, 15 nt, Mycobacterium avium subsp. paratuberculosis
cgcguccgcgucguc

SEQ ID NO: 2909323 - RNA, 16 nt, Mycobacterium avium subsp. paratuberculosis
cgcguccgcgucgucg

SEQ ID NO: 2909324 - RNA, 15 nt, Mycobacterium avium subsp. paratuberculosis
cgcguccggaggugc

SEQ ID NO: 2909325 - RNA, 19 nt, Mycobacterium avium subsp. paratuberculosis
cgcguccggaggugccggc

SEQ ID NO: 2909326 - RNA, 20 nt, Mycobacterium avium subsp. paratuberculosis
cgcguccggaggugccggcc

SEQ ID NO: 2909327 - RNA, 21 nt, Mycobacterium avium subsp. paratuberculosis
cgcguccggaggugccggccg

SEQ ID NO: 2909328 - RNA, 14 nt, Mycobacterium avium subsp. paratuberculosis
cgcguccggggugc

SEQ ID NO: 2909329 - RNA, 15 nt, Mycobacterium avium subsp. paratuberculosis
cgcguccggggugcc

SEQ ID NO: 2909330 - RNA, 14 nt, Mycobacterium avium subsp. paratuberculosis
cgcguccguagugc

SEQ ID NO: 2909331 - RNA, 21 nt, Mycobacterium avium subsp. paratuberculosis
cgcguccguagugcucggcgu

SEQ ID NO: 2909332 - RNA, 22 nt, Mycobacterium avium subsp. paratuberculosis
cgcguccguagugcucggcguc

SEQ ID NO: 2909333 - RNA, 14 nt, Mycobacterium avium subsp. paratuberculosis
cgcguccucgccgu

SEQ ID NO: 2909334 - RNA, 15 nt, Mycobacterium avium subsp. paratuberculosis
cgcguccucgccgua

SEQ ID NO: 2909335 - RNA, 17 nt, Mycobacterium avium subsp. paratuberculosis
cgcguccucgccguacg

SEQ ID NO: 2909336 - RNA, 19 nt, Mycobacterium avium subsp. paratuberculosis
cgcguccucgucgaugccg

SEQ ID NO: 2909337 - RNA, 19 nt, Mycobacterium avium subsp. paratuberculosis
cgcguccugcagcgccguc

SEQ ID NO: 2909338 - RNA, 14 nt, Mycobacterium avium subsp. paratuberculosis
cgcguccugcaggc

SEQ ID NO: 2909339 - RNA, 16 nt, Mycobacterium avium subsp. paratuberculosis
cgcguccugcaggcag

SEQ ID NO: 2909340 - RNA, 19 nt, Mycobacterium avium subsp. paratuberculosis
cgcguccugcaggcaggcc

SEQ ID NO: 2909341 - RNA, 20 nt, Mycobacterium avium subsp. paratuberculosis
cgcguccugcaggcaggccg

SEQ ID NO: 2909342 - RNA, 20 nt, Mycobacterium avium subsp. paratuberculosis
cgcguccuucuccgccgggc

SEQ ID NO: 2909343 - RNA, 15 nt, Mycobacterium avium subsp. paratuberculosis
cgcgucgaacacccu

SEQ ID NO: 2909344 - RNA, 18 nt, Mycobacterium avium subsp. paratuberculosis
cgcgucgaacagccgggc

SEQ ID NO: 2909345 - RNA, 22 nt, Mycobacterium avium subsp. paratuberculosis
cgcgucgaacagccgggccgcc

SEQ ID NO: 2909346 - RNA, 13 nt, Mycobacterium avium subsp. paratuberculosis
cgcgucgaaugcg

SEQ ID NO: 2909347 - RNA, 23 nt, Mycobacterium avium subsp. paratuberculosis
cgcgucgacaccccgcucggcca

SEQ ID NO: 2909348 - RNA, 15 nt, Mycobacterium avium subsp. paratuberculosis
cgcgucgaccaccgc

SEQ ID NO: 2909349 - RNA, 16 nt, Mycobacterium avium subsp. paratuberculosis
cgcgucgaccaccgcc

SEQ ID NO: 2909350 - RNA, 18 nt, Mycobacterium avium subsp. paratuberculosis
cgcgucgaccaccgccgg

SEQ ID NO: 2909351 - RNA, 19 nt, Mycobacterium avium subsp. paratuberculosis
cgcgucgaccaccgccggc

SEQ ID NO: 2909352 - RNA, 20 nt, Mycobacterium avium subsp. paratuberculosis
cgcgucgaccaccgccggcc

SEQ ID NO: 2909353 - RNA, 13 nt, Mycobacterium avium subsp. paratuberculosis
cgcgucgaccagc

SEQ ID NO: 2909354 - RNA, 15 nt, Mycobacterium avium subsp. paratuberculosis
cgcgucgaccagccg

SEQ ID NO: 2909355 - RNA, 16 nt, Mycobacterium avium subsp. paratuberculosis
cgcgucgaccagccgc

SEQ ID NO: 2909356 - RNA, 23 nt, Mycobacterium avium subsp. paratuberculosis
cgcgucgaccagccgcaucaccu

SEQ ID NO: 2909357 - RNA, 14 nt, Mycobacterium avium subsp. paratuberculosis
cgcgucgaccgccg

SEQ ID NO: 2909358 - RNA, 15 nt, Mycobacterium avium subsp. paratuberculosis
cgcgucgaccgccgc

SEQ ID NO: 2909359 - RNA, 17 nt, Mycobacterium avium subsp. paratuberculosis
cgcgucgaccgccgcga

SEQ ID NO: 2909360 - RNA, 14 nt, Mycobacterium avium subsp. paratuberculosis
cgcgucgacgaugg

SEQ ID NO: 2909361 - RNA, 20 nt, Mycobacterium avium subsp. paratuberculosis
cgcgucgacgauggcgucca

SEQ ID NO: 2909362 - RNA, 13 nt, Mycobacterium avium subsp. paratuberculosis
cgcgucgacgccg

SEQ ID NO: 2909363 - RNA, 17 nt, Mycobacterium avium subsp. paratuberculosis
cgcgucgacgccgcugc

SEQ ID NO: 2909364 - RNA, 12 nt, Mycobacterium avium subsp. paratuberculosis
cgcgucgacgcg

SEQ ID NO: 2909365 - RNA, 15 nt, Mycobacterium avium subsp. paratuberculosis
cgcgucgacgcgguc

SEQ ID NO: 2909366 - RNA, 14 nt, Mycobacterium avium subsp. paratuberculosis
cgcgucgacggcgc

SEQ ID NO: 2909367 - RNA, 15 nt, Mycobacterium avium subsp. paratuberculosis
cgcgucgacggcgcc

SEQ ID NO: 2909368 - RNA, 17 nt, Mycobacterium avium subsp. paratuberculosis
cgcgucgacggcgccgg

SEQ ID NO: 2909369 - RNA, 14 nt, Mycobacterium avium subsp. paratuberculosis
cgcgucgacgucgg

SEQ ID NO: 2909370 - RNA, 16 nt, Mycobacterium avium subsp. paratuberculosis
cgcgucgacgucgggc

SEQ ID NO: 2909371 - RNA, 18 nt, Mycobacterium avium subsp. paratuberculosis
cgcgucgacguucgccgc

SEQ ID NO: 2909372 - RNA, 20 nt, Mycobacterium avium subsp. paratuberculosis
cgcgucgacguucgccgcca

SEQ ID NO: 2909373 - RNA, 22 nt, Mycobacterium avium subsp. paratuberculosis
cgcgucgacguucgccgccagc

SEQ ID NO: 2909374 - RNA, 13 nt, Mycobacterium avium subsp. paratuberculosis
cgcgaggucgacg

SEQ ID NO: 2909375 - RNA, 18 nt, Mycobacterium avium subsp. paratuberculosis
cgcgaguaggcgaagagc

SEQ ID NO: 2909376 - RNA, 20 nt, Mycobacterium avium subsp. paratuberculosis
cgcgaguaggcgaagagcgg

SEQ ID NO: 2909377 - RNA, 13 nt, Mycobacterium avium subsp. paratuberculosis
cgcgagucaccgg

SEQ ID NO: 2909378 - RNA, 15 nt, Mycobacterium avium subsp. paratuberculosis
cgcgagucaccggcu

SEQ ID NO: 2909379 - RNA, 17 nt, Mycobacterium avium subsp. paratuberculosis
cgcgagucaccggcucg

SEQ ID NO: 2909380 - RNA, 17 nt, Mycobacterium avium subsp. paratuberculosis
cgcgagucgagcaccgc

SEQ ID NO: 2909381 - RNA, 19 nt, Mycobacterium avium subsp. paratuberculosis
cgcgagucgagcaccgcga

SEQ ID NO: 2909382 - RNA, 20 nt, Mycobacterium avium subsp. paratuberculosis
cgcgagucgagcaccgcgac

SEQ ID NO: 2909383 - RNA, 20 nt, Mycobacterium avium subsp. paratuberculosis
cgcgaguucgcgcacgcugg

SEQ ID NO: 2909384 - RNA, 21 nt, Mycobacterium avium subsp. paratuberculosis
cgcgaguucgcgcacgcuggc

SEQ ID NO: 2909385 - RNA, 20 nt, Mycobacterium avium subsp. paratuberculosis
cgcgauagaccucacggucg

SEQ ID NO: 2909386 - RNA, 15 nt, Mycobacterium avium subsp. paratuberculosis
cgcgauagccgguga

SEQ ID NO: 2909387 - RNA, 18 nt, Mycobacterium avium subsp. paratuberculosis
cgcgauagccggugaucg

SEQ ID NO: 2909388 - RNA, 19 nt, Mycobacterium avium subsp. paratuberculosis
cgcgauagggccggccgga

SEQ ID NO: 2909389 - RNA, 22 nt, Mycobacterium avium subsp. paratuberculosis
cgcgaucaacaccgguccggcc

SEQ ID NO: 2909390 - RNA, 23 nt, Mycobacterium avium subsp. paratuberculosis
cgcgaucaacaccgguccggccg

SEQ ID NO: 2909391 - RNA, 13 nt, Mycobacterium avium subsp. paratuberculosis
cgcgaucaacggg

SEQ ID NO: 2909392 - RNA, 17 nt, Mycobacterium avium subsp. paratuberculosis
cgcgaucacaccaccac

SEQ ID NO: 2909393 - RNA, 19 nt, Mycobacterium avium subsp. paratuberculosis
cgcgaucaccaccccggug

SEQ ID NO: 2909394 - RNA, 20 nt, Mycobacterium avium subsp. paratuberculosis
cgcgaucaccgcggccacca

SEQ ID NO: 2909395 - RNA, 20 nt, Mycobacterium avium subsp. paratuberculosis
cgcgaucacguucucggcga

SEQ ID NO: 2909396 - RNA, 21 nt, Mycobacterium avium subsp. paratuberculosis
cgcgaucacguucucggcgaa

SEQ ID NO: 2909397 - RNA, 15 nt, Mycobacterium avium subsp. paratuberculosis
cgcgaucagccccag

SEQ ID NO: 2909398 - RNA, 19 nt, Mycobacterium avium subsp. paratuberculosis
cgcgaucagccccagggug

SEQ ID NO: 2909399 - RNA, 20 nt, Mycobacterium avium subsp. paratuberculosis
cgcgaucagccccagggugc

SEQ ID NO: 2909400 - RNA, 23 nt, Mycobacterium avium subsp. paratuberculosis
cgcgaucagcucguggcgggccc

SEQ ID NO: 2909401 - RNA, 15 nt, Mycobacterium avium subsp. paratuberculosis
cgcgaucaggccggc

SEQ ID NO: 2909402 - RNA, 16 nt, Mycobacterium avium subsp. paratuberculosis
cgcgaucaggccggcc

SEQ ID NO: 2909403 - RNA, 17 nt, Mycobacterium avium subsp. paratuberculosis
cgcgaucaggccggcca

SEQ ID NO: 2909404 - RNA, 18 nt, Mycobacterium avium subsp. paratuberculosis
cgcgaucaggccggccac

SEQ ID NO: 2909405 - RNA, 20 nt, Mycobacterium avium subsp. paratuberculosis
cgcgaucaggccggccacca

SEQ ID NO: 2909406 - RNA, 16 nt, Mycobacterium avium subsp. paratuberculosis
cgcgaucagggcccac

SEQ ID NO: 2909407 - RNA, 19 nt, Mycobacterium avium subsp. paratuberculosis
cgcgaucagggcccacagc

SEQ ID NO: 2909408 - RNA, 20 nt, Mycobacterium avium subsp. paratuberculosis
cgcgaucagggcccacagca

SEQ ID NO: 2909409 - RNA, 19 nt, Mycobacterium avium subsp. paratuberculosis
cgcgaucagggccgcggcc

SEQ ID NO: 2909410 - RNA, 21 nt, Mycobacterium avium subsp. paratuberculosis
cgcgaucagggccgcggccgc

SEQ ID NO: 2909411 - RNA, 20 nt, Mycobacterium avium subsp. paratuberculosis
cgcgauccagcgcuggccgg

SEQ ID NO: 2909412 - RNA, 15 nt, Mycobacterium avium subsp. paratuberculosis
cgcgauccgcgcguc

SEQ ID NO: 2909413 - RNA, 16 nt, Mycobacterium avium subsp. paratuberculosis
cgcgauccgcgcgucg

SEQ ID NO: 2909414 - RNA, 13 nt, Mycobacterium avium subsp. paratuberculosis
cgcgauccgggcg

SEQ ID NO: 2909415 - RNA, 18 nt, Mycobacterium avium subsp. paratuberculosis
cgcgauccgggcgccggc

SEQ ID NO: 2909416 - RNA, 20 nt, Mycobacterium avium subsp. paratuberculosis
cgcgauccgggcgccggccg

SEQ ID NO: 2909417 - RNA, 21 nt, Mycobacterium avium subsp. paratuberculosis
cgcgauccggggggcgggguc

SEQ ID NO: 2909418 - RNA, 22 nt, Mycobacterium avium subsp. paratuberculosis
cgcgauccggggggcggggucg

SEQ ID NO: 2909419 - RNA, 22 nt, Mycobacterium avium subsp. paratuberculosis
cgcgaucgacagcuccaacagc

SEQ ID NO: 2909420 - RNA, 12 nt, Mycobacterium avium subsp. paratuberculosis
cgcgaucgagga

SEQ ID NO: 2909421 - RNA, 20 nt, Mycobacterium avium subsp. paratuberculosis
cgcgaucgccagcgcggugu

SEQ ID NO: 2909422 - RNA, 18 nt, Mycobacterium avium subsp. paratuberculosis
cgcgaucgccgacgucgg

SEQ ID NO: 2909423 - RNA, 14 nt, Mycobacterium avium subsp. paratuberculosis
cgcgaucgccgauc

SEQ ID NO: 2909424 - RNA, 23 nt, Mycobacterium avium subsp. paratuberculosis
cgcgaucgccggaucggucucgg

SEQ ID NO: 2909425 - RNA, 13 nt, Mycobacterium avium subsp. paratuberculosis
cgcgaucgccggg

SEQ ID NO: 2909426 - RNA, 15 nt, Mycobacterium avium subsp. paratuberculosis
cgcgaucgccggugc

SEQ ID NO: 2909427 - RNA, 18 nt, Mycobacterium avium subsp. paratuberculosis
cgcgaucgccggugcggc

SEQ ID NO: 2909428 - RNA, 21 nt, Mycobacterium avium subsp. paratuberculosis
cgcgaucgccggugcggccgc

SEQ ID NO: 2909429 - RNA, 23 nt, Mycobacterium avium subsp. paratuberculosis
cgcgaucgccggugcggccgcga

SEQ ID NO: 2909430 - RNA, 13 nt, Mycobacterium avium subsp. paratuberculosis
cgcgaucgcgguc

SEQ ID NO: 2909431 - RNA, 19 nt, Mycobacterium avium subsp. paratuberculosis
cgcgaucggauggugccca

SEQ ID NO: 2909432 - RNA, 22 nt, Mycobacterium avium subsp. paratuberculosis
cgcgaucggauggugcccaccg

SEQ ID NO: 2909433 - RNA, 14 nt, Mycobacterium avium subsp. paratuberculosis
cgcgaucggcaggu

SEQ ID NO: 2909434 - RNA, 19 nt, Mycobacterium avium subsp. paratuberculosis
cgcgaucggcaggucgucg

SEQ ID NO: 2909435 - RNA, 20 nt, Mycobacterium avium subsp. paratuberculosis
cgcgaucggcaggucgucga

SEQ ID NO: 2909436 - RNA, 13 nt, Mycobacterium avium subsp. paratuberculosis
cgcgaucggccgc

SEQ ID NO: 2909437 - RNA, 17 nt, Mycobacterium avium subsp. paratuberculosis
cgcgaucggccgcugcc

SEQ ID NO: 2909438 - RNA, 18 nt, Mycobacterium avium subsp. paratuberculosis
cgcgaucggccgcugccc

SEQ ID NO: 2909439 - RNA, 14 nt, Mycobacterium avium subsp. paratuberculosis
cgcgaucggcgagc

SEQ ID NO: 2909440 - RNA, 21 nt, Mycobacterium avium subsp. paratuberculosis
cgcgaucggcgagccgggacc

SEQ ID NO: 2909441 - RNA, 15 nt, Mycobacterium avium subsp. paratuberculosis
cgcgaucggcgccac

SEQ ID NO: 2909442 - RNA, 17 nt, Mycobacterium avium subsp. paratuberculosis
cgcgaucggcgccacga

SEQ ID NO: 2909443 - RNA, 20 nt, Mycobacterium avium subsp. paratuberculosis
cgcgaucggcgccacgacca

SEQ ID NO: 2909444 - RNA, 21 nt, Mycobacterium avium subsp. paratuberculosis
cgcgccgucccagccggacag

SEQ ID NO: 2909445 - RNA, 13 nt, Mycobacterium avium subsp. paratuberculosis
cgcgccgucggcg

SEQ ID NO: 2909446 - RNA, 17 nt, Mycobacterium avium subsp. paratuberculosis
cgcgccgucggcgaugc

SEQ ID NO: 2909447 - RNA, 18 nt, Mycobacterium avium subsp. paratuberculosis
cgcgccgucggcgaugcg

SEQ ID NO: 2909448 - RNA, 22 nt, Mycobacterium avium subsp. paratuberculosis
cgcgccgucggcgaugcggugg

SEQ ID NO: 2909449 - RNA, 23 nt, Mycobacterium avium subsp. paratuberculosis
cgcgccgucggcguucagcggca

SEQ ID NO: 2909450 - RNA, 14 nt, Mycobacterium avium subsp. paratuberculosis
cgcgccgucgucga

SEQ ID NO: 2909451 - RNA, 15 nt, Mycobacterium avium subsp. paratuberculosis
cgcgccgucgucgga

SEQ ID NO: 2909452 - RNA, 22 nt, Mycobacterium avium subsp. paratuberculosis
cgcgccgucgucggacaccagc

SEQ ID NO: 2909453 - RNA, 23 nt, Mycobacterium avium subsp. paratuberculosis
cgcgccgucgucggacaccagca

SEQ ID NO: 2909454 - RNA, 15 nt, Mycobacterium avium subsp. paratuberculosis
cgcgccgucgucguc

SEQ ID NO: 2909455 - RNA, 16 nt, Mycobacterium avium subsp. paratuberculosis
cgcgccgucgucgucg

SEQ ID NO: 2909456 - RNA, 17 nt, Mycobacterium avium subsp. paratuberculosis
cgcgccgucuccggcgu

SEQ ID NO: 2909457 - RNA, 18 nt, Mycobacterium avium subsp. paratuberculosis
cgcgccgucuuccgggcc

SEQ ID NO: 2909458 - RNA, 17 nt, Mycobacterium avium subsp. paratuberculosis
cgcgccgugcgccagcg

SEQ ID NO: 2909459 - RNA, 19 nt, Mycobacterium avium subsp. paratuberculosis
cgcgccgugcgccagcgac

SEQ ID NO: 2909460 - RNA, 20 nt, Mycobacterium avium subsp. paratuberculosis
cgcgccgugcgccagcgacc

SEQ ID NO: 2909461 - RNA, 23 nt, Mycobacterium avium subsp. paratuberculosis
cgcgccgugcgccagcgaccgca

SEQ ID NO: 2909462 - RNA, 18 nt, Mycobacterium avium subsp. paratuberculosis
cgcgccgugggcgucacg

SEQ ID NO: 2909463 - RNA, 20 nt, Mycobacterium avium subsp. paratuberculosis
cgcgccguguuccagguaca

SEQ ID NO: 2909464 - RNA, 23 nt, Mycobacterium avium subsp. paratuberculosis
cgcgccguugaccgcggcgaugg

SEQ ID NO: 2909465 - RNA, 23 nt, Mycobacterium avium subsp. paratuberculosis
cgcgccguugguggucugccaga

SEQ ID NO: 2909466 - RNA, 22 nt, Mycobacterium avium subsp. paratuberculosis
cgcgccuccauucgggccagcg

SEQ ID NO: 2909467 - RNA, 23 nt, Mycobacterium avium subsp. paratuberculosis
cgcgccuccauucgggccagcgc

SEQ ID NO: 2909468 - RNA, 20 nt, Mycobacterium avium subsp. paratuberculosis
cgcgccucgcguacccgggc

SEQ ID NO: 2909469 - RNA, 14 nt, Mycobacterium avium subsp. paratuberculosis
cgcgccugcaccgg

SEQ ID NO: 2909470 - RNA, 20 nt, Mycobacterium avium subsp. paratuberculosis
cgcgccugcaccggcgacgg

SEQ ID NO: 2909471 - RNA, 15 nt, Mycobacterium avium subsp. paratuberculosis
cgcgccugcgcggcg

SEQ ID NO: 2909472 - RNA, 21 nt, Mycobacterium avium subsp. paratuberculosis
cgcgccugcgcggcggcgucc

SEQ ID NO: 2909473 - RNA, 12 nt, Mycobacterium avium subsp. paratuberculosis
cgcgccuggcgc

SEQ ID NO: 2909474 - RNA, 14 nt, Mycobacterium avium subsp. paratuberculosis
cgcgccuggcgcag

SEQ ID NO: 2909475 - RNA, 22 nt, Mycobacterium avium subsp. paratuberculosis
cgcgccuucuugcugcccgcgg

SEQ ID NO: 2909476 - RNA, 23 nt, Mycobacterium avium subsp. paratuberculosis
cgcgccuucuugcugcccgcggc

SEQ ID NO: 2909477 - RNA, 16 nt, Mycobacterium avium subsp. paratuberculosis
cgcgccuugggccauc

SEQ ID NO: 2909478 - RNA, 19 nt, Mycobacterium avium subsp. paratuberculosis
cgcgccuugggccaucccg

SEQ ID NO: 2909479 - RNA, 20 nt, Mycobacterium avium subsp. paratuberculosis
cgcgcgaaaaaacggcggcg

SEQ ID NO: 2909480 - RNA, 15 nt, Mycobacterium avium subsp. paratuberculosis
cgcgcgaaacccccg

SEQ ID NO: 2909481 - RNA, 16 nt, Mycobacterium avium subsp. paratuberculosis
cgcgcgaaacccccgg

SEQ ID NO: 2909482 - RNA, 18 nt, Mycobacterium avium subsp. paratuberculosis
cgcgcgaaacccccggga

SEQ ID NO: 2909483 - RNA, 20 nt, Mycobacterium avium subsp. paratuberculosis
cgcgcgaaacccccgggaug

SEQ ID NO: 2909484 - RNA, 16 nt, Mycobacterium avium subsp. paratuberculosis
cgcgcgaacagccgac

SEQ ID NO: 2909485 - RNA, 18 nt, Mycobacterium avium subsp. paratuberculosis
cgcgcgaacagccgaccg

SEQ ID NO: 2909486 - RNA, 16 nt, Mycobacterium avium subsp. paratuberculosis
cgcgcgaacgcaacag

SEQ ID NO: 2909487 - RNA, 15 nt, Mycobacterium avium subsp. paratuberculosis
cgcgcgacaucaccg

SEQ ID NO: 2909488 - RNA, 17 nt, Mycobacterium avium subsp. paratuberculosis
cgcgcgacaucaccgcg

SEQ ID NO: 2909489 - RNA, 13 nt, Mycobacterium avium subsp. paratuberculosis
cgcgcgaccagua

SEQ ID NO: 2909490 - RNA, 15 nt, Mycobacterium avium subsp. paratuberculosis
cgcgcgaccaguacc

SEQ ID NO: 2909491 - RNA, 20 nt, Mycobacterium avium subsp. paratuberculosis
cgcgcgaccaguaccgggcc

SEQ ID NO: 2909492 - RNA, 21 nt, Mycobacterium avium subsp. paratuberculosis
cgcgcgaccaguaccgggccu

SEQ ID NO: 2909493 - RNA, 17 nt, Mycobacterium avium subsp. paratuberculosis
cgcgcgaccaucagccc

SEQ ID NO: 2909494 - RNA, 13 nt, Mycobacterium avium subsp. paratuberculosis
cgcgcgacggcgc

SEQ ID NO: 2909495 - RNA, 16 nt, Mycobacterium avium subsp. paratuberculosis
cgcgcgacggcgcgug

SEQ ID NO: 2909496 - RNA, 15 nt, Mycobacterium avium subsp. paratuberculosis
cgcgcgacugggcgc

SEQ ID NO: 2909497 - RNA, 23 nt, Mycobacterium avium subsp. paratuberculosis
cgcgcgagaguaucgccacgccg

SEQ ID NO: 2909498 - RNA, 15 nt, Mycobacterium avium subsp. paratuberculosis
cgcgcgagcagacgc

SEQ ID NO: 2909499 - RNA, 20 nt, Mycobacterium avium subsp. paratuberculosis
cgcgcgagccgaaacggugc

SEQ ID NO: 2909500 - RNA, 15 nt, Mycobacterium avium subsp. paratuberculosis
cgcgcgaucagcgcc

SEQ ID NO: 2909501 - RNA, 16 nt, Mycobacterium avium subsp. paratuberculosis
cgcgcgaucagcgccg

SEQ ID NO: 2909502 - RNA, 12 nt, Mycobacterium avium subsp. paratuberculosis
cgcgcgaucagg

SEQ ID NO: 2909503 - RNA, 14 nt, Mycobacterium avium subsp. paratuberculosis
cgcgcgaucaggcc

SEQ ID NO: 2909504 - RNA, 19 nt, Mycobacterium avium subsp. paratuberculosis
cgcgcgaucaggccggcca

SEQ ID NO: 2909505 - RNA, 20 nt, Mycobacterium avium subsp. paratuberculosis
cgcgcgaucaggccggccac

SEQ ID NO: 2909506 - RNA, 14 nt, Mycobacterium avium subsp. paratuberculosis
cgcgcgaucgccgg

SEQ ID NO: 2909507 - RNA, 23 nt, Mycobacterium avium subsp. paratuberculosis
cgcgcgaucgccggugcggccgc

SEQ ID NO: 2909508 - RNA, 14 nt, Mycobacterium avium subsp. paratuberculosis
cgcgcgaucggcga

SEQ ID NO: 2909509 - RNA, 16 nt, Mycobacterium avium subsp. paratuberculosis
cgcgcgaucggcgagc

SEQ ID NO: 2909510 - RNA, 19 nt, Mycobacterium avium subsp. paratuberculosis
cgcgcgaucggcgagccgg

SEQ ID NO: 2909511 - RNA, 23 nt, Mycobacterium avium subsp. paratuberculosis
cgcgcgaucggcgagccgggacc

SEQ ID NO: 2909512 - RNA, 21 nt, Mycobacterium avium subsp. paratuberculosis
cgcgcgaucgguguccagccg

SEQ ID NO: 2909513 - RNA, 22 nt, Mycobacterium avium subsp. paratuberculosis
cgcgcgaucuccgucaccgugg

SEQ ID NO: 2909514 - RNA, 23 nt, Mycobacterium avium subsp. paratuberculosis
cgcgcgaucuccgucaccguggu

SEQ ID NO: 2909515 - RNA, 17 nt, Mycobacterium avium subsp. paratuberculosis
cgcgcgaugcgggcgcc

SEQ ID NO: 2909516 - RNA, 19 nt, Mycobacterium avium subsp. paratuberculosis
cgcgcgauggacagcagcc

SEQ ID NO: 2909517 - RNA, 12 nt, Mycobacterium avium subsp. paratuberculosis
cgcgcgcaccac

SEQ ID NO: 2909518 - RNA, 14 nt, Mycobacterium avium subsp. paratuberculosis
cgcgcgcaccacgu

SEQ ID NO: 2909519 - RNA, 20 nt, Mycobacterium avium subsp. paratuberculosis
cgcgcgcaccacgugcgcga

SEQ ID NO: 2909520 - RNA, 12 nt, Mycobacterium avium subsp. paratuberculosis
cgcgcgcaggaa

SEQ ID NO: 2909521 - RNA, 12 nt, Mycobacterium avium subsp. paratuberculosis
cgcgcgcaggcc

SEQ ID NO: 2909522 - RNA, 16 nt, Mycobacterium avium subsp. paratuberculosis
cgcgcgcaggccccgg

SEQ ID NO: 2909523 - RNA, 21 nt, Mycobacterium avium subsp. paratuberculosis
cgcgcgcaggccccggcgcgc

SEQ ID NO: 2909524 - RNA, 13 nt, Mycobacterium avium subsp. paratuberculosis
cgcgcgcaggcgc

SEQ ID NO: 2909525 - RNA, 22 nt, Mycobacterium avium subsp. paratuberculosis
cgcgcgcaguugcgcggcgggc

SEQ ID NO: 2909526 - RNA, 14 nt, Mycobacterium avium subsp. paratuberculosis
cgcgcgccagcgcg

SEQ ID NO: 2909527 - RNA, 15 nt, Mycobacterium avium subsp. paratuberculosis
cgcgcgccaggucga

SEQ ID NO: 2909528 - RNA, 18 nt, Mycobacterium avium subsp. paratuberculosis
cggaucgagcacccggcg

SEQ ID NO: 2909529 - RNA, 15 nt, Mycobacterium avium subsp. paratuberculosis
cggaucgagcgcacc

SEQ ID NO: 2909530 - RNA, 22 nt, Mycobacterium avium subsp. paratuberculosis
cggaucgagguagcgugcgccc

SEQ ID NO: 2909531 - RNA, 17 nt, Mycobacterium avium subsp. paratuberculosis
cggaucgagucccgcgc

SEQ ID NO: 2909532 - RNA, 21 nt, Mycobacterium avium subsp. paratuberculosis
cggaucgagucccgcgcggcg

SEQ ID NO: 2909533 - RNA, 22 nt, Mycobacterium avium subsp. paratuberculosis
cggaucgaguucagcgucgaug

SEQ ID NO: 2909534 - RNA, 23 nt, Mycobacterium avium subsp. paratuberculosis
cggaucgaguucagcgucgaugu

SEQ ID NO: 2909535 - RNA, 18 nt, Mycobacterium avium subsp. paratuberculosis
cggaucgcaucgggcgac

SEQ ID NO: 2909536 - RNA, 18 nt, Mycobacterium avium subsp. paratuberculosis
cggaucgcccacccgcac

SEQ ID NO: 2909537 - RNA, 14 nt, Mycobacterium avium subsp. paratuberculosis
cggaucgcccuggc

SEQ ID NO: 2909538 - RNA, 18 nt, Mycobacterium avium subsp. paratuberculosis
cggaucgcccuggcaucc

SEQ ID NO: 2909539 - RNA, 24 nt, Mycobacterium avium subsp. paratuberculosis
cggaucgccggacagcgggccgac

SEQ ID NO: 2909540 - RNA, 13 nt, Mycobacterium avium subsp. paratuberculosis
cggaucgcgcuga

SEQ ID NO: 2909541 - RNA, 19 nt, Mycobacterium avium subsp. paratuberculosis
cggaucgcgcugaccaggc

SEQ ID NO: 2909542 - RNA, 19 nt, Mycobacterium avium subsp. paratuberculosis
cggaucgcgggcgacccgc

SEQ ID NO: 2909543 - RNA, 21 nt, Mycobacterium avium subsp. paratuberculosis
cggaucgcgggcgacccgcug

SEQ ID NO: 2909544 - RNA, 19 nt, Mycobacterium avium subsp. paratuberculosis
cggaucgcguaguccagca

SEQ ID NO: 2909545 - RNA, 21 nt, Mycobacterium avium subsp. paratuberculosis
cggaucgcguaguccagcacg

SEQ ID NO: 2909546 - RNA, 12 nt, Mycobacterium avium subsp. paratuberculosis
cggaucgcgugc

SEQ ID NO: 2909547 - RNA, 22 nt, Mycobacterium avium subsp. paratuberculosis
cggaucgcgugcgucacgcugg

SEQ ID NO: 2909548 - RNA, 14 nt, Mycobacterium avium subsp. paratuberculosis
cggaucgcuugacc

SEQ ID NO: 2909549 - RNA, 18 nt, Mycobacterium avium subsp. paratuberculosis
cggaucgcuugaccagca

SEQ ID NO: 2909550 - RNA, 19 nt, Mycobacterium avium subsp. paratuberculosis
cggaucgcuugaccagcaa

SEQ ID NO: 2909551 - RNA, 14 nt, Mycobacterium avium subsp. paratuberculosis
cggaucggccagca

SEQ ID NO: 2909552 - RNA, 16 nt, Mycobacterium avium subsp. paratuberculosis
cggaucggccagcagg

SEQ ID NO: 2909553 - RNA, 22 nt, Mycobacterium avium subsp. paratuberculosis
cggaucggccagcaggucgaag

SEQ ID NO: 2909554 - RNA, 17 nt, Mycobacterium avium subsp. paratuberculosis
cggaucggccauggugc

SEQ ID NO: 2909555 - RNA, 20 nt, Mycobacterium avium subsp. paratuberculosis
cggaucggcccgaucucgcg

SEQ ID NO: 2909556 - RNA, 12 nt, Mycobacterium avium subsp. paratuberculosis
cggaucggccgc

SEQ ID NO: 2909557 - RNA, 17 nt, Mycobacterium avium subsp. paratuberculosis
cggaucggccgcgucgg

SEQ ID NO: 2909558 - RNA, 16 nt, Mycobacterium avium subsp. paratuberculosis
cggaucggccgggaga

SEQ ID NO: 2909559 - RNA, 13 nt, Mycobacterium avium subsp. paratuberculosis
cggaucggcggcg

SEQ ID NO: 2909560 - RNA, 15 nt, Mycobacterium avium subsp. paratuberculosis
cggaucggcggcgac

SEQ ID NO: 2909561 - RNA, 18 nt, Mycobacterium avium subsp. paratuberculosis
cggaucggcggcgacggc

SEQ ID NO: 2909562 - RNA, 15 nt, Mycobacterium avium subsp. paratuberculosis
cggaucggcugcggg

SEQ ID NO: 2909563 - RNA, 18 nt, Mycobacterium avium subsp. paratuberculosis
cggaucggcugcgggcca

SEQ ID NO: 2909564 - RNA, 16 nt, Mycobacterium avium subsp. paratuberculosis
cggaucgggcggucca

SEQ ID NO: 2909565 - RNA, 15 nt, Mycobacterium avium subsp. paratuberculosis
cggaucgggcguggc

SEQ ID NO: 2909566 - RNA, 18 nt, Mycobacterium avium subsp. paratuberculosis
cggaucggugcaggccgc

SEQ ID NO: 2909567 - RNA, 22 nt, Mycobacterium avium subsp. paratuberculosis
cggaucggugcaggccgcgacg

SEQ ID NO: 2909568 - RNA, 23 nt, Mycobacterium avium subsp. paratuberculosis
cggaucggugcaggccgcgacgg

SEQ ID NO: 2909569 - RNA, 14 nt, Mycobacterium avium subsp. paratuberculosis
cggaucgguggacg

SEQ ID NO: 2909570 - RNA, 22 nt, Mycobacterium avium subsp. paratuberculosis
cggaucgguggacgcggucgcc

SEQ ID NO: 2909571 - RNA, 21 nt, Mycobacterium avium subsp. paratuberculosis
cggaucgguguagcccggugc

SEQ ID NO: 2909572 - RNA, 24 nt, Mycobacterium avium subsp. paratuberculosis
cggaucgguguagcccggugccac

SEQ ID NO: 2909573 - RNA, 14 nt, Mycobacterium avium subsp. paratuberculosis
cggaucgucaccga

SEQ ID NO: 2909574 - RNA, 19 nt, Mycobacterium avium subsp. paratuberculosis
cggaucgucaccgaccccu

SEQ ID NO: 2909575 - RNA, 15 nt, Mycobacterium avium subsp. paratuberculosis
cggaucgugucccgg

SEQ ID NO: 2909576 - RNA, 17 nt, Mycobacterium avium subsp. paratuberculosis
cggaucgugucccggcg

SEQ ID NO: 2909577 - RNA, 18 nt, Mycobacterium avium subsp. paratuberculosis
cggaucgugucccggcgc

SEQ ID NO: 2909578 - RNA, 22 nt, Mycobacterium avium subsp. paratuberculosis
cggaucucgaccucgucggcgg

SEQ ID NO: 2909579 - RNA, 13 nt, Mycobacterium avium subsp. paratuberculosis
cggaucucggugc

SEQ ID NO: 2909580 - RNA, 16 nt, Mycobacterium avium subsp. paratuberculosis
cggaucucggugccgg

SEQ ID NO: 2909581 - RNA, 13 nt, Mycobacterium avium subsp. paratuberculosis
cggaucucgucgg

SEQ ID NO: 2909582 - RNA, 14 nt, Mycobacterium avium subsp. paratuberculosis
cggaucucgucggg

SEQ ID NO: 2909583 - RNA, 19 nt, Mycobacterium avium subsp. paratuberculosis
cggaucucgucgggcaccg

SEQ ID NO: 2909584 - RNA, 16 nt, Mycobacterium avium subsp. paratuberculosis
cggaucugcucgugca

SEQ ID NO: 2909585 - RNA, 12 nt, Mycobacterium avium subsp. paratuberculosis
cggaucuggccc

SEQ ID NO: 2909586 - RNA, 20 nt, Mycobacterium avium subsp. paratuberculosis
cggaucuucuccgccacauc

SEQ ID NO: 2909587 - RNA, 19 nt, Mycobacterium avium subsp. paratuberculosis
cggaucuugccgucggccg

SEQ ID NO: 2909588 - RNA, 23 nt, Mycobacterium avium subsp. paratuberculosis
cggaucuugccgucggccgccga

SEQ ID NO: 2909589 - RNA, 16 nt, Mycobacterium avium subsp. paratuberculosis
cggaugaaggacuggc

SEQ ID NO: 2909590 - RNA, 20 nt, Mycobacterium avium subsp. paratuberculosis
cggaugaaggacuggcccac

SEQ ID NO: 2909591 - RNA, 22 nt, Mycobacterium avium subsp. paratuberculosis
cggaugaaggacuggcccacgc

SEQ ID NO: 2909592 - RNA, 15 nt, Mycobacterium avium subsp. paratuberculosis
cggaugaccaagccc

SEQ ID NO: 2909593 - RNA, 21 nt, Mycobacterium avium subsp. paratuberculosis
cggaugaccaagccccgcagu

SEQ ID NO: 2909594 - RNA, 22 nt, Mycobacterium avium subsp. paratuberculosis
cggaugaccaagccccgcagug

SEQ ID NO: 2909595 - RNA, 17 nt, Mycobacterium avium subsp. paratuberculosis
cggaugaccaggguggu

SEQ ID NO: 2909596 - RNA, 18 nt, Mycobacterium avium subsp. paratuberculosis
cggaugaccaggucgccg

SEQ ID NO: 2909597 - RNA, 20 nt, Mycobacterium avium subsp. paratuberculosis
cggaugaccaggucgccggc

SEQ ID NO: 2909598 - RNA, 22 nt, Mycobacterium avium subsp. paratuberculosis
cggaugaccaggucgccggcgg

SEQ ID NO: 2909599 - RNA, 23 nt, Mycobacterium avium subsp. paratuberculosis
cggaugaccaggucgccggcggc

SEQ ID NO: 2909600 - RNA, 19 nt, Mycobacterium avium subsp. paratuberculosis
cggaugacgggugcucagg

SEQ ID NO: 2909601 - RNA, 17 nt, Mycobacterium avium subsp. paratuberculosis
cggaugacgugcaccac

SEQ ID NO: 2909602 - RNA, 19 nt, Mycobacterium avium subsp. paratuberculosis
cggaugacgugcaccaccg

SEQ ID NO: 2909603 - RNA, 21 nt, Mycobacterium avium subsp. paratuberculosis
cggaugaucaacacgucgucg

SEQ ID NO: 2909604 - RNA, 15 nt, Mycobacterium avium subsp. paratuberculosis
cggaugaugccggug

SEQ ID NO: 2909605 - RNA, 21 nt, Mycobacterium avium subsp. paratuberculosis
cggaugauguucuccggcccg

SEQ ID NO: 2909606 - RNA, 22 nt, Mycobacterium avium subsp. paratuberculosis
cggaugauguucuccggcccgg

SEQ ID NO: 2909607 - RNA, 14 nt, Mycobacterium avium subsp. paratuberculosis
cggaugcaccggca

SEQ ID NO: 2909608 - RNA, 16 nt, Mycobacterium avium subsp. paratuberculosis
cggaugcaccggcagc

SEQ ID NO: 2909609 - RNA, 20 nt, Mycobacterium avium subsp. paratuberculosis
cggaugcaccggcagccaga

SEQ ID NO: 2909610 - RNA, 23 nt, Mycobacterium avium subsp. paratuberculosis
cggaugcacgugcaccgcggcca

SEQ ID NO: 2909611 - RNA, 18 nt, Mycobacterium avium subsp. paratuberculosis
cggaugccagcagguccg

SEQ ID NO: 2909612 - RNA, 19 nt, Mycobacterium avium subsp. paratuberculosis
cggaugcccaggccggcga

SEQ ID NO: 2909613 - RNA, 19 nt, Mycobacterium avium subsp. paratuberculosis
cggaugcccgccggcgucu

SEQ ID NO: 2909614 - RNA, 16 nt, Mycobacterium avium subsp. paratuberculosis
cggaugccgcgcggcg

SEQ ID NO: 2909615 - RNA, 17 nt, Mycobacterium avium subsp. paratuberculosis
cggaugccgcgcggcgc

SEQ ID NO: 2909616 - RNA, 19 nt, Mycobacterium avium subsp. paratuberculosis
cggaugccgcgcggcgcca

SEQ ID NO: 2909617 - RNA, 16 nt, Mycobacterium avium subsp. paratuberculosis
cggaugccggaggcgc

SEQ ID NO: 2909618 - RNA, 18 nt, Mycobacterium avium subsp. paratuberculosis
cggaugccggaggcgccg

SEQ ID NO: 2909619 - RNA, 14 nt, Mycobacterium avium subsp. paratuberculosis
cggaugccggcgcc

SEQ ID NO: 2909620 - RNA, 18 nt, Mycobacterium avium subsp. paratuberculosis
cggaugccggcgcccagc

SEQ ID NO: 2909621 - RNA, 19 nt, Mycobacterium avium subsp. paratuberculosis
cggaugccggggcagcacc

SEQ ID NO: 2909622 - RNA, 20 nt, Mycobacterium avium subsp. paratuberculosis
cggaugccggggcagcaccc

SEQ ID NO: 2909623 - RNA, 12 nt, Mycobacterium avium subsp. paratuberculosis
cggaugcggccg

SEQ ID NO: 2909624 - RNA, 14 nt, Mycobacterium avium subsp. paratuberculosis
cggaugcggccgaa

SEQ ID NO: 2909625 - RNA, 13 nt, Mycobacterium avium subsp. paratuberculosis
cggaugcggcgcc

SEQ ID NO: 2909626 - RNA, 13 nt, Mycobacterium avium subsp. paratuberculosis
cggaugcgggcgc

SEQ ID NO: 2909627 - RNA, 16 nt, Mycobacterium avium subsp. paratuberculosis
cggaugcgggcgcugc

SEQ ID NO: 2909628 - RNA, 20 nt, Mycobacterium avium subsp. paratuberculosis
cggaugcgggcgcugccguc

SEQ ID NO: 2909629 - RNA, 13 nt, Mycobacterium avium subsp. paratuberculosis
cggaugcggucga

SEQ ID NO: 2909630 - RNA, 23 nt, Mycobacterium avium subsp. paratuberculosis
cggaugcucaccggucagcuggu

SEQ ID NO: 2909631 - RNA, 13 nt, Mycobacterium avium subsp. paratuberculosis
cggaugcugcggg

SEQ ID NO: 2909632 - RNA, 19 nt, Mycobacterium avium subsp. paratuberculosis
cggaugcugcgggucagca

SEQ ID NO: 2909633 - RNA, 21 nt, Mycobacterium avium subsp. paratuberculosis
cggaugcugcgggucagcagc

SEQ ID NO: 2909634 - RNA, 12 nt, Mycobacterium avium subsp. paratuberculosis
cggauggccccg

SEQ ID NO: 2909635 - RNA, 16 nt, Mycobacterium avium subsp. paratuberculosis
cggauggccccggcga

SEQ ID NO: 2909636 - RNA, 17 nt, Mycobacterium avium subsp. paratuberculosis
cggauggccccggcgag

SEQ ID NO: 2909637 - RNA, 20 nt, Mycobacterium avium subsp. paratuberculosis
cggauggccgggcaggccgg

SEQ ID NO: 2909638 - RNA, 12 nt, Mycobacterium avium subsp. paratuberculosis
cggauggccucg

SEQ ID NO: 2909639 - RNA, 15 nt, Mycobacterium avium subsp. paratuberculosis
cggauggccucggcg

SEQ ID NO: 2909640 - RNA, 16 nt, Mycobacterium avium subsp. paratuberculosis
cggauggccucggcga

SEQ ID NO: 2909641 - RNA, 13 nt, Mycobacterium avium subsp. paratuberculosis
cggauggcgacgg

SEQ ID NO: 2909642 - RNA, 16 nt, Mycobacterium avium subsp. paratuberculosis
cggauggcgacggcga

SEQ ID NO: 2909643 - RNA, 17 nt, Mycobacterium avium subsp. paratuberculosis
cggauggcgacggcgac

SEQ ID NO: 2909644 - RNA, 13 nt, Mycobacterium avium subsp. paratuberculosis
cggauggcgcccg

SEQ ID NO: 2909645 - RNA, 14 nt, Mycobacterium avium subsp. paratuberculosis
cggauggcgcccgg

SEQ ID NO: 2909646 - RNA, 19 nt, Mycobacterium avium subsp. paratuberculosis
cggauggcgcccggcagcc

SEQ ID NO: 2909647 - RNA, 22 nt, Mycobacterium avium subsp. paratuberculosis
cggauggcgcccuuggccuccg

SEQ ID NO: 2909648 - RNA, 15 nt, Mycobacterium avium subsp. paratuberculosis
cggauggcgccgucg

SEQ ID NO: 2909649 - RNA, 14 nt, Mycobacterium avium subsp. paratuberculosis
cggaugggugcggu

SEQ ID NO: 2909650 - RNA, 21 nt, Mycobacterium avium subsp. paratuberculosis
cggaugggugcgguugagcac

SEQ ID NO: 2909651 - RNA, 17 nt, Mycobacterium avium subsp. paratuberculosis
cggauggguggcgauca

SEQ ID NO: 2909652 - RNA, 20 nt, Mycobacterium avium subsp. paratuberculosis
cggauggguggcgaucaccg

SEQ ID NO: 2909653 - RNA, 15 nt, Mycobacterium avium subsp. paratuberculosis
cggauggucugcagc

SEQ ID NO: 2909654 - RNA, 14 nt, Mycobacterium avium subsp. paratuberculosis
cggauggugcccac

SEQ ID NO: 2909655 - RNA, 16 nt, Mycobacterium avium subsp. paratuberculosis
cggauggugcccaccg

SEQ ID NO: 2909656 - RNA, 22 nt, Mycobacterium avium subsp. paratuberculosis
cggauggugcccaccgggcagc

SEQ ID NO: 2909657 - RNA, 18 nt, Mycobacterium avium subsp. paratuberculosis
cggauguccuacggcggg

SEQ ID NO: 2909658 - RNA, 19 nt, Mycobacterium avium subsp. paratuberculosis
cggauguccuacggcgggu

SEQ ID NO: 2909659 - RNA, 14 nt, Mycobacterium avium subsp. paratuberculosis
cggaugucggugug

SEQ ID NO: 2909660 - RNA, 20 nt, Mycobacterium avium subsp. paratuberculosis
cggaugucgguguggaccgc

SEQ ID NO: 2909661 - RNA, 15 nt, Mycobacterium avium subsp. paratuberculosis
cggaugugacgcggg

SEQ ID NO: 2909662 - RNA, 18 nt, Mycobacterium avium subsp. paratuberculosis
cggaugugacgcgggacc

SEQ ID NO: 2909663 - RNA, 19 nt, Mycobacterium avium subsp. paratuberculosis
cggaugugccuggcccaga

SEQ ID NO: 2909664 - RNA, 15 nt, Mycobacterium avium subsp. paratuberculosis
cggauguggaggcga

SEQ ID NO: 2909665 - RNA, 18 nt, Mycobacterium avium subsp. paratuberculosis
cggauguggaggcgagca

SEQ ID NO: 2909666 - RNA, 17 nt, Mycobacterium avium subsp. paratuberculosis
cggauguggucggccac

SEQ ID NO: 2909667 - RNA, 17 nt, Mycobacterium avium subsp. paratuberculosis
cggauguguugcgcacc

SEQ ID NO: 2909668 - RNA, 19 nt, Mycobacterium avium subsp. paratuberculosis
cggauuacucgccggcggc

SEQ ID NO: 2909669 - RNA, 21 nt, Mycobacterium avium subsp. paratuberculosis
cggauuacucgccggcggcgc

SEQ ID NO: 2909670 - RNA, 22 nt, Mycobacterium avium subsp. paratuberculosis
cggauuacucgccggcggcgcc

SEQ ID NO: 2909671 - RNA, 23 nt, Mycobacterium avium subsp. paratuberculosis
cggauuacucgccggcggcgccg

SEQ ID NO: 2909672 - RNA, 12 nt, Mycobacterium avium subsp. paratuberculosis
cggauucagcgu

SEQ ID NO: 2909673 - RNA, 16 nt, Mycobacterium avium subsp. paratuberculosis
cggauucagcgucgcc

SEQ ID NO: 2909674 - RNA, 20 nt, Mycobacterium avium subsp. paratuberculosis
cggauucagcgucgccaugc

SEQ ID NO: 2909675 - RNA, 19 nt, Mycobacterium avium subsp. paratuberculosis
cggauuccagcgcgaccgc

SEQ ID NO: 2909676 - RNA, 13 nt, Mycobacterium avium subsp. paratuberculosis
cggauucccgcuc

SEQ ID NO: 2909677 - RNA, 14 nt, Mycobacterium avium subsp. paratuberculosis
cggauucgcggcgg

SEQ ID NO: 2909678 - RNA, 18 nt, Mycobacterium avium subsp. paratuberculosis
cggauucgcggcggcgcc

SEQ ID NO: 2909679 - RNA, 13 nt, Mycobacterium avium subsp. paratuberculosis
cggauucggcucc

SEQ ID NO: 2909680 - RNA, 15 nt, Mycobacterium avium subsp. paratuberculosis
cggauucggguggcg

SEQ ID NO: 2909681 - RNA, 19 nt, Mycobacterium avium subsp. paratuberculosis
cggauucggguggcgucgc

SEQ ID NO: 2909682 - RNA, 16 nt, Mycobacterium avium subsp. paratuberculosis
cggauucucgcccggc

SEQ ID NO: 2909683 - RNA, 16 nt, Mycobacterium avium subsp. paratuberculosis
cggauugaccagcacg

SEQ ID NO: 2909684 - RNA, 21 nt, Mycobacterium avium subsp. paratuberculosis
cggauugaccagcacguugug

SEQ ID NO: 2909685 - RNA, 13 nt, Mycobacterium avium subsp. paratuberculosis
cggauugccgggc

SEQ ID NO: 2909686 - RNA, 19 nt, Mycobacterium avium subsp. paratuberculosis
cggauugccgggcagcggc

SEQ ID NO: 2909687 - RNA, 14 nt, Mycobacterium avium subsp. paratuberculosis
cggauugcgagccg

SEQ ID NO: 2909688 - RNA, 15 nt, Mycobacterium avium subsp. paratuberculosis
cggauugcgagccgg

SEQ ID NO: 2909689 - RNA, 18 nt, Mycobacterium avium subsp. paratuberculosis
cggauugcgagccggucu

SEQ ID NO: 2909690 - RNA, 14 nt, Mycobacterium avium subsp. paratuberculosis
cggauugcggacgc

SEQ ID NO: 2909691 - RNA, 13 nt, Mycobacterium avium subsp. paratuberculosis
cggauuggucaga

SEQ ID NO: 2909692 - RNA, 19 nt, Mycobacterium avium subsp. paratuberculosis
cggauuggugccgaucacc

SEQ ID NO: 2909693 - RNA, 19 nt, Mycobacterium avium subsp. paratuberculosis
cggauuugguugcggcacc

SEQ ID NO: 2909694 - RNA, 17 nt, Mycobacterium avium subsp. paratuberculosis
cggcaaaacgcugggcg

SEQ ID NO: 2909695 - RNA, 21 nt, Mycobacterium avium subsp. paratuberculosis
cggcaaaacgcugggcgccgg

SEQ ID NO: 2909696 - RNA, 18 nt, Mycobacterium avium subsp. paratuberculosis
cggcaaagcguugccgcg

SEQ ID NO: 2909697 - RNA, 21 nt, Mycobacterium avium subsp. paratuberculosis
cggcaaagcguugccgcgcgc

SEQ ID NO: 2909698 - RNA, 23 nt, Mycobacterium avium subsp. paratuberculosis
cggcaaagcguugccgcgcgccc

SEQ ID NO: 2909699 - RNA, 14 nt, Mycobacterium avium subsp. paratuberculosis
cggcaacacagcca

SEQ ID NO: 2909700 - RNA, 20 nt, Mycobacterium avium subsp. paratuberculosis
cggcaacacagccaaucgcc

SEQ ID NO: 2909701 - RNA, 23 nt, Mycobacterium avium subsp. paratuberculosis
cggcaacacagccaaucgccgau

SEQ ID NO: 2909702 - RNA, 14 nt, Mycobacterium avium subsp. paratuberculosis
cggcaacaccggcg

SEQ ID NO: 2909703 - RNA, 16 nt, Mycobacterium avium subsp. paratuberculosis
cggcaacaccggcggc

SEQ ID NO: 2909704 - RNA, 19 nt, Mycobacterium avium subsp. paratuberculosis
cggcaacaccggcggcgac

SEQ ID NO: 2909705 - RNA, 15 nt, Mycobacterium avium subsp. paratuberculosis
cggcaacacgccggc

SEQ ID NO: 2909706 - RNA, 19 nt, Mycobacterium avium subsp. paratuberculosis
cggcaacacgccggcggcc

SEQ ID NO: 2909707 - RNA, 16 nt, Mycobacterium avium subsp. paratuberculosis
cggcaacagcaccagc

SEQ ID NO: 2909708 - RNA, 17 nt, Mycobacterium avium subsp. paratuberculosis
cggcaacagcaccagca

SEQ ID NO: 2909709 - RNA, 18 nt, Mycobacterium avium subsp. paratuberculosis
cggcaacagcaccagcac

SEQ ID NO: 2909710 - RNA, 14 nt, Mycobacterium avium subsp. paratuberculosis
cggcaacccgaccu

SEQ ID NO: 2909711 - RNA, 15 nt, Mycobacterium avium subsp. paratuberculosis
cggcaacccgaucgc

SEQ ID NO: 2909712 - RNA, 19 nt, Mycobacterium avium subsp. paratuberculosis
cggcaacccgaucgccgag

SEQ ID NO: 2909713 - RNA, 19 nt, Mycobacterium avium subsp. paratuberculosis
cggcaaccgaaucgagccg

SEQ ID NO: 2909714 - RNA, 20 nt, Mycobacterium avium subsp. paratuberculosis
cggcaaccgaaucgagccga

SEQ ID NO: 2909715 - RNA, 12 nt, Mycobacterium avium subsp. paratuberculosis
cggcaaccgcca

SEQ ID NO: 2909716 - RNA, 14 nt, Mycobacterium avium subsp. paratuberculosis
cggcaaccgcugcg

SEQ ID NO: 2909717 - RNA, 15 nt, Mycobacterium avium subsp. paratuberculosis
cggcaaccgcugcgg

SEQ ID NO: 2909718 - RNA, 17 nt, Mycobacterium avium subsp. paratuberculosis
cggcaacgacccgucgg

SEQ ID NO: 2909719 - RNA, 16 nt, Mycobacterium avium subsp. paratuberculosis
cggcaacgaggccagg

SEQ ID NO: 2909720 - RNA, 20 nt, Mycobacterium avium subsp. paratuberculosis
cggcaacgaggccagggccc

SEQ ID NO: 2909721 - RNA, 13 nt, Mycobacterium avium subsp. paratuberculosis
cggcaacgccagc

SEQ ID NO: 2909722 - RNA, 15 nt, Mycobacterium avium subsp. paratuberculosis
cggcaacgccagcca

SEQ ID NO: 2909723 - RNA, 12 nt, Mycobacterium avium subsp. paratuberculosis
cggcaacgccgg

SEQ ID NO: 2909724 - RNA, 13 nt, Mycobacterium avium subsp. paratuberculosis
cggcaacgccggg

SEQ ID NO: 2909725 - RNA, 14 nt, Mycobacterium avium subsp. paratuberculosis
cggcaacgccgggu

SEQ ID NO: 2909726 - RNA, 16 nt, Mycobacterium avium subsp. paratuberculosis
cggcaacgccgggucc

SEQ ID NO: 2909727 - RNA, 15 nt, Mycobacterium avium subsp. paratuberculosis
cggcaacggcggcgg

SEQ ID NO: 2909728 - RNA, 20 nt, Mycobacterium avium subsp. paratuberculosis
cggcaacggcggcggcggca

SEQ ID NO: 2909729 - RNA, 15 nt, Mycobacterium avium subsp. paratuberculosis
cggcaacuggccgcc

SEQ ID NO: 2909730 - RNA, 15 nt, Mycobacterium avium subsp. paratuberculosis
cggcaaggcgcagaa

SEQ ID NO: 2909731 - RNA, 19 nt, Mycobacterium avium subsp. paratuberculosis
cggcaaggugccguccggg

SEQ ID NO: 2909732 - RNA, 18 nt, Mycobacterium avium subsp. paratuberculosis
cggcaaguccggguccua

SEQ ID NO: 2909733 - RNA, 15 nt, Mycobacterium avium subsp. paratuberculosis
cggcaauccggcccc

SEQ ID NO: 2909734 - RNA, 21 nt, Mycobacterium avium subsp. paratuberculosis
cggcaauccggccccgcugcc

SEQ ID NO: 2909735 - RNA, 21 nt, Mycobacterium avium subsp. paratuberculosis
cggcaaucgggacgccacggc

SEQ ID NO: 2909736 - RNA, 22 nt, Mycobacterium avium subsp. paratuberculosis
cggcaaucgggacgccacggcg

SEQ ID NO: 2909737 - RNA, 16 nt, Mycobacterium avium subsp. paratuberculosis
cggcaaugaccggcac

SEQ ID NO: 2909738 - RNA, 18 nt, Mycobacterium avium subsp. paratuberculosis
cggcaaugaccggcacca

SEQ ID NO: 2909739 - RNA, 15 nt, Mycobacterium avium subsp. paratuberculosis
cggcaaugguugcgg

SEQ ID NO: 2909740 - RNA, 16 nt, Mycobacterium avium subsp. paratuberculosis
cggcaaugguugcggc

SEQ ID NO: 2909741 - RNA, 20 nt, Mycobacterium avium subsp. paratuberculosis
cggcaaugguugcggcgggc

SEQ ID NO: 2909742 - RNA, 21 nt, Mycobacterium avium subsp. paratuberculosis
cggcaauugaauucgaccacg

SEQ ID NO: 2909743 - RNA, 23 nt, Mycobacterium avium subsp. paratuberculosis
cggcaauugaauucgaccacggc

SEQ ID NO: 2909744 - RNA, 13 nt, Mycobacterium avium subsp. paratuberculosis
cggcacaccagcg

SEQ ID NO: 2909745 - RNA, 21 nt, Mycobacterium avium subsp. paratuberculosis
cggcacaccagcguucgucgc

SEQ ID NO: 2909746 - RNA, 23 nt, Mycobacterium avium subsp. paratuberculosis
cggcacaccagcguucgucgccg

SEQ ID NO: 2909747 - RNA, 24 nt, Mycobacterium avium subsp. paratuberculosis
cggcacaccagcguucgucgccgg

SEQ ID NO: 2909748 - RNA, 15 nt, Mycobacterium avium subsp. paratuberculosis
cggcacaccagguag

SEQ ID NO: 2909749 - RNA, 22 nt, Mycobacterium avium subsp. paratuberculosis
cggcacaccagguaggcggugg

SEQ ID NO: 2909750 - RNA, 20 nt, Mycobacterium avium subsp. paratuberculosis
cggcacaccgagcgagcgca

SEQ ID NO: 2909751 - RNA, 14 nt, Mycobacterium avium subsp. paratuberculosis
cggcacaccgcgcg

SEQ ID NO: 2909752 - RNA, 17 nt, Mycobacterium avium subsp. paratuberculosis
cggcacaccgcgcgaac

SEQ ID NO: 2909753 - RNA, 13 nt, Mycobacterium avium subsp. paratuberculosis
cggcacacgcgga

SEQ ID NO: 2909754 - RNA, 13 nt, Mycobacterium avium subsp. paratuberculosis
cggcaccaacccg

SEQ ID NO: 2909755 - RNA, 22 nt, Mycobacterium avium subsp. paratuberculosis
cggcaccaacccgaucggcccg

SEQ ID NO: 2909756 - RNA, 18 nt, Mycobacterium avium subsp. paratuberculosis
cggcaccaccacccccga

SEQ ID NO: 2909757 - RNA, 22 nt, Mycobacterium avium subsp. paratuberculosis
cggcaccaccacgguggcgccg

SEQ ID NO: 2909758 - RNA, 23 nt, Mycobacterium avium subsp. paratuberculosis
cggcaccaccacgguggcgccgg

SEQ ID NO: 2909759 - RNA, 13 nt, Mycobacterium avium subsp. paratuberculosis
cggcaccaccagc

SEQ ID NO: 2909760 - RNA, 17 nt, Mycobacterium avium subsp. paratuberculosis
cggcaccaccagcgugu

SEQ ID NO: 2909761 - RNA, 20 nt, Mycobacterium avium subsp. paratuberculosis
cggcaccaccagcguguggc

SEQ ID NO: 2909762 - RNA, 12 nt, Mycobacterium avium subsp. paratuberculosis
cggcaccacccg

SEQ ID NO: 2909763 - RNA, 15 nt, Mycobacterium avium subsp. paratuberculosis
cggcaccacccgcgg

SEQ ID NO: 2909764 - RNA, 15 nt, Mycobacterium avium subsp. paratuberculosis
cggcaccacgaucac

SEQ ID NO: 2909765 - RNA, 19 nt, Mycobacterium avium subsp. paratuberculosis
cggcaccacgaucaccaga

SEQ ID NO: 2909766 - RNA, 23 nt, Mycobacterium avium subsp. paratuberculosis
cggcaccacgaucaccagaccgg

SEQ ID NO: 2909767 - RNA, 13 nt, Mycobacterium avium subsp. paratuberculosis
cggcaccacgcug

SEQ ID NO: 2909768 - RNA, 11 nt, Mycobacterium avium subsp. paratuberculosis
cggcaccagca

SEQ ID NO: 2909769 - RNA, 13 nt, Mycobacterium avium subsp. paratuberculosis
cggcaccagcagc

SEQ ID NO: 2909770 - RNA, 14 nt, Mycobacterium avium subsp. paratuberculosis
cggcaccagcagcc

SEQ ID NO: 2909771 - RNA, 17 nt, Mycobacterium avium subsp. paratuberculosis
cggcaccagcagccagc

SEQ ID NO: 2909772 - RNA, 20 nt, Mycobacterium avium subsp. paratuberculosis
cggcaccagcagccagccca

SEQ ID NO: 2909773 - RNA, 24 nt, Mycobacterium avium subsp. paratuberculosis
cggcaccagcagccagcccagccg

SEQ ID NO: 2909774 - RNA, 19 nt, Mycobacterium avium subsp. paratuberculosis
cggcaccagcagccgcagc

SEQ ID NO: 2909775 - RNA, 20 nt, Mycobacterium avium subsp. paratuberculosis
cggcaccagcagccgcagcg

SEQ ID NO: 2909776 - RNA, 14 nt, Mycobacterium avium subsp. paratuberculosis
cggcaccagcaggc

SEQ ID NO: 2909777 - RNA, 19 nt, Mycobacterium avium subsp. paratuberculosis
cggcaccagcaggccccgu

SEQ ID NO: 2909778 - RNA, 23 nt, Mycobacterium avium subsp. paratuberculosis
cggcaccagcaggccccguucgg

SEQ ID NO: 2909779 - RNA, 13 nt, Mycobacterium avium subsp. paratuberculosis
cggcaccagcccg

SEQ ID NO: 2909780 - RNA, 14 nt, Mycobacterium avium subsp. paratuberculosis
cggcaccagcccgc

SEQ ID NO: 2909781 - RNA, 16 nt, Mycobacterium avium subsp. paratuberculosis
cggcaccagcccgccg

SEQ ID NO: 2909782 - RNA, 13 nt, Mycobacterium avium subsp. paratuberculosis
cggcaccagcgga

SEQ ID NO: 2909783 - RNA, 21 nt, Mycobacterium avium subsp. paratuberculosis
cggcaccagcggaucggcggu

SEQ ID NO: 2909784 - RNA, 18 nt, Mycobacterium avium subsp. paratuberculosis
cggcaccagguaccggcg

SEQ ID NO: 2909785 - RNA, 21 nt, Mycobacterium avium subsp. paratuberculosis
cggcaccagguucacgucggg

SEQ ID NO: 2909786 - RNA, 22 nt, Mycobacterium avium subsp. paratuberculosis
cggcacccccaauugccgggcc

SEQ ID NO: 2909787 - RNA, 15 nt, Mycobacterium avium subsp. paratuberculosis
cggcaccccgcgguc

SEQ ID NO: 2909788 - RNA, 17 nt, Mycobacterium avium subsp. paratuberculosis
cggcaccccgcggucgg

SEQ ID NO: 2909789 - RNA, 13 nt, Mycobacterium avium subsp. paratuberculosis
cggcacccgcagc

SEQ ID NO: 2909790 - RNA, 20 nt, Mycobacterium avium subsp. paratuberculosis
cggcacccgcagcuccagcg

SEQ ID NO: 2909791 - RNA, 17 nt, Mycobacterium avium subsp. paratuberculosis
cggcacccgccagcccg

SEQ ID NO: 2909792 - RNA, 23 nt, Mycobacterium avium subsp. paratuberculosis
cggcacccgggccuugacggccu

SEQ ID NO: 2909793 - RNA, 22 nt, Mycobacterium avium subsp. paratuberculosis
cggcaccgacagggccagcgcc

SEQ ID NO: 2909794 - RNA, 18 nt, Mycobacterium avium subsp. paratuberculosis
cggcaccgacggagccga

SEQ ID NO: 2909795 - RNA, 20 nt, Mycobacterium avium subsp. paratuberculosis
cggcaccgacggagccgagc

SEQ ID NO: 2909796 - RNA, 22 nt, Mycobacterium avium subsp. paratuberculosis
cggcaccgauaguagccagcau

SEQ ID NO: 2909797 - RNA, 14 nt, Mycobacterium avium subsp. paratuberculosis
cggcaccgaucggc

SEQ ID NO: 2909798 - RNA, 21 nt, Mycobacterium avium subsp. paratuberculosis
cggcaccgaucggcacgucga

SEQ ID NO: 2909799 - RNA, 23 nt, Mycobacterium avium subsp. paratuberculosis
cggcaccgaucggcacgucgagc

SEQ ID NO: 2909800 - RNA, 15 nt, Mycobacterium avium subsp. paratuberculosis
cggcaccgccagcca

SEQ ID NO: 2909801 - RNA, 17 nt, Mycobacterium avium subsp. paratuberculosis
cggcaccgcccccgcgg

SEQ ID NO: 2909802 - RNA, 19 nt, Mycobacterium avium subsp. paratuberculosis
cggcaccgcccccgcggcg

SEQ ID NO: 2909803 - RNA, 21 nt, Mycobacterium avium subsp. paratuberculosis
cggcaccgcccccgcggcggc

SEQ ID NO: 2909804 - RNA, 13 nt, Mycobacterium avium subsp. paratuberculosis
cggcaccgcccgg

SEQ ID NO: 2909805 - RNA, 14 nt, Mycobacterium avium subsp. paratuberculosis
cggcaccgcccggg

SEQ ID NO: 2909806 - RNA, 23 nt, Mycobacterium avium subsp. paratuberculosis
cggcaccgcccggguugucgacg

SEQ ID NO: 2909807 - RNA, 13 nt, Mycobacterium avium subsp. paratuberculosis
cggcaccgccgcg

SEQ ID NO: 2909808 - RNA, 16 nt, Mycobacterium avium subsp. paratuberculosis
cggcaccgccgcgcgg

SEQ ID NO: 2909809 - RNA, 17 nt, Mycobacterium avium subsp. paratuberculosis
cggcaccgccgcgcggc

SEQ ID NO: 2909810 - RNA, 18 nt, Mycobacterium avium subsp. paratuberculosis
cggcaccgccgcgcggcc

SEQ ID NO: 2909811 - RNA, 16 nt, Mycobacterium avium subsp. paratuberculosis
cggcaccgccgcggug

SEQ ID NO: 2909812 - RNA, 17 nt, Mycobacterium avium subsp. paratuberculosis
cggcaccgccggcggcc

SEQ ID NO: 2909813 - RNA, 18 nt, Mycobacterium avium subsp. paratuberculosis
cggcaccgccggcggccu

SEQ ID NO: 2909814 - RNA, 22 nt, Mycobacterium avium subsp. paratuberculosis
cggcaccgccggcggccuccgc

SEQ ID NO: 2909815 - RNA, 13 nt, Mycobacterium avium subsp. paratuberculosis
cggcaccgcgagc

SEQ ID NO: 2909816 - RNA, 16 nt, Mycobacterium avium subsp. paratuberculosis
cggcaccgcgagcacc

SEQ ID NO: 2909817 - RNA, 14 nt, Mycobacterium avium subsp. paratuberculosis
cggcaccgcggcga

SEQ ID NO: 2909818 - RNA, 15 nt, Mycobacterium avium subsp. paratuberculosis
cggcaccgcggcgau

SEQ ID NO: 2909819 - RNA, 17 nt, Mycobacterium avium subsp. paratuberculosis
cggcaccgcggcgauga

SEQ ID NO: 2909820 - RNA, 15 nt, Mycobacterium avium subsp. paratuberculosis
cggcaccgcggcggu

SEQ ID NO: 2909821 - RNA, 16 nt, Mycobacterium avium subsp. paratuberculosis
cggcaccgcggcggug

SEQ ID NO: 2909822 - RNA, 17 nt, Mycobacterium avium subsp. paratuberculosis
cggcaccgcggcggugu

SEQ ID NO: 2909823 - RNA, 18 nt, Mycobacterium avium subsp. paratuberculosis
cggcaccgcggcgguguc

SEQ ID NO: 2909824 - RNA, 16 nt, Mycobacterium avium subsp. paratuberculosis
cggcaccgcggcucgg

SEQ ID NO: 2909825 - RNA, 19 nt, Mycobacterium avium subsp. paratuberculosis
cggcaccgcggucugcgcc

SEQ ID NO: 2909826 - RNA, 21 nt, Mycobacterium avium subsp. paratuberculosis
cggcaccgcggucugcgccag

SEQ ID NO: 2909827 - RNA, 22 nt, Mycobacterium avium subsp. paratuberculosis
cggcaccgcggucugcgccagc

SEQ ID NO: 2909828 - RNA, 14 nt, Mycobacterium avium subsp. paratuberculosis
cggcaccgcugccg

SEQ ID NO: 2909829 - RNA, 15 nt, Mycobacterium avium subsp. paratuberculosis
cggcaccgcugccgg

SEQ ID NO: 2909830 - RNA, 17 nt, Mycobacterium avium subsp. paratuberculosis
cggcaccgcugccggcc

SEQ ID NO: 2909831 - RNA, 18 nt, Mycobacterium avium subsp. paratuberculosis
cggcaccgcugccggccg

SEQ ID NO: 2909832 - RNA, 19 nt, Mycobacterium avium subsp. paratuberculosis
cggcaccgcugccggccga

SEQ ID NO: 2909833 - RNA, 12 nt, Mycobacterium avium subsp. paratuberculosis
cggcaccggcga

SEQ ID NO: 2909834 - RNA, 16 nt, Mycobacterium avium subsp. paratuberculosis
cggcaccgggaccugg

SEQ ID NO: 2909835 - RNA, 16 nt, Mycobacterium avium subsp. paratuberculosis
cggcaccggugcggcg

SEQ ID NO: 2909836 - RNA, 17 nt, Mycobacterium avium subsp. paratuberculosis
cggcaccggugcggcgg

SEQ ID NO: 2909837 - RNA, 20 nt, Mycobacterium avium subsp. paratuberculosis
cggcaccggugcggcgguga

SEQ ID NO: 2909838 - RNA, 22 nt, Mycobacterium avium subsp. paratuberculosis
cggcaccggugcggcggugacg

SEQ ID NO: 2909839 - RNA, 23 nt, Mycobacterium avium subsp. paratuberculosis
cggcaccggugcggcggugacga

SEQ ID NO: 2909840 - RNA, 15 nt, Mycobacterium avium subsp. paratuberculosis
cggcaccgucaccga

SEQ ID NO: 2909841 - RNA, 16 nt, Mycobacterium avium subsp. paratuberculosis
cggcaccgucaccgac

SEQ ID NO: 2909842 - RNA, 18 nt, Mycobacterium avium subsp. paratuberculosis
cggcaccgugccgcgcgg

SEQ ID NO: 2909843 - RNA, 19 nt, Mycobacterium avium subsp. paratuberculosis
cggcaccgugccgcgcggc

SEQ ID NO: 2909844 - RNA, 21 nt, Mycobacterium avium subsp. paratuberculosis
cggcaccgugccgcgcggcgg

SEQ ID NO: 2909845 - RNA, 24 nt, Mycobacterium avium subsp. paratuberculosis
cggcaccgugccgcgcggcgguga

SEQ ID NO: 2909846 - RNA, 20 nt, Mycobacterium avium subsp. paratuberculosis
cggcaccuccagcccggcga

SEQ ID NO: 2909847 - RNA, 16 nt, Mycobacterium avium subsp. paratuberculosis
cggcaccuccugcacc

SEQ ID NO: 2909848 - RNA, 17 nt, Mycobacterium avium subsp. paratuberculosis
cggcaccuccugcaccc

SEQ ID NO: 2909849 - RNA, 22 nt, Mycobacterium avium subsp. paratuberculosis
cggcaccuccugcacccguccg

SEQ ID NO: 2909850 - RNA, 23 nt, Mycobacterium avium subsp. paratuberculosis
cggcaccuccugcacccguccga

SEQ ID NO: 2909851 - RNA, 11 nt, Mycobacterium avium subsp. paratuberculosis
cggcaccucga

SEQ ID NO: 2909852 - RNA, 19 nt, Mycobacterium avium subsp. paratuberculosis
cggcaccucgaagggcgcc

SEQ ID NO: 2909853 - RNA, 23 nt, Mycobacterium avium subsp. paratuberculosis
cggcaccucgaagggcgccagcc

SEQ ID NO: 2909854 - RNA, 15 nt, Mycobacterium avium subsp. paratuberculosis
cggcaccucgaucac

SEQ ID NO: 2909855 - RNA, 16 nt, Mycobacterium avium subsp. paratuberculosis
cggcaccucgaucacc

SEQ ID NO: 2909856 - RNA, 17 nt, Mycobacterium avium subsp. paratuberculosis
cggcaccucgaucaccg

SEQ ID NO: 2909857 - RNA, 18 nt, Mycobacterium avium subsp. paratuberculosis
cggcaccucgaucaccgg

SEQ ID NO: 2909858 - RNA, 20 nt, Mycobacterium avium subsp. paratuberculosis
cggcaccucgaucaccgggc

SEQ ID NO: 2909859 - RNA, 21 nt, Mycobacterium avium subsp. paratuberculosis
cggcaccucgaucaccgggcg

SEQ ID NO: 2909860 - RNA, 22 nt, Mycobacterium avium subsp. paratuberculosis
cggcaccucgaucaccgggcgg

SEQ ID NO: 2909861 - RNA, 14 nt, Mycobacterium avium subsp. paratuberculosis
cggcaccucggccu

SEQ ID NO: 2909862 - RNA, 20 nt, Mycobacterium avium subsp. paratuberculosis
cggcaccucggccuugacca

SEQ ID NO: 2909863 - RNA, 20 nt, Mycobacterium avium subsp. paratuberculosis
cggcaccuucaccgaccagc

SEQ ID NO: 2909864 - RNA, 21 nt, Mycobacterium avium subsp. paratuberculosis
cggcaccuucaccgaccagcu

SEQ ID NO: 2909865 - RNA, 21 nt, Mycobacterium avium subsp. paratuberculosis
cggcaccuuggugagcaccgc

SEQ ID NO: 2909866 - RNA, 23 nt, Mycobacterium avium subsp. paratuberculosis
cggcaccuuggugagcaccgcga

SEQ ID NO: 2909867 - RNA, 13 nt, Mycobacterium avium subsp. paratuberculosis
cggcacgaacgcg

SEQ ID NO: 2909868 - RNA, 16 nt, Mycobacterium avium subsp. paratuberculosis
cggcacgaacgcgacg

SEQ ID NO: 2909869 - RNA, 14 nt, Mycobacterium avium subsp. paratuberculosis
cggcacgaagccga

SEQ ID NO: 2909870 - RNA, 16 nt, Mycobacterium avium subsp. paratuberculosis
cggcacgaagccgaac

SEQ ID NO: 2909871 - RNA, 17 nt, Mycobacterium avium subsp. paratuberculosis
cggcacgaagccgaacg

SEQ ID NO: 2909872 - RNA, 24 nt, Mycobacterium avium subsp. paratuberculosis
cggcacgaagccgaacgacagcag

SEQ ID NO: 2909873 - RNA, 13 nt, Mycobacterium avium subsp. paratuberculosis
cggcacgaucggc

SEQ ID NO: 2909874 - RNA, 16 nt, Mycobacterium avium subsp. paratuberculosis
cggcacgaucggcagc

SEQ ID NO: 2909875 - RNA, 13 nt, Mycobacterium avium subsp. paratuberculosis
cggcacgaucguc

SEQ ID NO: 2909876 - RNA, 19 nt, Mycobacterium avium subsp. paratuberculosis
cggcacgaucgucgccgcc

SEQ ID NO: 2909877 - RNA, 22 nt, Mycobacterium avium subsp. paratuberculosis
cggcacgaucucgaccaggccg

SEQ ID NO: 2909878 - RNA, 17 nt, Mycobacterium avium subsp. paratuberculosis
cggcacgauggacgccc

SEQ ID NO: 2909879 - RNA, 20 nt, Mycobacterium avium subsp. paratuberculosis
cggcacgauggcgcggcgca

SEQ ID NO: 2909880 - RNA, 21 nt, Mycobacterium avium subsp. paratuberculosis
cggcacgauggcgcggcgcac

SEQ ID NO: 2909881 - RNA, 21 nt, Mycobacterium avium subsp. paratuberculosis
cggcacgcccguucgagcgcc

SEQ ID NO: 2909882 - RNA, 13 nt, Mycobacterium avium subsp. paratuberculosis
cggcacgccgacc

SEQ ID NO: 2909883 - RNA, 14 nt, Mycobacterium avium subsp. paratuberculosis
cggcacgccgacca

SEQ ID NO: 2909884 - RNA, 13 nt, Mycobacterium avium subsp. paratuberculosis
cggcacgccgcuc

SEQ ID NO: 2909885 - RNA, 20 nt, Mycobacterium avium subsp. paratuberculosis
cggcacgccgcucgucgggc

SEQ ID NO: 2909886 - RNA, 15 nt, Mycobacterium avium subsp. paratuberculosis
cggcacgccggggcc

SEQ ID NO: 2909887 - RNA, 14 nt, Mycobacterium avium subsp. paratuberculosis
cggcacgcgcgccg

SEQ ID NO: 2909888 - RNA, 17 nt, Mycobacterium avium subsp. paratuberculosis
cggcacgcgcgccggag

SEQ ID NO: 2909889 - RNA, 17 nt, Mycobacterium avium subsp. paratuberculosis
cggcacgcgucaccgga

SEQ ID NO: 2909890 - RNA, 18 nt, Mycobacterium avium subsp. paratuberculosis
cggcacgcgucaccggaa

SEQ ID NO: 2909891 - RNA, 14 nt, Mycobacterium avium subsp. paratuberculosis
cggcacgcugcgcc

SEQ ID NO: 2909892 - RNA, 17 nt, Mycobacterium avium subsp. paratuberculosis
cggcacgcugcgccagc

SEQ ID NO: 2909893 - RNA, 14 nt, Mycobacterium avium subsp. paratuberculosis
cggcacggcaccgc

SEQ ID NO: 2909894 - RNA, 16 nt, Mycobacterium avium subsp. paratuberculosis
cggcacggcaccgcga

SEQ ID NO: 2909895 - RNA, 20 nt, Mycobacterium avium subsp. paratuberculosis
cggcacggcaccgcgagcac

SEQ ID NO: 2909896 - RNA, 13 nt, Mycobacterium avium subsp. paratuberculosis
cggcacggcaugg

SEQ ID NO: 2909897 - RNA, 16 nt, Mycobacterium avium subsp. paratuberculosis
cggcacggcauggcga

SEQ ID NO: 2909898 - RNA, 13 nt, Mycobacterium avium subsp. paratuberculosis
cggcacggccggc

SEQ ID NO: 2909899 - RNA, 15 nt, Mycobacterium avium subsp. paratuberculosis
cggcacggccggccg

SEQ ID NO: 2909900 - RNA, 16 nt, Mycobacterium avium subsp. paratuberculosis
cggcacggccggccgg

SEQ ID NO: 2909901 - RNA, 11 nt, Mycobacterium avium subsp. paratuberculosis
cggcacggcga

SEQ ID NO: 2909902 - RNA, 13 nt, Mycobacterium avium subsp. paratuberculosis
cggcacggcgagg

SEQ ID NO: 2909903 - RNA, 15 nt, Mycobacterium avium subsp. paratuberculosis
cggcacggcgagguc

SEQ ID NO: 2909904 - RNA, 17 nt, Mycobacterium avium subsp. paratuberculosis
cggcacggcgaggucgg

SEQ ID NO: 2909905 - RNA, 19 nt, Mycobacterium avium subsp. paratuberculosis
cggcacggcgaggucggga

SEQ ID NO: 2909906 - RNA, 22 nt, Mycobacterium avium subsp. paratuberculosis
cggcacggcuaccuaggcgucg

SEQ ID NO: 2909907 - RNA, 14 nt, Mycobacterium avium subsp. paratuberculosis
cggcacgggcaccg

SEQ ID NO: 2909908 - RNA, 16 nt, Mycobacterium avium subsp. paratuberculosis
cggcacgggcaccgac

SEQ ID NO: 2909909 - RNA, 20 nt, Mycobacterium avium subsp. paratuberculosis
cggcacgggcaccgacgagg

SEQ ID NO: 2909910 - RNA, 17 nt, Mycobacterium avium subsp. paratuberculosis
cggcacgggccguucgu

SEQ ID NO: 2909911 - RNA, 18 nt, Mycobacterium avium subsp. paratuberculosis
cggcacggugcacacgcc

SEQ ID NO: 2909912 - RNA, 20 nt, Mycobacterium avium subsp. paratuberculosis
cggcacggugcacacgccga

SEQ ID NO: 2909913 - RNA, 23 nt, Mycobacterium avium subsp. paratuberculosis
cggcacggugcgggugccgaaca

SEQ ID NO: 2909914 - RNA, 13 nt, Mycobacterium avium subsp. paratuberculosis
cggcacgguuggc

SEQ ID NO: 2909915 - RNA, 15 nt, Mycobacterium avium subsp. paratuberculosis
cggcacgguuggccg

SEQ ID NO: 2909916 - RNA, 20 nt, Mycobacterium avium subsp. paratuberculosis
cggcacgguuggccggcccg

SEQ ID NO: 2909917 - RNA, 19 nt, Mycobacterium avium subsp. paratuberculosis
cggcacgucgagcuccucg

SEQ ID NO: 2909918 - RNA, 13 nt, Mycobacterium avium subsp. paratuberculosis
cggcacgucgagg

SEQ ID NO: 2909919 - RNA, 16 nt, Mycobacterium avium subsp. paratuberculosis
cggcacgucggccacg

SEQ ID NO: 2909920 - RNA, 18 nt, Mycobacterium avium subsp. paratuberculosis
cggcacgucggccacgcc

SEQ ID NO: 2909921 - RNA, 14 nt, Mycobacterium avium subsp. paratuberculosis
cggcacgugcgggu

SEQ ID NO: 2909922 - RNA, 19 nt, Mycobacterium avium subsp. paratuberculosis
cggcacguguccgacgccg

SEQ ID NO: 2909923 - RNA, 20 nt, Mycobacterium avium subsp. paratuberculosis
cggcacguguccgacgccgu

SEQ ID NO: 2909924 - RNA, 23 nt, Mycobacterium avium subsp. paratuberculosis
cggcacguguccgacgccgucga

SEQ ID NO: 2909925 - RNA, 22 nt, Mycobacterium avium subsp. paratuberculosis
cggcacguugacguagacgacg

SEQ ID NO: 2909926 - RNA, 14 nt, Mycobacterium avium subsp. paratuberculosis
cggcacguugccca

SEQ ID NO: 2909927 - RNA, 23 nt, Mycobacterium avium subsp. paratuberculosis
cggcacguugcccaggaaguagc

SEQ ID NO: 2909928 - RNA, 18 nt, Mycobacterium avium subsp. paratuberculosis
cggcacuaccgccucgcc

SEQ ID NO: 2909929 - RNA, 20 nt, Mycobacterium avium subsp. paratuberculosis
cggcacuaccgccucgccag

SEQ ID NO: 2909930 - RNA, 22 nt, Mycobacterium avium subsp. paratuberculosis
cggcacuaccgccucgccagcc

SEQ ID NO: 2909931 - RNA, 17 nt, Mycobacterium avium subsp. paratuberculosis
cggcacucgccucggag

SEQ ID NO: 2909932 - RNA, 20 nt, Mycobacterium avium subsp. paratuberculosis
cggcacucgccucggaggcc

SEQ ID NO: 2909933 - RNA, 15 nt, Mycobacterium avium subsp. paratuberculosis
cggcacucgucgugg

SEQ ID NO: 2909934 - RNA, 17 nt, Mycobacterium avium subsp. paratuberculosis
cggcacucgucguggcg

SEQ ID NO: 2909935 - RNA, 18 nt, Mycobacterium avium subsp. paratuberculosis
cggcacucgucguggcgg

SEQ ID NO: 2909936 - RNA, 16 nt, Mycobacterium avium subsp. paratuberculosis
cggcacugaaggcgcg

SEQ ID NO: 2909937 - RNA, 19 nt, Mycobacterium avium subsp. paratuberculosis
cggcacugaaggcgcgggc

SEQ ID NO: 2909938 - RNA, 14 nt, Mycobacterium avium subsp. paratuberculosis
cggcacugcccgca

SEQ ID NO: 2909939 - RNA, 17 nt, Mycobacterium avium subsp. paratuberculosis
cggcacugcccgcaucg

SEQ ID NO: 2909940 - RNA, 17 nt, Mycobacterium avium subsp. paratuberculosis
cggcacugcugcccgcg

SEQ ID NO: 2909941 - RNA, 22 nt, Mycobacterium avium subsp. paratuberculosis
cggcacugcugcccgcgacggc

SEQ ID NO: 2909942 - RNA, 23 nt, Mycobacterium avium subsp. paratuberculosis
cggcacugcugcccgcgacggcg

SEQ ID NO: 2909943 - RNA, 23 nt, Mycobacterium avium subsp. paratuberculosis
cggcacuucgaucaucuccaccc

SEQ ID NO: 2909944 - RNA, 15 nt, Mycobacterium avium subsp. paratuberculosis
cggcagaacgacgcc

SEQ ID NO: 2909945 - RNA, 17 nt, Mycobacterium avium subsp. paratuberculosis
cggcagaacgacgccag

SEQ ID NO: 2909946 - RNA, 16 nt, Mycobacterium avium subsp. paratuberculosis
cggcagacccagcagc

SEQ ID NO: 2909947 - RNA, 17 nt, Mycobacterium avium subsp. paratuberculosis
cggcagacccagcagcg

SEQ ID NO: 2909948 - RNA, 21 nt, Mycobacterium avium subsp. paratuberculosis
cggcagacccagcagcggccg

SEQ ID NO: 2909949 - RNA, 19 nt, Mycobacterium avium subsp. paratuberculosis
cggcagaccggugagcacc

SEQ ID NO: 2909950 - RNA, 21 nt, Mycobacterium avium subsp. paratuberculosis
cggcagacgaauucggagacc

SEQ ID NO: 2909951 - RNA, 18 nt, Mycobacterium avium subsp. paratuberculosis
cggcagauagaucagcag

SEQ ID NO: 2909952 - RNA, 19 nt, Mycobacterium avium subsp. paratuberculosis
cggcagauagaucagcagg

SEQ ID NO: 2909953 - RNA, 20 nt, Mycobacterium avium subsp. paratuberculosis
cggcagauagaucagcaggc

SEQ ID NO: 2909954 - RNA, 15 nt, Mycobacterium avium subsp. paratuberculosis
cggcagaucgcggcc

SEQ ID NO: 2909955 - RNA, 17 nt, Mycobacterium avium subsp. paratuberculosis
cggcagaucgcggcccg

SEQ ID NO: 2909956 - RNA, 18 nt, Mycobacterium avium subsp. paratuberculosis
cggcagaucgcggcccgc

SEQ ID NO: 2909957 - RNA, 20 nt, Mycobacterium avium subsp. paratuberculosis
cggcagaucgcggcccgccg

SEQ ID NO: 2909958 - RNA, 18 nt, Mycobacterium avium subsp. paratuberculosis
cggcagaucugcaggguu

SEQ ID NO: 2909959 - RNA, 19 nt, Mycobacterium avium subsp. paratuberculosis
cggcagauugguucggccg

SEQ ID NO: 2909960 - RNA, 14 nt, Mycobacterium avium subsp. paratuberculosis
cggcagcaaccgcg

SEQ ID NO: 2909961 - RNA, 16 nt, Mycobacterium avium subsp. paratuberculosis
cggcagcaaccgcgaa

SEQ ID NO: 2909962 - RNA, 17 nt, Mycobacterium avium subsp. paratuberculosis
cggcagcaaccgcgaaa

SEQ ID NO: 2909963 - RNA, 18 nt, Mycobacterium avium subsp. paratuberculosis
cggcagcaaccggcggcu

SEQ ID NO: 2909964 - RNA, 22 nt, Mycobacterium avium subsp. paratuberculosis
cggcagcacaccuuccaccacc

SEQ ID NO: 2909965 - RNA, 23 nt, Mycobacterium avium subsp. paratuberculosis
cggcagcacaccuuccaccaccg

SEQ ID NO: 2909966 - RNA, 14 nt, Mycobacterium avium subsp. paratuberculosis
cggcagcaccgccg

SEQ ID NO: 2909967 - RNA, 16 nt, Mycobacterium avium subsp. paratuberculosis
cggcagcaccgccgac

SEQ ID NO: 2909968 - RNA, 19 nt, Mycobacterium avium subsp. paratuberculosis
cggcagcaccgccgagccg

SEQ ID NO: 2909969 - RNA, 13 nt, Mycobacterium avium subsp. paratuberculosis
cggcagcaccggc

SEQ ID NO: 2909970 - RNA, 14 nt, Mycobacterium avium subsp. paratuberculosis
cggcagcaccggca

SEQ ID NO: 2909971 - RNA, 16 nt, Mycobacterium avium subsp. paratuberculosis
cggcagcaccggcagc

SEQ ID NO: 2909972 - RNA, 17 nt, Mycobacterium avium subsp. paratuberculosis
cggcagcaccggccgga

SEQ ID NO: 2909973 - RNA, 19 nt, Mycobacterium avium subsp. paratuberculosis
cggcagcaccucgcgcagc

SEQ ID NO: 2909974 - RNA, 20 nt, Mycobacterium avium subsp. paratuberculosis
cggcagcaccucgcgcagca

SEQ ID NO: 2909975 - RNA, 23 nt, Mycobacterium avium subsp. paratuberculosis
cggcagcaccucgcgcagcaccg

SEQ ID NO: 2909976 - RNA, 21 nt, Mycobacterium avium subsp. paratuberculosis
cggcagcacguccccgggcac

SEQ ID NO: 2909977 - RNA, 13 nt, Mycobacterium avium subsp. paratuberculosis
cggcagcagcacc

SEQ ID NO: 2909978 - RNA, 17 nt, Mycobacterium avium subsp. paratuberculosis
cggcagcagcaccagcg

SEQ ID NO: 2909979 - RNA, 16 nt, Mycobacterium avium subsp. paratuberculosis
cggcagcagcgagucg

SEQ ID NO: 2909980 - RNA, 22 nt, Mycobacterium avium subsp. paratuberculosis
cggcagcagcgagucgaagccg

SEQ ID NO: 2909981 - RNA, 16 nt, Mycobacterium avium subsp. paratuberculosis
cggcagcagcgcgucg

SEQ ID NO: 2909982 - RNA, 17 nt, Mycobacterium avium subsp. paratuberculosis
cggcagcagcgcgucgu

SEQ ID NO: 2909983 - RNA, 21 nt, Mycobacterium avium subsp. paratuberculosis
cggcagcagcugcgucggcac

SEQ ID NO: 2909984 - RNA, 18 nt, Mycobacterium avium subsp. paratuberculosis
cggcagcagggugccgcc

SEQ ID NO: 2909985 - RNA, 19 nt, Mycobacterium avium subsp. paratuberculosis
cggcagcagggugccgccg

SEQ ID NO: 2909986 - RNA, 17 nt, Mycobacterium avium subsp. paratuberculosis
cggcagcaggugcacca

SEQ ID NO: 2909987 - RNA, 18 nt, Mycobacterium avium subsp. paratuberculosis
cggcagcaggugcaccac

SEQ ID NO: 2909988 - RNA, 20 nt, Mycobacterium avium subsp. paratuberculosis
cggcagcaggugcaccaccc

SEQ ID NO: 2909989 - RNA, 20 nt, Mycobacterium avium subsp. paratuberculosis
cggcagcaucgggacgccug

SEQ ID NO: 2909990 - RNA, 13 nt, Mycobacterium avium subsp. paratuberculosis
cggcagccacggc

SEQ ID NO: 2909991 - RNA, 16 nt, Mycobacterium avium subsp. paratuberculosis
cggcagccacggcagc

SEQ ID NO: 2909992 - RNA, 17 nt, Mycobacterium avium subsp. paratuberculosis
cggcagccacggcagcu

SEQ ID NO: 2909993 - RNA, 21 nt, Mycobacterium avium subsp. paratuberculosis
cggcagccacggcagcugcag

SEQ ID NO: 2909994 - RNA, 13 nt, Mycobacterium avium subsp. paratuberculosis
cggcagccagccu

SEQ ID NO: 2909995 - RNA, 17 nt, Mycobacterium avium subsp. paratuberculosis
cggcagccagccuggcg

SEQ ID NO: 2909996 - RNA, 23 nt, Mycobacterium avium subsp. paratuberculosis
cggcagccagccuggcggcgacc

SEQ ID NO: 2909997 - RNA, 17 nt, Mycobacterium avium subsp. paratuberculosis
cggcagccagguacucc

SEQ ID NO: 2909998 - RNA, 14 nt, Mycobacterium avium subsp. paratuberculosis
cggcagccccgucg

SEQ ID NO: 2909999 - RNA, 15 nt, Mycobacterium avium subsp. paratuberculosis
cggcagccccgucgg

SEQ ID NO: 2910000 - RNA, 21 nt, Mycobacterium avium subsp. paratuberculosis
cggcagccccgucggucccga

SEQ ID NO: 2910001 - RNA, 16 nt, Mycobacterium avium subsp. paratuberculosis
cggcagcccgacgucc

SEQ ID NO: 2910002 - RNA, 13 nt, Mycobacterium avium subsp. paratuberculosis
cggcagcccggag

SEQ ID NO: 2910003 - RNA, 19 nt, Mycobacterium avium subsp. paratuberculosis
cggcagcccggaggcgaug

SEQ ID NO: 2910004 - RNA, 14 nt, Mycobacterium avium subsp. paratuberculosis
cggcagccgcagcg

SEQ ID NO: 2910005 - RNA, 18 nt, Mycobacterium avium subsp. paratuberculosis
cggcagccgcgcccaccc

SEQ ID NO: 2910006 - RNA, 21 nt, Mycobacterium avium subsp. paratuberculosis
cggcagccgcgcccacccgcg

SEQ ID NO: 2910007 - RNA, 15 nt, Mycobacterium avium subsp. paratuberculosis
cggcagccgcuccgg

SEQ ID NO: 2910008 - RNA, 16 nt, Mycobacterium avium subsp. paratuberculosis
cggcagccgcucggau

SEQ ID NO: 2910009 - RNA, 13 nt, Mycobacterium avium subsp. paratuberculosis
cggcagccggcca

SEQ ID NO: 2910010 - RNA, 14 nt, Mycobacterium avium subsp. paratuberculosis
cggcagccggcgcg

SEQ ID NO: 2910011 - RNA, 15 nt, Mycobacterium avium subsp. paratuberculosis
cggcagccggcgcgg

SEQ ID NO: 2910012 - RNA, 14 nt, Mycobacterium avium subsp. paratuberculosis
cggcagccggcgua

SEQ ID NO: 2910013 - RNA, 16 nt, Mycobacterium avium subsp. paratuberculosis
cggcagccggcguacu

SEQ ID NO: 2910014 - RNA, 13 nt, Mycobacterium avium subsp. paratuberculosis
cggcagccggggu

SEQ ID NO: 2910015 - RNA, 21 nt, Mycobacterium avium subsp. paratuberculosis
cggcagccggggugcccgggc

SEQ ID NO: 2910016 - RNA, 22 nt, Mycobacterium avium subsp. paratuberculosis
cggcagccggggugcccgggcc

SEQ ID NO: 2910017 - RNA, 19 nt, Mycobacterium avium subsp. paratuberculosis
cggcagccuuuccacaucu

SEQ ID NO: 2910018 - RNA, 17 nt, Mycobacterium avium subsp. paratuberculosis
cggcagcgacagcgcgu

SEQ ID NO: 2910019 - RNA, 19 nt, Mycobacterium avium subsp. paratuberculosis
cggcagcgacagcgcgucg

SEQ ID NO: 2910020 - RNA, 20 nt, Mycobacterium avium subsp. paratuberculosis
cggcagcgacagcgcgucgg

SEQ ID NO: 2910021 - RNA, 22 nt, Mycobacterium avium subsp. paratuberculosis
cggcagcgacagcgcgucggcc

SEQ ID NO: 2910022 - RNA, 14 nt, Mycobacterium avium subsp. paratuberculosis
cggcagcgacgcgg

SEQ ID NO: 2910023 - RNA, 15 nt, Mycobacterium avium subsp. paratuberculosis
cggcagcgacgcggu

SEQ ID NO: 2910024 - RNA, 22 nt, Mycobacterium avium subsp. paratuberculosis
cggcagcgacucgggcaggaug

SEQ ID NO: 2910025 - RNA, 13 nt, Mycobacterium avium subsp. paratuberculosis
cggcagcgaggcg

SEQ ID NO: 2910026 - RNA, 15 nt, Mycobacterium avium subsp. paratuberculosis
cggcagcgaggcgcg

SEQ ID NO: 2910027 - RNA, 17 nt, Mycobacterium avium subsp. paratuberculosis
cggcagcgaggcgcgca

SEQ ID NO: 2910028 - RNA, 22 nt, Mycobacterium avium subsp. paratuberculosis
cggcagcgccaacauggcgcag

SEQ ID NO: 2910029 - RNA, 16 nt, Mycobacterium avium subsp. paratuberculosis
cggcagcgccaccagc

SEQ ID NO: 2910030 - RNA, 13 nt, Mycobacterium avium subsp. paratuberculosis
cggcagcgccagc

SEQ ID NO: 2910031 - RNA, 16 nt, Mycobacterium avium subsp. paratuberculosis
cggcagcgccagcggg

SEQ ID NO: 2910032 - RNA, 22 nt, Mycobacterium avium subsp. paratuberculosis
cggcagcgccucccggaccacc

SEQ ID NO: 2910033 - RNA, 23 nt, Mycobacterium avium subsp. paratuberculosis
cggcagcgccucccggaccacca

SEQ ID NO: 2910034 - RNA, 15 nt, Mycobacterium avium subsp. paratuberculosis
cggcagcgcgauccg

SEQ ID NO: 2910035 - RNA, 17 nt, Mycobacterium avium subsp. paratuberculosis
cggcagcgcgauccggg

SEQ ID NO: 2910036 - RNA, 19 nt, Mycobacterium avium subsp. paratuberculosis
cggcagcgcgauccggggg

SEQ ID NO: 2910037 - RNA, 16 nt, Mycobacterium avium subsp. paratuberculosis
cggcagcgcgcccucg

SEQ ID NO: 2910038 - RNA, 13 nt, Mycobacterium avium subsp. paratuberculosis
cggcagcgcggcg

SEQ ID NO: 2910039 - RNA, 23 nt, Mycobacterium avium subsp. paratuberculosis
cggcagcgcggcguucagcagcg

SEQ ID NO: 2910040 - RNA, 16 nt, Mycobacterium avium subsp. paratuberculosis
cggcagcgcucgucgu

SEQ ID NO: 2910041 - RNA, 17 nt, Mycobacterium avium subsp. paratuberculosis
cggcagcggcgucgucg

SEQ ID NO: 2910042 - RNA, 17 nt, Mycobacterium avium subsp. paratuberculosis
cggcagcggcugcugca

SEQ ID NO: 2910043 - RNA, 22 nt, Mycobacterium avium subsp. paratuberculosis
cggcagcggcugcugcagcgcc

SEQ ID NO: 2910044 - RNA, 13 nt, Mycobacterium avium subsp. paratuberculosis
cggcagcggggcg

SEQ ID NO: 2910045 - RNA, 22 nt, Mycobacterium avium subsp. paratuberculosis
cggcagcggggcgaacccggcg

SEQ ID NO: 2910046 - RNA, 14 nt, Mycobacterium avium subsp. paratuberculosis
cggcagcggugccg

SEQ ID NO: 2910047 - RNA, 16 nt, Mycobacterium avium subsp. paratuberculosis
cggcagcggugccgcc

SEQ ID NO: 2910048 - RNA, 18 nt, Mycobacterium avium subsp. paratuberculosis
cggcagcggugccgcccg

SEQ ID NO: 2910049 - RNA, 19 nt, Mycobacterium avium subsp. paratuberculosis
cggcagcggugccgcccgg

SEQ ID NO: 2910050 - RNA, 17 nt, Mycobacterium avium subsp. paratuberculosis
cggcagcgucgccagcc

SEQ ID NO: 2910051 - RNA, 15 nt, Mycobacterium avium subsp. paratuberculosis
cggcagcgucuugga

SEQ ID NO: 2910052 - RNA, 22 nt, Mycobacterium avium subsp. paratuberculosis
cggcagcgucuuggacgcccgg

SEQ ID NO: 2910053 - RNA, 23 nt, Mycobacterium avium subsp. paratuberculosis
cggcagcgucuuggacgcccggu

SEQ ID NO: 2910054 - RNA, 16 nt, Mycobacterium avium subsp. paratuberculosis
cggcagcucggcggcc

SEQ ID NO: 2910055 - RNA, 17 nt, Mycobacterium avium subsp. paratuberculosis
cggcagcucggcggccc

SEQ ID NO: 2910056 - RNA, 18 nt, Mycobacterium avium subsp. paratuberculosis
cggcagcucggcggcccg

SEQ ID NO: 2910057 - RNA, 21 nt, Mycobacterium avium subsp. paratuberculosis
cggcagcucggcggcccgccg

SEQ ID NO: 2910058 - RNA, 22 nt, Mycobacterium avium subsp. paratuberculosis
cggcagcucggcggcccgccgg

SEQ ID NO: 2910059 - RNA, 13 nt, Mycobacterium avium subsp. paratuberculosis
cggcagcucgucg

SEQ ID NO: 2910060 - RNA, 14 nt, Mycobacterium avium subsp. paratuberculosis
cggcagcucgucga

SEQ ID NO: 2910061 - RNA, 17 nt, Mycobacterium avium subsp. paratuberculosis
cggcagcucgucgacgu

SEQ ID NO: 2910062 - RNA, 18 nt, Mycobacterium avium subsp. paratuberculosis
cggcagcucgucgacguc

SEQ ID NO: 2910063 - RNA, 14 nt, Mycobacterium avium subsp. paratuberculosis
cggcagcugcagcg

SEQ ID NO: 2910064 - RNA, 16 nt, Mycobacterium avium subsp. paratuberculosis
cggcagcugcagcgga

SEQ ID NO: 2910065 - RNA, 14 nt, Mycobacterium avium subsp. paratuberculosis
cggcaggaaagcgc

SEQ ID NO: 2910066 - RNA, 14 nt, Mycobacterium avium subsp. paratuberculosis
cggcaggaaccggg

SEQ ID NO: 2910067 - RNA, 17 nt, Mycobacterium avium subsp. paratuberculosis
cggcaggaaccggguca

SEQ ID NO: 2910068 - RNA, 20 nt, Mycobacterium avium subsp. paratuberculosis
cggcaggaaccgggucagca

SEQ ID NO: 2910069 - RNA, 20 nt, Mycobacterium avium subsp. paratuberculosis
cggcaggaauuccagcgaca

SEQ ID NO: 2910070 - RNA, 18 nt, Mycobacterium avium subsp. paratuberculosis
cggcaggacgggggccgg

SEQ ID NO: 2910071 - RNA, 14 nt, Mycobacterium avium subsp. paratuberculosis
cggcaggauccgga

SEQ ID NO: 2910072 - RNA, 17 nt, Mycobacterium avium subsp. paratuberculosis
cggcaggauccggucga

SEQ ID NO: 2910073 - RNA, 20 nt, Mycobacterium avium subsp. paratuberculosis
cggcaggauccggucgauca

SEQ ID NO: 2910074 - RNA, 21 nt, Mycobacterium avium subsp. paratuberculosis
cggcaggauccggucgaucac

SEQ ID NO: 2910075 - RNA, 14 nt, Mycobacterium avium subsp. paratuberculosis
cggcaggccgcccg

SEQ ID NO: 2910076 - RNA, 15 nt, Mycobacterium avium subsp. paratuberculosis
cggcaggccgcggcc

SEQ ID NO: 2910077 - RNA, 19 nt, Mycobacterium avium subsp. paratuberculosis
cggcaggccgcggccgucg

SEQ ID NO: 2910078 - RNA, 22 nt, Mycobacterium avium subsp. paratuberculosis
cggcaggccgcggccgucgucg

SEQ ID NO: 2910079 - RNA, 16 nt, Mycobacterium avium subsp. paratuberculosis
cggcaggcgacccgca

SEQ ID NO: 2910080 - RNA, 12 nt, Mycobacterium avium subsp. paratuberculosis
cggcaggcgccc

SEQ ID NO: 2910081 - RNA, 16 nt, Mycobacterium avium subsp. paratuberculosis
cggcaggcgccccagc

SEQ ID NO: 2910082 - RNA, 17 nt, Mycobacterium avium subsp. paratuberculosis
cggcaggcgccccagcu

SEQ ID NO: 2910083 - RNA, 14 nt, Mycobacterium avium subsp. paratuberculosis
cggcaggcggcccg

SEQ ID NO: 2910084 - RNA, 18 nt, Mycobacterium avium subsp. paratuberculosis
cggcaggcggcccgcucg

SEQ ID NO: 2910085 - RNA, 21 nt, Mycobacterium avium subsp. paratuberculosis
cggcaggcucagcagcaccgc

SEQ ID NO: 2910086 - RNA, 13 nt, Mycobacterium avium subsp. paratuberculosis
cggcagggccacc

SEQ ID NO: 2910087 - RNA, 15 nt, Mycobacterium avium subsp. paratuberculosis
cggcagggccaccgu

SEQ ID NO: 2910088 - RNA, 15 nt, Mycobacterium avium subsp. paratuberculosis
cggcagggccagcac

SEQ ID NO: 2910089 - RNA, 16 nt, Mycobacterium avium subsp. paratuberculosis
cggcagggccagcacc

SEQ ID NO: 2910090 - RNA, 19 nt, Mycobacterium avium subsp. paratuberculosis
cggcagggccagcaccaug

SEQ ID NO: 2910091 - RNA, 14 nt, Mycobacterium avium subsp. paratuberculosis
cggcagggccaggc

SEQ ID NO: 2910092 - RNA, 20 nt, Mycobacterium avium subsp. paratuberculosis
cggcagggccaggccgugau

SEQ ID NO: 2910093 - RNA, 19 nt, Mycobacterium avium subsp. paratuberculosis
cggcagguaggcgccgcuc

SEQ ID NO: 2910094 - RNA, 20 nt, Mycobacterium avium subsp. paratuberculosis
cggcaggucgaggccggcca

SEQ ID NO: 2910095 - RNA, 22 nt, Mycobacterium avium subsp. paratuberculosis
cggcaggucgaggccggccagc

SEQ ID NO: 2910096 - RNA, 17 nt, Mycobacterium avium subsp. paratuberculosis
cggcaggucggccagcg

SEQ ID NO: 2910097 - RNA, 23 nt, Mycobacterium avium subsp. paratuberculosis
cggcaggucggccagcgccgccc

SEQ ID NO: 2910098 - RNA, 13 nt, Mycobacterium avium subsp. paratuberculosis
cggcaggucggcg

SEQ ID NO: 2910099 - RNA, 14 nt, Mycobacterium avium subsp. paratuberculosis
cggcaggucggcgg

SEQ ID NO: 2910100 - RNA, 18 nt, Mycobacterium avium subsp. paratuberculosis
cggcaggucggcgggagc

SEQ ID NO: 2910101 - RNA, 20 nt, Mycobacterium avium subsp. paratuberculosis
cggcaggucggcgggagccg

SEQ ID NO: 2910102 - RNA, 18 nt, Mycobacterium avium subsp. paratuberculosis
cggcaggucggugcgcgg

SEQ ID NO: 2910103 - RNA, 21 nt, Mycobacterium avium subsp. paratuberculosis
cggcaggucggugcgcggggu

SEQ ID NO: 2910104 - RNA, 13 nt, Mycobacterium avium subsp. paratuberculosis
cggcaggucgucg

SEQ ID NO: 2910105 - RNA, 15 nt, Mycobacterium avium subsp. paratuberculosis
cggcaggucgucgac

SEQ ID NO: 2910106 - RNA, 16 nt, Mycobacterium avium subsp. paratuberculosis
cggcaggucgucgacg

SEQ ID NO: 2910107 - RNA, 19 nt, Mycobacterium avium subsp. paratuberculosis
cggcaggucgucgucgccg

SEQ ID NO: 2910108 - RNA, 21 nt, Mycobacterium avium subsp. paratuberculosis
cggcaggucgucgucgccgcg

SEQ ID NO: 2910109 - RNA, 14 nt, Mycobacterium avium subsp. paratuberculosis
cggcaggugaaggu

SEQ ID NO: 2910110 - RNA, 22 nt, Mycobacterium avium subsp. paratuberculosis
cggcaggugaaggugccccacg

SEQ ID NO: 2910111 - RNA, 24 nt, Mycobacterium avium subsp. paratuberculosis
cggcagguggauugucggccgccc

SEQ ID NO: 2910112 - RNA, 22 nt, Mycobacterium avium subsp. paratuberculosis
cggcagguggggcagcaccucg

SEQ ID NO: 2910113 - RNA, 17 nt, Mycobacterium avium subsp. paratuberculosis
cggcagguugcgcugga

SEQ ID NO: 2910114 - RNA, 16 nt, Mycobacterium avium subsp. paratuberculosis
cggcaguagcgcaccg

SEQ ID NO: 2910115 - RNA, 17 nt, Mycobacterium avium subsp. paratuberculosis
cggcaguagcgcaccgg

SEQ ID NO: 2910116 - RNA, 21 nt, Mycobacterium avium subsp. paratuberculosis
cggcaguagcgcaccggucag

SEQ ID NO: 2910117 - RNA, 23 nt, Mycobacterium avium subsp. paratuberculosis
cggcaguaucuuguucgccgaca

SEQ ID NO: 2910118 - RNA, 14 nt, Mycobacterium avium subsp. paratuberculosis
cggcaguccgccgg

SEQ ID NO: 2910119 - RNA, 19 nt, Mycobacterium avium subsp. paratuberculosis
cggcaguccgccggagacc

SEQ ID NO: 2910120 - RNA, 13 nt, Mycobacterium avium subsp. paratuberculosis
cggcaguccgcgc

SEQ ID NO: 2910121 - RNA, 16 nt, Mycobacterium avium subsp. paratuberculosis
cggcaguccgcgccgg

SEQ ID NO: 2910122 - RNA, 18 nt, Mycobacterium avium subsp. paratuberculosis
cggcaguccggacacggc

SEQ ID NO: 2910123 - RNA, 21 nt, Mycobacterium avium subsp. paratuberculosis
cggcaguccggacacggccag

SEQ ID NO: 2910124 - RNA, 15 nt, Mycobacterium avium subsp. paratuberculosis
cggcagucgcagcag

SEQ ID NO: 2910125 - RNA, 16 nt, Mycobacterium avium subsp. paratuberculosis
cggcagucgcagcagc

SEQ ID NO: 2910126 - RNA, 23 nt, Mycobacterium avium subsp. paratuberculosis
cggcagucgcagcagcagcccga

SEQ ID NO: 2910127 - RNA, 18 nt, Mycobacterium avium subsp. paratuberculosis
cggcagugagggaacgcc

SEQ ID NO: 2910128 - RNA, 17 nt, Mycobacterium avium subsp. paratuberculosis
cggcagugcgccguccc

SEQ ID NO: 2910129 - RNA, 18 nt, Mycobacterium avium subsp. paratuberculosis
cggcagugcgccgucccg

SEQ ID NO: 2910130 - RNA, 20 nt, Mycobacterium avium subsp. paratuberculosis
cggcagugugauucggguca

SEQ ID NO: 2910131 - RNA, 16 nt, Mycobacterium avium subsp. paratuberculosis
cggcaguuccucgccg

SEQ ID NO: 2910132 - RNA, 19 nt, Mycobacterium avium subsp. paratuberculosis
cggcaguuccucgccggag

SEQ ID NO: 2910133 - RNA, 20 nt, Mycobacterium avium subsp. paratuberculosis
cggcaguugcacuuucgcgu

SEQ ID NO: 2910134 - RNA, 12 nt, Mycobacterium avium subsp. paratuberculosis
cggcaguugcgg

SEQ ID NO: 2910135 - RNA, 15 nt, Mycobacterium avium subsp. paratuberculosis
cggcauaacgcaacc

SEQ ID NO: 2910136 - RNA, 15 nt, Mycobacterium avium subsp. paratuberculosis
cggcauagagcuggu

SEQ ID NO: 2910137 - RNA, 19 nt, Mycobacterium avium subsp. paratuberculosis
cggcauagagcuggugggc

SEQ ID NO: 2910138 - RNA, 21 nt, Mycobacterium avium subsp. paratuberculosis
cggcauagauaccggccagca

SEQ ID NO: 2910139 - RNA, 22 nt, Mycobacterium avium subsp. paratuberculosis
cggcauagauaccggccagcac

SEQ ID NO: 2910140 - RNA, 23 nt, Mycobacterium avium subsp. paratuberculosis
cggcauagauaccggccagcacg

SEQ ID NO: 2910141 - RNA, 13 nt, Mycobacterium avium subsp. paratuberculosis
cggcauagcgccg

SEQ ID NO: 2910142 - RNA, 14 nt, Mycobacterium avium subsp. paratuberculosis
cggcauagcgccgc

SEQ ID NO: 2910143 - RNA, 17 nt, Mycobacterium avium subsp. paratuberculosis
cggcauagcgccgcucg

SEQ ID NO: 2910144 - RNA, 16 nt, Mycobacterium avium subsp. paratuberculosis
cggcaucagcgagacg

SEQ ID NO: 2910145 - RNA, 23 nt, Mycobacterium avium subsp. paratuberculosis
cggcauccacccguuccucgacg

SEQ ID NO: 2910146 - RNA, 16 nt, Mycobacterium avium subsp. paratuberculosis
cggcauccagcacggc

SEQ ID NO: 2910147 - RNA, 18 nt, Mycobacterium avium subsp. paratuberculosis
cggcauccagcacggccg

SEQ ID NO: 2910148 - RNA, 14 nt, Mycobacterium avium subsp. paratuberculosis
cggcaucccacccg

SEQ ID NO: 2910149 - RNA, 18 nt, Mycobacterium avium subsp. paratuberculosis
cggcauccccagcugggc

SEQ ID NO: 2910150 - RNA, 20 nt, Mycobacterium avium subsp. paratuberculosis
cggcauccccagcugggccg

SEQ ID NO: 2910151 - RNA, 23 nt, Mycobacterium avium subsp. paratuberculosis
cggcauccccagcugggccgcca

SEQ ID NO: 2910152 - RNA, 13 nt, Mycobacterium avium subsp. paratuberculosis
cggcaucccggag

SEQ ID NO: 2910153 - RNA, 17 nt, Mycobacterium avium subsp. paratuberculosis
cggcaucccuggugacc

SEQ ID NO: 2910154 - RNA, 19 nt, Mycobacterium avium subsp. paratuberculosis
cggcaucccuggugaccga

SEQ ID NO: 2910155 - RNA, 23 nt, Mycobacterium avium subsp. paratuberculosis
cggcaucccuggugaccgacgac

SEQ ID NO: 2910156 - RNA, 15 nt, Mycobacterium avium subsp. paratuberculosis
cggcauccucggcgc

SEQ ID NO: 2910157 - RNA, 17 nt, Mycobacterium avium subsp. paratuberculosis
cggcauccucggcgcgu

SEQ ID NO: 2910158 - RNA, 17 nt, Mycobacterium avium subsp. paratuberculosis
cggcaucgaccgcccgc

SEQ ID NO: 2910159 - RNA, 21 nt, Mycobacterium avium subsp. paratuberculosis
cggcaucgaccgcccgcugaa

SEQ ID NO: 2910160 - RNA, 19 nt, Mycobacterium avium subsp. paratuberculosis
cggcaucgaggaccggcgc

SEQ ID NO: 2910161 - RNA, 21 nt, Mycobacterium avium subsp. paratuberculosis
cggcaucgaggaccggcgccg

SEQ ID NO: 2910162 - RNA, 20 nt, Mycobacterium avium subsp. paratuberculosis
cggcaucgauggcgggcgcg

SEQ ID NO: 2910163 - RNA, 18 nt, Mycobacterium avium subsp. paratuberculosis
cggcaucgccgccaaggg

SEQ ID NO: 2910164 - RNA, 17 nt, Mycobacterium avium subsp. paratuberculosis
cggcaucgcgccgcaug

SEQ ID NO: 2910165 - RNA, 12 nt, Mycobacterium avium subsp. paratuberculosis
cggcaucgcgcg

SEQ ID NO: 2910166 - RNA, 14 nt, Mycobacterium avium subsp. paratuberculosis
cggcaucgcgcgcg

SEQ ID NO: 2910167 - RNA, 15 nt, Mycobacterium avium subsp. paratuberculosis
cggcaucgcgcgcgg

SEQ ID NO: 2910168 - RNA, 17 nt, Mycobacterium avium subsp. paratuberculosis
cggcaucgcgcgcggcg

SEQ ID NO: 2910169 - RNA, 18 nt, Mycobacterium avium subsp. paratuberculosis
cggcaucgcgcgcggcga

SEQ ID NO: 2910170 - RNA, 19 nt, Mycobacterium avium subsp. paratuberculosis
cggcaucgcgcgcggcgac

SEQ ID NO: 2910171 - RNA, 20 nt, Mycobacterium avium subsp. paratuberculosis
cggcaucgcgcgcggcgacg

SEQ ID NO: 2910172 - RNA, 23 nt, Mycobacterium avium subsp. paratuberculosis
cggcaucgcgcgcggcgacggug

SEQ ID NO: 2910173 - RNA, 13 nt, Mycobacterium avium subsp. paratuberculosis
cggcaucggcgac

SEQ ID NO: 2910174 - RNA, 14 nt, Mycobacterium avium subsp. paratuberculosis
cggcaucggcgacg

SEQ ID NO: 2910175 - RNA, 15 nt, Mycobacterium avium subsp. paratuberculosis
cggcaucggcgacgg

SEQ ID NO: 2910176 - RNA, 22 nt, Mycobacterium avium subsp. paratuberculosis
cggcaucggcgcccucgccgac

SEQ ID NO: 2910177 - RNA, 14 nt, Mycobacterium avium subsp. paratuberculosis
cggcaucggcucgu

SEQ ID NO: 2910178 - RNA, 19 nt, Mycobacterium avium subsp. paratuberculosis
cggcaucgguggcaccccg

SEQ ID NO: 2910179 - RNA, 21 nt, Mycobacterium avium subsp. paratuberculosis
cggcaucgguggcaccccgcg

SEQ ID NO: 2910180 - RNA, 23 nt, Mycobacterium avium subsp. paratuberculosis
cggcaucgguggcaccccgcgcc

SEQ ID NO: 2910181 - RNA, 23 nt, Mycobacterium avium subsp. paratuberculosis
cggcaucgucggggacgaagacc

SEQ ID NO: 2910182 - RNA, 16 nt, Mycobacterium avium subsp. paratuberculosis
cggcaucucggccgga

SEQ ID NO: 2910183 - RNA, 15 nt, Mycobacterium avium subsp. paratuberculosis
cggcaugaccggcca

SEQ ID NO: 2910184 - RNA, 16 nt, Mycobacterium avium subsp. paratuberculosis
cggcaugaccggccag

SEQ ID NO: 2910185 - RNA, 17 nt, Mycobacterium avium subsp. paratuberculosis
cggcaugaccggccagc

SEQ ID NO: 2910186 - RNA, 19 nt, Mycobacterium avium subsp. paratuberculosis
cggcaugaccggccagcau

SEQ ID NO: 2910187 - RNA, 21 nt, Mycobacterium avium subsp. paratuberculosis
cggcaugaccggccagcaugg

SEQ ID NO: 2910188 - RNA, 17 nt, Mycobacterium avium subsp. paratuberculosis
cggcaugccgggccagc

SEQ ID NO: 2910189 - RNA, 20 nt, Mycobacterium avium subsp. paratuberculosis
cggcaugccgggccagccgg

SEQ ID NO: 2910190 - RNA, 21 nt, Mycobacterium avium subsp. paratuberculosis
cggcaugccgggccagccggc

SEQ ID NO: 2910191 - RNA, 22 nt, Mycobacterium avium subsp. paratuberculosis
cggcaugccgggccagccggcc

SEQ ID NO: 2910192 - RNA, 13 nt, Mycobacterium avium subsp. paratuberculosis
cggcauggcgaug

SEQ ID NO: 2910193 - RNA, 15 nt, Mycobacterium avium subsp. paratuberculosis
cggcauggcgaugac

SEQ ID NO: 2910194 - RNA, 16 nt, Mycobacterium avium subsp. paratuberculosis
cggcauggcgaugacc

SEQ ID NO: 2910195 - RNA, 21 nt, Mycobacterium avium subsp. paratuberculosis
cggcauggcgaugaccagcgc

SEQ ID NO: 2910196 - RNA, 23 nt, Mycobacterium avium subsp. paratuberculosis
cggcauggcgaugaccagcgcga

SEQ ID NO: 2910197 - RNA, 18 nt, Mycobacterium avium subsp. paratuberculosis
cggcauggcuggcggcaa

SEQ ID NO: 2910198 - RNA, 23 nt, Mycobacterium avium subsp. paratuberculosis
cggcauggcuggcggcaacggcc

SEQ ID NO: 2910199 - RNA, 14 nt, Mycobacterium avium subsp. paratuberculosis
cggcaugggcggca

SEQ ID NO: 2910200 - RNA, 12 nt, Mycobacterium avium subsp. paratuberculosis
cggcauggugau

SEQ ID NO: 2910201 - RNA, 15 nt, Mycobacterium avium subsp. paratuberculosis
cggcaugugccacag

SEQ ID NO: 2910202 - RNA, 17 nt, Mycobacterium avium subsp. paratuberculosis
cggcauucguguggcgc

SEQ ID NO: 2910203 - RNA, 23 nt, Mycobacterium avium subsp. paratuberculosis
cggcauugcagcggaugccggag

SEQ ID NO: 2910204 - RNA, 22 nt, Mycobacterium avium subsp. paratuberculosis
cggccaaacccguugcagcaca

SEQ ID NO: 2910205 - RNA, 14 nt, Mycobacterium avium subsp. paratuberculosis
cggccaacaacgcc

SEQ ID NO: 2910206 - RNA, 16 nt, Mycobacterium avium subsp. paratuberculosis
cggccaacaacgccaa

SEQ ID NO: 2910207 - RNA, 17 nt, Mycobacterium avium subsp. paratuberculosis
cggccaacagcagcgcc

SEQ ID NO: 2910208 - RNA, 21 nt, Mycobacterium avium subsp. paratuberculosis
cggccaacagcagcgccgcgg

SEQ ID NO: 2910209 - RNA, 14 nt, Mycobacterium avium subsp. paratuberculosis
cggccaacccgggc

SEQ ID NO: 2910210 - RNA, 15 nt, Mycobacterium avium subsp. paratuberculosis
cggccaacccgggcg

SEQ ID NO: 2910211 - RNA, 16 nt, Mycobacterium avium subsp. paratuberculosis
cggccaacccgggcgc

SEQ ID NO: 2910212 - RNA, 17 nt, Mycobacterium avium subsp. paratuberculosis
cggccaacccgggcgcc

SEQ ID NO: 2910213 - RNA, 14 nt, Mycobacterium avium subsp. paratuberculosis
cggccaaccgcccg

SEQ ID NO: 2910214 - RNA, 15 nt, Mycobacterium avium subsp. paratuberculosis
cggccaaccgcccgg

SEQ ID NO: 2910215 - RNA, 16 nt, Mycobacterium avium subsp. paratuberculosis
cggccaaccgcccggc

SEQ ID NO: 2910216 - RNA, 18 nt, Mycobacterium avium subsp. paratuberculosis
cggccaaccgcccggcgc

SEQ ID NO: 2910217 - RNA, 20 nt, Mycobacterium avium subsp. paratuberculosis
cggccaaccgcccggcgccg

SEQ ID NO: 2910218 - RNA, 13 nt, Mycobacterium avium subsp. paratuberculosis
cggccaaccgggc

SEQ ID NO: 2910219 - RNA, 21 nt, Mycobacterium avium subsp. paratuberculosis
cggccaaccgggcaggcacgg

SEQ ID NO: 2910220 - RNA, 16 nt, Mycobacterium avium subsp. paratuberculosis
cggccaacgcccacca

SEQ ID NO: 2910221 - RNA, 18 nt, Mycobacterium avium subsp. paratuberculosis
cggccaacgccucgucga

SEQ ID NO: 2910222 - RNA, 20 nt, Mycobacterium avium subsp. paratuberculosis
cggccaacgccucgucgacc

SEQ ID NO: 2910223 - RNA, 22 nt, Mycobacterium avium subsp. paratuberculosis
cggccaacgccucgucgaccgc

SEQ ID NO: 2910224 - RNA, 22 nt, Mycobacterium avium subsp. paratuberculosis
cggccaacggauagcguccgcc

SEQ ID NO: 2910225 - RNA, 23 nt, Mycobacterium avium subsp. paratuberculosis
cggccaacgggaagagcggcgug

SEQ ID NO: 2910226 - RNA, 18 nt, Mycobacterium avium subsp. paratuberculosis
cggccaacugcaucgcca

SEQ ID NO: 2910227 - RNA, 19 nt, Mycobacterium avium subsp. paratuberculosis
cggccaaggcaagucgucg

SEQ ID NO: 2910228 - RNA, 22 nt, Mycobacterium avium subsp. paratuberculosis
cggccaaggcaagucgucggug

SEQ ID NO: 2910229 - RNA, 15 nt, Mycobacterium avium subsp. paratuberculosis
cggccaaucccacca

SEQ ID NO: 2910230 - RNA, 22 nt, Mycobacterium avium subsp. paratuberculosis
cggccaaucccaccaugagcag

SEQ ID NO: 2910231 - RNA, 17 nt, Mycobacterium avium subsp. paratuberculosis
cggccaaucgcugugcg

SEQ ID NO: 2910232 - RNA, 18 nt, Mycobacterium avium subsp. paratuberculosis
cggccaauuccucagccc

SEQ ID NO: 2910233 - RNA, 21 nt, Mycobacterium avium subsp. paratuberculosis
cggccaauuccucagcccggc

SEQ ID NO: 2910234 - RNA, 17 nt, Mycobacterium avium subsp. paratuberculosis
cggccacaccgaucagc

SEQ ID NO: 2910235 - RNA, 17 nt, Mycobacterium avium subsp. paratuberculosis
cggccacaccggggcca

SEQ ID NO: 2910236 - RNA, 17 nt, Mycobacterium avium subsp. paratuberculosis
cggccacacuggcguga

SEQ ID NO: 2910237 - RNA, 19 nt, Mycobacterium avium subsp. paratuberculosis
cggccacacuggcgugacg

SEQ ID NO: 2910238 - RNA, 20 nt, Mycobacterium avium subsp. paratuberculosis
cggccaccaacaggucggcg

SEQ ID NO: 2910239 - RNA, 23 nt, Mycobacterium avium subsp. paratuberculosis
cggccaccaacaggucggcgugc

SEQ ID NO: 2910240 - RNA, 19 nt, Mycobacterium avium subsp. paratuberculosis
cggccaccaacggcagcag

SEQ ID NO: 2910241 - RNA, 20 nt, Mycobacterium avium subsp. paratuberculosis
cggccaccaacggcagcagc

SEQ ID NO: 2910242 - RNA, 12 nt, Mycobacterium avium subsp. paratuberculosis
cggccaccacca

SEQ ID NO: 2910243 - RNA, 14 nt, Mycobacterium avium subsp. paratuberculosis
cggccaccaccacg

SEQ ID NO: 2910244 - RNA, 16 nt, Mycobacterium avium subsp. paratuberculosis
cggccaccaccacggc

SEQ ID NO: 2910245 - RNA, 18 nt, Mycobacterium avium subsp. paratuberculosis
cggccaccaccacggcca

SEQ ID NO: 2910246 - RNA, 20 nt, Mycobacterium avium subsp. paratuberculosis
cggccaccaccacggccaug

SEQ ID NO: 2910247 - RNA, 14 nt, Mycobacterium avium subsp. paratuberculosis
cggccaccaccgcc

SEQ ID NO: 2910248 - RNA, 16 nt, Mycobacterium avium subsp. paratuberculosis
cggccaccaccgccac

SEQ ID NO: 2910249 - RNA, 17 nt, Mycobacterium avium subsp. paratuberculosis
cggccaccaccgccacg

SEQ ID NO: 2910250 - RNA, 19 nt, Mycobacterium avium subsp. paratuberculosis
cggccaccaccgccacggc

SEQ ID NO: 2910251 - RNA, 16 nt, Mycobacterium avium subsp. paratuberculosis
cggccaccaccucgcg

SEQ ID NO: 2910252 - RNA, 13 nt, Mycobacterium avium subsp. paratuberculosis
cggccaccacgac

SEQ ID NO: 2910253 - RNA, 17 nt, Mycobacterium avium subsp. paratuberculosis
cggccaccacgacgccg

SEQ ID NO: 2910254 - RNA, 18 nt, Mycobacterium avium subsp. paratuberculosis
cggccaccacgacgccgg

SEQ ID NO: 2910255 - RNA, 21 nt, Mycobacterium avium subsp. paratuberculosis
cggccaccacgacgccgggcg

SEQ ID NO: 2910256 - RNA, 20 nt, Mycobacterium avium subsp. paratuberculosis
cggccaccacggcaccgccg

SEQ ID NO: 2910257 - RNA, 12 nt, Mycobacterium avium subsp. paratuberculosis
cggccaccacuu

SEQ ID NO: 2910258 - RNA, 21 nt, Mycobacterium avium subsp. paratuberculosis
cggccaccagaugccgggcuc

SEQ ID NO: 2910259 - RNA, 23 nt, Mycobacterium avium subsp. paratuberculosis
cggccaccagaugccgggcuccg

SEQ ID NO: 2910260 - RNA, 14 nt, Mycobacterium avium subsp. paratuberculosis
cggccaccagcagc

SEQ ID NO: 2910261 - RNA, 16 nt, Mycobacterium avium subsp. paratuberculosis
cggccaccagcagcga

SEQ ID NO: 2910262 - RNA, 17 nt, Mycobacterium avium subsp. paratuberculosis
cggccaccagcagcgag

SEQ ID NO: 2910263 - RNA, 15 nt, Mycobacterium avium subsp. paratuberculosis
cggccaccagccggc

SEQ ID NO: 2910264 - RNA, 16 nt, Mycobacterium avium subsp. paratuberculosis
cggccaccagccggcc

SEQ ID NO: 2910265 - RNA, 19 nt, Mycobacterium avium subsp. paratuberculosis
cggccaccagccggccggc

SEQ ID NO: 2910266 - RNA, 22 nt, Mycobacterium avium subsp. paratuberculosis
cggccaccagccggccggccga

SEQ ID NO: 2910267 - RNA, 14 nt, Mycobacterium avium subsp. paratuberculosis
cggccaccagcgcc

SEQ ID NO: 2910268 - RNA, 15 nt, Mycobacterium avium subsp. paratuberculosis
cggccaccagcgccc

SEQ ID NO: 2910269 - RNA, 17 nt, Mycobacterium avium subsp. paratuberculosis
cggccaccagcgcccgc

SEQ ID NO: 2910270 - RNA, 17 nt, Mycobacterium avium subsp. paratuberculosis
cggccaccagcgcggcc

SEQ ID NO: 2910271 - RNA, 13 nt, Mycobacterium avium subsp. paratuberculosis
cggccaccagcgg

SEQ ID NO: 2910272 - RNA, 22 nt, Mycobacterium avium subsp. paratuberculosis
cggccaccagcggccggaacag

SEQ ID NO: 2910273 - RNA, 14 nt, Mycobacterium avium subsp. paratuberculosis
cggccaccagggcg

SEQ ID NO: 2910274 - RNA, 15 nt, Mycobacterium avium subsp. paratuberculosis
cggccaccagggcga

SEQ ID NO: 2910275 - RNA, 16 nt, Mycobacterium avium subsp. paratuberculosis
cggccaccagggcgac

SEQ ID NO: 2910276 - RNA, 19 nt, Mycobacterium avium subsp. paratuberculosis
cggccaccagggcgaccgc

SEQ ID NO: 2910277 - RNA, 20 nt, Mycobacterium avium subsp. paratuberculosis
cggccaccagggcgaccgcc

SEQ ID NO: 2910278 - RNA, 21 nt, Mycobacterium avium subsp. paratuberculosis
cggccaccagggcgaccgccg

SEQ ID NO: 2910279 - RNA, 22 nt, Mycobacterium avium subsp. paratuberculosis
cggccaccagggcgaccgccgc

SEQ ID NO: 2910280 - RNA, 23 nt, Mycobacterium avium subsp. paratuberculosis
cggccaccagggcgaccgccgcg

SEQ ID NO: 2910281 - RNA, 23 nt, Mycobacterium avium subsp. paratuberculosis
cggccaccaggucgcacaccagc

SEQ ID NO: 2910282 - RNA, 20 nt, Mycobacterium avium subsp. paratuberculosis
cggccaccaucuccgcggcg

SEQ ID NO: 2910283 - RNA, 23 nt, Mycobacterium avium subsp. paratuberculosis
cggccaccaucuccgcggcgcgg

SEQ ID NO: 2910284 - RNA, 14 nt, Mycobacterium avium subsp. paratuberculosis
cggccaccaugccg

SEQ ID NO: 2910285 - RNA, 19 nt, Mycobacterium avium subsp. paratuberculosis
cggccaccaugccggcguc

SEQ ID NO: 2910286 - RNA, 17 nt, Mycobacterium avium subsp. paratuberculosis
cggccaccaugucggcg

SEQ ID NO: 2910287 - RNA, 19 nt, Mycobacterium avium subsp. paratuberculosis
cggccaccaugucggcguc

SEQ ID NO: 2910288 - RNA, 23 nt, Mycobacterium avium subsp. paratuberculosis
cggccaccccgcagaacaccagc

SEQ ID NO: 2910289 - RNA, 21 nt, Mycobacterium avium subsp. paratuberculosis
cggccaccccggugaccuccc

SEQ ID NO: 2910290 - RNA, 19 nt, Mycobacterium avium subsp. paratuberculosis
cggccaccgccccagccga

SEQ ID NO: 2910291 - RNA, 22 nt, Mycobacterium avium subsp. paratuberculosis
cggccaccgccccagccgacca

SEQ ID NO: 2910292 - RNA, 12 nt, Mycobacterium avium subsp. paratuberculosis
cggccaccgccg

SEQ ID NO: 2910293 - RNA, 13 nt, Mycobacterium avium subsp. paratuberculosis
cggccaccgccgc

SEQ ID NO: 2910294 - RNA, 14 nt, Mycobacterium avium subsp. paratuberculosis
cggccaccgccgcc

SEQ ID NO: 2910295 - RNA, 17 nt, Mycobacterium avium subsp. paratuberculosis
cggccaccgccgccagc

SEQ ID NO: 2910296 - RNA, 18 nt, Mycobacterium avium subsp. paratuberculosis
cggccaccgccgccagca

SEQ ID NO: 2910297 - RNA, 20 nt, Mycobacterium avium subsp. paratuberculosis
cggccaccgccgccagcagc

SEQ ID NO: 2910298 - RNA, 12 nt, Mycobacterium avium subsp. paratuberculosis
cggccaccgcga

SEQ ID NO: 2910299 - RNA, 14 nt, Mycobacterium avium subsp. paratuberculosis
cggccaccgcgauc

SEQ ID NO: 2910300 - RNA, 13 nt, Mycobacterium avium subsp. paratuberculosis
cggccaccgcgcc

SEQ ID NO: 2910301 - RNA, 15 nt, Mycobacterium avium subsp. paratuberculosis
cggccaccgcgcccc

SEQ ID NO: 2910302 - RNA, 17 nt, Mycobacterium avium subsp. paratuberculosis
cggccaccgcgccccgg

SEQ ID NO: 2910303 - RNA, 19 nt, Mycobacterium avium subsp. paratuberculosis
cggccaccgcgccccggcg

SEQ ID NO: 2910304 - RNA, 20 nt, Mycobacterium avium subsp. paratuberculosis
cggccaccgcgccccggcgc

SEQ ID NO: 2910305 - RNA, 15 nt, Mycobacterium avium subsp. paratuberculosis
cggccaccgcgcgcu

SEQ ID NO: 2910306 - RNA, 16 nt, Mycobacterium avium subsp. paratuberculosis
cggccaccgcgcgcug

SEQ ID NO: 2910307 - RNA, 19 nt, Mycobacterium avium subsp. paratuberculosis
cggccaccgcgcgcugccg

SEQ ID NO: 2910308 - RNA, 14 nt, Mycobacterium avium subsp. paratuberculosis
cggccaccgcgcgg

SEQ ID NO: 2910309 - RNA, 16 nt, Mycobacterium avium subsp. paratuberculosis
cggccaccgcgcggcg

SEQ ID NO: 2910310 - RNA, 14 nt, Mycobacterium avium subsp. paratuberculosis
cggccaccgcgguc

SEQ ID NO: 2910311 - RNA, 15 nt, Mycobacterium avium subsp. paratuberculosis
cggccaccgcggucg

SEQ ID NO: 2910312 - RNA, 15 nt, Mycobacterium avium subsp. paratuberculosis
cggccaccgcguccg

SEQ ID NO: 2910313 - RNA, 12 nt, Mycobacterium avium subsp. paratuberculosis
cggccaccggcg

SEQ ID NO: 2910314 - RNA, 15 nt, Mycobacterium avium subsp. paratuberculosis
cggccaccggcgcga

SEQ ID NO: 2910315 - RNA, 16 nt, Mycobacterium avium subsp. paratuberculosis
cggccaccggcgcgac

SEQ ID NO: 2910316 - RNA, 17 nt, Mycobacterium avium subsp. paratuberculosis
cggccaccggcgcgacg

SEQ ID NO: 2910317 - RNA, 19 nt, Mycobacterium avium subsp. paratuberculosis
cggccaccggcgcgacggc

SEQ ID NO: 2910318 - RNA, 23 nt, Mycobacterium avium subsp. paratuberculosis
cggccaccggcgcgacggcggcg

SEQ ID NO: 2910319 - RNA, 20 nt, Mycobacterium avium subsp. paratuberculosis
cggccaccgggucguccgcg

SEQ ID NO: 2910320 - RNA, 20 nt, Mycobacterium avium subsp. paratuberculosis
cggccaccgucagcgucagc

SEQ ID NO: 2910321 - RNA, 16 nt, Mycobacterium avium subsp. paratuberculosis
cggccaccuccagccc

SEQ ID NO: 2910322 - RNA, 17 nt, Mycobacterium avium subsp. paratuberculosis
cggccaccuccagcccg

SEQ ID NO: 2910323 - RNA, 14 nt, Mycobacterium avium subsp. paratuberculosis
cggccaccucgccg

SEQ ID NO: 2910324 - RNA, 19 nt, Mycobacterium avium subsp. paratuberculosis
cggccaccucgccgcaggc

SEQ ID NO: 2910325 - RNA, 23 nt, Mycobacterium avium subsp. paratuberculosis
cggccaccucgccgcaggcgucc

SEQ ID NO: 2910326 - RNA, 17 nt, Mycobacterium avium subsp. paratuberculosis
cggccaccucggcggca

SEQ ID NO: 2910327 - RNA, 19 nt, Mycobacterium avium subsp. paratuberculosis
cggccaccucggcggcacc

SEQ ID NO: 2910328 - RNA, 22 nt, Mycobacterium avium subsp. paratuberculosis
cggccaccucggcggcaccgcc

SEQ ID NO: 2910329 - RNA, 15 nt, Mycobacterium avium subsp. paratuberculosis
cggccaccucguccc

SEQ ID NO: 2910330 - RNA, 19 nt, Mycobacterium avium subsp. paratuberculosis
cggccaccucgucccagcg

SEQ ID NO: 2910331 - RNA, 20 nt, Mycobacterium avium subsp. paratuberculosis
cggccaccucgucccagcgc

SEQ ID NO: 2910332 - RNA, 21 nt, Mycobacterium avium subsp. paratuberculosis
cggccaccucgucccagcgca

SEQ ID NO: 2910333 - RNA, 19 nt, Mycobacterium avium subsp. paratuberculosis
cggccaccucgucggcggu

SEQ ID NO: 2910334 - RNA, 23 nt, Mycobacterium avium subsp. paratuberculosis
cggccaccucgucggcggucaac

SEQ ID NO: 2910335 - RNA, 19 nt, Mycobacterium avium subsp. paratuberculosis
cggccaccugggcggggcu

SEQ ID NO: 2910336 - RNA, 20 nt, Mycobacterium avium subsp. paratuberculosis
cggccaccugggcggggcug

SEQ ID NO: 2910337 - RNA, 17 nt, Mycobacterium avium subsp. paratuberculosis
cggccaccuugucggcg

SEQ ID NO: 2910338 - RNA, 22 nt, Mycobacterium avium subsp. paratuberculosis
cggccaccuugucggcgcccag

SEQ ID NO: 2910339 - RNA, 20 nt, Mycobacterium avium subsp. paratuberculosis
cggccacgaccucggggucg

SEQ ID NO: 2910340 - RNA, 22 nt, Mycobacterium avium subsp. paratuberculosis
cggccacgacgcgccacgcccc

SEQ ID NO: 2910341 - RNA, 16 nt, Mycobacterium avium subsp. paratuberculosis
cggccacgacgcggcg

SEQ ID NO: 2910342 - RNA, 18 nt, Mycobacterium avium subsp. paratuberculosis
cggccacgacgcggcgcg

SEQ ID NO: 2910343 - RNA, 21 nt, Mycobacterium avium subsp. paratuberculosis
cggccacgacggcgcuggccg

SEQ ID NO: 2910344 - RNA, 19 nt, Mycobacterium avium subsp. paratuberculosis
cggccacgaucgcggccag

SEQ ID NO: 2910345 - RNA, 23 nt, Mycobacterium avium subsp. paratuberculosis
cggccacgaucgcggccagcgug

SEQ ID NO: 2910346 - RNA, 16 nt, Mycobacterium avium subsp. paratuberculosis
cggccacgcaggcguc

SEQ ID NO: 2910347 - RNA, 17 nt, Mycobacterium avium subsp. paratuberculosis
cggccacgcaggcgucc

SEQ ID NO: 2910348 - RNA, 23 nt, Mycobacterium avium subsp. paratuberculosis
cggccacgcaggcguccagggcc

SEQ ID NO: 2910349 - RNA, 17 nt, Mycobacterium avium subsp. paratuberculosis
cggccacgcccuggccg

SEQ ID NO: 2910350 - RNA, 19 nt, Mycobacterium avium subsp. paratuberculosis
cggccacgcccuggccgcc

SEQ ID NO: 2910351 - RNA, 20 nt, Mycobacterium avium subsp. paratuberculosis
cggccacgcccuggccgccg

SEQ ID NO: 2910352 - RNA, 21 nt, Mycobacterium avium subsp. paratuberculosis
cggccacgccgggcauccgcc

SEQ ID NO: 2910353 - RNA, 14 nt, Mycobacterium avium subsp. paratuberculosis
cggccacgcucgcc

SEQ ID NO: 2910354 - RNA, 17 nt, Mycobacterium avium subsp. paratuberculosis
cggccacgcucgccaga

SEQ ID NO: 2910355 - RNA, 22 nt, Mycobacterium avium subsp. paratuberculosis
cggccacgcucgccagaccggu

SEQ ID NO: 2910356 - RNA, 13 nt, Mycobacterium avium subsp. paratuberculosis
cggccacgcucgg

SEQ ID NO: 2910357 - RNA, 15 nt, Mycobacterium avium subsp. paratuberculosis
cggccacgcucggcg

SEQ ID NO: 2910358 - RNA, 16 nt, Mycobacterium avium subsp. paratuberculosis
cggccacgcucggcgg

SEQ ID NO: 2910359 - RNA, 20 nt, Mycobacterium avium subsp. paratuberculosis
cggccacgcucggcggcgcg

SEQ ID NO: 2910360 - RNA, 21 nt, Mycobacterium avium subsp. paratuberculosis
cggccacgcucggcggcgcgc

SEQ ID NO: 2910361 - RNA, 18 nt, Mycobacterium avium subsp. paratuberculosis
cggccacgcucgggccgg

SEQ ID NO: 2910362 - RNA, 21 nt, Mycobacterium avium subsp. paratuberculosis
cggccacgcucgggccggcgc

SEQ ID NO: 2910363 - RNA, 14 nt, Mycobacterium avium subsp. paratuberculosis
cggccacgucgaug

SEQ ID NO: 2910364 - RNA, 12 nt, Mycobacterium avium subsp. paratuberculosis
cggccacguugc

SEQ ID NO: 2910365 - RNA, 16 nt, Mycobacterium avium subsp. paratuberculosis
cggccacguugccggg

SEQ ID NO: 2910366 - RNA, 17 nt, Mycobacterium avium subsp. paratuberculosis
cggccacguugccgggu

SEQ ID NO: 2910367 - RNA, 15 nt, Mycobacterium avium subsp. paratuberculosis
cggccacucgccgcg

SEQ ID NO: 2910368 - RNA, 18 nt, Mycobacterium avium subsp. paratuberculosis
cggccacucgccgcgaac

SEQ ID NO: 2910369 - RNA, 14 nt, Mycobacterium avium subsp. paratuberculosis
cggccacugccccg

SEQ ID NO: 2910370 - RNA, 17 nt, Mycobacterium avium subsp. paratuberculosis
cggccacugccccggcg

SEQ ID NO: 2910371 - RNA, 18 nt, Mycobacterium avium subsp. paratuberculosis
cggccacugccccggcga

SEQ ID NO: 2910372 - RNA, 20 nt, Mycobacterium avium subsp. paratuberculosis
cggccacugccccggcgaac

SEQ ID NO: 2910373 - RNA, 23 nt, Mycobacterium avium subsp. paratuberculosis
cggccacugccccggcgaacgcc

SEQ ID NO: 2910374 - RNA, 15 nt, Mycobacterium avium subsp. paratuberculosis
cggccagauagauga

SEQ ID NO: 2910375 - RNA, 22 nt, Mycobacterium avium subsp. paratuberculosis
cggccagauagaugagccgcag

SEQ ID NO: 2910376 - RNA, 16 nt, Mycobacterium avium subsp. paratuberculosis
cggccagaucgacgcc

SEQ ID NO: 2910377 - RNA, 18 nt, Mycobacterium avium subsp. paratuberculosis
cggccagaucgacgccgc

SEQ ID NO: 2910378 - RNA, 16 nt, Mycobacterium avium subsp. paratuberculosis
cggccagaucggccag

SEQ ID NO: 2910379 - RNA, 20 nt, Mycobacterium avium subsp. paratuberculosis
cggccagaucggccagguug

SEQ ID NO: 2910380 - RNA, 15 nt, Mycobacterium avium subsp. paratuberculosis
cggccagcacacccu

SEQ ID NO: 2910381 - RNA, 16 nt, Mycobacterium avium subsp. paratuberculosis
cggccagcacacccuc

SEQ ID NO: 2910382 - RNA, 22 nt, Mycobacterium avium subsp. paratuberculosis
cggccagcacacccucgacccg

SEQ ID NO: 2910383 - RNA, 12 nt, Mycobacterium avium subsp. paratuberculosis
cggccagcacca

SEQ ID NO: 2910384 - RNA, 14 nt, Mycobacterium avium subsp. paratuberculosis
cggccagcaccacc

SEQ ID NO: 2910385 - RNA, 16 nt, Mycobacterium avium subsp. paratuberculosis
cggccagcaccaccaa

SEQ ID NO: 2910386 - RNA, 21 nt, Mycobacterium avium subsp. paratuberculosis
cggccagcaccacggugaucu

SEQ ID NO: 2910387 - RNA, 13 nt, Mycobacterium avium subsp. paratuberculosis
cggccagcaccag

SEQ ID NO: 2910388 - RNA, 15 nt, Mycobacterium avium subsp. paratuberculosis
cggccagcaccagca

SEQ ID NO: 2910389 - RNA, 17 nt, Mycobacterium avium subsp. paratuberculosis
cggccagcaccagcagc

SEQ ID NO: 2910390 - RNA, 20 nt, Mycobacterium avium subsp. paratuberculosis
cggccagcaccagcagccgg

SEQ ID NO: 2910391 - RNA, 22 nt, Mycobacterium avium subsp. paratuberculosis
cggccagcaccagcagccgguc

SEQ ID NO: 2910392 - RNA, 14 nt, Mycobacterium avium subsp. paratuberculosis
cggccagcaccagg

SEQ ID NO: 2910393 - RNA, 16 nt, Mycobacterium avium subsp. paratuberculosis
cggccagcaccaggaa

SEQ ID NO: 2910394 - RNA, 19 nt, Mycobacterium avium subsp. paratuberculosis
cggccagcaccaggaaggc

SEQ ID NO: 2910395 - RNA, 17 nt, Mycobacterium avium subsp. paratuberculosis
cggccagcacccgcuga

SEQ ID NO: 2910396 - RNA, 18 nt, Mycobacterium avium subsp. paratuberculosis
cggccagcacccgcugau

SEQ ID NO: 2910397 - RNA, 13 nt, Mycobacterium avium subsp. paratuberculosis
cggccagcaccgc

SEQ ID NO: 2910398 - RNA, 15 nt, Mycobacterium avium subsp. paratuberculosis
cggccagcaccgcca

SEQ ID NO: 2910399 - RNA, 17 nt, Mycobacterium avium subsp. paratuberculosis
cggccagcaccgccagc

SEQ ID NO: 2910400 - RNA, 19 nt, Mycobacterium avium subsp. paratuberculosis
cggccagcaccgccagcgc

SEQ ID NO: 2910401 - RNA, 20 nt, Mycobacterium avium subsp. paratuberculosis
cggccagcaccgccagcgcc

SEQ ID NO: 2910402 - RNA, 22 nt, Mycobacterium avium subsp. paratuberculosis
cggccagcacgaacaccacgua

SEQ ID NO: 2910403 - RNA, 14 nt, Mycobacterium avium subsp. paratuberculosis
cggccagcacgccg

SEQ ID NO: 2910404 - RNA, 15 nt, Mycobacterium avium subsp. paratuberculosis
cggccagcacggcca

SEQ ID NO: 2910405 - RNA, 16 nt, Mycobacterium avium subsp. paratuberculosis
cggccagcacggccag

SEQ ID NO: 2910406 - RNA, 17 nt, Mycobacterium avium subsp. paratuberculosis
cggccagcacggccagc

SEQ ID NO: 2910407 - RNA, 20 nt, Mycobacterium avium subsp. paratuberculosis
cggccagcacggccagccag

SEQ ID NO: 2910408 - RNA, 14 nt, Mycobacterium avium subsp. paratuberculosis
cggccagcacggcg

SEQ ID NO: 2910409 - RNA, 15 nt, Mycobacterium avium subsp. paratuberculosis
cggccagcacggcgg

SEQ ID NO: 2910410 - RNA, 17 nt, Mycobacterium avium subsp. paratuberculosis
cggccagcacggcggcg

SEQ ID NO: 2910411 - RNA, 19 nt, Mycobacterium avium subsp. paratuberculosis
cggccagcacggcggcgug

SEQ ID NO: 2910412 - RNA, 20 nt, Mycobacterium avium subsp. paratuberculosis
cggccagcacggcggcgugc

SEQ ID NO: 2910413 - RNA, 15 nt, Mycobacterium avium subsp. paratuberculosis
cggccagcacgguca

SEQ ID NO: 2910414 - RNA, 17 nt, Mycobacterium avium subsp. paratuberculosis
cggccagcacggucagc

SEQ ID NO: 2910415 - RNA, 11 nt, Mycobacterium avium subsp. paratuberculosis
cggccagcagc

SEQ ID NO: 2910416 - RNA, 14 nt, Mycobacterium avium subsp. paratuberculosis
cggccagcagcacc

SEQ ID NO: 2910417 - RNA, 16 nt, Mycobacterium avium subsp. paratuberculosis
cggccagcagcaccag

SEQ ID NO: 2910418 - RNA, 17 nt, Mycobacterium avium subsp. paratuberculosis
cggccagcagcaccaga

SEQ ID NO: 2910419 - RNA, 17 nt, Mycobacterium avium subsp. paratuberculosis
cggccagcagcaccagg

SEQ ID NO: 2910420 - RNA, 18 nt, Mycobacterium avium subsp. paratuberculosis
cggccagcagcaccaggg

SEQ ID NO: 2910421 - RNA, 16 nt, Mycobacterium avium subsp. paratuberculosis
cggccagcagcaccgc

SEQ ID NO: 2910422 - RNA, 17 nt, Mycobacterium avium subsp. paratuberculosis
cggccagcagcaccgcg

SEQ ID NO: 2910423 - RNA, 19 nt, Mycobacterium avium subsp. paratuberculosis
cggccagcagcaccgcguu

SEQ ID NO: 2910424 - RNA, 20 nt, Mycobacterium avium subsp. paratuberculosis
cggccagcagcagcccgccg

SEQ ID NO: 2910425 - RNA, 21 nt, Mycobacterium avium subsp. paratuberculosis
cggccagcagcagcccgccga

SEQ ID NO: 2910426 - RNA, 14 nt, Mycobacterium avium subsp. paratuberculosis
cggccagcagcagg

SEQ ID NO: 2910427 - RNA, 13 nt, Mycobacterium avium subsp. paratuberculosis
cggccagcagccg

SEQ ID NO: 2910428 - RNA, 16 nt, Mycobacterium avium subsp. paratuberculosis
cggccagcagccgcuc

SEQ ID NO: 2910429 - RNA, 18 nt, Mycobacterium avium subsp. paratuberculosis
cggccagcagccgcucgu

SEQ ID NO: 2910430 - RNA, 15 nt, Mycobacterium avium subsp. paratuberculosis
cggccagcagccggu

SEQ ID NO: 2910431 - RNA, 12 nt, Mycobacterium avium subsp. paratuberculosis
cggccagcagcg

SEQ ID NO: 2910432 - RNA, 17 nt, Mycobacterium avium subsp. paratuberculosis
cggccagcagcgcgucg

SEQ ID NO: 2910433 - RNA, 20 nt, Mycobacterium avium subsp. paratuberculosis
cggccagcagcgcgucgcgg

SEQ ID NO: 2910434 - RNA, 14 nt, Mycobacterium avium subsp. paratuberculosis
cggccagcagcggc

SEQ ID NO: 2910435 - RNA, 16 nt, Mycobacterium avium subsp. paratuberculosis
cggccagcagcggcuu

SEQ ID NO: 2910436 - RNA, 17 nt, Mycobacterium avium subsp. paratuberculosis
cggccagcagggcgccg

SEQ ID NO: 2910437 - RNA, 12 nt, Mycobacterium avium subsp. paratuberculosis
cggccagcaggu

SEQ ID NO: 2910438 - RNA, 14 nt, Mycobacterium avium subsp. paratuberculosis
cggccagcaggucg

SEQ ID NO: 2910439 - RNA, 17 nt, Mycobacterium avium subsp. paratuberculosis
cggccagcaggucgucg

SEQ ID NO: 2910440 - RNA, 18 nt, Mycobacterium avium subsp. paratuberculosis
cggccagcaggucgucga

SEQ ID NO: 2910441 - RNA, 12 nt, Mycobacterium avium subsp. paratuberculosis
cggccagcaucg

SEQ ID NO: 2910442 - RNA, 14 nt, Mycobacterium avium subsp. paratuberculosis
cggccagcaucgga

SEQ ID NO: 2910443 - RNA, 16 nt, Mycobacterium avium subsp. paratuberculosis
cggccagccacgccga

SEQ ID NO: 2910444 - RNA, 18 nt, Mycobacterium avium subsp. paratuberculosis
cggccagccacgccgaca

SEQ ID NO: 2910445 - RNA, 19 nt, Mycobacterium avium subsp. paratuberculosis
cggccagccacgccgacac

SEQ ID NO: 2910446 - RNA, 20 nt, Mycobacterium avium subsp. paratuberculosis
cggccagccacgccgacacc

SEQ ID NO: 2910447 - RNA, 18 nt, Mycobacterium avium subsp. paratuberculosis
cggccagccagccgccca

SEQ ID NO: 2910448 - RNA, 20 nt, Mycobacterium avium subsp. paratuberculosis
cggccagccagccgcccagc

SEQ ID NO: 2910449 - RNA, 18 nt, Mycobacterium avium subsp. paratuberculosis
cggccagccaggccgucg

SEQ ID NO: 2910450 - RNA, 19 nt, Mycobacterium avium subsp. paratuberculosis
cggccagccaggccgucgg

SEQ ID NO: 2910451 - RNA, 21 nt, Mycobacterium avium subsp. paratuberculosis
cggccagccaggccgucggcg

SEQ ID NO: 2910452 - RNA, 17 nt, Mycobacterium avium subsp. paratuberculosis
cggccagcccaucccga

SEQ ID NO: 2910453 - RNA, 14 nt, Mycobacterium avium subsp. paratuberculosis
cggccagccccacc

SEQ ID NO: 2910454 - RNA, 15 nt, Mycobacterium avium subsp. paratuberculosis
cggccagccccacca

SEQ ID NO: 2910455 - RNA, 18 nt, Mycobacterium avium subsp. paratuberculosis
cggccagccccaccaccg

SEQ ID NO: 2910456 - RNA, 20 nt, Mycobacterium avium subsp. paratuberculosis
cggccagccccaccaccgcc

SEQ ID NO: 2910457 - RNA, 22 nt, Mycobacterium avium subsp. paratuberculosis
cggccagccccaccaccgccac

SEQ ID NO: 2910458 - RNA, 21 nt, Mycobacterium avium subsp. paratuberculosis
cggccagccccgggaaccagc

SEQ ID NO: 2910459 - RNA, 18 nt, Mycobacterium avium subsp. paratuberculosis
cggccagcccgcggcagc

SEQ ID NO: 2910460 - RNA, 20 nt, Mycobacterium avium subsp. paratuberculosis
cggccagcccgcggcagcca

SEQ ID NO: 2910461 - RNA, 22 nt, Mycobacterium avium subsp. paratuberculosis
cggccagcccgcggcagccagc

SEQ ID NO: 2910462 - RNA, 14 nt, Mycobacterium avium subsp. paratuberculosis
cggccagcccgucg

SEQ ID NO: 2910463 - RNA, 15 nt, Mycobacterium avium subsp. paratuberculosis
cggccagcccgucgg

SEQ ID NO: 2910464 - RNA, 13 nt, Mycobacterium avium subsp. paratuberculosis
cggccagccgcgc

SEQ ID NO: 2910465 - RNA, 14 nt, Mycobacterium avium subsp. paratuberculosis
cggccagccgcgcg

SEQ ID NO: 2910466 - RNA, 15 nt, Mycobacterium avium subsp. paratuberculosis
cggccagccgcgcga

SEQ ID NO: 2910467 - RNA, 17 nt, Mycobacterium avium subsp. paratuberculosis
cggccagccgcgcgacg

SEQ ID NO: 2910468 - RNA, 18 nt, Mycobacterium avium subsp. paratuberculosis
cggccagccgcucccggc

SEQ ID NO: 2910469 - RNA, 16 nt, Mycobacterium avium subsp. paratuberculosis
cggccagccggccgcu

SEQ ID NO: 2910470 - RNA, 14 nt, Mycobacterium avium subsp. paratuberculosis
cggccagccgggcg

SEQ ID NO: 2910471 - RNA, 18 nt, Mycobacterium avium subsp. paratuberculosis
cggccagccgggcggcca

SEQ ID NO: 2910472 - RNA, 19 nt, Mycobacterium avium subsp. paratuberculosis
cggccagccgggcggccag

SEQ ID NO: 2910473 - RNA, 23 nt, Mycobacterium avium subsp. paratuberculosis
cggccagccgggcggccagggug

SEQ ID NO: 2910474 - RNA, 14 nt, Mycobacterium avium subsp. paratuberculosis
cggccagccggggg

SEQ ID NO: 2910475 - RNA, 19 nt, Mycobacterium avium subsp. paratuberculosis
cggccagccgggggaucac

SEQ ID NO: 2910476 - RNA, 18 nt, Mycobacterium avium subsp. paratuberculosis
cggccagccggucgucgg

SEQ ID NO: 2910477 - RNA, 21 nt, Mycobacterium avium subsp. paratuberculosis
cggccagccggucgucggggc

SEQ ID NO: 2910478 - RNA, 23 nt, Mycobacterium avium subsp. paratuberculosis
cggccagcgagaagucgcucagc

SEQ ID NO: 2910479 - RNA, 14 nt, Mycobacterium avium subsp. paratuberculosis
cggccagcgaggug

SEQ ID NO: 2910480 - RNA, 15 nt, Mycobacterium avium subsp. paratuberculosis
cggccagcgaggugg

SEQ ID NO: 2910481 - RNA, 17 nt, Mycobacterium avium subsp. paratuberculosis
cggccagcgaguccagc

SEQ ID NO: 2910482 - RNA, 21 nt, Mycobacterium avium subsp. paratuberculosis
cggccagcgaguccagccagc

SEQ ID NO: 2910483 - RNA, 23 nt, Mycobacterium avium subsp. paratuberculosis
cggccagcgaguccagccagccg

SEQ ID NO: 2910484 - RNA, 20 nt, Mycobacterium avium subsp. paratuberculosis
cggccagcgagucgaugacc

SEQ ID NO: 2910485 - RNA, 11 nt, Mycobacterium avium subsp. paratuberculosis
cggccagcgca

SEQ ID NO: 2910486 - RNA, 13 nt, Mycobacterium avium subsp. paratuberculosis
cggccagcgcagc

SEQ ID NO: 2910487 - RNA, 23 nt, Mycobacterium avium subsp. paratuberculosis
cggccagcgcagguacgcggcgu

SEQ ID NO: 2910488 - RNA, 13 nt, Mycobacterium avium subsp. paratuberculosis
cggccagcgcccc

SEQ ID NO: 2910489 - RNA, 17 nt, Mycobacterium avium subsp. paratuberculosis
cggccagcgccccgccg

SEQ ID NO: 2910490 - RNA, 18 nt, Mycobacterium avium subsp. paratuberculosis
cggccagcgccccgccgg

SEQ ID NO: 2910491 - RNA, 17 nt, Mycobacterium avium subsp. paratuberculosis
cggccagcgcccgcgcg

SEQ ID NO: 2910492 - RNA, 21 nt, Mycobacterium avium subsp. paratuberculosis
cggccagcgcccgcgcgaucg

SEQ ID NO: 2910493 - RNA, 23 nt, Mycobacterium avium subsp. paratuberculosis
cggccagcgcccgcgcgaucggc

SEQ ID NO: 2910494 - RNA, 24 nt, Mycobacterium avium subsp. paratuberculosis
cggccagcgcccgcgcgaucggcg

SEQ ID NO: 2910495 - RNA, 16 nt, Mycobacterium avium subsp. paratuberculosis
cggccagcgcccgcgg

SEQ ID NO: 2910496 - RNA, 17 nt, Mycobacterium avium subsp. paratuberculosis
cggccagcgcccgcggg

SEQ ID NO: 2910497 - RNA, 18 nt, Mycobacterium avium subsp. paratuberculosis
cggccagcgcccgcgggu

SEQ ID NO: 2910498 - RNA, 19 nt, Mycobacterium avium subsp. paratuberculosis
cggccagcgcccgcgggug

SEQ ID NO: 2910499 - RNA, 12 nt, Mycobacterium avium subsp. paratuberculosis
cggccagcgccg

SEQ ID NO: 2910500 - RNA, 13 nt, Mycobacterium avium subsp. paratuberculosis
cggccagcgccgc

SEQ ID NO: 2910501 - RNA, 15 nt, Mycobacterium avium subsp. paratuberculosis
cggccagcgccgccc

SEQ ID NO: 2910502 - RNA, 17 nt, Mycobacterium avium subsp. paratuberculosis
cggccagcgccgcccgg

SEQ ID NO: 2910503 - RNA, 18 nt, Mycobacterium avium subsp. paratuberculosis
cggccagcgccgcccggg

SEQ ID NO: 2910504 - RNA, 19 nt, Mycobacterium avium subsp. paratuberculosis
cggccagcgccgcccgggc

SEQ ID NO: 2910505 - RNA, 21 nt, Mycobacterium avium subsp. paratuberculosis
cggccagcgccgcccgggcgg

SEQ ID NO: 2910506 - RNA, 14 nt, Mycobacterium avium subsp. paratuberculosis
cggccagcgccgcg

SEQ ID NO: 2910507 - RNA, 16 nt, Mycobacterium avium subsp. paratuberculosis
cggccagcgccgcgcg

SEQ ID NO: 2910508 - RNA, 17 nt, Mycobacterium avium subsp. paratuberculosis
cggccagcgccgcgcgc

SEQ ID NO: 2910509 - RNA, 21 nt, Mycobacterium avium subsp. paratuberculosis
cggccagcgccgcgcgcgcgg

SEQ ID NO: 2910510 - RNA, 13 nt, Mycobacterium avium subsp. paratuberculosis
cggccagcgccgu

SEQ ID NO: 2910511 - RNA, 14 nt, Mycobacterium avium subsp. paratuberculosis
cggccagcgccguc

SEQ ID NO: 2910512 - RNA, 15 nt, Mycobacterium avium subsp. paratuberculosis
cggccagcgccguca

SEQ ID NO: 2910513 - RNA, 23 nt, Mycobacterium avium subsp. paratuberculosis
cggccagcgccgucaucaccgcc

SEQ ID NO: 2910514 - RNA, 12 nt, Mycobacterium avium subsp. paratuberculosis
cggccagcgccu

SEQ ID NO: 2910515 - RNA, 18 nt, Mycobacterium avium subsp. paratuberculosis
cggccagcgccuucucca

SEQ ID NO: 2910516 - RNA, 12 nt, Mycobacterium avium subsp. paratuberculosis
cggccagcgcga

SEQ ID NO: 2910517 - RNA, 20 nt, Mycobacterium avium subsp. paratuberculosis
cggccagcgcgacgcgcaug

SEQ ID NO: 2910518 - RNA, 12 nt, Mycobacterium avium subsp. paratuberculosis
cggccagcgcgc

SEQ ID NO: 2910519 - RNA, 16 nt, Mycobacterium avium subsp. paratuberculosis
cggccagcgcgccgca

SEQ ID NO: 2910520 - RNA, 18 nt, Mycobacterium avium subsp. paratuberculosis
cggccagcgcgccgcaca

SEQ ID NO: 2910521 - RNA, 20 nt, Mycobacterium avium subsp. paratuberculosis
cggccagcgcgccgcacagc

SEQ ID NO: 2910522 - RNA, 16 nt, Mycobacterium avium subsp. paratuberculosis
cggccagcgcgcgcag

SEQ ID NO: 2910523 - RNA, 15 nt, Mycobacterium avium subsp. paratuberculosis
cggccagcgcgcggc

SEQ ID NO: 2910524 - RNA, 16 nt, Mycobacterium avium subsp. paratuberculosis
cggccagcgcgcggcc

SEQ ID NO: 2910525 - RNA, 17 nt, Mycobacterium avium subsp. paratuberculosis
cggccagcgcgcggccc

SEQ ID NO: 2910526 - RNA, 17 nt, Mycobacterium avium subsp. paratuberculosis
cggccagcgcgcgggcg

SEQ ID NO: 2910527 - RNA, 22 nt, Mycobacterium avium subsp. paratuberculosis
cggccagcgcgcgggcgcgcgc

SEQ ID NO: 2910528 - RNA, 18 nt, Mycobacterium avium subsp. paratuberculosis
cggccagcgcgcgggcgu

SEQ ID NO: 2910529 - RNA, 19 nt, Mycobacterium avium subsp. paratuberculosis
cggccagcgcgcgggcguc

SEQ ID NO: 2910530 - RNA, 16 nt, Mycobacterium avium subsp. paratuberculosis
cggccagcgcggccgg

SEQ ID NO: 2910531 - RNA, 14 nt, Mycobacterium avium subsp. paratuberculosis
cggccagcgcggcg

SEQ ID NO: 2910532 - RNA, 15 nt, Mycobacterium avium subsp. paratuberculosis
cggccagcgcggcgg

SEQ ID NO: 2910533 - RNA, 16 nt, Mycobacterium avium subsp. paratuberculosis
cggccagcgcggcggc

SEQ ID NO: 2910534 - RNA, 17 nt, Mycobacterium avium subsp. paratuberculosis
cggccagcgcggcggcc

SEQ ID NO: 2910535 - RNA, 20 nt, Mycobacterium avium subsp. paratuberculosis
cggccagcgcggcggccagc

SEQ ID NO: 2910536 - RNA, 18 nt, Mycobacterium avium subsp. paratuberculosis
cggccagcgcggcggucg

SEQ ID NO: 2910537 - RNA, 14 nt, Mycobacterium avium subsp. paratuberculosis
cggccagcgcggug

SEQ ID NO: 2910538 - RNA, 15 nt, Mycobacterium avium subsp. paratuberculosis
cggccagcgcggugu

SEQ ID NO: 2910539 - RNA, 20 nt, Mycobacterium avium subsp. paratuberculosis
cggccagcgcggugugcggc

SEQ ID NO: 2910540 - RNA, 22 nt, Mycobacterium avium subsp. paratuberculosis
cggccagcgcggugugcggcgg

SEQ ID NO: 2910541 - RNA, 12 nt, Mycobacterium avium subsp. paratuberculosis
cggccagcgcgu

SEQ ID NO: 2910542 - RNA, 14 nt, Mycobacterium avium subsp. paratuberculosis
cggccagcgcgucg

SEQ ID NO: 2910543 - RNA, 17 nt, Mycobacterium avium subsp. paratuberculosis
cggccagcgcgucggcc

SEQ ID NO: 2910544 - RNA, 20 nt, Mycobacterium avium subsp. paratuberculosis
cggccagcgcgucggccagc

SEQ ID NO: 2910545 - RNA, 22 nt, Mycobacterium avium subsp. paratuberculosis
cggccagcgcgucggccagcac

SEQ ID NO: 2910546 - RNA, 14 nt, Mycobacterium avium subsp. paratuberculosis
cggccagcgcguga

SEQ ID NO: 2910547 - RNA, 12 nt, Mycobacterium avium subsp. paratuberculosis
cggccagcggca

SEQ ID NO: 2910548 - RNA, 15 nt, Mycobacterium avium subsp. paratuberculosis
cggccagcggcagcg

SEQ ID NO: 2910549 - RNA, 18 nt, Mycobacterium avium subsp. paratuberculosis
cggccagcggcagcggcg

SEQ ID NO: 2910550 - RNA, 21 nt, Mycobacterium avium subsp. paratuberculosis
cggccagcggcagcggcgucg

SEQ ID NO: 2910551 - RNA, 14 nt, Mycobacterium avium subsp. paratuberculosis
cggccagcggcauc

SEQ ID NO: 2910552 - RNA, 15 nt, Mycobacterium avium subsp. paratuberculosis
cggccagcggccagc

SEQ ID NO: 2910553 - RNA, 17 nt, Mycobacterium avium subsp. paratuberculosis
cggccagcggccagccc

SEQ ID NO: 2910554 - RNA, 18 nt, Mycobacterium avium subsp. paratuberculosis
cggccagcggccagcccg

SEQ ID NO: 2910555 - RNA, 21 nt, Mycobacterium avium subsp. paratuberculosis
cggccagcggccagcccgcgg

SEQ ID NO: 2910556 - RNA, 13 nt, Mycobacterium avium subsp. paratuberculosis
cggccagcggcgc

SEQ ID NO: 2910557 - RNA, 14 nt, Mycobacterium avium subsp. paratuberculosis
cggccagcggcgcc

SEQ ID NO: 2910558 - RNA, 15 nt, Mycobacterium avium subsp. paratuberculosis
cggccagcggcgccg

SEQ ID NO: 2910559 - RNA, 19 nt, Mycobacterium avium subsp. paratuberculosis
cggccagcggcuuggccgu

SEQ ID NO: 2910560 - RNA, 14 nt, Mycobacterium avium subsp. paratuberculosis
cggccagcgggcgg

SEQ ID NO: 2910561 - RNA, 18 nt, Mycobacterium avium subsp. paratuberculosis
cggccagcgggcggcccc

SEQ ID NO: 2910562 - RNA, 13 nt, Mycobacterium avium subsp. paratuberculosis
cggccagcggguc

SEQ ID NO: 2910563 - RNA, 14 nt, Mycobacterium avium subsp. paratuberculosis
cggccagcggguga

SEQ ID NO: 2910564 - RNA, 17 nt, Mycobacterium avium subsp. paratuberculosis
cggccagcgggugaugg

SEQ ID NO: 2910565 - RNA, 23 nt, Mycobacterium avium subsp. paratuberculosis
cggccagcgggugauggccgccg

SEQ ID NO: 2910566 - RNA, 17 nt, Mycobacterium avium subsp. paratuberculosis
cggccagcgguugcacg

SEQ ID NO: 2910567 - RNA, 23 nt, Mycobacterium avium subsp. paratuberculosis
cggccagcgguugcacggucugg

SEQ ID NO: 2910568 - RNA, 18 nt, Mycobacterium avium subsp. paratuberculosis
cggccagcgucgcgccgc

SEQ ID NO: 2910569 - RNA, 20 nt, Mycobacterium avium subsp. paratuberculosis
cggccagcgucgcgccgcca

SEQ ID NO: 2910570 - RNA, 20 nt, Mycobacterium avium subsp. paratuberculosis
cggccagcgucuccggcggg

SEQ ID NO: 2910571 - RNA, 23 nt, Mycobacterium avium subsp. paratuberculosis
cggccagcgucuccggcgggcug

SEQ ID NO: 2910572 - RNA, 12 nt, Mycobacterium avium subsp. paratuberculosis
cggccagcguga

SEQ ID NO: 2910573 - RNA, 19 nt, Mycobacterium avium subsp. paratuberculosis
cggccagcgugaacaccgc

SEQ ID NO: 2910574 - RNA, 20 nt, Mycobacterium avium subsp. paratuberculosis
cggccagcgugaacaccgcg

SEQ ID NO: 2910575 - RNA, 22 nt, Mycobacterium avium subsp. paratuberculosis
cggccagcgugaacaccgcguu

SEQ ID NO: 2910576 - RNA, 23 nt, Mycobacterium avium subsp. paratuberculosis
cggccagcgugaacaccgcguug

SEQ ID NO: 2910577 - RNA, 15 nt, Mycobacterium avium subsp. paratuberculosis
cggccagcguggcgc

SEQ ID NO: 2910578 - RNA, 17 nt, Mycobacterium avium subsp. paratuberculosis
cggccagcguggcgcgc

SEQ ID NO: 2910579 - RNA, 18 nt, Mycobacterium avium subsp. paratuberculosis
cggccagcguggcgcgcc

SEQ ID NO: 2910580 - RNA, 19 nt, Mycobacterium avium subsp. paratuberculosis
cggccagcguggcgcgccc

SEQ ID NO: 2910581 - RNA, 22 nt, Mycobacterium avium subsp. paratuberculosis
cggccagcguggcgcgccccgg

SEQ ID NO: 2910582 - RNA, 16 nt, Mycobacterium avium subsp. paratuberculosis
cggccagcguguugcu

SEQ ID NO: 2910583 - RNA, 17 nt, Mycobacterium avium subsp. paratuberculosis
cggccagcucaccggcc

SEQ ID NO: 2910584 - RNA, 21 nt, Mycobacterium avium subsp. paratuberculosis
cggccagcucaccggccaggg

SEQ ID NO: 2910585 - RNA, 15 nt, Mycobacterium avium subsp. paratuberculosis
cggccagcucccggg

SEQ ID NO: 2910586 - RNA, 17 nt, Mycobacterium avium subsp. paratuberculosis
cggccagcucccgggcg

SEQ ID NO: 2910587 - RNA, 18 nt, Mycobacterium avium subsp. paratuberculosis
cggccagcucccgggcgg

SEQ ID NO: 2910588 - RNA, 22 nt, Mycobacterium avium subsp. paratuberculosis
cggccagcucccgggcggcgcc

SEQ ID NO: 2910589 - RNA, 23 nt, Mycobacterium avium subsp. paratuberculosis
cggccagcucccgggcggcgccg

SEQ ID NO: 2910590 - RNA, 16 nt, Mycobacterium avium subsp. paratuberculosis
cggccagcuccgccac

SEQ ID NO: 2910591 - RNA, 17 nt, Mycobacterium avium subsp. paratuberculosis
cggccagcuccgccacc

SEQ ID NO: 2910592 - RNA, 15 nt, Mycobacterium avium subsp. paratuberculosis
cggccagcuccgggu

SEQ ID NO: 2910593 - RNA, 18 nt, Mycobacterium avium subsp. paratuberculosis
cggccagcuccgggucga

SEQ ID NO: 2910594 - RNA, 21 nt, Mycobacterium avium subsp. paratuberculosis
cggccagcuccgggucgaccg

SEQ ID NO: 2910595 - RNA, 23 nt, Mycobacterium avium subsp. paratuberculosis
cggccagcuccgggucgaccgcc

SEQ ID NO: 2910596 - RNA, 17 nt, Mycobacterium avium subsp. paratuberculosis
cggccagcucgagcauc

SEQ ID NO: 2910597 - RNA, 18 nt, Mycobacterium avium subsp. paratuberculosis
cggccagcucgagcauca

SEQ ID NO: 2910598 - RNA, 20 nt, Mycobacterium avium subsp. paratuberculosis
cggccagcucgagcaucacg

SEQ ID NO: 2910599 - RNA, 22 nt, Mycobacterium avium subsp. paratuberculosis
cggccagcucgagcaucacgaa

SEQ ID NO: 2910600 - RNA, 15 nt, Mycobacterium avium subsp. paratuberculosis
cggccagcucgccgc

SEQ ID NO: 2910601 - RNA, 16 nt, Mycobacterium avium subsp. paratuberculosis
cggccagcucgccgcc

SEQ ID NO: 2910602 - RNA, 17 nt, Mycobacterium avium subsp. paratuberculosis
cggccagcucgccgccg

SEQ ID NO: 2910603 - RNA, 18 nt, Mycobacterium avium subsp. paratuberculosis
cggccagcucgccgccga

SEQ ID NO: 2910604 - RNA, 20 nt, Mycobacterium avium subsp. paratuberculosis
cggccagcucgccgccgacg

SEQ ID NO: 2910605 - RNA, 16 nt, Mycobacterium avium subsp. paratuberculosis
cggccagcucggcccg

SEQ ID NO: 2910606 - RNA, 19 nt, Mycobacterium avium subsp. paratuberculosis
cggccagcucggcccgcug

SEQ ID NO: 2910607 - RNA, 21 nt, Mycobacterium avium subsp. paratuberculosis
cggccagcucggcccgcugcg

SEQ ID NO: 2910608 - RNA, 16 nt, Mycobacterium avium subsp. paratuberculosis
cggccagcucggucgc

SEQ ID NO: 2910609 - RNA, 21 nt, Mycobacterium avium subsp. paratuberculosis
cggccagcucggucgcggucg

SEQ ID NO: 2910610 - RNA, 23 nt, Mycobacterium avium subsp. paratuberculosis
cggccagcugauagccgcccugc

SEQ ID NO: 2910611 - RNA, 17 nt, Mycobacterium avium subsp. paratuberculosis
cggccagcugcccgccg

SEQ ID NO: 2910612 - RNA, 21 nt, Mycobacterium avium subsp. paratuberculosis
cggccagcugcccgccgacgc

SEQ ID NO: 2910613 - RNA, 23 nt, Mycobacterium avium subsp. paratuberculosis
cggccagcugcccgccgacgccc

SEQ ID NO: 2910614 - RNA, 18 nt, Mycobacterium avium subsp. paratuberculosis
cggccagcugcgacagca

SEQ ID NO: 2910615 - RNA, 14 nt, Mycobacterium avium subsp. paratuberculosis
cggccagcugcggg

SEQ ID NO: 2910616 - RNA, 16 nt, Mycobacterium avium subsp. paratuberculosis
cggccagcugcggguu

SEQ ID NO: 2910617 - RNA, 16 nt, Mycobacterium avium subsp. paratuberculosis
cggccaggaaccaccg

SEQ ID NO: 2910618 - RNA, 17 nt, Mycobacterium avium subsp. paratuberculosis
cggccaggaaccaccgg

SEQ ID NO: 2910619 - RNA, 18 nt, Mycobacterium avium subsp. paratuberculosis
cggccaggaaccaccgga

SEQ ID NO: 2910620 - RNA, 19 nt, Mycobacterium avium subsp. paratuberculosis
cggccaggaagccggcgac

SEQ ID NO: 2910621 - RNA, 24 nt, Mycobacterium avium subsp. paratuberculosis
cggccaggaagccggcgacgaccg

SEQ ID NO: 2910622 - RNA, 20 nt, Mycobacterium avium subsp. paratuberculosis
cggccaggaucuugucggcg

SEQ ID NO: 2910623 - RNA, 22 nt, Mycobacterium avium subsp. paratuberculosis
cggccaggaucuugucggcggc

SEQ ID NO: 2910624 - RNA, 20 nt, Mycobacterium avium subsp. paratuberculosis
cggccaggaugaacacccgg

SEQ ID NO: 2910625 - RNA, 14 nt, Mycobacterium avium subsp. paratuberculosis
cggccaggcacagc

SEQ ID NO: 2910626 - RNA, 15 nt, Mycobacterium avium subsp. paratuberculosis
cggccaggcacagca

SEQ ID NO: 2910627 - RNA, 19 nt, Mycobacterium avium subsp. paratuberculosis
cggccaggcacagcagggc

SEQ ID NO: 2910628 - RNA, 20 nt, Mycobacterium avium subsp. paratuberculosis
cggccaggcacagcagggca

SEQ ID NO: 2910629 - RNA, 14 nt, Mycobacterium avium subsp. paratuberculosis
cggccaggcccagc

SEQ ID NO: 2910630 - RNA, 17 nt, Mycobacterium avium subsp. paratuberculosis
cggccaggcccagccca

SEQ ID NO: 2910631 - RNA, 12 nt, Mycobacterium avium subsp. paratuberculosis
cggccaggccgg

SEQ ID NO: 2910632 - RNA, 23 nt, Mycobacterium avium subsp. paratuberculosis
cggccaggccggccugccggaug

SEQ ID NO: 2910633 - RNA, 15 nt, Mycobacterium avium subsp. paratuberculosis
cggccaggccggcga

SEQ ID NO: 2910634 - RNA, 23 nt, Mycobacterium avium subsp. paratuberculosis
cggccaggcgacuguccaggccg

SEQ ID NO: 2910635 - RNA, 15 nt, Mycobacterium avium subsp. paratuberculosis
cggccaggcgcccag

SEQ ID NO: 2910636 - RNA, 19 nt, Mycobacterium avium subsp. paratuberculosis
cggccaggcgcccagcacc

SEQ ID NO: 2910637 - RNA, 12 nt, Mycobacterium avium subsp. paratuberculosis
cggccagggccg

SEQ ID NO: 2910638 - RNA, 14 nt, Mycobacterium avium subsp. paratuberculosis
cggccagggccgcc

SEQ ID NO: 2910639 - RNA, 15 nt, Mycobacterium avium subsp. paratuberculosis
cggccagggccgccg

SEQ ID NO: 2910640 - RNA, 21 nt, Mycobacterium avium subsp. paratuberculosis
cggccagggccgccgcauacc

SEQ ID NO: 2910641 - RNA, 15 nt, Mycobacterium avium subsp. paratuberculosis
cggccagggcggcgc

SEQ ID NO: 2910642 - RNA, 16 nt, Mycobacterium avium subsp. paratuberculosis
cggccagggcggcgcc

SEQ ID NO: 2910643 - RNA, 17 nt, Mycobacterium avium subsp. paratuberculosis
cggccagggcggcgccg

SEQ ID NO: 2910644 - RNA, 14 nt, Mycobacterium avium subsp. paratuberculosis
cggccagggcgugg

SEQ ID NO: 2910645 - RNA, 15 nt, Mycobacterium avium subsp. paratuberculosis
cggccagggcgugga

SEQ ID NO: 2910646 - RNA, 19 nt, Mycobacterium avium subsp. paratuberculosis
cggccagggcucgugcagc

SEQ ID NO: 2910647 - RNA, 21 nt, Mycobacterium avium subsp. paratuberculosis
cggccagggcucgugcagccg

SEQ ID NO: 2910648 - RNA, 22 nt, Mycobacterium avium subsp. paratuberculosis
cggccaggguagaggcggcgac

SEQ ID NO: 2910649 - RNA, 21 nt, Mycobacterium avium subsp. paratuberculosis
cggccagggugacggucaugc

SEQ ID NO: 2910650 - RNA, 18 nt, Mycobacterium avium subsp. paratuberculosis
cggccagggugccgacga

SEQ ID NO: 2910651 - RNA, 20 nt, Mycobacterium avium subsp. paratuberculosis
cggccagggugucccagcgc

SEQ ID NO: 2910652 - RNA, 21 nt, Mycobacterium avium subsp. paratuberculosis
cggccagggugucccagcgcc

SEQ ID NO: 2910653 - RNA, 18 nt, Mycobacterium avium subsp. paratuberculosis
cggccagguacugaucac

SEQ ID NO: 2910654 - RNA, 21 nt, Mycobacterium avium subsp. paratuberculosis
cggccagguacugaucaccgc

SEQ ID NO: 2910655 - RNA, 23 nt, Mycobacterium avium subsp. paratuberculosis
cggccagguacugaucaccgcgc

SEQ ID NO: 2910656 - RNA, 18 nt, Mycobacterium avium subsp. paratuberculosis
cggccagguccacaccgu

SEQ ID NO: 2910657 - RNA, 20 nt, Mycobacterium avium subsp. paratuberculosis
cggccagguccacaccgugg

SEQ ID NO: 2910658 - RNA, 21 nt, Mycobacterium avium subsp. paratuberculosis
cggccagguccacaccgugga

SEQ ID NO: 2910659 - RNA, 20 nt, Mycobacterium avium subsp. paratuberculosis
cggccaggucgacggggucg

SEQ ID NO: 2910660 - RNA, 22 nt, Mycobacterium avium subsp. paratuberculosis
cggccaggucgagguagugcgc

SEQ ID NO: 2910661 - RNA, 21 nt, Mycobacterium avium subsp. paratuberculosis
cggccaggucgccgcgcagca

SEQ ID NO: 2910662 - RNA, 15 nt, Mycobacterium avium subsp. paratuberculosis
cggccagguuccacc

SEQ ID NO: 2910663 - RNA, 17 nt, Mycobacterium avium subsp. paratuberculosis
cggccagguuccaccgg

SEQ ID NO: 2910664 - RNA, 19 nt, Mycobacterium avium subsp. paratuberculosis
cggccagguuccaccgggc

SEQ ID NO: 2910665 - RNA, 20 nt, Mycobacterium avium subsp. paratuberculosis
cggccagguuccaccgggcg

SEQ ID NO: 2910666 - RNA, 15 nt, Mycobacterium avium subsp. paratuberculosis
cggccagguugacca

SEQ ID NO: 2910667 - RNA, 18 nt, Mycobacterium avium subsp. paratuberculosis
cggccagguugucgucgg

SEQ ID NO: 2910668 - RNA, 19 nt, Mycobacterium avium subsp. paratuberculosis
cggccagguugucgucggg

SEQ ID NO: 2910669 - RNA, 20 nt, Mycobacterium avium subsp. paratuberculosis
cggccagguugucgucgggc

SEQ ID NO: 2910670 - RNA, 14 nt, Mycobacterium avium subsp. paratuberculosis
cggccaguccagcg

SEQ ID NO: 2910671 - RNA, 13 nt, Mycobacterium avium subsp. paratuberculosis
cggccaguccagg

SEQ ID NO: 2910672 - RNA, 14 nt, Mycobacterium avium subsp. paratuberculosis
cggccaguccaggc

SEQ ID NO: 2910673 - RNA, 15 nt, Mycobacterium avium subsp. paratuberculosis
cggccaguccgcgug

SEQ ID NO: 2910674 - RNA, 17 nt, Mycobacterium avium subsp. paratuberculosis
cggccaguccggcagca

SEQ ID NO: 2910675 - RNA, 18 nt, Mycobacterium avium subsp. paratuberculosis
cggccaguccggcagcag

SEQ ID NO: 2910676 - RNA, 21 nt, Mycobacterium avium subsp. paratuberculosis
cggccaguccggcagcagcga

SEQ ID NO: 2910677 - RNA, 21 nt, Mycobacterium avium subsp. paratuberculosis
cggccaguccugggccagauc

SEQ ID NO: 2910678 - RNA, 23 nt, Mycobacterium avium subsp. paratuberculosis
cggccagucguacucccaggccg

SEQ ID NO: 2910679 - RNA, 18 nt, Mycobacterium avium subsp. paratuberculosis
cggccagugccgggccag

SEQ ID NO: 2910680 - RNA, 16 nt, Mycobacterium avium subsp. paratuberculosis
cggccaguucccgggc

SEQ ID NO: 2910681 - RNA, 17 nt, Mycobacterium avium subsp. paratuberculosis
cggccaguucccgggcg

SEQ ID NO: 2910682 - RNA, 17 nt, Mycobacterium avium subsp. paratuberculosis
cggccaguucgagcgcc

SEQ ID NO: 2910683 - RNA, 18 nt, Mycobacterium avium subsp. paratuberculosis
cggccaguucgagcgccg

SEQ ID NO: 2910684 - RNA, 19 nt, Mycobacterium avium subsp. paratuberculosis
cggccaguucgagcgccgc

SEQ ID NO: 2910685 - RNA, 18 nt, Mycobacterium avium subsp. paratuberculosis
cggccaguucgccgguga

SEQ ID NO: 2910686 - RNA, 20 nt, Mycobacterium avium subsp. paratuberculosis
cggccaguucgccggugacc

SEQ ID NO: 2910687 - RNA, 23 nt, Mycobacterium avium subsp. paratuberculosis
cggccaguucggguccgcggucc

SEQ ID NO: 2910688 - RNA, 17 nt, Mycobacterium avium subsp. paratuberculosis
cggccauauaggggugg

SEQ ID NO: 2910689 - RNA, 19 nt, Mycobacterium avium subsp. paratuberculosis
cggccauauaggggugggc

SEQ ID NO: 2910690 - RNA, 21 nt, Mycobacterium avium subsp. paratuberculosis
cggccauauaggggugggcga

SEQ ID NO: 2910691 - RNA, 16 nt, Mycobacterium avium subsp. paratuberculosis
cggccaucacggugcc

SEQ ID NO: 2910692 - RNA, 13 nt, Mycobacterium avium subsp. paratuberculosis
cggccaucagcac

SEQ ID NO: 2910693 - RNA, 17 nt, Mycobacterium avium subsp. paratuberculosis
cggccaucagccgccgu

SEQ ID NO: 2910694 - RNA, 18 nt, Mycobacterium avium subsp. paratuberculosis
cggccaucagccgccguc

SEQ ID NO: 2910695 - RNA, 20 nt, Mycobacterium avium subsp. paratuberculosis
cggccaucagccgccgucgc

SEQ ID NO: 2910696 - RNA, 23 nt, Mycobacterium avium subsp. paratuberculosis
cggccaucagccgccgucgcgcc

SEQ ID NO: 2910697 - RNA, 19 nt, Mycobacterium avium subsp. paratuberculosis
cggccaucaugcccaccau

SEQ ID NO: 2910698 - RNA, 20 nt, Mycobacterium avium subsp. paratuberculosis
cggccaucaugcccaccauc

SEQ ID NO: 2910699 - RNA, 14 nt, Mycobacterium avium subsp. paratuberculosis
cggccaucccggug

SEQ ID NO: 2910700 - RNA, 14 nt, Mycobacterium avium subsp. paratuberculosis
cggccauccgggcg

SEQ ID NO: 2910701 - RNA, 17 nt, Mycobacterium avium subsp. paratuberculosis
cggccauccgggcggca

SEQ ID NO: 2910702 - RNA, 19 nt, Mycobacterium avium subsp. paratuberculosis
cggccauccgggcggcauc

SEQ ID NO: 2910703 - RNA, 13 nt, Mycobacterium avium subsp. paratuberculosis
cggccaucgccgc

SEQ ID NO: 2910704 - RNA, 14 nt, Mycobacterium avium subsp. paratuberculosis
cggccaucgccgcc

SEQ ID NO: 2910705 - RNA, 15 nt, Mycobacterium avium subsp. paratuberculosis
cggccaucgccgcca

SEQ ID NO: 2910706 - RNA, 20 nt, Mycobacterium avium subsp. paratuberculosis
cggccaucgccgccaucgcc

SEQ ID NO: 2910707 - RNA, 16 nt, Mycobacterium avium subsp. paratuberculosis
cggccaucgccgcggu

SEQ ID NO: 2910708 - RNA, 17 nt, Mycobacterium avium subsp. paratuberculosis
cggccaucgccgcggug

SEQ ID NO: 2910709 - RNA, 14 nt, Mycobacterium avium subsp. paratuberculosis
cggccaucgccuga

SEQ ID NO: 2910710 - RNA, 16 nt, Mycobacterium avium subsp. paratuberculosis
cggccaucgccugagc

SEQ ID NO: 2910711 - RNA, 21 nt, Mycobacterium avium subsp. paratuberculosis
cggccaucuccugcacgcgcg

SEQ ID NO: 2910712 - RNA, 20 nt, Mycobacterium avium subsp. paratuberculosis
cggccaucucgugcccgggc

SEQ ID NO: 2910713 - RNA, 21 nt, Mycobacterium avium subsp. paratuberculosis
cggccaucuucaguucggccg

SEQ ID NO: 2910714 - RNA, 23 nt, Mycobacterium avium subsp. paratuberculosis
cggccaucuucaguucggccggc

SEQ ID NO: 2910715 - RNA, 22 nt, Mycobacterium avium subsp. paratuberculosis
cggccaugaagccguugccgcc

SEQ ID NO: 2910716 - RNA, 23 nt, Mycobacterium avium subsp. paratuberculosis
cggccaugaagccguugccgccg

SEQ ID NO: 2910717 - RNA, 17 nt, Mycobacterium avium subsp. paratuberculosis
cggccaugcagaccagc

SEQ ID NO: 2910718 - RNA, 19 nt, Mycobacterium avium subsp. paratuberculosis
cggccaugcagaccagccc

SEQ ID NO: 2910719 - RNA, 20 nt, Mycobacterium avium subsp. paratuberculosis
cggccaugcagaccagcccg

SEQ ID NO: 2910720 - RNA, 15 nt, Mycobacterium avium subsp. paratuberculosis
cggccaugcccucga

SEQ ID NO: 2910721 - RNA, 18 nt, Mycobacterium avium subsp. paratuberculosis
cggccauggucgcggccg

SEQ ID NO: 2910722 - RNA, 19 nt, Mycobacterium avium subsp. paratuberculosis
cggccauggucgcggccgu

SEQ ID NO: 2910723 - RNA, 17 nt, Mycobacterium avium subsp. paratuberculosis
cggccauggugccgccg

SEQ ID NO: 2910724 - RNA, 18 nt, Mycobacterium avium subsp. paratuberculosis
cggccauggugccgccgu

SEQ ID NO: 2910725 - RNA, 16 nt, Mycobacterium avium subsp. paratuberculosis
cggccauguccccgcc

SEQ ID NO: 2910726 - RNA, 18 nt, Mycobacterium avium subsp. paratuberculosis
cggccauguccccgccgg

SEQ ID NO: 2910727 - RNA, 23 nt, Mycobacterium avium subsp. paratuberculosis
cggccauguccccgccgguggcg

SEQ ID NO: 2910728 - RNA, 12 nt, Mycobacterium avium subsp. paratuberculosis
cggccaugucgg

SEQ ID NO: 2910729 - RNA, 23 nt, Mycobacterium avium subsp. paratuberculosis
cggccaugucggagcugcgcgcc

SEQ ID NO: 2910730 - RNA, 20 nt, Mycobacterium avium subsp. paratuberculosis
cggccauucaucgcgcacca

SEQ ID NO: 2910731 - RNA, 21 nt, Mycobacterium avium subsp. paratuberculosis
cggccauucaucgcgcaccag

SEQ ID NO: 2910732 - RNA, 23 nt, Mycobacterium avium subsp. paratuberculosis
cggccauucaucgcgcaccaggg

SEQ ID NO: 2910733 - RNA, 16 nt, Mycobacterium avium subsp. paratuberculosis
cggcccaacacgcccu

SEQ ID NO: 2910734 - RNA, 21 nt, Mycobacterium avium subsp. paratuberculosis
cggcccaacacgcccugcagg

SEQ ID NO: 2910735 - RNA, 17 nt, Mycobacterium avium subsp. paratuberculosis
cggcccaagacccgcgu

SEQ ID NO: 2910736 - RNA, 18 nt, Mycobacterium avium subsp. paratuberculosis
cggcccaauucguaggcg

SEQ ID NO: 2910737 - RNA, 13 nt, Mycobacterium avium subsp. paratuberculosis
cggcccaccaccg

SEQ ID NO: 2910738 - RNA, 15 nt, Mycobacterium avium subsp. paratuberculosis
cggcccaccaccgcc

SEQ ID NO: 2910739 - RNA, 16 nt, Mycobacterium avium subsp. paratuberculosis
cggcccaccaccgccu

SEQ ID NO: 2910740 - RNA, 18 nt, Mycobacterium avium subsp. paratuberculosis
cggcccaccaccgccucg

SEQ ID NO: 2910741 - RNA, 20 nt, Mycobacterium avium subsp. paratuberculosis
cggcccaccaccgccucgac

SEQ ID NO: 2910742 - RNA, 14 nt, Mycobacterium avium subsp. paratuberculosis
cggcccacccgcag

SEQ ID NO: 2910743 - RNA, 15 nt, Mycobacterium avium subsp. paratuberculosis
cggcccaccgcgacc

SEQ ID NO: 2910744 - RNA, 17 nt, Mycobacterium avium subsp. paratuberculosis
cggcccaccgcgacccg

SEQ ID NO: 2910745 - RNA, 19 nt, Mycobacterium avium subsp. paratuberculosis
cggcccaccgcgacccggc

SEQ ID NO: 2910746 - RNA, 14 nt, Mycobacterium avium subsp. paratuberculosis
cggcccaccggccc

SEQ ID NO: 2910747 - RNA, 17 nt, Mycobacterium avium subsp. paratuberculosis
cggcccaccggcccggc

SEQ ID NO: 2910748 - RNA, 18 nt, Mycobacterium avium subsp. paratuberculosis
cggcccaccggcccggcg

SEQ ID NO: 2910749 - RNA, 19 nt, Mycobacterium avium subsp. paratuberculosis
cggcccaccggcccggcgg

SEQ ID NO: 2910750 - RNA, 14 nt, Mycobacterium avium subsp. paratuberculosis
cggcccacgucgcg

SEQ ID NO: 2910751 - RNA, 23 nt, Mycobacterium avium subsp. paratuberculosis
cggcccagacgaugucgucgccg

SEQ ID NO: 2910752 - RNA, 24 nt, Mycobacterium avium subsp. paratuberculosis
cggcccagacgaugucgucgccgg

SEQ ID NO: 2910753 - RNA, 18 nt, Mycobacterium avium subsp. paratuberculosis
cggcccagaucgcggucc

SEQ ID NO: 2910754 - RNA, 13 nt, Mycobacterium avium subsp. paratuberculosis
cggcccagcacca

SEQ ID NO: 2910755 - RNA, 16 nt, Mycobacterium avium subsp. paratuberculosis
cggcccagcaccaccu

SEQ ID NO: 2910756 - RNA, 13 nt, Mycobacterium avium subsp. paratuberculosis
cggcccagcagcg

SEQ ID NO: 2910757 - RNA, 22 nt, Mycobacterium avium subsp. paratuberculosis
cggcccagcagcgucacgucga

SEQ ID NO: 2910758 - RNA, 12 nt, Mycobacterium avium subsp. paratuberculosis
cggcccagcccg

SEQ ID NO: 2910759 - RNA, 16 nt, Mycobacterium avium subsp. paratuberculosis
cggcccagcccggcca

SEQ ID NO: 2910760 - RNA, 18 nt, Mycobacterium avium subsp. paratuberculosis
cggcccagcccggccagc

SEQ ID NO: 2910761 - RNA, 11 nt, Mycobacterium avium subsp. paratuberculosis
cggcccagccg

SEQ ID NO: 2910762 - RNA, 13 nt, Mycobacterium avium subsp. paratuberculosis
cggcccagccgcu

SEQ ID NO: 2910763 - RNA, 17 nt, Mycobacterium avium subsp. paratuberculosis
cggcccagcgcgcggcg

SEQ ID NO: 2910764 - RNA, 18 nt, Mycobacterium avium subsp. paratuberculosis
cggcccagcgcgcggcgg

SEQ ID NO: 2910765 - RNA, 13 nt, Mycobacterium avium subsp. paratuberculosis
cggcccagcgcgg

SEQ ID NO: 2910766 - RNA, 14 nt, Mycobacterium avium subsp. paratuberculosis
cggcccagcgcggu

SEQ ID NO: 2910767 - RNA, 12 nt, Mycobacterium avium subsp. paratuberculosis
cggcccagcguc

SEQ ID NO: 2910768 - RNA, 22 nt, Mycobacterium avium subsp. paratuberculosis
cggcccagcgucaacucgucgg

SEQ ID NO: 2910769 - RNA, 24 nt, Mycobacterium avium subsp. paratuberculosis
cggcccagcuccacgcguagccga

SEQ ID NO: 2910770 - RNA, 16 nt, Mycobacterium avium subsp. paratuberculosis
cggcccagcucgguga

SEQ ID NO: 2910771 - RNA, 19 nt, Mycobacterium avium subsp. paratuberculosis
cggcccagcucggugaucu

SEQ ID NO: 2910772 - RNA, 22 nt, Mycobacterium avium subsp. paratuberculosis
cggcccaggcaguagccgaucu

SEQ ID NO: 2910773 - RNA, 24 nt, Mycobacterium avium subsp. paratuberculosis
cggcccagguauucguugcccugc

SEQ ID NO: 2910774 - RNA, 16 nt, Mycobacterium avium subsp. paratuberculosis
cggcccaguccagucg

SEQ ID NO: 2910775 - RNA, 22 nt, Mycobacterium avium subsp. paratuberculosis
cggcccaguccagucgcgccga

SEQ ID NO: 2910776 - RNA, 16 nt, Mycobacterium avium subsp. paratuberculosis
cggcccaguggaucgg

SEQ ID NO: 2910777 - RNA, 15 nt, Mycobacterium avium subsp. paratuberculosis
cggcccaucaccagc

SEQ ID NO: 2910778 - RNA, 18 nt, Mycobacterium avium subsp. paratuberculosis
cggcccaucaccagcggc

SEQ ID NO: 2910779 - RNA, 19 nt, Mycobacterium avium subsp. paratuberculosis
cggcccaucaccagcggcu

SEQ ID NO: 2910780 - RNA, 15 nt, Mycobacterium avium subsp. paratuberculosis
cggcccaucaccgga

SEQ ID NO: 2910781 - RNA, 22 nt, Mycobacterium avium subsp. paratuberculosis
cggcccaucaccggaccggcca

SEQ ID NO: 2910782 - RNA, 23 nt, Mycobacterium avium subsp. paratuberculosis
cggcccaucaccggaccggccag

SEQ ID NO: 2910783 - RNA, 24 nt, Mycobacterium avium subsp. paratuberculosis
cggcccaucaccggaccggccagc

SEQ ID NO: 2910784 - RNA, 15 nt, Mycobacterium avium subsp. paratuberculosis
cggcccaucacgucg

SEQ ID NO: 2910785 - RNA, 21 nt, Mycobacterium avium subsp. paratuberculosis
cggcccaugggggaacccccu

SEQ ID NO: 2910786 - RNA, 23 nt, Mycobacterium avium subsp. paratuberculosis
cggccccaaaagccuugacguag

SEQ ID NO: 2910787 - RNA, 23 nt, Mycobacterium avium subsp. paratuberculosis
cggccccaacggcgugcagccga

SEQ ID NO: 2910788 - RNA, 17 nt, Mycobacterium avium subsp. paratuberculosis
cggccccaccgccgcug

SEQ ID NO: 2910789 - RNA, 17 nt, Mycobacterium avium subsp. paratuberculosis
cggccccagccgccgcg

SEQ ID NO: 2910790 - RNA, 17 nt, Mycobacterium avium subsp. paratuberculosis
cggcccccacgcagcgg

SEQ ID NO: 2910791 - RNA, 19 nt, Mycobacterium avium subsp. paratuberculosis
cggccccccgcacaccggc

SEQ ID NO: 2910792 - RNA, 12 nt, Mycobacterium avium subsp. paratuberculosis
cggccccccggg

SEQ ID NO: 2910793 - RNA, 13 nt, Mycobacterium avium subsp. paratuberculosis
cggccccccgggc

SEQ ID NO: 2910794 - RNA, 19 nt, Mycobacterium avium subsp. paratuberculosis
cggccccccgggcaccagc

SEQ ID NO: 2910795 - RNA, 20 nt, Mycobacterium avium subsp. paratuberculosis
cggccccccgggcaccagcg

SEQ ID NO: 2910796 - RNA, 18 nt, Mycobacterium avium subsp. paratuberculosis
cggcccccgagcuucggg

SEQ ID NO: 2910797 - RNA, 14 nt, Mycobacterium avium subsp. paratuberculosis
cggcccccgggccc

SEQ ID NO: 2910798 - RNA, 24 nt, Mycobacterium avium subsp. paratuberculosis
cggcccccugcucagcggccaucg

SEQ ID NO: 2910799 - RNA, 13 nt, Mycobacterium avium subsp. paratuberculosis
cggccccgagccg

SEQ ID NO: 2910800 - RNA, 17 nt, Mycobacterium avium subsp. paratuberculosis
cggccccgagccgacga

SEQ ID NO: 2910801 - RNA, 13 nt, Mycobacterium avium subsp. paratuberculosis
cggccccgccagc

SEQ ID NO: 2910802 - RNA, 15 nt, Mycobacterium avium subsp. paratuberculosis
cggccccgccagcag

SEQ ID NO: 2910803 - RNA, 16 nt, Mycobacterium avium subsp. paratuberculosis
cggccccgccagcaga

SEQ ID NO: 2910804 - RNA, 15 nt, Mycobacterium avium subsp. paratuberculosis
cggccccgcccggcg

SEQ ID NO: 2910805 - RNA, 14 nt, Mycobacterium avium subsp. paratuberculosis
cggccccgcccggg

SEQ ID NO: 2910806 - RNA, 16 nt, Mycobacterium avium subsp. paratuberculosis
cggccccgcccggggc

SEQ ID NO: 2910807 - RNA, 17 nt, Mycobacterium avium subsp. paratuberculosis
cggccccgcccggggcg

SEQ ID NO: 2910808 - RNA, 16 nt, Mycobacterium avium subsp. paratuberculosis
cggccccgcgcaucgg

SEQ ID NO: 2910809 - RNA, 18 nt, Mycobacterium avium subsp. paratuberculosis
cggccccgcugccguccg

SEQ ID NO: 2910810 - RNA, 22 nt, Mycobacterium avium subsp. paratuberculosis
cggccccgcugccguccggcgg

SEQ ID NO: 2910811 - RNA, 23 nt, Mycobacterium avium subsp. paratuberculosis
cggccccgcugccguccggcggc

SEQ ID NO: 2910812 - RNA, 17 nt, Mycobacterium avium subsp. paratuberculosis
cggccccggccgagccg

SEQ ID NO: 2910813 - RNA, 18 nt, Mycobacterium avium subsp. paratuberculosis
cggccccggccgagccgg

SEQ ID NO: 2910814 - RNA, 15 nt, Mycobacterium avium subsp. paratuberculosis
cggccccggccggcg

SEQ ID NO: 2910815 - RNA, 18 nt, Mycobacterium avium subsp. paratuberculosis
cggccccggccggcgggu

SEQ ID NO: 2910816 - RNA, 18 nt, Mycobacterium avium subsp. paratuberculosis
cggccccggccgggcgac

SEQ ID NO: 2910817 - RNA, 12 nt, Mycobacterium avium subsp. paratuberculosis
cggccccggcga

SEQ ID NO: 2910818 - RNA, 13 nt, Mycobacterium avium subsp. paratuberculosis
cggccccggcgac

SEQ ID NO: 2910819 - RNA, 14 nt, Mycobacterium avium subsp. paratuberculosis
cggccccggcgacg

SEQ ID NO: 2910820 - RNA, 17 nt, Mycobacterium avium subsp. paratuberculosis
cggccccggcgacggcg

SEQ ID NO: 2910821 - RNA, 14 nt, Mycobacterium avium subsp. paratuberculosis
cggccccggcucgg

SEQ ID NO: 2910822 - RNA, 16 nt, Mycobacterium avium subsp. paratuberculosis
cggccccggcucgggc

SEQ ID NO: 2910823 - RNA, 13 nt, Mycobacterium avium subsp. paratuberculosis
cggccccgggcgc

SEQ ID NO: 2910824 - RNA, 17 nt, Mycobacterium avium subsp. paratuberculosis
cggccccgggcgcuggc

SEQ ID NO: 2910825 - RNA, 18 nt, Mycobacterium avium subsp. paratuberculosis
cggccccgggcgcuggcg

SEQ ID NO: 2910826 - RNA, 15 nt, Mycobacterium avium subsp. paratuberculosis
cggccccgggggacc

SEQ ID NO: 2910827 - RNA, 20 nt, Mycobacterium avium subsp. paratuberculosis
cggccccgggggaccagcgc

SEQ ID NO: 2910828 - RNA, 13 nt, Mycobacterium avium subsp. paratuberculosis
cggccccgguagc

SEQ ID NO: 2910829 - RNA, 18 nt, Mycobacterium avium subsp. paratuberculosis
cggccccgguagccagca

SEQ ID NO: 2910830 - RNA, 19 nt, Mycobacterium avium subsp. paratuberculosis
cggccccgguagccagcac

SEQ ID NO: 2910831 - RNA, 16 nt, Mycobacterium avium subsp. paratuberculosis
cggccccuaccgccga

SEQ ID NO: 2910832 - RNA, 17 nt, Mycobacterium avium subsp. paratuberculosis
cggccccuaccgccgag

SEQ ID NO: 2910833 - RNA, 23 nt, Mycobacterium avium subsp. paratuberculosis
cggccccugcggggugucgaccc

SEQ ID NO: 2910834 - RNA, 22 nt, Mycobacterium avium subsp. paratuberculosis
cggccccuucgaugucgccggc

SEQ ID NO: 2910835 - RNA, 23 nt, Mycobacterium avium subsp. paratuberculosis
cggccccuucgaugucgccggcg

SEQ ID NO: 2910836 - RNA, 23 nt, Mycobacterium avium subsp. paratuberculosis
cggccccuuggcguauucggcgc

SEQ ID NO: 2910837 - RNA, 18 nt, Mycobacterium avium subsp. paratuberculosis
cggcccgaaaacgcccgg

SEQ ID NO: 2910838 - RNA, 21 nt, Mycobacterium avium subsp. paratuberculosis
cggcccgaaaacgcccgggug

SEQ ID NO: 2910839 - RNA, 15 nt, Mycobacterium avium subsp. paratuberculosis
cggcccgaacaccca

SEQ ID NO: 2910840 - RNA, 19 nt, Mycobacterium avium subsp. paratuberculosis
cggcccgaacaccuccucg

SEQ ID NO: 2910841 - RNA, 20 nt, Mycobacterium avium subsp. paratuberculosis
cggcccgaacaccuccucgg

SEQ ID NO: 2910842 - RNA, 13 nt, Mycobacterium avium subsp. paratuberculosis
cggcccgaccagc

SEQ ID NO: 2910843 - RNA, 15 nt, Mycobacterium avium subsp. paratuberculosis
cggcccgaccagcgg

SEQ ID NO: 2910844 - RNA, 16 nt, Mycobacterium avium subsp. paratuberculosis
cggcccgaccagcggg

SEQ ID NO: 2910845 - RNA, 17 nt, Mycobacterium avium subsp. paratuberculosis
cggcccgaccagcgggc

SEQ ID NO: 2910846 - RNA, 23 nt, Mycobacterium avium subsp. paratuberculosis
cggcccgaccagcgggccgacag

SEQ ID NO: 2910847 - RNA, 13 nt, Mycobacterium avium subsp. paratuberculosis
cggcccgacccgg

SEQ ID NO: 2910848 - RNA, 18 nt, Mycobacterium avium subsp. paratuberculosis
cggcccgacccggucagc

SEQ ID NO: 2910849 - RNA, 13 nt, Mycobacterium avium subsp. paratuberculosis
cggcccgacgacg

SEQ ID NO: 2910850 - RNA, 16 nt, Mycobacterium avium subsp. paratuberculosis
cggcccgacgacgccg

SEQ ID NO: 2910851 - RNA, 19 nt, Mycobacterium avium subsp. paratuberculosis
cggcccgacgacgccguca

SEQ ID NO: 2910852 - RNA, 17 nt, Mycobacterium avium subsp. paratuberculosis
cggcccgacggguucgc

SEQ ID NO: 2910853 - RNA, 22 nt, Mycobacterium avium subsp. paratuberculosis
cggcccgacggguucgcgcagc

SEQ ID NO: 2910854 - RNA, 15 nt, Mycobacterium avium subsp. paratuberculosis
cggcccgagcaccac

SEQ ID NO: 2910855 - RNA, 16 nt, Mycobacterium avium subsp. paratuberculosis
cggcccgagcaccacc

SEQ ID NO: 2910856 - RNA, 14 nt, Mycobacterium avium subsp. paratuberculosis
cggcccgagcccug

SEQ ID NO: 2910857 - RNA, 15 nt, Mycobacterium avium subsp. paratuberculosis
cggcccgagcccugc

SEQ ID NO: 2910858 - RNA, 18 nt, Mycobacterium avium subsp. paratuberculosis
cggcccgagcccugcgcc

SEQ ID NO: 2910859 - RNA, 19 nt, Mycobacterium avium subsp. paratuberculosis
cggcccgagcccugcgcca

SEQ ID NO: 2910860 - RNA, 21 nt, Mycobacterium avium subsp. paratuberculosis
cggcccgagcccugcgccagc

SEQ ID NO: 2910861 - RNA, 21 nt, Mycobacterium avium subsp. paratuberculosis
cggcccgauaggccgacuggu

SEQ ID NO: 2910862 - RNA, 22 nt, Mycobacterium avium subsp. paratuberculosis
cggcccgauaggccgacuggug

SEQ ID NO: 2910863 - RNA, 13 nt, Mycobacterium avium subsp. paratuberculosis
cggcccgaucacc

SEQ ID NO: 2910864 - RNA, 20 nt, Mycobacterium avium subsp. paratuberculosis
cggcccgaucaccaggccca

SEQ ID NO: 2910865 - RNA, 23 nt, Mycobacterium avium subsp. paratuberculosis
cggcccgaucaccaggcccaggc

SEQ ID NO: 2910866 - RNA, 14 nt, Mycobacterium avium subsp. paratuberculosis
cggcccgaucaccg

SEQ ID NO: 2910867 - RNA, 16 nt, Mycobacterium avium subsp. paratuberculosis
cggcccgaucaccgcc

SEQ ID NO: 2910868 - RNA, 16 nt, Mycobacterium avium subsp. paratuberculosis
cggcccgaucgcggcg

SEQ ID NO: 2910869 - RNA, 19 nt, Mycobacterium avium subsp. paratuberculosis
cggcccgaucgcggcgagc

SEQ ID NO: 2910870 - RNA, 16 nt, Mycobacterium avium subsp. paratuberculosis
cggcccgaucgcgucg

SEQ ID NO: 2910871 - RNA, 19 nt, Mycobacterium avium subsp. paratuberculosis
cggcccgaucgcgucgacg

SEQ ID NO: 2910872 - RNA, 14 nt, Mycobacterium avium subsp. paratuberculosis
cggcccgaucucgc

SEQ ID NO: 2910873 - RNA, 16 nt, Mycobacterium avium subsp. paratuberculosis
cggcccgaucucgcgc

SEQ ID NO: 2910874 - RNA, 18 nt, Mycobacterium avium subsp. paratuberculosis
cggcccgaucucgcgcgg

SEQ ID NO: 2910875 - RNA, 23 nt, Mycobacterium avium subsp. paratuberculosis
cggcccgaucucgcgcgggucga

SEQ ID NO: 2910876 - RNA, 14 nt, Mycobacterium avium subsp. paratuberculosis
cggcccgcacggcc

SEQ ID NO: 2910877 - RNA, 17 nt, Mycobacterium avium subsp. paratuberculosis
cggcccgcacggccgcc

SEQ ID NO: 2910878 - RNA, 18 nt, Mycobacterium avium subsp. paratuberculosis
cggcccgcacggccgcca

SEQ ID NO: 2910879 - RNA, 14 nt, Mycobacterium avium subsp. paratuberculosis
cggcccggccggcg

SEQ ID NO: 2910880 - RNA, 17 nt, Mycobacterium avium subsp. paratuberculosis
cggcccggccggcgcga

SEQ ID NO: 2910881 - RNA, 13 nt, Mycobacterium avium subsp. paratuberculosis
cggcccggcgaug

SEQ ID NO: 2910882 - RNA, 15 nt, Mycobacterium avium subsp. paratuberculosis
cggcccggcgaugcc

SEQ ID NO: 2910883 - RNA, 21 nt, Mycobacterium avium subsp. paratuberculosis
cggcccggcgaugccgagccc

SEQ ID NO: 2910884 - RNA, 13 nt, Mycobacterium avium subsp. paratuberculosis
cggcccggcgcgg

SEQ ID NO: 2910885 - RNA, 12 nt, Mycobacterium avium subsp. paratuberculosis
cggcccggcggg

SEQ ID NO: 2910886 - RNA, 15 nt, Mycobacterium avium subsp. paratuberculosis
cggcccggcgggcau

SEQ ID NO: 2910887 - RNA, 13 nt, Mycobacterium avium subsp. paratuberculosis
cgcgcgccccggu

SEQ ID NO: 2910888 - RNA, 20 nt, Mycobacterium avium subsp. paratuberculosis
cgcgcgccccggucccgccg

SEQ ID NO: 2910889 - RNA, 23 nt, Mycobacterium avium subsp. paratuberculosis
cgcgcgccccggucccgccggug

SEQ ID NO: 2910890 - RNA, 13 nt, Mycobacterium avium subsp. paratuberculosis
cgcgcgcccgcgg

SEQ ID NO: 2910891 - RNA, 14 nt, Mycobacterium avium subsp. paratuberculosis
cgcgcgcccgcggc

SEQ ID NO: 2910892 - RNA, 16 nt, Mycobacterium avium subsp. paratuberculosis
cgcgcgcccgcggcca

SEQ ID NO: 2910893 - RNA, 12 nt, Mycobacterium avium subsp. paratuberculosis
cgcgcgcccguc

SEQ ID NO: 2910894 - RNA, 14 nt, Mycobacterium avium subsp. paratuberculosis
cgcgcgcccgucgu

SEQ ID NO: 2910895 - RNA, 22 nt, Mycobacterium avium subsp. paratuberculosis
cgcgcgcccgucgucggucagc

SEQ ID NO: 2910896 - RNA, 19 nt, Mycobacterium avium subsp. paratuberculosis
cgcgcgccgacagacccga

SEQ ID NO: 2910897 - RNA, 21 nt, Mycobacterium avium subsp. paratuberculosis
cgcgcgccgagagcgcgucga

SEQ ID NO: 2910898 - RNA, 14 nt, Mycobacterium avium subsp. paratuberculosis
cgcgcgccgcagcg

SEQ ID NO: 2910899 - RNA, 14 nt, Mycobacterium avium subsp. paratuberculosis
cgcgcgccgccccc

SEQ ID NO: 2910900 - RNA, 13 nt, Mycobacterium avium subsp. paratuberculosis
cgcgcgccggcca

SEQ ID NO: 2910901 - RNA, 20 nt, Mycobacterium avium subsp. paratuberculosis
cgcgcgccggccagcacggc

SEQ ID NO: 2910902 - RNA, 14 nt, Mycobacterium avium subsp. paratuberculosis
cgcgcgccggcgca

SEQ ID NO: 2910903 - RNA, 15 nt, Mycobacterium avium subsp. paratuberculosis
cgcgcgccggcgcag

SEQ ID NO: 2910904 - RNA, 11 nt, Mycobacterium avium subsp. paratuberculosis
cgcgcgccggg

SEQ ID NO: 2910905 - RNA, 12 nt, Mycobacterium avium subsp. paratuberculosis
cgcgcgccggga

SEQ ID NO: 2910906 - RNA, 14 nt, Mycobacterium avium subsp. paratuberculosis
cgcgcgccgggauc

SEQ ID NO: 2910907 - RNA, 17 nt, Mycobacterium avium subsp. paratuberculosis
cgcgcgcgaacaggucc

SEQ ID NO: 2910908 - RNA, 15 nt, Mycobacterium avium subsp. paratuberculosis
cgcgcgcgacggcgc

SEQ ID NO: 2910909 - RNA, 14 nt, Mycobacterium avium subsp. paratuberculosis
cgcgcgcgagccga

SEQ ID NO: 2910910 - RNA, 13 nt, Mycobacterium avium subsp. paratuberculosis
cgcgcgcgaucgg

SEQ ID NO: 2910911 - RNA, 12 nt, Mycobacterium avium subsp. paratuberculosis
cgcgcgcgccgu

SEQ ID NO: 2910912 - RNA, 13 nt, Mycobacterium avium subsp. paratuberculosis
cgcgcgcgccguc

SEQ ID NO: 2910913 - RNA, 15 nt, Mycobacterium avium subsp. paratuberculosis
cgcgcgcgcggccuc

SEQ ID NO: 2910914 - RNA, 14 nt, Mycobacterium avium subsp. paratuberculosis
cgcgcgcggcacgg

SEQ ID NO: 2910915 - RNA, 15 nt, Mycobacterium avium subsp. paratuberculosis
cgcgcgcggccaccg

SEQ ID NO: 2910916 - RNA, 11 nt, Mycobacterium avium subsp. paratuberculosis
cgcgcgcggcg

SEQ ID NO: 2910917 - RNA, 13 nt, Mycobacterium avium subsp. paratuberculosis
cgcgcgcggcgac

SEQ ID NO: 2910918 - RNA, 15 nt, Mycobacterium avium subsp. paratuberculosis
cgcgcgcggcgacgg

SEQ ID NO: 2910919 - RNA, 15 nt, Mycobacterium avium subsp. paratuberculosis
cgcgcgcggcgccgc

SEQ ID NO: 2910920 - RNA, 13 nt, Mycobacterium avium subsp. paratuberculosis
cgcgcgcggcgcg

SEQ ID NO: 2910921 - RNA, 15 nt, Mycobacterium avium subsp. paratuberculosis
cgcgcgcggcgcgga

SEQ ID NO: 2910922 - RNA, 17 nt, Mycobacterium avium subsp. paratuberculosis
cgcgcgcggcggccacc

SEQ ID NO: 2910923 - RNA, 14 nt, Mycobacterium avium subsp. paratuberculosis
cgcgcgcggcguca

SEQ ID NO: 2910924 - RNA, 15 nt, Mycobacterium avium subsp. paratuberculosis
cgcgcgcggcguggu

SEQ ID NO: 2910925 - RNA, 13 nt, Mycobacterium avium subsp. paratuberculosis
cgcgcgcgggcca

SEQ ID NO: 2910926 - RNA, 14 nt, Mycobacterium avium subsp. paratuberculosis
cgcgcgcgggccag

SEQ ID NO: 2910927 - RNA, 14 nt, Mycobacterium avium subsp. paratuberculosis
cgcgcgcggguaga

SEQ ID NO: 2910928 - RNA, 12 nt, Mycobacterium avium subsp. paratuberculosis
cgcgcgcucggg

SEQ ID NO: 2910929 - RNA, 13 nt, Mycobacterium avium subsp. paratuberculosis
cgcgcgcucgggg

SEQ ID NO: 2910930 - RNA, 19 nt, Mycobacterium avium subsp. paratuberculosis
cgcgcgcucggucagcacc

SEQ ID NO: 2910931 - RNA, 21 nt, Mycobacterium avium subsp. paratuberculosis
cgcgcgcucggucagcaccgg

SEQ ID NO: 2910932 - RNA, 12 nt, Mycobacterium avium subsp. paratuberculosis
cgcgcgcugacc

SEQ ID NO: 2910933 - RNA, 14 nt, Mycobacterium avium subsp. paratuberculosis
cgcgcgcugacccc

SEQ ID NO: 2910934 - RNA, 17 nt, Mycobacterium avium subsp. paratuberculosis
cgcgcgcugcagcaucc

SEQ ID NO: 2910935 - RNA, 13 nt, Mycobacterium avium subsp. paratuberculosis
cgcgcgcugccgc

SEQ ID NO: 2910936 - RNA, 14 nt, Mycobacterium avium subsp. paratuberculosis
cgcgcgcugccgcg

SEQ ID NO: 2910937 - RNA, 21 nt, Mycobacterium avium subsp. paratuberculosis
cgcgcgcugccgcgccccgag

SEQ ID NO: 2910938 - RNA, 22 nt, Mycobacterium avium subsp. paratuberculosis
cgcgcgcuguccucgucgggga

SEQ ID NO: 2910939 - RNA, 20 nt, Mycobacterium avium subsp. paratuberculosis
cgcgcggaugcccaggccgg

SEQ ID NO: 2910940 - RNA, 22 nt, Mycobacterium avium subsp. paratuberculosis
cgcgcggaugcccaggccggcg

SEQ ID NO: 2910941 - RNA, 23 nt, Mycobacterium avium subsp. paratuberculosis
cgcgcggaugcccaggccggcga

SEQ ID NO: 2910942 - RNA, 21 nt, Mycobacterium avium subsp. paratuberculosis
cgcgcggauuucucagcggcg

SEQ ID NO: 2910943 - RNA, 23 nt, Mycobacterium avium subsp. paratuberculosis
cgcgcggauuucucagcggcgcu

SEQ ID NO: 2910944 - RNA, 20 nt, Mycobacterium avium subsp. paratuberculosis
cgcgcggcaccaccagcgug

SEQ ID NO: 2910945 - RNA, 22 nt, Mycobacterium avium subsp. paratuberculosis
cgcgcggcaccaccagcgugug

SEQ ID NO: 2910946 - RNA, 15 nt, Mycobacterium avium subsp. paratuberculosis
cgcgcggcaucguca

SEQ ID NO: 2910947 - RNA, 13 nt, Mycobacterium avium subsp. paratuberculosis
cgcgcggccacca

SEQ ID NO: 2910948 - RNA, 14 nt, Mycobacterium avium subsp. paratuberculosis
cgcgcggccaccag

SEQ ID NO: 2910949 - RNA, 19 nt, Mycobacterium avium subsp. paratuberculosis
cgcgcggccaccagcgcgg

SEQ ID NO: 2910950 - RNA, 14 nt, Mycobacterium avium subsp. paratuberculosis
cgcgcggccaccgc

SEQ ID NO: 2910951 - RNA, 21 nt, Mycobacterium avium subsp. paratuberculosis
cgcgcggccaccgcgcgcugc

SEQ ID NO: 2910952 - RNA, 12 nt, Mycobacterium avium subsp. paratuberculosis
cgcgcggccagc

SEQ ID NO: 2910953 - RNA, 13 nt, Mycobacterium avium subsp. paratuberculosis
cgcgcggccagcc

SEQ ID NO: 2910954 - RNA, 14 nt, Mycobacterium avium subsp. paratuberculosis
cgcgcggccagccc

SEQ ID NO: 2910955 - RNA, 15 nt, Mycobacterium avium subsp. paratuberculosis
cgcgcggccagcggc

SEQ ID NO: 2910956 - RNA, 18 nt, Mycobacterium avium subsp. paratuberculosis
cgcgcggccagcggcgcc

SEQ ID NO: 2910957 - RNA, 13 nt, Mycobacterium avium subsp. paratuberculosis
cgcgcggcccagc

SEQ ID NO: 2910958 - RNA, 17 nt, Mycobacterium avium subsp. paratuberculosis
cgcgcggcccagcguca

SEQ ID NO: 2910959 - RNA, 14 nt, Mycobacterium avium subsp. paratuberculosis
cgcgcggccgccag

SEQ ID NO: 2910960 - RNA, 15 nt, Mycobacterium avium subsp. paratuberculosis
cgcgcggccgccagg

SEQ ID NO: 2910961 - RNA, 16 nt, Mycobacterium avium subsp. paratuberculosis
cgcgcggccgccaggu

SEQ ID NO: 2910962 - RNA, 13 nt, Mycobacterium avium subsp. paratuberculosis
cgcgcggccgcga

SEQ ID NO: 2910963 - RNA, 14 nt, Mycobacterium avium subsp. paratuberculosis
cgcgcggccggcca

SEQ ID NO: 2910964 - RNA, 15 nt, Mycobacterium avium subsp. paratuberculosis
cgcgcggccggccac

SEQ ID NO: 2910965 - RNA, 17 nt, Mycobacterium avium subsp. paratuberculosis
cgcgcggccggccacgc

SEQ ID NO: 2910966 - RNA, 16 nt, Mycobacterium avium subsp. paratuberculosis
cgcgcggccuccagcc

SEQ ID NO: 2910967 - RNA, 17 nt, Mycobacterium avium subsp. paratuberculosis
cgcgcggccuccagccg

SEQ ID NO: 2910968 - RNA, 15 nt, Mycobacterium avium subsp. paratuberculosis
cgcgcggcgacggug

SEQ ID NO: 2910969 - RNA, 19 nt, Mycobacterium avium subsp. paratuberculosis
cgcgcggcgcagggcggcc

SEQ ID NO: 2910970 - RNA, 23 nt, Mycobacterium avium subsp. paratuberculosis
cgcgcggcgcaguucgaccggca

SEQ ID NO: 2910971 - RNA, 14 nt, Mycobacterium avium subsp. paratuberculosis
cgcgcggcgccagc

SEQ ID NO: 2910972 - RNA, 16 nt, Mycobacterium avium subsp. paratuberculosis
cgcgcggcgccagcgg

SEQ ID NO: 2910973 - RNA, 12 nt, Mycobacterium avium subsp. paratuberculosis
cgcgcggcgccc

SEQ ID NO: 2910974 - RNA, 13 nt, Mycobacterium avium subsp. paratuberculosis
cgcgcggcgccgc

SEQ ID NO: 2910975 - RNA, 18 nt, Mycobacterium avium subsp. paratuberculosis
cgcgcggcgcggagccgg

SEQ ID NO: 2910976 - RNA, 21 nt, Mycobacterium avium subsp. paratuberculosis
cgcgcggcgcggagccggccg

SEQ ID NO: 2910977 - RNA, 22 nt, Mycobacterium avium subsp. paratuberculosis
cgcgcggcgcggagccggccgc

SEQ ID NO: 2910978 - RNA, 21 nt, Mycobacterium avium subsp. paratuberculosis
cgcgcggcggccaacgcgacg

SEQ ID NO: 2910979 - RNA, 17 nt, Mycobacterium avium subsp. paratuberculosis
cgcgcggcggccaccgc

SEQ ID NO: 2910980 - RNA, 23 nt, Mycobacterium avium subsp. paratuberculosis
cgcgcggcggccaccgcgccgug

SEQ ID NO: 2910981 - RNA, 11 nt, Mycobacterium avium subsp. paratuberculosis
cgcgcggcggg

SEQ ID NO: 2910982 - RNA, 12 nt, Mycobacterium avium subsp. paratuberculosis
cgcgcggcgggc

SEQ ID NO: 2910983 - RNA, 14 nt, Mycobacterium avium subsp. paratuberculosis
cgcgcggcgggccc

SEQ ID NO: 2910984 - RNA, 16 nt, Mycobacterium avium subsp. paratuberculosis
cgcgcggcgggcccgc

SEQ ID NO: 2910985 - RNA, 13 nt, Mycobacterium avium subsp. paratuberculosis
cgcgcggcgguga

SEQ ID NO: 2910986 - RNA, 14 nt, Mycobacterium avium subsp. paratuberculosis
cgcgcggcgguguc

SEQ ID NO: 2910987 - RNA, 14 nt, Mycobacterium avium subsp. paratuberculosis
cgcgcggcgucggc

SEQ ID NO: 2910988 - RNA, 17 nt, Mycobacterium avium subsp. paratuberculosis
cgcgcggcgucggccgg

SEQ ID NO: 2910989 - RNA, 18 nt, Mycobacterium avium subsp. paratuberculosis
cgcgcggcgucggccggg

SEQ ID NO: 2910990 - RNA, 20 nt, Mycobacterium avium subsp. paratuberculosis
cgcgcggcuaguuggccggc

SEQ ID NO: 2910991 - RNA, 20 nt, Mycobacterium avium subsp. paratuberculosis
cgcgcggcucacagcgcggc

SEQ ID NO: 2910992 - RNA, 13 nt, Mycobacterium avium subsp. paratuberculosis
cgcgcggcucgcg

SEQ ID NO: 2910993 - RNA, 18 nt, Mycobacterium avium subsp. paratuberculosis
cgcgcggcucgcgggcga

SEQ ID NO: 2910994 - RNA, 15 nt, Mycobacterium avium subsp. paratuberculosis
cgcgcggcugcucga

SEQ ID NO: 2910995 - RNA, 15 nt, Mycobacterium avium subsp. paratuberculosis
cgcgcgggagcgcug

SEQ ID NO: 2910996 - RNA, 17 nt, Mycobacterium avium subsp. paratuberculosis
cgcgcgggagcgcuggu

SEQ ID NO: 2910997 - RNA, 20 nt, Mycobacterium avium subsp. paratuberculosis
cgcgcgggagcgcuggucgg

SEQ ID NO: 2910998 - RNA, 23 nt, Mycobacterium avium subsp. paratuberculosis
cgcgcgggagcgcuggucggcga

SEQ ID NO: 2910999 - RNA, 14 nt, Mycobacterium avium subsp. paratuberculosis
cgcgcgggccagcg

SEQ ID NO: 2911000 - RNA, 15 nt, Mycobacterium avium subsp. paratuberculosis
cgcgcgggccagcgc

SEQ ID NO: 2911001 - RNA, 16 nt, Mycobacterium avium subsp. paratuberculosis
cgcgcgggccagcgcc

SEQ ID NO: 2911002 - RNA, 14 nt, Mycobacterium avium subsp. paratuberculosis
cgcgcgggcgaccu

SEQ ID NO: 2911003 - RNA, 22 nt, Mycobacterium avium subsp. paratuberculosis
cgcgcgggcgaccugcgggccc

SEQ ID NO: 2911004 - RNA, 23 nt, Mycobacterium avium subsp. paratuberculosis
cgcgcgggcgaccugcgggccca

SEQ ID NO: 2911005 - RNA, 13 nt, Mycobacterium avium subsp. paratuberculosis
cgcgcgggcgcgc

SEQ ID NO: 2911006 - RNA, 15 nt, Mycobacterium avium subsp. paratuberculosis
cgcgcgggcgcgcgc

SEQ ID NO: 2911007 - RNA, 20 nt, Mycobacterium avium subsp. paratuberculosis
cgcgcgggcgcgcgccgccc

SEQ ID NO: 2911008 - RNA, 15 nt, Mycobacterium avium subsp. paratuberculosis
cgcgcgggcggcguc

SEQ ID NO: 2911009 - RNA, 16 nt, Mycobacterium avium subsp. paratuberculosis
cgcgcgggcggcgucg

SEQ ID NO: 2911010 - RNA, 15 nt, Mycobacterium avium subsp. paratuberculosis
cgcgcgggcguccuc

SEQ ID NO: 2911011 - RNA, 14 nt, Mycobacterium avium subsp. paratuberculosis
cgcgcggggccggc

SEQ ID NO: 2911012 - RNA, 16 nt, Mycobacterium avium subsp. paratuberculosis
cgcgcggggccggcgc

SEQ ID NO: 2911013 - RNA, 17 nt, Mycobacterium avium subsp. paratuberculosis
cgcgcggggccggcgcg

SEQ ID NO: 2911014 - RNA, 18 nt, Mycobacterium avium subsp. paratuberculosis
cgcgcggggccggcgcgg

SEQ ID NO: 2911015 - RNA, 14 nt, Mycobacterium avium subsp. paratuberculosis
cgcgcggggcggcc

SEQ ID NO: 2911016 - RNA, 16 nt, Mycobacterium avium subsp. paratuberculosis
cgcgcggggcggccgc

SEQ ID NO: 2911017 - RNA, 17 nt, Mycobacterium avium subsp. paratuberculosis
cgcgcggggcggccgcc

SEQ ID NO: 2911018 - RNA, 19 nt, Mycobacterium avium subsp. paratuberculosis
cgcgcgggggccgccgcga

SEQ ID NO: 2911019 - RNA, 20 nt, Mycobacterium avium subsp. paratuberculosis
cgcgcgggggccgccgcgau

SEQ ID NO: 2911020 - RNA, 21 nt, Mycobacterium avium subsp. paratuberculosis
cgcgcgggggccgccgcgaua

SEQ ID NO: 2911021 - RNA, 18 nt, Mycobacterium avium subsp. paratuberculosis
cgcgcggggucgggccgg

SEQ ID NO: 2911022 - RNA, 19 nt, Mycobacterium avium subsp. paratuberculosis
cgcgcggggucgggccgga

SEQ ID NO: 2911023 - RNA, 22 nt, Mycobacterium avium subsp. paratuberculosis
cgcgcggggucgggccggacag

SEQ ID NO: 2911024 - RNA, 18 nt, Mycobacterium avium subsp. paratuberculosis
cgcgcggggugacgcccg

SEQ ID NO: 2911025 - RNA, 20 nt, Mycobacterium avium subsp. paratuberculosis
cgcgcggggugacgcccguc

SEQ ID NO: 2911026 - RNA, 18 nt, Mycobacterium avium subsp. paratuberculosis
cgcgcggggugucgcggc

SEQ ID NO: 2911027 - RNA, 21 nt, Mycobacterium avium subsp. paratuberculosis
cgcgcggggugucgcggcugc

SEQ ID NO: 2911028 - RNA, 17 nt, Mycobacterium avium subsp. paratuberculosis
cgcgcggguagacguuc

SEQ ID NO: 2911029 - RNA, 22 nt, Mycobacterium avium subsp. paratuberculosis
cgcgcgggucgagcagcagccg

SEQ ID NO: 2911030 - RNA, 15 nt, Mycobacterium avium subsp. paratuberculosis
cgcgcgggucgucgg

SEQ ID NO: 2911031 - RNA, 14 nt, Mycobacterium avium subsp. paratuberculosis
cgcgcgggugcggg

SEQ ID NO: 2911032 - RNA, 19 nt, Mycobacterium avium subsp. paratuberculosis
cgcgcgggugcgggcgucc

SEQ ID NO: 2911033 - RNA, 12 nt, Mycobacterium avium subsp. paratuberculosis
cgcgcggugcac

SEQ ID NO: 2911034 - RNA, 18 nt, Mycobacterium avium subsp. paratuberculosis
cgcgcggugcaccaggac

SEQ ID NO: 2911035 - RNA, 14 nt, Mycobacterium avium subsp. paratuberculosis
cgcgcggugcacgg

SEQ ID NO: 2911036 - RNA, 16 nt, Mycobacterium avium subsp. paratuberculosis
cgcgcggugcacgguc

SEQ ID NO: 2911037 - RNA, 23 nt, Mycobacterium avium subsp. paratuberculosis
cgcgcggugcacggucagcucgc

SEQ ID NO: 2911038 - RNA, 16 nt, Mycobacterium avium subsp. paratuberculosis
cgcgcggugcccggaa

SEQ ID NO: 2911039 - RNA, 16 nt, Mycobacterium avium subsp. paratuberculosis
cgcgcggugcgccagc

SEQ ID NO: 2911040 - RNA, 17 nt, Mycobacterium avium subsp. paratuberculosis
cgcgcggugcgccagcg

SEQ ID NO: 2911041 - RNA, 19 nt, Mycobacterium avium subsp. paratuberculosis
cgcgcggugcgccagcgcc

SEQ ID NO: 2911042 - RNA, 22 nt, Mycobacterium avium subsp. paratuberculosis
cgcgcgguguuuggccgcgcag

SEQ ID NO: 2911043 - RNA, 23 nt, Mycobacterium avium subsp. paratuberculosis
cgcgcgguguuuggccgcgcagc

SEQ ID NO: 2911044 - RNA, 15 nt, Mycobacterium avium subsp. paratuberculosis
cgcgcgguuccggcg

SEQ ID NO: 2911045 - RNA, 21 nt, Mycobacterium avium subsp. paratuberculosis
cgcgcgguuccggcgugcagc

SEQ ID NO: 2911046 - RNA, 20 nt, Mycobacterium avium subsp. paratuberculosis
cgcgcguagugcucgcgcag

SEQ ID NO: 2911047 - RNA, 19 nt, Mycobacterium avium subsp. paratuberculosis
cgcgcguauuccagcgcca

SEQ ID NO: 2911048 - RNA, 23 nt, Mycobacterium avium subsp. paratuberculosis
cgcgcguauuccagcgccagcga

SEQ ID NO: 2911049 - RNA, 15 nt, Mycobacterium avium subsp. paratuberculosis
cgcgcgucgggcucg

SEQ ID NO: 2911050 - RNA, 19 nt, Mycobacterium avium subsp. paratuberculosis
cgcgcgucgggggugccgc

SEQ ID NO: 2911051 - RNA, 16 nt, Mycobacterium avium subsp. paratuberculosis
cgcgcgucucccccga

SEQ ID NO: 2911052 - RNA, 19 nt, Mycobacterium avium subsp. paratuberculosis
cgcgcgucucccccgauca

SEQ ID NO: 2911053 - RNA, 15 nt, Mycobacterium avium subsp. paratuberculosis
cgcgcgugcagccgg

SEQ ID NO: 2911054 - RNA, 16 nt, Mycobacterium avium subsp. paratuberculosis
cgcgcgugggccaacg

SEQ ID NO: 2911055 - RNA, 18 nt, Mycobacterium avium subsp. paratuberculosis
cgcgcgugggccaacgcg

SEQ ID NO: 2911056 - RNA, 17 nt, Mycobacterium avium subsp. paratuberculosis
cgcgcguuccagcacgc

SEQ ID NO: 2911057 - RNA, 20 nt, Mycobacterium avium subsp. paratuberculosis
cgcgcguuccagcacgccca

SEQ ID NO: 2911058 - RNA, 22 nt, Mycobacterium avium subsp. paratuberculosis
cgcgcguucgaguucgucgacc

SEQ ID NO: 2911059 - RNA, 19 nt, Mycobacterium avium subsp. paratuberculosis
cgcgcuaggacgcgggccu

SEQ ID NO: 2911060 - RNA, 19 nt, Mycobacterium avium subsp. paratuberculosis
cgcgcucaacccgggccgg

SEQ ID NO: 2911061 - RNA, 13 nt, Mycobacterium avium subsp. paratuberculosis
cgcgcucaaccgc

SEQ ID NO: 2911062 - RNA, 19 nt, Mycobacterium avium subsp. paratuberculosis
cgcgcucaaccgcccagcg

SEQ ID NO: 2911063 - RNA, 20 nt, Mycobacterium avium subsp. paratuberculosis
cgcgcucaaccgcccagcgg

SEQ ID NO: 2911064 - RNA, 14 nt, Mycobacterium avium subsp. paratuberculosis
cgcgcucaccgucg

SEQ ID NO: 2911065 - RNA, 16 nt, Mycobacterium avium subsp. paratuberculosis
cgcgcucaccgucgcg

SEQ ID NO: 2911066 - RNA, 17 nt, Mycobacterium avium subsp. paratuberculosis
cgcgcucaccgucgcgg

SEQ ID NO: 2911067 - RNA, 14 nt, Mycobacterium avium subsp. paratuberculosis
cgcgcucagcgcgg

SEQ ID NO: 2911068 - RNA, 17 nt, Mycobacterium avium subsp. paratuberculosis
cgcgcucagcgcggcca

SEQ ID NO: 2911069 - RNA, 16 nt, Mycobacterium avium subsp. paratuberculosis
cgcgcucagugcacgc

SEQ ID NO: 2911070 - RNA, 21 nt, Mycobacterium avium subsp. paratuberculosis
cgcgcucagugcacgcucggc

SEQ ID NO: 2911071 - RNA, 17 nt, Mycobacterium avium subsp. paratuberculosis
cgcgcucauaucccguc

SEQ ID NO: 2911072 - RNA, 19 nt, Mycobacterium avium subsp. paratuberculosis
cgcgcucauaucccgucag

SEQ ID NO: 2911073 - RNA, 14 nt, Mycobacterium avium subsp. paratuberculosis
cgcgcucccggcgc

SEQ ID NO: 2911074 - RNA, 14 nt, Mycobacterium avium subsp. paratuberculosis
cgcgcucgaacuca

SEQ ID NO: 2911075 - RNA, 23 nt, Mycobacterium avium subsp. paratuberculosis
cgcgcucgacgaugucgacgccc

SEQ ID NO: 2911076 - RNA, 21 nt, Mycobacterium avium subsp. paratuberculosis
cgcgcucggccauccgggcgg

SEQ ID NO: 2911077 - RNA, 15 nt, Mycobacterium avium subsp. paratuberculosis
cgcgcucggcgaccg

SEQ ID NO: 2911078 - RNA, 17 nt, Mycobacterium avium subsp. paratuberculosis
cgcgcucggcgaccgcc

SEQ ID NO: 2911079 - RNA, 15 nt, Mycobacterium avium subsp. paratuberculosis
cgcgcucggcgacga

SEQ ID NO: 2911080 - RNA, 14 nt, Mycobacterium avium subsp. paratuberculosis
cgcgcucggcguug

SEQ ID NO: 2911081 - RNA, 15 nt, Mycobacterium avium subsp. paratuberculosis
cgcgcucggcguugg

SEQ ID NO: 2911082 - RNA, 20 nt, Mycobacterium avium subsp. paratuberculosis
cgcgcucgggggugcccggc

SEQ ID NO: 2911083 - RNA, 18 nt, Mycobacterium avium subsp. paratuberculosis
cgcgcucggucagcaccg

SEQ ID NO: 2911084 - RNA, 21 nt, Mycobacterium avium subsp. paratuberculosis
cgcgcucggucagcaccgggg

SEQ ID NO: 2911085 - RNA, 22 nt, Mycobacterium avium subsp. paratuberculosis
cgcgcucggucagcaccggggc

SEQ ID NO: 2911086 - RNA, 14 nt, Mycobacterium avium subsp. paratuberculosis
cgcgcucguccagg

SEQ ID NO: 2911087 - RNA, 21 nt, Mycobacterium avium subsp. paratuberculosis
cgcgcucguccaggguggcca

SEQ ID NO: 2911088 - RNA, 15 nt, Mycobacterium avium subsp. paratuberculosis
cgcgcucgucgauca

SEQ ID NO: 2911089 - RNA, 14 nt, Mycobacterium avium subsp. paratuberculosis
cgcgcucgucgucg

SEQ ID NO: 2911090 - RNA, 15 nt, Mycobacterium avium subsp. paratuberculosis
cgcgcucgucgucgg

SEQ ID NO: 2911091 - RNA, 20 nt, Mycobacterium avium subsp. paratuberculosis
cgcgcucgucgucggugaac

SEQ ID NO: 2911092 - RNA, 23 nt, Mycobacterium avium subsp. paratuberculosis
cgcgcucgucgucggugaacgcc

SEQ ID NO: 2911093 - RNA, 24 nt, Mycobacterium avium subsp. paratuberculosis
cgcgcucgucgucggugaacgccg

SEQ ID NO: 2911094 - RNA, 20 nt, Mycobacterium avium subsp. paratuberculosis
cgcgcucuaacuccgcucgg

SEQ ID NO: 2911095 - RNA, 22 nt, Mycobacterium avium subsp. paratuberculosis
cgcgcucuaacuccgcucgggc

SEQ ID NO: 2911096 - RNA, 20 nt, Mycobacterium avium subsp. paratuberculosis
cgcgcucuugggcggccggc

SEQ ID NO: 2911097 - RNA, 21 nt, Mycobacterium avium subsp. paratuberculosis
cgcgcucuugggcggccggcu

SEQ ID NO: 2911098 - RNA, 13 nt, Mycobacterium avium subsp. paratuberculosis
cgcgcugaacgcg

SEQ ID NO: 2911099 - RNA, 16 nt, Mycobacterium avium subsp. paratuberculosis
cgcgcugaagcgcgac

SEQ ID NO: 2911100 - RNA, 14 nt, Mycobacterium avium subsp. paratuberculosis
cgcgcugaccagcg

SEQ ID NO: 2911101 - RNA, 15 nt, Mycobacterium avium subsp. paratuberculosis
cgcgcugaccagcgu

SEQ ID NO: 2911102 - RNA, 16 nt, Mycobacterium avium subsp. paratuberculosis
cgcgcugaccagcgug

SEQ ID NO: 2911103 - RNA, 17 nt, Mycobacterium avium subsp. paratuberculosis
cgcgcugaccagcguga

SEQ ID NO: 2911104 - RNA, 23 nt, Mycobacterium avium subsp. paratuberculosis
cgcgcugaccagcgugaccucga

SEQ ID NO: 2911105 - RNA, 15 nt, Mycobacterium avium subsp. paratuberculosis
cgcgcugaccaggcc

SEQ ID NO: 2911106 - RNA, 23 nt, Mycobacterium avium subsp. paratuberculosis
cgcgcugaccaggccguccacca

SEQ ID NO: 2911107 - RNA, 13 nt, Mycobacterium avium subsp. paratuberculosis
cgcgcugagcagg

SEQ ID NO: 2911108 - RNA, 13 nt, Mycobacterium avium subsp. paratuberculosis
cgcgcugaucgcc

SEQ ID NO: 2911109 - RNA, 16 nt, Mycobacterium avium subsp. paratuberculosis
cgcgcugaucgccgcu

SEQ ID NO: 2911110 - RNA, 20 nt, Mycobacterium avium subsp. paratuberculosis
cgcgcugcagcauccaggug

SEQ ID NO: 2911111 - RNA, 14 nt, Mycobacterium avium subsp. paratuberculosis
cgcgcugccagggc

SEQ ID NO: 2911112 - RNA, 13 nt, Mycobacterium avium subsp. paratuberculosis
cgcgcugcccagc

SEQ ID NO: 2911113 - RNA, 17 nt, Mycobacterium avium subsp. paratuberculosis
cgcgcugcccagcgcgg

SEQ ID NO: 2911114 - RNA, 22 nt, Mycobacterium avium subsp. paratuberculosis
cgcgcugcccagcgcggucgcc

SEQ ID NO: 2911115 - RNA, 17 nt, Mycobacterium avium subsp. paratuberculosis
cgcgcugccgacgaugu

SEQ ID NO: 2911116 - RNA, 15 nt, Mycobacterium avium subsp. paratuberculosis
cgcgcugccgcgccc

SEQ ID NO: 2911117 - RNA, 15 nt, Mycobacterium avium subsp. paratuberculosis
cgcgcugccggcccg

SEQ ID NO: 2911118 - RNA, 16 nt, Mycobacterium avium subsp. paratuberculosis
cgcgcugccggcccga

SEQ ID NO: 2911119 - RNA, 12 nt, Mycobacterium avium subsp. paratuberculosis
cgcgcugcgccg

SEQ ID NO: 2911120 - RNA, 14 nt, Mycobacterium avium subsp. paratuberculosis
cgcgcugcgcgccg

SEQ ID NO: 2911121 - RNA, 17 nt, Mycobacterium avium subsp. paratuberculosis
cgcgcugcgcgccgccc

SEQ ID NO: 2911122 - RNA, 14 nt, Mycobacterium avium subsp. paratuberculosis
cgcgcugcgcgcgu

SEQ ID NO: 2911123 - RNA, 14 nt, Mycobacterium avium subsp. paratuberculosis
cgcgcugcggcguc

SEQ ID NO: 2911124 - RNA, 14 nt, Mycobacterium avium subsp. paratuberculosis
cgcgcugcuugacc

SEQ ID NO: 2911125 - RNA, 16 nt, Mycobacterium avium subsp. paratuberculosis
cgcgcugcuugacccg

SEQ ID NO: 2911126 - RNA, 19 nt, Mycobacterium avium subsp. paratuberculosis
cgcgcugcuugacccgcuc

SEQ ID NO: 2911127 - RNA, 14 nt, Mycobacterium avium subsp. paratuberculosis
cgcgcuggccagcg

SEQ ID NO: 2911128 - RNA, 23 nt, Mycobacterium avium subsp. paratuberculosis
cgcgcuggccagcgucagggcga

SEQ ID NO: 2911129 - RNA, 14 nt, Mycobacterium avium subsp. paratuberculosis
cgcgcuggccgcgu

SEQ ID NO: 2911130 - RNA, 16 nt, Mycobacterium avium subsp. paratuberculosis
cgcgcuggccgcgugc

SEQ ID NO: 2911131 - RNA, 14 nt, Mycobacterium avium subsp. paratuberculosis
cgcgcuggcggcca

SEQ ID NO: 2911132 - RNA, 19 nt, Mycobacterium avium subsp. paratuberculosis
cgcgcuggcggccaucgcc

SEQ ID NO: 2911133 - RNA, 22 nt, Mycobacterium avium subsp. paratuberculosis
cgcgcuggcggccaucgccgcg

SEQ ID NO: 2911134 - RNA, 15 nt, Mycobacterium avium subsp. paratuberculosis
cgcgcugggcuaacg

SEQ ID NO: 2911135 - RNA, 23 nt, Mycobacterium avium subsp. paratuberculosis
cgcgcugggcuaacgcuggucga

SEQ ID NO: 2911136 - RNA, 18 nt, Mycobacterium avium subsp. paratuberculosis
cgcgcugggcuggccguc

SEQ ID NO: 2911137 - RNA, 19 nt, Mycobacterium avium subsp. paratuberculosis
cgcgcuggugcgggccagc

SEQ ID NO: 2911138 - RNA, 20 nt, Mycobacterium avium subsp. paratuberculosis
cgcgcuggugcgggccagca

SEQ ID NO: 2911139 - RNA, 21 nt, Mycobacterium avium subsp. paratuberculosis
cgcgcuggugcgggccagcac

SEQ ID NO: 2911140 - RNA, 22 nt, Mycobacterium avium subsp. paratuberculosis
cgcgcuggugcgggccagcacg

SEQ ID NO: 2911141 - RNA, 15 nt, Mycobacterium avium subsp. paratuberculosis
cgcgcuggugcugcc

SEQ ID NO: 2911142 - RNA, 12 nt, Mycobacterium avium subsp. paratuberculosis
cgcgcuguccac

SEQ ID NO: 2911143 - RNA, 19 nt, Mycobacterium avium subsp. paratuberculosis
cgcgcuguccacguccugc

SEQ ID NO: 2911144 - RNA, 14 nt, Mycobacterium avium subsp. paratuberculosis
cgcgcugucgacgc

SEQ ID NO: 2911145 - RNA, 15 nt, Mycobacterium avium subsp. paratuberculosis
cgcgcugucgacgcg

SEQ ID NO: 2911146 - RNA, 15 nt, Mycobacterium avium subsp. paratuberculosis
cgcgcugucgcccuc

SEQ ID NO: 2911147 - RNA, 23 nt, Mycobacterium avium subsp. paratuberculosis
cgcgcugucgcccucgaucgcga

SEQ ID NO: 2911148 - RNA, 23 nt, Mycobacterium avium subsp. paratuberculosis
cgcgcugugcgccauguccggca

SEQ ID NO: 2911149 - RNA, 16 nt, Mycobacterium avium subsp. paratuberculosis
cgcgcuugacggccgg

SEQ ID NO: 2911150 - RNA, 17 nt, Mycobacterium avium subsp. paratuberculosis
cgcgcuugacggccggg

SEQ ID NO: 2911151 - RNA, 19 nt, Mycobacterium avium subsp. paratuberculosis
cgcgcuugacggccgggcc

SEQ ID NO: 2911152 - RNA, 16 nt, Mycobacterium avium subsp. paratuberculosis
cgcgcuugccgcgacc

SEQ ID NO: 2911153 - RNA, 14 nt, Mycobacterium avium subsp. paratuberculosis
cgcgcuugcgaccg

SEQ ID NO: 2911154 - RNA, 16 nt, Mycobacterium avium subsp. paratuberculosis
cgcgcuugcgaccgcc

SEQ ID NO: 2911155 - RNA, 18 nt, Mycobacterium avium subsp. paratuberculosis
cgcgcuugcgaccgccgc

SEQ ID NO: 2911156 - RNA, 20 nt, Mycobacterium avium subsp. paratuberculosis
cgcgcuugcgaccgccgcua

SEQ ID NO: 2911157 - RNA, 21 nt, Mycobacterium avium subsp. paratuberculosis
cgcgcuugcgaucgccgcgca

SEQ ID NO: 2911158 - RNA, 15 nt, Mycobacterium avium subsp. paratuberculosis
cgcgcuugcgcucgg

SEQ ID NO: 2911159 - RNA, 23 nt, Mycobacterium avium subsp. paratuberculosis
cgcgcuugcgcucggucgcggcg

SEQ ID NO: 2911160 - RNA, 21 nt, Mycobacterium avium subsp. paratuberculosis
cgcgcuugggguucuuggcgu

SEQ ID NO: 2911161 - RNA, 15 nt, Mycobacterium avium subsp. paratuberculosis
cgcgcuugguggcga

SEQ ID NO: 2911162 - RNA, 17 nt, Mycobacterium avium subsp. paratuberculosis
cgcgcuuguacaggucg

SEQ ID NO: 2911163 - RNA, 18 nt, Mycobacterium avium subsp. paratuberculosis
cgcgcuuuggaccagggc

SEQ ID NO: 2911164 - RNA, 21 nt, Mycobacterium avium subsp. paratuberculosis
cgcgcuuuggaccagggcggu

SEQ ID NO: 2911165 - RNA, 19 nt, Mycobacterium avium subsp. paratuberculosis
cgcggaaacuccuggcccc

SEQ ID NO: 2911166 - RNA, 14 nt, Mycobacterium avium subsp. paratuberculosis
cgcggaacagccgg

SEQ ID NO: 2911167 - RNA, 18 nt, Mycobacterium avium subsp. paratuberculosis
cgcggaacagcgucgccg

SEQ ID NO: 2911168 - RNA, 20 nt, Mycobacterium avium subsp. paratuberculosis
cgcggaacagcgucgccgac

SEQ ID NO: 2911169 - RNA, 21 nt, Mycobacterium avium subsp. paratuberculosis
cgcggaacagcgucgccgacg

SEQ ID NO: 2911170 - RNA, 22 nt, Mycobacterium avium subsp. paratuberculosis
cgcggaacagcgucgccgacgg

SEQ ID NO: 2911171 - RNA, 20 nt, Mycobacterium avium subsp. paratuberculosis
cgcggaaccggccggggcgc

SEQ ID NO: 2911172 - RNA, 21 nt, Mycobacterium avium subsp. paratuberculosis
cgcggaaccguagaccaccuc

SEQ ID NO: 2911173 - RNA, 16 nt, Mycobacterium avium subsp. paratuberculosis
cgcggaaccguugcag

SEQ ID NO: 2911174 - RNA, 15 nt, Mycobacterium avium subsp. paratuberculosis
cgcggaacgcgccgg

SEQ ID NO: 2911175 - RNA, 17 nt, Mycobacterium avium subsp. paratuberculosis
cgcggaacgcgccgggc

SEQ ID NO: 2911176 - RNA, 23 nt, Mycobacterium avium subsp. paratuberculosis
cgcggaacgcgccgggcaacagc

SEQ ID NO: 2911177 - RNA, 15 nt, Mycobacterium avium subsp. paratuberculosis
cgcggaacgggucga

SEQ ID NO: 2911178 - RNA, 20 nt, Mycobacterium avium subsp. paratuberculosis
cgcggaacugcucccaggcg

SEQ ID NO: 2911179 - RNA, 21 nt, Mycobacterium avium subsp. paratuberculosis
cgcggaacugcucccaggcgu

SEQ ID NO: 2911180 - RNA, 21 nt, Mycobacterium avium subsp. paratuberculosis
cgcggaagaacaguuccucgg

SEQ ID NO: 2911181 - RNA, 23 nt, Mycobacterium avium subsp. paratuberculosis
cgcggaagaacaguuccucggcg

SEQ ID NO: 2911182 - RNA, 18 nt, Mycobacterium avium subsp. paratuberculosis
cgcggaagccccaggccc

SEQ ID NO: 2911183 - RNA, 20 nt, Mycobacterium avium subsp. paratuberculosis
cgcggaaguggaccgcgugu

SEQ ID NO: 2911184 - RNA, 15 nt, Mycobacterium avium subsp. paratuberculosis
cgcggaaugcucgac

SEQ ID NO: 2911185 - RNA, 20 nt, Mycobacterium avium subsp. paratuberculosis
cgcggaaugcucgacacgau

SEQ ID NO: 2911186 - RNA, 22 nt, Mycobacterium avium subsp. paratuberculosis
cgcggaaugcucgacacgaugu

SEQ ID NO: 2911187 - RNA, 14 nt, Mycobacterium avium subsp. paratuberculosis
cgcggacaccaggu

SEQ ID NO: 2911188 - RNA, 18 nt, Mycobacterium avium subsp. paratuberculosis
cgcggacacgaacgacgc

SEQ ID NO: 2911189 - RNA, 24 nt, Mycobacterium avium subsp. paratuberculosis
cgcggacacgaacgacgcggcacg

SEQ ID NO: 2911190 - RNA, 12 nt, Mycobacterium avium subsp. paratuberculosis
cgcggacacgcg

SEQ ID NO: 2911191 - RNA, 14 nt, Mycobacterium avium subsp. paratuberculosis
cgcggacacgcgga

SEQ ID NO: 2911192 - RNA, 13 nt, Mycobacterium avium subsp. paratuberculosis
cgcggacacggcc

SEQ ID NO: 2911193 - RNA, 14 nt, Mycobacterium avium subsp. paratuberculosis
cgcggacacggccg

SEQ ID NO: 2911194 - RNA, 15 nt, Mycobacterium avium subsp. paratuberculosis
cgcggacacggccgg

SEQ ID NO: 2911195 - RNA, 17 nt, Mycobacterium avium subsp. paratuberculosis
cgcggacacggccggga

SEQ ID NO: 2911196 - RNA, 14 nt, Mycobacterium avium subsp. paratuberculosis
cgcggacagcgcgg

SEQ ID NO: 2911197 - RNA, 16 nt, Mycobacterium avium subsp. paratuberculosis
cgcggacagcgcggug

SEQ ID NO: 2911198 - RNA, 13 nt, Mycobacterium avium subsp. paratuberculosis
cgcggacagcucg

SEQ ID NO: 2911199 - RNA, 16 nt, Mycobacterium avium subsp. paratuberculosis
cgcggacagcucgccg

SEQ ID NO: 2911200 - RNA, 19 nt, Mycobacterium avium subsp. paratuberculosis
cgcggacagcucgccggcc

SEQ ID NO: 2911201 - RNA, 22 nt, Mycobacterium avium subsp. paratuberculosis
cgcggacagcucgccggccgcg

SEQ ID NO: 2911202 - RNA, 15 nt, Mycobacterium avium subsp. paratuberculosis
cgcggacagcugcgc

SEQ ID NO: 2911203 - RNA, 19 nt, Mycobacterium avium subsp. paratuberculosis
cgcggacagcugcgcgggc

SEQ ID NO: 2911204 - RNA, 14 nt, Mycobacterium avium subsp. paratuberculosis
cgcggacagggcgg

SEQ ID NO: 2911205 - RNA, 18 nt, Mycobacterium avium subsp. paratuberculosis
cgcggacagggcggcgac

SEQ ID NO: 2911206 - RNA, 19 nt, Mycobacterium avium subsp. paratuberculosis
cgcggacagggcggcgacc

SEQ ID NO: 2911207 - RNA, 19 nt, Mycobacterium avium subsp. paratuberculosis
cgcggacauucggacggcc

SEQ ID NO: 2911208 - RNA, 21 nt, Mycobacterium avium subsp. paratuberculosis
cgcggacauucugcacgacga

SEQ ID NO: 2911209 - RNA, 14 nt, Mycobacterium avium subsp. paratuberculosis
cgcggaccaccgcg

SEQ ID NO: 2911210 - RNA, 15 nt, Mycobacterium avium subsp. paratuberculosis
cgcggaccccagcgu

SEQ ID NO: 2911211 - RNA, 16 nt, Mycobacterium avium subsp. paratuberculosis
cgcggaccccagcgug

SEQ ID NO: 2911212 - RNA, 17 nt, Mycobacterium avium subsp. paratuberculosis
cgcggaccccagugcag

SEQ ID NO: 2911213 - RNA, 18 nt, Mycobacterium avium subsp. paratuberculosis
cgcggacccgacggucgg

SEQ ID NO: 2911214 - RNA, 22 nt, Mycobacterium avium subsp. paratuberculosis
cgcggacccgacggucgggccc

SEQ ID NO: 2911215 - RNA, 18 nt, Mycobacterium avium subsp. paratuberculosis
cgcggacccuggccagca

SEQ ID NO: 2911216 - RNA, 20 nt, Mycobacterium avium subsp. paratuberculosis
cgcggacccuggccagcacc

SEQ ID NO: 2911217 - RNA, 21 nt, Mycobacterium avium subsp. paratuberculosis
cgcggacccuggccagcaccg

SEQ ID NO: 2911218 - RNA, 22 nt, Mycobacterium avium subsp. paratuberculosis
cgcggacccuggccagcaccgc

SEQ ID NO: 2911219 - RNA, 20 nt, Mycobacterium avium subsp. paratuberculosis
cgcggaccgcacccccagcu

SEQ ID NO: 2911220 - RNA, 14 nt, Mycobacterium avium subsp. paratuberculosis
cgcggaccggcgau

SEQ ID NO: 2911221 - RNA, 21 nt, Mycobacterium avium subsp. paratuberculosis
cgcggaccggcgauuucggcc

SEQ ID NO: 2911222 - RNA, 18 nt, Mycobacterium avium subsp. paratuberculosis
cgcggaccuuggugucgg

SEQ ID NO: 2911223 - RNA, 21 nt, Mycobacterium avium subsp. paratuberculosis
cgcggaccuuggugucggcga

SEQ ID NO: 2911224 - RNA, 23 nt, Mycobacterium avium subsp. paratuberculosis
cgcggaccuuggugucggcgagc

SEQ ID NO: 2911225 - RNA, 14 nt, Mycobacterium avium subsp. paratuberculosis
cgcggacgcggcgg

SEQ ID NO: 2911226 - RNA, 13 nt, Mycobacterium avium subsp. paratuberculosis
cgcggacggaucg

SEQ ID NO: 2911227 - RNA, 22 nt, Mycobacterium avium subsp. paratuberculosis
cgcggacggaucgagucccgcg

SEQ ID NO: 2911228 - RNA, 15 nt, Mycobacterium avium subsp. paratuberculosis
cgcggacggccagcc

SEQ ID NO: 2911229 - RNA, 20 nt, Mycobacterium avium subsp. paratuberculosis
cgcggacggguugggcgcca

SEQ ID NO: 2911230 - RNA, 22 nt, Mycobacterium avium subsp. paratuberculosis
cgcggacggguugggcgccagc

SEQ ID NO: 2911231 - RNA, 23 nt, Mycobacterium avium subsp. paratuberculosis
cgcggacggguugggcgccagca

SEQ ID NO: 2911232 - RNA, 14 nt, Mycobacterium avium subsp. paratuberculosis
cgcggacuggccac

SEQ ID NO: 2911233 - RNA, 15 nt, Mycobacterium avium subsp. paratuberculosis
cgcggacuggccacc

SEQ ID NO: 2911234 - RNA, 17 nt, Mycobacterium avium subsp. paratuberculosis
cgcggacuggccaccgc

SEQ ID NO: 2911235 - RNA, 18 nt, Mycobacterium avium subsp. paratuberculosis
cgcggacuggccaccgcg

SEQ ID NO: 2911236 - RNA, 19 nt, Mycobacterium avium subsp. paratuberculosis
cgcggacuggccaccgcga

SEQ ID NO: 2911237 - RNA, 23 nt, Mycobacterium avium subsp. paratuberculosis
cgcggacuggccaccgcgaucuc

SEQ ID NO: 2911238 - RNA, 22 nt, Mycobacterium avium subsp. paratuberculosis
cgcggacuggugggcgucgugg

SEQ ID NO: 2911239 - RNA, 23 nt, Mycobacterium avium subsp. paratuberculosis
cgcggacuggugggcgucguggu

SEQ ID NO: 2911240 - RNA, 22 nt, Mycobacterium avium subsp. paratuberculosis
cgcggagaucaccccuggcggg

SEQ ID NO: 2911241 - RNA, 16 nt, Mycobacterium avium subsp. paratuberculosis
cgcggagaugcuggug

SEQ ID NO: 2911242 - RNA, 23 nt, Mycobacterium avium subsp. paratuberculosis
cgcggagaugguggucaccacca

SEQ ID NO: 2911243 - RNA, 16 nt, Mycobacterium avium subsp. paratuberculosis
cgcggagccggccgcc

SEQ ID NO: 2911244 - RNA, 17 nt, Mycobacterium avium subsp. paratuberculosis
cgcggagccggccgccg

SEQ ID NO: 2911245 - RNA, 14 nt, Mycobacterium avium subsp. paratuberculosis
cgcggagcgcaacg

SEQ ID NO: 2911246 - RNA, 12 nt, Mycobacterium avium subsp. paratuberculosis
cgcggagcggcg

SEQ ID NO: 2911247 - RNA, 13 nt, Mycobacterium avium subsp. paratuberculosis
cgcggagcggcgg

SEQ ID NO: 2911248 - RNA, 16 nt, Mycobacterium avium subsp. paratuberculosis
cgcggagcggcgguca

SEQ ID NO: 2911249 - RNA, 17 nt, Mycobacterium avium subsp. paratuberculosis
cgcggagcggcggucac

SEQ ID NO: 2911250 - RNA, 17 nt, Mycobacterium avium subsp. paratuberculosis
cgcggagcgggucagcg

SEQ ID NO: 2911251 - RNA, 18 nt, Mycobacterium avium subsp. paratuberculosis
cgcggagcguuccagguu

SEQ ID NO: 2911252 - RNA, 20 nt, Mycobacterium avium subsp. paratuberculosis
cgcggaggaauucgccgacg

SEQ ID NO: 2911253 - RNA, 22 nt, Mycobacterium avium subsp. paratuberculosis
cgcggaggaguuuuucggggug

SEQ ID NO: 2911254 - RNA, 14 nt, Mycobacterium avium subsp. paratuberculosis
cgcggaggaugccg

SEQ ID NO: 2911255 - RNA, 17 nt, Mycobacterium avium subsp. paratuberculosis
cgcggaggaugccggcc

SEQ ID NO: 2911256 - RNA, 20 nt, Mycobacterium avium subsp. paratuberculosis
cgcggaggaugccggccagc

SEQ ID NO: 2911257 - RNA, 15 nt, Mycobacterium avium subsp. paratuberculosis
cgcggaggcgagcag

SEQ ID NO: 2911258 - RNA, 22 nt, Mycobacterium avium subsp. paratuberculosis
cgcggaggcgagcagccgggug

SEQ ID NO: 2911259 - RNA, 21 nt, Mycobacterium avium subsp. paratuberculosis
cgcggaguaggcgccgccgcg

SEQ ID NO: 2911260 - RNA, 15 nt, Mycobacterium avium subsp. paratuberculosis
cgcggauacgcccgg

SEQ ID NO: 2911261 - RNA, 16 nt, Mycobacterium avium subsp. paratuberculosis
cgcggauacgcccggc

SEQ ID NO: 2911262 - RNA, 21 nt, Mycobacterium avium subsp. paratuberculosis
cgcggauacgcccggccaccu

SEQ ID NO: 2911263 - RNA, 15 nt, Mycobacterium avium subsp. paratuberculosis
cgcggauagcccagc

SEQ ID NO: 2911264 - RNA, 20 nt, Mycobacterium avium subsp. paratuberculosis
cgcggauagcccagcguggu

SEQ ID NO: 2911265 - RNA, 20 nt, Mycobacterium avium subsp. paratuberculosis
cgcggaucagcaggaccggg

SEQ ID NO: 2911266 - RNA, 24 nt, Mycobacterium avium subsp. paratuberculosis
cgcggaucagcaggaccgggaucg

SEQ ID NO: 2911267 - RNA, 16 nt, Mycobacterium avium subsp. paratuberculosis
cgcggaucaugauccg

SEQ ID NO: 2911268 - RNA, 17 nt, Mycobacterium avium subsp. paratuberculosis
cgcggaucaugauccgg

SEQ ID NO: 2911269 - RNA, 13 nt, Mycobacterium avium subsp. paratuberculosis
cgcggauccgcag

SEQ ID NO: 2911270 - RNA, 22 nt, Mycobacterium avium subsp. paratuberculosis
cgcggauccgcagcugaucggg

SEQ ID NO: 2911271 - RNA, 18 nt, Mycobacterium avium subsp. paratuberculosis
cgcggauccgggccggcg

SEQ ID NO: 2911272 - RNA, 22 nt, Mycobacterium avium subsp. paratuberculosis
cgcggauccgggccggcgucgc

SEQ ID NO: 2911273 - RNA, 22 nt, Mycobacterium avium subsp. paratuberculosis
cgcggaucgaacagggcggcgg

SEQ ID NO: 2911274 - RNA, 23 nt, Mycobacterium avium subsp. paratuberculosis
cgcggaucgaacagggcggcggg

SEQ ID NO: 2911275 - RNA, 15 nt, Mycobacterium avium subsp. paratuberculosis
cgcggaucgcgcuga

SEQ ID NO: 2911276 - RNA, 17 nt, Mycobacterium avium subsp. paratuberculosis
cgcggaucgcgcugacc

SEQ ID NO: 2911277 - RNA, 16 nt, Mycobacterium avium subsp. paratuberculosis
cgcggaucgcguaguc

SEQ ID NO: 2911278 - RNA, 23 nt, Mycobacterium avium subsp. paratuberculosis
cgcggaucgcguaguccagcacg

SEQ ID NO: 2911279 - RNA, 22 nt, Mycobacterium avium subsp. paratuberculosis
cgcggaucgguggacgcggucg

SEQ ID NO: 2911280 - RNA, 23 nt, Mycobacterium avium subsp. paratuberculosis
cgcggaucgguggacgcggucgc

SEQ ID NO: 2911281 - RNA, 22 nt, Mycobacterium avium subsp. paratuberculosis
cgcggaucgguuucuccacccc

SEQ ID NO: 2911282 - RNA, 14 nt, Mycobacterium avium subsp. paratuberculosis
cgcggaucucgcgc

SEQ ID NO: 2911283 - RNA, 20 nt, Mycobacterium avium subsp. paratuberculosis
cgcggaucuucuccgccaca

SEQ ID NO: 2911284 - RNA, 14 nt, Mycobacterium avium subsp. paratuberculosis
cgcggaugaccagg

SEQ ID NO: 2911285 - RNA, 17 nt, Mycobacterium avium subsp. paratuberculosis
cgcggaugaccaggucg

SEQ ID NO: 2911286 - RNA, 23 nt, Mycobacterium avium subsp. paratuberculosis
cgcggaugaccaggucgccggcg

SEQ ID NO: 2911287 - RNA, 18 nt, Mycobacterium avium subsp. paratuberculosis
cgcggaugacgugcacca

SEQ ID NO: 2911288 - RNA, 19 nt, Mycobacterium avium subsp. paratuberculosis
cgcggaugacgugcaccac

SEQ ID NO: 2911289 - RNA, 22 nt, Mycobacterium avium subsp. paratuberculosis
cgcggaugacgugcaccaccgc

SEQ ID NO: 2911290 - RNA, 18 nt, Mycobacterium avium subsp. paratuberculosis
cgcggaugcccaggccgg

SEQ ID NO: 2911291 - RNA, 21 nt, Mycobacterium avium subsp. paratuberculosis
cgcggaugcccaggccggcga

SEQ ID NO: 2911292 - RNA, 18 nt, Mycobacterium avium subsp. paratuberculosis
cgcggaugcgggcgcugc

SEQ ID NO: 2911293 - RNA, 23 nt, Mycobacterium avium subsp. paratuberculosis
cgcggaugcgggcgcugccgucc

SEQ ID NO: 2911294 - RNA, 17 nt, Mycobacterium avium subsp. paratuberculosis
cgcggauggccucggcg

SEQ ID NO: 2911295 - RNA, 18 nt, Mycobacterium avium subsp. paratuberculosis
cgcggauggccucggcga

SEQ ID NO: 2911296 - RNA, 20 nt, Mycobacterium avium subsp. paratuberculosis
cgcggauggccucggcgaug

SEQ ID NO: 2911297 - RNA, 21 nt, Mycobacterium avium subsp. paratuberculosis
cgcggauggccucggcgaugc

SEQ ID NO: 2911298 - RNA, 20 nt, Mycobacterium avium subsp. paratuberculosis
cgcggauggguggcgaucac

SEQ ID NO: 2911299 - RNA, 22 nt, Mycobacterium avium subsp. paratuberculosis
cgcggauggugacggccgugau

SEQ ID NO: 2911300 - RNA, 15 nt, Mycobacterium avium subsp. paratuberculosis
cgcggauguccgacc

SEQ ID NO: 2911301 - RNA, 16 nt, Mycobacterium avium subsp. paratuberculosis
cgcggauguggaggcg

SEQ ID NO: 2911302 - RNA, 16 nt, Mycobacterium avium subsp. paratuberculosis
cgcggauuccagcgcg

SEQ ID NO: 2911303 - RNA, 18 nt, Mycobacterium avium subsp. paratuberculosis
cgcggauuccagcgcgac

SEQ ID NO: 2911304 - RNA, 19 nt, Mycobacterium avium subsp. paratuberculosis
cgcggauuccagcgcgacc

SEQ ID NO: 2911305 - RNA, 20 nt, Mycobacterium avium subsp. paratuberculosis
cgcggauuccagcgcgaccg

SEQ ID NO: 2911306 - RNA, 20 nt, Mycobacterium avium subsp. paratuberculosis
cgcggauuccagcgcguagu

SEQ ID NO: 2911307 - RNA, 23 nt, Mycobacterium avium subsp. paratuberculosis
cgcggauuccggcaucggcucgu

SEQ ID NO: 2911308 - RNA, 20 nt, Mycobacterium avium subsp. paratuberculosis
cgcggauuucucagcggcgc

SEQ ID NO: 2911309 - RNA, 16 nt, Mycobacterium avium subsp. paratuberculosis
cgcggcaacgccagcc

SEQ ID NO: 2911310 - RNA, 13 nt, Mycobacterium avium subsp. paratuberculosis
cgcggcaaggcgu

SEQ ID NO: 2911311 - RNA, 21 nt, Mycobacterium avium subsp. paratuberculosis
cgcggcaaggcguuccaucug

SEQ ID NO: 2911312 - RNA, 15 nt, Mycobacterium avium subsp. paratuberculosis
cgcggcaccaccagc

SEQ ID NO: 2911313 - RNA, 17 nt, Mycobacterium avium subsp. paratuberculosis
cgcggcaccuucaccga

SEQ ID NO: 2911314 - RNA, 12 nt, Mycobacterium avium subsp. paratuberculosis
cgcggcacgccg

SEQ ID NO: 2911315 - RNA, 14 nt, Mycobacterium avium subsp. paratuberculosis
cgcggcacgccgcu

SEQ ID NO: 2911316 - RNA, 17 nt, Mycobacterium avium subsp. paratuberculosis
cgcggcacgccgcucgu

SEQ ID NO: 2911317 - RNA, 18 nt, Mycobacterium avium subsp. paratuberculosis
cgcggcacgccgcucguc

SEQ ID NO: 2911318 - RNA, 12 nt, Mycobacterium avium subsp. paratuberculosis
cgcggcacgcug

SEQ ID NO: 2911319 - RNA, 13 nt, Mycobacterium avium subsp. paratuberculosis
cgcggcacgcugc

SEQ ID NO: 2911320 - RNA, 15 nt, Mycobacterium avium subsp. paratuberculosis
cgcggcacgcugcgc

SEQ ID NO: 2911321 - RNA, 16 nt, Mycobacterium avium subsp. paratuberculosis
cgcggcacgcugcgcc

SEQ ID NO: 2911322 - RNA, 17 nt, Mycobacterium avium subsp. paratuberculosis
cgcggcacgcugcgcca

SEQ ID NO: 2911323 - RNA, 19 nt, Mycobacterium avium subsp. paratuberculosis
cgcggcacgcugcgccagc

SEQ ID NO: 2911324 - RNA, 20 nt, Mycobacterium avium subsp. paratuberculosis
cgcggcacgcugcgccagcc

SEQ ID NO: 2911325 - RNA, 22 nt, Mycobacterium avium subsp. paratuberculosis
cgcggcagccagccuggcggcg

SEQ ID NO: 2911326 - RNA, 23 nt, Mycobacterium avium subsp. paratuberculosis
cgcggcagccagccuggcggcga

SEQ ID NO: 2911327 - RNA, 15 nt, Mycobacterium avium subsp. paratuberculosis
cgcggcagccgggcg

SEQ ID NO: 2911328 - RNA, 14 nt, Mycobacterium avium subsp. paratuberculosis
cgcggcagccuuuc

SEQ ID NO: 2911329 - RNA, 15 nt, Mycobacterium avium subsp. paratuberculosis
cgcggcaggcgcccc

SEQ ID NO: 2911330 - RNA, 17 nt, Mycobacterium avium subsp. paratuberculosis
cgcggcagggccaggcc

SEQ ID NO: 2911331 - RNA, 17 nt, Mycobacterium avium subsp. paratuberculosis
cgcggcaguccgccgga

SEQ ID NO: 2911332 - RNA, 19 nt, Mycobacterium avium subsp. paratuberculosis
cgcggcaguccgccggaga

SEQ ID NO: 2911333 - RNA, 20 nt, Mycobacterium avium subsp. paratuberculosis
cgcggcaguccgccggagac

SEQ ID NO: 2911334 - RNA, 16 nt, Mycobacterium avium subsp. paratuberculosis
cgcggcaucggcgacg

SEQ ID NO: 2911335 - RNA, 15 nt, Mycobacterium avium subsp. paratuberculosis
cgcggcaucgucacc

SEQ ID NO: 2911336 - RNA, 15 nt, Mycobacterium avium subsp. paratuberculosis
cgcggcaucgugaug

SEQ ID NO: 2911337 - RNA, 23 nt, Mycobacterium avium subsp. paratuberculosis
cgcggcaugaccggccagcaugg

SEQ ID NO: 2911338 - RNA, 15 nt, Mycobacterium avium subsp. paratuberculosis
cgcggcaugccgccc

SEQ ID NO: 2911339 - RNA, 18 nt, Mycobacterium avium subsp. paratuberculosis
cgcggcauggcuggcggc

SEQ ID NO: 2911340 - RNA, 19 nt, Mycobacterium avium subsp. paratuberculosis
cgcggcauggcuggcggca

SEQ ID NO: 2911341 - RNA, 18 nt, Mycobacterium avium subsp. paratuberculosis
cgcggccaacccgggcgc

SEQ ID NO: 2911342 - RNA, 20 nt, Mycobacterium avium subsp. paratuberculosis
cgcggccaacccgggcgcca

SEQ ID NO: 2911343 - RNA, 16 nt, Mycobacterium avium subsp. paratuberculosis
cgcggccaagugcggu

SEQ ID NO: 2911344 - RNA, 14 nt, Mycobacterium avium subsp. paratuberculosis
cgcggccacaccga

SEQ ID NO: 2911345 - RNA, 19 nt, Mycobacterium avium subsp. paratuberculosis
cgcggccacaccgaucagc

SEQ ID NO: 2911346 - RNA, 21 nt, Mycobacterium avium subsp. paratuberculosis
cgcggccacacuggcgugacg

SEQ ID NO: 2911347 - RNA, 15 nt, Mycobacterium avium subsp. paratuberculosis
cgcggccaccaccac

SEQ ID NO: 2911348 - RNA, 22 nt, Mycobacterium avium subsp. paratuberculosis
cgcggccaccaccacggccaug

SEQ ID NO: 2911349 - RNA, 17 nt, Mycobacterium avium subsp. paratuberculosis
cgcggccaccaccgcca

SEQ ID NO: 2911350 - RNA, 20 nt, Mycobacterium avium subsp. paratuberculosis
cgcggccaccaccgccacgg

SEQ ID NO: 2911351 - RNA, 17 nt, Mycobacterium avium subsp. paratuberculosis
cgcggccaccaccggug

SEQ ID NO: 2911352 - RNA, 19 nt, Mycobacterium avium subsp. paratuberculosis
cgcggccaccacgacgccg

SEQ ID NO: 2911353 - RNA, 20 nt, Mycobacterium avium subsp. paratuberculosis
cgcggccaccacgacgccgg

SEQ ID NO: 2911354 - RNA, 22 nt, Mycobacterium avium subsp. paratuberculosis
cgcggccaccacgacgccgggc

SEQ ID NO: 2911355 - RNA, 19 nt, Mycobacterium avium subsp. paratuberculosis
cgcggccaccacgacgggg

SEQ ID NO: 2911356 - RNA, 16 nt, Mycobacterium avium subsp. paratuberculosis
cgcggccaccagcgcg

SEQ ID NO: 2911357 - RNA, 21 nt, Mycobacterium avium subsp. paratuberculosis
cgcggccaccagcgcggccac

SEQ ID NO: 2911358 - RNA, 22 nt, Mycobacterium avium subsp. paratuberculosis
cgcggccaccagcgcggccacc

SEQ ID NO: 2911359 - RNA, 14 nt, Mycobacterium avium subsp. paratuberculosis
cgcggccaccccgg

SEQ ID NO: 2911360 - RNA, 15 nt, Mycobacterium avium subsp. paratuberculosis
cgcggccaccccgga

SEQ ID NO: 2911361 - RNA, 18 nt, Mycobacterium avium subsp. paratuberculosis
cgcggccaccccggagca

SEQ ID NO: 2911362 - RNA, 18 nt, Mycobacterium avium subsp. paratuberculosis
cgcggccaccccggugac

SEQ ID NO: 2911363 - RNA, 12 nt, Mycobacterium avium subsp. paratuberculosis
cgcggccaccgc

SEQ ID NO: 2911364 - RNA, 13 nt, Mycobacterium avium subsp. paratuberculosis
cgcggccaccgcg

SEQ ID NO: 2911365 - RNA, 14 nt, Mycobacterium avium subsp. paratuberculosis
cgcggccaccgcgc

SEQ ID NO: 2911366 - RNA, 18 nt, Mycobacterium avium subsp. paratuberculosis
cgcggccaccgcgcgcug

SEQ ID NO: 2911367 - RNA, 21 nt, Mycobacterium avium subsp. paratuberculosis
cgcggccaccgcgcgcugccg

SEQ ID NO: 2911368 - RNA, 15 nt, Mycobacterium avium subsp. paratuberculosis
cgcggccaccgggac

SEQ ID NO: 2911369 - RNA, 22 nt, Mycobacterium avium subsp. paratuberculosis
cgcggccaccgggucguccgcg

SEQ ID NO: 2911370 - RNA, 18 nt, Mycobacterium avium subsp. paratuberculosis
cgcggccaccuccagccc

SEQ ID NO: 2911371 - RNA, 13 nt, Mycobacterium avium subsp. paratuberculosis
cgcggccaccugg

SEQ ID NO: 2911372 - RNA, 14 nt, Mycobacterium avium subsp. paratuberculosis
cgcggccacgcccu

SEQ ID NO: 2911373 - RNA, 16 nt, Mycobacterium avium subsp. paratuberculosis
cgcggccacgcccugg

SEQ ID NO: 2911374 - RNA, 19 nt, Mycobacterium avium subsp. paratuberculosis
cgcggccacgcccuggccg

SEQ ID NO: 2911375 - RNA, 20 nt, Mycobacterium avium subsp. paratuberculosis
cgcggccacgcccuggccgc

SEQ ID NO: 2911376 - RNA, 23 nt, Mycobacterium avium subsp. paratuberculosis
cgcggccacgcccuggccgccgg

SEQ ID NO: 2911377 - RNA, 16 nt, Mycobacterium avium subsp. paratuberculosis
cgcggccacgcucggg

SEQ ID NO: 2911378 - RNA, 19 nt, Mycobacterium avium subsp. paratuberculosis
cgcggccacgcucgggccg

SEQ ID NO: 2911379 - RNA, 13 nt, Mycobacterium avium subsp. paratuberculosis
cgcggccagcacg

SEQ ID NO: 2911380 - RNA, 14 nt, Mycobacterium avium subsp. paratuberculosis
cgcggccagcacgg

SEQ ID NO: 2911381 - RNA, 18 nt, Mycobacterium avium subsp. paratuberculosis
cgcggccagcacggucag

SEQ ID NO: 2911382 - RNA, 21 nt, Mycobacterium avium subsp. paratuberculosis
cgcggccagcacggucagcgg

SEQ ID NO: 2911383 - RNA, 24 nt, Mycobacterium avium subsp. paratuberculosis
cgcggccagcacggucagcggcca

SEQ ID NO: 2911384 - RNA, 23 nt, Mycobacterium avium subsp. paratuberculosis
cgcggccagccccgggaaccagc

SEQ ID NO: 2911385 - RNA, 13 nt, Mycobacterium avium subsp. paratuberculosis
cgcggccagccgg

SEQ ID NO: 2911386 - RNA, 12 nt, Mycobacterium avium subsp. paratuberculosis
cgcggccagcga

SEQ ID NO: 2911387 - RNA, 13 nt, Mycobacterium avium subsp. paratuberculosis
cgcggccagcgag

SEQ ID NO: 2911388 - RNA, 12 nt, Mycobacterium avium subsp. paratuberculosis
cgcggccagcgc

SEQ ID NO: 2911389 - RNA, 16 nt, Mycobacterium avium subsp. paratuberculosis
cgcggccagcgccccg

SEQ ID NO: 2911390 - RNA, 21 nt, Mycobacterium avium subsp. paratuberculosis
cgcggccagcgccccgccggg

SEQ ID NO: 2911391 - RNA, 15 nt, Mycobacterium avium subsp. paratuberculosis
cgcggccagcgcccg

SEQ ID NO: 2911392 - RNA, 13 nt, Mycobacterium avium subsp. paratuberculosis
cgcggccagcgcg

SEQ ID NO: 2911393 - RNA, 14 nt, Mycobacterium avium subsp. paratuberculosis
cgcggccagcgcgc

SEQ ID NO: 2911394 - RNA, 19 nt, Mycobacterium avium subsp. paratuberculosis
cgcggccagcgcgcgggcg

SEQ ID NO: 2911395 - RNA, 18 nt, Mycobacterium avium subsp. paratuberculosis
cgcggccagcggcgccga

SEQ ID NO: 2911396 - RNA, 22 nt, Mycobacterium avium subsp. paratuberculosis
cgcgaucggcgccacgaccagc

SEQ ID NO: 2911397 - RNA, 21 nt, Mycobacterium avium subsp. paratuberculosis
cgcgaucgguguccagccgca

SEQ ID NO: 2911398 - RNA, 15 nt, Mycobacterium avium subsp. paratuberculosis
cgcgaucgucgacca

SEQ ID NO: 2911399 - RNA, 17 nt, Mycobacterium avium subsp. paratuberculosis
cgcgaucuccgucaccg

SEQ ID NO: 2911400 - RNA, 18 nt, Mycobacterium avium subsp. paratuberculosis
cgcgaucuccgucaccgu

SEQ ID NO: 2911401 - RNA, 14 nt, Mycobacterium avium subsp. paratuberculosis
cgcgaucucggcgg

SEQ ID NO: 2911402 - RNA, 17 nt, Mycobacterium avium subsp. paratuberculosis
cgcgaucugcucggugu

SEQ ID NO: 2911403 - RNA, 18 nt, Mycobacterium avium subsp. paratuberculosis
cgcgaucugcucgguguc

SEQ ID NO: 2911404 - RNA, 20 nt, Mycobacterium avium subsp. paratuberculosis
cgcgaucuugccgccgcgga

SEQ ID NO: 2911405 - RNA, 19 nt, Mycobacterium avium subsp. paratuberculosis
cgcgaugaggcucaggccg

SEQ ID NO: 2911406 - RNA, 17 nt, Mycobacterium avium subsp. paratuberculosis
cgcgaugaucacaccca

SEQ ID NO: 2911407 - RNA, 16 nt, Mycobacterium avium subsp. paratuberculosis
cgcgaugaucagcucg

SEQ ID NO: 2911408 - RNA, 21 nt, Mycobacterium avium subsp. paratuberculosis
cgcgaugaucagcucgcgcau

SEQ ID NO: 2911409 - RNA, 17 nt, Mycobacterium avium subsp. paratuberculosis
cgcgaugaugagcaagu

SEQ ID NO: 2911410 - RNA, 22 nt, Mycobacterium avium subsp. paratuberculosis
cgcgaugaugagcaagucggcg

SEQ ID NO: 2911411 - RNA, 16 nt, Mycobacterium avium subsp. paratuberculosis
cgcgaugauggcgucg

SEQ ID NO: 2911412 - RNA, 21 nt, Mycobacterium avium subsp. paratuberculosis
cgcgaugauggcgucgacgug

SEQ ID NO: 2911413 - RNA, 19 nt, Mycobacterium avium subsp. paratuberculosis
cgcgaugcaacaccgaacg

SEQ ID NO: 2911414 - RNA, 24 nt, Mycobacterium avium subsp. paratuberculosis
cgcgaugcagaacagccgguccga

SEQ ID NO: 2911415 - RNA, 15 nt, Mycobacterium avium subsp. paratuberculosis
cgcgaugcccaagcc

SEQ ID NO: 2911416 - RNA, 22 nt, Mycobacterium avium subsp. paratuberculosis
cgcgaugcccaagccggccagg

SEQ ID NO: 2911417 - RNA, 14 nt, Mycobacterium avium subsp. paratuberculosis
cgcgaugcccgccg

SEQ ID NO: 2911418 - RNA, 15 nt, Mycobacterium avium subsp. paratuberculosis
cgcgaugcccgccgg

SEQ ID NO: 2911419 - RNA, 17 nt, Mycobacterium avium subsp. paratuberculosis
cgcgaugcccgccggcc

SEQ ID NO: 2911420 - RNA, 14 nt, Mycobacterium avium subsp. paratuberculosis
cgcgaugccggcca

SEQ ID NO: 2911421 - RNA, 16 nt, Mycobacterium avium subsp. paratuberculosis
cgcgaugccggccagg

SEQ ID NO: 2911422 - RNA, 17 nt, Mycobacterium avium subsp. paratuberculosis
cgcgaugccggccaggc

SEQ ID NO: 2911423 - RNA, 21 nt, Mycobacterium avium subsp. paratuberculosis
cgcgaugccggccaggcacag

SEQ ID NO: 2911424 - RNA, 22 nt, Mycobacterium avium subsp. paratuberculosis
cgcgaugccggccaggcacagc

SEQ ID NO: 2911425 - RNA, 16 nt, Mycobacterium avium subsp. paratuberculosis
cgcgaugcgacaccgc

SEQ ID NO: 2911426 - RNA, 18 nt, Mycobacterium avium subsp. paratuberculosis
cgcgaugcgacaccgcgu

SEQ ID NO: 2911427 - RNA, 14 nt, Mycobacterium avium subsp. paratuberculosis
cgcgaugcggcuca

SEQ ID NO: 2911428 - RNA, 15 nt, Mycobacterium avium subsp. paratuberculosis
cgcgaugcgggcgcc

SEQ ID NO: 2911429 - RNA, 17 nt, Mycobacterium avium subsp. paratuberculosis
cgcgaugcgggcgccga

SEQ ID NO: 2911430 - RNA, 18 nt, Mycobacterium avium subsp. paratuberculosis
cgcgaugcgggcgccgaa

SEQ ID NO: 2911431 - RNA, 17 nt, Mycobacterium avium subsp. paratuberculosis
cgcgaugcuauucgggc

SEQ ID NO: 2911432 - RNA, 21 nt, Mycobacterium avium subsp. paratuberculosis
cgcgaugcuauucgggccagc

SEQ ID NO: 2911433 - RNA, 20 nt, Mycobacterium avium subsp. paratuberculosis
cgcgauggaagcgcccgcgc

SEQ ID NO: 2911434 - RNA, 16 nt, Mycobacterium avium subsp. paratuberculosis
cgcgauggcacacagc

SEQ ID NO: 2911435 - RNA, 20 nt, Mycobacterium avium subsp. paratuberculosis
cgcgauggcccgcgcgaugc

SEQ ID NO: 2911436 - RNA, 13 nt, Mycobacterium avium subsp. paratuberculosis
cgcgauggccucc

SEQ ID NO: 2911437 - RNA, 20 nt, Mycobacterium avium subsp. paratuberculosis
cgcgauggccuccgacccgu

SEQ ID NO: 2911438 - RNA, 18 nt, Mycobacterium avium subsp. paratuberculosis
cgcgauggcgcuggccgc

SEQ ID NO: 2911439 - RNA, 19 nt, Mycobacterium avium subsp. paratuberculosis
cgcgauggcgcuggccgcg

SEQ ID NO: 2911440 - RNA, 13 nt, Mycobacterium avium subsp. paratuberculosis
cgcgauggcgugc

SEQ ID NO: 2911441 - RNA, 13 nt, Mycobacterium avium subsp. paratuberculosis
cgcgaugguggcg

SEQ ID NO: 2911442 - RNA, 15 nt, Mycobacterium avium subsp. paratuberculosis
cgcgauguagcggac

SEQ ID NO: 2911443 - RNA, 22 nt, Mycobacterium avium subsp. paratuberculosis
cgcgauguagcggacgggccgc

SEQ ID NO: 2911444 - RNA, 21 nt, Mycobacterium avium subsp. paratuberculosis
cgcgauguccgacagcccgcc

SEQ ID NO: 2911445 - RNA, 14 nt, Mycobacterium avium subsp. paratuberculosis
cgcgaugucgacgg

SEQ ID NO: 2911446 - RNA, 15 nt, Mycobacterium avium subsp. paratuberculosis
cgcgaugucgacgga

SEQ ID NO: 2911447 - RNA, 20 nt, Mycobacterium avium subsp. paratuberculosis
cgcgauucucgcugcggcgc

SEQ ID NO: 2911448 - RNA, 20 nt, Mycobacterium avium subsp. paratuberculosis
cgcgauuuccgguugcggca

SEQ ID NO: 2911449 - RNA, 23 nt, Mycobacterium avium subsp. paratuberculosis
cgcgauuuccgguugcggcagca

SEQ ID NO: 2911450 - RNA, 19 nt, Mycobacterium avium subsp. paratuberculosis
cgcgcaaacugacaggcgg

SEQ ID NO: 2911451 - RNA, 23 nt, Mycobacterium avium subsp. paratuberculosis
cgcgcaaacugacaggcggucgu

SEQ ID NO: 2911452 - RNA, 16 nt, Mycobacterium avium subsp. paratuberculosis
cgcgcaacaacuucgc

SEQ ID NO: 2911453 - RNA, 21 nt, Mycobacterium avium subsp. paratuberculosis
cgcgcaacaacuucgcguacg

SEQ ID NO: 2911454 - RNA, 20 nt, Mycobacterium avium subsp. paratuberculosis
cgcgcaacagcgucucgacg

SEQ ID NO: 2911455 - RNA, 19 nt, Mycobacterium avium subsp. paratuberculosis
cgcgcaaccgggccgcacc

SEQ ID NO: 2911456 - RNA, 13 nt, Mycobacterium avium subsp. paratuberculosis
cgcgcaacgacga

SEQ ID NO: 2911457 - RNA, 15 nt, Mycobacterium avium subsp. paratuberculosis
cgcgcaacgaggcgg

SEQ ID NO: 2911458 - RNA, 21 nt, Mycobacterium avium subsp. paratuberculosis
cgcgcaacgauucacccagcg

SEQ ID NO: 2911459 - RNA, 19 nt, Mycobacterium avium subsp. paratuberculosis
cgcgcaacucguccaccag

SEQ ID NO: 2911460 - RNA, 21 nt, Mycobacterium avium subsp. paratuberculosis
cgcgcaacucguccaccagcu

SEQ ID NO: 2911461 - RNA, 19 nt, Mycobacterium avium subsp. paratuberculosis
cgcgcaacuggguggucac

SEQ ID NO: 2911462 - RNA, 19 nt, Mycobacterium avium subsp. paratuberculosis
cgcgcaauaacggagcggc

SEQ ID NO: 2911463 - RNA, 20 nt, Mycobacterium avium subsp. paratuberculosis
cgcgcaauacccgaccagca

SEQ ID NO: 2911464 - RNA, 21 nt, Mycobacterium avium subsp. paratuberculosis
cgcgcaauacccgaccagcac

SEQ ID NO: 2911465 - RNA, 23 nt, Mycobacterium avium subsp. paratuberculosis
cgcgcaauacccgaccagcaccg

SEQ ID NO: 2911466 - RNA, 20 nt, Mycobacterium avium subsp. paratuberculosis
cgcgcaaucaaaaaccccgc

SEQ ID NO: 2911467 - RNA, 19 nt, Mycobacterium avium subsp. paratuberculosis
cgcgcaaugccaucgucac

SEQ ID NO: 2911468 - RNA, 11 nt, Mycobacterium avium subsp. paratuberculosis
cgcgcacaaca

SEQ ID NO: 2911469 - RNA, 14 nt, Mycobacterium avium subsp. paratuberculosis
cgcgcacaacagcc

SEQ ID NO: 2911470 - RNA, 21 nt, Mycobacterium avium subsp. paratuberculosis
cgcgcacaacagccaugccgg

SEQ ID NO: 2911471 - RNA, 18 nt, Mycobacterium avium subsp. paratuberculosis
cgcgcacaauucggucag

SEQ ID NO: 2911472 - RNA, 19 nt, Mycobacterium avium subsp. paratuberculosis
cgcgcacaauucggucagc

SEQ ID NO: 2911473 - RNA, 23 nt, Mycobacterium avium subsp. paratuberculosis
cgcgcacaauucggucagcgcgu

SEQ ID NO: 2911474 - RNA, 18 nt, Mycobacterium avium subsp. paratuberculosis
cgcgcacacggccucgcc

SEQ ID NO: 2911475 - RNA, 14 nt, Mycobacterium avium subsp. paratuberculosis
cgcgcacagcgcca

SEQ ID NO: 2911476 - RNA, 15 nt, Mycobacterium avium subsp. paratuberculosis
cgcgcacagcgccac

SEQ ID NO: 2911477 - RNA, 18 nt, Mycobacterium avium subsp. paratuberculosis
cgcgcacagcgccacacc

SEQ ID NO: 2911478 - RNA, 20 nt, Mycobacterium avium subsp. paratuberculosis
cgcgcacaucacgguggccg

SEQ ID NO: 2911479 - RNA, 21 nt, Mycobacterium avium subsp. paratuberculosis
cgcgcacaucacgguggccgc

SEQ ID NO: 2911480 - RNA, 23 nt, Mycobacterium avium subsp. paratuberculosis
cgcgcacaucacgguggccgcca

SEQ ID NO: 2911481 - RNA, 12 nt, Mycobacterium avium subsp. paratuberculosis
cgcgcaccaccu

SEQ ID NO: 2911482 - RNA, 15 nt, Mycobacterium avium subsp. paratuberculosis
cgcgcaccaccucgg

SEQ ID NO: 2911483 - RNA, 17 nt, Mycobacterium avium subsp. paratuberculosis
cgcgcaccaccucggcg

SEQ ID NO: 2911484 - RNA, 20 nt, Mycobacterium avium subsp. paratuberculosis
cgcgcaccaccucggcgauc

SEQ ID NO: 2911485 - RNA, 20 nt, Mycobacterium avium subsp. paratuberculosis
cgcgcaccacgguggcgccg

SEQ ID NO: 2911486 - RNA, 21 nt, Mycobacterium avium subsp. paratuberculosis
cgcgcaccacgguggcgccgc

SEQ ID NO: 2911487 - RNA, 13 nt, Mycobacterium avium subsp. paratuberculosis
cgcgcaccagcuc

SEQ ID NO: 2911488 - RNA, 14 nt, Mycobacterium avium subsp. paratuberculosis
cgcgcaccagcucg

SEQ ID NO: 2911489 - RNA, 17 nt, Mycobacterium avium subsp. paratuberculosis
cgcgcaccaggccgacg

SEQ ID NO: 2911490 - RNA, 23 nt, Mycobacterium avium subsp. paratuberculosis
cgcgcaccagggccgcgagcgcu

SEQ ID NO: 2911491 - RNA, 18 nt, Mycobacterium avium subsp. paratuberculosis
cgcgcaccauccgcgacg

SEQ ID NO: 2911492 - RNA, 23 nt, Mycobacterium avium subsp. paratuberculosis
cgcgcaccauccgcgacgccagc

SEQ ID NO: 2911493 - RNA, 13 nt, Mycobacterium avium subsp. paratuberculosis
cgcgcacccagcc

SEQ ID NO: 2911494 - RNA, 21 nt, Mycobacterium avium subsp. paratuberculosis
cgcgcacccccuucuccacgc

SEQ ID NO: 2911495 - RNA, 23 nt, Mycobacterium avium subsp. paratuberculosis
cgcgcaccccgaaccgcccgccc

SEQ ID NO: 2911496 - RNA, 17 nt, Mycobacterium avium subsp. paratuberculosis
cgcgcaccccggcauag

SEQ ID NO: 2911497 - RNA, 23 nt, Mycobacterium avium subsp. paratuberculosis
cgcgcacccgcacgugcgcgccg

SEQ ID NO: 2911498 - RNA, 18 nt, Mycobacterium avium subsp. paratuberculosis
cgcgcacccggccacgcc

SEQ ID NO: 2911499 - RNA, 15 nt, Mycobacterium avium subsp. paratuberculosis
cgcgcaccgccaccg

SEQ ID NO: 2911500 - RNA, 16 nt, Mycobacterium avium subsp. paratuberculosis
cgcgcaccgccaccgc

SEQ ID NO: 2911501 - RNA, 13 nt, Mycobacterium avium subsp. paratuberculosis
cgcgcaccgcccc

SEQ ID NO: 2911502 - RNA, 11 nt, Mycobacterium avium subsp. paratuberculosis
cgcgcaccgcg

SEQ ID NO: 2911503 - RNA, 12 nt, Mycobacterium avium subsp. paratuberculosis
cgcgcaccgcga

SEQ ID NO: 2911504 - RNA, 12 nt, Mycobacterium avium subsp. paratuberculosis
cgcgcaccgcgc

SEQ ID NO: 2911505 - RNA, 19 nt, Mycobacterium avium subsp. paratuberculosis
cgcgcaccgcgcguucgag

SEQ ID NO: 2911506 - RNA, 12 nt, Mycobacterium avium subsp. paratuberculosis
cgcgcaccgcgg

SEQ ID NO: 2911507 - RNA, 15 nt, Mycobacterium avium subsp. paratuberculosis
cgcgcaccgcggcgg

SEQ ID NO: 2911508 - RNA, 14 nt, Mycobacterium avium subsp. paratuberculosis
cgcgcaccgcgggc

SEQ ID NO: 2911509 - RNA, 15 nt, Mycobacterium avium subsp. paratuberculosis
cgcgcaccgcgggcu

SEQ ID NO: 2911510 - RNA, 14 nt, Mycobacterium avium subsp. paratuberculosis
cgcgcaccgggacc

SEQ ID NO: 2911511 - RNA, 22 nt, Mycobacterium avium subsp. paratuberculosis
cgcgcaccgggaccagcgcggu

SEQ ID NO: 2911512 - RNA, 12 nt, Mycobacterium avium subsp. paratuberculosis
cgcgcaccgguu

SEQ ID NO: 2911513 - RNA, 20 nt, Mycobacterium avium subsp. paratuberculosis
cgcgcaccgguuugucggcg

SEQ ID NO: 2911514 - RNA, 22 nt, Mycobacterium avium subsp. paratuberculosis
cgcgcaccgguuugucggcgcc

SEQ ID NO: 2911515 - RNA, 23 nt, Mycobacterium avium subsp. paratuberculosis
cgcgcaccgucaucgcggcgaac

SEQ ID NO: 2911516 - RNA, 20 nt, Mycobacterium avium subsp. paratuberculosis
cgcgcaccugaaccgcgcac

SEQ ID NO: 2911517 - RNA, 16 nt, Mycobacterium avium subsp. paratuberculosis
cgcgcaccuucccggc

SEQ ID NO: 2911518 - RNA, 19 nt, Mycobacterium avium subsp. paratuberculosis
cgcgcaccuucccggccgc

SEQ ID NO: 2911519 - RNA, 14 nt, Mycobacterium avium subsp. paratuberculosis
cgcgcacgccaucg

SEQ ID NO: 2911520 - RNA, 15 nt, Mycobacterium avium subsp. paratuberculosis
cgcgcacgccaucgc

SEQ ID NO: 2911521 - RNA, 20 nt, Mycobacterium avium subsp. paratuberculosis
cgcgcacgccaucgccucgg

SEQ ID NO: 2911522 - RNA, 17 nt, Mycobacterium avium subsp. paratuberculosis
cgcgcacgcucgcggug

SEQ ID NO: 2911523 - RNA, 19 nt, Mycobacterium avium subsp. paratuberculosis
cgcgcacggcagcccgacg

SEQ ID NO: 2911524 - RNA, 14 nt, Mycobacterium avium subsp. paratuberculosis
cgcgcacggcgcgc

SEQ ID NO: 2911525 - RNA, 19 nt, Mycobacterium avium subsp. paratuberculosis
cgcgcacggcgcgcaccgc

SEQ ID NO: 2911526 - RNA, 22 nt, Mycobacterium avium subsp. paratuberculosis
cgcgcacgucaccgcgcuugcc

SEQ ID NO: 2911527 - RNA, 15 nt, Mycobacterium avium subsp. paratuberculosis
cgcgcacgucgaggu

SEQ ID NO: 2911528 - RNA, 18 nt, Mycobacterium avium subsp. paratuberculosis
cgcgcacgucgaggucgg

SEQ ID NO: 2911529 - RNA, 21 nt, Mycobacterium avium subsp. paratuberculosis
cgcgcacguuggcggccagcg

SEQ ID NO: 2911530 - RNA, 22 nt, Mycobacterium avium subsp. paratuberculosis
cgcgcacucgaacggcccggac

SEQ ID NO: 2911531 - RNA, 21 nt, Mycobacterium avium subsp. paratuberculosis
cgcgcacuucgcgggcggcgc

SEQ ID NO: 2911532 - RNA, 22 nt, Mycobacterium avium subsp. paratuberculosis
cgcgcacuucgcgggcggcgca

SEQ ID NO: 2911533 - RNA, 17 nt, Mycobacterium avium subsp. paratuberculosis
cgcgcagaacaccaccg

SEQ ID NO: 2911534 - RNA, 18 nt, Mycobacterium avium subsp. paratuberculosis
cgcgcagaacaccaccgc

SEQ ID NO: 2911535 - RNA, 20 nt, Mycobacterium avium subsp. paratuberculosis
cgcgcagaacaccaccgcca

SEQ ID NO: 2911536 - RNA, 22 nt, Mycobacterium avium subsp. paratuberculosis
cgcgcagaacaccaccgccagg

SEQ ID NO: 2911537 - RNA, 14 nt, Mycobacterium avium subsp. paratuberculosis
cgcgcagaaccgca

SEQ ID NO: 2911538 - RNA, 16 nt, Mycobacterium avium subsp. paratuberculosis
cgcgcagaaccgcacc

SEQ ID NO: 2911539 - RNA, 20 nt, Mycobacterium avium subsp. paratuberculosis
cgcgcagaaccgcaccccgu

SEQ ID NO: 2911540 - RNA, 14 nt, Mycobacterium avium subsp. paratuberculosis
cgcgcagaucgcca

SEQ ID NO: 2911541 - RNA, 15 nt, Mycobacterium avium subsp. paratuberculosis
cgcgcagaucgccag

SEQ ID NO: 2911542 - RNA, 17 nt, Mycobacterium avium subsp. paratuberculosis
cgcgcagaucgccagca

SEQ ID NO: 2911543 - RNA, 18 nt, Mycobacterium avium subsp. paratuberculosis
cgcgcagaucgccagcac

SEQ ID NO: 2911544 - RNA, 19 nt, Mycobacterium avium subsp. paratuberculosis
cgcgcagaucgccagcacc

SEQ ID NO: 2911545 - RNA, 23 nt, Mycobacterium avium subsp. paratuberculosis
cgcgcagaucgccagcaccggcg

SEQ ID NO: 2911546 - RNA, 14 nt, Mycobacterium avium subsp. paratuberculosis
cgcgcagaucgucg

SEQ ID NO: 2911547 - RNA, 20 nt, Mycobacterium avium subsp. paratuberculosis
cgcgcagaucgucgaacucg

SEQ ID NO: 2911548 - RNA, 17 nt, Mycobacterium avium subsp. paratuberculosis
cgcgcagaucgucgacc

SEQ ID NO: 2911549 - RNA, 18 nt, Mycobacterium avium subsp. paratuberculosis
cgcgcagaucgucgaccu

SEQ ID NO: 2911550 - RNA, 15 nt, Mycobacterium avium subsp. paratuberculosis
cgcgcagauggugac

SEQ ID NO: 2911551 - RNA, 16 nt, Mycobacterium avium subsp. paratuberculosis
cgcgcagauggugacc

SEQ ID NO: 2911552 - RNA, 19 nt, Mycobacterium avium subsp. paratuberculosis
cgcgcagcaauugacgccg

SEQ ID NO: 2911553 - RNA, 21 nt, Mycobacterium avium subsp. paratuberculosis
cgcgcagcaauugacgccgac

SEQ ID NO: 2911554 - RNA, 22 nt, Mycobacterium avium subsp. paratuberculosis
cgcgcagcaauugacgccgaca

SEQ ID NO: 2911555 - RNA, 14 nt, Mycobacterium avium subsp. paratuberculosis
cgcgcagcaccgau

SEQ ID NO: 2911556 - RNA, 14 nt, Mycobacterium avium subsp. paratuberculosis
cgcgcagcaccgcg

SEQ ID NO: 2911557 - RNA, 13 nt, Mycobacterium avium subsp. paratuberculosis
cgcgcagcaccgu

SEQ ID NO: 2911558 - RNA, 15 nt, Mycobacterium avium subsp. paratuberculosis
cgcgcagcaccguca

SEQ ID NO: 2911559 - RNA, 21 nt, Mycobacterium avium subsp. paratuberculosis
cgcgcagcaccuccuggguga

SEQ ID NO: 2911560 - RNA, 14 nt, Mycobacterium avium subsp. paratuberculosis
cgcgcagcacggaa

SEQ ID NO: 2911561 - RNA, 12 nt, Mycobacterium avium subsp. paratuberculosis
cgcgcagcagcg

SEQ ID NO: 2911562 - RNA, 15 nt, Mycobacterium avium subsp. paratuberculosis
cgcgcagcagcggga

SEQ ID NO: 2911563 - RNA, 23 nt, Mycobacterium avium subsp. paratuberculosis
cgcgcagcagcgggaucagcucc

SEQ ID NO: 2911564 - RNA, 14 nt, Mycobacterium avium subsp. paratuberculosis
cgcgcagcaggcgc

SEQ ID NO: 2911565 - RNA, 15 nt, Mycobacterium avium subsp. paratuberculosis
cgcgcagcaggcgcc

SEQ ID NO: 2911566 - RNA, 17 nt, Mycobacterium avium subsp. paratuberculosis
cgcgcagcaggcgccgg

SEQ ID NO: 2911567 - RNA, 13 nt, Mycobacterium avium subsp. paratuberculosis
cgcgcagcauccg

SEQ ID NO: 2911568 - RNA, 17 nt, Mycobacterium avium subsp. paratuberculosis
cgcgcagcauccgcacc

SEQ ID NO: 2911569 - RNA, 20 nt, Mycobacterium avium subsp. paratuberculosis
cgcgcagcauccgcaccagg

SEQ ID NO: 2911570 - RNA, 13 nt, Mycobacterium avium subsp. paratuberculosis
cgcgcagccaaug

SEQ ID NO: 2911571 - RNA, 20 nt, Mycobacterium avium subsp. paratuberculosis
cgcgcagccaaugccggauc

SEQ ID NO: 2911572 - RNA, 15 nt, Mycobacterium avium subsp. paratuberculosis
cgcgcagccaccgcc

SEQ ID NO: 2911573 - RNA, 18 nt, Mycobacterium avium subsp. paratuberculosis
cgcgcagccaccgcccga

SEQ ID NO: 2911574 - RNA, 14 nt, Mycobacterium avium subsp. paratuberculosis
cgcgcagccacgag

SEQ ID NO: 2911575 - RNA, 19 nt, Mycobacterium avium subsp. paratuberculosis
cgcgcagccacgagcccag

SEQ ID NO: 2911576 - RNA, 20 nt, Mycobacterium avium subsp. paratuberculosis
cgcgcagccacgagcccagc

SEQ ID NO: 2911577 - RNA, 22 nt, Mycobacterium avium subsp. paratuberculosis
cgcgcagccacgagcccagccg

SEQ ID NO: 2911578 - RNA, 16 nt, Mycobacterium avium subsp. paratuberculosis
cgcgcagccagaccuc

SEQ ID NO: 2911579 - RNA, 18 nt, Mycobacterium avium subsp. paratuberculosis
cgcgcagccagaccucgc

SEQ ID NO: 2911580 - RNA, 22 nt, Mycobacterium avium subsp. paratuberculosis
cgcgcagccagaccucgccgac

SEQ ID NO: 2911581 - RNA, 23 nt, Mycobacterium avium subsp. paratuberculosis
cgcgcagccagaccucgccgacg

SEQ ID NO: 2911582 - RNA, 12 nt, Mycobacterium avium subsp. paratuberculosis
cgcgcagccagg

SEQ ID NO: 2911583 - RNA, 14 nt, Mycobacterium avium subsp. paratuberculosis
cgcgcagccaggac

SEQ ID NO: 2911584 - RNA, 19 nt, Mycobacterium avium subsp. paratuberculosis
cgcgcagccagucgccggc

SEQ ID NO: 2911585 - RNA, 19 nt, Mycobacterium avium subsp. paratuberculosis
cgcgcagcccagccagcga

SEQ ID NO: 2911586 - RNA, 15 nt, Mycobacterium avium subsp. paratuberculosis
cgcgcagcccccgga

SEQ ID NO: 2911587 - RNA, 22 nt, Mycobacterium avium subsp. paratuberculosis
cgcgcagcccccggaccacguc

SEQ ID NO: 2911588 - RNA, 13 nt, Mycobacterium avium subsp. paratuberculosis
cgcgcagccgccg

SEQ ID NO: 2911589 - RNA, 14 nt, Mycobacterium avium subsp. paratuberculosis
cgcgcagccgccgg

SEQ ID NO: 2911590 - RNA, 15 nt, Mycobacterium avium subsp. paratuberculosis
cgcgcagccgccggg

SEQ ID NO: 2911591 - RNA, 12 nt, Mycobacterium avium subsp. paratuberculosis
cgcgcagccgcg

SEQ ID NO: 2911592 - RNA, 14 nt, Mycobacterium avium subsp. paratuberculosis
cgcgcagccgcggu

SEQ ID NO: 2911593 - RNA, 16 nt, Mycobacterium avium subsp. paratuberculosis
cgcgcagccgcggugg

SEQ ID NO: 2911594 - RNA, 14 nt, Mycobacterium avium subsp. paratuberculosis
cgcgcagccggccg

SEQ ID NO: 2911595 - RNA, 16 nt, Mycobacterium avium subsp. paratuberculosis
cgcgcagccggccgac

SEQ ID NO: 2911596 - RNA, 16 nt, Mycobacterium avium subsp. paratuberculosis
cgcgcagccggccguc

SEQ ID NO: 2911597 - RNA, 17 nt, Mycobacterium avium subsp. paratuberculosis
cgcgcagccggccgucc

SEQ ID NO: 2911598 - RNA, 15 nt, Mycobacterium avium subsp. paratuberculosis
cgcgcagccgggcgg

SEQ ID NO: 2911599 - RNA, 22 nt, Mycobacterium avium subsp. paratuberculosis
cgcgcagcgaagcgaggcgcca

SEQ ID NO: 2911600 - RNA, 13 nt, Mycobacterium avium subsp. paratuberculosis
cgcgcagcgcguc

SEQ ID NO: 2911601 - RNA, 15 nt, Mycobacterium avium subsp. paratuberculosis
cgcgcagcgucaucg

SEQ ID NO: 2911602 - RNA, 15 nt, Mycobacterium avium subsp. paratuberculosis
cgcgcagcgugucgg

SEQ ID NO: 2911603 - RNA, 18 nt, Mycobacterium avium subsp. paratuberculosis
cgcgcagcgugugcaccu

SEQ ID NO: 2911604 - RNA, 20 nt, Mycobacterium avium subsp. paratuberculosis
cgcgcagcgugugcaccuga

SEQ ID NO: 2911605 - RNA, 23 nt, Mycobacterium avium subsp. paratuberculosis
cgcgcagcucgacgaccucgccg

SEQ ID NO: 2911606 - RNA, 13 nt, Mycobacterium avium subsp. paratuberculosis
cgcgcagcucggg

SEQ ID NO: 2911607 - RNA, 18 nt, Mycobacterium avium subsp. paratuberculosis
cgcgcagcucggggucgg

SEQ ID NO: 2911608 - RNA, 22 nt, Mycobacterium avium subsp. paratuberculosis
cgcgcagcucggggucggcguc

SEQ ID NO: 2911609 - RNA, 16 nt, Mycobacterium avium subsp. paratuberculosis
cgcgcagcugcgccgc

SEQ ID NO: 2911610 - RNA, 15 nt, Mycobacterium avium subsp. paratuberculosis
cgcgcagcuggccgu

SEQ ID NO: 2911611 - RNA, 23 nt, Mycobacterium avium subsp. paratuberculosis
cgcgcagcuggccgugcaccguc

SEQ ID NO: 2911612 - RNA, 16 nt, Mycobacterium avium subsp. paratuberculosis
cgcgcaggaacgucuc

SEQ ID NO: 2911613 - RNA, 18 nt, Mycobacterium avium subsp. paratuberculosis
cgcgcaggaacuccagca

SEQ ID NO: 2911614 - RNA, 18 nt, Mycobacterium avium subsp. paratuberculosis
cgcgcaggaugcccagca

SEQ ID NO: 2911615 - RNA, 20 nt, Mycobacterium avium subsp. paratuberculosis
cgcgcaggaugcccagcacc

SEQ ID NO: 2911616 - RNA, 23 nt, Mycobacterium avium subsp. paratuberculosis
cgcgcaggaugcccagcaccacu

SEQ ID NO: 2911617 - RNA, 15 nt, Mycobacterium avium subsp. paratuberculosis
cgcgcaggcacucgc

SEQ ID NO: 2911618 - RNA, 16 nt, Mycobacterium avium subsp. paratuberculosis
cgcgcaggccccggcg

SEQ ID NO: 2911619 - RNA, 15 nt, Mycobacterium avium subsp. paratuberculosis
cgcgcaggccccggg

SEQ ID NO: 2911620 - RNA, 15 nt, Mycobacterium avium subsp. paratuberculosis
cgcgcaggccgccga

SEQ ID NO: 2911621 - RNA, 17 nt, Mycobacterium avium subsp. paratuberculosis
cgcgcaggccgccgacg

SEQ ID NO: 2911622 - RNA, 19 nt, Mycobacterium avium subsp. paratuberculosis
cgcgcaggccgccgacgac

SEQ ID NO: 2911623 - RNA, 14 nt, Mycobacterium avium subsp. paratuberculosis
cgcgcaggccgucc

SEQ ID NO: 2911624 - RNA, 20 nt, Mycobacterium avium subsp. paratuberculosis
cgcgcaggcgcaccaccagc

SEQ ID NO: 2911625 - RNA, 17 nt, Mycobacterium avium subsp. paratuberculosis
cgcgcaggcgcgcggcc

SEQ ID NO: 2911626 - RNA, 14 nt, Mycobacterium avium subsp. paratuberculosis
cgcgcaggcgcuga

SEQ ID NO: 2911627 - RNA, 14 nt, Mycobacterium avium subsp. paratuberculosis
cgcgcaggcggcga

SEQ ID NO: 2911628 - RNA, 22 nt, Mycobacterium avium subsp. paratuberculosis
cgcgcaggcggcgacggccguc

SEQ ID NO: 2911629 - RNA, 23 nt, Mycobacterium avium subsp. paratuberculosis
cgcgcaggcggcgacggccgucc

SEQ ID NO: 2911630 - RNA, 17 nt, Mycobacterium avium subsp. paratuberculosis
cgcgcagggacgggcgu

SEQ ID NO: 2911631 - RNA, 20 nt, Mycobacterium avium subsp. paratuberculosis
cgcgcagggacgggcgugac

SEQ ID NO: 2911632 - RNA, 17 nt, Mycobacterium avium subsp. paratuberculosis
cgcgcagggccagcgcc

SEQ ID NO: 2911633 - RNA, 22 nt, Mycobacterium avium subsp. paratuberculosis
cgcgcagggccagcgccucggc

SEQ ID NO: 2911634 - RNA, 15 nt, Mycobacterium avium subsp. paratuberculosis
cgcgcagggcgaacg

SEQ ID NO: 2911635 - RNA, 18 nt, Mycobacterium avium subsp. paratuberculosis
cgcgcagggcgaacggcg

SEQ ID NO: 2911636 - RNA, 20 nt, Mycobacterium avium subsp. paratuberculosis
cgcgcagggcgaacggcgga

SEQ ID NO: 2911637 - RNA, 16 nt, Mycobacterium avium subsp. paratuberculosis
cgcgcagguagccgcc

SEQ ID NO: 2911638 - RNA, 17 nt, Mycobacterium avium subsp. paratuberculosis
cgcgcagguagccgccg

SEQ ID NO: 2911639 - RNA, 21 nt, Mycobacterium avium subsp. paratuberculosis
cgcgcaggucacccuccucgc

SEQ ID NO: 2911640 - RNA, 22 nt, Mycobacterium avium subsp. paratuberculosis
cgcgcaggucacccuccucgcg

SEQ ID NO: 2911641 - RNA, 16 nt, Mycobacterium avium subsp. paratuberculosis
cgcgcagguccguggu

SEQ ID NO: 2911642 - RNA, 17 nt, Mycobacterium avium subsp. paratuberculosis
cgcgcagguccguggug

SEQ ID NO: 2911643 - RNA, 19 nt, Mycobacterium avium subsp. paratuberculosis
cgcgcaggucgggccggcc

SEQ ID NO: 2911644 - RNA, 20 nt, Mycobacterium avium subsp. paratuberculosis
cgcgcaggucgggccggccg

SEQ ID NO: 2911645 - RNA, 13 nt, Mycobacterium avium subsp. paratuberculosis
cgcgcaggucguc

SEQ ID NO: 2911646 - RNA, 21 nt, Mycobacterium avium subsp. paratuberculosis
cgcgcaggucguccgacagga

SEQ ID NO: 2911647 - RNA, 14 nt, Mycobacterium avium subsp. paratuberculosis
cgcgcaggugaugc

SEQ ID NO: 2911648 - RNA, 17 nt, Mycobacterium avium subsp. paratuberculosis
cgcgcaggugaugcggc

SEQ ID NO: 2911649 - RNA, 21 nt, Mycobacterium avium subsp. paratuberculosis
cgcgcaggugaugcggcccga

SEQ ID NO: 2911650 - RNA, 17 nt, Mycobacterium avium subsp. paratuberculosis
cgcgcagucgcaggccc

SEQ ID NO: 2911651 - RNA, 23 nt, Mycobacterium avium subsp. paratuberculosis
cgcgcagucgcaggccccggauc

SEQ ID NO: 2911652 - RNA, 13 nt, Mycobacterium avium subsp. paratuberculosis
cgcgcagucggcg

SEQ ID NO: 2911653 - RNA, 14 nt, Mycobacterium avium subsp. paratuberculosis
cgcgcagucggcgu

SEQ ID NO: 2911654 - RNA, 16 nt, Mycobacterium avium subsp. paratuberculosis
cgcgcagucggcgucg

SEQ ID NO: 2911655 - RNA, 20 nt, Mycobacterium avium subsp. paratuberculosis
cgcgcagucggcgucgcggc

SEQ ID NO: 2911656 - RNA, 17 nt, Mycobacterium avium subsp. paratuberculosis
cgcgcaguugcgcggcg

SEQ ID NO: 2911657 - RNA, 20 nt, Mycobacterium avium subsp. paratuberculosis
cgcgcaguugcgcggcgggc

SEQ ID NO: 2911658 - RNA, 21 nt, Mycobacterium avium subsp. paratuberculosis
cgcgcaguugcgcggcgggcg

SEQ ID NO: 2911659 - RNA, 22 nt, Mycobacterium avium subsp. paratuberculosis
cgcgcaguugcgcggcgggcga

SEQ ID NO: 2911660 - RNA, 13 nt, Mycobacterium avium subsp. paratuberculosis
cgcgcaucacccg

SEQ ID NO: 2911661 - RNA, 15 nt, Mycobacterium avium subsp. paratuberculosis
cgcgcaucacccggc

SEQ ID NO: 2911662 - RNA, 19 nt, Mycobacterium avium subsp. paratuberculosis
cgcgcaucacccggcgcgc

SEQ ID NO: 2911663 - RNA, 19 nt, Mycobacterium avium subsp. paratuberculosis
cgcgcaucaccgaggucac

SEQ ID NO: 2911664 - RNA, 13 nt, Mycobacterium avium subsp. paratuberculosis
cgcgcaucagcac

SEQ ID NO: 2911665 - RNA, 13 nt, Mycobacterium avium subsp. paratuberculosis
cgcgcaucagcgg

SEQ ID NO: 2911666 - RNA, 18 nt, Mycobacterium avium subsp. paratuberculosis
cgcgcaucaucgcccagc

SEQ ID NO: 2911667 - RNA, 19 nt, Mycobacterium avium subsp. paratuberculosis
cgcgcaucaucgcccagcg

SEQ ID NO: 2911668 - RNA, 20 nt, Mycobacterium avium subsp. paratuberculosis
cgcgcaucaucgcccagcgc

SEQ ID NO: 2911669 - RNA, 22 nt, Mycobacterium avium subsp. paratuberculosis
cgcgcaucaugcguuugccguc

SEQ ID NO: 2911670 - RNA, 23 nt, Mycobacterium avium subsp. paratuberculosis
cgcgcaucaugcguuugccgucg

SEQ ID NO: 2911671 - RNA, 18 nt, Mycobacterium avium subsp. paratuberculosis
cgcgcaucccgaucgacg

SEQ ID NO: 2911672 - RNA, 14 nt, Mycobacterium avium subsp. paratuberculosis
cgcgcaucccgucg

SEQ ID NO: 2911673 - RNA, 17 nt, Mycobacterium avium subsp. paratuberculosis
cgcgcaucccgucgacc

SEQ ID NO: 2911674 - RNA, 18 nt, Mycobacterium avium subsp. paratuberculosis
cgcgcaucccgucgacca

SEQ ID NO: 2911675 - RNA, 16 nt, Mycobacterium avium subsp. paratuberculosis
cgcgcauccgcaccga

SEQ ID NO: 2911676 - RNA, 17 nt, Mycobacterium avium subsp. paratuberculosis
cgcgcauccgcaccgag

SEQ ID NO: 2911677 - RNA, 14 nt, Mycobacterium avium subsp. paratuberculosis
cgcgcaucgccguc

SEQ ID NO: 2911678 - RNA, 18 nt, Mycobacterium avium subsp. paratuberculosis
cgcgcaucgccguccacg

SEQ ID NO: 2911679 - RNA, 17 nt, Mycobacterium avium subsp. paratuberculosis
cgcgcaucgccucggcg

SEQ ID NO: 2911680 - RNA, 15 nt, Mycobacterium avium subsp. paratuberculosis
cgcgcaucgcgggcc

SEQ ID NO: 2911681 - RNA, 16 nt, Mycobacterium avium subsp. paratuberculosis
cgcgcaucgcgggcca

SEQ ID NO: 2911682 - RNA, 13 nt, Mycobacterium avium subsp. paratuberculosis
cgcgcaucgguca

SEQ ID NO: 2911683 - RNA, 22 nt, Mycobacterium avium subsp. paratuberculosis
cgcgcaucguggcuuuggucgc

SEQ ID NO: 2911684 - RNA, 15 nt, Mycobacterium avium subsp. paratuberculosis
cgcgcaucugcucgg

SEQ ID NO: 2911685 - RNA, 18 nt, Mycobacterium avium subsp. paratuberculosis
cgcgcaucugcucggcgu

SEQ ID NO: 2911686 - RNA, 19 nt, Mycobacterium avium subsp. paratuberculosis
cgcgcaucugcucggcguc

SEQ ID NO: 2911687 - RNA, 20 nt, Mycobacterium avium subsp. paratuberculosis
cgcgcaucugcucggcgucc

SEQ ID NO: 2911688 - RNA, 14 nt, Mycobacterium avium subsp. paratuberculosis
cgcgcaucuugauc

SEQ ID NO: 2911689 - RNA, 17 nt, Mycobacterium avium subsp. paratuberculosis
cgcgcauguuggugauc

SEQ ID NO: 2911690 - RNA, 20 nt, Mycobacterium avium subsp. paratuberculosis
cgcgcauguuggugaucagc

SEQ ID NO: 2911691 - RNA, 15 nt, Mycobacterium avium subsp. paratuberculosis
cgcgcauucaccagc

SEQ ID NO: 2911692 - RNA, 17 nt, Mycobacterium avium subsp. paratuberculosis
cgcgcauucaccagcug

SEQ ID NO: 2911693 - RNA, 17 nt, Mycobacterium avium subsp. paratuberculosis
cgcgccaacgaggcacg

SEQ ID NO: 2911694 - RNA, 19 nt, Mycobacterium avium subsp. paratuberculosis
cgcgccaacgaggcacggc

SEQ ID NO: 2911695 - RNA, 14 nt, Mycobacterium avium subsp. paratuberculosis
cgcgccacagcguc

SEQ ID NO: 2911696 - RNA, 13 nt, Mycobacterium avium subsp. paratuberculosis
cgcgccaccccga

SEQ ID NO: 2911697 - RNA, 14 nt, Mycobacterium avium subsp. paratuberculosis
cgcgccaccccgag

SEQ ID NO: 2911698 - RNA, 20 nt, Mycobacterium avium subsp. paratuberculosis
cgcgccaccccgagcucggg

SEQ ID NO: 2911699 - RNA, 21 nt, Mycobacterium avium subsp. paratuberculosis
cgcgccaccccgagcucgggc

SEQ ID NO: 2911700 - RNA, 21 nt, Mycobacterium avium subsp. paratuberculosis
cgcgccacccgacgaaaucgu

SEQ ID NO: 2911701 - RNA, 13 nt, Mycobacterium avium subsp. paratuberculosis
cgcgccaccgagg

SEQ ID NO: 2911702 - RNA, 11 nt, Mycobacterium avium subsp. paratuberculosis
cgcgccaccgc

SEQ ID NO: 2911703 - RNA, 13 nt, Mycobacterium avium subsp. paratuberculosis
cgcgccaccgcgg

SEQ ID NO: 2911704 - RNA, 21 nt, Mycobacterium avium subsp. paratuberculosis
cgcgccaccgcggggcugggc

SEQ ID NO: 2911705 - RNA, 23 nt, Mycobacterium avium subsp. paratuberculosis
cgcgccaccgcggggcugggcgc

SEQ ID NO: 2911706 - RNA, 17 nt, Mycobacterium avium subsp. paratuberculosis
cgcgccacgacguaccc

SEQ ID NO: 2911707 - RNA, 21 nt, Mycobacterium avium subsp. paratuberculosis
cgcgccacgacguacccccgc

SEQ ID NO: 2911708 - RNA, 16 nt, Mycobacterium avium subsp. paratuberculosis
cgcgccacgccccggc

SEQ ID NO: 2911709 - RNA, 13 nt, Mycobacterium avium subsp. paratuberculosis
cgcgccacgccgc

SEQ ID NO: 2911710 - RNA, 14 nt, Mycobacterium avium subsp. paratuberculosis
cgcgccacgcgcag

SEQ ID NO: 2911711 - RNA, 17 nt, Mycobacterium avium subsp. paratuberculosis
cgcgccacgcgcagggc

SEQ ID NO: 2911712 - RNA, 13 nt, Mycobacterium avium subsp. paratuberculosis
cgcgccagacguc

SEQ ID NO: 2911713 - RNA, 16 nt, Mycobacterium avium subsp. paratuberculosis
cgcgccagacguccag

SEQ ID NO: 2911714 - RNA, 18 nt, Mycobacterium avium subsp. paratuberculosis
cgcgccagacguccagcg

SEQ ID NO: 2911715 - RNA, 22 nt, Mycobacterium avium subsp. paratuberculosis
cgcgccagacguccagcgccgc

SEQ ID NO: 2911716 - RNA, 12 nt, Mycobacterium avium subsp. paratuberculosis
cgcgccagcagc

SEQ ID NO: 2911717 - RNA, 16 nt, Mycobacterium avium subsp. paratuberculosis
cgcgccagcagcgcgc

SEQ ID NO: 2911718 - RNA, 19 nt, Mycobacterium avium subsp. paratuberculosis
cgcgccagcagcgcgccgc

SEQ ID NO: 2911719 - RNA, 20 nt, Mycobacterium avium subsp. paratuberculosis
cgcgccagcagcgcgccgcg

SEQ ID NO: 2911720 - RNA, 12 nt, Mycobacterium avium subsp. paratuberculosis
cgcgccagccgc

SEQ ID NO: 2911721 - RNA, 15 nt, Mycobacterium avium subsp. paratuberculosis
cgcgccagccgccgc

SEQ ID NO: 2911722 - RNA, 19 nt, Mycobacterium avium subsp. paratuberculosis
cgcgccagccgccgccgac

SEQ ID NO: 2911723 - RNA, 18 nt, Mycobacterium avium subsp. paratuberculosis
cgcgccagcgguccagcg

SEQ ID NO: 2911724 - RNA, 21 nt, Mycobacterium avium subsp. paratuberculosis
cgcgccagcgguccagcguga

SEQ ID NO: 2911725 - RNA, 13 nt, Mycobacterium avium subsp. paratuberculosis
cgcgccagcucgg

SEQ ID NO: 2911726 - RNA, 15 nt, Mycobacterium avium subsp. paratuberculosis
cgcgccagcucggcg

SEQ ID NO: 2911727 - RNA, 16 nt, Mycobacterium avium subsp. paratuberculosis
cgcgccagcucggcgg

SEQ ID NO: 2911728 - RNA, 18 nt, Mycobacterium avium subsp. paratuberculosis
cgcgccagcucggcggcc

SEQ ID NO: 2911729 - RNA, 22 nt, Mycobacterium avium subsp. paratuberculosis
cgcgccagcucggcggccgggu

SEQ ID NO: 2911730 - RNA, 21 nt, Mycobacterium avium subsp. paratuberculosis
cgcgccaggucgaagaggugc

SEQ ID NO: 2911731 - RNA, 13 nt, Mycobacterium avium subsp. paratuberculosis
cgcgcccacccga

SEQ ID NO: 2911732 - RNA, 21 nt, Mycobacterium avium subsp. paratuberculosis
cgcgcccacccgaugaccggc

SEQ ID NO: 2911733 - RNA, 13 nt, Mycobacterium avium subsp. paratuberculosis
cgcgcccacccgc

SEQ ID NO: 2911734 - RNA, 20 nt, Mycobacterium avium subsp. paratuberculosis
cgcgcccacccgcgcacgcu

SEQ ID NO: 2911735 - RNA, 16 nt, Mycobacterium avium subsp. paratuberculosis
cgcgcccacccgcgcc

SEQ ID NO: 2911736 - RNA, 22 nt, Mycobacterium avium subsp. paratuberculosis
cgcgcccacccgcgccggcaga

SEQ ID NO: 2911737 - RNA, 14 nt, Mycobacterium avium subsp. paratuberculosis
cgcgcccaccugga

SEQ ID NO: 2911738 - RNA, 18 nt, Mycobacterium avium subsp. paratuberculosis
cgcgcccaccuggaggcc

SEQ ID NO: 2911739 - RNA, 12 nt, Mycobacterium avium subsp. paratuberculosis
cgcgcccagcac

SEQ ID NO: 2911740 - RNA, 14 nt, Mycobacterium avium subsp. paratuberculosis
cgcgcccagcacgu

SEQ ID NO: 2911741 - RNA, 23 nt, Mycobacterium avium subsp. paratuberculosis
cgcgcccagcacgucaccgcuga

SEQ ID NO: 2911742 - RNA, 12 nt, Mycobacterium avium subsp. paratuberculosis
cgcgcccagccc

SEQ ID NO: 2911743 - RNA, 14 nt, Mycobacterium avium subsp. paratuberculosis
cgcgcccagcccca

SEQ ID NO: 2911744 - RNA, 18 nt, Mycobacterium avium subsp. paratuberculosis
cgcgcccagccccagcac

SEQ ID NO: 2911745 - RNA, 20 nt, Mycobacterium avium subsp. paratuberculosis
cgcgcccagccccagcacga

SEQ ID NO: 2911746 - RNA, 14 nt, Mycobacterium avium subsp. paratuberculosis
cgcgcccaggaacg

SEQ ID NO: 2911747 - RNA, 11 nt, Mycobacterium avium subsp. paratuberculosis
cgcgcccaggc

SEQ ID NO: 2911748 - RNA, 13 nt, Mycobacterium avium subsp. paratuberculosis
cgcgcccaggccc

SEQ ID NO: 2911749 - RNA, 22 nt, Mycobacterium avium subsp. paratuberculosis
cgcgcccaggggagcggcggag

SEQ ID NO: 2911750 - RNA, 21 nt, Mycobacterium avium subsp. paratuberculosis
cgcgcccaucgcggccgcccg

SEQ ID NO: 2911751 - RNA, 16 nt, Mycobacterium avium subsp. paratuberculosis
cgcgcccaugaacgcg

SEQ ID NO: 2911752 - RNA, 22 nt, Mycobacterium avium subsp. paratuberculosis
cgcgcccccugggacagcgaga

SEQ ID NO: 2911753 - RNA, 13 nt, Mycobacterium avium subsp. paratuberculosis
cgcgccccggccc

SEQ ID NO: 2911754 - RNA, 14 nt, Mycobacterium avium subsp. paratuberculosis
cgcgccccggcccg

SEQ ID NO: 2911755 - RNA, 16 nt, Mycobacterium avium subsp. paratuberculosis
cgcgccccggcccggc

SEQ ID NO: 2911756 - RNA, 17 nt, Mycobacterium avium subsp. paratuberculosis
cgcgccccggcccggcg

SEQ ID NO: 2911757 - RNA, 14 nt, Mycobacterium avium subsp. paratuberculosis
cgcgccccggccug

SEQ ID NO: 2911758 - RNA, 13 nt, Mycobacterium avium subsp. paratuberculosis
cgcgccccggcgc

SEQ ID NO: 2911759 - RNA, 22 nt, Mycobacterium avium subsp. paratuberculosis
cgcgccccggcgcagcgccgcg

SEQ ID NO: 2911760 - RNA, 16 nt, Mycobacterium avium subsp. paratuberculosis
cgcgccccggcgcgcc

SEQ ID NO: 2911761 - RNA, 16 nt, Mycobacterium avium subsp. paratuberculosis
cgcgccccggcggcca

SEQ ID NO: 2911762 - RNA, 21 nt, Mycobacterium avium subsp. paratuberculosis
cgcgccccggucccgccggug

SEQ ID NO: 2911763 - RNA, 22 nt, Mycobacterium avium subsp. paratuberculosis
cgcgccccggucccgccgguga

SEQ ID NO: 2911764 - RNA, 14 nt, Mycobacterium avium subsp. paratuberculosis
cgcgcccgacgaug

SEQ ID NO: 2911765 - RNA, 18 nt, Mycobacterium avium subsp. paratuberculosis
cgcgcccgagucacccgg

SEQ ID NO: 2911766 - RNA, 20 nt, Mycobacterium avium subsp. paratuberculosis
cgcgcccgagucacccggcu

SEQ ID NO: 2911767 - RNA, 22 nt, Mycobacterium avium subsp. paratuberculosis
cgcgcccgauggaggugccgcg

SEQ ID NO: 2911768 - RNA, 15 nt, Mycobacterium avium subsp. paratuberculosis
cgcgcccgccaucug

SEQ ID NO: 2911769 - RNA, 21 nt, Mycobacterium avium subsp. paratuberculosis
cgcgcccgccggcccagcucc

SEQ ID NO: 2911770 - RNA, 16 nt, Mycobacterium avium subsp. paratuberculosis
cgcgcccgcgaacacg

SEQ ID NO: 2911771 - RNA, 13 nt, Mycobacterium avium subsp. paratuberculosis
cgcgcccgcggcc

SEQ ID NO: 2911772 - RNA, 16 nt, Mycobacterium avium subsp. paratuberculosis
cgcgcccgcggccauc

SEQ ID NO: 2911773 - RNA, 19 nt, Mycobacterium avium subsp. paratuberculosis
cgcgcccgcggccaucgcc

SEQ ID NO: 2911774 - RNA, 19 nt, Mycobacterium avium subsp. paratuberculosis
cgcgcccggaaagcgcggg

SEQ ID NO: 2911775 - RNA, 20 nt, Mycobacterium avium subsp. paratuberculosis
cgcgcccggaaagcgcgggc

SEQ ID NO: 2911776 - RNA, 23 nt, Mycobacterium avium subsp. paratuberculosis
cgcgcccggaaagcgcgggcagc

SEQ ID NO: 2911777 - RNA, 22 nt, Mycobacterium avium subsp. paratuberculosis
cgcgcccggcaccgcggcggug

SEQ ID NO: 2911778 - RNA, 13 nt, Mycobacterium avium subsp. paratuberculosis
cgcgcccggccag

SEQ ID NO: 2911779 - RNA, 12 nt, Mycobacterium avium subsp. paratuberculosis
cgcgcccggcga

SEQ ID NO: 2911780 - RNA, 14 nt, Mycobacterium avium subsp. paratuberculosis
cgcgcccggcgacg

SEQ ID NO: 2911781 - RNA, 17 nt, Mycobacterium avium subsp. paratuberculosis
cgcgcccggcgacgcgg

SEQ ID NO: 2911782 - RNA, 21 nt, Mycobacterium avium subsp. paratuberculosis
cgcgcccggcgacgcggcggg

SEQ ID NO: 2911783 - RNA, 13 nt, Mycobacterium avium subsp. paratuberculosis
cgcgcccggcgcc

SEQ ID NO: 2911784 - RNA, 14 nt, Mycobacterium avium subsp. paratuberculosis
cgcgcccggcgccg

SEQ ID NO: 2911785 - RNA, 15 nt, Mycobacterium avium subsp. paratuberculosis
cgcgcccggcgccgg

SEQ ID NO: 2911786 - RNA, 17 nt, Mycobacterium avium subsp. paratuberculosis
cgcgcccggcgucggug

SEQ ID NO: 2911787 - RNA, 15 nt, Mycobacterium avium subsp. paratuberculosis
cgcgcccggcuucgc

SEQ ID NO: 2911788 - RNA, 19 nt, Mycobacterium avium subsp. paratuberculosis
cgcgcccggcuucgccgcg

SEQ ID NO: 2911789 - RNA, 23 nt, Mycobacterium avium subsp. paratuberculosis
cgcgcccgucgagcgucacgccg

SEQ ID NO: 2911790 - RNA, 15 nt, Mycobacterium avium subsp. paratuberculosis
cgcgcccgucgucgg

SEQ ID NO: 2911791 - RNA, 18 nt, Mycobacterium avium subsp. paratuberculosis
cgcgcccgucgucgguca

SEQ ID NO: 2911792 - RNA, 19 nt, Mycobacterium avium subsp. paratuberculosis
cgcgcccuaacgugcccgg

SEQ ID NO: 2911793 - RNA, 20 nt, Mycobacterium avium subsp. paratuberculosis
cgcgcccuaacgugcccggc

SEQ ID NO: 2911794 - RNA, 16 nt, Mycobacterium avium subsp. paratuberculosis
cgcgcccuagucgacg

SEQ ID NO: 2911795 - RNA, 20 nt, Mycobacterium avium subsp. paratuberculosis
cgcgcccuagucgacgccga

SEQ ID NO: 2911796 - RNA, 20 nt, Mycobacterium avium subsp. paratuberculosis
cgcgcccugcugggagcggc

SEQ ID NO: 2911797 - RNA, 22 nt, Mycobacterium avium subsp. paratuberculosis
cgcgcccuggugcaacaccgaa

SEQ ID NO: 2911798 - RNA, 16 nt, Mycobacterium avium subsp. paratuberculosis
cgcgccgaacaccacg

SEQ ID NO: 2911799 - RNA, 17 nt, Mycobacterium avium subsp. paratuberculosis
cgcgccgaacaccacgc

SEQ ID NO: 2911800 - RNA, 23 nt, Mycobacterium avium subsp. paratuberculosis
cgcgccgaacaccacgccgagca

SEQ ID NO: 2911801 - RNA, 17 nt, Mycobacterium avium subsp. paratuberculosis
cgcgccgaacgcaccac

SEQ ID NO: 2911802 - RNA, 20 nt, Mycobacterium avium subsp. paratuberculosis
cgcgccgaacgcaccaccgc

SEQ ID NO: 2911803 - RNA, 19 nt, Mycobacterium avium subsp. paratuberculosis
cgcgccgaagauggccagc

SEQ ID NO: 2911804 - RNA, 21 nt, Mycobacterium avium subsp. paratuberculosis
cgcgccgaagauggccagcgc

SEQ ID NO: 2911805 - RNA, 23 nt, Mycobacterium avium subsp. paratuberculosis
cgcgccgaagauggccagcgcgg

SEQ ID NO: 2911806 - RNA, 24 nt, Mycobacterium avium subsp. paratuberculosis
cgcgccgaagauggccagcgcggc

SEQ ID NO: 2911807 - RNA, 16 nt, Mycobacterium avium subsp. paratuberculosis
cgcgccgacagaugcg

SEQ ID NO: 2911808 - RNA, 22 nt, Mycobacterium avium subsp. paratuberculosis
cgcgccgacagaugcggcacca

SEQ ID NO: 2911809 - RNA, 14 nt, Mycobacterium avium subsp. paratuberculosis
cgcgccgaccacgg

SEQ ID NO: 2911810 - RNA, 20 nt, Mycobacterium avium subsp. paratuberculosis
cgcgccgaccacggccccag

SEQ ID NO: 2911811 - RNA, 14 nt, Mycobacterium avium subsp. paratuberculosis
cgcgccgaccagcg

SEQ ID NO: 2911812 - RNA, 16 nt, Mycobacterium avium subsp. paratuberculosis
cgcgccgaccagcgcg

SEQ ID NO: 2911813 - RNA, 17 nt, Mycobacterium avium subsp. paratuberculosis
cgcgccgaccagcgcgu

SEQ ID NO: 2911814 - RNA, 19 nt, Mycobacterium avium subsp. paratuberculosis
cgcgccgacccgcccgccg

SEQ ID NO: 2911815 - RNA, 21 nt, Mycobacterium avium subsp. paratuberculosis
cgcgccgacccgcccgccggg

SEQ ID NO: 2911816 - RNA, 13 nt, Mycobacterium avium subsp. paratuberculosis
cgcgccgaccgcg

SEQ ID NO: 2911817 - RNA, 14 nt, Mycobacterium avium subsp. paratuberculosis
cgcgccgaccgcga

SEQ ID NO: 2911818 - RNA, 15 nt, Mycobacterium avium subsp. paratuberculosis
cgcgccgaccgcgag

SEQ ID NO: 2911819 - RNA, 16 nt, Mycobacterium avium subsp. paratuberculosis
cgcgccgaccgcgagc

SEQ ID NO: 2911820 - RNA, 12 nt, Mycobacterium avium subsp. paratuberculosis
cgcgccgaccuc

SEQ ID NO: 2911821 - RNA, 17 nt, Mycobacterium avium subsp. paratuberculosis
cgcgccgaccucgucgg

SEQ ID NO: 2911822 - RNA, 22 nt, Mycobacterium avium subsp. paratuberculosis
cgcgccgaccucgucggcggug

SEQ ID NO: 2911823 - RNA, 16 nt, Mycobacterium avium subsp. paratuberculosis
cgcgccgacgcccaca

SEQ ID NO: 2911824 - RNA, 15 nt, Mycobacterium avium subsp. paratuberculosis
cgcgccgacggccgc

SEQ ID NO: 2911825 - RNA, 18 nt, Mycobacterium avium subsp. paratuberculosis
cgcgccgacggccgcgcc

SEQ ID NO: 2911826 - RNA, 14 nt, Mycobacterium avium subsp. paratuberculosis
cgcgccgagagcgc

SEQ ID NO: 2911827 - RNA, 17 nt, Mycobacterium avium subsp. paratuberculosis
cgcgccgagagcgcguc

SEQ ID NO: 2911828 - RNA, 21 nt, Mycobacterium avium subsp. paratuberculosis
cgcgccgagauuggacgacac

SEQ ID NO: 2911829 - RNA, 15 nt, Mycobacterium avium subsp. paratuberculosis
cgcgccgagcaaccg

SEQ ID NO: 2911830 - RNA, 17 nt, Mycobacterium avium subsp. paratuberculosis
cgcgccgagcaaccggg

SEQ ID NO: 2911831 - RNA, 18 nt, Mycobacterium avium subsp. paratuberculosis
cgcgccgagcaaccggga

SEQ ID NO: 2911832 - RNA, 23 nt, Mycobacterium avium subsp. paratuberculosis
cgcgccgagcagcugggacagcg

SEQ ID NO: 2911833 - RNA, 16 nt, Mycobacterium avium subsp. paratuberculosis
cgcgccgagcgcuggu

SEQ ID NO: 2911834 - RNA, 17 nt, Mycobacterium avium subsp. paratuberculosis
cgcgccgagcgcugguu

SEQ ID NO: 2911835 - RNA, 23 nt, Mycobacterium avium subsp. paratuberculosis
cgcgccgaggaacugcagcgacu

SEQ ID NO: 2911836 - RNA, 13 nt, Mycobacterium avium subsp. paratuberculosis
cgcgccgaggcgc

SEQ ID NO: 2911837 - RNA, 14 nt, Mycobacterium avium subsp. paratuberculosis
cgcgccgaggcgcu

SEQ ID NO: 2911838 - RNA, 17 nt, Mycobacterium avium subsp. paratuberculosis
cgcgccgaggcgcucgg

SEQ ID NO: 2911839 - RNA, 14 nt, Mycobacterium avium subsp. paratuberculosis
cgcgccgagguggc

SEQ ID NO: 2911840 - RNA, 18 nt, Mycobacterium avium subsp. paratuberculosis
cgcgccgagguggcccgc

SEQ ID NO: 2911841 - RNA, 17 nt, Mycobacterium avium subsp. paratuberculosis
cgcgccgagguggccgc

SEQ ID NO: 2911842 - RNA, 19 nt, Mycobacterium avium subsp. paratuberculosis
cgcgccgagguggccgcca

SEQ ID NO: 2911843 - RNA, 15 nt, Mycobacterium avium subsp. paratuberculosis
cgcgccgaucacgaa

SEQ ID NO: 2911844 - RNA, 17 nt, Mycobacterium avium subsp. paratuberculosis
cgcgccgaucacgaaca

SEQ ID NO: 2911845 - RNA, 22 nt, Mycobacterium avium subsp. paratuberculosis
cgcgccgaucacgaacaggucc

SEQ ID NO: 2911846 - RNA, 23 nt, Mycobacterium avium subsp. paratuberculosis
cgcgccgaucgagacgaugcggu

SEQ ID NO: 2911847 - RNA, 19 nt, Mycobacterium avium subsp. paratuberculosis
cgcgccgaucgcccagugc

SEQ ID NO: 2911848 - RNA, 20 nt, Mycobacterium avium subsp. paratuberculosis
cgcgccgaucugaccgagca

SEQ ID NO: 2911849 - RNA, 22 nt, Mycobacterium avium subsp. paratuberculosis
cgcgccgaucugaccgagcagc

SEQ ID NO: 2911850 - RNA, 17 nt, Mycobacterium avium subsp. paratuberculosis
cgcgccgauguggccgg

SEQ ID NO: 2911851 - RNA, 15 nt, Mycobacterium avium subsp. paratuberculosis
cgcgccgcacagccg

SEQ ID NO: 2911852 - RNA, 20 nt, Mycobacterium avium subsp. paratuberculosis
cgcgccgcacagccggcggc

SEQ ID NO: 2911853 - RNA, 13 nt, Mycobacterium avium subsp. paratuberculosis
cgcgccgcaccuc

SEQ ID NO: 2911854 - RNA, 17 nt, Mycobacterium avium subsp. paratuberculosis
cgcgccgcaccucgccg

SEQ ID NO: 2911855 - RNA, 19 nt, Mycobacterium avium subsp. paratuberculosis
cgcgccgcacugcacggcc

SEQ ID NO: 2911856 - RNA, 13 nt, Mycobacterium avium subsp. paratuberculosis
cgcgccgcagcgc

SEQ ID NO: 2911857 - RNA, 15 nt, Mycobacterium avium subsp. paratuberculosis
cgcgccgcagcgcgc

SEQ ID NO: 2911858 - RNA, 20 nt, Mycobacterium avium subsp. paratuberculosis
cgcgccgcagcgcgcgcucg

SEQ ID NO: 2911859 - RNA, 12 nt, Mycobacterium avium subsp. paratuberculosis
cgcgccgcagga

SEQ ID NO: 2911860 - RNA, 20 nt, Mycobacterium avium subsp. paratuberculosis
cgcgccgcaugaugcggcca

SEQ ID NO: 2911861 - RNA, 18 nt, Mycobacterium avium subsp. paratuberculosis
cgcgccgcauuggcaccg

SEQ ID NO: 2911862 - RNA, 14 nt, Mycobacterium avium subsp. paratuberculosis
cgcgccgccacacc

SEQ ID NO: 2911863 - RNA, 14 nt, Mycobacterium avium subsp. paratuberculosis
cgcgccgccacccc

SEQ ID NO: 2911864 - RNA, 18 nt, Mycobacterium avium subsp. paratuberculosis
cgcgccgccaccccaggc

SEQ ID NO: 2911865 - RNA, 19 nt, Mycobacterium avium subsp. paratuberculosis
cgcgccgccacgcggcgcg

SEQ ID NO: 2911866 - RNA, 20 nt, Mycobacterium avium subsp. paratuberculosis
cgcgccgccacgcggcgcgc

SEQ ID NO: 2911867 - RNA, 22 nt, Mycobacterium avium subsp. paratuberculosis
cgcgccgccagcaaccccgcgg

SEQ ID NO: 2911868 - RNA, 14 nt, Mycobacterium avium subsp. paratuberculosis
cgcgccgcccagcg

SEQ ID NO: 2911869 - RNA, 18 nt, Mycobacterium avium subsp. paratuberculosis
cgcgccgcccagcggccc

SEQ ID NO: 2911870 - RNA, 19 nt, Mycobacterium avium subsp. paratuberculosis
cgcgccgcccccgcggcgu

SEQ ID NO: 2911871 - RNA, 13 nt, Mycobacterium avium subsp. paratuberculosis
cgcgccgcccgga

SEQ ID NO: 2911872 - RNA, 13 nt, Mycobacterium avium subsp. paratuberculosis
cgcgccgcccggc

SEQ ID NO: 2911873 - RNA, 19 nt, Mycobacterium avium subsp. paratuberculosis
cgcgccgcccucgccgaac

SEQ ID NO: 2911874 - RNA, 22 nt, Mycobacterium avium subsp. paratuberculosis
cgcgccgcccucgccgaaccgg

SEQ ID NO: 2911875 - RNA, 14 nt, Mycobacterium avium subsp. paratuberculosis
cgcgccgccgacca

SEQ ID NO: 2911876 - RNA, 20 nt, Mycobacterium avium subsp. paratuberculosis
cgcgccgccgaccacgccgc

SEQ ID NO: 2911877 - RNA, 24 nt, Mycobacterium avium subsp. paratuberculosis
cgcgccgccgaccacgccgcgcuu

SEQ ID NO: 2911878 - RNA, 15 nt, Mycobacterium avium subsp. paratuberculosis
cgcgccgccgaugug

SEQ ID NO: 2911879 - RNA, 12 nt, Mycobacterium avium subsp. paratuberculosis
cgcgccgccgcc

SEQ ID NO: 2911880 - RNA, 15 nt, Mycobacterium avium subsp. paratuberculosis
cgcgccgccgccagc

SEQ ID NO: 2911881 - RNA, 16 nt, Mycobacterium avium subsp. paratuberculosis
cgcgccgccgcccugg

SEQ ID NO: 2911882 - RNA, 21 nt, Mycobacterium avium subsp. paratuberculosis
cgcgccgccgcccuggcccca

SEQ ID NO: 2911883 - RNA, 13 nt, Mycobacterium avium subsp. paratuberculosis
cgcgccgccgccg

SEQ ID NO: 2911884 - RNA, 21 nt, Mycobacterium avium subsp. paratuberculosis
cgcgccgccgccgcccacgcc

SEQ ID NO: 2911885 - RNA, 22 nt, Mycobacterium avium subsp. paratuberculosis
cgcgccgccgccgcccacgccg

SEQ ID NO: 2911886 - RNA, 13 nt, Mycobacterium avium subsp. paratuberculosis
cgcgccgccgcgu

SEQ ID NO: 2911887 - RNA, 14 nt, Mycobacterium avium subsp. paratuberculosis
cgcgccgccgguga

SEQ ID NO: 2911888 - RNA, 14 nt, Mycobacterium avium subsp. paratuberculosis
cgcgccgcgacguc

SEQ ID NO: 2911889 - RNA, 15 nt, Mycobacterium avium subsp. paratuberculosis
cgcgccgcgacgucg

SEQ ID NO: 2911890 - RNA, 15 nt, Mycobacterium avium subsp. paratuberculosis
cgcgccgcgaugcaa

SEQ ID NO: 2911891 - RNA, 16 nt, Mycobacterium avium subsp. paratuberculosis
cgcgccgcgccgccuu

SEQ ID NO: 2911892 - RNA, 15 nt, Mycobacterium avium subsp. paratuberculosis
cgcgccgcgcgcccu

SEQ ID NO: 2911893 - RNA, 13 nt, Mycobacterium avium subsp. paratuberculosis
cgcgccgcgcugg

SEQ ID NO: 2911894 - RNA, 20 nt, Mycobacterium avium subsp. paratuberculosis
cgcgccgcgcuggccgaucc

SEQ ID NO: 2911895 - RNA, 12 nt, Mycobacterium avium subsp. paratuberculosis
cgcgccgcggcc

SEQ ID NO: 2911896 - RNA, 17 nt, Mycobacterium avium subsp. paratuberculosis
cgcgccgcggccagcgc

SEQ ID NO: 2911897 - RNA, 18 nt, Mycobacterium avium subsp. paratuberculosis
cgcgccgcggccagcgcc

SEQ ID NO: 2911898 - RNA, 13 nt, Mycobacterium avium subsp. paratuberculosis
cgcgccgcggcgc

SEQ ID NO: 2911899 - RNA, 14 nt, Mycobacterium avium subsp. paratuberculosis
cgcgccgcggguga

SEQ ID NO: 2911900 - RNA, 23 nt, Mycobacterium avium subsp. paratuberculosis
cgcgccgcgguagaaccaacgcg

SEQ ID NO: 2911901 - RNA, 13 nt, Mycobacterium avium subsp. paratuberculosis
cgcgccgcgucgu

SEQ ID NO: 2911902 - RNA, 16 nt, Mycobacterium avium subsp. paratuberculosis
cgcgccgcgucgucgu

SEQ ID NO: 2911903 - RNA, 19 nt, Mycobacterium avium subsp. paratuberculosis
cgcgccgcguucggcggcg

SEQ ID NO: 2911904 - RNA, 20 nt, Mycobacterium avium subsp. paratuberculosis
cgcgccgcguucggcggcgc

SEQ ID NO: 2911905 - RNA, 18 nt, Mycobacterium avium subsp. paratuberculosis
cgcgccgcucggccagca

SEQ ID NO: 2911906 - RNA, 13 nt, Mycobacterium avium subsp. paratuberculosis
cgcgccgcugacu

SEQ ID NO: 2911907 - RNA, 17 nt, Mycobacterium avium subsp. paratuberculosis
cgcgccggagccggaga

SEQ ID NO: 2911908 - RNA, 20 nt, Mycobacterium avium subsp. paratuberculosis
cgcgccggaguugccgaugg

SEQ ID NO: 2911909 - RNA, 15 nt, Mycobacterium avium subsp. paratuberculosis
cgcgccggaugcugc

SEQ ID NO: 2911910 - RNA, 18 nt, Mycobacterium avium subsp. paratuberculosis
cgcgccggaugguccgca

SEQ ID NO: 2911911 - RNA, 18 nt, Mycobacterium avium subsp. paratuberculosis
cgcgccggcacucgucgu

SEQ ID NO: 2911912 - RNA, 14 nt, Mycobacterium avium subsp. paratuberculosis
cgcgccggccagca

SEQ ID NO: 2911913 - RNA, 15 nt, Mycobacterium avium subsp. paratuberculosis
cgcgccggccagcac

SEQ ID NO: 2911914 - RNA, 16 nt, Mycobacterium avium subsp. paratuberculosis
cgcgccggccagccgg

SEQ ID NO: 2911915 - RNA, 17 nt, Mycobacterium avium subsp. paratuberculosis
cgcgccggccagccggc

SEQ ID NO: 2911916 - RNA, 20 nt, Mycobacterium avium subsp. paratuberculosis
cgcgccggcccagacgguuc

SEQ ID NO: 2911917 - RNA, 12 nt, Mycobacterium avium subsp. paratuberculosis
cgcgccggcccg

SEQ ID NO: 2911918 - RNA, 13 nt, Mycobacterium avium subsp. paratuberculosis
cgcgccggcccga

SEQ ID NO: 2911919 - RNA, 14 nt, Mycobacterium avium subsp. paratuberculosis
cgcgccggcccgau

SEQ ID NO: 2911920 - RNA, 16 nt, Mycobacterium avium subsp. paratuberculosis
cgcgccggccgccgcg

SEQ ID NO: 2911921 - RNA, 20 nt, Mycobacterium avium subsp. paratuberculosis
cgcgccggccgccgcgaucu

SEQ ID NO: 2911922 - RNA, 12 nt, Mycobacterium avium subsp. paratuberculosis
cgcgccggccgg

SEQ ID NO: 2911923 - RNA, 13 nt, Mycobacterium avium subsp. paratuberculosis
cgcgccggccggc

SEQ ID NO: 2911924 - RNA, 15 nt, Mycobacterium avium subsp. paratuberculosis
cgcgccggccggcac

SEQ ID NO: 2911925 - RNA, 17 nt, Mycobacterium avium subsp. paratuberculosis
cgcgccggccggcacga

SEQ ID NO: 2911926 - RNA, 23 nt, Mycobacterium avium subsp. paratuberculosis
cgcgccggccggcacgauggcgc

SEQ ID NO: 2911927 - RNA, 21 nt, Mycobacterium avium subsp. paratuberculosis
cgcgccggcgauaggcggcca

SEQ ID NO: 2911928 - RNA, 23 nt, Mycobacterium avium subsp. paratuberculosis
cgcgccggcgauaggcggccagc

SEQ ID NO: 2911929 - RNA, 12 nt, Mycobacterium avium subsp. paratuberculosis
cgcgccggcgca

SEQ ID NO: 2911930 - RNA, 13 nt, Mycobacterium avium subsp. paratuberculosis
cgcgccggcgcaa

SEQ ID NO: 2911931 - RNA, 15 nt, Mycobacterium avium subsp. paratuberculosis
cgcgccggcgcaacu

SEQ ID NO: 2911932 - RNA, 13 nt, Mycobacterium avium subsp. paratuberculosis
cgcgccggcgcac

SEQ ID NO: 2911933 - RNA, 20 nt, Mycobacterium avium subsp. paratuberculosis
cgcgccggcgcacaucgugg

SEQ ID NO: 2911934 - RNA, 14 nt, Mycobacterium avium subsp. paratuberculosis
cgcgccggcgcagc

SEQ ID NO: 2911935 - RNA, 17 nt, Mycobacterium avium subsp. paratuberculosis
cgcgccggcgcagcggc

SEQ ID NO: 2911936 - RNA, 14 nt, Mycobacterium avium subsp. paratuberculosis
cgcgccggcgcgca

SEQ ID NO: 2911937 - RNA, 15 nt, Mycobacterium avium subsp. paratuberculosis
cgcgccggcgcgcag

SEQ ID NO: 2911938 - RNA, 13 nt, Mycobacterium avium subsp. paratuberculosis
cgcgccggcgcgg

SEQ ID NO: 2911939 - RNA, 14 nt, Mycobacterium avium subsp. paratuberculosis
cgcgccggcgcggg

SEQ ID NO: 2911940 - RNA, 12 nt, Mycobacterium avium subsp. paratuberculosis
cgcgccggcggc

SEQ ID NO: 2911941 - RNA, 13 nt, Mycobacterium avium subsp. paratuberculosis
cgcgccggcggcg

SEQ ID NO: 2911942 - RNA, 14 nt, Mycobacterium avium subsp. paratuberculosis
cgcgccggcggcgg

SEQ ID NO: 2911943 - RNA, 12 nt, Mycobacterium avium subsp. paratuberculosis
cgcgccggcggu

SEQ ID NO: 2911944 - RNA, 15 nt, Mycobacterium avium subsp. paratuberculosis
cgcgccggcggucga

SEQ ID NO: 2911945 - RNA, 13 nt, Mycobacterium avium subsp. paratuberculosis
cgcgccggcgucg

SEQ ID NO: 2911946 - RNA, 14 nt, Mycobacterium avium subsp. paratuberculosis
cgcgccggcgucgg

SEQ ID NO: 2911947 - RNA, 20 nt, Mycobacterium avium subsp. paratuberculosis
cgcgccggcgugucggcgcc

SEQ ID NO: 2911948 - RNA, 21 nt, Mycobacterium avium subsp. paratuberculosis
cgcgccggcgugucggcgcca

SEQ ID NO: 2911949 - RNA, 14 nt, Mycobacterium avium subsp. paratuberculosis
cgcgccgggaucac

SEQ ID NO: 2911950 - RNA, 21 nt, Mycobacterium avium subsp. paratuberculosis
cgcgccgggaucacacgcgcg

SEQ ID NO: 2911951 - RNA, 22 nt, Mycobacterium avium subsp. paratuberculosis
cgcgccgggaucacacgcgcgc

SEQ ID NO: 2911952 - RNA, 23 nt, Mycobacterium avium subsp. paratuberculosis
cgcgccgggaucacacgcgcgcc

SEQ ID NO: 2911953 - RNA, 21 nt, Mycobacterium avium subsp. paratuberculosis
cgcgccgggcaacagcgcgcc

SEQ ID NO: 2911954 - RNA, 18 nt, Mycobacterium avium subsp. paratuberculosis
cgcgccgggcaccaccac

SEQ ID NO: 2911955 - RNA, 20 nt, Mycobacterium avium subsp. paratuberculosis
cgcgccgggcaccaccaccg

SEQ ID NO: 2911956 - RNA, 12 nt, Mycobacterium avium subsp. paratuberculosis
cgcgccgggcag

SEQ ID NO: 2911957 - RNA, 20 nt, Mycobacterium avium subsp. paratuberculosis
cgcgccgggcagcccgccgc

SEQ ID NO: 2911958 - RNA, 12 nt, Mycobacterium avium subsp. paratuberculosis
cgcgccgggcga

SEQ ID NO: 2911959 - RNA, 23 nt, Mycobacterium avium subsp. paratuberculosis
cgcgccgggcgaagucgccggcc

SEQ ID NO: 2911960 - RNA, 15 nt, Mycobacterium avium subsp. paratuberculosis
cgcgccgggcgcccg

SEQ ID NO: 2911961 - RNA, 19 nt, Mycobacterium avium subsp. paratuberculosis
cgcgccgggcggaugucgg

SEQ ID NO: 2911962 - RNA, 23 nt, Mycobacterium avium subsp. paratuberculosis
cgcgccgggcggaugucggugug

SEQ ID NO: 2911963 - RNA, 13 nt, Mycobacterium avium subsp. paratuberculosis
cgcgccgggcggc

SEQ ID NO: 2911964 - RNA, 15 nt, Mycobacterium avium subsp. paratuberculosis
cgcgccgggcggccu

SEQ ID NO: 2911965 - RNA, 16 nt, Mycobacterium avium subsp. paratuberculosis
cgcgccgggcggccuc

SEQ ID NO: 2911966 - RNA, 19 nt, Mycobacterium avium subsp. paratuberculosis
cgcgccgggcggccucggc

SEQ ID NO: 2911967 - RNA, 12 nt, Mycobacterium avium subsp. paratuberculosis
cgcgccgggcgu

SEQ ID NO: 2911968 - RNA, 21 nt, Mycobacterium avium subsp. paratuberculosis
cgcgccgggcguugcccgccg

SEQ ID NO: 2911969 - RNA, 19 nt, Mycobacterium avium subsp. paratuberculosis
cgcgccgggguccucucgg

SEQ ID NO: 2911970 - RNA, 20 nt, Mycobacterium avium subsp. paratuberculosis
cgcgccgggguccucucggc

SEQ ID NO: 2911971 - RNA, 17 nt, Mycobacterium avium subsp. paratuberculosis
cgcgccggggugggcca

SEQ ID NO: 2911972 - RNA, 18 nt, Mycobacterium avium subsp. paratuberculosis
cgcgccggggugggccau

SEQ ID NO: 2911973 - RNA, 18 nt, Mycobacterium avium subsp. paratuberculosis
cgcgccgguaaugggcga

SEQ ID NO: 2911974 - RNA, 17 nt, Mycobacterium avium subsp. paratuberculosis
cgcgccgguagagcgcc

SEQ ID NO: 2911975 - RNA, 19 nt, Mycobacterium avium subsp. paratuberculosis
cgcgccgguaggcggccag

SEQ ID NO: 2911976 - RNA, 20 nt, Mycobacterium avium subsp. paratuberculosis
cgcgccgguaggcggccagc

SEQ ID NO: 2911977 - RNA, 22 nt, Mycobacterium avium subsp. paratuberculosis
cgcgccgguaggcggccagcgc

SEQ ID NO: 2911978 - RNA, 22 nt, Mycobacterium avium subsp. paratuberculosis
cgcgccggucccgcggcggcgc

SEQ ID NO: 2911979 - RNA, 23 nt, Mycobacterium avium subsp. paratuberculosis
cgcgccggucccgcggcggcgcc

SEQ ID NO: 2911980 - RNA, 19 nt, Mycobacterium avium subsp. paratuberculosis
cgcgccggugaccccgucg

SEQ ID NO: 2911981 - RNA, 19 nt, Mycobacterium avium subsp. paratuberculosis
cgcgccgguguucggcgcc

SEQ ID NO: 2911982 - RNA, 20 nt, Mycobacterium avium subsp. paratuberculosis
cgcgccgguguucggcgcca

SEQ ID NO: 2911983 - RNA, 21 nt, Mycobacterium avium subsp. paratuberculosis
cgcgccgguguucggcgccag

SEQ ID NO: 2911984 - RNA, 22 nt, Mycobacterium avium subsp. paratuberculosis
cgcgccgguguucggcgccagc

SEQ ID NO: 2911985 - RNA, 21 nt, Mycobacterium avium subsp. paratuberculosis
cgcgccguaccgcuuggccca

SEQ ID NO: 2911986 - RNA, 19 nt, Mycobacterium avium subsp. paratuberculosis
cgcgccguagcggcccagg

SEQ ID NO: 2911987 - RNA, 14 nt, Mycobacterium avium subsp. paratuberculosis
cgcgccgucccagc

SEQ ID NO: 2911988 - RNA, 16 nt, Mycobacterium avium subsp. paratuberculosis
cgcgccgucccagccg

SEQ ID NO: 2911989 - RNA, 17 nt, Mycobacterium avium subsp. paratuberculosis
cgcgccgucccagccgg

SEQ ID NO: 2911990 - RNA, 17 nt, Mycobacterium avium subsp. paratuberculosis
cgccggcgcccugcgcg

SEQ ID NO: 2911991 - RNA, 20 nt, Mycobacterium avium subsp. paratuberculosis
cgccggcgcccugcgcgccc

SEQ ID NO: 2911992 - RNA, 16 nt, Mycobacterium avium subsp. paratuberculosis
cgccggcgccggaggg

SEQ ID NO: 2911993 - RNA, 13 nt, Mycobacterium avium subsp. paratuberculosis
cgccggcgccggg

SEQ ID NO: 2911994 - RNA, 16 nt, Mycobacterium avium subsp. paratuberculosis
cgccggcgccgggcgg

SEQ ID NO: 2911995 - RNA, 13 nt, Mycobacterium avium subsp. paratuberculosis
cgccggcgccguc

SEQ ID NO: 2911996 - RNA, 15 nt, Mycobacterium avium subsp. paratuberculosis
cgccggcgcgcaccc

SEQ ID NO: 2911997 - RNA, 18 nt, Mycobacterium avium subsp. paratuberculosis
cgccggcgcgcaccccgg

SEQ ID NO: 2911998 - RNA, 14 nt, Mycobacterium avium subsp. paratuberculosis
cgccggcgcgcagc

SEQ ID NO: 2911999 - RNA, 16 nt, Mycobacterium avium subsp. paratuberculosis
cgccggcgcgcagcca

SEQ ID NO: 2912000 - RNA, 20 nt, Mycobacterium avium subsp. paratuberculosis
cgccggcgcgcagccagucg

SEQ ID NO: 2912001 - RNA, 15 nt, Mycobacterium avium subsp. paratuberculosis
cgccggcgcgcgagc

SEQ ID NO: 2912002 - RNA, 16 nt, Mycobacterium avium subsp. paratuberculosis
cgccggcgcgcgagcg

SEQ ID NO: 2912003 - RNA, 18 nt, Mycobacterium avium subsp. paratuberculosis
cgccggcgcgcgagcguc

SEQ ID NO: 2912004 - RNA, 19 nt, Mycobacterium avium subsp. paratuberculosis
cgccggcgcgcgagcguca

SEQ ID NO: 2912005 - RNA, 12 nt, Mycobacterium avium subsp. paratuberculosis
cgccggcgcgcu

SEQ ID NO: 2912006 - RNA, 14 nt, Mycobacterium avium subsp. paratuberculosis
cgccggcgcgcuga

SEQ ID NO: 2912007 - RNA, 12 nt, Mycobacterium avium subsp. paratuberculosis
cgccgggcggcg

SEQ ID NO: 2912008 - RNA, 19 nt, Mycobacterium avium subsp. paratuberculosis
cgccgggcggcguccucga

SEQ ID NO: 2912009 - RNA, 22 nt, Mycobacterium avium subsp. paratuberculosis
cgccgggcgggccgcagcacca

SEQ ID NO: 2912010 - RNA, 15 nt, Mycobacterium avium subsp. paratuberculosis
cgccgggcgggcgca

SEQ ID NO: 2912011 - RNA, 17 nt, Mycobacterium avium subsp. paratuberculosis
cgccgggcgggguggug

SEQ ID NO: 2912012 - RNA, 20 nt, Mycobacterium avium subsp. paratuberculosis
cgccgggcggggugguggac

SEQ ID NO: 2912013 - RNA, 13 nt, Mycobacterium avium subsp. paratuberculosis
cgccgggcgucac

SEQ ID NO: 2912014 - RNA, 22 nt, Mycobacterium avium subsp. paratuberculosis
cgccgggcgucacgccagcgug

SEQ ID NO: 2912015 - RNA, 15 nt, Mycobacterium avium subsp. paratuberculosis
cgccgggcgucacuc

SEQ ID NO: 2912016 - RNA, 19 nt, Mycobacterium avium subsp. paratuberculosis
cgccgggcgucacucuggc

SEQ ID NO: 2912017 - RNA, 14 nt, Mycobacterium avium subsp. paratuberculosis
cgccgggcgucgcg

SEQ ID NO: 2912018 - RNA, 15 nt, Mycobacterium avium subsp. paratuberculosis
cgccgggcgucgcgc

SEQ ID NO: 2912019 - RNA, 16 nt, Mycobacterium avium subsp. paratuberculosis
cgccgggcgucgcgcu

SEQ ID NO: 2912020 - RNA, 23 nt, Mycobacterium avium subsp. paratuberculosis
cgccgggcguugcccgccgcggc

SEQ ID NO: 2912021 - RNA, 13 nt, Mycobacterium avium subsp. paratuberculosis
cgccgggcugacc

SEQ ID NO: 2912022 - RNA, 19 nt, Mycobacterium avium subsp. paratuberculosis
cgccgggcugaccgucgac

SEQ ID NO: 2912023 - RNA, 21 nt, Mycobacterium avium subsp. paratuberculosis
cgccgggcugaccgucgacca

SEQ ID NO: 2912024 - RNA, 23 nt, Mycobacterium avium subsp. paratuberculosis
cgccgggcugaccgucgaccaac

SEQ ID NO: 2912025 - RNA, 19 nt, Mycobacterium avium subsp. paratuberculosis
cgccgggcugcacgcugcg

SEQ ID NO: 2912026 - RNA, 14 nt, Mycobacterium avium subsp. paratuberculosis
cgccgggcuggccg

SEQ ID NO: 2912027 - RNA, 17 nt, Mycobacterium avium subsp. paratuberculosis
cgccgggcuggccgucg

SEQ ID NO: 2912028 - RNA, 18 nt, Mycobacterium avium subsp. paratuberculosis
cgccgggcuggccgucgg

SEQ ID NO: 2912029 - RNA, 20 nt, Mycobacterium avium subsp. paratuberculosis
cgccgggcuggccgucggcg

SEQ ID NO: 2912030 - RNA, 20 nt, Mycobacterium avium subsp. paratuberculosis
cgccgggcuuccccaaccug

SEQ ID NO: 2912031 - RNA, 19 nt, Mycobacterium avium subsp. paratuberculosis
cgccggggaacaccggcga

SEQ ID NO: 2912032 - RNA, 20 nt, Mycobacterium avium subsp. paratuberculosis
cgccggggaacaccggcgag

SEQ ID NO: 2912033 - RNA, 20 nt, Mycobacterium avium subsp. paratuberculosis
cgccggggaagaucucggcc

SEQ ID NO: 2912034 - RNA, 22 nt, Mycobacterium avium subsp. paratuberculosis
cgccggggaagaucucggccag

SEQ ID NO: 2912035 - RNA, 17 nt, Mycobacterium avium subsp. paratuberculosis
cgccggggacccgcacc

SEQ ID NO: 2912036 - RNA, 20 nt, Mycobacterium avium subsp. paratuberculosis
cgccggggacccgcaccgga

SEQ ID NO: 2912037 - RNA, 15 nt, Mycobacterium avium subsp. paratuberculosis
cgccggggacgacgg

SEQ ID NO: 2912038 - RNA, 17 nt, Mycobacterium avium subsp. paratuberculosis
cgccggggacgacggcg

SEQ ID NO: 2912039 - RNA, 18 nt, Mycobacterium avium subsp. paratuberculosis
cgccggggacgacggcgg

SEQ ID NO: 2912040 - RNA, 20 nt, Mycobacterium avium subsp. paratuberculosis
cgccggggacgacggcgggg

SEQ ID NO: 2912041 - RNA, 13 nt, Mycobacterium avium subsp. paratuberculosis
cgccggggcacca

SEQ ID NO: 2912042 - RNA, 15 nt, Mycobacterium avium subsp. paratuberculosis
cgccggggcaccauu

SEQ ID NO: 2912043 - RNA, 13 nt, Mycobacterium avium subsp. paratuberculosis
cgccggggcccca

SEQ ID NO: 2912044 - RNA, 13 nt, Mycobacterium avium subsp. paratuberculosis
cgccggggcccuc

SEQ ID NO: 2912045 - RNA, 15 nt, Mycobacterium avium subsp. paratuberculosis
cgccggggccgcggc

SEQ ID NO: 2912046 - RNA, 16 nt, Mycobacterium avium subsp. paratuberculosis
cgccggggccgcggcu

SEQ ID NO: 2912047 - RNA, 17 nt, Mycobacterium avium subsp. paratuberculosis
cgccggggccgcggcuc

SEQ ID NO: 2912048 - RNA, 18 nt, Mycobacterium avium subsp. paratuberculosis
cgccggggccgcggcucg

SEQ ID NO: 2912049 - RNA, 20 nt, Mycobacterium avium subsp. paratuberculosis
cgccggggccgcggcucgcg

SEQ ID NO: 2912050 - RNA, 14 nt, Mycobacterium avium subsp. paratuberculosis
cgccggggccggcg

SEQ ID NO: 2912051 - RNA, 15 nt, Mycobacterium avium subsp. paratuberculosis
cgccggggccggcga

SEQ ID NO: 2912052 - RNA, 17 nt, Mycobacterium avium subsp. paratuberculosis
cgccggggccggcgaug

SEQ ID NO: 2912053 - RNA, 13 nt, Mycobacterium avium subsp. paratuberculosis
cgccggggcgccg

SEQ ID NO: 2912054 - RNA, 19 nt, Mycobacterium avium subsp. paratuberculosis
cgccggggcgccgccgaac

SEQ ID NO: 2912055 - RNA, 23 nt, Mycobacterium avium subsp. paratuberculosis
cgccggggcgcugagcagguccu

SEQ ID NO: 2912056 - RNA, 21 nt, Mycobacterium avium subsp. paratuberculosis
cgccggggcggauccccgcgc

SEQ ID NO: 2912057 - RNA, 23 nt, Mycobacterium avium subsp. paratuberculosis
cgccggggcggauccccgcgcug

SEQ ID NO: 2912058 - RNA, 14 nt, Mycobacterium avium subsp. paratuberculosis
cgccggggcgggca

SEQ ID NO: 2912059 - RNA, 16 nt, Mycobacterium avium subsp. paratuberculosis
cgccggggcgggcagc

SEQ ID NO: 2912060 - RNA, 22 nt, Mycobacterium avium subsp. paratuberculosis
cgccggggcgggcagcaccagc

SEQ ID NO: 2912061 - RNA, 23 nt, Mycobacterium avium subsp. paratuberculosis
cgccggggcgggcagcaccagcg

SEQ ID NO: 2912062 - RNA, 15 nt, Mycobacterium avium subsp. paratuberculosis
cgccggggcgggcgg

SEQ ID NO: 2912063 - RNA, 20 nt, Mycobacterium avium subsp. paratuberculosis
cgccggggcgggcggcggcu

SEQ ID NO: 2912064 - RNA, 21 nt, Mycobacterium avium subsp. paratuberculosis
cgccggggcgggcggcggcug

SEQ ID NO: 2912065 - RNA, 13 nt, Mycobacterium avium subsp. paratuberculosis
cgccggggcgucg

SEQ ID NO: 2912066 - RNA, 23 nt, Mycobacterium avium subsp. paratuberculosis
cgccggggcgucggacgccagug

SEQ ID NO: 2912067 - RNA, 16 nt, Mycobacterium avium subsp. paratuberculosis
cgccgggguagaggcc

SEQ ID NO: 2912068 - RNA, 20 nt, Mycobacterium avium subsp. paratuberculosis
cgccgggguagaggccgcgg

SEQ ID NO: 2912069 - RNA, 14 nt, Mycobacterium avium subsp. paratuberculosis
cgccgggguccgca

SEQ ID NO: 2912070 - RNA, 16 nt, Mycobacterium avium subsp. paratuberculosis
cgccgggguccgcaac

SEQ ID NO: 2912071 - RNA, 18 nt, Mycobacterium avium subsp. paratuberculosis
cgccgggguccgcaacgc

SEQ ID NO: 2912072 - RNA, 19 nt, Mycobacterium avium subsp. paratuberculosis
cgccgggguccucucggcg

SEQ ID NO: 2912073 - RNA, 14 nt, Mycobacterium avium subsp. paratuberculosis
cgccggggucgaca

SEQ ID NO: 2912074 - RNA, 17 nt, Mycobacterium avium subsp. paratuberculosis
cgccggggucgcgcgcg

SEQ ID NO: 2912075 - RNA, 18 nt, Mycobacterium avium subsp. paratuberculosis
cgccggggucgcgcgcga

SEQ ID NO: 2912076 - RNA, 16 nt, Mycobacterium avium subsp. paratuberculosis
cgccggggugcaccgu

SEQ ID NO: 2912077 - RNA, 17 nt, Mycobacterium avium subsp. paratuberculosis
cgccggggugcaccgug

SEQ ID NO: 2912078 - RNA, 15 nt, Mycobacterium avium subsp. paratuberculosis
cgccggggugggcca

SEQ ID NO: 2912079 - RNA, 16 nt, Mycobacterium avium subsp. paratuberculosis
cgccgggguguccagc

SEQ ID NO: 2912080 - RNA, 20 nt, Mycobacterium avium subsp. paratuberculosis
cgccgggguguccagcgggu

SEQ ID NO: 2912081 - RNA, 20 nt, Mycobacterium avium subsp. paratuberculosis
cgccggggugugcagcggga

SEQ ID NO: 2912082 - RNA, 19 nt, Mycobacterium avium subsp. paratuberculosis
cgccgggguuuucgugguc

SEQ ID NO: 2912083 - RNA, 19 nt, Mycobacterium avium subsp. paratuberculosis
cgccggguaguucaccccg

SEQ ID NO: 2912084 - RNA, 20 nt, Mycobacterium avium subsp. paratuberculosis
cgccggguaguucaccccgu

SEQ ID NO: 2912085 - RNA, 18 nt, Mycobacterium avium subsp. paratuberculosis
cgccgggucaccggaugc

SEQ ID NO: 2912086 - RNA, 15 nt, Mycobacterium avium subsp. paratuberculosis
cgccgggucaucccc

SEQ ID NO: 2912087 - RNA, 22 nt, Mycobacterium avium subsp. paratuberculosis
cgccgggucauccccgugcggg

SEQ ID NO: 2912088 - RNA, 16 nt, Mycobacterium avium subsp. paratuberculosis
cgccggguccacgaac

SEQ ID NO: 2912089 - RNA, 17 nt, Mycobacterium avium subsp. paratuberculosis
cgccggguccagccgcg

SEQ ID NO: 2912090 - RNA, 12 nt, Mycobacterium avium subsp. paratuberculosis
cgccggguccca

SEQ ID NO: 2912091 - RNA, 21 nt, Mycobacterium avium subsp. paratuberculosis
cgccggugaagaucgcccgcc

SEQ ID NO: 2912092 - RNA, 23 nt, Mycobacterium avium subsp. paratuberculosis
cgccggugaagaucgcccgccgc

SEQ ID NO: 2912093 - RNA, 15 nt, Mycobacterium avium subsp. paratuberculosis
cgccggugaagcggg

SEQ ID NO: 2912094 - RNA, 20 nt, Mycobacterium avium subsp. paratuberculosis
cgccggugaagcgggacagc

SEQ ID NO: 2912095 - RNA, 14 nt, Mycobacterium avium subsp. paratuberculosis
cgccggugaccaga

SEQ ID NO: 2912096 - RNA, 13 nt, Mycobacterium avium subsp. paratuberculosis
cgccggugacccc

SEQ ID NO: 2912097 - RNA, 16 nt, Mycobacterium avium subsp. paratuberculosis
cgccggugaccgcgcc

SEQ ID NO: 2912098 - RNA, 17 nt, Mycobacterium avium subsp. paratuberculosis
cgccggugaccgcgccg

SEQ ID NO: 2912099 - RNA, 14 nt, Mycobacterium avium subsp. paratuberculosis
cgccggugaccugc

SEQ ID NO: 2912100 - RNA, 17 nt, Mycobacterium avium subsp. paratuberculosis
cgccggugaccugcagc

SEQ ID NO: 2912101 - RNA, 21 nt, Mycobacterium avium subsp. paratuberculosis
cgccggugaccugcagcgccu

SEQ ID NO: 2912102 - RNA, 22 nt, Mycobacterium avium subsp. paratuberculosis
cgccggugaccugcagcgccuu

SEQ ID NO: 2912103 - RNA, 14 nt, Mycobacterium avium subsp. paratuberculosis
cgccggugagcacg

SEQ ID NO: 2912104 - RNA, 17 nt, Mycobacterium avium subsp. paratuberculosis
cgccggugagcacgacc

SEQ ID NO: 2912105 - RNA, 20 nt, Mycobacterium avium subsp. paratuberculosis
cgccggugagcacgaccgcc

SEQ ID NO: 2912106 - RNA, 21 nt, Mycobacterium avium subsp. paratuberculosis
cgccggugagcacgaccgcca

SEQ ID NO: 2912107 - RNA, 16 nt, Mycobacterium avium subsp. paratuberculosis
cgccggugagcacggu

SEQ ID NO: 2912108 - RNA, 15 nt, Mycobacterium avium subsp. paratuberculosis
cgccggugagguggc

SEQ ID NO: 2912109 - RNA, 16 nt, Mycobacterium avium subsp. paratuberculosis
cgccggugccagcaac

SEQ ID NO: 2912110 - RNA, 13 nt, Mycobacterium avium subsp. paratuberculosis
cgccggugcccac

SEQ ID NO: 2912111 - RNA, 16 nt, Mycobacterium avium subsp. paratuberculosis
cgccggugcccacgcc

SEQ ID NO: 2912112 - RNA, 17 nt, Mycobacterium avium subsp. paratuberculosis
cgccggugccgacgaug

SEQ ID NO: 2912113 - RNA, 17 nt, Mycobacterium avium subsp. paratuberculosis
cgccggugccgcagccg

SEQ ID NO: 2912114 - RNA, 20 nt, Mycobacterium avium subsp. paratuberculosis
cgccggugccguugaucagg

SEQ ID NO: 2912115 - RNA, 13 nt, Mycobacterium avium subsp. paratuberculosis
cgccggugcgcag

SEQ ID NO: 2912116 - RNA, 16 nt, Mycobacterium avium subsp. paratuberculosis
cgccggugcggccgcg

SEQ ID NO: 2912117 - RNA, 18 nt, Mycobacterium avium subsp. paratuberculosis
cgccggugcggccgcgau

SEQ ID NO: 2912118 - RNA, 14 nt, Mycobacterium avium subsp. paratuberculosis
cgccggugcgggcu

SEQ ID NO: 2912119 - RNA, 16 nt, Mycobacterium avium subsp. paratuberculosis
cgccggugcgggcugg

SEQ ID NO: 2912120 - RNA, 15 nt, Mycobacterium avium subsp. paratuberculosis
cgccggugcugguca

SEQ ID NO: 2912121 - RNA, 22 nt, Mycobacterium avium subsp. paratuberculosis
cgccgguggacaggugcaucca

SEQ ID NO: 2912122 - RNA, 20 nt, Mycobacterium avium subsp. paratuberculosis
cgccgguggagauggccagc

SEQ ID NO: 2912123 - RNA, 22 nt, Mycobacterium avium subsp. paratuberculosis
cgccgguggagauggccagcac

SEQ ID NO: 2912124 - RNA, 23 nt, Mycobacterium avium subsp. paratuberculosis
cgccgguggagauggccagcacc

SEQ ID NO: 2912125 - RNA, 16 nt, Mycobacterium avium subsp. paratuberculosis
cgccgguggccgccgg

SEQ ID NO: 2912126 - RNA, 14 nt, Mycobacterium avium subsp. paratuberculosis
cgccgguggcggcg

SEQ ID NO: 2912127 - RNA, 15 nt, Mycobacterium avium subsp. paratuberculosis
cgccgguggcggcga

SEQ ID NO: 2912128 - RNA, 15 nt, Mycobacterium avium subsp. paratuberculosis
cgccgguggcgucgg

SEQ ID NO: 2912129 - RNA, 20 nt, Mycobacterium avium subsp. paratuberculosis
cgccgguggcgucggugaug

SEQ ID NO: 2912130 - RNA, 15 nt, Mycobacterium avium subsp. paratuberculosis
cgccgguggggucgg

SEQ ID NO: 2912131 - RNA, 19 nt, Mycobacterium avium subsp. paratuberculosis
cgccgguggggugaugagg

SEQ ID NO: 2912132 - RNA, 21 nt, Mycobacterium avium subsp. paratuberculosis
cgccggugucauaccagccgu

SEQ ID NO: 2912133 - RNA, 18 nt, Mycobacterium avium subsp. paratuberculosis
cgccggugucggcgacca

SEQ ID NO: 2912134 - RNA, 16 nt, Mycobacterium avium subsp. paratuberculosis
cgccggugugaucgag

SEQ ID NO: 2912135 - RNA, 19 nt, Mycobacterium avium subsp. paratuberculosis
cgccggugugaucgagcac

SEQ ID NO: 2912136 - RNA, 14 nt, Mycobacterium avium subsp. paratuberculosis
cgccggugugcagc

SEQ ID NO: 2912137 - RNA, 20 nt, Mycobacterium avium subsp. paratuberculosis
cgccggugugcagccacccg

SEQ ID NO: 2912138 - RNA, 23 nt, Mycobacterium avium subsp. paratuberculosis
cgccggugugcagccacccgucg

SEQ ID NO: 2912139 - RNA, 15 nt, Mycobacterium avium subsp. paratuberculosis
cgccgguguucggcg

SEQ ID NO: 2912140 - RNA, 18 nt, Mycobacterium avium subsp. paratuberculosis
cgccgguguucggcgcca

SEQ ID NO: 2912141 - RNA, 20 nt, Mycobacterium avium subsp. paratuberculosis
cgccgguguucggcgccagc

SEQ ID NO: 2912142 - RNA, 14 nt, Mycobacterium avium subsp. paratuberculosis
cgccgguucgcugg

SEQ ID NO: 2912143 - RNA, 20 nt, Mycobacterium avium subsp. paratuberculosis
cgccgguucgcuggcggcca

SEQ ID NO: 2912144 - RNA, 14 nt, Mycobacterium avium subsp. paratuberculosis
cgccgguugaucac

SEQ ID NO: 2912145 - RNA, 19 nt, Mycobacterium avium subsp. paratuberculosis
cgccgguugaucacccggg

SEQ ID NO: 2912146 - RNA, 16 nt, Mycobacterium avium subsp. paratuberculosis
cgccgguuuccaggac

SEQ ID NO: 2912147 - RNA, 19 nt, Mycobacterium avium subsp. paratuberculosis
cgccgguuuccaggacgau

SEQ ID NO: 2912148 - RNA, 23 nt, Mycobacterium avium subsp. paratuberculosis
cgccgguuuccaggacgaugcgc

SEQ ID NO: 2912149 - RNA, 19 nt, Mycobacterium avium subsp. paratuberculosis
cgccgguuucgucggucug

SEQ ID NO: 2912150 - RNA, 20 nt, Mycobacterium avium subsp. paratuberculosis
cgccgguuucgucggucugc

SEQ ID NO: 2912151 - RNA, 23 nt, Mycobacterium avium subsp. paratuberculosis
cgccguacaccgugcccgagccg

SEQ ID NO: 2912152 - RNA, 13 nt, Mycobacterium avium subsp. paratuberculosis
cgccguacagcug

SEQ ID NO: 2912153 - RNA, 15 nt, Mycobacterium avium subsp. paratuberculosis
cgccguacagcuggu

SEQ ID NO: 2912154 - RNA, 13 nt, Mycobacterium avium subsp. paratuberculosis
cgccguacccgaa

SEQ ID NO: 2912155 - RNA, 15 nt, Mycobacterium avium subsp. paratuberculosis
cgccguacgcgccgg

SEQ ID NO: 2912156 - RNA, 17 nt, Mycobacterium avium subsp. paratuberculosis
cgccguacgcgccggcc

SEQ ID NO: 2912157 - RNA, 18 nt, Mycobacterium avium subsp. paratuberculosis
cgccguacgcgccggcca

SEQ ID NO: 2912158 - RNA, 20 nt, Mycobacterium avium subsp. paratuberculosis
cgccguacgcgccggccagc

SEQ ID NO: 2912159 - RNA, 17 nt, Mycobacterium avium subsp. paratuberculosis
cgccguagaauccgccg

SEQ ID NO: 2912160 - RNA, 21 nt, Mycobacterium avium subsp. paratuberculosis
cgccguagaucacgccgguga

SEQ ID NO: 2912161 - RNA, 21 nt, Mycobacterium avium subsp. paratuberculosis
cgccguagccggcgguggcca

SEQ ID NO: 2912162 - RNA, 16 nt, Mycobacterium avium subsp. paratuberculosis
cgccguagcgccggca

SEQ ID NO: 2912163 - RNA, 19 nt, Mycobacterium avium subsp. paratuberculosis
cgccguagcgccggcaaca

SEQ ID NO: 2912164 - RNA, 15 nt, Mycobacterium avium subsp. paratuberculosis
cgccguagcggccca

SEQ ID NO: 2912165 - RNA, 16 nt, Mycobacterium avium subsp. paratuberculosis
cgccguaggccgcgcu

SEQ ID NO: 2912166 - RNA, 17 nt, Mycobacterium avium subsp. paratuberculosis
cgccguaggccgcgcug

SEQ ID NO: 2912167 - RNA, 18 nt, Mycobacterium avium subsp. paratuberculosis
cgccguaggccgcgcuga

SEQ ID NO: 2912168 - RNA, 15 nt, Mycobacterium avium subsp. paratuberculosis
cgccguagguggcca

SEQ ID NO: 2912169 - RNA, 15 nt, Mycobacterium avium subsp. paratuberculosis
cgccguauucgccga

SEQ ID NO: 2912170 - RNA, 16 nt, Mycobacterium avium subsp. paratuberculosis
cgccguauucgccgac

SEQ ID NO: 2912171 - RNA, 17 nt, Mycobacterium avium subsp. paratuberculosis
cgccguauucgccgacg

SEQ ID NO: 2912172 - RNA, 17 nt, Mycobacterium avium subsp. paratuberculosis
cgccguauuggcaggcg

SEQ ID NO: 2912173 - RNA, 20 nt, Mycobacterium avium subsp. paratuberculosis
cgccguauuggcaggcgaug

SEQ ID NO: 2912174 - RNA, 22 nt, Mycobacterium avium subsp. paratuberculosis
cgccguauuggcaggcgaugug

SEQ ID NO: 2912175 - RNA, 19 nt, Mycobacterium avium subsp. paratuberculosis
cgccgucacaccgcggcca

SEQ ID NO: 2912176 - RNA, 14 nt, Mycobacterium avium subsp. paratuberculosis
cgccgucgccggac

SEQ ID NO: 2912177 - RNA, 21 nt, Mycobacterium avium subsp. paratuberculosis
cgccgucgccggacucgaucg

SEQ ID NO: 2912178 - RNA, 15 nt, Mycobacterium avium subsp. paratuberculosis
cgccgucgcgaucgc

SEQ ID NO: 2912179 - RNA, 16 nt, Mycobacterium avium subsp. paratuberculosis
cgccgucgcgaucgcg

SEQ ID NO: 2912180 - RNA, 20 nt, Mycobacterium avium subsp. paratuberculosis
cgccgucgcgaucgcggucc

SEQ ID NO: 2912181 - RNA, 21 nt, Mycobacterium avium subsp. paratuberculosis
cgccgucgcgaucgcggucca

SEQ ID NO: 2912182 - RNA, 15 nt, Mycobacterium avium subsp. paratuberculosis
cgccgucgcgccagg

SEQ ID NO: 2912183 - RNA, 14 nt, Mycobacterium avium subsp. paratuberculosis
cgccgucggcaucc

SEQ ID NO: 2912184 - RNA, 22 nt, Mycobacterium avium subsp. paratuberculosis
cgccgucggcauccacccguuc

SEQ ID NO: 2912185 - RNA, 11 nt, Mycobacterium avium subsp. paratuberculosis
cgccgucggcc

SEQ ID NO: 2912186 - RNA, 15 nt, Mycobacterium avium subsp. paratuberculosis
cgccgucggccagca

SEQ ID NO: 2912187 - RNA, 17 nt, Mycobacterium avium subsp. paratuberculosis
cgccgucggccagcagc

SEQ ID NO: 2912188 - RNA, 18 nt, Mycobacterium avium subsp. paratuberculosis
cgccgucggccagcagcg

SEQ ID NO: 2912189 - RNA, 22 nt, Mycobacterium avium subsp. paratuberculosis
cgccgucggccagcagcgcguc

SEQ ID NO: 2912190 - RNA, 16 nt, Mycobacterium avium subsp. paratuberculosis
cgccgucggcccacgg

SEQ ID NO: 2912191 - RNA, 12 nt, Mycobacterium avium subsp. paratuberculosis
cgccgucggcgg

SEQ ID NO: 2912192 - RNA, 23 nt, Mycobacterium avium subsp. paratuberculosis
cgccgucggcguucagcggcacc

SEQ ID NO: 2912193 - RNA, 12 nt, Mycobacterium avium subsp. paratuberculosis
cgccgucggggc

SEQ ID NO: 2912194 - RNA, 18 nt, Mycobacterium avium subsp. paratuberculosis
cgccgucggggcgucggc

SEQ ID NO: 2912195 - RNA, 13 nt, Mycobacterium avium subsp. paratuberculosis
cgccgucggggcu

SEQ ID NO: 2912196 - RNA, 14 nt, Mycobacterium avium subsp. paratuberculosis
cgccgucggggcug

SEQ ID NO: 2912197 - RNA, 14 nt, Mycobacterium avium subsp. paratuberculosis
cgccgucgggguag

SEQ ID NO: 2912198 - RNA, 15 nt, Mycobacterium avium subsp. paratuberculosis
cgccgucggggucgc

SEQ ID NO: 2912199 - RNA, 21 nt, Mycobacterium avium subsp. paratuberculosis
cgccgucggggucgcgccggu

SEQ ID NO: 2912200 - RNA, 20 nt, Mycobacterium avium subsp. paratuberculosis
cgccgucggggugcggucgg

SEQ ID NO: 2912201 - RNA, 21 nt, Mycobacterium avium subsp. paratuberculosis
cgccgucggggugcggucggc

SEQ ID NO: 2912202 - RNA, 22 nt, Mycobacterium avium subsp. paratuberculosis
cgccgucggggugcggucggcg

SEQ ID NO: 2912203 - RNA, 20 nt, Mycobacterium avium subsp. paratuberculosis
cgccgucgguaucgaggucc

SEQ ID NO: 2912204 - RNA, 13 nt, Mycobacterium avium subsp. paratuberculosis
cgccgucggugau

SEQ ID NO: 2912205 - RNA, 14 nt, Mycobacterium avium subsp. paratuberculosis
cgccgucggugaug

SEQ ID NO: 2912206 - RNA, 13 nt, Mycobacterium avium subsp. paratuberculosis
cgccgucgguggg

SEQ ID NO: 2912207 - RNA, 21 nt, Mycobacterium avium subsp. paratuberculosis
cgccgucggugggggccaggc

SEQ ID NO: 2912208 - RNA, 23 nt, Mycobacterium avium subsp. paratuberculosis
cgccgucgguguagcgagugccg

SEQ ID NO: 2912209 - RNA, 16 nt, Mycobacterium avium subsp. paratuberculosis
cgccgucgucagccgg

SEQ ID NO: 2912210 - RNA, 20 nt, Mycobacterium avium subsp. paratuberculosis
cgccgucgucagccgggcca

SEQ ID NO: 2912211 - RNA, 14 nt, Mycobacterium avium subsp. paratuberculosis
cgccgucgucgagc

SEQ ID NO: 2912212 - RNA, 17 nt, Mycobacterium avium subsp. paratuberculosis
cgccgucgucgagcacc

SEQ ID NO: 2912213 - RNA, 15 nt, Mycobacterium avium subsp. paratuberculosis
cgccgucgucggaca

SEQ ID NO: 2912214 - RNA, 17 nt, Mycobacterium avium subsp. paratuberculosis
cgccgucgucgucggcc

SEQ ID NO: 2912215 - RNA, 23 nt, Mycobacterium avium subsp. paratuberculosis
cgccgucgucguuguuggcggcg

SEQ ID NO: 2912216 - RNA, 16 nt, Mycobacterium avium subsp. paratuberculosis
cgccgucgugcucggc

SEQ ID NO: 2912217 - RNA, 19 nt, Mycobacterium avium subsp. paratuberculosis
cgccgucgugcucggcgag

SEQ ID NO: 2912218 - RNA, 21 nt, Mycobacterium avium subsp. paratuberculosis
cgccgucgugcucggcgagca

SEQ ID NO: 2912219 - RNA, 20 nt, Mycobacterium avium subsp. paratuberculosis
cgccgucgugguggccgcga

SEQ ID NO: 2912220 - RNA, 21 nt, Mycobacterium avium subsp. paratuberculosis
cgccgucgugguggccgcgaa

SEQ ID NO: 2912221 - RNA, 22 nt, Mycobacterium avium subsp. paratuberculosis
cgccgucguugaucaggugcag

SEQ ID NO: 2912222 - RNA, 13 nt, Mycobacterium avium subsp. paratuberculosis
cgccgucucagga

SEQ ID NO: 2912223 - RNA, 16 nt, Mycobacterium avium subsp. paratuberculosis
cgccgucuccggcgua

SEQ ID NO: 2912224 - RNA, 17 nt, Mycobacterium avium subsp. paratuberculosis
cgccgucuccucgacca

SEQ ID NO: 2912225 - RNA, 21 nt, Mycobacterium avium subsp. paratuberculosis
cgccgucuccucgaccagcgc

SEQ ID NO: 2912226 - RNA, 22 nt, Mycobacterium avium subsp. paratuberculosis
cgccgucuccucgaccagcgcg

SEQ ID NO: 2912227 - RNA, 14 nt, Mycobacterium avium subsp. paratuberculosis
cgccgucucgacca

SEQ ID NO: 2912228 - RNA, 22 nt, Mycobacterium avium subsp. paratuberculosis
cgccgucuucccagugccgcag

SEQ ID NO: 2912229 - RNA, 14 nt, Mycobacterium avium subsp. paratuberculosis
cgccgucuuccggg

SEQ ID NO: 2912230 - RNA, 23 nt, Mycobacterium avium subsp. paratuberculosis
cgccgugaacugugcggugcggc

SEQ ID NO: 2912231 - RNA, 17 nt, Mycobacterium avium subsp. paratuberculosis
cgccgugaagggcccgc

SEQ ID NO: 2912232 - RNA, 19 nt, Mycobacterium avium subsp. paratuberculosis
cgccgugaagggcccgccg

SEQ ID NO: 2912233 - RNA, 20 nt, Mycobacterium avium subsp. paratuberculosis
cgccgugaagggcccgccgg

SEQ ID NO: 2912234 - RNA, 13 nt, Mycobacterium avium subsp. paratuberculosis
cgccgugaccggc

SEQ ID NO: 2912235 - RNA, 16 nt, Mycobacterium avium subsp. paratuberculosis
cgccgugaccggcgau

SEQ ID NO: 2912236 - RNA, 17 nt, Mycobacterium avium subsp. paratuberculosis
cgccgugaccggcgauc

SEQ ID NO: 2912237 - RNA, 12 nt, Mycobacterium avium subsp. paratuberculosis
cgccgugacgcc

SEQ ID NO: 2912238 - RNA, 14 nt, Mycobacterium avium subsp. paratuberculosis
cgccgugacgccga

SEQ ID NO: 2912239 - RNA, 16 nt, Mycobacterium avium subsp. paratuberculosis
cgccgugagauccagc

SEQ ID NO: 2912240 - RNA, 20 nt, Mycobacterium avium subsp. paratuberculosis
cgccgugagauccagcagcc

SEQ ID NO: 2912241 - RNA, 18 nt, Mycobacterium avium subsp. paratuberculosis
cgccgugcagaacagcac

SEQ ID NO: 2912242 - RNA, 20 nt, Mycobacterium avium subsp. paratuberculosis
cgccgugcagaacagcacga

SEQ ID NO: 2912243 - RNA, 13 nt, Mycobacterium avium subsp. paratuberculosis
cgccgugcagcac

SEQ ID NO: 2912244 - RNA, 14 nt, Mycobacterium avium subsp. paratuberculosis
cgccgugcagcacc

SEQ ID NO: 2912245 - RNA, 15 nt, Mycobacterium avium subsp. paratuberculosis
cgccgugcagcaccu

SEQ ID NO: 2912246 - RNA, 16 nt, Mycobacterium avium subsp. paratuberculosis
cgccgugcagcacgcc

SEQ ID NO: 2912247 - RNA, 17 nt, Mycobacterium avium subsp. paratuberculosis
cgccgugcagcacgccg

SEQ ID NO: 2912248 - RNA, 22 nt, Mycobacterium avium subsp. paratuberculosis
cgccgugcagcacgccgcggaa

SEQ ID NO: 2912249 - RNA, 12 nt, Mycobacterium avium subsp. paratuberculosis
cgccgugcagga

SEQ ID NO: 2912250 - RNA, 21 nt, Mycobacterium avium subsp. paratuberculosis
cgccgugcaggaugaccgcgu

SEQ ID NO: 2912251 - RNA, 22 nt, Mycobacterium avium subsp. paratuberculosis
cgccgugcaggaugaccgcguc

SEQ ID NO: 2912252 - RNA, 21 nt, Mycobacterium avium subsp. paratuberculosis
cgccgugcauccagccgucca

SEQ ID NO: 2912253 - RNA, 22 nt, Mycobacterium avium subsp. paratuberculosis
cgccgugcauccagccguccag

SEQ ID NO: 2912254 - RNA, 13 nt, Mycobacterium avium subsp. paratuberculosis
cgccgugcccggc

SEQ ID NO: 2912255 - RNA, 14 nt, Mycobacterium avium subsp. paratuberculosis
cgccgugcccggcg

SEQ ID NO: 2912256 - RNA, 15 nt, Mycobacterium avium subsp. paratuberculosis
cgccgugccgcgcgg

SEQ ID NO: 2912257 - RNA, 18 nt, Mycobacterium avium subsp. paratuberculosis
cgccgugccgcgcggcga

SEQ ID NO: 2912258 - RNA, 14 nt, Mycobacterium avium subsp. paratuberculosis
cgccgugccggacc

SEQ ID NO: 2912259 - RNA, 15 nt, Mycobacterium avium subsp. paratuberculosis
cgccgugccggaccg

SEQ ID NO: 2912260 - RNA, 16 nt, Mycobacterium avium subsp. paratuberculosis
cgccgugccggaccgc

SEQ ID NO: 2912261 - RNA, 23 nt, Mycobacterium avium subsp. paratuberculosis
cgccguuucggacgagccgucgc

SEQ ID NO: 2912262 - RNA, 15 nt, Mycobacterium avium subsp. paratuberculosis
cgccguuucggaucc

SEQ ID NO: 2912263 - RNA, 21 nt, Mycobacterium avium subsp. paratuberculosis
cgccguuuugccgccgagcgu

SEQ ID NO: 2912264 - RNA, 23 nt, Mycobacterium avium subsp. paratuberculosis
cgccguuuugccgccgagcguga

SEQ ID NO: 2912265 - RNA, 22 nt, Mycobacterium avium subsp. paratuberculosis
cgccuaauucguuguuggcggu

SEQ ID NO: 2912266 - RNA, 23 nt, Mycobacterium avium subsp. paratuberculosis
cgccuacacagcccccacgcucg

SEQ ID NO: 2912267 - RNA, 16 nt, Mycobacterium avium subsp. paratuberculosis
cgccuaccggguggcc

SEQ ID NO: 2912268 - RNA, 20 nt, Mycobacterium avium subsp. paratuberculosis
cgccuaccggguggccagca

SEQ ID NO: 2912269 - RNA, 21 nt, Mycobacterium avium subsp. paratuberculosis
cgccuaccggguggccagcac

SEQ ID NO: 2912270 - RNA, 14 nt, Mycobacterium avium subsp. paratuberculosis
cgccuacugcgcca

SEQ ID NO: 2912271 - RNA, 21 nt, Mycobacterium avium subsp. paratuberculosis
cgccucaacgguugucgcuca

SEQ ID NO: 2912272 - RNA, 21 nt, Mycobacterium avium subsp. paratuberculosis
cgccucacacggggcagaccg

SEQ ID NO: 2912273 - RNA, 17 nt, Mycobacterium avium subsp. paratuberculosis
cgccucaccccagcgcg

SEQ ID NO: 2912274 - RNA, 23 nt, Mycobacterium avium subsp. paratuberculosis
cgccucaccccagcgcgaccagu

SEQ ID NO: 2912275 - RNA, 16 nt, Mycobacterium avium subsp. paratuberculosis
cgccucacgcagggcc

SEQ ID NO: 2912276 - RNA, 17 nt, Mycobacterium avium subsp. paratuberculosis
cgccucacgcagggcca

SEQ ID NO: 2912277 - RNA, 18 nt, Mycobacterium avium subsp. paratuberculosis
cgccucacgcagggccaa

SEQ ID NO: 2912278 - RNA, 22 nt, Mycobacterium avium subsp. paratuberculosis
cgccucacgcagggccaagaca

SEQ ID NO: 2912279 - RNA, 22 nt, Mycobacterium avium subsp. paratuberculosis
cgccucagcagcugcuggcgug

SEQ ID NO: 2912280 - RNA, 17 nt, Mycobacterium avium subsp. paratuberculosis
cgccucaggcgagcacc

SEQ ID NO: 2912281 - RNA, 18 nt, Mycobacterium avium subsp. paratuberculosis
cgccucaggcgagcaccc

SEQ ID NO: 2912282 - RNA, 19 nt, Mycobacterium avium subsp. paratuberculosis
cgccucaggcgagcacccg

SEQ ID NO: 2912283 - RNA, 23 nt, Mycobacterium avium subsp. paratuberculosis
cgccucaugccagacgcgcaccg

SEQ ID NO: 2912284 - RNA, 19 nt, Mycobacterium avium subsp. paratuberculosis
cgccuccacauacgcggcg

SEQ ID NO: 2912285 - RNA, 21 nt, Mycobacterium avium subsp. paratuberculosis
cgccuccacauacgcggcggc

SEQ ID NO: 2912286 - RNA, 23 nt, Mycobacterium avium subsp. paratuberculosis
cgccuccacauacgcggcggccu

SEQ ID NO: 2912287 - RNA, 14 nt, Mycobacterium avium subsp. paratuberculosis
cgccuccaggugaa

SEQ ID NO: 2912288 - RNA, 14 nt, Mycobacterium avium subsp. paratuberculosis
cgccucccccaccc

SEQ ID NO: 2912289 - RNA, 16 nt, Mycobacterium avium subsp. paratuberculosis
cgccucccccacccgc

SEQ ID NO: 2912290 - RNA, 18 nt, Mycobacterium avium subsp. paratuberculosis
cgccucccccacccgcac

SEQ ID NO: 2912291 - RNA, 21 nt, Mycobacterium avium subsp. paratuberculosis
cgccucccccacccgcacggu

SEQ ID NO: 2912292 - RNA, 12 nt, Mycobacterium avium subsp. paratuberculosis
cgccucccgcag

SEQ ID NO: 2912293 - RNA, 14 nt, Mycobacterium avium subsp. paratuberculosis
cgccucccgcagcg

SEQ ID NO: 2912294 - RNA, 19 nt, Mycobacterium avium subsp. paratuberculosis
cgccucccgcagcgccagc

SEQ ID NO: 2912295 - RNA, 22 nt, Mycobacterium avium subsp. paratuberculosis
cgccucccgcagcgccagcgcg

SEQ ID NO: 2912296 - RNA, 23 nt, Mycobacterium avium subsp. paratuberculosis
cgccucccgcagcgccagcgcgc

SEQ ID NO: 2912297 - RNA, 17 nt, Mycobacterium avium subsp. paratuberculosis
cgccucccggaccacca

SEQ ID NO: 2912298 - RNA, 23 nt, Mycobacterium avium subsp. paratuberculosis
cgccuccgaauccagcgcgccgc

SEQ ID NO: 2912299 - RNA, 24 nt, Mycobacterium avium subsp. paratuberculosis
cgccuccgaauccagcgcgccgcu

SEQ ID NO: 2912300 - RNA, 20 nt, Mycobacterium avium subsp. paratuberculosis
cgccuccgacagccgcaccg

SEQ ID NO: 2912301 - RNA, 22 nt, Mycobacterium avium subsp. paratuberculosis
cgccuccgacagccgcaccggc

SEQ ID NO: 2912302 - RNA, 14 nt, Mycobacterium avium subsp. paratuberculosis
cgccuccgacgacg

SEQ ID NO: 2912303 - RNA, 14 nt, Mycobacterium avium subsp. paratuberculosis
cgccuccgagaugg

SEQ ID NO: 2912304 - RNA, 20 nt, Mycobacterium avium subsp. paratuberculosis
cgccuccgagauggacagca

SEQ ID NO: 2912305 - RNA, 19 nt, Mycobacterium avium subsp. paratuberculosis
cgccuccgcccgggugcag

SEQ ID NO: 2912306 - RNA, 22 nt, Mycobacterium avium subsp. paratuberculosis
cgccuccgcccgggugcaggcc

SEQ ID NO: 2912307 - RNA, 15 nt, Mycobacterium avium subsp. paratuberculosis
cgccuccgccgcccc

SEQ ID NO: 2912308 - RNA, 16 nt, Mycobacterium avium subsp. paratuberculosis
cgccuccgccgccccg

SEQ ID NO: 2912309 - RNA, 22 nt, Mycobacterium avium subsp. paratuberculosis
cgccuccggcaguacgcgccgg

SEQ ID NO: 2912310 - RNA, 12 nt, Mycobacterium avium subsp. paratuberculosis
cgccuccgggaa

SEQ ID NO: 2912311 - RNA, 19 nt, Mycobacterium avium subsp. paratuberculosis
cgccuccgggaaggcggcc

SEQ ID NO: 2912312 - RNA, 20 nt, Mycobacterium avium subsp. paratuberculosis
cgccuccgggaaggcggccg

SEQ ID NO: 2912313 - RNA, 21 nt, Mycobacterium avium subsp. paratuberculosis
cgccuccgggaaggcggccgc

SEQ ID NO: 2912314 - RNA, 14 nt, Mycobacterium avium subsp. paratuberculosis
cgccuccgggcugc

SEQ ID NO: 2912315 - RNA, 19 nt, Mycobacterium avium subsp. paratuberculosis
cgccuccgguuugcgccgg

SEQ ID NO: 2912316 - RNA, 20 nt, Mycobacterium avium subsp. paratuberculosis
cgccuccgguuugcgccggc

SEQ ID NO: 2912317 - RNA, 23 nt, Mycobacterium avium subsp. paratuberculosis
cgccuccgguuugcgccggcucc

SEQ ID NO: 2912318 - RNA, 16 nt, Mycobacterium avium subsp. paratuberculosis
cgccuccgucagcgcc

SEQ ID NO: 2912319 - RNA, 19 nt, Mycobacterium avium subsp. paratuberculosis
cgccuccucgaugucggug

SEQ ID NO: 2912320 - RNA, 16 nt, Mycobacterium avium subsp. paratuberculosis
cgccuccugcuggcgc

SEQ ID NO: 2912321 - RNA, 19 nt, Mycobacterium avium subsp. paratuberculosis
cgccuccugcuggcgcugc

SEQ ID NO: 2912322 - RNA, 19 nt, Mycobacterium avium subsp. paratuberculosis
cgccucgaacaucggcacg

SEQ ID NO: 2912323 - RNA, 19 nt, Mycobacterium avium subsp. paratuberculosis
cgccucgaaggcgccgaug

SEQ ID NO: 2912324 - RNA, 20 nt, Mycobacterium avium subsp. paratuberculosis
cgccucgaaggcgccgaugg

SEQ ID NO: 2912325 - RNA, 14 nt, Mycobacterium avium subsp. paratuberculosis
cgccucgaagucgc

SEQ ID NO: 2912326 - RNA, 17 nt, Mycobacterium avium subsp. paratuberculosis
cgccucgaagucgccgg

SEQ ID NO: 2912327 - RNA, 19 nt, Mycobacterium avium subsp. paratuberculosis
cgccucgaagucgccggcc

SEQ ID NO: 2912328 - RNA, 20 nt, Mycobacterium avium subsp. paratuberculosis
cgccucgaagucgccggccu

SEQ ID NO: 2912329 - RNA, 23 nt, Mycobacterium avium subsp. paratuberculosis
cgccucgaagucgccggccucca

SEQ ID NO: 2912330 - RNA, 15 nt, Mycobacterium avium subsp. paratuberculosis
cgccucgaccagcac

SEQ ID NO: 2912331 - RNA, 13 nt, Mycobacterium avium subsp. paratuberculosis
cgccucgaccagg

SEQ ID NO: 2912332 - RNA, 14 nt, Mycobacterium avium subsp. paratuberculosis
cgccucgacgguga

SEQ ID NO: 2912333 - RNA, 15 nt, Mycobacterium avium subsp. paratuberculosis
cgccucgacggugac

SEQ ID NO: 2912334 - RNA, 14 nt, Mycobacterium avium subsp. paratuberculosis
cgccucgagcaacg

SEQ ID NO: 2912335 - RNA, 16 nt, Mycobacterium avium subsp. paratuberculosis
cgccucgagcaacggc

SEQ ID NO: 2912336 - RNA, 19 nt, Mycobacterium avium subsp. paratuberculosis
cgccucgagcaacggccgc

SEQ ID NO: 2912337 - RNA, 21 nt, Mycobacterium avium subsp. paratuberculosis
cgccucgagcaacggccgcag

SEQ ID NO: 2912338 - RNA, 23 nt, Mycobacterium avium subsp. paratuberculosis
cgccucgagcaacggccgcagcg

SEQ ID NO: 2912339 - RNA, 14 nt, Mycobacterium avium subsp. paratuberculosis
cgccucgagcacca

SEQ ID NO: 2912340 - RNA, 18 nt, Mycobacterium avium subsp. paratuberculosis
cgccucgagcaccacggc

SEQ ID NO: 2912341 - RNA, 17 nt, Mycobacterium avium subsp. paratuberculosis
cgccucgaucaacgccg

SEQ ID NO: 2912342 - RNA, 22 nt, Mycobacterium avium subsp. paratuberculosis
cgccucgaucaacgccgggucg

SEQ ID NO: 2912343 - RNA, 17 nt, Mycobacterium avium subsp. paratuberculosis
cgccucgaucagcgcga

SEQ ID NO: 2912344 - RNA, 19 nt, Mycobacterium avium subsp. paratuberculosis
cgccucgaucagcgcgaaa

SEQ ID NO: 2912345 - RNA, 19 nt, Mycobacterium avium subsp. paratuberculosis
cgccugauacgacguccgg

SEQ ID NO: 2912346 - RNA, 20 nt, Mycobacterium avium subsp. paratuberculosis
cgccugauacgacguccggg

SEQ ID NO: 2912347 - RNA, 18 nt, Mycobacterium avium subsp. paratuberculosis
cgccugauccgcggucag

SEQ ID NO: 2912348 - RNA, 18 nt, Mycobacterium avium subsp. paratuberculosis
cgccugcaccggcgacgg

SEQ ID NO: 2912349 - RNA, 19 nt, Mycobacterium avium subsp. paratuberculosis
cgccugcaccuugcccguc

SEQ ID NO: 2912350 - RNA, 20 nt, Mycobacterium avium subsp. paratuberculosis
cgccugcaccuugcccgucg

SEQ ID NO: 2912351 - RNA, 22 nt, Mycobacterium avium subsp. paratuberculosis
cgccugcacgaaauaaccgcgc

SEQ ID NO: 2912352 - RNA, 23 nt, Mycobacterium avium subsp. paratuberculosis
cgccugcacgaaauaaccgcgcg

SEQ ID NO: 2912353 - RNA, 23 nt, Mycobacterium avium subsp. paratuberculosis
cgccugcacggugccgccgucca

SEQ ID NO: 2912354 - RNA, 21 nt, Mycobacterium avium subsp. paratuberculosis
cgccugcagggauucggccau

SEQ ID NO: 2912355 - RNA, 22 nt, Mycobacterium avium subsp. paratuberculosis
cgccugcagggauucggccaug

SEQ ID NO: 2912356 - RNA, 23 nt, Mycobacterium avium subsp. paratuberculosis
cgccugcagggauucggccaugc

SEQ ID NO: 2912357 - RNA, 22 nt, Mycobacterium avium subsp. paratuberculosis
cgccugcccggagaaaccgucg

SEQ ID NO: 2912358 - RNA, 14 nt, Mycobacterium avium subsp. paratuberculosis
cgccugcccgggcg

SEQ ID NO: 2912359 - RNA, 15 nt, Mycobacterium avium subsp. paratuberculosis
cgccugcccgggcgc

SEQ ID NO: 2912360 - RNA, 12 nt, Mycobacterium avium subsp. paratuberculosis
cgccugccggcg

SEQ ID NO: 2912361 - RNA, 14 nt, Mycobacterium avium subsp. paratuberculosis
cgccugccggcgcc

SEQ ID NO: 2912362 - RNA, 15 nt, Mycobacterium avium subsp. paratuberculosis
cgccugccggcgccg

SEQ ID NO: 2912363 - RNA, 16 nt, Mycobacterium avium subsp. paratuberculosis
cgccugccggcgccgg

SEQ ID NO: 2912364 - RNA, 23 nt, Mycobacterium avium subsp. paratuberculosis
cgccugccuggccacguggucgc

SEQ ID NO: 2912365 - RNA, 17 nt, Mycobacterium avium subsp. paratuberculosis
cgccugcgagcacaccc

SEQ ID NO: 2912366 - RNA, 17 nt, Mycobacterium avium subsp. paratuberculosis
cgccugcgccgccguag

SEQ ID NO: 2912367 - RNA, 13 nt, Mycobacterium avium subsp. paratuberculosis
cgccugcgcgauc

SEQ ID NO: 2912368 - RNA, 12 nt, Mycobacterium avium subsp. paratuberculosis
cgccugcgcggc

SEQ ID NO: 2912369 - RNA, 14 nt, Mycobacterium avium subsp. paratuberculosis
cgccugcgcggcgg

SEQ ID NO: 2912370 - RNA, 19 nt, Mycobacterium avium subsp. paratuberculosis
cgccugcgcggcggcgucc

SEQ ID NO: 2912371 - RNA, 20 nt, Mycobacterium avium subsp. paratuberculosis
cgccugcgcggcggcguccg

SEQ ID NO: 2912372 - RNA, 22 nt, Mycobacterium avium subsp. paratuberculosis
cgccugcggguucuggccgugg

SEQ ID NO: 2912373 - RNA, 22 nt, Mycobacterium avium subsp. paratuberculosis
cgccugcggugagcugaucgcg

SEQ ID NO: 2912374 - RNA, 15 nt, Mycobacterium avium subsp. paratuberculosis
cgccugcugccagga

SEQ ID NO: 2912375 - RNA, 23 nt, Mycobacterium avium subsp. paratuberculosis
cgccugcuggacguugggguggu

SEQ ID NO: 2912376 - RNA, 15 nt, Mycobacterium avium subsp. paratuberculosis
cgccugcuucuggau

SEQ ID NO: 2912377 - RNA, 18 nt, Mycobacterium avium subsp. paratuberculosis
cgccugcuucuggaugcg

SEQ ID NO: 2912378 - RNA, 20 nt, Mycobacterium avium subsp. paratuberculosis
cgccugcuucuggaugcggu

SEQ ID NO: 2912379 - RNA, 22 nt, Mycobacterium avium subsp. paratuberculosis
cgccugcuucuggaugcggucg

SEQ ID NO: 2912380 - RNA, 22 nt, Mycobacterium avium subsp. paratuberculosis
cgccugcuugagguugacgugc

SEQ ID NO: 2912381 - RNA, 19 nt, Mycobacterium avium subsp. paratuberculosis
cgccuggacgacgucgaug

SEQ ID NO: 2912382 - RNA, 15 nt, Mycobacterium avium subsp. paratuberculosis
cgccuggcagcugcc

SEQ ID NO: 2912383 - RNA, 22 nt, Mycobacterium avium subsp. paratuberculosis
cgccuggccaccucgacggcgu

SEQ ID NO: 2912384 - RNA, 17 nt, Mycobacterium avium subsp. paratuberculosis
cgccuggcgcagggcgu

SEQ ID NO: 2912385 - RNA, 20 nt, Mycobacterium avium subsp. paratuberculosis
cgccuggcggaaggccgcgc

SEQ ID NO: 2912386 - RNA, 18 nt, Mycobacterium avium subsp. paratuberculosis
cgccugggcguacagcgg

SEQ ID NO: 2912387 - RNA, 23 nt, Mycobacterium avium subsp. paratuberculosis
cgccugggcguacagcggcgcca

SEQ ID NO: 2912388 - RNA, 23 nt, Mycobacterium avium subsp. paratuberculosis
cgccugggucucgggaucgccga

SEQ ID NO: 2912389 - RNA, 20 nt, Mycobacterium avium subsp. paratuberculosis
cgccugguagggguccucca

SEQ ID NO: 2912390 - RNA, 18 nt, Mycobacterium avium subsp. paratuberculosis
cgccuggucaaggugcug

SEQ ID NO: 2912391 - RNA, 15 nt, Mycobacterium avium subsp. paratuberculosis
cgccugguccucccg

SEQ ID NO: 2912392 - RNA, 20 nt, Mycobacterium avium subsp. paratuberculosis
cgccugguccucccgggugg

SEQ ID NO: 2912393 - RNA, 15 nt, Mycobacterium avium subsp. paratuberculosis
cgccuguccgaccag

SEQ ID NO: 2912394 - RNA, 16 nt, Mycobacterium avium subsp. paratuberculosis
cgccuguccgaccagc

SEQ ID NO: 2912395 - RNA, 18 nt, Mycobacterium avium subsp. paratuberculosis
cgccugugcgacggcguc

SEQ ID NO: 2912396 - RNA, 19 nt, Mycobacterium avium subsp. paratuberculosis
cgccugugcgacggcgucg

SEQ ID NO: 2912397 - RNA, 20 nt, Mycobacterium avium subsp. paratuberculosis
cgccugugcgacggcgucgg

SEQ ID NO: 2912398 - RNA, 19 nt, Mycobacterium avium subsp. paratuberculosis
cgccuucacgaccggcagc

SEQ ID NO: 2912399 - RNA, 22 nt, Mycobacterium avium subsp. paratuberculosis
cgccuucacgaccggcagcacc

SEQ ID NO: 2912400 - RNA, 15 nt, Mycobacterium avium subsp. paratuberculosis
cgccuuccgccacgc

SEQ ID NO: 2912401 - RNA, 19 nt, Mycobacterium avium subsp. paratuberculosis
cgccuuccgccacgcccag

SEQ ID NO: 2912402 - RNA, 13 nt, Mycobacterium avium subsp. paratuberculosis
cgccuuccgggaa

SEQ ID NO: 2912403 - RNA, 13 nt, Mycobacterium avium subsp. paratuberculosis
cgccuucgacggc

SEQ ID NO: 2912404 - RNA, 18 nt, Mycobacterium avium subsp. paratuberculosis
cgccuucgacggccggcc

SEQ ID NO: 2912405 - RNA, 14 nt, Mycobacterium avium subsp. paratuberculosis
cgccuucgaugccc

SEQ ID NO: 2912406 - RNA, 14 nt, Mycobacterium avium subsp. paratuberculosis
cgccuucggcgcca

SEQ ID NO: 2912407 - RNA, 18 nt, Mycobacterium avium subsp. paratuberculosis
cgccuucggcgccagccc

SEQ ID NO: 2912408 - RNA, 20 nt, Mycobacterium avium subsp. paratuberculosis
cgccuucggcgccagcccgc

SEQ ID NO: 2912409 - RNA, 22 nt, Mycobacterium avium subsp. paratuberculosis
cgccuucggcgccagcccgccg

SEQ ID NO: 2912410 - RNA, 18 nt, Mycobacterium avium subsp. paratuberculosis
cgccuucuugcgcggcgc

SEQ ID NO: 2912411 - RNA, 23 nt, Mycobacterium avium subsp. paratuberculosis
cgccuucuuggccgcgcccuucu

SEQ ID NO: 2912412 - RNA, 17 nt, Mycobacterium avium subsp. paratuberculosis
cgccuucuuggcggcgg

SEQ ID NO: 2912413 - RNA, 17 nt, Mycobacterium avium subsp. paratuberculosis
cgccuugaaccggcugg

SEQ ID NO: 2912414 - RNA, 13 nt, Mycobacterium avium subsp. paratuberculosis
cgccuugaccgcc

SEQ ID NO: 2912415 - RNA, 13 nt, Mycobacterium avium subsp. paratuberculosis
cgccuugcacacg

SEQ ID NO: 2912416 - RNA, 19 nt, Mycobacterium avium subsp. paratuberculosis
cgccuugccgacgacgucg

SEQ ID NO: 2912417 - RNA, 18 nt, Mycobacterium avium subsp. paratuberculosis
cgccuugccgucgagcag

SEQ ID NO: 2912418 - RNA, 15 nt, Mycobacterium avium subsp. paratuberculosis
cgccuuggcgcgcuc

SEQ ID NO: 2912419 - RNA, 15 nt, Mycobacterium avium subsp. paratuberculosis
cgccuugggccaucc

SEQ ID NO: 2912420 - RNA, 17 nt, Mycobacterium avium subsp. paratuberculosis
cgccuuggugccguuga

SEQ ID NO: 2912421 - RNA, 22 nt, Mycobacterium avium subsp. paratuberculosis
cgccuuggugccguugaccacg

SEQ ID NO: 2912422 - RNA, 14 nt, Mycobacterium avium subsp. paratuberculosis
cgccuugucgaugg

SEQ ID NO: 2912423 - RNA, 19 nt, Mycobacterium avium subsp. paratuberculosis
cgccuuguuggcccacagc

SEQ ID NO: 2912424 - RNA, 16 nt, Mycobacterium avium subsp. paratuberculosis
cgccuuuugcacccgc

SEQ ID NO: 2912425 - RNA, 22 nt, Mycobacterium avium subsp. paratuberculosis
cgccuuuugcacccgccauggc

SEQ ID NO: 2912426 - RNA, 21 nt, Mycobacterium avium subsp. paratuberculosis
cgcgaaaaaacggcggcggaa

SEQ ID NO: 2912427 - RNA, 16 nt, Mycobacterium avium subsp. paratuberculosis
cgcgaaaaccagcacc

SEQ ID NO: 2912428 - RNA, 17 nt, Mycobacterium avium subsp. paratuberculosis
cgcgaaaauaccgccgg

SEQ ID NO: 2912429 - RNA, 17 nt, Mycobacterium avium subsp. paratuberculosis
cgcgacacgucgacacg

SEQ ID NO: 2912430 - RNA, 23 nt, Mycobacterium avium subsp. paratuberculosis
cgcgacacgucgacacgccggcc

SEQ ID NO: 2912431 - RNA, 14 nt, Mycobacterium avium subsp. paratuberculosis
cgcgacagccgccc

SEQ ID NO: 2912432 - RNA, 18 nt, Mycobacterium avium subsp. paratuberculosis
cgcgacagccgcccggcg

SEQ ID NO: 2912433 - RNA, 14 nt, Mycobacterium avium subsp. paratuberculosis
cgcgacaucaccgc

SEQ ID NO: 2912434 - RNA, 15 nt, Mycobacterium avium subsp. paratuberculosis
cgcgacaucaccgcg

SEQ ID NO: 2912435 - RNA, 16 nt, Mycobacterium avium subsp. paratuberculosis
cgcgacaucaccgcgg

SEQ ID NO: 2912436 - RNA, 19 nt, Mycobacterium avium subsp. paratuberculosis
cgcgacaucaccgcgggcg

SEQ ID NO: 2912437 - RNA, 12 nt, Mycobacterium avium subsp. paratuberculosis
cgcgacaucgcc

SEQ ID NO: 2912438 - RNA, 15 nt, Mycobacterium avium subsp. paratuberculosis
cgcgacaucgccggc

SEQ ID NO: 2912439 - RNA, 16 nt, Mycobacterium avium subsp. paratuberculosis
cgcgacaucgccggcg

SEQ ID NO: 2912440 - RNA, 17 nt, Mycobacterium avium subsp. paratuberculosis
cgcgacaucgccggcga

SEQ ID NO: 2912441 - RNA, 18 nt, Mycobacterium avium subsp. paratuberculosis
cgcgacaucgccggcgac

SEQ ID NO: 2912442 - RNA, 19 nt, Mycobacterium avium subsp. paratuberculosis
cgcgacaucgccggcgacc

SEQ ID NO: 2912443 - RNA, 20 nt, Mycobacterium avium subsp. paratuberculosis
cgcgacaucgccggcgaccg

SEQ ID NO: 2912444 - RNA, 13 nt, Mycobacterium avium subsp. paratuberculosis
cgcgacaucggcg

SEQ ID NO: 2912445 - RNA, 17 nt, Mycobacterium avium subsp. paratuberculosis
cgcgacaucggcgccga

SEQ ID NO: 2912446 - RNA, 16 nt, Mycobacterium avium subsp. paratuberculosis
cgcgacaucggugacc

SEQ ID NO: 2912447 - RNA, 19 nt, Mycobacterium avium subsp. paratuberculosis
cgcgacaucggugaccguc

SEQ ID NO: 2912448 - RNA, 22 nt, Mycobacterium avium subsp. paratuberculosis
cgcgacaucggugaccgucgcc

SEQ ID NO: 2912449 - RNA, 22 nt, Mycobacterium avium subsp. paratuberculosis
cgcgaccaaacgcagcgucuuc

SEQ ID NO: 2912450 - RNA, 12 nt, Mycobacterium avium subsp. paratuberculosis
cgcgaccacagc

SEQ ID NO: 2912451 - RNA, 18 nt, Mycobacterium avium subsp. paratuberculosis
cgcgaccacagcgccucg

SEQ ID NO: 2912452 - RNA, 15 nt, Mycobacterium avium subsp. paratuberculosis
cgcgaccacauaccg

SEQ ID NO: 2912453 - RNA, 16 nt, Mycobacterium avium subsp. paratuberculosis
cgcgaccacgccgcgg

SEQ ID NO: 2912454 - RNA, 19 nt, Mycobacterium avium subsp. paratuberculosis
cgcgaccacgccgcggucg

SEQ ID NO: 2912455 - RNA, 20 nt, Mycobacterium avium subsp. paratuberculosis
cgcgaccacgccgcggucgc

SEQ ID NO: 2912456 - RNA, 13 nt, Mycobacterium avium subsp. paratuberculosis
cgcgaccagcccg

SEQ ID NO: 2912457 - RNA, 14 nt, Mycobacterium avium subsp. paratuberculosis
cgcgaccagcccgg

SEQ ID NO: 2912458 - RNA, 18 nt, Mycobacterium avium subsp. paratuberculosis
cgcgaccagcccggccgc

SEQ ID NO: 2912459 - RNA, 15 nt, Mycobacterium avium subsp. paratuberculosis
cgcgaccagcggcag

SEQ ID NO: 2912460 - RNA, 19 nt, Mycobacterium avium subsp. paratuberculosis
cgcgaccagcggcagcagc

SEQ ID NO: 2912461 - RNA, 20 nt, Mycobacterium avium subsp. paratuberculosis
cgcgaccagcggcagcagca

SEQ ID NO: 2912462 - RNA, 16 nt, Mycobacterium avium subsp. paratuberculosis
cgcgaccagcucgggc

SEQ ID NO: 2912463 - RNA, 13 nt, Mycobacterium avium subsp. paratuberculosis
cgcgaccaggccc

SEQ ID NO: 2912464 - RNA, 14 nt, Mycobacterium avium subsp. paratuberculosis
cgcgaccaggccca

SEQ ID NO: 2912465 - RNA, 19 nt, Mycobacterium avium subsp. paratuberculosis
cgcgaccaggcccagcgga

SEQ ID NO: 2912466 - RNA, 14 nt, Mycobacterium avium subsp. paratuberculosis
cgcgaccagguucu

SEQ ID NO: 2912467 - RNA, 14 nt, Mycobacterium avium subsp. paratuberculosis
cgcgaccaguaccg

SEQ ID NO: 2912468 - RNA, 19 nt, Mycobacterium avium subsp. paratuberculosis
cgcgaccagugcaccucga

SEQ ID NO: 2912469 - RNA, 22 nt, Mycobacterium avium subsp. paratuberculosis
cgcgaccaucagcccggugacg

SEQ ID NO: 2912470 - RNA, 17 nt, Mycobacterium avium subsp. paratuberculosis
cgcgaccaugcccggcg

SEQ ID NO: 2912471 - RNA, 23 nt, Mycobacterium avium subsp. paratuberculosis
cgcgacccagacuugggcagcag

SEQ ID NO: 2912472 - RNA, 13 nt, Mycobacterium avium subsp. paratuberculosis
cgcgacccaggcc

SEQ ID NO: 2912473 - RNA, 22 nt, Mycobacterium avium subsp. paratuberculosis
cgcgaccccuacgggcgcaccg

SEQ ID NO: 2912474 - RNA, 21 nt, Mycobacterium avium subsp. paratuberculosis
cgcgaccccuccaacggccgc

SEQ ID NO: 2912475 - RNA, 22 nt, Mycobacterium avium subsp. paratuberculosis
cgcgaccccuccaacggccgca

SEQ ID NO: 2912476 - RNA, 12 nt, Mycobacterium avium subsp. paratuberculosis
cgcgacccggcc

SEQ ID NO: 2912477 - RNA, 15 nt, Mycobacterium avium subsp. paratuberculosis
cgcgacccggccgag

SEQ ID NO: 2912478 - RNA, 16 nt, Mycobacterium avium subsp. paratuberculosis
cgcgacccggccgagc

SEQ ID NO: 2912479 - RNA, 16 nt, Mycobacterium avium subsp. paratuberculosis
cgcgacccgggccgcc

SEQ ID NO: 2912480 - RNA, 18 nt, Mycobacterium avium subsp. paratuberculosis
cgcgacccgguccaccug

SEQ ID NO: 2912481 - RNA, 14 nt, Mycobacterium avium subsp. paratuberculosis
cgcgaccgaggucg

SEQ ID NO: 2912482 - RNA, 17 nt, Mycobacterium avium subsp. paratuberculosis
cgcgaccgaggucgacg

SEQ ID NO: 2912483 - RNA, 20 nt, Mycobacterium avium subsp. paratuberculosis
cgcgaccgaggucgacgccc

SEQ ID NO: 2912484 - RNA, 14 nt, Mycobacterium avium subsp. paratuberculosis
cgcgaccgcagcag

SEQ ID NO: 2912485 - RNA, 12 nt, Mycobacterium avium subsp. paratuberculosis
cgcgaccgccgg

SEQ ID NO: 2912486 - RNA, 13 nt, Mycobacterium avium subsp. paratuberculosis
cgcgaccgccucg

SEQ ID NO: 2912487 - RNA, 14 nt, Mycobacterium avium subsp. paratuberculosis
cgcgaccgccucgu

SEQ ID NO: 2912488 - RNA, 22 nt, Mycobacterium avium subsp. paratuberculosis
cgcgaccgcgaucagggccgcg

SEQ ID NO: 2912489 - RNA, 14 nt, Mycobacterium avium subsp. paratuberculosis
cgcgaccgcgaugc

SEQ ID NO: 2912490 - RNA, 14 nt, Mycobacterium avium subsp. paratuberculosis
cgcgaccgcgcggc

SEQ ID NO: 2912491 - RNA, 18 nt, Mycobacterium avium subsp. paratuberculosis
cgcgaccgcgcggcgagu

SEQ ID NO: 2912492 - RNA, 13 nt, Mycobacterium avium subsp. paratuberculosis
cgcgaccgcgucg

SEQ ID NO: 2912493 - RNA, 19 nt, Mycobacterium avium subsp. paratuberculosis
cgcgaccgcgucgacggcg

SEQ ID NO: 2912494 - RNA, 15 nt, Mycobacterium avium subsp. paratuberculosis
cgcgaccggccaucu

SEQ ID NO: 2912495 - RNA, 13 nt, Mycobacterium avium subsp. paratuberculosis
cgcgaccgucagc

SEQ ID NO: 2912496 - RNA, 15 nt, Mycobacterium avium subsp. paratuberculosis
cgcgaccgucagcag

SEQ ID NO: 2912497 - RNA, 22 nt, Mycobacterium avium subsp. paratuberculosis
cgcgaccgucagcagggccucg

SEQ ID NO: 2912498 - RNA, 16 nt, Mycobacterium avium subsp. paratuberculosis
cgcgaccgucgggacg

SEQ ID NO: 2912499 - RNA, 23 nt, Mycobacterium avium subsp. paratuberculosis
cgcgaccgucgggacggccagca

SEQ ID NO: 2912500 - RNA, 19 nt, Mycobacterium avium subsp. paratuberculosis
cgcgaccugcaucucgacc

SEQ ID NO: 2912501 - RNA, 22 nt, Mycobacterium avium subsp. paratuberculosis
cgcgaccugcaucucgacccgg

SEQ ID NO: 2912502 - RNA, 23 nt, Mycobacterium avium subsp. paratuberculosis
cgcgaccugcaucucgacccggg

SEQ ID NO: 2912503 - RNA, 19 nt, Mycobacterium avium subsp. paratuberculosis
cgcgaccugcuuggcggcc

SEQ ID NO: 2912504 - RNA, 20 nt, Mycobacterium avium subsp. paratuberculosis
cgcgaccugcuuggcggccu

SEQ ID NO: 2912505 - RNA, 20 nt, Mycobacterium avium subsp. paratuberculosis
cgcgacgaacagcaccgcca

SEQ ID NO: 2912506 - RNA, 23 nt, Mycobacterium avium subsp. paratuberculosis
cgcgacgaacagcaccgccacgg

SEQ ID NO: 2912507 - RNA, 16 nt, Mycobacterium avium subsp. paratuberculosis
cgcgacgaagccggug

SEQ ID NO: 2912508 - RNA, 18 nt, Mycobacterium avium subsp. paratuberculosis
cgcgacgaagccggugcc

SEQ ID NO: 2912509 - RNA, 21 nt, Mycobacterium avium subsp. paratuberculosis
cgcgacgaagcggucgcggaa

SEQ ID NO: 2912510 - RNA, 16 nt, Mycobacterium avium subsp. paratuberculosis
cgcgacgaauccggug

SEQ ID NO: 2912511 - RNA, 13 nt, Mycobacterium avium subsp. paratuberculosis
cgcgacgacacca

SEQ ID NO: 2912512 - RNA, 19 nt, Mycobacterium avium subsp. paratuberculosis
cgcgacgacaccaccgugc

SEQ ID NO: 2912513 - RNA, 20 nt, Mycobacterium avium subsp. paratuberculosis
cgcgacgacaccaccgugcu

SEQ ID NO: 2912514 - RNA, 13 nt, Mycobacterium avium subsp. paratuberculosis
cgcgacggucacg

SEQ ID NO: 2912515 - RNA, 19 nt, Mycobacterium avium subsp. paratuberculosis
cgcgacggucacgcuggcg

SEQ ID NO: 2912516 - RNA, 20 nt, Mycobacterium avium subsp. paratuberculosis
cgcgacggucacgcuggcgu

SEQ ID NO: 2912517 - RNA, 19 nt, Mycobacterium avium subsp. paratuberculosis
cgcgacggucaguccgggu

SEQ ID NO: 2912518 - RNA, 21 nt, Mycobacterium avium subsp. paratuberculosis
cgcgacggucaguccggguug

SEQ ID NO: 2912519 - RNA, 14 nt, Mycobacterium avium subsp. paratuberculosis
cgcgacggucgugc

SEQ ID NO: 2912520 - RNA, 17 nt, Mycobacterium avium subsp. paratuberculosis
cgcgacgguggacccga

SEQ ID NO: 2912521 - RNA, 21 nt, Mycobacterium avium subsp. paratuberculosis
cgcgacgguguaggacgccgu

SEQ ID NO: 2912522 - RNA, 23 nt, Mycobacterium avium subsp. paratuberculosis
cgcgacgguguaggacgccgugc

SEQ ID NO: 2912523 - RNA, 20 nt, Mycobacterium avium subsp. paratuberculosis
cgcgacgguuuccggcuuca

SEQ ID NO: 2912524 - RNA, 14 nt, Mycobacterium avium subsp. paratuberculosis
cgcgacguccaucg

SEQ ID NO: 2912525 - RNA, 20 nt, Mycobacterium avium subsp. paratuberculosis
cgcgacguccaucgggaccg

SEQ ID NO: 2912526 - RNA, 14 nt, Mycobacterium avium subsp. paratuberculosis
cgcgacgucgaccg

SEQ ID NO: 2912527 - RNA, 19 nt, Mycobacterium avium subsp. paratuberculosis
cgcgacgucgaccgcgacg

SEQ ID NO: 2912528 - RNA, 20 nt, Mycobacterium avium subsp. paratuberculosis
cgcgacgucgaccgcgacga

SEQ ID NO: 2912529 - RNA, 13 nt, Mycobacterium avium subsp. paratuberculosis
cgcgacgucggug

SEQ ID NO: 2912530 - RNA, 15 nt, Mycobacterium avium subsp. paratuberculosis
cgcgacgugccggcg

SEQ ID NO: 2912531 - RNA, 17 nt, Mycobacterium avium subsp. paratuberculosis
cgcgacgugccggcgau

SEQ ID NO: 2912532 - RNA, 14 nt, Mycobacterium avium subsp. paratuberculosis
cgcgacucgguguc

SEQ ID NO: 2912533 - RNA, 17 nt, Mycobacterium avium subsp. paratuberculosis
cgcgacucugcacucag

SEQ ID NO: 2912534 - RNA, 16 nt, Mycobacterium avium subsp. paratuberculosis
cgcgacugggcgccca

SEQ ID NO: 2912535 - RNA, 18 nt, Mycobacterium avium subsp. paratuberculosis
cgcgacugggcgcccacc

SEQ ID NO: 2912536 - RNA, 19 nt, Mycobacterium avium subsp. paratuberculosis
cgcgacugggcgcccaccc

SEQ ID NO: 2912537 - RNA, 21 nt, Mycobacterium avium subsp. paratuberculosis
cgcgacugggcgcccacccgu

SEQ ID NO: 2912538 - RNA, 15 nt, Mycobacterium avium subsp. paratuberculosis
cgcgacugggugcuc

SEQ ID NO: 2912539 - RNA, 21 nt, Mycobacterium avium subsp. paratuberculosis
cgcgacugggugcucccgcca

SEQ ID NO: 2912540 - RNA, 13 nt, Mycobacterium avium subsp. paratuberculosis
cgcgacugucggc

SEQ ID NO: 2912541 - RNA, 14 nt, Mycobacterium avium subsp. paratuberculosis
cgcgacugucggcg

SEQ ID NO: 2912542 - RNA, 18 nt, Mycobacterium avium subsp. paratuberculosis
cgcgacugucggcgcccc

SEQ ID NO: 2912543 - RNA, 16 nt, Mycobacterium avium subsp. paratuberculosis
cgcgacugucggcucg

SEQ ID NO: 2912544 - RNA, 14 nt, Mycobacterium avium subsp. paratuberculosis
cgcgagaagcgcgc

SEQ ID NO: 2912545 - RNA, 12 nt, Mycobacterium avium subsp. paratuberculosis
cgcgagacccgg

SEQ ID NO: 2912546 - RNA, 17 nt, Mycobacterium avium subsp. paratuberculosis
cgcgagacgagccgccg

SEQ ID NO: 2912547 - RNA, 20 nt, Mycobacterium avium subsp. paratuberculosis
cgcgagacgagccgccgcgg

SEQ ID NO: 2912548 - RNA, 22 nt, Mycobacterium avium subsp. paratuberculosis
cgcgagaguaucgccacgccga

SEQ ID NO: 2912549 - RNA, 23 nt, Mycobacterium avium subsp. paratuberculosis
cgcgagaguaucgccacgccgac

SEQ ID NO: 2912550 - RNA, 20 nt, Mycobacterium avium subsp. paratuberculosis
cgcgagagugcaacuaccga

SEQ ID NO: 2912551 - RNA, 20 nt, Mycobacterium avium subsp. paratuberculosis
cgcgagagugcaacuagcga

SEQ ID NO: 2912552 - RNA, 16 nt, Mycobacterium avium subsp. paratuberculosis
cgcgagaucagcgcca

SEQ ID NO: 2912553 - RNA, 18 nt, Mycobacterium avium subsp. paratuberculosis
cgcgagaucagcgccaug

SEQ ID NO: 2912554 - RNA, 13 nt, Mycobacterium avium subsp. paratuberculosis
cgcgagauggcga

SEQ ID NO: 2912555 - RNA, 18 nt, Mycobacterium avium subsp. paratuberculosis
cgcgagauggcgaucaga

SEQ ID NO: 2912556 - RNA, 18 nt, Mycobacterium avium subsp. paratuberculosis
cgcgagcaccgcgaucgc

SEQ ID NO: 2912557 - RNA, 23 nt, Mycobacterium avium subsp. paratuberculosis
cgcgagcaccgcgaucgccgacg

SEQ ID NO: 2912558 - RNA, 19 nt, Mycobacterium avium subsp. paratuberculosis
cgcgagcagacacaaaagc

SEQ ID NO: 2912559 - RNA, 19 nt, Mycobacterium avium subsp. paratuberculosis
cgcgagcagcucgacaucg

SEQ ID NO: 2912560 - RNA, 17 nt, Mycobacterium avium subsp. paratuberculosis
cgcgagcagggcgggca

SEQ ID NO: 2912561 - RNA, 23 nt, Mycobacterium avium subsp. paratuberculosis
cgcgagcagggcgggcaggcccg

SEQ ID NO: 2912562 - RNA, 17 nt, Mycobacterium avium subsp. paratuberculosis
cgcgagcaucaccguca

SEQ ID NO: 2912563 - RNA, 13 nt, Mycobacterium avium subsp. paratuberculosis
cgcgagcccgcaa

SEQ ID NO: 2912564 - RNA, 13 nt, Mycobacterium avium subsp. paratuberculosis
cgcgagcccggcg

SEQ ID NO: 2912565 - RNA, 14 nt, Mycobacterium avium subsp. paratuberculosis
cgcgagcccggcga

SEQ ID NO: 2912566 - RNA, 15 nt, Mycobacterium avium subsp. paratuberculosis
cgcgagcccggcgac

SEQ ID NO: 2912567 - RNA, 23 nt, Mycobacterium avium subsp. paratuberculosis
cgcgagcccggcgacgucgucga

SEQ ID NO: 2912568 - RNA, 16 nt, Mycobacterium avium subsp. paratuberculosis
cgcgagccgagccggu

SEQ ID NO: 2912569 - RNA, 17 nt, Mycobacterium avium subsp. paratuberculosis
cgcgagccgagccgguc

SEQ ID NO: 2912570 - RNA, 19 nt, Mycobacterium avium subsp. paratuberculosis
cgcgagccgagccgguccg

SEQ ID NO: 2912571 - RNA, 23 nt, Mycobacterium avium subsp. paratuberculosis
cgcgagccgagccgguccgacca

SEQ ID NO: 2912572 - RNA, 12 nt, Mycobacterium avium subsp. paratuberculosis
cgcgagccgccc

SEQ ID NO: 2912573 - RNA, 13 nt, Mycobacterium avium subsp. paratuberculosis
cgcgagccgccca

SEQ ID NO: 2912574 - RNA, 18 nt, Mycobacterium avium subsp. paratuberculosis
cgcgagccgcccaggcgg

SEQ ID NO: 2912575 - RNA, 22 nt, Mycobacterium avium subsp. paratuberculosis
cgcgagccgcccaggcgggcca

SEQ ID NO: 2912576 - RNA, 15 nt, Mycobacterium avium subsp. paratuberculosis
cgcgagcgcagcgcc

SEQ ID NO: 2912577 - RNA, 13 nt, Mycobacterium avium subsp. paratuberculosis
cgcgagcgcgcgg

SEQ ID NO: 2912578 - RNA, 15 nt, Mycobacterium avium subsp. paratuberculosis
cgcgagcgcgcggug

SEQ ID NO: 2912579 - RNA, 13 nt, Mycobacterium avium subsp. paratuberculosis
cgcgagcgcgcug

SEQ ID NO: 2912580 - RNA, 17 nt, Mycobacterium avium subsp. paratuberculosis
cgcgagcgcuaccgcgc

SEQ ID NO: 2912581 - RNA, 18 nt, Mycobacterium avium subsp. paratuberculosis
cgcgagcggacgggccua

SEQ ID NO: 2912582 - RNA, 23 nt, Mycobacterium avium subsp. paratuberculosis
cgcgagcugccccuucgcgacac

SEQ ID NO: 2912583 - RNA, 22 nt, Mycobacterium avium subsp. paratuberculosis
cgccggaucgugucccggcgcc

SEQ ID NO: 2912584 - RNA, 21 nt, Mycobacterium avium subsp. paratuberculosis
cgccggaugccagcagguccg

SEQ ID NO: 2912585 - RNA, 13 nt, Mycobacterium avium subsp. paratuberculosis
cgccggaugcggc

SEQ ID NO: 2912586 - RNA, 13 nt, Mycobacterium avium subsp. paratuberculosis
cgccggaugcugc

SEQ ID NO: 2912587 - RNA, 22 nt, Mycobacterium avium subsp. paratuberculosis
cgccggaugggcgcacgaucgg

SEQ ID NO: 2912588 - RNA, 21 nt, Mycobacterium avium subsp. paratuberculosis
cgccggaugguccgcaugucg

SEQ ID NO: 2912589 - RNA, 17 nt, Mycobacterium avium subsp. paratuberculosis
cgccggauuacucgccg

SEQ ID NO: 2912590 - RNA, 18 nt, Mycobacterium avium subsp. paratuberculosis
cgccggauuacucgccgg

SEQ ID NO: 2912591 - RNA, 19 nt, Mycobacterium avium subsp. paratuberculosis
cgccggauuacucgccggc

SEQ ID NO: 2912592 - RNA, 20 nt, Mycobacterium avium subsp. paratuberculosis
cgccggauuacucgccggcg

SEQ ID NO: 2912593 - RNA, 22 nt, Mycobacterium avium subsp. paratuberculosis
cgccggauuacucgccggcggc

SEQ ID NO: 2912594 - RNA, 21 nt, Mycobacterium avium subsp. paratuberculosis
cgccggauucggcgcggcuca

SEQ ID NO: 2912595 - RNA, 17 nt, Mycobacterium avium subsp. paratuberculosis
cgccggauuggcgucgg

SEQ ID NO: 2912596 - RNA, 18 nt, Mycobacterium avium subsp. paratuberculosis
cgccggauuggcgucggu

SEQ ID NO: 2912597 - RNA, 19 nt, Mycobacterium avium subsp. paratuberculosis
cgccggauuggcgucggug

SEQ ID NO: 2912598 - RNA, 16 nt, Mycobacterium avium subsp. paratuberculosis
cgccggauugucgcug

SEQ ID NO: 2912599 - RNA, 20 nt, Mycobacterium avium subsp. paratuberculosis
cgccggcaacaacgccagcg

SEQ ID NO: 2912600 - RNA, 14 nt, Mycobacterium avium subsp. paratuberculosis
cgccgcccccgcgg

SEQ ID NO: 2912601 - RNA, 15 nt, Mycobacterium avium subsp. paratuberculosis
cgccgcccccgcggc

SEQ ID NO: 2912602 - RNA, 18 nt, Mycobacterium avium subsp. paratuberculosis
cgccgccccgucggucgg

SEQ ID NO: 2912603 - RNA, 20 nt, Mycobacterium avium subsp. paratuberculosis
cgccgcccgcccgagcguca

SEQ ID NO: 2912604 - RNA, 16 nt, Mycobacterium avium subsp. paratuberculosis
cgccgcccgcgcggcg

SEQ ID NO: 2912605 - RNA, 13 nt, Mycobacterium avium subsp. paratuberculosis
cgccgcccgggcc

SEQ ID NO: 2912606 - RNA, 14 nt, Mycobacterium avium subsp. paratuberculosis
cgccgcccgggccc

SEQ ID NO: 2912607 - RNA, 15 nt, Mycobacterium avium subsp. paratuberculosis
cgccgcccgggcccg

SEQ ID NO: 2912608 - RNA, 15 nt, Mycobacterium avium subsp. paratuberculosis
cgccgcccgggccgc

SEQ ID NO: 2912609 - RNA, 18 nt, Mycobacterium avium subsp. paratuberculosis
cgccgcccgggccgcgcc

SEQ ID NO: 2912610 - RNA, 20 nt, Mycobacterium avium subsp. paratuberculosis
cgccgcccgggccgcgccca

SEQ ID NO: 2912611 - RNA, 14 nt, Mycobacterium avium subsp. paratuberculosis
cgccgcccgggcgg

SEQ ID NO: 2912612 - RNA, 13 nt, Mycobacterium avium subsp. paratuberculosis
cgccgcccgucca

SEQ ID NO: 2912613 - RNA, 17 nt, Mycobacterium avium subsp. paratuberculosis
cgccgcccguccagcgc

SEQ ID NO: 2912614 - RNA, 14 nt, Mycobacterium avium subsp. paratuberculosis
cgccgcccucgccc

SEQ ID NO: 2912615 - RNA, 17 nt, Mycobacterium avium subsp. paratuberculosis
cgccgcccucgcccucg

SEQ ID NO: 2912616 - RNA, 16 nt, Mycobacterium avium subsp. paratuberculosis
cgccgcccucgccgaa

SEQ ID NO: 2912617 - RNA, 17 nt, Mycobacterium avium subsp. paratuberculosis
cgccgcccucggugacg

SEQ ID NO: 2912618 - RNA, 21 nt, Mycobacterium avium subsp. paratuberculosis
cgccgcccucggugacgaacu

SEQ ID NO: 2912619 - RNA, 23 nt, Mycobacterium avium subsp. paratuberculosis
cgccgcccucggugacgaacuca

SEQ ID NO: 2912620 - RNA, 21 nt, Mycobacterium avium subsp. paratuberculosis
cgccgcccucucacggcggua

SEQ ID NO: 2912621 - RNA, 16 nt, Mycobacterium avium subsp. paratuberculosis
cgccgcccugcgggaa

SEQ ID NO: 2912622 - RNA, 22 nt, Mycobacterium avium subsp. paratuberculosis
cgccgcccugcgggaacagcgg

SEQ ID NO: 2912623 - RNA, 18 nt, Mycobacterium avium subsp. paratuberculosis
cgccgccgaacagccggg

SEQ ID NO: 2912624 - RNA, 17 nt, Mycobacterium avium subsp. paratuberculosis
cgccgccgaaccccagc

SEQ ID NO: 2912625 - RNA, 21 nt, Mycobacterium avium subsp. paratuberculosis
cgccgccgaaccccagcuccg

SEQ ID NO: 2912626 - RNA, 13 nt, Mycobacterium avium subsp. paratuberculosis
cgccgccgacagc

SEQ ID NO: 2912627 - RNA, 16 nt, Mycobacterium avium subsp. paratuberculosis
cgccgccgacagcacc

SEQ ID NO: 2912628 - RNA, 17 nt, Mycobacterium avium subsp. paratuberculosis
cgccgccgaccacgccg

SEQ ID NO: 2912629 - RNA, 21 nt, Mycobacterium avium subsp. paratuberculosis
cgccgccgaccacgccgcgcu

SEQ ID NO: 2912630 - RNA, 17 nt, Mycobacterium avium subsp. paratuberculosis
cgccgccgaccgcccgc

SEQ ID NO: 2912631 - RNA, 18 nt, Mycobacterium avium subsp. paratuberculosis
cgccgccgaccgcccgcu

SEQ ID NO: 2912632 - RNA, 16 nt, Mycobacterium avium subsp. paratuberculosis
cgccgccgacuccccg

SEQ ID NO: 2912633 - RNA, 22 nt, Mycobacterium avium subsp. paratuberculosis
cgccgccgagcaacagcccgac

SEQ ID NO: 2912634 - RNA, 15 nt, Mycobacterium avium subsp. paratuberculosis
cgccgccgagccgcg

SEQ ID NO: 2912635 - RNA, 16 nt, Mycobacterium avium subsp. paratuberculosis
cgccgccgagccgcgg

SEQ ID NO: 2912636 - RNA, 18 nt, Mycobacterium avium subsp. paratuberculosis
cgccgccgagccgcgggu

SEQ ID NO: 2912637 - RNA, 17 nt, Mycobacterium avium subsp. paratuberculosis
cgccgccgagcucggcc

SEQ ID NO: 2912638 - RNA, 23 nt, Mycobacterium avium subsp. paratuberculosis
cgccgccgagcucggccaccagc

SEQ ID NO: 2912639 - RNA, 24 nt, Mycobacterium avium subsp. paratuberculosis
cgccgccgaucuugagccggaugc

SEQ ID NO: 2912640 - RNA, 22 nt, Mycobacterium avium subsp. paratuberculosis
cgccgccgaugcugauccgcag

SEQ ID NO: 2912641 - RNA, 23 nt, Mycobacterium avium subsp. paratuberculosis
cgccgccgaugcugauccgcagg

SEQ ID NO: 2912642 - RNA, 14 nt, Mycobacterium avium subsp. paratuberculosis
cgccgccgcaccgg

SEQ ID NO: 2912643 - RNA, 16 nt, Mycobacterium avium subsp. paratuberculosis
cgccgccgcaccggcc

SEQ ID NO: 2912644 - RNA, 19 nt, Mycobacterium avium subsp. paratuberculosis
cgccgccgcaccggccggc

SEQ ID NO: 2912645 - RNA, 13 nt, Mycobacterium avium subsp. paratuberculosis
cgccgccgccagc

SEQ ID NO: 2912646 - RNA, 14 nt, Mycobacterium avium subsp. paratuberculosis
cgccgccgccagca

SEQ ID NO: 2912647 - RNA, 15 nt, Mycobacterium avium subsp. paratuberculosis
cgccgccgccagcac

SEQ ID NO: 2912648 - RNA, 16 nt, Mycobacterium avium subsp. paratuberculosis
cgccgccgccagcacc

SEQ ID NO: 2912649 - RNA, 14 nt, Mycobacterium avium subsp. paratuberculosis
cgccgccgccagcc

SEQ ID NO: 2912650 - RNA, 12 nt, Mycobacterium avium subsp. paratuberculosis
cgccgccgccga

SEQ ID NO: 2912651 - RNA, 14 nt, Mycobacterium avium subsp. paratuberculosis
cgccgccgccgccc

SEQ ID NO: 2912652 - RNA, 15 nt, Mycobacterium avium subsp. paratuberculosis
cgccgccgccgccca

SEQ ID NO: 2912653 - RNA, 16 nt, Mycobacterium avium subsp. paratuberculosis
cgccgccgcgaccaca

SEQ ID NO: 2912654 - RNA, 14 nt, Mycobacterium avium subsp. paratuberculosis
cgccgccgcgcacc

SEQ ID NO: 2912655 - RNA, 15 nt, Mycobacterium avium subsp. paratuberculosis
cgccgccgcgcaccg

SEQ ID NO: 2912656 - RNA, 12 nt, Mycobacterium avium subsp. paratuberculosis
cgccgccgcggc

SEQ ID NO: 2912657 - RNA, 13 nt, Mycobacterium avium subsp. paratuberculosis
cgccgccgcggcc

SEQ ID NO: 2912658 - RNA, 15 nt, Mycobacterium avium subsp. paratuberculosis
cgccgccgcggccgc

SEQ ID NO: 2912659 - RNA, 17 nt, Mycobacterium avium subsp. paratuberculosis
cgccgccgcggccgcgg

SEQ ID NO: 2912660 - RNA, 19 nt, Mycobacterium avium subsp. paratuberculosis
cgccgccgcggccgcggcg

SEQ ID NO: 2912661 - RNA, 22 nt, Mycobacterium avium subsp. paratuberculosis
cgcccucaggcguccagcaccu

SEQ ID NO: 2912662 - RNA, 20 nt, Mycobacterium avium subsp. paratuberculosis
cgcccuccccggccagcacg

SEQ ID NO: 2912663 - RNA, 16 nt, Mycobacterium avium subsp. paratuberculosis
cgcccuccuggcgggu

SEQ ID NO: 2912664 - RNA, 18 nt, Mycobacterium avium subsp. paratuberculosis
cgcccuccuggcgggugg

SEQ ID NO: 2912665 - RNA, 23 nt, Mycobacterium avium subsp. paratuberculosis
cgcccucgauaauggcggccgcc

SEQ ID NO: 2912666 - RNA, 21 nt, Mycobacterium avium subsp. paratuberculosis
cgcccucgaucgcgaccaccg

SEQ ID NO: 2912667 - RNA, 17 nt, Mycobacterium avium subsp. paratuberculosis
cgcccucgcccucgcug

SEQ ID NO: 2912668 - RNA, 13 nt, Mycobacterium avium subsp. paratuberculosis
cgcccucgccgac

SEQ ID NO: 2912669 - RNA, 20 nt, Mycobacterium avium subsp. paratuberculosis
cgcccucgccggcggcgccc

SEQ ID NO: 2912670 - RNA, 20 nt, Mycobacterium avium subsp. paratuberculosis
cgcccucgcgcagggccagc

SEQ ID NO: 2912671 - RNA, 15 nt, Mycobacterium avium subsp. paratuberculosis
cgcccucgcugccgc

SEQ ID NO: 2912672 - RNA, 16 nt, Mycobacterium avium subsp. paratuberculosis
cgcccucgcugccgcc

SEQ ID NO: 2912673 - RNA, 20 nt, Mycobacterium avium subsp. paratuberculosis
cgcccucgcugccgcccccg

SEQ ID NO: 2912674 - RNA, 12 nt, Mycobacterium avium subsp. paratuberculosis
cgcccucggccg

SEQ ID NO: 2912675 - RNA, 15 nt, Mycobacterium avium subsp. paratuberculosis
cgcccucggccguac

SEQ ID NO: 2912676 - RNA, 19 nt, Mycobacterium avium subsp. paratuberculosis
cgcccucggccguaccggc

SEQ ID NO: 2912677 - RNA, 21 nt, Mycobacterium avium subsp. paratuberculosis
cgcccucggccguaccggcgu

SEQ ID NO: 2912678 - RNA, 22 nt, Mycobacterium avium subsp. paratuberculosis
cgcccucggccguaccggcgua

SEQ ID NO: 2912679 - RNA, 13 nt, Mycobacterium avium subsp. paratuberculosis
cgcccucggcgau

SEQ ID NO: 2912680 - RNA, 21 nt, Mycobacterium avium subsp. paratuberculosis
cgcccucggcuuccgagccgg

SEQ ID NO: 2912681 - RNA, 22 nt, Mycobacterium avium subsp. paratuberculosis
cgcccucgggguacucggcggc

SEQ ID NO: 2912682 - RNA, 21 nt, Mycobacterium avium subsp. paratuberculosis
cgcccucgguguucgggucgg

SEQ ID NO: 2912683 - RNA, 21 nt, Mycobacterium avium subsp. paratuberculosis
cgcccucgucuuccgcggcgg

SEQ ID NO: 2912684 - RNA, 18 nt, Mycobacterium avium subsp. paratuberculosis
cgcccucucacggcggua

SEQ ID NO: 2912685 - RNA, 15 nt, Mycobacterium avium subsp. paratuberculosis
cgcccugacacagca

SEQ ID NO: 2912686 - RNA, 18 nt, Mycobacterium avium subsp. paratuberculosis
cgcccugacacagcaccg

SEQ ID NO: 2912687 - RNA, 21 nt, Mycobacterium avium subsp. paratuberculosis
cgcccugacacagcaccggcg

SEQ ID NO: 2912688 - RNA, 19 nt, Mycobacterium avium subsp. paratuberculosis
cgcccugcacccagccgug

SEQ ID NO: 2912689 - RNA, 22 nt, Mycobacterium avium subsp. paratuberculosis
cgcccugcacccagccgugccc

SEQ ID NO: 2912690 - RNA, 15 nt, Mycobacterium avium subsp. paratuberculosis
cgcccugcagccggg

SEQ ID NO: 2912691 - RNA, 14 nt, Mycobacterium avium subsp. paratuberculosis
cgcccugccacagc

SEQ ID NO: 2912692 - RNA, 15 nt, Mycobacterium avium subsp. paratuberculosis
cgcccugccacagcg

SEQ ID NO: 2912693 - RNA, 18 nt, Mycobacterium avium subsp. paratuberculosis
cgcccugccacagcgaca

SEQ ID NO: 2912694 - RNA, 14 nt, Mycobacterium avium subsp. paratuberculosis
cgcccugcccgucg

SEQ ID NO: 2912695 - RNA, 18 nt, Mycobacterium avium subsp. paratuberculosis
cgcccugcccgucgggcg

SEQ ID NO: 2912696 - RNA, 20 nt, Mycobacterium avium subsp. paratuberculosis
cgcccugcccgucgggcgcg

SEQ ID NO: 2912697 - RNA, 21 nt, Mycobacterium avium subsp. paratuberculosis
cgcccugcccgucgggcgcgg

SEQ ID NO: 2912698 - RNA, 22 nt, Mycobacterium avium subsp. paratuberculosis
cgcccugcgaauacccgcccag

SEQ ID NO: 2912699 - RNA, 23 nt, Mycobacterium avium subsp. paratuberculosis
cgcccugcgaauacccgcccagc

SEQ ID NO: 2912700 - RNA, 14 nt, Mycobacterium avium subsp. paratuberculosis
cgcccugcgagccc

SEQ ID NO: 2912701 - RNA, 16 nt, Mycobacterium avium subsp. paratuberculosis
cgcccugcgagcccgg

SEQ ID NO: 2912702 - RNA, 18 nt, Mycobacterium avium subsp. paratuberculosis
cgcccugcgcgcccugcu

SEQ ID NO: 2912703 - RNA, 19 nt, Mycobacterium avium subsp. paratuberculosis
cgcccugcgggaacagcgg

SEQ ID NO: 2912704 - RNA, 19 nt, Mycobacterium avium subsp. paratuberculosis
cgcccugcugggagcggcc

SEQ ID NO: 2912705 - RNA, 21 nt, Mycobacterium avium subsp. paratuberculosis
cgcccugcugggagcggccca

SEQ ID NO: 2912706 - RNA, 23 nt, Mycobacterium avium subsp. paratuberculosis
cgcccugcugggagcggcccaac

SEQ ID NO: 2912707 - RNA, 20 nt, Mycobacterium avium subsp. paratuberculosis
cgcccugcuugaacagcacc

SEQ ID NO: 2912708 - RNA, 18 nt, Mycobacterium avium subsp. paratuberculosis
cgcccuggaaggcgauca

SEQ ID NO: 2912709 - RNA, 14 nt, Mycobacterium avium subsp. paratuberculosis
cgcccuggcauccg

SEQ ID NO: 2912710 - RNA, 17 nt, Mycobacterium avium subsp. paratuberculosis
cgcccuggcauccgucg

SEQ ID NO: 2912711 - RNA, 18 nt, Mycobacterium avium subsp. paratuberculosis
cgcccuggcauccgucgg

SEQ ID NO: 2912712 - RNA, 16 nt, Mycobacterium avium subsp. paratuberculosis
cgcccuggccgccggc

SEQ ID NO: 2912713 - RNA, 18 nt, Mycobacterium avium subsp. paratuberculosis
cgcccuggccgccggccg

SEQ ID NO: 2912714 - RNA, 21 nt, Mycobacterium avium subsp. paratuberculosis
cgcccuggccgccggccgcgc

SEQ ID NO: 2912715 - RNA, 22 nt, Mycobacterium avium subsp. paratuberculosis
cgcccuggccgccggccgcgca

SEQ ID NO: 2912716 - RNA, 20 nt, Mycobacterium avium subsp. paratuberculosis
cgcccugggggucggugacc

SEQ ID NO: 2912717 - RNA, 21 nt, Mycobacterium avium subsp. paratuberculosis
cgcccugguaggccuggaacc

SEQ ID NO: 2912718 - RNA, 15 nt, Mycobacterium avium subsp. paratuberculosis
cgcccugguugaucc

SEQ ID NO: 2912719 - RNA, 18 nt, Mycobacterium avium subsp. paratuberculosis
cgcccugguugauccagc

SEQ ID NO: 2912720 - RNA, 19 nt, Mycobacterium avium subsp. paratuberculosis
cgcccugguugauccagcg

SEQ ID NO: 2912721 - RNA, 15 nt, Mycobacterium avium subsp. paratuberculosis
cgcccuuccagcacc

SEQ ID NO: 2912722 - RNA, 17 nt, Mycobacterium avium subsp. paratuberculosis
cgcccuucccggucggc

SEQ ID NO: 2912723 - RNA, 13 nt, Mycobacterium avium subsp. paratuberculosis
cgcccuucggcgc

SEQ ID NO: 2912724 - RNA, 18 nt, Mycobacterium avium subsp. paratuberculosis
cgcccuucggcgcccgcu

SEQ ID NO: 2912725 - RNA, 17 nt, Mycobacterium avium subsp. paratuberculosis
cgcccuugaacggcacc

SEQ ID NO: 2912726 - RNA, 14 nt, Mycobacterium avium subsp. paratuberculosis
cgcccuugagcacg

SEQ ID NO: 2912727 - RNA, 17 nt, Mycobacterium avium subsp. paratuberculosis
cgcccuugagcucggcc

SEQ ID NO: 2912728 - RNA, 19 nt, Mycobacterium avium subsp. paratuberculosis
cgcccuugagcuucccggc

SEQ ID NO: 2912729 - RNA, 21 nt, Mycobacterium avium subsp. paratuberculosis
cgcccuugagcuucccggcgg

SEQ ID NO: 2912730 - RNA, 14 nt, Mycobacterium avium subsp. paratuberculosis
cgcccuugccgaug

SEQ ID NO: 2912731 - RNA, 18 nt, Mycobacterium avium subsp. paratuberculosis
cgcccuugcucgcggcgu

SEQ ID NO: 2912732 - RNA, 15 nt, Mycobacterium avium subsp. paratuberculosis
cgcccuuggccgcgg

SEQ ID NO: 2912733 - RNA, 15 nt, Mycobacterium avium subsp. paratuberculosis
cgcccuuggccuccg

SEQ ID NO: 2912734 - RNA, 19 nt, Mycobacterium avium subsp. paratuberculosis
cgcccuuggcgcccagcgu

SEQ ID NO: 2912735 - RNA, 20 nt, Mycobacterium avium subsp. paratuberculosis
cgcccuuggcgcccagcgug

SEQ ID NO: 2912736 - RNA, 17 nt, Mycobacterium avium subsp. paratuberculosis
cgcccuuguugauggug

SEQ ID NO: 2912737 - RNA, 16 nt, Mycobacterium avium subsp. paratuberculosis
cgccgaaaaacgcgac

SEQ ID NO: 2912738 - RNA, 21 nt, Mycobacterium avium subsp. paratuberculosis
cgccgaaaaacgcgacggccc

SEQ ID NO: 2912739 - RNA, 15 nt, Mycobacterium avium subsp. paratuberculosis
cgccgaaacccgcug

SEQ ID NO: 2912740 - RNA, 16 nt, Mycobacterium avium subsp. paratuberculosis
cgccgaaacccgcugu

SEQ ID NO: 2912741 - RNA, 21 nt, Mycobacterium avium subsp. paratuberculosis
cgccgaaagccuccgcgauca

SEQ ID NO: 2912742 - RNA, 23 nt, Mycobacterium avium subsp. paratuberculosis
cgccgaaagccuccgcgaucagc

SEQ ID NO: 2912743 - RNA, 18 nt, Mycobacterium avium subsp. paratuberculosis
cgccgaaaugccgugcca

SEQ ID NO: 2912744 - RNA, 19 nt, Mycobacterium avium subsp. paratuberculosis
cgccgaaaugccgugccag

SEQ ID NO: 2912745 - RNA, 15 nt, Mycobacterium avium subsp. paratuberculosis
cgccgaaggccgggu

SEQ ID NO: 2912746 - RNA, 18 nt, Mycobacterium avium subsp. paratuberculosis
cgccgaaggccgggucgg

SEQ ID NO: 2912747 - RNA, 18 nt, Mycobacterium avium subsp. paratuberculosis
cgccgaaguuccagccga

SEQ ID NO: 2912748 - RNA, 22 nt, Mycobacterium avium subsp. paratuberculosis
cgccgaaguuccagccgaucgc

SEQ ID NO: 2912749 - RNA, 21 nt, Mycobacterium avium subsp. paratuberculosis
cgccgaaguugucggguucuc

SEQ ID NO: 2912750 - RNA, 16 nt, Mycobacterium avium subsp. paratuberculosis
cgccgaauccggcggg

SEQ ID NO: 2912751 - RNA, 18 nt, Mycobacterium avium subsp. paratuberculosis
cgccgaaucggcuguggc

SEQ ID NO: 2912752 - RNA, 15 nt, Mycobacterium avium subsp. paratuberculosis
cgccgaaugccacgc

SEQ ID NO: 2912753 - RNA, 17 nt, Mycobacterium avium subsp. paratuberculosis
cgccgaaugccacgccg

SEQ ID NO: 2912754 - RNA, 20 nt, Mycobacterium avium subsp. paratuberculosis
cgccgaaugccacgccgaug

SEQ ID NO: 2912755 - RNA, 23 nt, Mycobacterium avium subsp. paratuberculosis
cgccgaauugcuuacgcaucgcc

SEQ ID NO: 2912756 - RNA, 16 nt, Mycobacterium avium subsp. paratuberculosis
cgccgaauuguucggc

SEQ ID NO: 2912757 - RNA, 19 nt, Mycobacterium avium subsp. paratuberculosis
cgccgaauuguucggccac

SEQ ID NO: 2912758 - RNA, 20 nt, Mycobacterium avium subsp. paratuberculosis
cgccgaauuguucggccacc

SEQ ID NO: 2912759 - RNA, 14 nt, Mycobacterium avium subsp. paratuberculosis
cgccgacaccaccg

SEQ ID NO: 2912760 - RNA, 15 nt, Mycobacterium avium subsp. paratuberculosis
cgccgacaccaccgc

SEQ ID NO: 2912761 - RNA, 20 nt, Mycobacterium avium subsp. paratuberculosis
cgccgacaccagcgcgcacg

SEQ ID NO: 2912762 - RNA, 21 nt, Mycobacterium avium subsp. paratuberculosis
cgccgacaccagcgcgcacgc

SEQ ID NO: 2912763 - RNA, 14 nt, Mycobacterium avium subsp. paratuberculosis
cgccgacaccaggg

SEQ ID NO: 2912764 - RNA, 15 nt, Mycobacterium avium subsp. paratuberculosis
cgccgacaccagggu

SEQ ID NO: 2912765 - RNA, 16 nt, Mycobacterium avium subsp. paratuberculosis
cgccgacaccagggug

SEQ ID NO: 2912766 - RNA, 23 nt, Mycobacterium avium subsp. paratuberculosis
cgccgacaccagggugcgcacga

SEQ ID NO: 2912767 - RNA, 16 nt, Mycobacterium avium subsp. paratuberculosis
cgccgacaccgucgcc

SEQ ID NO: 2912768 - RNA, 19 nt, Mycobacterium avium subsp. paratuberculosis
cgccgacaccgucgccgug

SEQ ID NO: 2912769 - RNA, 16 nt, Mycobacterium avium subsp. paratuberculosis
cgccgacagaugcggc

SEQ ID NO: 2912770 - RNA, 22 nt, Mycobacterium avium subsp. paratuberculosis
cgccgacagaugcggcaccagc

SEQ ID NO: 2912771 - RNA, 23 nt, Mycobacterium avium subsp. paratuberculosis
cgccgacagaugcggcaccagcc

SEQ ID NO: 2912772 - RNA, 15 nt, Mycobacterium avium subsp. paratuberculosis
cgccgacagcaccuc

SEQ ID NO: 2912773 - RNA, 14 nt, Mycobacterium avium subsp. paratuberculosis
cgccgacagcagcu

SEQ ID NO: 2912774 - RNA, 14 nt, Mycobacterium avium subsp. paratuberculosis
cgccgacagcgaca

SEQ ID NO: 2912775 - RNA, 12 nt, Mycobacterium avium subsp. paratuberculosis
cgccgacagcgg

SEQ ID NO: 2912776 - RNA, 16 nt, Mycobacterium avium subsp. paratuberculosis
cgccgacagcgggaug

SEQ ID NO: 2912777 - RNA, 15 nt, Mycobacterium avium subsp. paratuberculosis
cgccgacagcgucgu

SEQ ID NO: 2912778 - RNA, 16 nt, Mycobacterium avium subsp. paratuberculosis
cgccgacagcgucguc

SEQ ID NO: 2912779 - RNA, 20 nt, Mycobacterium avium subsp. paratuberculosis
cgccgacagcgucguccaug

SEQ ID NO: 2912780 - RNA, 24 nt, Mycobacterium avium subsp. paratuberculosis
cgccgacagcgucguccaugcccg

SEQ ID NO: 2912781 - RNA, 21 nt, Mycobacterium avium subsp. paratuberculosis
cgccgacagcugagcagcccg

SEQ ID NO: 2912782 - RNA, 15 nt, Mycobacterium avium subsp. paratuberculosis
cgccgacagucgcgg

SEQ ID NO: 2912783 - RNA, 19 nt, Mycobacterium avium subsp. paratuberculosis
cgccgacagucgcgggcag

SEQ ID NO: 2912784 - RNA, 13 nt, Mycobacterium avium subsp. paratuberculosis
cgccgacaucgcc

SEQ ID NO: 2912785 - RNA, 14 nt, Mycobacterium avium subsp. paratuberculosis
cgccgacaucgcgg

SEQ ID NO: 2912786 - RNA, 16 nt, Mycobacterium avium subsp. paratuberculosis
cgccgacaucgcggcg

SEQ ID NO: 2912787 - RNA, 17 nt, Mycobacterium avium subsp. paratuberculosis
cgccgacaucgcggcga

SEQ ID NO: 2912788 - RNA, 19 nt, Mycobacterium avium subsp. paratuberculosis
cgccgacaucgcggcgauc

SEQ ID NO: 2912789 - RNA, 16 nt, Mycobacterium avium subsp. paratuberculosis
cgccgacaucucccgg

SEQ ID NO: 2912790 - RNA, 17 nt, Mycobacterium avium subsp. paratuberculosis
cgccgacaucucccggu

SEQ ID NO: 2912791 - RNA, 19 nt, Mycobacterium avium subsp. paratuberculosis
cgccgacaucucccggucg

SEQ ID NO: 2912792 - RNA, 20 nt, Mycobacterium avium subsp. paratuberculosis
cgccgacaucucccggucga

SEQ ID NO: 2912793 - RNA, 19 nt, Mycobacterium avium subsp. paratuberculosis
cgccgaccacaugccguug

SEQ ID NO: 2912794 - RNA, 20 nt, Mycobacterium avium subsp. paratuberculosis
cgccgaccacccccagcccg

SEQ ID NO: 2912795 - RNA, 21 nt, Mycobacterium avium subsp. paratuberculosis
cgccgaccacccccagcccgc

SEQ ID NO: 2912796 - RNA, 20 nt, Mycobacterium avium subsp. paratuberculosis
cgccgaccaccuugcgcagc

SEQ ID NO: 2912797 - RNA, 21 nt, Mycobacterium avium subsp. paratuberculosis
cgccgaccaccuugcgcagca

SEQ ID NO: 2912798 - RNA, 22 nt, Mycobacterium avium subsp. paratuberculosis
cgccgaccaccuugcgcagcag

SEQ ID NO: 2912799 - RNA, 15 nt, Mycobacterium avium subsp. paratuberculosis
cgccgaccacgccgc

SEQ ID NO: 2912800 - RNA, 17 nt, Mycobacterium avium subsp. paratuberculosis
cgccgaccacggcccca

SEQ ID NO: 2912801 - RNA, 23 nt, Mycobacterium avium subsp. paratuberculosis
cgccgaccagcaggacgcgcccg

SEQ ID NO: 2912802 - RNA, 14 nt, Mycobacterium avium subsp. paratuberculosis
cgccgaccagccga

SEQ ID NO: 2912803 - RNA, 18 nt, Mycobacterium avium subsp. paratuberculosis
cgccgaccagccgaggcg

SEQ ID NO: 2912804 - RNA, 12 nt, Mycobacterium avium subsp. paratuberculosis
cgccgaccagcg

SEQ ID NO: 2912805 - RNA, 16 nt, Mycobacterium avium subsp. paratuberculosis
cgccgaccagcgcguu

SEQ ID NO: 2912806 - RNA, 17 nt, Mycobacterium avium subsp. paratuberculosis
cgccgaccaggaucggg

SEQ ID NO: 2912807 - RNA, 19 nt, Mycobacterium avium subsp. paratuberculosis
cgccgaccaggaucgggau

SEQ ID NO: 2912808 - RNA, 21 nt, Mycobacterium avium subsp. paratuberculosis
cgccgaccaggaucgggaucg

SEQ ID NO: 2912809 - RNA, 21 nt, Mycobacterium avium subsp. paratuberculosis
cgccgaccagguagcgcugca

SEQ ID NO: 2912810 - RNA, 23 nt, Mycobacterium avium subsp. paratuberculosis
cgccgaccaguucggccaccgcg

SEQ ID NO: 2912811 - RNA, 15 nt, Mycobacterium avium subsp. paratuberculosis
cgccgacccccgccg

SEQ ID NO: 2912812 - RNA, 19 nt, Mycobacterium avium subsp. paratuberculosis
cgccgacccccgccgcguc

SEQ ID NO: 2912813 - RNA, 14 nt, Mycobacterium avium subsp. paratuberculosis
cgccgacccgcccg

SEQ ID NO: 2912814 - RNA, 17 nt, Mycobacterium avium subsp. paratuberculosis
cgccgacccgcccgccg

SEQ ID NO: 2912815 - RNA, 20 nt, Mycobacterium avium subsp. paratuberculosis
cgccgacccgguugauccgg

SEQ ID NO: 2912816 - RNA, 13 nt, Mycobacterium avium subsp. paratuberculosis
cgccgaccgcccg

SEQ ID NO: 2912817 - RNA, 12 nt, Mycobacterium avium subsp. paratuberculosis
cgccgaccgccg

SEQ ID NO: 2912818 - RNA, 13 nt, Mycobacterium avium subsp. paratuberculosis
cgccgaccgccga

SEQ ID NO: 2912819 - RNA, 16 nt, Mycobacterium avium subsp. paratuberculosis
cgccgaccgccgagcg

SEQ ID NO: 2912820 - RNA, 18 nt, Mycobacterium avium subsp. paratuberculosis
cgccgaccgccgagcggg

SEQ ID NO: 2912821 - RNA, 15 nt, Mycobacterium avium subsp. paratuberculosis
cgccgaccgcgagca

SEQ ID NO: 2912822 - RNA, 17 nt, Mycobacterium avium subsp. paratuberculosis
cgccgaccgcgagcacg

SEQ ID NO: 2912823 - RNA, 18 nt, Mycobacterium avium subsp. paratuberculosis
cgccgaccgcggucgcgg

SEQ ID NO: 2912824 - RNA, 19 nt, Mycobacterium avium subsp. paratuberculosis
cgccgaccgcggucgcggc

SEQ ID NO: 2912825 - RNA, 21 nt, Mycobacterium avium subsp. paratuberculosis
cgccgaccgcggucgcggcgc

SEQ ID NO: 2912826 - RNA, 19 nt, Mycobacterium avium subsp. paratuberculosis
cgccgaccgguccgccgcc

SEQ ID NO: 2912827 - RNA, 22 nt, Mycobacterium avium subsp. paratuberculosis
cgccgaccgguccgccgccggc

SEQ ID NO: 2912828 - RNA, 23 nt, Mycobacterium avium subsp. paratuberculosis
cgccgaccgguccgccgccggcg

SEQ ID NO: 2912829 - RNA, 14 nt, Mycobacterium avium subsp. paratuberculosis
cgcccgccgcguac

SEQ ID NO: 2912830 - RNA, 17 nt, Mycobacterium avium subsp. paratuberculosis
cgcccgccgcguacacc

SEQ ID NO: 2912831 - RNA, 23 nt, Mycobacterium avium subsp. paratuberculosis
cgcccgccgcguacaccggcuga

SEQ ID NO: 2912832 - RNA, 15 nt, Mycobacterium avium subsp. paratuberculosis
cgcccgccggcccag

SEQ ID NO: 2912833 - RNA, 16 nt, Mycobacterium avium subsp. paratuberculosis
cgcccgccggcccagc

SEQ ID NO: 2912834 - RNA, 20 nt, Mycobacterium avium subsp. paratuberculosis
cgcccgccggcccagcucca

SEQ ID NO: 2912835 - RNA, 23 nt, Mycobacterium avium subsp. paratuberculosis
cgcccgccgggcacccgggugga

SEQ ID NO: 2912836 - RNA, 16 nt, Mycobacterium avium subsp. paratuberculosis
cgcccgccgguggccg

SEQ ID NO: 2912837 - RNA, 23 nt, Mycobacterium avium subsp. paratuberculosis
cgcccgcgaaaucuucgccguca

SEQ ID NO: 2912838 - RNA, 12 nt, Mycobacterium avium subsp. paratuberculosis
cgcccgcgaccc

SEQ ID NO: 2912839 - RNA, 13 nt, Mycobacterium avium subsp. paratuberculosis
cgcccgcgccacc

SEQ ID NO: 2912840 - RNA, 15 nt, Mycobacterium avium subsp. paratuberculosis
cgcccgcgccacccc

SEQ ID NO: 2912841 - RNA, 18 nt, Mycobacterium avium subsp. paratuberculosis
cgcccgcgccaccccgag

SEQ ID NO: 2912842 - RNA, 14 nt, Mycobacterium avium subsp. paratuberculosis
cgcccgcgcgaucg

SEQ ID NO: 2912843 - RNA, 22 nt, Mycobacterium avium subsp. paratuberculosis
cgcccgcgcgaugcgggcgccg

SEQ ID NO: 2912844 - RNA, 14 nt, Mycobacterium avium subsp. paratuberculosis
cgcccgcgcggcgg

SEQ ID NO: 2912845 - RNA, 15 nt, Mycobacterium avium subsp. paratuberculosis
cgcccgcgcggcggc

SEQ ID NO: 2912846 - RNA, 17 nt, Mycobacterium avium subsp. paratuberculosis
cgcccgcgcggcggcca

SEQ ID NO: 2912847 - RNA, 17 nt, Mycobacterium avium subsp. paratuberculosis
cgcccgcgcgugggcca

SEQ ID NO: 2912848 - RNA, 20 nt, Mycobacterium avium subsp. paratuberculosis
cgcccgcgcgugggccaacg

SEQ ID NO: 2912849 - RNA, 22 nt, Mycobacterium avium subsp. paratuberculosis
cgcccgcgcgugggccaacgcg

SEQ ID NO: 2912850 - RNA, 13 nt, Mycobacterium avium subsp. paratuberculosis
cgcccgcgcuggu

SEQ ID NO: 2912851 - RNA, 15 nt, Mycobacterium avium subsp. paratuberculosis
cgcccgcgcuggugc

SEQ ID NO: 2912852 - RNA, 16 nt, Mycobacterium avium subsp. paratuberculosis
cgcccgcgcuggugcu

SEQ ID NO: 2912853 - RNA, 13 nt, Mycobacterium avium subsp. paratuberculosis
cgcccgcggccau

SEQ ID NO: 2912854 - RNA, 15 nt, Mycobacterium avium subsp. paratuberculosis
cgcccgcggccaucg

SEQ ID NO: 2912855 - RNA, 14 nt, Mycobacterium avium subsp. paratuberculosis
cgcccgcggccucc

SEQ ID NO: 2912856 - RNA, 15 nt, Mycobacterium avium subsp. paratuberculosis
cgcccgcggccucca

SEQ ID NO: 2912857 - RNA, 17 nt, Mycobacterium avium subsp. paratuberculosis
cgcccgcggccuccagc

SEQ ID NO: 2912858 - RNA, 20 nt, Mycobacterium avium subsp. paratuberculosis
cgcccgcggccuccagccgc

SEQ ID NO: 2912859 - RNA, 21 nt, Mycobacterium avium subsp. paratuberculosis
cgcccgcggccuccagccgcu

SEQ ID NO: 2912860 - RNA, 11 nt, Mycobacterium avium subsp. paratuberculosis
cgcccgcggcg

SEQ ID NO: 2912861 - RNA, 12 nt, Mycobacterium avium subsp. paratuberculosis
cgcccgcggcgc

SEQ ID NO: 2912862 - RNA, 13 nt, Mycobacterium avium subsp. paratuberculosis
cgcccgcggcgcg

SEQ ID NO: 2912863 - RNA, 16 nt, Mycobacterium avium subsp. paratuberculosis
cgcccgcgggugcagc

SEQ ID NO: 2912864 - RNA, 12 nt, Mycobacterium avium subsp. paratuberculosis
cgcccgcggugg

SEQ ID NO: 2912865 - RNA, 23 nt, Mycobacterium avium subsp. paratuberculosis
cgcccgcgguggaacccagcacc

SEQ ID NO: 2912866 - RNA, 21 nt, Mycobacterium avium subsp. paratuberculosis
cgcccgcggugugcuggccag

SEQ ID NO: 2912867 - RNA, 18 nt, Mycobacterium avium subsp. paratuberculosis
cgcccgcguacagcaguu

SEQ ID NO: 2912868 - RNA, 20 nt, Mycobacterium avium subsp. paratuberculosis
cgcccgcgucguggcccugc

SEQ ID NO: 2912869 - RNA, 19 nt, Mycobacterium avium subsp. paratuberculosis
cgcccgcgugggcaccccg

SEQ ID NO: 2912870 - RNA, 17 nt, Mycobacterium avium subsp. paratuberculosis
cgcccgcguugcggcgc

SEQ ID NO: 2912871 - RNA, 18 nt, Mycobacterium avium subsp. paratuberculosis
cgcccgcguugcggcgca

SEQ ID NO: 2912872 - RNA, 20 nt, Mycobacterium avium subsp. paratuberculosis
cgcccgcguugcggcgcagc

SEQ ID NO: 2912873 - RNA, 17 nt, Mycobacterium avium subsp. paratuberculosis
cgcccgcuccgcgggca

SEQ ID NO: 2912874 - RNA, 16 nt, Mycobacterium avium subsp. paratuberculosis
cgcccgcuccgcggug

SEQ ID NO: 2912875 - RNA, 15 nt, Mycobacterium avium subsp. paratuberculosis
cgcccgcuccggcgg

SEQ ID NO: 2912876 - RNA, 20 nt, Mycobacterium avium subsp. paratuberculosis
cgcccgcuccugcaggccga

SEQ ID NO: 2912877 - RNA, 23 nt, Mycobacterium avium subsp. paratuberculosis
cgcccgcuccugcaggccgagcc

SEQ ID NO: 2912878 - RNA, 17 nt, Mycobacterium avium subsp. paratuberculosis
cgcccgcucgacggccg

SEQ ID NO: 2912879 - RNA, 19 nt, Mycobacterium avium subsp. paratuberculosis
cgcccgcucgacggccggu

SEQ ID NO: 2912880 - RNA, 23 nt, Mycobacterium avium subsp. paratuberculosis
cgcccgcugaaagcucgcgucga

SEQ ID NO: 2912881 - RNA, 18 nt, Mycobacterium avium subsp. paratuberculosis
cgcccgcugaccgccgcg

SEQ ID NO: 2912882 - RNA, 21 nt, Mycobacterium avium subsp. paratuberculosis
cgcccgcugaccgccgcgcuc

SEQ ID NO: 2912883 - RNA, 12 nt, Mycobacterium avium subsp. paratuberculosis
cgcccgcugcgc

SEQ ID NO: 2912884 - RNA, 17 nt, Mycobacterium avium subsp. paratuberculosis
cgcccgcugcgcggguc

SEQ ID NO: 2912885 - RNA, 22 nt, Mycobacterium avium subsp. paratuberculosis
cgcccgcugcgcgggucggcgc

SEQ ID NO: 2912886 - RNA, 13 nt, Mycobacterium avium subsp. paratuberculosis
cgcccgcugcggc

SEQ ID NO: 2912887 - RNA, 14 nt, Mycobacterium avium subsp. paratuberculosis
cgcccgcugcggcg

SEQ ID NO: 2912888 - RNA, 15 nt, Mycobacterium avium subsp. paratuberculosis
cgcccgcugcggcgc

SEQ ID NO: 2912889 - RNA, 16 nt, Mycobacterium avium subsp. paratuberculosis
cgcccgcugcggcgca

SEQ ID NO: 2912890 - RNA, 19 nt, Mycobacterium avium subsp. paratuberculosis
cgcccgcuggggcgcaccg

SEQ ID NO: 2912891 - RNA, 21 nt, Mycobacterium avium subsp. paratuberculosis
cgcccgcuggggcgcaccgcc

SEQ ID NO: 2912892 - RNA, 22 nt, Mycobacterium avium subsp. paratuberculosis
cgcccgcuggggcgcaccgccu

SEQ ID NO: 2912893 - RNA, 16 nt, Mycobacterium avium subsp. paratuberculosis
cgcccgcuugauggcg

SEQ ID NO: 2912894 - RNA, 22 nt, Mycobacterium avium subsp. paratuberculosis
cgcccgcuugauggcggcgcgg

SEQ ID NO: 2912895 - RNA, 23 nt, Mycobacterium avium subsp. paratuberculosis
cgcccgcuugauggcggcgcgga

SEQ ID NO: 2912896 - RNA, 15 nt, Mycobacterium avium subsp. paratuberculosis
cgcccggacaccccg

SEQ ID NO: 2912897 - RNA, 22 nt, Mycobacterium avium subsp. paratuberculosis
cgcccggaccaggguggcccca

SEQ ID NO: 2912898 - RNA, 17 nt, Mycobacterium avium subsp. paratuberculosis
cgcccggacccgcucgc

SEQ ID NO: 2912899 - RNA, 13 nt, Mycobacterium avium subsp. paratuberculosis
cgcccggaccggc

SEQ ID NO: 2912900 - RNA, 14 nt, Mycobacterium avium subsp. paratuberculosis
cgcccggaccggcu

SEQ ID NO: 2912901 - RNA, 15 nt, Mycobacterium avium subsp. paratuberculosis
cgcccggaccggcuc

SEQ ID NO: 2912902 - RNA, 21 nt, Mycobacterium avium subsp. paratuberculosis
cgcccggacgcgcacacggcc

SEQ ID NO: 2912903 - RNA, 15 nt, Mycobacterium avium subsp. paratuberculosis
cgcccggaucagcug

SEQ ID NO: 2912904 - RNA, 18 nt, Mycobacterium avium subsp. paratuberculosis
cgcccggaucagcugacc

SEQ ID NO: 2912905 - RNA, 12 nt, Mycobacterium avium subsp. paratuberculosis
cgcccggaugcc

SEQ ID NO: 2912906 - RNA, 16 nt, Mycobacterium avium subsp. paratuberculosis
cgcccggaugccggcg

SEQ ID NO: 2912907 - RNA, 14 nt, Mycobacterium avium subsp. paratuberculosis
cgcccggaugucgg

SEQ ID NO: 2912908 - RNA, 18 nt, Mycobacterium avium subsp. paratuberculosis
cgcccggaugucgggcga

SEQ ID NO: 2912909 - RNA, 18 nt, Mycobacterium avium subsp. paratuberculosis
cgcccggauucgcggcgg

SEQ ID NO: 2912910 - RNA, 19 nt, Mycobacterium avium subsp. paratuberculosis
cgcccggauucgcggcggc

SEQ ID NO: 2912911 - RNA, 20 nt, Mycobacterium avium subsp. paratuberculosis
cgcccggauucgcggcggcg

SEQ ID NO: 2912912 - RNA, 21 nt, Mycobacterium avium subsp. paratuberculosis
cgcccggauucgcggcggcgc

SEQ ID NO: 2912913 - RNA, 23 nt, Mycobacterium avium subsp. paratuberculosis
cgcccggauucgcggcggcgccg

SEQ ID NO: 2912914 - RNA, 21 nt, Mycobacterium avium subsp. paratuberculosis
cgcccgggcgcgugcacaccg

SEQ ID NO: 2912915 - RNA, 23 nt, Mycobacterium avium subsp. paratuberculosis
cgcccgggcgcgugcacaccggc

SEQ ID NO: 2912916 - RNA, 12 nt, Mycobacterium avium subsp. paratuberculosis
cgcccgggcggc

SEQ ID NO: 2912917 - RNA, 16 nt, Mycobacterium avium subsp. paratuberculosis
cgcccgggcggcccgc

SEQ ID NO: 2912918 - RNA, 18 nt, Mycobacterium avium subsp. paratuberculosis
cgcccgggcggcccgcau

SEQ ID NO: 2912919 - RNA, 19 nt, Mycobacterium avium subsp. paratuberculosis
cgcccgggcggcccgcauc

SEQ ID NO: 2912920 - RNA, 21 nt, Mycobacterium avium subsp. paratuberculosis
cgcccgggcggcccgggugga

SEQ ID NO: 2912921 - RNA, 13 nt, Mycobacterium avium subsp. paratuberculosis
cgcccgggcggcg

SEQ ID NO: 2912922 - RNA, 15 nt, Mycobacterium avium subsp. paratuberculosis
cgcccgggcggcggg

SEQ ID NO: 2912923 - RNA, 22 nt, Mycobacterium avium subsp. paratuberculosis
cgcccgggcggcggggcugccc

SEQ ID NO: 2912924 - RNA, 14 nt, Mycobacterium avium subsp. paratuberculosis
cgcccggggcgcgg

SEQ ID NO: 2912925 - RNA, 22 nt, Mycobacterium avium subsp. paratuberculosis
cgcccggggcgcggaccgcacc

SEQ ID NO: 2912926 - RNA, 23 nt, Mycobacterium avium subsp. paratuberculosis
cgcccggggcgcggaccgcaccc

SEQ ID NO: 2912927 - RNA, 13 nt, Mycobacterium avium subsp. paratuberculosis
cgcccggggcggc

SEQ ID NO: 2912928 - RNA, 14 nt, Mycobacterium avium subsp. paratuberculosis
cgcccggggcggcg

SEQ ID NO: 2912929 - RNA, 19 nt, Mycobacterium avium subsp. paratuberculosis
cgcccggggcggcgaugcg

SEQ ID NO: 2912930 - RNA, 22 nt, Mycobacterium avium subsp. paratuberculosis
cgcccggggugaugccggcggu

SEQ ID NO: 2912931 - RNA, 17 nt, Mycobacterium avium subsp. paratuberculosis
cgcccggguacaccgac

SEQ ID NO: 2912932 - RNA, 21 nt, Mycobacterium avium subsp. paratuberculosis
cgcccggguagggcagccaca

SEQ ID NO: 2912933 - RNA, 15 nt, Mycobacterium avium subsp. paratuberculosis
cgcccgggucgucgg

SEQ ID NO: 2912934 - RNA, 20 nt, Mycobacterium avium subsp. paratuberculosis
cgcccgggugacaacggugg

SEQ ID NO: 2912935 - RNA, 23 nt, Mycobacterium avium subsp. paratuberculosis
cgcccgggugacaacgguggugg

SEQ ID NO: 2912936 - RNA, 20 nt, Mycobacterium avium subsp. paratuberculosis
cgcccgggugcaggcccagc

SEQ ID NO: 2912937 - RNA, 19 nt, Mycobacterium avium subsp. paratuberculosis
cgcccgggugcugcggcuc

SEQ ID NO: 2912938 - RNA, 14 nt, Mycobacterium avium subsp. paratuberculosis
cgcccggguguggg

SEQ ID NO: 2912939 - RNA, 20 nt, Mycobacterium avium subsp. paratuberculosis
cgcccggguugucgacgugg

SEQ ID NO: 2912940 - RNA, 17 nt, Mycobacterium avium subsp. paratuberculosis
cgcccgguaggccgccg

SEQ ID NO: 2912941 - RNA, 18 nt, Mycobacterium avium subsp. paratuberculosis
cgcccgguaggccgccgc

SEQ ID NO: 2912942 - RNA, 19 nt, Mycobacterium avium subsp. paratuberculosis
cgcccgguaggccgccgcg

SEQ ID NO: 2912943 - RNA, 17 nt, Mycobacterium avium subsp. paratuberculosis
cgcccggucacccgugg

SEQ ID NO: 2912944 - RNA, 20 nt, Mycobacterium avium subsp. paratuberculosis
cgcccggucaggaacccggc

SEQ ID NO: 2912945 - RNA, 21 nt, Mycobacterium avium subsp. paratuberculosis
cgcccggucaggaacccggcc

SEQ ID NO: 2912946 - RNA, 22 nt, Mycobacterium avium subsp. paratuberculosis
cgcccggucaggaacccggccc

SEQ ID NO: 2912947 - RNA, 23 nt, Mycobacterium avium subsp. paratuberculosis
cgcccggucaggaacccggcccg

SEQ ID NO: 2912948 - RNA, 19 nt, Mycobacterium avium subsp. paratuberculosis
cgcccggucgaccaggguu

SEQ ID NO: 2912949 - RNA, 23 nt, Mycobacterium avium subsp. paratuberculosis
cgcccggucgaggucggccagca

SEQ ID NO: 2912950 - RNA, 16 nt, Mycobacterium avium subsp. paratuberculosis
cgcccggugcgccagc

SEQ ID NO: 2912951 - RNA, 19 nt, Mycobacterium avium subsp. paratuberculosis
cgcccggugcgccagcgug

SEQ ID NO: 2912952 - RNA, 22 nt, Mycobacterium avium subsp. paratuberculosis
cgcccguagaacaguucgacgu

SEQ ID NO: 2912953 - RNA, 19 nt, Mycobacterium avium subsp. paratuberculosis
cgcccguagacccacagcu

SEQ ID NO: 2912954 - RNA, 18 nt, Mycobacterium avium subsp. paratuberculosis
cgcccguagaugcggccc

SEQ ID NO: 2912955 - RNA, 19 nt, Mycobacterium avium subsp. paratuberculosis
cgcccguagaugcggccca

SEQ ID NO: 2912956 - RNA, 21 nt, Mycobacterium avium subsp. paratuberculosis
cgcccguagaugcggcccagc

SEQ ID NO: 2912957 - RNA, 15 nt, Mycobacterium avium subsp. paratuberculosis
cgcccguagcggcgg

SEQ ID NO: 2912958 - RNA, 16 nt, Mycobacterium avium subsp. paratuberculosis
cgcccguagcggcgga

SEQ ID NO: 2912959 - RNA, 20 nt, Mycobacterium avium subsp. paratuberculosis
cgcccguagcggugggcgcg

SEQ ID NO: 2912960 - RNA, 16 nt, Mycobacterium avium subsp. paratuberculosis
cgcccgucacgcuggc

SEQ ID NO: 2912961 - RNA, 17 nt, Mycobacterium avium subsp. paratuberculosis
cgcccgucacgcuggcg

SEQ ID NO: 2912962 - RNA, 20 nt, Mycobacterium avium subsp. paratuberculosis
cgcccgucacgcuggcguga

SEQ ID NO: 2912963 - RNA, 14 nt, Mycobacterium avium subsp. paratuberculosis
cgcccgucagcccc

SEQ ID NO: 2912964 - RNA, 13 nt, Mycobacterium avium subsp. paratuberculosis
cgcccgucccgcc

SEQ ID NO: 2912965 - RNA, 15 nt, Mycobacterium avium subsp. paratuberculosis
cgcccgucccgccga

SEQ ID NO: 2912966 - RNA, 18 nt, Mycobacterium avium subsp. paratuberculosis
cgcccgucccgccgacgg

SEQ ID NO: 2912967 - RNA, 13 nt, Mycobacterium avium subsp. paratuberculosis
cgccgaccucggc

SEQ ID NO: 2912968 - RNA, 16 nt, Mycobacterium avium subsp. paratuberculosis
cgccgaccucggccag

SEQ ID NO: 2912969 - RNA, 17 nt, Mycobacterium avium subsp. paratuberculosis
cgccgaccucggccagc

SEQ ID NO: 2912970 - RNA, 20 nt, Mycobacterium avium subsp. paratuberculosis
cgccgaccucggccagcgug

SEQ ID NO: 2912971 - RNA, 15 nt, Mycobacterium avium subsp. paratuberculosis
cgccgaccucgucgg

SEQ ID NO: 2912972 - RNA, 16 nt, Mycobacterium avium subsp. paratuberculosis
cgccgaccucgucggc

SEQ ID NO: 2912973 - RNA, 17 nt, Mycobacterium avium subsp. paratuberculosis
cgccgaccucgucggcg

SEQ ID NO: 2912974 - RNA, 18 nt, Mycobacterium avium subsp. paratuberculosis
cgccgaccucgucggcgg

SEQ ID NO: 2912975 - RNA, 20 nt, Mycobacterium avium subsp. paratuberculosis
cgccgaccucgucggcggug

SEQ ID NO: 2912976 - RNA, 23 nt, Mycobacterium avium subsp. paratuberculosis
cgccgaccucgucggcggugccg

SEQ ID NO: 2912977 - RNA, 15 nt, Mycobacterium avium subsp. paratuberculosis
cgccgaccuggucgc

SEQ ID NO: 2912978 - RNA, 12 nt, Mycobacterium avium subsp. paratuberculosis
cgccgaccuugg

SEQ ID NO: 2912979 - RNA, 13 nt, Mycobacterium avium subsp. paratuberculosis
cgccgaccuuggc

SEQ ID NO: 2912980 - RNA, 18 nt, Mycobacterium avium subsp. paratuberculosis
cgccgacgaacagguucg

SEQ ID NO: 2912981 - RNA, 22 nt, Mycobacterium avium subsp. paratuberculosis
cgccgacgaagaugcgcccggu

SEQ ID NO: 2912982 - RNA, 14 nt, Mycobacterium avium subsp. paratuberculosis
cgccgacgacggcg

SEQ ID NO: 2912983 - RNA, 19 nt, Mycobacterium avium subsp. paratuberculosis
cgccgacgacgucgcgcag

SEQ ID NO: 2912984 - RNA, 13 nt, Mycobacterium avium subsp. paratuberculosis
cgccgacgauccc

SEQ ID NO: 2912985 - RNA, 20 nt, Mycobacterium avium subsp. paratuberculosis
cgccgacgauccgcgccgcg

SEQ ID NO: 2912986 - RNA, 21 nt, Mycobacterium avium subsp. paratuberculosis
cgccgacgauccgcgccgcga

SEQ ID NO: 2912987 - RNA, 12 nt, Mycobacterium avium subsp. paratuberculosis
cgccgacgcaug

SEQ ID NO: 2912988 - RNA, 17 nt, Mycobacterium avium subsp. paratuberculosis
cgccgacgcauguccgc

SEQ ID NO: 2912989 - RNA, 22 nt, Mycobacterium avium subsp. paratuberculosis
cgccgacgcauguccgccguca

SEQ ID NO: 2912990 - RNA, 14 nt, Mycobacterium avium subsp. paratuberculosis
cgccgacgccagca

SEQ ID NO: 2912991 - RNA, 22 nt, Mycobacterium avium subsp. paratuberculosis
cgccgacgccagcacguggccg

SEQ ID NO: 2912992 - RNA, 17 nt, Mycobacterium avium subsp. paratuberculosis
cgccgacgcccacagcg

SEQ ID NO: 2912993 - RNA, 22 nt, Mycobacterium avium subsp. paratuberculosis
cgccgacgcccacagcgccagc

SEQ ID NO: 2912994 - RNA, 13 nt, Mycobacterium avium subsp. paratuberculosis
cgccgacgcccag

SEQ ID NO: 2912995 - RNA, 16 nt, Mycobacterium avium subsp. paratuberculosis
cgccgacgcccagcgc

SEQ ID NO: 2912996 - RNA, 17 nt, Mycobacterium avium subsp. paratuberculosis
cgccgacgcccagcgcg

SEQ ID NO: 2912997 - RNA, 15 nt, Mycobacterium avium subsp. paratuberculosis
cgccgacgcccaggc

SEQ ID NO: 2912998 - RNA, 15 nt, Mycobacterium avium subsp. paratuberculosis
cgccgacgccgucga

SEQ ID NO: 2912999 - RNA, 20 nt, Mycobacterium avium subsp. paratuberculosis
cgccgacgcgcugcgcgccg

SEQ ID NO: 2913000 - RNA, 23 nt, Mycobacterium avium subsp. paratuberculosis
cgccgacgcgcugcgcgccgccc

SEQ ID NO: 2913001 - RNA, 17 nt, Mycobacterium avium subsp. paratuberculosis
cgccgacggagacgacc

SEQ ID NO: 2913002 - RNA, 20 nt, Mycobacterium avium subsp. paratuberculosis
cgccgacggagacgaccagg

SEQ ID NO: 2913003 - RNA, 13 nt, Mycobacterium avium subsp. paratuberculosis
cgccgacggccag

SEQ ID NO: 2913004 - RNA, 13 nt, Mycobacterium avium subsp. paratuberculosis
cgccgacggccgc

SEQ ID NO: 2913005 - RNA, 14 nt, Mycobacterium avium subsp. paratuberculosis
cgccgacggccgcg

SEQ ID NO: 2913006 - RNA, 15 nt, Mycobacterium avium subsp. paratuberculosis
cgccgacggccgcgc

SEQ ID NO: 2913007 - RNA, 23 nt, Mycobacterium avium subsp. paratuberculosis
cgccgacggcugcccggcccgcc

SEQ ID NO: 2913008 - RNA, 15 nt, Mycobacterium avium subsp. paratuberculosis
cgccgacgggcccag

SEQ ID NO: 2913009 - RNA, 19 nt, Mycobacterium avium subsp. paratuberculosis
cgccgacgggcccagcgcg

SEQ ID NO: 2913010 - RNA, 23 nt, Mycobacterium avium subsp. paratuberculosis
cgccgacgggcccagcgcgacgu

SEQ ID NO: 2913011 - RNA, 15 nt, Mycobacterium avium subsp. paratuberculosis
cgccgacgggcccgc

SEQ ID NO: 2913012 - RNA, 16 nt, Mycobacterium avium subsp. paratuberculosis
cgccgacgggcccgcg

SEQ ID NO: 2913013 - RNA, 17 nt, Mycobacterium avium subsp. paratuberculosis
cgccgacgggcccgcgc

SEQ ID NO: 2913014 - RNA, 18 nt, Mycobacterium avium subsp. paratuberculosis
cgccgacgggcccgcgcc

SEQ ID NO: 2913015 - RNA, 13 nt, Mycobacterium avium subsp. paratuberculosis
cgccgacggugag

SEQ ID NO: 2913016 - RNA, 21 nt, Mycobacterium avium subsp. paratuberculosis
cgccgacgguggcccccacca

SEQ ID NO: 2913017 - RNA, 22 nt, Mycobacterium avium subsp. paratuberculosis
cgccgacgguggcccccaccac

SEQ ID NO: 2913018 - RNA, 14 nt, Mycobacterium avium subsp. paratuberculosis
cgccgacgguggcg

SEQ ID NO: 2913019 - RNA, 18 nt, Mycobacterium avium subsp. paratuberculosis
cgccgacgguggcgaagc

SEQ ID NO: 2913020 - RNA, 22 nt, Mycobacterium avium subsp. paratuberculosis
cgccgacgguguccgcgggcag

SEQ ID NO: 2913021 - RNA, 21 nt, Mycobacterium avium subsp. paratuberculosis
cgccgacguagacgagccggu

SEQ ID NO: 2913022 - RNA, 18 nt, Mycobacterium avium subsp. paratuberculosis
cgccgacguaggacagca

SEQ ID NO: 2913023 - RNA, 21 nt, Mycobacterium avium subsp. paratuberculosis
cgccgacguaggacagcacca

SEQ ID NO: 2913024 - RNA, 13 nt, Mycobacterium avium subsp. paratuberculosis
cgccgacgucagg

SEQ ID NO: 2913025 - RNA, 17 nt, Mycobacterium avium subsp. paratuberculosis
cgccgacgucccagcac

SEQ ID NO: 2913026 - RNA, 22 nt, Mycobacterium avium subsp. paratuberculosis
cgccgacgucccagcacaacgc

SEQ ID NO: 2913027 - RNA, 17 nt, Mycobacterium avium subsp. paratuberculosis
cgccgacguccugguug

SEQ ID NO: 2913028 - RNA, 19 nt, Mycobacterium avium subsp. paratuberculosis
cgccgacgucgugggcgau

SEQ ID NO: 2913029 - RNA, 14 nt, Mycobacterium avium subsp. paratuberculosis
cgccgacgucuggu

SEQ ID NO: 2913030 - RNA, 20 nt, Mycobacterium avium subsp. paratuberculosis
cgccgacguuguugucgaug

SEQ ID NO: 2913031 - RNA, 17 nt, Mycobacterium avium subsp. paratuberculosis
cgccgacuagcgcggcg

SEQ ID NO: 2913032 - RNA, 14 nt, Mycobacterium avium subsp. paratuberculosis
cgccgacuccccgc

SEQ ID NO: 2913033 - RNA, 15 nt, Mycobacterium avium subsp. paratuberculosis
cgccgacuccccgcc

SEQ ID NO: 2913034 - RNA, 17 nt, Mycobacterium avium subsp. paratuberculosis
cgccgacuccccgcccg

SEQ ID NO: 2913035 - RNA, 19 nt, Mycobacterium avium subsp. paratuberculosis
cgccgacuccccgcccggc

SEQ ID NO: 2913036 - RNA, 16 nt, Mycobacterium avium subsp. paratuberculosis
cgccgacucgcaggug

SEQ ID NO: 2913037 - RNA, 21 nt, Mycobacterium avium subsp. paratuberculosis
cgccgacucgcaggugccggu

SEQ ID NO: 2913038 - RNA, 22 nt, Mycobacterium avium subsp. paratuberculosis
cgccgacugugcgaugucggug

SEQ ID NO: 2913039 - RNA, 21 nt, Mycobacterium avium subsp. paratuberculosis
cgccgacuugaucgcggcgua

SEQ ID NO: 2913040 - RNA, 20 nt, Mycobacterium avium subsp. paratuberculosis
cgccgagaacaggccgagcg

SEQ ID NO: 2913041 - RNA, 18 nt, Mycobacterium avium subsp. paratuberculosis
cgccgagaaugccguaga

SEQ ID NO: 2913042 - RNA, 22 nt, Mycobacterium avium subsp. paratuberculosis
cgccgagacacauucgcgugug

SEQ ID NO: 2913043 - RNA, 15 nt, Mycobacterium avium subsp. paratuberculosis
cgccgagacggcgug

SEQ ID NO: 2913044 - RNA, 16 nt, Mycobacterium avium subsp. paratuberculosis
cgccgagacggcgugg

SEQ ID NO: 2913045 - RNA, 14 nt, Mycobacterium avium subsp. paratuberculosis
cgccgagacguggu

SEQ ID NO: 2913046 - RNA, 16 nt, Mycobacterium avium subsp. paratuberculosis
cgccgagacguggugg

SEQ ID NO: 2913047 - RNA, 20 nt, Mycobacterium avium subsp. paratuberculosis
cgccgagacgugguggugcg

SEQ ID NO: 2913048 - RNA, 15 nt, Mycobacterium avium subsp. paratuberculosis
cgccgagagcgcguc

SEQ ID NO: 2913049 - RNA, 17 nt, Mycobacterium avium subsp. paratuberculosis
cgccgagagcgcgucga

SEQ ID NO: 2913050 - RNA, 20 nt, Mycobacterium avium subsp. paratuberculosis
cgccgagagcgcgucgacgc

SEQ ID NO: 2913051 - RNA, 22 nt, Mycobacterium avium subsp. paratuberculosis
cgccgagagcucuugcgcccca

SEQ ID NO: 2913052 - RNA, 21 nt, Mycobacterium avium subsp. paratuberculosis
cgccgagauccaccgcgcggc

SEQ ID NO: 2913053 - RNA, 24 nt, Mycobacterium avium subsp. paratuberculosis
cgccgagauccaccgcgcggccag

SEQ ID NO: 2913054 - RNA, 13 nt, Mycobacterium avium subsp. paratuberculosis
cgccgagaucgcg

SEQ ID NO: 2913055 - RNA, 20 nt, Mycobacterium avium subsp. paratuberculosis
cgccgagauuggacgacacc

SEQ ID NO: 2913056 - RNA, 14 nt, Mycobacterium avium subsp. paratuberculosis
cgccgagcaacagc

SEQ ID NO: 2913057 - RNA, 21 nt, Mycobacterium avium subsp. paratuberculosis
cgccgagcaacagcccgaccg

SEQ ID NO: 2913058 - RNA, 12 nt, Mycobacterium avium subsp. paratuberculosis
cgccgagcacac

SEQ ID NO: 2913059 - RNA, 17 nt, Mycobacterium avium subsp. paratuberculosis
cgccgagcaccuggccg

SEQ ID NO: 2913060 - RNA, 23 nt, Mycobacterium avium subsp. paratuberculosis
cgccgagcaccuggccguucagg

SEQ ID NO: 2913061 - RNA, 16 nt, Mycobacterium avium subsp. paratuberculosis
cgccgagcacgaacgc

SEQ ID NO: 2913062 - RNA, 22 nt, Mycobacterium avium subsp. paratuberculosis
cgccgagcacgaacgcggccgc

SEQ ID NO: 2913063 - RNA, 23 nt, Mycobacterium avium subsp. paratuberculosis
cgccgagcacgaacgcggccgcc

SEQ ID NO: 2913064 - RNA, 14 nt, Mycobacterium avium subsp. paratuberculosis
cgccgagcagaucg

SEQ ID NO: 2913065 - RNA, 21 nt, Mycobacterium avium subsp. paratuberculosis
cgccgagcagaucggguccca

SEQ ID NO: 2913066 - RNA, 20 nt, Mycobacterium avium subsp. paratuberculosis
cgccgagcagcaccggcaug

SEQ ID NO: 2913067 - RNA, 13 nt, Mycobacterium avium subsp. paratuberculosis
cgccgagcagccg

SEQ ID NO: 2913068 - RNA, 16 nt, Mycobacterium avium subsp. paratuberculosis
cgccgagcagccgguc

SEQ ID NO: 2913069 - RNA, 17 nt, Mycobacterium avium subsp. paratuberculosis
cgccgagcagccggucc

SEQ ID NO: 2913070 - RNA, 14 nt, Mycobacterium avium subsp. paratuberculosis
cgccgagcagcuca

SEQ ID NO: 2913071 - RNA, 14 nt, Mycobacterium avium subsp. paratuberculosis
cgccgagccgaggc

SEQ ID NO: 2913072 - RNA, 16 nt, Mycobacterium avium subsp. paratuberculosis
cgccgagccgaggcag

SEQ ID NO: 2913073 - RNA, 14 nt, Mycobacterium avium subsp. paratuberculosis
cgccgagccgcacc

SEQ ID NO: 2913074 - RNA, 15 nt, Mycobacterium avium subsp. paratuberculosis
cgccgagccgcaccg

SEQ ID NO: 2913075 - RNA, 16 nt, Mycobacterium avium subsp. paratuberculosis
cgccgagccgcaccgc

SEQ ID NO: 2913076 - RNA, 15 nt, Mycobacterium avium subsp. paratuberculosis
cgccgagccgcgcca

SEQ ID NO: 2913077 - RNA, 20 nt, Mycobacterium avium subsp. paratuberculosis
cgccgagccgcgccacgcgc

SEQ ID NO: 2913078 - RNA, 14 nt, Mycobacterium avium subsp. paratuberculosis
cgccgagccgcggg

SEQ ID NO: 2913079 - RNA, 15 nt, Mycobacterium avium subsp. paratuberculosis
cgccgagccgcucca

SEQ ID NO: 2913080 - RNA, 21 nt, Mycobacterium avium subsp. paratuberculosis
cgccgagccgcuccaccgcgu

SEQ ID NO: 2913081 - RNA, 15 nt, Mycobacterium avium subsp. paratuberculosis
cgccgagccggcacg

SEQ ID NO: 2913082 - RNA, 19 nt, Mycobacterium avium subsp. paratuberculosis
cgccgagccggcacggccg

SEQ ID NO: 2913083 - RNA, 20 nt, Mycobacterium avium subsp. paratuberculosis
cgccgagccggcacggccgg

SEQ ID NO: 2913084 - RNA, 13 nt, Mycobacterium avium subsp. paratuberculosis
cgccgagccgucg

SEQ ID NO: 2913085 - RNA, 17 nt, Mycobacterium avium subsp. paratuberculosis
cgccgagccgucgucgc

SEQ ID NO: 2913086 - RNA, 20 nt, Mycobacterium avium subsp. paratuberculosis
cgccgagccgucgucgcugc

SEQ ID NO: 2913087 - RNA, 22 nt, Mycobacterium avium subsp. paratuberculosis
cgccgagccgucgucgcugcag

SEQ ID NO: 2913088 - RNA, 22 nt, Mycobacterium avium subsp. paratuberculosis
cgccgagcgcugguugucgacg

SEQ ID NO: 2913089 - RNA, 14 nt, Mycobacterium avium subsp. paratuberculosis
cgccgagcgggcga

SEQ ID NO: 2913090 - RNA, 19 nt, Mycobacterium avium subsp. paratuberculosis
cgccgagcgggcgaucucg

SEQ ID NO: 2913091 - RNA, 13 nt, Mycobacterium avium subsp. paratuberculosis
cgccgagcggguc

SEQ ID NO: 2913092 - RNA, 14 nt, Mycobacterium avium subsp. paratuberculosis
cgccgagcgggucg

SEQ ID NO: 2913093 - RNA, 13 nt, Mycobacterium avium subsp. paratuberculosis
cgccgagcgucac

SEQ ID NO: 2913094 - RNA, 18 nt, Mycobacterium avium subsp. paratuberculosis
cgccgagcgucacgcugg

SEQ ID NO: 2913095 - RNA, 20 nt, Mycobacterium avium subsp. paratuberculosis
cgccgagcgucacgcuggcg

SEQ ID NO: 2913096 - RNA, 22 nt, Mycobacterium avium subsp. paratuberculosis
cgccgagcgugcauucagugcg

SEQ ID NO: 2913097 - RNA, 16 nt, Mycobacterium avium subsp. paratuberculosis
cgccgagcucgauguc

SEQ ID NO: 2913098 - RNA, 15 nt, Mycobacterium avium subsp. paratuberculosis
cgccgagcucggcca

SEQ ID NO: 2913099 - RNA, 17 nt, Mycobacterium avium subsp. paratuberculosis
cgccgagcucggccacc

SEQ ID NO: 2913100 - RNA, 18 nt, Mycobacterium avium subsp. paratuberculosis
cgccgagcucggccacca

SEQ ID NO: 2913101 - RNA, 19 nt, Mycobacterium avium subsp. paratuberculosis
cgccgagcucggccaccag

SEQ ID NO: 2913102 - RNA, 17 nt, Mycobacterium avium subsp. paratuberculosis
cgccgaggaaccggcag

SEQ ID NO: 2913103 - RNA, 21 nt, Mycobacterium avium subsp. paratuberculosis
cgccgaggaaccggcagccgg

SEQ ID NO: 2913104 - RNA, 23 nt, Mycobacterium avium subsp. paratuberculosis
cgccgaggaaccggcagccggcg

SEQ ID NO: 2913105 - RNA, 17 nt, Mycobacterium avium subsp. paratuberculosis
cgccgaggacacguugg

SEQ ID NO: 2913106 - RNA, 15 nt, Mycobacterium avium subsp. paratuberculosis
cgccgaggaggccgc

SEQ ID NO: 2913107 - RNA, 19 nt, Mycobacterium avium subsp. paratuberculosis
cgccgaggaggccgcggcg

SEQ ID NO: 2913108 - RNA, 20 nt, Mycobacterium avium subsp. paratuberculosis
cgccgaggaggccgcggcga

SEQ ID NO: 2913109 - RNA, 21 nt, Mycobacterium avium subsp. paratuberculosis
cgccgaggaggccgcggcgac

SEQ ID NO: 2913110 - RNA, 15 nt, Mycobacterium avium subsp. paratuberculosis
cgccgaggccagcac

SEQ ID NO: 2913111 - RNA, 16 nt, Mycobacterium avium subsp. paratuberculosis
cgccgaggccagcacg

SEQ ID NO: 2913112 - RNA, 19 nt, Mycobacterium avium subsp. paratuberculosis
cgccgaggccagcacgccg

SEQ ID NO: 2913113 - RNA, 21 nt, Mycobacterium avium subsp. paratuberculosis
cgccgaggccagcacgccggu

SEQ ID NO: 2913114 - RNA, 22 nt, Mycobacterium avium subsp. paratuberculosis
cgccgaggccagcacgccgguc

SEQ ID NO: 2913115 - RNA, 15 nt, Mycobacterium avium subsp. paratuberculosis
cgccgaggcgaugcc

SEQ ID NO: 2913116 - RNA, 22 nt, Mycobacterium avium subsp. paratuberculosis
cgccgaggcgaugccgugcugg

SEQ ID NO: 2913117 - RNA, 19 nt, Mycobacterium avium subsp. paratuberculosis
cgccgaggcgcucggcccg

SEQ ID NO: 2913118 - RNA, 21 nt, Mycobacterium avium subsp. paratuberculosis
cgccgaggcgcucggcccgcu

SEQ ID NO: 2913119 - RNA, 13 nt, Mycobacterium avium subsp. paratuberculosis
cgccgaggcgugc

SEQ ID NO: 2913120 - RNA, 17 nt, Mycobacterium avium subsp. paratuberculosis
cgccgaggcgugccgcu

SEQ ID NO: 2913121 - RNA, 22 nt, Mycobacterium avium subsp. paratuberculosis
cgccgaggcgugccgcugggag

SEQ ID NO: 2913122 - RNA, 15 nt, Mycobacterium avium subsp. paratuberculosis
cgccgagggccagca

SEQ ID NO: 2913123 - RNA, 18 nt, Mycobacterium avium subsp. paratuberculosis
cgccgagggccagcagcc

SEQ ID NO: 2913124 - RNA, 19 nt, Mycobacterium avium subsp. paratuberculosis
cgccgagggccagcagcca

SEQ ID NO: 2913125 - RNA, 22 nt, Mycobacterium avium subsp. paratuberculosis
cgccgagggccagcagccagcu

SEQ ID NO: 2913126 - RNA, 16 nt, Mycobacterium avium subsp. paratuberculosis
cgccgagggcccgggc

SEQ ID NO: 2913127 - RNA, 18 nt, Mycobacterium avium subsp. paratuberculosis
cgccgagggcccgggcag

SEQ ID NO: 2913128 - RNA, 17 nt, Mycobacterium avium subsp. paratuberculosis
cgccgagggcgacgaug

SEQ ID NO: 2913129 - RNA, 14 nt, Mycobacterium avium subsp. paratuberculosis
cgccgagggcggcg

SEQ ID NO: 2913130 - RNA, 15 nt, Mycobacterium avium subsp. paratuberculosis
cgccgagggcggcgg

SEQ ID NO: 2913131 - RNA, 16 nt, Mycobacterium avium subsp. paratuberculosis
cgccgagggcggcggc

SEQ ID NO: 2913132 - RNA, 20 nt, Mycobacterium avium subsp. paratuberculosis
cgccgagggugccggccacc

SEQ ID NO: 2913133 - RNA, 21 nt, Mycobacterium avium subsp. paratuberculosis
cgccgagggugccggccaccg

SEQ ID NO: 2913134 - RNA, 23 nt, Mycobacterium avium subsp. paratuberculosis
cgccgagggugccggccaccggc

SEQ ID NO: 2913135 - RNA, 16 nt, Mycobacterium avium subsp. paratuberculosis
cgccgagguagccgcg

SEQ ID NO: 2913136 - RNA, 19 nt, Mycobacterium avium subsp. paratuberculosis
cgccgagguagccgcgcac

SEQ ID NO: 2913137 - RNA, 20 nt, Mycobacterium avium subsp. paratuberculosis
cgccgagguagccgcgcacc

SEQ ID NO: 2913138 - RNA, 22 nt, Mycobacterium avium subsp. paratuberculosis
cgccgagguagccgcgcaccac

SEQ ID NO: 2913139 - RNA, 19 nt, Mycobacterium avium subsp. paratuberculosis
cgccgaggucaccgcggga

SEQ ID NO: 2913140 - RNA, 22 nt, Mycobacterium avium subsp. paratuberculosis
cgccgaggugcaacacucgagc

SEQ ID NO: 2913141 - RNA, 21 nt, Mycobacterium avium subsp. paratuberculosis
cgccgaggugcugucgucgcc

SEQ ID NO: 2913142 - RNA, 13 nt, Mycobacterium avium subsp. paratuberculosis
cgccgagguggcc

SEQ ID NO: 2913143 - RNA, 16 nt, Mycobacterium avium subsp. paratuberculosis
cgccgagguggcccgc

SEQ ID NO: 2913144 - RNA, 18 nt, Mycobacterium avium subsp. paratuberculosis
cgccgagguggcccgcca

SEQ ID NO: 2913145 - RNA, 22 nt, Mycobacterium avium subsp. paratuberculosis
cgccgagguggcccgccacgug

SEQ ID NO: 2913146 - RNA, 16 nt, Mycobacterium avium subsp. paratuberculosis
cgccgagguggccgcc

SEQ ID NO: 2913147 - RNA, 18 nt, Mycobacterium avium subsp. paratuberculosis
cgccgagguggccgccag

SEQ ID NO: 2913148 - RNA, 20 nt, Mycobacterium avium subsp. paratuberculosis
cgccgagguggccgccagca

SEQ ID NO: 2913149 - RNA, 21 nt, Mycobacterium avium subsp. paratuberculosis
cgccgagguggccgccagcac

SEQ ID NO: 2913150 - RNA, 23 nt, Mycobacterium avium subsp. paratuberculosis
cgccgagguggccgccagcaccu

SEQ ID NO: 2913151 - RNA, 17 nt, Mycobacterium avium subsp. paratuberculosis
cgccgaguccgggccgc

SEQ ID NO: 2913152 - RNA, 19 nt, Mycobacterium avium subsp. paratuberculosis
cgccgaguccgggccgccg

SEQ ID NO: 2913153 - RNA, 20 nt, Mycobacterium avium subsp. paratuberculosis
cgccgaguccgggccgccgg

SEQ ID NO: 2913154 - RNA, 21 nt, Mycobacterium avium subsp. paratuberculosis
cgccgaguccgggccgccggc

SEQ ID NO: 2913155 - RNA, 22 nt, Mycobacterium avium subsp. paratuberculosis
cgccgaguccgggccgccggcc

SEQ ID NO: 2913156 - RNA, 17 nt, Mycobacterium avium subsp. paratuberculosis
cgccgagucgaucgcca

SEQ ID NO: 2913157 - RNA, 18 nt, Mycobacterium avium subsp. paratuberculosis
cgccgagucgaucgccag

SEQ ID NO: 2913158 - RNA, 20 nt, Mycobacterium avium subsp. paratuberculosis
cgccgagucgaucgccagcg

SEQ ID NO: 2913159 - RNA, 13 nt, Mycobacterium avium subsp. paratuberculosis
cgccgagucgcgc

SEQ ID NO: 2913160 - RNA, 15 nt, Mycobacterium avium subsp. paratuberculosis
cgccgagucgcgccg

SEQ ID NO: 2913161 - RNA, 18 nt, Mycobacterium avium subsp. paratuberculosis
cgccgagucgcgccgcgu

SEQ ID NO: 2913162 - RNA, 17 nt, Mycobacterium avium subsp. paratuberculosis
cgccgaucaacaggccc

SEQ ID NO: 2913163 - RNA, 22 nt, Mycobacterium avium subsp. paratuberculosis
cgccgaucaacaggcccagcag

SEQ ID NO: 2913164 - RNA, 16 nt, Mycobacterium avium subsp. paratuberculosis
cgccgaucaccgcguu

SEQ ID NO: 2913165 - RNA, 15 nt, Mycobacterium avium subsp. paratuberculosis
cgccgaucaccggca

SEQ ID NO: 2913166 - RNA, 21 nt, Mycobacterium avium subsp. paratuberculosis
cgccgaucaccugacagaccc

SEQ ID NO: 2913167 - RNA, 12 nt, Mycobacterium avium subsp. paratuberculosis
cgccgaucacga

SEQ ID NO: 2913168 - RNA, 15 nt, Mycobacterium avium subsp. paratuberculosis
cgccgaucacgaaca

SEQ ID NO: 2913169 - RNA, 17 nt, Mycobacterium avium subsp. paratuberculosis
cgccgaucacgaacagg

SEQ ID NO: 2913170 - RNA, 14 nt, Mycobacterium avium subsp. paratuberculosis
cgccgaucacgccg

SEQ ID NO: 2913171 - RNA, 15 nt, Mycobacterium avium subsp. paratuberculosis
cgccgaucacgccgg

SEQ ID NO: 2913172 - RNA, 16 nt, Mycobacterium avium subsp. paratuberculosis
cgccgaucacgccggu

SEQ ID NO: 2913173 - RNA, 15 nt, Mycobacterium avium subsp. paratuberculosis
cgccgaucagcacca

SEQ ID NO: 2913174 - RNA, 17 nt, Mycobacterium avium subsp. paratuberculosis
cgccgaucagcaccagg

SEQ ID NO: 2913175 - RNA, 14 nt, Mycobacterium avium subsp. paratuberculosis
cgccgauccagccg

SEQ ID NO: 2913176 - RNA, 17 nt, Mycobacterium avium subsp. paratuberculosis
cgccgauccagccgucg

SEQ ID NO: 2913177 - RNA, 18 nt, Mycobacterium avium subsp. paratuberculosis
cgccgauccagccgucgu

SEQ ID NO: 2913178 - RNA, 14 nt, Mycobacterium avium subsp. paratuberculosis
cgccgauccgcagc

SEQ ID NO: 2913179 - RNA, 16 nt, Mycobacterium avium subsp. paratuberculosis
cgccgauccgcagccg

SEQ ID NO: 2913180 - RNA, 15 nt, Mycobacterium avium subsp. paratuberculosis
cgccgauccgcugcg

SEQ ID NO: 2913181 - RNA, 17 nt, Mycobacterium avium subsp. paratuberculosis
cgccgauccgcugcgga

SEQ ID NO: 2913182 - RNA, 16 nt, Mycobacterium avium subsp. paratuberculosis
cgccgauccggcgccg

SEQ ID NO: 2913183 - RNA, 17 nt, Mycobacterium avium subsp. paratuberculosis
cgccgauccggcgccgc

SEQ ID NO: 2913184 - RNA, 19 nt, Mycobacterium avium subsp. paratuberculosis
cgccgauccggcgccgcgg

SEQ ID NO: 2913185 - RNA, 14 nt, Mycobacterium avium subsp. paratuberculosis
cgccgauccggcuc

SEQ ID NO: 2913186 - RNA, 13 nt, Mycobacterium avium subsp. paratuberculosis
cgccgaucgagac

SEQ ID NO: 2913187 - RNA, 16 nt, Mycobacterium avium subsp. paratuberculosis
cgccgaucgagacgau

SEQ ID NO: 2913188 - RNA, 16 nt, Mycobacterium avium subsp. paratuberculosis
cgccgaucgaucagcc

SEQ ID NO: 2913189 - RNA, 19 nt, Mycobacterium avium subsp. paratuberculosis
cgccgaucgaucagccgcg

SEQ ID NO: 2913190 - RNA, 20 nt, Mycobacterium avium subsp. paratuberculosis
cgccgaucgaucagccgcga

SEQ ID NO: 2913191 - RNA, 15 nt, Mycobacterium avium subsp. paratuberculosis
cgccgaucgcccagu

SEQ ID NO: 2913192 - RNA, 13 nt, Mycobacterium avium subsp. paratuberculosis
cgccgaucgcccg

SEQ ID NO: 2913193 - RNA, 16 nt, Mycobacterium avium subsp. paratuberculosis
cgccgaucgcgcgcag

SEQ ID NO: 2913194 - RNA, 17 nt, Mycobacterium avium subsp. paratuberculosis
cgccgaucgcgcgcagg

SEQ ID NO: 2913195 - RNA, 15 nt, Mycobacterium avium subsp. paratuberculosis
cgccgaucgggaccg

SEQ ID NO: 2913196 - RNA, 23 nt, Mycobacterium avium subsp. paratuberculosis
cgccgaucgggaccgucaccgug

SEQ ID NO: 2913197 - RNA, 20 nt, Mycobacterium avium subsp. paratuberculosis
cgccgaucgugacgccgucc

SEQ ID NO: 2913198 - RNA, 17 nt, Mycobacterium avium subsp. paratuberculosis
cgccgaucucgaccagc

SEQ ID NO: 2913199 - RNA, 20 nt, Mycobacterium avium subsp. paratuberculosis
cgccgaucucgaccagcgcc

SEQ ID NO: 2913200 - RNA, 23 nt, Mycobacterium avium subsp. paratuberculosis
cgccgaucucgaccagcgccgag

SEQ ID NO: 2913201 - RNA, 12 nt, Mycobacterium avium subsp. paratuberculosis
cgccgaucucgg

SEQ ID NO: 2913202 - RNA, 15 nt, Mycobacterium avium subsp. paratuberculosis
cgccgaucucggcca

SEQ ID NO: 2913203 - RNA, 21 nt, Mycobacterium avium subsp. paratuberculosis
cgccgaucucggccaaccggg

SEQ ID NO: 2913204 - RNA, 16 nt, Mycobacterium avium subsp. paratuberculosis
cgccgaucugaccgag

SEQ ID NO: 2913205 - RNA, 17 nt, Mycobacterium avium subsp. paratuberculosis
cgccgaucugaccgagc

SEQ ID NO: 2913206 - RNA, 19 nt, Mycobacterium avium subsp. paratuberculosis
cgccgaucugaccgagcag

SEQ ID NO: 2913207 - RNA, 16 nt, Mycobacterium avium subsp. paratuberculosis
cgccgaucugcucggc

SEQ ID NO: 2913208 - RNA, 18 nt, Mycobacterium avium subsp. paratuberculosis
cgccgaucugcucggcug

SEQ ID NO: 2913209 - RNA, 14 nt, Mycobacterium avium subsp. paratuberculosis
cgccgaucuggcgc

SEQ ID NO: 2913210 - RNA, 20 nt, Mycobacterium avium subsp. paratuberculosis
cgccgaucuggcgcagcguc

SEQ ID NO: 2913211 - RNA, 14 nt, Mycobacterium avium subsp. paratuberculosis
cgccgaugacggcg

SEQ ID NO: 2913212 - RNA, 20 nt, Mycobacterium avium subsp. paratuberculosis
cgccgaugacguugcgcgcc

SEQ ID NO: 2913213 - RNA, 14 nt, Mycobacterium avium subsp. paratuberculosis
cgccgaugaucugg

SEQ ID NO: 2913214 - RNA, 12 nt, Mycobacterium avium subsp. paratuberculosis
cgccgaugcagc

SEQ ID NO: 2913215 - RNA, 19 nt, Mycobacterium avium subsp. paratuberculosis
cgccgaugcauuggugcac

SEQ ID NO: 2913216 - RNA, 20 nt, Mycobacterium avium subsp. paratuberculosis
cgccgaugcauuggugcacg

SEQ ID NO: 2913217 - RNA, 23 nt, Mycobacterium avium subsp. paratuberculosis
cgccgaugcauuggugcacgccg

SEQ ID NO: 2913218 - RNA, 14 nt, Mycobacterium avium subsp. paratuberculosis
cgccgaugcccgcc

SEQ ID NO: 2913219 - RNA, 17 nt, Mycobacterium avium subsp. paratuberculosis
cgccgaugccgaacguc

SEQ ID NO: 2913220 - RNA, 15 nt, Mycobacterium avium subsp. paratuberculosis
cgccgaugccgcgcu

SEQ ID NO: 2913221 - RNA, 17 nt, Mycobacterium avium subsp. paratuberculosis
cgccgaugccgcgcugc

SEQ ID NO: 2913222 - RNA, 14 nt, Mycobacterium avium subsp. paratuberculosis
cgccgaugcgcccg

SEQ ID NO: 2913223 - RNA, 19 nt, Mycobacterium avium subsp. paratuberculosis
cgccgaugcgcccgcugcg

SEQ ID NO: 2913224 - RNA, 13 nt, Mycobacterium avium subsp. paratuberculosis
cgccgaugcgccg

SEQ ID NO: 2913225 - RNA, 16 nt, Mycobacterium avium subsp. paratuberculosis
cgccgaugcgccgcac

SEQ ID NO: 2913226 - RNA, 17 nt, Mycobacterium avium subsp. paratuberculosis
cgccgaugcgccgcacc

SEQ ID NO: 2913227 - RNA, 18 nt, Mycobacterium avium subsp. paratuberculosis
cgccgaugcgccgcacca

SEQ ID NO: 2913228 - RNA, 20 nt, Mycobacterium avium subsp. paratuberculosis
cgccgaugcgguugaucaac

SEQ ID NO: 2913229 - RNA, 12 nt, Mycobacterium avium subsp. paratuberculosis
cgccgaugcuga

SEQ ID NO: 2913230 - RNA, 13 nt, Mycobacterium avium subsp. paratuberculosis
cgccgauggccug

SEQ ID NO: 2913231 - RNA, 15 nt, Mycobacterium avium subsp. paratuberculosis
cgccgauggccuggu

SEQ ID NO: 2913232 - RNA, 13 nt, Mycobacterium avium subsp. paratuberculosis
cgccgauggcgac

SEQ ID NO: 2913233 - RNA, 16 nt, Mycobacterium avium subsp. paratuberculosis
cgccgauggcgacggu

SEQ ID NO: 2913234 - RNA, 18 nt, Mycobacterium avium subsp. paratuberculosis
cgccgauggcgacggucu

SEQ ID NO: 2913235 - RNA, 21 nt, Mycobacterium avium subsp. paratuberculosis
cgccgauggcguucaucgucc

SEQ ID NO: 2913236 - RNA, 23 nt, Mycobacterium avium subsp. paratuberculosis
cgccgauggugaccucggucgau

SEQ ID NO: 2913237 - RNA, 14 nt, Mycobacterium avium subsp. paratuberculosis
cgccgauggugacg

SEQ ID NO: 2913238 - RNA, 23 nt, Mycobacterium avium subsp. paratuberculosis
cgccgauggugacggugccgccg

SEQ ID NO: 2913239 - RNA, 17 nt, Mycobacterium avium subsp. paratuberculosis
cgccgauguacuccugg

SEQ ID NO: 2913240 - RNA, 20 nt, Mycobacterium avium subsp. paratuberculosis
cgccgauguaguccagccca

SEQ ID NO: 2913241 - RNA, 17 nt, Mycobacterium avium subsp. paratuberculosis
cgccgauguccccgcgg

SEQ ID NO: 2913242 - RNA, 18 nt, Mycobacterium avium subsp. paratuberculosis
cgccgauguccccgcggg

SEQ ID NO: 2913243 - RNA, 19 nt, Mycobacterium avium subsp. paratuberculosis
cgccgauguccccgcgggu

SEQ ID NO: 2913244 - RNA, 20 nt, Mycobacterium avium subsp. paratuberculosis
cgccgauguccccgcgggug

SEQ ID NO: 2913245 - RNA, 15 nt, Mycobacterium avium subsp. paratuberculosis
cgccgaugucggccg

SEQ ID NO: 2913246 - RNA, 17 nt, Mycobacterium avium subsp. paratuberculosis
cgccgaugucggccggu

SEQ ID NO: 2913247 - RNA, 18 nt, Mycobacterium avium subsp. paratuberculosis
cgccgaugucggccgguc

SEQ ID NO: 2913248 - RNA, 19 nt, Mycobacterium avium subsp. paratuberculosis
cgccgaugucggccggucc

SEQ ID NO: 2913249 - RNA, 19 nt, Mycobacterium avium subsp. paratuberculosis
cgccgaugugaucggcggc

SEQ ID NO: 2913250 - RNA, 22 nt, Mycobacterium avium subsp. paratuberculosis
cgccgaugugaucggcggccac

SEQ ID NO: 2913251 - RNA, 23 nt, Mycobacterium avium subsp. paratuberculosis
cgccgaugugaucggcggccacc

SEQ ID NO: 2913252 - RNA, 18 nt, Mycobacterium avium subsp. paratuberculosis
cgccgaugugcucgguca

SEQ ID NO: 2913253 - RNA, 15 nt, Mycobacterium avium subsp. paratuberculosis
cgccgauguggccgg

SEQ ID NO: 2913254 - RNA, 18 nt, Mycobacterium avium subsp. paratuberculosis
cgccgauguggcgggcgu

SEQ ID NO: 2913255 - RNA, 19 nt, Mycobacterium avium subsp. paratuberculosis
cgccgauguggcgggcguc

SEQ ID NO: 2913256 - RNA, 20 nt, Mycobacterium avium subsp. paratuberculosis
cgccgauguggcgggcgucc

SEQ ID NO: 2913257 - RNA, 18 nt, Mycobacterium avium subsp. paratuberculosis
cgccgauguuuugggugc

SEQ ID NO: 2913258 - RNA, 17 nt, Mycobacterium avium subsp. paratuberculosis
cgccgauucaaccccgc

SEQ ID NO: 2913259 - RNA, 23 nt, Mycobacterium avium subsp. paratuberculosis
cgccgauucaaccccgcgcgcgg

SEQ ID NO: 2913260 - RNA, 16 nt, Mycobacterium avium subsp. paratuberculosis
cgccgauuccggccgg

SEQ ID NO: 2913261 - RNA, 17 nt, Mycobacterium avium subsp. paratuberculosis
cgccgauuccggccggc

SEQ ID NO: 2913262 - RNA, 18 nt, Mycobacterium avium subsp. paratuberculosis
cgccgauuccggccggcc

SEQ ID NO: 2913263 - RNA, 16 nt, Mycobacterium avium subsp. paratuberculosis
cgccgauuucgguguc

SEQ ID NO: 2913264 - RNA, 14 nt, Mycobacterium avium subsp. paratuberculosis
cgccgcaacagccg

SEQ ID NO: 2913265 - RNA, 17 nt, Mycobacterium avium subsp. paratuberculosis
cgccgcaacagccggcc

SEQ ID NO: 2913266 - RNA, 19 nt, Mycobacterium avium subsp. paratuberculosis
cgccgcaacagccggcccg

SEQ ID NO: 2913267 - RNA, 21 nt, Mycobacterium avium subsp. paratuberculosis
cgccgcaacagccggcccgag

SEQ ID NO: 2913268 - RNA, 22 nt, Mycobacterium avium subsp. paratuberculosis
cgccgcaacagguuucgcucgu

SEQ ID NO: 2913269 - RNA, 23 nt, Mycobacterium avium subsp. paratuberculosis
cgccgcaacagguuucgcucguc

SEQ ID NO: 2913270 - RNA, 23 nt, Mycobacterium avium subsp. paratuberculosis
cgccgcaaccgucaguucguaga

SEQ ID NO: 2913271 - RNA, 20 nt, Mycobacterium avium subsp. paratuberculosis
cgccgcaaccuucuuggccg

SEQ ID NO: 2913272 - RNA, 13 nt, Mycobacterium avium subsp. paratuberculosis
cgccgcaacggcg

SEQ ID NO: 2913273 - RNA, 15 nt, Mycobacterium avium subsp. paratuberculosis
cgccgcaacggcgca

SEQ ID NO: 2913274 - RNA, 23 nt, Mycobacterium avium subsp. paratuberculosis
cgccgcaacggcucccaggccca

SEQ ID NO: 2913275 - RNA, 19 nt, Mycobacterium avium subsp. paratuberculosis
cgccgcaacuugcccgacg

SEQ ID NO: 2913276 - RNA, 21 nt, Mycobacterium avium subsp. paratuberculosis
cgccgcaacuugcccgacggc

SEQ ID NO: 2913277 - RNA, 23 nt, Mycobacterium avium subsp. paratuberculosis
cgccgcaacuugcccgacggcgu

SEQ ID NO: 2913278 - RNA, 21 nt, Mycobacterium avium subsp. paratuberculosis
cgccgcaauacaccgcgaacu

SEQ ID NO: 2913279 - RNA, 14 nt, Mycobacterium avium subsp. paratuberculosis
cgccgcacacuucc

SEQ ID NO: 2913280 - RNA, 20 nt, Mycobacterium avium subsp. paratuberculosis
cgccgcacagccggcggcgg

SEQ ID NO: 2913281 - RNA, 21 nt, Mycobacterium avium subsp. paratuberculosis
cgccgcacagccggcggcggc

SEQ ID NO: 2913282 - RNA, 14 nt, Mycobacterium avium subsp. paratuberculosis
cgccgcacccagcg

SEQ ID NO: 2913283 - RNA, 16 nt, Mycobacterium avium subsp. paratuberculosis
cgccgcacccagcggg

SEQ ID NO: 2913284 - RNA, 17 nt, Mycobacterium avium subsp. paratuberculosis
cgccgcacccagcgggc

SEQ ID NO: 2913285 - RNA, 19 nt, Mycobacterium avium subsp. paratuberculosis
cgccgcacccagcgggcga

SEQ ID NO: 2913286 - RNA, 20 nt, Mycobacterium avium subsp. paratuberculosis
cgccgcacccagcgggcgac

SEQ ID NO: 2913287 - RNA, 23 nt, Mycobacterium avium subsp. paratuberculosis
cgccgcacccagcgggcgacguc

SEQ ID NO: 2913288 - RNA, 22 nt, Mycobacterium avium subsp. paratuberculosis
cgccgcaccgcaaagcaccgcg

SEQ ID NO: 2913289 - RNA, 14 nt, Mycobacterium avium subsp. paratuberculosis
cgccgcaccggccg

SEQ ID NO: 2913290 - RNA, 15 nt, Mycobacterium avium subsp. paratuberculosis
cgccgcaccggccgg

SEQ ID NO: 2913291 - RNA, 14 nt, Mycobacterium avium subsp. paratuberculosis
cgccgcaccgucgu

SEQ ID NO: 2913292 - RNA, 16 nt, Mycobacterium avium subsp. paratuberculosis
cgccgcaccgucgugc

SEQ ID NO: 2913293 - RNA, 15 nt, Mycobacterium avium subsp. paratuberculosis
cgccgcaccucgccg

SEQ ID NO: 2913294 - RNA, 21 nt, Mycobacterium avium subsp. paratuberculosis
cgccgcaccucgccgaucucg

SEQ ID NO: 2913295 - RNA, 20 nt, Mycobacterium avium subsp. paratuberculosis
cgccgcaccucgccggccgc

SEQ ID NO: 2913296 - RNA, 19 nt, Mycobacterium avium subsp. paratuberculosis
cgccgcacgaauugccggu

SEQ ID NO: 2913297 - RNA, 15 nt, Mycobacterium avium subsp. paratuberculosis
cgccgcacgcgaccg

SEQ ID NO: 2913298 - RNA, 23 nt, Mycobacterium avium subsp. paratuberculosis
cgccgcacguguucucacggcga

SEQ ID NO: 2913299 - RNA, 20 nt, Mycobacterium avium subsp. paratuberculosis
cgccgcacugcacggccucg

SEQ ID NO: 2913300 - RNA, 22 nt, Mycobacterium avium subsp. paratuberculosis
cgccgcacugcacggccucggu

SEQ ID NO: 2913301 - RNA, 21 nt, Mycobacterium avium subsp. paratuberculosis
cgccgcagaucagggcgaugg

SEQ ID NO: 2913302 - RNA, 12 nt, Mycobacterium avium subsp. paratuberculosis
cgccgcagcacg

SEQ ID NO: 2913303 - RNA, 14 nt, Mycobacterium avium subsp. paratuberculosis
cgccgcagcacgcu

SEQ ID NO: 2913304 - RNA, 18 nt, Mycobacterium avium subsp. paratuberculosis
cgccgcagcacgcugaag

SEQ ID NO: 2913305 - RNA, 21 nt, Mycobacterium avium subsp. paratuberculosis
cgccgcagcaggugcaucgcc

SEQ ID NO: 2913306 - RNA, 15 nt, Mycobacterium avium subsp. paratuberculosis
cgccgcagcccaggc

SEQ ID NO: 2913307 - RNA, 16 nt, Mycobacterium avium subsp. paratuberculosis
cgccgcagcccaggcc

SEQ ID NO: 2913308 - RNA, 18 nt, Mycobacterium avium subsp. paratuberculosis
cgccgcagcccaggccca

SEQ ID NO: 2913309 - RNA, 20 nt, Mycobacterium avium subsp. paratuberculosis
cgccgcagcccaggcccagc

SEQ ID NO: 2913310 - RNA, 23 nt, Mycobacterium avium subsp. paratuberculosis
cgccgcagcccaggcccagcagc

SEQ ID NO: 2913311 - RNA, 14 nt, Mycobacterium avium subsp. paratuberculosis
cgccgcagccuucu

SEQ ID NO: 2913312 - RNA, 18 nt, Mycobacterium avium subsp. paratuberculosis
cgccgcagcgcagcgucg

SEQ ID NO: 2913313 - RNA, 19 nt, Mycobacterium avium subsp. paratuberculosis
cgccgcagcgcagcgucgg

SEQ ID NO: 2913314 - RNA, 20 nt, Mycobacterium avium subsp. paratuberculosis
cgccgcagcgcagcgucggc

SEQ ID NO: 2913315 - RNA, 23 nt, Mycobacterium avium subsp. paratuberculosis
cgccgcagcgcagcgucggcgug

SEQ ID NO: 2913316 - RNA, 16 nt, Mycobacterium avium subsp. paratuberculosis
cgccgcagcgcgcgcu

SEQ ID NO: 2913317 - RNA, 20 nt, Mycobacterium avium subsp. paratuberculosis
cgccgcagcgcgcgcucggu

SEQ ID NO: 2913318 - RNA, 16 nt, Mycobacterium avium subsp. paratuberculosis
cgccgcagcggcgccg

SEQ ID NO: 2913319 - RNA, 18 nt, Mycobacterium avium subsp. paratuberculosis
cgccgcagcggcgccgca

SEQ ID NO: 2913320 - RNA, 22 nt, Mycobacterium avium subsp. paratuberculosis
cgccgcagcggugaucgcguca

SEQ ID NO: 2913321 - RNA, 12 nt, Mycobacterium avium subsp. paratuberculosis
cgccgcagcucg

SEQ ID NO: 2913322 - RNA, 20 nt, Mycobacterium avium subsp. paratuberculosis
cgccgcaggagaucggcgcg

SEQ ID NO: 2913323 - RNA, 22 nt, Mycobacterium avium subsp. paratuberculosis
cgccgcaggagaucggcgcgga

SEQ ID NO: 2913324 - RNA, 23 nt, Mycobacterium avium subsp. paratuberculosis
cgccgcauacaccuugucggcga

SEQ ID NO: 2913325 - RNA, 16 nt, Mycobacterium avium subsp. paratuberculosis
cgccgcauaccgcccg

SEQ ID NO: 2913326 - RNA, 17 nt, Mycobacterium avium subsp. paratuberculosis
cgccgcauaccgcccgc

SEQ ID NO: 2913327 - RNA, 20 nt, Mycobacterium avium subsp. paratuberculosis
cgccgcauaccgcccgcgcu

SEQ ID NO: 2913328 - RNA, 22 nt, Mycobacterium avium subsp. paratuberculosis
cgccgcauaccgcccgcgcugg

SEQ ID NO: 2913329 - RNA, 23 nt, Mycobacterium avium subsp. paratuberculosis
cgccgcauaccgcccgcgcuggu

SEQ ID NO: 2913330 - RNA, 18 nt, Mycobacterium avium subsp. paratuberculosis
cgccgcaugaugcggcca

SEQ ID NO: 2913331 - RNA, 19 nt, Mycobacterium avium subsp. paratuberculosis
cgccgcauuccucggccag

SEQ ID NO: 2913332 - RNA, 21 nt, Mycobacterium avium subsp. paratuberculosis
cgccgcauuccucggccagcu

SEQ ID NO: 2913333 - RNA, 13 nt, Mycobacterium avium subsp. paratuberculosis
cgccgcauuggca

SEQ ID NO: 2913334 - RNA, 16 nt, Mycobacterium avium subsp. paratuberculosis
cgccgcauuggcaccg

SEQ ID NO: 2913335 - RNA, 19 nt, Mycobacterium avium subsp. paratuberculosis
cgccgcauuggcaccgucg

SEQ ID NO: 2913336 - RNA, 21 nt, Mycobacterium avium subsp. paratuberculosis
cgccgcauuggcaccgucgac

SEQ ID NO: 2913337 - RNA, 23 nt, Mycobacterium avium subsp. paratuberculosis
cgccgcauuggcaccgucgaccu

SEQ ID NO: 2913338 - RNA, 15 nt, Mycobacterium avium subsp. paratuberculosis
cgccgcauuggugcc

SEQ ID NO: 2913339 - RNA, 17 nt, Mycobacterium avium subsp. paratuberculosis
cgccgcauuggugccgg

SEQ ID NO: 2913340 - RNA, 17 nt, Mycobacterium avium subsp. paratuberculosis
cgccgccaaccaggucg

SEQ ID NO: 2913341 - RNA, 21 nt, Mycobacterium avium subsp. paratuberculosis
cgccgccaaccaggucgcggc

SEQ ID NO: 2913342 - RNA, 23 nt, Mycobacterium avium subsp. paratuberculosis
cgccgccaaccaggucgcggcgc

SEQ ID NO: 2913343 - RNA, 21 nt, Mycobacterium avium subsp. paratuberculosis
cgccgccaacgcgaacgggua

SEQ ID NO: 2913344 - RNA, 22 nt, Mycobacterium avium subsp. paratuberculosis
cgccgccaaggggaacaacgcg

SEQ ID NO: 2913345 - RNA, 19 nt, Mycobacterium avium subsp. paratuberculosis
cgccgccacaccucggcga

SEQ ID NO: 2913346 - RNA, 21 nt, Mycobacterium avium subsp. paratuberculosis
cgccgccacaccucggcgacc

SEQ ID NO: 2913347 - RNA, 13 nt, Mycobacterium avium subsp. paratuberculosis
cgccgccaccacg

SEQ ID NO: 2913348 - RNA, 14 nt, Mycobacterium avium subsp. paratuberculosis
cgccgccaccacga

SEQ ID NO: 2913349 - RNA, 16 nt, Mycobacterium avium subsp. paratuberculosis
cgccgccaccccaggc

SEQ ID NO: 2913350 - RNA, 20 nt, Mycobacterium avium subsp. paratuberculosis
cgccgccaccccaggcgaug

SEQ ID NO: 2913351 - RNA, 12 nt, Mycobacterium avium subsp. paratuberculosis
cgccgccaccgg

SEQ ID NO: 2913352 - RNA, 18 nt, Mycobacterium avium subsp. paratuberculosis
cgccgccaccggccgguc

SEQ ID NO: 2913353 - RNA, 14 nt, Mycobacterium avium subsp. paratuberculosis
cgccgccaccgucg

SEQ ID NO: 2913354 - RNA, 19 nt, Mycobacterium avium subsp. paratuberculosis
cgccgccaccgucgccggc

SEQ ID NO: 2913355 - RNA, 14 nt, Mycobacterium avium subsp. paratuberculosis
cgccgccacgcggc

SEQ ID NO: 2913356 - RNA, 15 nt, Mycobacterium avium subsp. paratuberculosis
cgccgccacgcggcg

SEQ ID NO: 2913357 - RNA, 21 nt, Mycobacterium avium subsp. paratuberculosis
cgccgccacgcggcgcgcauc

SEQ ID NO: 2913358 - RNA, 19 nt, Mycobacterium avium subsp. paratuberculosis
cgccgccacggcacgucga

SEQ ID NO: 2913359 - RNA, 21 nt, Mycobacterium avium subsp. paratuberculosis
cgccgccagcaaccccgcggu

SEQ ID NO: 2913360 - RNA, 23 nt, Mycobacterium avium subsp. paratuberculosis
cgccgccagcaaccccgcggugc

SEQ ID NO: 2913361 - RNA, 24 nt, Mycobacterium avium subsp. paratuberculosis
cgccgccagcaaccccgcggugca

SEQ ID NO: 2913362 - RNA, 12 nt, Mycobacterium avium subsp. paratuberculosis
cgccgccagcac

SEQ ID NO: 2913363 - RNA, 15 nt, Mycobacterium avium subsp. paratuberculosis
cgccgccagcaccac

SEQ ID NO: 2913364 - RNA, 17 nt, Mycobacterium avium subsp. paratuberculosis
cgccgccagcaccaccg

SEQ ID NO: 2913365 - RNA, 23 nt, Mycobacterium avium subsp. paratuberculosis
cgccgccagcaccaccgucaccg

SEQ ID NO: 2913366 - RNA, 13 nt, Mycobacterium avium subsp. paratuberculosis
cgccgccagcacg

SEQ ID NO: 2913367 - RNA, 16 nt, Mycobacterium avium subsp. paratuberculosis
cgccgccagcacguga

SEQ ID NO: 2913368 - RNA, 13 nt, Mycobacterium avium subsp. paratuberculosis
cgccgccagcagc

SEQ ID NO: 2913369 - RNA, 14 nt, Mycobacterium avium subsp. paratuberculosis
cgccgccagcagca

SEQ ID NO: 2913370 - RNA, 19 nt, Mycobacterium avium subsp. paratuberculosis
cgccgccagcagcagcgcc

SEQ ID NO: 2913371 - RNA, 21 nt, Mycobacterium avium subsp. paratuberculosis
cgccgccagccagccggugcg

SEQ ID NO: 2913372 - RNA, 12 nt, Mycobacterium avium subsp. paratuberculosis
cgccgccagccg

SEQ ID NO: 2913373 - RNA, 15 nt, Mycobacterium avium subsp. paratuberculosis
cgccgccagccgcag

SEQ ID NO: 2913374 - RNA, 17 nt, Mycobacterium avium subsp. paratuberculosis
cgccgccagccgcagca

SEQ ID NO: 2913375 - RNA, 13 nt, Mycobacterium avium subsp. paratuberculosis
cgccgccagcgcc

SEQ ID NO: 2913376 - RNA, 14 nt, Mycobacterium avium subsp. paratuberculosis
cgccgccagcgcca

SEQ ID NO: 2913377 - RNA, 15 nt, Mycobacterium avium subsp. paratuberculosis
cgccgccagcgccac

SEQ ID NO: 2913378 - RNA, 18 nt, Mycobacterium avium subsp. paratuberculosis
cgccgccagcgccacccc

SEQ ID NO: 2913379 - RNA, 14 nt, Mycobacterium avium subsp. paratuberculosis
cgccgccagcgcgg

SEQ ID NO: 2913380 - RNA, 23 nt, Mycobacterium avium subsp. paratuberculosis
cgccgccagggcgcggcgcaccg

SEQ ID NO: 2913381 - RNA, 17 nt, Mycobacterium avium subsp. paratuberculosis
cgccgccauccgcgccg

SEQ ID NO: 2913382 - RNA, 18 nt, Mycobacterium avium subsp. paratuberculosis
cgccgccauccgcgccga

SEQ ID NO: 2913383 - RNA, 17 nt, Mycobacterium avium subsp. paratuberculosis
cgccgccauccguucgg

SEQ ID NO: 2913384 - RNA, 23 nt, Mycobacterium avium subsp. paratuberculosis
cgccgccauccguucggcucugc

SEQ ID NO: 2913385 - RNA, 16 nt, Mycobacterium avium subsp. paratuberculosis
cgccgccaucgccgcc

SEQ ID NO: 2913386 - RNA, 18 nt, Mycobacterium avium subsp. paratuberculosis
cgccgccaucgccgccgc

SEQ ID NO: 2913387 - RNA, 17 nt, Mycobacterium avium subsp. paratuberculosis
cgccgccaucuccuccg

SEQ ID NO: 2913388 - RNA, 19 nt, Mycobacterium avium subsp. paratuberculosis
cgccgcccacaccgacacc

SEQ ID NO: 2913389 - RNA, 13 nt, Mycobacterium avium subsp. paratuberculosis
cgccagcugggug

SEQ ID NO: 2913390 - RNA, 14 nt, Mycobacterium avium subsp. paratuberculosis
cgccagcugggugg

SEQ ID NO: 2913391 - RNA, 21 nt, Mycobacterium avium subsp. paratuberculosis
cgccaggaaccacaccccggc

SEQ ID NO: 2913392 - RNA, 23 nt, Mycobacterium avium subsp. paratuberculosis
cgccaggaaccacaccccggcca

SEQ ID NO: 2913393 - RNA, 19 nt, Mycobacterium avium subsp. paratuberculosis
cgccaggaauaacgccggc

SEQ ID NO: 2913394 - RNA, 20 nt, Mycobacterium avium subsp. paratuberculosis
cgccaggaauaacgccggcc

SEQ ID NO: 2913395 - RNA, 22 nt, Mycobacterium avium subsp. paratuberculosis
cgccaggaauaacgccggcccc

SEQ ID NO: 2913396 - RNA, 13 nt, Mycobacterium avium subsp. paratuberculosis
cgccaggaccacc

SEQ ID NO: 2913397 - RNA, 14 nt, Mycobacterium avium subsp. paratuberculosis
cgccaggaccaccc

SEQ ID NO: 2913398 - RNA, 22 nt, Mycobacterium avium subsp. paratuberculosis
cgccaggaccacccacucccag

SEQ ID NO: 2913399 - RNA, 23 nt, Mycobacterium avium subsp. paratuberculosis
cgccaggaccacccacucccagc

SEQ ID NO: 2913400 - RNA, 14 nt, Mycobacterium avium subsp. paratuberculosis
cgccaggaccagcg

SEQ ID NO: 2913401 - RNA, 18 nt, Mycobacterium avium subsp. paratuberculosis
cgccaggaccagcggguc

SEQ ID NO: 2913402 - RNA, 16 nt, Mycobacterium avium subsp. paratuberculosis
cgccaggauccgcccg

SEQ ID NO: 2913403 - RNA, 18 nt, Mycobacterium avium subsp. paratuberculosis
cgccaggauccgcccgcc

SEQ ID NO: 2913404 - RNA, 19 nt, Mycobacterium avium subsp. paratuberculosis
cgccaggauccgcccgccg

SEQ ID NO: 2913405 - RNA, 20 nt, Mycobacterium avium subsp. paratuberculosis
cgccaggauccgcccgccgg

SEQ ID NO: 2913406 - RNA, 21 nt, Mycobacterium avium subsp. paratuberculosis
cgccaggauccgcccgccggu

SEQ ID NO: 2913407 - RNA, 23 nt, Mycobacterium avium subsp. paratuberculosis
cgccaggauccgcccgccggugg

SEQ ID NO: 2913408 - RNA, 18 nt, Mycobacterium avium subsp. paratuberculosis
cgccaggaucugcucggc

SEQ ID NO: 2913409 - RNA, 19 nt, Mycobacterium avium subsp. paratuberculosis
cgccaggauguacccgcag

SEQ ID NO: 2913410 - RNA, 19 nt, Mycobacterium avium subsp. paratuberculosis
cgccaggaugucguccucg

SEQ ID NO: 2913411 - RNA, 17 nt, Mycobacterium avium subsp. paratuberculosis
cgccaggcaggcggcca

SEQ ID NO: 2913412 - RNA, 23 nt, Mycobacterium avium subsp. paratuberculosis
cgccaggcaggcggccagggcgg

SEQ ID NO: 2913413 - RNA, 13 nt, Mycobacterium avium subsp. paratuberculosis
cgccaggccaccg

SEQ ID NO: 2913414 - RNA, 15 nt, Mycobacterium avium subsp. paratuberculosis
cgccaggccggcgac

SEQ ID NO: 2913415 - RNA, 17 nt, Mycobacterium avium subsp. paratuberculosis
cgccaggccggcgacgc

SEQ ID NO: 2913416 - RNA, 19 nt, Mycobacterium avium subsp. paratuberculosis
cgccaggccggcgacgccg

SEQ ID NO: 2913417 - RNA, 20 nt, Mycobacterium avium subsp. paratuberculosis
cgccaggccggcgacgccgg

SEQ ID NO: 2913418 - RNA, 22 nt, Mycobacterium avium subsp. paratuberculosis
cgccaggccggcgacgccggcg

SEQ ID NO: 2913419 - RNA, 13 nt, Mycobacterium avium subsp. paratuberculosis
cgccaggcggcga

SEQ ID NO: 2913420 - RNA, 14 nt, Mycobacterium avium subsp. paratuberculosis
cgccaggcggcgac

SEQ ID NO: 2913421 - RNA, 16 nt, Mycobacterium avium subsp. paratuberculosis
cgccaggcggcgacga

SEQ ID NO: 2913422 - RNA, 20 nt, Mycobacterium avium subsp. paratuberculosis
cgccaggcggcgacgaacgc

SEQ ID NO: 2913423 - RNA, 13 nt, Mycobacterium avium subsp. paratuberculosis
cgccaggcuggcc

SEQ ID NO: 2913424 - RNA, 14 nt, Mycobacterium avium subsp. paratuberculosis
cgccaggcuggcca

SEQ ID NO: 2913425 - RNA, 15 nt, Mycobacterium avium subsp. paratuberculosis
cgccaggcuggccag

SEQ ID NO: 2913426 - RNA, 22 nt, Mycobacterium avium subsp. paratuberculosis
cgccagggccagguucaggccc

SEQ ID NO: 2913427 - RNA, 13 nt, Mycobacterium avium subsp. paratuberculosis
cgccagggccccg

SEQ ID NO: 2913428 - RNA, 17 nt, Mycobacterium avium subsp. paratuberculosis
cgccagggccccguugg

SEQ ID NO: 2913429 - RNA, 19 nt, Mycobacterium avium subsp. paratuberculosis
cgccagggccccguuggug

SEQ ID NO: 2913430 - RNA, 16 nt, Mycobacterium avium subsp. paratuberculosis
cgccagggcgacgccg

SEQ ID NO: 2913431 - RNA, 18 nt, Mycobacterium avium subsp. paratuberculosis
cgccagggcgacgccgcg

SEQ ID NO: 2913432 - RNA, 19 nt, Mycobacterium avium subsp. paratuberculosis
cgccagggcgacgccgcgg

SEQ ID NO: 2913433 - RNA, 20 nt, Mycobacterium avium subsp. paratuberculosis
cgccagggcgacgccgcgga

SEQ ID NO: 2913434 - RNA, 13 nt, Mycobacterium avium subsp. paratuberculosis
cgccagggcgcgg

SEQ ID NO: 2913435 - RNA, 17 nt, Mycobacterium avium subsp. paratuberculosis
cgccagggcgcggcgca

SEQ ID NO: 2913436 - RNA, 22 nt, Mycobacterium avium subsp. paratuberculosis
cgccagggcgcggcgcaccgag

SEQ ID NO: 2913437 - RNA, 20 nt, Mycobacterium avium subsp. paratuberculosis
cgccagggucucgggcagca

SEQ ID NO: 2913438 - RNA, 22 nt, Mycobacterium avium subsp. paratuberculosis
cgccagggucucgggcagcagc

SEQ ID NO: 2913439 - RNA, 21 nt, Mycobacterium avium subsp. paratuberculosis
cgccagggucuggcccggugc

SEQ ID NO: 2913440 - RNA, 22 nt, Mycobacterium avium subsp. paratuberculosis
cgccagggucuggcccggugcg

SEQ ID NO: 2913441 - RNA, 16 nt, Mycobacterium avium subsp. paratuberculosis
cgccagggugccccgc

SEQ ID NO: 2913442 - RNA, 19 nt, Mycobacterium avium subsp. paratuberculosis
cgccagggugccccgcacc

SEQ ID NO: 2913443 - RNA, 21 nt, Mycobacterium avium subsp. paratuberculosis
cgccagggugccgcugcccgc

SEQ ID NO: 2913444 - RNA, 17 nt, Mycobacterium avium subsp. paratuberculosis
cgccaggucggggcccg

SEQ ID NO: 2913445 - RNA, 19 nt, Mycobacterium avium subsp. paratuberculosis
cgccaggucggggcccguc

SEQ ID NO: 2913446 - RNA, 19 nt, Mycobacterium avium subsp. paratuberculosis
cgccaggucgggguccagg

SEQ ID NO: 2913447 - RNA, 15 nt, Mycobacterium avium subsp. paratuberculosis
cgccagguuggcggc

SEQ ID NO: 2913448 - RNA, 19 nt, Mycobacterium avium subsp. paratuberculosis
cgccagguuggcggcggcc

SEQ ID NO: 2913449 - RNA, 20 nt, Mycobacterium avium subsp. paratuberculosis
cgccagguuggcggcggccc

SEQ ID NO: 2913450 - RNA, 21 nt, Mycobacterium avium subsp. paratuberculosis
cgccagguuggcggcggcccg

SEQ ID NO: 2913451 - RNA, 22 nt, Mycobacterium avium subsp. paratuberculosis
cgccagguuggcggcggcccgc

SEQ ID NO: 2913452 - RNA, 18 nt, Mycobacterium avium subsp. paratuberculosis
cgccaguaguggaucagc

SEQ ID NO: 2913453 - RNA, 13 nt, Mycobacterium avium subsp. paratuberculosis
cgccaguccggcg

SEQ ID NO: 2913454 - RNA, 21 nt, Mycobacterium avium subsp. paratuberculosis
cgccaguccggcgccgacccc

SEQ ID NO: 2913455 - RNA, 14 nt, Mycobacterium avium subsp. paratuberculosis
cgccagucgcggcg

SEQ ID NO: 2913456 - RNA, 23 nt, Mycobacterium avium subsp. paratuberculosis
cgccagucgcggcgaaccagcau

SEQ ID NO: 2913457 - RNA, 14 nt, Mycobacterium avium subsp. paratuberculosis
cgccagugccgcgc

SEQ ID NO: 2913458 - RNA, 19 nt, Mycobacterium avium subsp. paratuberculosis
cgccagugccgcgcggacg

SEQ ID NO: 2913459 - RNA, 16 nt, Mycobacterium avium subsp. paratuberculosis
cgccaguggcugcacg

SEQ ID NO: 2913460 - RNA, 16 nt, Mycobacterium avium subsp. paratuberculosis
cgccaguguggccgcg

SEQ ID NO: 2913461 - RNA, 14 nt, Mycobacterium avium subsp. paratuberculosis
cgccaguucccggc

SEQ ID NO: 2913462 - RNA, 16 nt, Mycobacterium avium subsp. paratuberculosis
cgccaguucccggcca

SEQ ID NO: 2913463 - RNA, 15 nt, Mycobacterium avium subsp. paratuberculosis
cgccaguucgucggc

SEQ ID NO: 2913464 - RNA, 17 nt, Mycobacterium avium subsp. paratuberculosis
cgccaguucgucggccg

SEQ ID NO: 2913465 - RNA, 20 nt, Mycobacterium avium subsp. paratuberculosis
cgccaguucgucggccgucg

SEQ ID NO: 2913466 - RNA, 23 nt, Mycobacterium avium subsp. paratuberculosis
cgccaguucgucggccgucggcg

SEQ ID NO: 2913467 - RNA, 21 nt, Mycobacterium avium subsp. paratuberculosis
cgccaguugcacuuucggcag

SEQ ID NO: 2913468 - RNA, 22 nt, Mycobacterium avium subsp. paratuberculosis
cgccaguugcacuuucggcagc

SEQ ID NO: 2913469 - RNA, 16 nt, Mycobacterium avium subsp. paratuberculosis
cgccaguugcucgggu

SEQ ID NO: 2913470 - RNA, 23 nt, Mycobacterium avium subsp. paratuberculosis
cgccaguugcucgggugacgccu

SEQ ID NO: 2913471 - RNA, 17 nt, Mycobacterium avium subsp. paratuberculosis
cgccaguuugccgucgg

SEQ ID NO: 2913472 - RNA, 22 nt, Mycobacterium avium subsp. paratuberculosis
cgccaucaaccgauuucggcca

SEQ ID NO: 2913473 - RNA, 24 nt, Mycobacterium avium subsp. paratuberculosis
cgccaucaaccgauuucggccagc

SEQ ID NO: 2913474 - RNA, 14 nt, Mycobacterium avium subsp. paratuberculosis
cgccaucaccagcg

SEQ ID NO: 2913475 - RNA, 17 nt, Mycobacterium avium subsp. paratuberculosis
cgccaucaccagcgcgu

SEQ ID NO: 2913476 - RNA, 13 nt, Mycobacterium avium subsp. paratuberculosis
cgccaucaccgcg

SEQ ID NO: 2913477 - RNA, 14 nt, Mycobacterium avium subsp. paratuberculosis
cgccaucaccgcgc

SEQ ID NO: 2913478 - RNA, 15 nt, Mycobacterium avium subsp. paratuberculosis
cgccaucaccgcgcu

SEQ ID NO: 2913479 - RNA, 13 nt, Mycobacterium avium subsp. paratuberculosis
cgccaucagcacc

SEQ ID NO: 2913480 - RNA, 14 nt, Mycobacterium avium subsp. paratuberculosis
cgccaucagcagcg

SEQ ID NO: 2913481 - RNA, 16 nt, Mycobacterium avium subsp. paratuberculosis
cgccaucagcagcgcc

SEQ ID NO: 2913482 - RNA, 17 nt, Mycobacterium avium subsp. paratuberculosis
cgccaucagcagcgccu

SEQ ID NO: 2913483 - RNA, 18 nt, Mycobacterium avium subsp. paratuberculosis
cgccaucagcagcgccuc

SEQ ID NO: 2913484 - RNA, 21 nt, Mycobacterium avium subsp. paratuberculosis
cgccauccccgcuucggcucg

SEQ ID NO: 2913485 - RNA, 15 nt, Mycobacterium avium subsp. paratuberculosis
cgccauccgcagccc

SEQ ID NO: 2913486 - RNA, 18 nt, Mycobacterium avium subsp. paratuberculosis
cgccauccgcagcccguc

SEQ ID NO: 2913487 - RNA, 13 nt, Mycobacterium avium subsp. paratuberculosis
cgccauccgccac

SEQ ID NO: 2913488 - RNA, 14 nt, Mycobacterium avium subsp. paratuberculosis
cgccauccgccacc

SEQ ID NO: 2913489 - RNA, 17 nt, Mycobacterium avium subsp. paratuberculosis
cgccauccgccacccgc

SEQ ID NO: 2913490 - RNA, 15 nt, Mycobacterium avium subsp. paratuberculosis
cgccauccguucggc

SEQ ID NO: 2913491 - RNA, 18 nt, Mycobacterium avium subsp. paratuberculosis
cgccauccugucauccgu

SEQ ID NO: 2913492 - RNA, 18 nt, Mycobacterium avium subsp. paratuberculosis
cgccaucgaucgggcguc

SEQ ID NO: 2913493 - RNA, 19 nt, Mycobacterium avium subsp. paratuberculosis
cgccaucgaucgggcgucg

SEQ ID NO: 2913494 - RNA, 20 nt, Mycobacterium avium subsp. paratuberculosis
cgccaucgaucgggcgucgc

SEQ ID NO: 2913495 - RNA, 19 nt, Mycobacterium avium subsp. paratuberculosis
cgccaucgcaccgcgagca

SEQ ID NO: 2913496 - RNA, 17 nt, Mycobacterium avium subsp. paratuberculosis
cgccaucgcccggugcg

SEQ ID NO: 2913497 - RNA, 14 nt, Mycobacterium avium subsp. paratuberculosis
cgccaucgccgccg

SEQ ID NO: 2913498 - RNA, 14 nt, Mycobacterium avium subsp. paratuberculosis
cgccaucgccucgg

SEQ ID NO: 2913499 - RNA, 18 nt, Mycobacterium avium subsp. paratuberculosis
cgccaucgccucggccac

SEQ ID NO: 2913500 - RNA, 19 nt, Mycobacterium avium subsp. paratuberculosis
cgccaucgccucggccacc

SEQ ID NO: 2913501 - RNA, 13 nt, Mycobacterium avium subsp. paratuberculosis
cgccaucgcggcg

SEQ ID NO: 2913502 - RNA, 14 nt, Mycobacterium avium subsp. paratuberculosis
cgccaucgcggcgu

SEQ ID NO: 2913503 - RNA, 17 nt, Mycobacterium avium subsp. paratuberculosis
cgccaucgcggcguugu

SEQ ID NO: 2913504 - RNA, 21 nt, Mycobacterium avium subsp. paratuberculosis
cgccaucgcggcguuguggcc

SEQ ID NO: 2913505 - RNA, 23 nt, Mycobacterium avium subsp. paratuberculosis
cgccaucggcaucgcgcgcggcg

SEQ ID NO: 2913506 - RNA, 14 nt, Mycobacterium avium subsp. paratuberculosis
cgccaucguggccg

SEQ ID NO: 2913507 - RNA, 16 nt, Mycobacterium avium subsp. paratuberculosis
cgccaucguggccgcg

SEQ ID NO: 2913508 - RNA, 14 nt, Mycobacterium avium subsp. paratuberculosis
cgcccacgccggug

SEQ ID NO: 2913509 - RNA, 15 nt, Mycobacterium avium subsp. paratuberculosis
cgcccacgccggugg

SEQ ID NO: 2913510 - RNA, 13 nt, Mycobacterium avium subsp. paratuberculosis
cgcccacggccac

SEQ ID NO: 2913511 - RNA, 17 nt, Mycobacterium avium subsp. paratuberculosis
cgcccacggccaccacg

SEQ ID NO: 2913512 - RNA, 13 nt, Mycobacterium avium subsp. paratuberculosis
cgcccacgggucg

SEQ ID NO: 2913513 - RNA, 20 nt, Mycobacterium avium subsp. paratuberculosis
cgcccacguaggggcccggg

SEQ ID NO: 2913514 - RNA, 22 nt, Mycobacterium avium subsp. paratuberculosis
cgcccacguaggggcccggguu

SEQ ID NO: 2913515 - RNA, 23 nt, Mycobacterium avium subsp. paratuberculosis
cgcccacguaggggcccggguug

SEQ ID NO: 2913516 - RNA, 21 nt, Mycobacterium avium subsp. paratuberculosis
cgcccacugguaaccgcccga

SEQ ID NO: 2913517 - RNA, 14 nt, Mycobacterium avium subsp. paratuberculosis
cgcccacuggucgu

SEQ ID NO: 2913518 - RNA, 17 nt, Mycobacterium avium subsp. paratuberculosis
cgcccacuggucguugc

SEQ ID NO: 2913519 - RNA, 16 nt, Mycobacterium avium subsp. paratuberculosis
cgcccagaacgacgcg

SEQ ID NO: 2913520 - RNA, 19 nt, Mycobacterium avium subsp. paratuberculosis
cgcccagaacgacgcgcuc

SEQ ID NO: 2913521 - RNA, 18 nt, Mycobacterium avium subsp. paratuberculosis
cgcccagaacugggccgc

SEQ ID NO: 2913522 - RNA, 23 nt, Mycobacterium avium subsp. paratuberculosis
cgcccagaacugggccgccgucg

SEQ ID NO: 2913523 - RNA, 17 nt, Mycobacterium avium subsp. paratuberculosis
cgcccagaagccccggu

SEQ ID NO: 2913524 - RNA, 19 nt, Mycobacterium avium subsp. paratuberculosis
cgcccagacgcgggcgccc

SEQ ID NO: 2913525 - RNA, 22 nt, Mycobacterium avium subsp. paratuberculosis
cgcccagacgcgggcgcccagc

SEQ ID NO: 2913526 - RNA, 23 nt, Mycobacterium avium subsp. paratuberculosis
cgcccagacgcgggcgcccagca

SEQ ID NO: 2913527 - RNA, 18 nt, Mycobacterium avium subsp. paratuberculosis
cgcccagaucgacgccga

SEQ ID NO: 2913528 - RNA, 21 nt, Mycobacterium avium subsp. paratuberculosis
cgcccagaucgacgccgaccg

SEQ ID NO: 2913529 - RNA, 16 nt, Mycobacterium avium subsp. paratuberculosis
cgcccagaucgccgac

SEQ ID NO: 2913530 - RNA, 18 nt, Mycobacterium avium subsp. paratuberculosis
cgcccagaucgccgaccc

SEQ ID NO: 2913531 - RNA, 16 nt, Mycobacterium avium subsp. paratuberculosis
cgcccagaucggccag

SEQ ID NO: 2913532 - RNA, 14 nt, Mycobacterium avium subsp. paratuberculosis
cgcccagaugcagg

SEQ ID NO: 2913533 - RNA, 16 nt, Mycobacterium avium subsp. paratuberculosis
cgcccagaugccgccg

SEQ ID NO: 2913534 - RNA, 19 nt, Mycobacterium avium subsp. paratuberculosis
cgcccagaugccgccgcca

SEQ ID NO: 2913535 - RNA, 21 nt, Mycobacterium avium subsp. paratuberculosis
cgcccagaugccgccgccagc

SEQ ID NO: 2913536 - RNA, 15 nt, Mycobacterium avium subsp. paratuberculosis
cgcccagaugccggc

SEQ ID NO: 2913537 - RNA, 17 nt, Mycobacterium avium subsp. paratuberculosis
cgcccagaugccggcgu

SEQ ID NO: 2913538 - RNA, 20 nt, Mycobacterium avium subsp. paratuberculosis
cgcccagaugccggcguagc

SEQ ID NO: 2913539 - RNA, 20 nt, Mycobacterium avium subsp. paratuberculosis
cgcccagcaaacccagcacc

SEQ ID NO: 2913540 - RNA, 24 nt, Mycobacterium avium subsp. paratuberculosis
cgcccagcaaacccagcaccaaca

SEQ ID NO: 2913541 - RNA, 15 nt, Mycobacterium avium subsp. paratuberculosis
cgcccagcacccggu

SEQ ID NO: 2913542 - RNA, 21 nt, Mycobacterium avium subsp. paratuberculosis
cgcccagcacccgguuccacc

SEQ ID NO: 2913543 - RNA, 23 nt, Mycobacterium avium subsp. paratuberculosis
cgcccagcacccgguuccaccgg

SEQ ID NO: 2913544 - RNA, 12 nt, Mycobacterium avium subsp. paratuberculosis
cgcccagcaccg

SEQ ID NO: 2913545 - RNA, 13 nt, Mycobacterium avium subsp. paratuberculosis
cgcccagcaccga

SEQ ID NO: 2913546 - RNA, 14 nt, Mycobacterium avium subsp. paratuberculosis
cgcccagcaccgcg

SEQ ID NO: 2913547 - RNA, 20 nt, Mycobacterium avium subsp. paratuberculosis
cgcccagcaccgucugcgcc

SEQ ID NO: 2913548 - RNA, 19 nt, Mycobacterium avium subsp. paratuberculosis
cgcccagcacgucaccgcu

SEQ ID NO: 2913549 - RNA, 17 nt, Mycobacterium avium subsp. paratuberculosis
cgcccagcagcccggcc

SEQ ID NO: 2913550 - RNA, 18 nt, Mycobacterium avium subsp. paratuberculosis
cgcccagcagcccggcca

SEQ ID NO: 2913551 - RNA, 19 nt, Mycobacterium avium subsp. paratuberculosis
cgcccagcagcccggccag

SEQ ID NO: 2913552 - RNA, 20 nt, Mycobacterium avium subsp. paratuberculosis
cgcccagcagcccggccagc

SEQ ID NO: 2913553 - RNA, 22 nt, Mycobacterium avium subsp. paratuberculosis
cgcccagcagcccggccagccg

SEQ ID NO: 2913554 - RNA, 20 nt, Mycobacterium avium subsp. paratuberculosis
cgcccagcagccgcgccgac

SEQ ID NO: 2913555 - RNA, 21 nt, Mycobacterium avium subsp. paratuberculosis
cgcccagcagccgcgccgacg

SEQ ID NO: 2913556 - RNA, 15 nt, Mycobacterium avium subsp. paratuberculosis
cgcccagcagcgggc

SEQ ID NO: 2913557 - RNA, 23 nt, Mycobacterium avium subsp. paratuberculosis
cgcccagcagcgggcccgggcug

SEQ ID NO: 2913558 - RNA, 21 nt, Mycobacterium avium subsp. paratuberculosis
cgcccagcagcugcgcgucga

SEQ ID NO: 2913559 - RNA, 23 nt, Mycobacterium avium subsp. paratuberculosis
cgcccagcagcugcgcgucgaag

SEQ ID NO: 2913560 - RNA, 19 nt, Mycobacterium avium subsp. paratuberculosis
cgcccagcaucgccgcgac

SEQ ID NO: 2913561 - RNA, 14 nt, Mycobacterium avium subsp. paratuberculosis
cgcccagccccagc

SEQ ID NO: 2913562 - RNA, 12 nt, Mycobacterium avium subsp. paratuberculosis
cgcccagcccga

SEQ ID NO: 2913563 - RNA, 16 nt, Mycobacterium avium subsp. paratuberculosis
cgcccagcccgagcac

SEQ ID NO: 2913564 - RNA, 17 nt, Mycobacterium avium subsp. paratuberculosis
cgcccagcccgagcacc

SEQ ID NO: 2913565 - RNA, 20 nt, Mycobacterium avium subsp. paratuberculosis
cgcccagcccgagcaccagc

SEQ ID NO: 2913566 - RNA, 22 nt, Mycobacterium avium subsp. paratuberculosis
cgcccagcccgagcaccagcgg

SEQ ID NO: 2913567 - RNA, 17 nt, Mycobacterium avium subsp. paratuberculosis
cgcccagcccgcgccga

SEQ ID NO: 2913568 - RNA, 15 nt, Mycobacterium avium subsp. paratuberculosis
cgcccagcccgcggg

SEQ ID NO: 2913569 - RNA, 17 nt, Mycobacterium avium subsp. paratuberculosis
cgcccagcccgcgggcg

SEQ ID NO: 2913570 - RNA, 19 nt, Mycobacterium avium subsp. paratuberculosis
cgcccagcccgcgggcggc

SEQ ID NO: 2913571 - RNA, 14 nt, Mycobacterium avium subsp. paratuberculosis
cgcccagccgagcc

SEQ ID NO: 2913572 - RNA, 15 nt, Mycobacterium avium subsp. paratuberculosis
cgcccagccgagccg

SEQ ID NO: 2913573 - RNA, 16 nt, Mycobacterium avium subsp. paratuberculosis
cgcccagccgagccgg

SEQ ID NO: 2913574 - RNA, 17 nt, Mycobacterium avium subsp. paratuberculosis
cgcccagccgagccggg

SEQ ID NO: 2913575 - RNA, 13 nt, Mycobacterium avium subsp. paratuberculosis
cgcccagccggcg

SEQ ID NO: 2913576 - RNA, 14 nt, Mycobacterium avium subsp. paratuberculosis
cgcccagccggcgg

SEQ ID NO: 2913577 - RNA, 19 nt, Mycobacterium avium subsp. paratuberculosis
cgcccagcgacucggccag

SEQ ID NO: 2913578 - RNA, 23 nt, Mycobacterium avium subsp. paratuberculosis
cgcccagcgacucggccaggaug

SEQ ID NO: 2913579 - RNA, 14 nt, Mycobacterium avium subsp. paratuberculosis
cgcccagcgagcug

SEQ ID NO: 2913580 - RNA, 22 nt, Mycobacterium avium subsp. paratuberculosis
cgcccagcgagcugccggcggc

SEQ ID NO: 2913581 - RNA, 14 nt, Mycobacterium avium subsp. paratuberculosis
cgcccagcgcagca

SEQ ID NO: 2913582 - RNA, 20 nt, Mycobacterium avium subsp. paratuberculosis
cgcccagcgcagcaucggca

SEQ ID NO: 2913583 - RNA, 21 nt, Mycobacterium avium subsp. paratuberculosis
cgcccagcgcagcgccucggc

SEQ ID NO: 2913584 - RNA, 22 nt, Mycobacterium avium subsp. paratuberculosis
cgcccagcgcagcgccucggcg

SEQ ID NO: 2913585 - RNA, 20 nt, Mycobacterium avium subsp. paratuberculosis
cgcccagcgcauccaccagg

SEQ ID NO: 2913586 - RNA, 12 nt, Mycobacterium avium subsp. paratuberculosis
cgcccagcgcca

SEQ ID NO: 2913587 - RNA, 16 nt, Mycobacterium avium subsp. paratuberculosis
cgcccagcgccacggu

SEQ ID NO: 2913588 - RNA, 15 nt, Mycobacterium avium subsp. paratuberculosis
cgcccagcgccgcgg

SEQ ID NO: 2913589 - RNA, 16 nt, Mycobacterium avium subsp. paratuberculosis
cgcccagcgccgcggc

SEQ ID NO: 2913590 - RNA, 19 nt, Mycobacterium avium subsp. paratuberculosis
cgcccagcgccgcggcgaa

SEQ ID NO: 2913591 - RNA, 15 nt, Mycobacterium avium subsp. paratuberculosis
cgcccagcgccgcgu

SEQ ID NO: 2913592 - RNA, 14 nt, Mycobacterium avium subsp. paratuberculosis
cgccccagcccggc

SEQ ID NO: 2913593 - RNA, 21 nt, Mycobacterium avium subsp. paratuberculosis
cgccccagcccggcuggcagg

SEQ ID NO: 2913594 - RNA, 17 nt, Mycobacterium avium subsp. paratuberculosis
cgccccagccgaccagu

SEQ ID NO: 2913595 - RNA, 12 nt, Mycobacterium avium subsp. paratuberculosis
cgccccagcucc

SEQ ID NO: 2913596 - RNA, 16 nt, Mycobacterium avium subsp. paratuberculosis
cgccccagcuccucgg

SEQ ID NO: 2913597 - RNA, 12 nt, Mycobacterium avium subsp. paratuberculosis
cgccccaggcgc

SEQ ID NO: 2913598 - RNA, 15 nt, Mycobacterium avium subsp. paratuberculosis
cgccccagggccucg

SEQ ID NO: 2913599 - RNA, 18 nt, Mycobacterium avium subsp. paratuberculosis
cgccccagggccucggcg

SEQ ID NO: 2913600 - RNA, 19 nt, Mycobacterium avium subsp. paratuberculosis
cgccccagggccucggcga

SEQ ID NO: 2913601 - RNA, 20 nt, Mycobacterium avium subsp. paratuberculosis
cgccccagggccucggcgac

SEQ ID NO: 2913602 - RNA, 21 nt, Mycobacterium avium subsp. paratuberculosis
cgccccagggccucggcgacc

SEQ ID NO: 2913603 - RNA, 21 nt, Mycobacterium avium subsp. paratuberculosis
cgccccagguuccggugucga

SEQ ID NO: 2913604 - RNA, 17 nt, Mycobacterium avium subsp. paratuberculosis
cgccccaguuggcgucg

SEQ ID NO: 2913605 - RNA, 21 nt, Mycobacterium avium subsp. paratuberculosis
cgccccaguuggcgucgucgg

SEQ ID NO: 2913606 - RNA, 24 nt, Mycobacterium avium subsp. paratuberculosis
cgccccaguuggcgucgucggcgg

SEQ ID NO: 2913607 - RNA, 19 nt, Mycobacterium avium subsp. paratuberculosis
cgccccauugccgcgccgg

SEQ ID NO: 2913608 - RNA, 23 nt, Mycobacterium avium subsp. paratuberculosis
cgccccauugccgcgccggggug

SEQ ID NO: 2913609 - RNA, 14 nt, Mycobacterium avium subsp. paratuberculosis
cgcccccagcgggg

SEQ ID NO: 2913610 - RNA, 13 nt, Mycobacterium avium subsp. paratuberculosis
cgcccccgacagg

SEQ ID NO: 2913611 - RNA, 14 nt, Mycobacterium avium subsp. paratuberculosis
cgcccccgacaggc

SEQ ID NO: 2913612 - RNA, 23 nt, Mycobacterium avium subsp. paratuberculosis
cgcccccgauagccccgccaggc

SEQ ID NO: 2913613 - RNA, 12 nt, Mycobacterium avium subsp. paratuberculosis
cgcccccgccca

SEQ ID NO: 2913614 - RNA, 14 nt, Mycobacterium avium subsp. paratuberculosis
cgcccccgccgcga

SEQ ID NO: 2913615 - RNA, 23 nt, Mycobacterium avium subsp. paratuberculosis
cgcccccgcgacguccaucggga

SEQ ID NO: 2913616 - RNA, 13 nt, Mycobacterium avium subsp. paratuberculosis
cgcccccgcggcg

SEQ ID NO: 2913617 - RNA, 15 nt, Mycobacterium avium subsp. paratuberculosis
cgcccccgcggcggc

SEQ ID NO: 2913618 - RNA, 20 nt, Mycobacterium avium subsp. paratuberculosis
cgcccccgcggcggccaucu

SEQ ID NO: 2913619 - RNA, 14 nt, Mycobacterium avium subsp. paratuberculosis
cgcccccgcggcgu

SEQ ID NO: 2913620 - RNA, 15 nt, Mycobacterium avium subsp. paratuberculosis
cgcccccgcggcguc

SEQ ID NO: 2913621 - RNA, 15 nt, Mycobacterium avium subsp. paratuberculosis
cgcccccgcuggccc

SEQ ID NO: 2913622 - RNA, 15 nt, Mycobacterium avium subsp. paratuberculosis
cgcccccucggccgg

SEQ ID NO: 2913623 - RNA, 16 nt, Mycobacterium avium subsp. paratuberculosis
cgcccccucggccggu

SEQ ID NO: 2913624 - RNA, 18 nt, Mycobacterium avium subsp. paratuberculosis
cgcccccucggccggucc

SEQ ID NO: 2913625 - RNA, 20 nt, Mycobacterium avium subsp. paratuberculosis
cgcccccucggccgguccga

SEQ ID NO: 2913626 - RNA, 17 nt, Mycobacterium avium subsp. paratuberculosis
cgccccgaacagcgcca

SEQ ID NO: 2913627 - RNA, 16 nt, Mycobacterium avium subsp. paratuberculosis
cgccccgacagcaacg

SEQ ID NO: 2913628 - RNA, 21 nt, Mycobacterium avium subsp. paratuberculosis
cgccccgacagcaacgccagg

SEQ ID NO: 2913629 - RNA, 22 nt, Mycobacterium avium subsp. paratuberculosis
cgccccgacaucgccaucagca

SEQ ID NO: 2913630 - RNA, 21 nt, Mycobacterium avium subsp. paratuberculosis
cgccccgacgaucgcgccggc

SEQ ID NO: 2913631 - RNA, 20 nt, Mycobacterium avium subsp. paratuberculosis
cgccccgacgugcagcgcca

SEQ ID NO: 2913632 - RNA, 22 nt, Mycobacterium avium subsp. paratuberculosis
cgccccgacgugcagcgccagc

SEQ ID NO: 2913633 - RNA, 21 nt, Mycobacterium avium subsp. paratuberculosis
cgccccgagaucccagcggga

SEQ ID NO: 2913634 - RNA, 23 nt, Mycobacterium avium subsp. paratuberculosis
cgccccgagaucccagcgggaca

SEQ ID NO: 2913635 - RNA, 14 nt, Mycobacterium avium subsp. paratuberculosis
cgccccgagcagcg

SEQ ID NO: 2913636 - RNA, 15 nt, Mycobacterium avium subsp. paratuberculosis
cgccccgagcagcgg

SEQ ID NO: 2913637 - RNA, 23 nt, Mycobacterium avium subsp. paratuberculosis
cgccccgagcagcgggucgucgg

SEQ ID NO: 2913638 - RNA, 19 nt, Mycobacterium avium subsp. paratuberculosis
cgccccgaguuccagcucc

SEQ ID NO: 2913639 - RNA, 13 nt, Mycobacterium avium subsp. paratuberculosis
cgccccgcaccga

SEQ ID NO: 2913640 - RNA, 12 nt, Mycobacterium avium subsp. paratuberculosis
cgccccgcccgg

SEQ ID NO: 2913641 - RNA, 16 nt, Mycobacterium avium subsp. paratuberculosis
cgccccgccgcgccgg

SEQ ID NO: 2913642 - RNA, 21 nt, Mycobacterium avium subsp. paratuberculosis
cgccccgccgcgccgggcgcc

SEQ ID NO: 2913643 - RNA, 16 nt, Mycobacterium avium subsp. paratuberculosis
cgccagcagcgccgcu

SEQ ID NO: 2913644 - RNA, 19 nt, Mycobacterium avium subsp. paratuberculosis
cgccagcagcgcgccgcgc

SEQ ID NO: 2913645 - RNA, 20 nt, Mycobacterium avium subsp. paratuberculosis
cgccagcagcggcacccggu

SEQ ID NO: 2913646 - RNA, 23 nt, Mycobacterium avium subsp. paratuberculosis
cgccagcagcggcacccgguccg

SEQ ID NO: 2913647 - RNA, 17 nt, Mycobacterium avium subsp. paratuberculosis
cgccagcagcugcggga

SEQ ID NO: 2913648 - RNA, 20 nt, Mycobacterium avium subsp. paratuberculosis
cgccagcagcugcgggacca

SEQ ID NO: 2913649 - RNA, 13 nt, Mycobacterium avium subsp. paratuberculosis
cgccagcagggca

SEQ ID NO: 2913650 - RNA, 23 nt, Mycobacterium avium subsp. paratuberculosis
cgccagcaguguccagucggccg

SEQ ID NO: 2913651 - RNA, 17 nt, Mycobacterium avium subsp. paratuberculosis
cgccagcauccgcuggu

SEQ ID NO: 2913652 - RNA, 18 nt, Mycobacterium avium subsp. paratuberculosis
cgccagcauccgcuggug

SEQ ID NO: 2913653 - RNA, 20 nt, Mycobacterium avium subsp. paratuberculosis
cgccagcauccgcuggugcg

SEQ ID NO: 2913654 - RNA, 16 nt, Mycobacterium avium subsp. paratuberculosis
cgccagcaugaucacc

SEQ ID NO: 2913655 - RNA, 18 nt, Mycobacterium avium subsp. paratuberculosis
cgccagcaugaucaccgc

SEQ ID NO: 2913656 - RNA, 20 nt, Mycobacterium avium subsp. paratuberculosis
cgccagcaugaucaccgcca

SEQ ID NO: 2913657 - RNA, 22 nt, Mycobacterium avium subsp. paratuberculosis
cgccagcaugaucaccgccagc

SEQ ID NO: 2913658 - RNA, 13 nt, Mycobacterium avium subsp. paratuberculosis
cgccagccagccg

SEQ ID NO: 2913659 - RNA, 16 nt, Mycobacterium avium subsp. paratuberculosis
cgccagccagccggug

SEQ ID NO: 2913660 - RNA, 18 nt, Mycobacterium avium subsp. paratuberculosis
cgccagccagccggugcg

SEQ ID NO: 2913661 - RNA, 22 nt, Mycobacterium avium subsp. paratuberculosis
cgccagccagccggugcggucg

SEQ ID NO: 2913662 - RNA, 16 nt, Mycobacterium avium subsp. paratuberculosis
cgccagccaggcgaug

SEQ ID NO: 2913663 - RNA, 20 nt, Mycobacterium avium subsp. paratuberculosis
cgccagccaggcgaugaagc

SEQ ID NO: 2913664 - RNA, 20 nt, Mycobacterium avium subsp. paratuberculosis
cgccagccccaccggccacu

SEQ ID NO: 2913665 - RNA, 14 nt, Mycobacterium avium subsp. paratuberculosis
cgccagcccgccga

SEQ ID NO: 2913666 - RNA, 15 nt, Mycobacterium avium subsp. paratuberculosis
cgccagcccgccgaa

SEQ ID NO: 2913667 - RNA, 12 nt, Mycobacterium avium subsp. paratuberculosis
cgccagcccgcg

SEQ ID NO: 2913668 - RNA, 12 nt, Mycobacterium avium subsp. paratuberculosis
cgccagcccggc

SEQ ID NO: 2913669 - RNA, 19 nt, Mycobacterium avium subsp. paratuberculosis
cgccagcccggcguacagc

SEQ ID NO: 2913670 - RNA, 13 nt, Mycobacterium avium subsp. paratuberculosis
cgccagcccggug

SEQ ID NO: 2913671 - RNA, 22 nt, Mycobacterium avium subsp. paratuberculosis
cgccagcccggugaucgccgcc

SEQ ID NO: 2913672 - RNA, 14 nt, Mycobacterium avium subsp. paratuberculosis
cgccagccgcaccg

SEQ ID NO: 2913673 - RNA, 17 nt, Mycobacterium avium subsp. paratuberculosis
cgccagccgcaccgcga

SEQ ID NO: 2913674 - RNA, 19 nt, Mycobacterium avium subsp. paratuberculosis
cgccagccgcaccgcgacc

SEQ ID NO: 2913675 - RNA, 20 nt, Mycobacterium avium subsp. paratuberculosis
cgccagccgcaccgcgaccg

SEQ ID NO: 2913676 - RNA, 18 nt, Mycobacterium avium subsp. paratuberculosis
cgccagccgcagcaggca

SEQ ID NO: 2913677 - RNA, 12 nt, Mycobacterium avium subsp. paratuberculosis
cgccagccgccg

SEQ ID NO: 2913678 - RNA, 13 nt, Mycobacterium avium subsp. paratuberculosis
cgccagccgccgc

SEQ ID NO: 2913679 - RNA, 14 nt, Mycobacterium avium subsp. paratuberculosis
cgccagccgccgcc

SEQ ID NO: 2913680 - RNA, 21 nt, Mycobacterium avium subsp. paratuberculosis
cgccagccgccgccgaccaca

SEQ ID NO: 2913681 - RNA, 15 nt, Mycobacterium avium subsp. paratuberculosis
cgccagccgccggcu

SEQ ID NO: 2913682 - RNA, 16 nt, Mycobacterium avium subsp. paratuberculosis
cgccagccgccggcuc

SEQ ID NO: 2913683 - RNA, 20 nt, Mycobacterium avium subsp. paratuberculosis
cgccagccgccggcucagcg

SEQ ID NO: 2913684 - RNA, 14 nt, Mycobacterium avium subsp. paratuberculosis
cgccagccgggugg

SEQ ID NO: 2913685 - RNA, 19 nt, Mycobacterium avium subsp. paratuberculosis
cgccagccggguggcccgc

SEQ ID NO: 2913686 - RNA, 20 nt, Mycobacterium avium subsp. paratuberculosis
cgccagccggguggcccgcg

SEQ ID NO: 2913687 - RNA, 19 nt, Mycobacterium avium subsp. paratuberculosis
cgccagccgguacggaucg

SEQ ID NO: 2913688 - RNA, 22 nt, Mycobacterium avium subsp. paratuberculosis
cgccagccgguacggaucgccg

SEQ ID NO: 2913689 - RNA, 13 nt, Mycobacterium avium subsp. paratuberculosis
cgccagccgguca

SEQ ID NO: 2913690 - RNA, 12 nt, Mycobacterium avium subsp. paratuberculosis
cgccagccgucc

SEQ ID NO: 2913691 - RNA, 17 nt, Mycobacterium avium subsp. paratuberculosis
cgccagccguccugguc

SEQ ID NO: 2913692 - RNA, 18 nt, Mycobacterium avium subsp. paratuberculosis
cgccagccguccuggucg

SEQ ID NO: 2913693 - RNA, 15 nt, Mycobacterium avium subsp. paratuberculosis
cgccagccgucgccg

SEQ ID NO: 2913694 - RNA, 20 nt, Mycobacterium avium subsp. paratuberculosis
cgccagccgucgccgcgccc

SEQ ID NO: 2913695 - RNA, 21 nt, Mycobacterium avium subsp. paratuberculosis
cgccagccgucgccgcgcccg

SEQ ID NO: 2913696 - RNA, 20 nt, Mycobacterium avium subsp. paratuberculosis
cgccagccguucccggcaga

SEQ ID NO: 2913697 - RNA, 12 nt, Mycobacterium avium subsp. paratuberculosis
cgccagcgaccg

SEQ ID NO: 2913698 - RNA, 15 nt, Mycobacterium avium subsp. paratuberculosis
cgccagcgaccgcag

SEQ ID NO: 2913699 - RNA, 15 nt, Mycobacterium avium subsp. paratuberculosis
cgccagcgacggccg

SEQ ID NO: 2913700 - RNA, 16 nt, Mycobacterium avium subsp. paratuberculosis
cgccagcgacggccgg

SEQ ID NO: 2913701 - RNA, 17 nt, Mycobacterium avium subsp. paratuberculosis
cgccagcgacggccggg

SEQ ID NO: 2913702 - RNA, 14 nt, Mycobacterium avium subsp. paratuberculosis
cgccagcgccacgc

SEQ ID NO: 2913703 - RNA, 16 nt, Mycobacterium avium subsp. paratuberculosis
cgccagcgccacgcuc

SEQ ID NO: 2913704 - RNA, 11 nt, Mycobacterium avium subsp. paratuberculosis
cgccagcgccc

SEQ ID NO: 2913705 - RNA, 13 nt, Mycobacterium avium subsp. paratuberculosis
cgccagcgccccc

SEQ ID NO: 2913706 - RNA, 14 nt, Mycobacterium avium subsp. paratuberculosis
cgccagcgccccca

SEQ ID NO: 2913707 - RNA, 22 nt, Mycobacterium avium subsp. paratuberculosis
cgccagcgcccccagcggggca

SEQ ID NO: 2913708 - RNA, 15 nt, Mycobacterium avium subsp. paratuberculosis
cgccagcgcccgcgc

SEQ ID NO: 2913709 - RNA, 18 nt, Mycobacterium avium subsp. paratuberculosis
cgccagcgcccgcgcgug

SEQ ID NO: 2913710 - RNA, 15 nt, Mycobacterium avium subsp. paratuberculosis
cgccagcgccgcaac

SEQ ID NO: 2913711 - RNA, 18 nt, Mycobacterium avium subsp. paratuberculosis
cgccagcgccgcaacggc

SEQ ID NO: 2913712 - RNA, 13 nt, Mycobacterium avium subsp. paratuberculosis
cgccagcgccggc

SEQ ID NO: 2913713 - RNA, 17 nt, Mycobacterium avium subsp. paratuberculosis
cgccagcgccggcagca

SEQ ID NO: 2913714 - RNA, 21 nt, Mycobacterium avium subsp. paratuberculosis
cgccagcgccggguugcaggc

SEQ ID NO: 2913715 - RNA, 13 nt, Mycobacterium avium subsp. paratuberculosis
cgccagcgcgacc

SEQ ID NO: 2913716 - RNA, 15 nt, Mycobacterium avium subsp. paratuberculosis
cgccagcgcgacccg

SEQ ID NO: 2913717 - RNA, 16 nt, Mycobacterium avium subsp. paratuberculosis
cgccagcgcgacccgc

SEQ ID NO: 2913718 - RNA, 19 nt, Mycobacterium avium subsp. paratuberculosis
cgccagcgcgacccgcucg

SEQ ID NO: 2913719 - RNA, 13 nt, Mycobacterium avium subsp. paratuberculosis
cgccagcgcgcag

SEQ ID NO: 2913720 - RNA, 22 nt, Mycobacterium avium subsp. paratuberculosis
cgccagcgcgcagaacaccacc

SEQ ID NO: 2913721 - RNA, 23 nt, Mycobacterium avium subsp. paratuberculosis
cgccagcgcgcagaacaccaccg

SEQ ID NO: 2913722 - RNA, 16 nt, Mycobacterium avium subsp. paratuberculosis
cgccagcgcgcccgcc

SEQ ID NO: 2913723 - RNA, 13 nt, Mycobacterium avium subsp. paratuberculosis
cgccagcgcgccg

SEQ ID NO: 2913724 - RNA, 16 nt, Mycobacterium avium subsp. paratuberculosis
cgccagcgcgccgauc

SEQ ID NO: 2913725 - RNA, 11 nt, Mycobacterium avium subsp. paratuberculosis
cgccagcgcgg

SEQ ID NO: 2913726 - RNA, 13 nt, Mycobacterium avium subsp. paratuberculosis
cgccagcgcggcg

SEQ ID NO: 2913727 - RNA, 14 nt, Mycobacterium avium subsp. paratuberculosis
cgccagcgcggcga

SEQ ID NO: 2913728 - RNA, 18 nt, Mycobacterium avium subsp. paratuberculosis
cgcagcaucuccgagucg

SEQ ID NO: 2913729 - RNA, 19 nt, Mycobacterium avium subsp. paratuberculosis
cgcagcaucuccgagucgg

SEQ ID NO: 2913730 - RNA, 21 nt, Mycobacterium avium subsp. paratuberculosis
cgcagcaucuccgagucggcg

SEQ ID NO: 2913731 - RNA, 21 nt, Mycobacterium avium subsp. paratuberculosis
cgcagcaucucuugaugcagc

SEQ ID NO: 2913732 - RNA, 20 nt, Mycobacterium avium subsp. paratuberculosis
cgcagcaucuuggccacggg

SEQ ID NO: 2913733 - RNA, 16 nt, Mycobacterium avium subsp. paratuberculosis
cgcagcauggcccaca

SEQ ID NO: 2913734 - RNA, 19 nt, Mycobacterium avium subsp. paratuberculosis
cgcagccaaugccggaucg

SEQ ID NO: 2913735 - RNA, 20 nt, Mycobacterium avium subsp. paratuberculosis
cgcagccaaugccggaucgg

SEQ ID NO: 2913736 - RNA, 22 nt, Mycobacterium avium subsp. paratuberculosis
cgcagccaaugccggaucggga

SEQ ID NO: 2913737 - RNA, 14 nt, Mycobacterium avium subsp. paratuberculosis
cgcagccaccgccc

SEQ ID NO: 2913738 - RNA, 16 nt, Mycobacterium avium subsp. paratuberculosis
cgcagccaccgcccga

SEQ ID NO: 2913739 - RNA, 17 nt, Mycobacterium avium subsp. paratuberculosis
cgcagccaccgcccgaa

SEQ ID NO: 2913740 - RNA, 18 nt, Mycobacterium avium subsp. paratuberculosis
cgcagccaccgcccgaac

SEQ ID NO: 2913741 - RNA, 22 nt, Mycobacterium avium subsp. paratuberculosis
cgcagccaccgcccgaaccgcg

SEQ ID NO: 2913742 - RNA, 14 nt, Mycobacterium avium subsp. paratuberculosis
cgcagccacgagcc

SEQ ID NO: 2913743 - RNA, 16 nt, Mycobacterium avium subsp. paratuberculosis
cgcagccacgagccca

SEQ ID NO: 2913744 - RNA, 18 nt, Mycobacterium avium subsp. paratuberculosis
cgcagccacgagcccagc

SEQ ID NO: 2913745 - RNA, 23 nt, Mycobacterium avium subsp. paratuberculosis
cgcagccacgagcccagccgucg

SEQ ID NO: 2913746 - RNA, 16 nt, Mycobacterium avium subsp. paratuberculosis
cgcagccagaccucgc

SEQ ID NO: 2913747 - RNA, 13 nt, Mycobacterium avium subsp. paratuberculosis
cgcagccagcgca

SEQ ID NO: 2913748 - RNA, 16 nt, Mycobacterium avium subsp. paratuberculosis
cgcagccagcgcagca

SEQ ID NO: 2913749 - RNA, 17 nt, Mycobacterium avium subsp. paratuberculosis
cgcagccagcgcagcac

SEQ ID NO: 2913750 - RNA, 16 nt, Mycobacterium avium subsp. paratuberculosis
cgcagccagcucggcg

SEQ ID NO: 2913751 - RNA, 18 nt, Mycobacterium avium subsp. paratuberculosis
cgcagccagcucggcgua

SEQ ID NO: 2913752 - RNA, 16 nt, Mycobacterium avium subsp. paratuberculosis
cgcagccagucgccgg

SEQ ID NO: 2913753 - RNA, 18 nt, Mycobacterium avium subsp. paratuberculosis
cgcagccagucgccggcc

SEQ ID NO: 2913754 - RNA, 17 nt, Mycobacterium avium subsp. paratuberculosis
cgcagcccccggaccac

SEQ ID NO: 2913755 - RNA, 16 nt, Mycobacterium avium subsp. paratuberculosis
cgcagcccgaccuucu

SEQ ID NO: 2913756 - RNA, 14 nt, Mycobacterium avium subsp. paratuberculosis
cgcagcccgagcgg

SEQ ID NO: 2913757 - RNA, 15 nt, Mycobacterium avium subsp. paratuberculosis
cgcagcccgagcggc

SEQ ID NO: 2913758 - RNA, 19 nt, Mycobacterium avium subsp. paratuberculosis
cgcagcccgagcggcauca

SEQ ID NO: 2913759 - RNA, 20 nt, Mycobacterium avium subsp. paratuberculosis
cgcagcccgagcggcaucag

SEQ ID NO: 2913760 - RNA, 22 nt, Mycobacterium avium subsp. paratuberculosis
cgcagcccgaucgccagcgccc

SEQ ID NO: 2913761 - RNA, 14 nt, Mycobacterium avium subsp. paratuberculosis
cgcagcccgccggg

SEQ ID NO: 2913762 - RNA, 15 nt, Mycobacterium avium subsp. paratuberculosis
cgcagcccgccggga

SEQ ID NO: 2913763 - RNA, 17 nt, Mycobacterium avium subsp. paratuberculosis
cgcagcccggcgguuga

SEQ ID NO: 2913764 - RNA, 16 nt, Mycobacterium avium subsp. paratuberculosis
cgcagcccgggugcga

SEQ ID NO: 2913765 - RNA, 21 nt, Mycobacterium avium subsp. paratuberculosis
cgcagcccguacuugcuggcg

SEQ ID NO: 2913766 - RNA, 22 nt, Mycobacterium avium subsp. paratuberculosis
cgcagcccguacuugcuggcgc

SEQ ID NO: 2913767 - RNA, 16 nt, Mycobacterium avium subsp. paratuberculosis
cgcagcccgucgaucc

SEQ ID NO: 2913768 - RNA, 19 nt, Mycobacterium avium subsp. paratuberculosis
cgcagcccgucgaucccgg

SEQ ID NO: 2913769 - RNA, 16 nt, Mycobacterium avium subsp. paratuberculosis
cgcagccgaucgacga

SEQ ID NO: 2913770 - RNA, 17 nt, Mycobacterium avium subsp. paratuberculosis
cgcagccgaucgacgaa

SEQ ID NO: 2913771 - RNA, 21 nt, Mycobacterium avium subsp. paratuberculosis
cgcagccgaucucguagccca

SEQ ID NO: 2913772 - RNA, 20 nt, Mycobacterium avium subsp. paratuberculosis
cgcagccgaugucgucgaac

SEQ ID NO: 2913773 - RNA, 14 nt, Mycobacterium avium subsp. paratuberculosis
cgcagccgccgggc

SEQ ID NO: 2913774 - RNA, 15 nt, Mycobacterium avium subsp. paratuberculosis
cgcagccgccgggcu

SEQ ID NO: 2913775 - RNA, 14 nt, Mycobacterium avium subsp. paratuberculosis
cgcagccgcgacgg

SEQ ID NO: 2913776 - RNA, 17 nt, Mycobacterium avium subsp. paratuberculosis
cgcagccgcgacggcgg

SEQ ID NO: 2913777 - RNA, 19 nt, Mycobacterium avium subsp. paratuberculosis
cgcagccgcgacggcgggu

SEQ ID NO: 2913778 - RNA, 16 nt, Mycobacterium avium subsp. paratuberculosis
cgcagccgcgagucga

SEQ ID NO: 2913779 - RNA, 16 nt, Mycobacterium avium subsp. paratuberculosis
cgcagccgcgcccgau

SEQ ID NO: 2913780 - RNA, 17 nt, Mycobacterium avium subsp. paratuberculosis
cgcagccgcgcccgaug

SEQ ID NO: 2913781 - RNA, 14 nt, Mycobacterium avium subsp. paratuberculosis
cgcagccgcgcggc

SEQ ID NO: 2913782 - RNA, 15 nt, Mycobacterium avium subsp. paratuberculosis
cgcagccgcgcggcc

SEQ ID NO: 2913783 - RNA, 16 nt, Mycobacterium avium subsp. paratuberculosis
cgcagccgcgcggccg

SEQ ID NO: 2913784 - RNA, 21 nt, Mycobacterium avium subsp. paratuberculosis
cgcagccgcgguggcgguguu

SEQ ID NO: 2913785 - RNA, 20 nt, Mycobacterium avium subsp. paratuberculosis
cgcagccgcugcagcgccgc

SEQ ID NO: 2913786 - RNA, 22 nt, Mycobacterium avium subsp. paratuberculosis
cgcagccgcugcagcgccgccc

SEQ ID NO: 2913787 - RNA, 14 nt, Mycobacterium avium subsp. paratuberculosis
cgcagccgcugccg

SEQ ID NO: 2913788 - RNA, 21 nt, Mycobacterium avium subsp. paratuberculosis
cgcagccgcuggccgcgccac

SEQ ID NO: 2913789 - RNA, 14 nt, Mycobacterium avium subsp. paratuberculosis
cgcagccggaucac

SEQ ID NO: 2913790 - RNA, 14 nt, Mycobacterium avium subsp. paratuberculosis
cgcagccggccacc

SEQ ID NO: 2913791 - RNA, 16 nt, Mycobacterium avium subsp. paratuberculosis
cgcagccggccaccgc

SEQ ID NO: 2913792 - RNA, 17 nt, Mycobacterium avium subsp. paratuberculosis
cgcagccggccaccgcc

SEQ ID NO: 2913793 - RNA, 18 nt, Mycobacterium avium subsp. paratuberculosis
cgcagccggccaccgccc

SEQ ID NO: 2913794 - RNA, 19 nt, Mycobacterium avium subsp. paratuberculosis
cgcagccggccaccgcccc

SEQ ID NO: 2913795 - RNA, 20 nt, Mycobacterium avium subsp. paratuberculosis
cgcagccggccaccgcccca

SEQ ID NO: 2913796 - RNA, 15 nt, Mycobacterium avium subsp. paratuberculosis
cgcagccggccgacc

SEQ ID NO: 2913797 - RNA, 18 nt, Mycobacterium avium subsp. paratuberculosis
cgcagccggccgaccgcc

SEQ ID NO: 2913798 - RNA, 14 nt, Mycobacterium avium subsp. paratuberculosis
cgcagccgggcggc

SEQ ID NO: 2913799 - RNA, 17 nt, Mycobacterium avium subsp. paratuberculosis
cgcagccgggcggcgcu

SEQ ID NO: 2913800 - RNA, 14 nt, Mycobacterium avium subsp. paratuberculosis
cgcagccgggcggu

SEQ ID NO: 2913801 - RNA, 20 nt, Mycobacterium avium subsp. paratuberculosis
cgcagccgggugcgggccag

SEQ ID NO: 2913802 - RNA, 22 nt, Mycobacterium avium subsp. paratuberculosis
cgcagccgggugcgggccagca

SEQ ID NO: 2913803 - RNA, 21 nt, Mycobacterium avium subsp. paratuberculosis
cgcagccgggugggcggcaca

SEQ ID NO: 2913804 - RNA, 12 nt, Mycobacterium avium subsp. paratuberculosis
cgcagccgucga

SEQ ID NO: 2913805 - RNA, 18 nt, Mycobacterium avium subsp. paratuberculosis
cgcagccgucgcaucagc

SEQ ID NO: 2913806 - RNA, 19 nt, Mycobacterium avium subsp. paratuberculosis
cgcagccgucgcaucagcu

SEQ ID NO: 2913807 - RNA, 23 nt, Mycobacterium avium subsp. paratuberculosis
cgcagccgucgcaucagcucggc

SEQ ID NO: 2913808 - RNA, 21 nt, Mycobacterium avium subsp. paratuberculosis
cgcagccuucuucgccggggc

SEQ ID NO: 2913809 - RNA, 16 nt, Mycobacterium avium subsp. paratuberculosis
cgcagccuucuuggcg

SEQ ID NO: 2913810 - RNA, 21 nt, Mycobacterium avium subsp. paratuberculosis
cgcagccuucuuggcgggcgc

SEQ ID NO: 2913811 - RNA, 19 nt, Mycobacterium avium subsp. paratuberculosis
cgcagcgaaacucguugcc

SEQ ID NO: 2913812 - RNA, 20 nt, Mycobacterium avium subsp. paratuberculosis
cgcagcgaagcgaggcgcca

SEQ ID NO: 2913813 - RNA, 22 nt, Mycobacterium avium subsp. paratuberculosis
cgcagcgaagcgaggcgccaca

SEQ ID NO: 2913814 - RNA, 19 nt, Mycobacterium avium subsp. paratuberculosis
cgcagcgacaaucggcucg

SEQ ID NO: 2913815 - RNA, 15 nt, Mycobacterium avium subsp. paratuberculosis
cgcagcgaccgcgga

SEQ ID NO: 2913816 - RNA, 22 nt, Mycobacterium avium subsp. paratuberculosis
cgcagcgaccugguccaccgcg

SEQ ID NO: 2913817 - RNA, 13 nt, Mycobacterium avium subsp. paratuberculosis
cgcagcgaggcga

SEQ ID NO: 2913818 - RNA, 15 nt, Mycobacterium avium subsp. paratuberculosis
cgcagcgaggcgaug

SEQ ID NO: 2913819 - RNA, 16 nt, Mycobacterium avium subsp. paratuberculosis
cgcagcgaggcgaugg

SEQ ID NO: 2913820 - RNA, 16 nt, Mycobacterium avium subsp. paratuberculosis
cgcagcgagucggcga

SEQ ID NO: 2913821 - RNA, 15 nt, Mycobacterium avium subsp. paratuberculosis
cgcagcgaucggcgg

SEQ ID NO: 2913822 - RNA, 18 nt, Mycobacterium avium subsp. paratuberculosis
cgcagcgcacgucgccgc

SEQ ID NO: 2913823 - RNA, 20 nt, Mycobacterium avium subsp. paratuberculosis
cgcagcgcacgucgccgccg

SEQ ID NO: 2913824 - RNA, 14 nt, Mycobacterium avium subsp. paratuberculosis
cgcagcgcagcacc

SEQ ID NO: 2913825 - RNA, 17 nt, Mycobacterium avium subsp. paratuberculosis
cgcagcgcagcgucggc

SEQ ID NO: 2913826 - RNA, 18 nt, Mycobacterium avium subsp. paratuberculosis
cgcagcgcagcgucggcg

SEQ ID NO: 2913827 - RNA, 23 nt, Mycobacterium avium subsp. paratuberculosis
cgcagcgcauccgacaccgccuu

SEQ ID NO: 2913828 - RNA, 13 nt, Mycobacterium avium subsp. paratuberculosis
cgcagcgcaucgc

SEQ ID NO: 2913829 - RNA, 17 nt, Mycobacterium avium subsp. paratuberculosis
cgcagcgcaucgccggc

SEQ ID NO: 2913830 - RNA, 21 nt, Mycobacterium avium subsp. paratuberculosis
cgcagcgcaucguugccggcg

SEQ ID NO: 2913831 - RNA, 23 nt, Mycobacterium avium subsp. paratuberculosis
cgcagcgcaucguugccggcggc

SEQ ID NO: 2913832 - RNA, 18 nt, Mycobacterium avium subsp. paratuberculosis
cgcagcgccagcgcgccc

SEQ ID NO: 2913833 - RNA, 14 nt, Mycobacterium avium subsp. paratuberculosis
cgcagcgcccaggc

SEQ ID NO: 2913834 - RNA, 13 nt, Mycobacterium avium subsp. paratuberculosis
cgcagcgcccggc

SEQ ID NO: 2913835 - RNA, 17 nt, Mycobacterium avium subsp. paratuberculosis
cgcagcgcccggcagcg

SEQ ID NO: 2913836 - RNA, 21 nt, Mycobacterium avium subsp. paratuberculosis
cgcagcgcccggcagcgguca

SEQ ID NO: 2913837 - RNA, 17 nt, Mycobacterium avium subsp. paratuberculosis
cgcagcgccgcgccgac

SEQ ID NO: 2913838 - RNA, 19 nt, Mycobacterium avium subsp. paratuberculosis
cgcagcgccgcgccgaccu

SEQ ID NO: 2913839 - RNA, 18 nt, Mycobacterium avium subsp. paratuberculosis
cgcagcgccgucucgacc

SEQ ID NO: 2913840 - RNA, 12 nt, Mycobacterium avium subsp. paratuberculosis
cgcagcgccucg

SEQ ID NO: 2913841 - RNA, 15 nt, Mycobacterium avium subsp. paratuberculosis
cgcagcgccucggcg

SEQ ID NO: 2913842 - RNA, 17 nt, Mycobacterium avium subsp. paratuberculosis
cgcagcgccucggcggc

SEQ ID NO: 2913843 - RNA, 18 nt, Mycobacterium avium subsp. paratuberculosis
cgcagcgccucggcggcc

SEQ ID NO: 2913844 - RNA, 16 nt, Mycobacterium avium subsp. paratuberculosis
cgcagcgccucggcgu

SEQ ID NO: 2913845 - RNA, 13 nt, Mycobacterium avium subsp. paratuberculosis
cgcagcgcgacga

SEQ ID NO: 2913846 - RNA, 14 nt, Mycobacterium avium subsp. paratuberculosis
cgcagcgcgacgaa

SEQ ID NO: 2913847 - RNA, 19 nt, Mycobacterium avium subsp. paratuberculosis
cgcagcgcgacgaacagca

SEQ ID NO: 2913848 - RNA, 17 nt, Mycobacterium avium subsp. paratuberculosis
cgcagcgcgcgaccgcg

SEQ ID NO: 2913849 - RNA, 14 nt, Mycobacterium avium subsp. paratuberculosis
cgcagcgcgcgcuc

SEQ ID NO: 2913850 - RNA, 17 nt, Mycobacterium avium subsp. paratuberculosis
cgcagcgcgcgcucggu

SEQ ID NO: 2913851 - RNA, 12 nt, Mycobacterium avium subsp. paratuberculosis
cgcagcgcgcgg

SEQ ID NO: 2913852 - RNA, 13 nt, Mycobacterium avium subsp. paratuberculosis
cgcagcgcgcggc

SEQ ID NO: 2913853 - RNA, 15 nt, Mycobacterium avium subsp. paratuberculosis
cgcagcgcgcggcgc

SEQ ID NO: 2913854 - RNA, 17 nt, Mycobacterium avium subsp. paratuberculosis
cgcagcgcgcggcgcag

SEQ ID NO: 2913855 - RNA, 16 nt, Mycobacterium avium subsp. paratuberculosis
cgcagcgcgcggguga

SEQ ID NO: 2913856 - RNA, 12 nt, Mycobacterium avium subsp. paratuberculosis
cgcagcgcggcg

SEQ ID NO: 2913857 - RNA, 14 nt, Mycobacterium avium subsp. paratuberculosis
cgcagcgcggcgac

SEQ ID NO: 2913858 - RNA, 21 nt, Mycobacterium avium subsp. paratuberculosis
cgcagcgcggcggaggucagc

SEQ ID NO: 2913859 - RNA, 13 nt, Mycobacterium avium subsp. paratuberculosis
cgcagcgcgucgc

SEQ ID NO: 2913860 - RNA, 17 nt, Mycobacterium avium subsp. paratuberculosis
cgcagcgcgucgcgccc

SEQ ID NO: 2913861 - RNA, 18 nt, Mycobacterium avium subsp. paratuberculosis
cgcagcgcgucgcgcccg

SEQ ID NO: 2913862 - RNA, 20 nt, Mycobacterium avium subsp. paratuberculosis
cgcagcgcgucgcgcccggc

SEQ ID NO: 2913863 - RNA, 15 nt, Mycobacterium avium subsp. paratuberculosis
cgcagcgcgucgggc

SEQ ID NO: 2913864 - RNA, 16 nt, Mycobacterium avium subsp. paratuberculosis
cgcagcgcgucgucgg

SEQ ID NO: 2913865 - RNA, 17 nt, Mycobacterium avium subsp. paratuberculosis
cgcagcgcgucgucggu

SEQ ID NO: 2913866 - RNA, 15 nt, Mycobacterium avium subsp. paratuberculosis
cgcagcggcacgucg

SEQ ID NO: 2913867 - RNA, 13 nt, Mycobacterium avium subsp. paratuberculosis
cgcagcggcccga

SEQ ID NO: 2913868 - RNA, 12 nt, Mycobacterium avium subsp. paratuberculosis
cgcagcggcgcc

SEQ ID NO: 2913869 - RNA, 13 nt, Mycobacterium avium subsp. paratuberculosis
cgcagcggcgccg

SEQ ID NO: 2913870 - RNA, 14 nt, Mycobacterium avium subsp. paratuberculosis
cgcagcggcgccgc

SEQ ID NO: 2913871 - RNA, 16 nt, Mycobacterium avium subsp. paratuberculosis
cgcagcggcgccgcag

SEQ ID NO: 2913872 - RNA, 20 nt, Mycobacterium avium subsp. paratuberculosis
cgcagcggcgccgcagcucg

SEQ ID NO: 2913873 - RNA, 16 nt, Mycobacterium avium subsp. paratuberculosis
cgcagcggcgccggga

SEQ ID NO: 2913874 - RNA, 19 nt, Mycobacterium avium subsp. paratuberculosis
cgcagcggcgccgggaucg

SEQ ID NO: 2913875 - RNA, 18 nt, Mycobacterium avium subsp. paratuberculosis
cgcagcggcggcacgguu

SEQ ID NO: 2913876 - RNA, 22 nt, Mycobacterium avium subsp. paratuberculosis
cgcagcggcggcacgguuggcc

SEQ ID NO: 2913877 - RNA, 15 nt, Mycobacterium avium subsp. paratuberculosis
cgcagcggcggcucg

SEQ ID NO: 2913878 - RNA, 17 nt, Mycobacterium avium subsp. paratuberculosis
cgcagcggcggcucguc

SEQ ID NO: 2913879 - RNA, 21 nt, Mycobacterium avium subsp. paratuberculosis
cgcagcggcggcucguccagc

SEQ ID NO: 2913880 - RNA, 13 nt, Mycobacterium avium subsp. paratuberculosis
cgcagcggcgguu

SEQ ID NO: 2913881 - RNA, 22 nt, Mycobacterium avium subsp. paratuberculosis
cgcagcggcgguugcucgucgg

SEQ ID NO: 2913882 - RNA, 13 nt, Mycobacterium avium subsp. paratuberculosis
cgcagcggcguca

SEQ ID NO: 2913883 - RNA, 15 nt, Mycobacterium avium subsp. paratuberculosis
cgcagcggcuugacc

SEQ ID NO: 2913884 - RNA, 21 nt, Mycobacterium avium subsp. paratuberculosis
cgcagcggcuugaccggcucg

SEQ ID NO: 2913885 - RNA, 19 nt, Mycobacterium avium subsp. paratuberculosis
cgcagcgggauuggcgcca

SEQ ID NO: 2913886 - RNA, 23 nt, Mycobacterium avium subsp. paratuberculosis
cgcagcgggauuggcgccacugc

SEQ ID NO: 2913887 - RNA, 13 nt, Mycobacterium avium subsp. paratuberculosis
cgcagcggggagg

SEQ ID NO: 2913888 - RNA, 19 nt, Mycobacterium avium subsp. paratuberculosis
cgcagcggggaggcccagc

SEQ ID NO: 2913889 - RNA, 22 nt, Mycobacterium avium subsp. paratuberculosis
cgcagcggggaggcccagcccg

SEQ ID NO: 2913890 - RNA, 23 nt, Mycobacterium avium subsp. paratuberculosis
cgcagcggggaggcccagcccgc

SEQ ID NO: 2913891 - RNA, 12 nt, Mycobacterium avium subsp. paratuberculosis
cgcagcggggcg

SEQ ID NO: 2913892 - RNA, 14 nt, Mycobacterium avium subsp. paratuberculosis
cgcagcggggcgcu

SEQ ID NO: 2913893 - RNA, 22 nt, Mycobacterium avium subsp. paratuberculosis
cgcagcggggcgcuguccuggu

SEQ ID NO: 2913894 - RNA, 16 nt, Mycobacterium avium subsp. paratuberculosis
cgcagcggugcagccc

SEQ ID NO: 2913895 - RNA, 18 nt, Mycobacterium avium subsp. paratuberculosis
cgcagcggugcagccccg

SEQ ID NO: 2913896 - RNA, 19 nt, Mycobacterium avium subsp. paratuberculosis
cgcagcggugcagccccgc

SEQ ID NO: 2913897 - RNA, 19 nt, Mycobacterium avium subsp. paratuberculosis
cgcagcgucaucgcguagu

SEQ ID NO: 2913898 - RNA, 13 nt, Mycobacterium avium subsp. paratuberculosis
cgcagcgucggcg

SEQ ID NO: 2913899 - RNA, 21 nt, Mycobacterium avium subsp. paratuberculosis
cgcagcgucuccucgaccgcc

SEQ ID NO: 2913900 - RNA, 20 nt, Mycobacterium avium subsp. paratuberculosis
cgcagcgucucgaucgacga

SEQ ID NO: 2913901 - RNA, 21 nt, Mycobacterium avium subsp. paratuberculosis
cgcagcgucuucuucucgccg

SEQ ID NO: 2913902 - RNA, 17 nt, Mycobacterium avium subsp. paratuberculosis
cgcagcgucuugcccag

SEQ ID NO: 2913903 - RNA, 22 nt, Mycobacterium avium subsp. paratuberculosis
cgcagcgucuugcccagcgggg

SEQ ID NO: 2913904 - RNA, 12 nt, Mycobacterium avium subsp. paratuberculosis
cgcagcgugggc

SEQ ID NO: 2913905 - RNA, 18 nt, Mycobacterium avium subsp. paratuberculosis
cgcagcgugggcaccggc

SEQ ID NO: 2913906 - RNA, 20 nt, Mycobacterium avium subsp. paratuberculosis
cgcagcgugggcaccggcac

SEQ ID NO: 2913907 - RNA, 21 nt, Mycobacterium avium subsp. paratuberculosis
cgcagcgugggcaccggcacc

SEQ ID NO: 2913908 - RNA, 22 nt, Mycobacterium avium subsp. paratuberculosis
cgcagcgugggcaccggcaccg

SEQ ID NO: 2913909 - RNA, 22 nt, Mycobacterium avium subsp. paratuberculosis
cgcagcgugucggggucggcgc

SEQ ID NO: 2913910 - RNA, 15 nt, Mycobacterium avium subsp. paratuberculosis
cgcagcgugugcacc

SEQ ID NO: 2913911 - RNA, 15 nt, Mycobacterium avium subsp. paratuberculosis
cgcagcuccagcgag

SEQ ID NO: 2913912 - RNA, 14 nt, Mycobacterium avium subsp. paratuberculosis
cgcagcuccagguc

SEQ ID NO: 2913913 - RNA, 14 nt, Mycobacterium avium subsp. paratuberculosis
cgcagcucccccgg

SEQ ID NO: 2913914 - RNA, 18 nt, Mycobacterium avium subsp. paratuberculosis
cgcagcucccccggcgug

SEQ ID NO: 2913915 - RNA, 15 nt, Mycobacterium avium subsp. paratuberculosis
cgcagcucgacgacc

SEQ ID NO: 2913916 - RNA, 15 nt, Mycobacterium avium subsp. paratuberculosis
cgcagcucgaucacc

SEQ ID NO: 2913917 - RNA, 18 nt, Mycobacterium avium subsp. paratuberculosis
cgcagcucgaucacccag

SEQ ID NO: 2913918 - RNA, 22 nt, Mycobacterium avium subsp. paratuberculosis
cgcagcucgaucacccaggucu

SEQ ID NO: 2913919 - RNA, 17 nt, Mycobacterium avium subsp. paratuberculosis
cgcagcucgcccagcac

SEQ ID NO: 2913920 - RNA, 19 nt, Mycobacterium avium subsp. paratuberculosis
cgcagcucgcccagcaccg

SEQ ID NO: 2913921 - RNA, 12 nt, Mycobacterium avium subsp. paratuberculosis
cgcagcucgccg

SEQ ID NO: 2913922 - RNA, 13 nt, Mycobacterium avium subsp. paratuberculosis
cgcagcucgccgg

SEQ ID NO: 2913923 - RNA, 18 nt, Mycobacterium avium subsp. paratuberculosis
cgcagcucgccgguggcg

SEQ ID NO: 2913924 - RNA, 22 nt, Mycobacterium avium subsp. paratuberculosis
cgcagcucgccgguggcggcga

SEQ ID NO: 2913925 - RNA, 17 nt, Mycobacterium avium subsp. paratuberculosis
cgcagcucgcgcagccg

SEQ ID NO: 2913926 - RNA, 19 nt, Mycobacterium avium subsp. paratuberculosis
cgcagcucgcgcagccggc

SEQ ID NO: 2913927 - RNA, 21 nt, Mycobacterium avium subsp. paratuberculosis
cgcagcucgcgcagcuggccg

SEQ ID NO: 2913928 - RNA, 15 nt, Mycobacterium avium subsp. paratuberculosis
cgcagcucggggucg

SEQ ID NO: 2913929 - RNA, 19 nt, Mycobacterium avium subsp. paratuberculosis
cgcagcucggggucggcgu

SEQ ID NO: 2913930 - RNA, 21 nt, Mycobacterium avium subsp. paratuberculosis
cgcagcucggggucggcgucg

SEQ ID NO: 2913931 - RNA, 15 nt, Mycobacterium avium subsp. paratuberculosis
cgcagcucgucgugg

SEQ ID NO: 2913932 - RNA, 21 nt, Mycobacterium avium subsp. paratuberculosis
cgcagcucugcucguucguca

SEQ ID NO: 2913933 - RNA, 16 nt, Mycobacterium avium subsp. paratuberculosis
cgcagcugaucggggc

SEQ ID NO: 2913934 - RNA, 22 nt, Mycobacterium avium subsp. paratuberculosis
cgcagcugaucggggcccaccc

SEQ ID NO: 2913935 - RNA, 14 nt, Mycobacterium avium subsp. paratuberculosis
cgcagcugcagcuc

SEQ ID NO: 2913936 - RNA, 16 nt, Mycobacterium avium subsp. paratuberculosis
cgcagcugcagcuccu

SEQ ID NO: 2913937 - RNA, 20 nt, Mycobacterium avium subsp. paratuberculosis
cgcagcugcagcuccucggc

SEQ ID NO: 2913938 - RNA, 22 nt, Mycobacterium avium subsp. paratuberculosis
cgcagcugcagcuccucggcgg

SEQ ID NO: 2913939 - RNA, 18 nt, Mycobacterium avium subsp. paratuberculosis
cgcagcugcgccgcgucg

SEQ ID NO: 2913940 - RNA, 22 nt, Mycobacterium avium subsp. paratuberculosis
cgcagcugcgccgcgucgacgc

SEQ ID NO: 2913941 - RNA, 13 nt, Mycobacterium avium subsp. paratuberculosis
cgcagcuggccgu

SEQ ID NO: 2913942 - RNA, 16 nt, Mycobacterium avium subsp. paratuberculosis
cgcagcuggccgugca

SEQ ID NO: 2913943 - RNA, 18 nt, Mycobacterium avium subsp. paratuberculosis
cgcagcuggccgugcacc

SEQ ID NO: 2913944 - RNA, 22 nt, Mycobacterium avium subsp. paratuberculosis
cgcagcuggccgugcaccgucg

SEQ ID NO: 2913945 - RNA, 17 nt, Mycobacterium avium subsp. paratuberculosis
cgcagcuguucgggcag

SEQ ID NO: 2913946 - RNA, 21 nt, Mycobacterium avium subsp. paratuberculosis
cgcagcuguucgggcagaugg

SEQ ID NO: 2913947 - RNA, 16 nt, Mycobacterium avium subsp. paratuberculosis
cgcaggaaaggaaggc

SEQ ID NO: 2913948 - RNA, 21 nt, Mycobacterium avium subsp. paratuberculosis
cgcaggaaaggaaggcgcaug

SEQ ID NO: 2913949 - RNA, 18 nt, Mycobacterium avium subsp. paratuberculosis
cgcaggaacuccagcagc

SEQ ID NO: 2913950 - RNA, 19 nt, Mycobacterium avium subsp. paratuberculosis
cgcaggaacuccagcagcu

SEQ ID NO: 2913951 - RNA, 17 nt, Mycobacterium avium subsp. paratuberculosis
cgcaggagaucggcgcg

SEQ ID NO: 2913952 - RNA, 15 nt, Mycobacterium avium subsp. paratuberculosis
cgcaggaggcggcca

SEQ ID NO: 2913953 - RNA, 17 nt, Mycobacterium avium subsp. paratuberculosis
cgcaggaucgagccggc

SEQ ID NO: 2913954 - RNA, 22 nt, Mycobacterium avium subsp. paratuberculosis
cgcaggaucgagccggccguca

SEQ ID NO: 2913955 - RNA, 13 nt, Mycobacterium avium subsp. paratuberculosis
cgcaggaugccca

SEQ ID NO: 2913956 - RNA, 19 nt, Mycobacterium avium subsp. paratuberculosis
cgcaggaugcccagcacca

SEQ ID NO: 2913957 - RNA, 21 nt, Mycobacterium avium subsp. paratuberculosis
cgcaggaugcccagcaccacu

SEQ ID NO: 2913958 - RNA, 16 nt, Mycobacterium avium subsp. paratuberculosis
cgcaggaugccgaugu

SEQ ID NO: 2913959 - RNA, 19 nt, Mycobacterium avium subsp. paratuberculosis
cgcaggaugccgaugucgg

SEQ ID NO: 2913960 - RNA, 18 nt, Mycobacterium avium subsp. paratuberculosis
cgcaggauggccugcacg

SEQ ID NO: 2913961 - RNA, 22 nt, Mycobacterium avium subsp. paratuberculosis
cgcaggauggccugcacggugc

SEQ ID NO: 2913962 - RNA, 17 nt, Mycobacterium avium subsp. paratuberculosis
cgcaggcacucgcgcag

SEQ ID NO: 2913963 - RNA, 22 nt, Mycobacterium avium subsp. paratuberculosis
cgcaggcacucgcgcaggguca

SEQ ID NO: 2913964 - RNA, 12 nt, Mycobacterium avium subsp. paratuberculosis
cgcaggcagcag

SEQ ID NO: 2913965 - RNA, 16 nt, Mycobacterium avium subsp. paratuberculosis
cgcaggcagcagcacc

SEQ ID NO: 2913966 - RNA, 17 nt, Mycobacterium avium subsp. paratuberculosis
cgcaggcagcagcaccc

SEQ ID NO: 2913967 - RNA, 17 nt, Mycobacterium avium subsp. paratuberculosis
cgcaggccaugaucgaa

SEQ ID NO: 2913968 - RNA, 16 nt, Mycobacterium avium subsp. paratuberculosis
cgcaggccccggcgcg

SEQ ID NO: 2913969 - RNA, 14 nt, Mycobacterium avium subsp. paratuberculosis
cgcaggccgcccgg

SEQ ID NO: 2913970 - RNA, 15 nt, Mycobacterium avium subsp. paratuberculosis
cgcaggccgcccggc

SEQ ID NO: 2913971 - RNA, 18 nt, Mycobacterium avium subsp. paratuberculosis
cgcaggccgcccggccca

SEQ ID NO: 2913972 - RNA, 21 nt, Mycobacterium avium subsp. paratuberculosis
cgcaggccgcccggcccaaga

SEQ ID NO: 2913973 - RNA, 17 nt, Mycobacterium avium subsp. paratuberculosis
cgcaggccgccgacgac

SEQ ID NO: 2913974 - RNA, 14 nt, Mycobacterium avium subsp. paratuberculosis
cgcaggccgcgagc

SEQ ID NO: 2913975 - RNA, 15 nt, Mycobacterium avium subsp. paratuberculosis
cgcaggccggucacc

SEQ ID NO: 2913976 - RNA, 15 nt, Mycobacterium avium subsp. paratuberculosis
cgcaggccguccagc

SEQ ID NO: 2913977 - RNA, 17 nt, Mycobacterium avium subsp. paratuberculosis
cgcaggccguccagcag

SEQ ID NO: 2913978 - RNA, 18 nt, Mycobacterium avium subsp. paratuberculosis
cgcaggccguccagcagc

SEQ ID NO: 2913979 - RNA, 21 nt, Mycobacterium avium subsp. paratuberculosis
cgcaggccguccagcagcagc

SEQ ID NO: 2913980 - RNA, 18 nt, Mycobacterium avium subsp. paratuberculosis
cgcaggccgucgccgguc

SEQ ID NO: 2913981 - RNA, 20 nt, Mycobacterium avium subsp. paratuberculosis
cgcaggccguuguggccacc

SEQ ID NO: 2913982 - RNA, 18 nt, Mycobacterium avium subsp. paratuberculosis
cgcaggccucuacucagc

SEQ ID NO: 2913983 - RNA, 18 nt, Mycobacterium avium subsp. paratuberculosis
cgcaggcgaacaccucgg

SEQ ID NO: 2913984 - RNA, 13 nt, Mycobacterium avium subsp. paratuberculosis
cgcaggcgaaggu

SEQ ID NO: 2913985 - RNA, 14 nt, Mycobacterium avium subsp. paratuberculosis
cgcaggcgagccga

SEQ ID NO: 2913986 - RNA, 15 nt, Mycobacterium avium subsp. paratuberculosis
cgcaggcgagccgac

SEQ ID NO: 2913987 - RNA, 12 nt, Mycobacterium avium subsp. paratuberculosis
cgcaggcgcgca

SEQ ID NO: 2913988 - RNA, 13 nt, Mycobacterium avium subsp. paratuberculosis
cgcaggcgcgcac

SEQ ID NO: 2913989 - RNA, 12 nt, Mycobacterium avium subsp. paratuberculosis
cgcaggcgcgcg

SEQ ID NO: 2913990 - RNA, 16 nt, Mycobacterium avium subsp. paratuberculosis
cgcaggcgcgcggcca

SEQ ID NO: 2913991 - RNA, 18 nt, Mycobacterium avium subsp. paratuberculosis
cgcaggcgcgcggccagc

SEQ ID NO: 2913992 - RNA, 13 nt, Mycobacterium avium subsp. paratuberculosis
cgcaggcgcugag

SEQ ID NO: 2913993 - RNA, 12 nt, Mycobacterium avium subsp. paratuberculosis
cgcaggcggcca

SEQ ID NO: 2913994 - RNA, 14 nt, Mycobacterium avium subsp. paratuberculosis
cgcaggcggccagc

SEQ ID NO: 2913995 - RNA, 17 nt, Mycobacterium avium subsp. paratuberculosis
cgcaggcggccagcacc

SEQ ID NO: 2913996 - RNA, 18 nt, Mycobacterium avium subsp. paratuberculosis
cgcaggcggccagcacca

SEQ ID NO: 2913997 - RNA, 14 nt, Mycobacterium avium subsp. paratuberculosis
cgcaggcggcgacg

SEQ ID NO: 2913998 - RNA, 15 nt, Mycobacterium avium subsp. paratuberculosis
cgcaggcggcgacgg

SEQ ID NO: 2913999 - RNA, 18 nt, Mycobacterium avium subsp. paratuberculosis
cgcaggcggcgacggccg

SEQ ID NO: 2914000 - RNA, 13 nt, Mycobacterium avium subsp. paratuberculosis
cgcaggcggcgcg

SEQ ID NO: 2914001 - RNA, 15 nt, Mycobacterium avium subsp. paratuberculosis
cgcaggcggcgcgca

SEQ ID NO: 2914002 - RNA, 17 nt, Mycobacterium avium subsp. paratuberculosis
cgcaggcggcgcgcagc

SEQ ID NO: 2914003 - RNA, 19 nt, Mycobacterium avium subsp. paratuberculosis
cgcaggcggcgcgcagccg

SEQ ID NO: 2914004 - RNA, 21 nt, Mycobacterium avium subsp. paratuberculosis
cgcaggcguccagggccaccg

SEQ ID NO: 2914005 - RNA, 15 nt, Mycobacterium avium subsp. paratuberculosis
cgcaggcguccuuga

SEQ ID NO: 2914006 - RNA, 14 nt, Mycobacterium avium subsp. paratuberculosis
cgcaggcguggccc

SEQ ID NO: 2914007 - RNA, 15 nt, Mycobacterium avium subsp. paratuberculosis
cgcaggcguggccca

SEQ ID NO: 2914008 - RNA, 19 nt, Mycobacterium avium subsp. paratuberculosis
cgcaggcguggcccagccg

SEQ ID NO: 2914009 - RNA, 20 nt, Mycobacterium avium subsp. paratuberculosis
cgcaggcguggcccagccgg

SEQ ID NO: 2914010 - RNA, 16 nt, Mycobacterium avium subsp. paratuberculosis
cgcaggcuggcaucgu

SEQ ID NO: 2914011 - RNA, 17 nt, Mycobacterium avium subsp. paratuberculosis
cgcaggcuggcaucguc

SEQ ID NO: 2914012 - RNA, 21 nt, Mycobacterium avium subsp. paratuberculosis
cgcaggcuggcaucgucggcg

SEQ ID NO: 2914013 - RNA, 15 nt, Mycobacterium avium subsp. paratuberculosis
cgcagggccagcgcc

SEQ ID NO: 2914014 - RNA, 17 nt, Mycobacterium avium subsp. paratuberculosis
cgcagggccagcgccuc

SEQ ID NO: 2914015 - RNA, 19 nt, Mycobacterium avium subsp. paratuberculosis
cgcagggccagcgccucgg

SEQ ID NO: 2914016 - RNA, 16 nt, Mycobacterium avium subsp. paratuberculosis
cgcagggcgaacggcg

SEQ ID NO: 2914017 - RNA, 18 nt, Mycobacterium avium subsp. paratuberculosis
cgcagggcgaacggcgga

SEQ ID NO: 2914018 - RNA, 15 nt, Mycobacterium avium subsp. paratuberculosis
cgcagggcgccggug

SEQ ID NO: 2914019 - RNA, 16 nt, Mycobacterium avium subsp. paratuberculosis
cgcagggcggaaucgc

SEQ ID NO: 2914020 - RNA, 22 nt, Mycobacterium avium subsp. paratuberculosis
cgcagggcguucgacguccacc

SEQ ID NO: 2914021 - RNA, 17 nt, Mycobacterium avium subsp. paratuberculosis
cgcaggguggccagcac

SEQ ID NO: 2914022 - RNA, 18 nt, Mycobacterium avium subsp. paratuberculosis
cgcaggguggccagcacc

SEQ ID NO: 2914023 - RNA, 19 nt, Mycobacterium avium subsp. paratuberculosis
cgcaggguggccagcaccg

SEQ ID NO: 2914024 - RNA, 15 nt, Mycobacterium avium subsp. paratuberculosis
cgcagguacgcggcg

SEQ ID NO: 2914025 - RNA, 17 nt, Mycobacterium avium subsp. paratuberculosis
cgcagguacgcggcguu

SEQ ID NO: 2914026 - RNA, 18 nt, Mycobacterium avium subsp. paratuberculosis
cgcagguacgcggcguug

SEQ ID NO: 2914027 - RNA, 15 nt, Mycobacterium avium subsp. paratuberculosis
cgcagguagccgccg

SEQ ID NO: 2914028 - RNA, 21 nt, Mycobacterium avium subsp. paratuberculosis
cgcagguagccgccguagccg

SEQ ID NO: 2914029 - RNA, 13 nt, Mycobacterium avium subsp. paratuberculosis
cgcagguccaccc

SEQ ID NO: 2914030 - RNA, 15 nt, Mycobacterium avium subsp. paratuberculosis
cgcagguccacccgc

SEQ ID NO: 2914031 - RNA, 16 nt, Mycobacterium avium subsp. paratuberculosis
cgcagguccacccgcc

SEQ ID NO: 2914032 - RNA, 18 nt, Mycobacterium avium subsp. paratuberculosis
cgcagguccacccgcccc

SEQ ID NO: 2914033 - RNA, 15 nt, Mycobacterium avium subsp. paratuberculosis
cgcagguccggcagc

SEQ ID NO: 2914034 - RNA, 16 nt, Mycobacterium avium subsp. paratuberculosis
cgcagguccggcagcg

SEQ ID NO: 2914035 - RNA, 18 nt, Mycobacterium avium subsp. paratuberculosis
cgcagguccucggacucg

SEQ ID NO: 2914036 - RNA, 21 nt, Mycobacterium avium subsp. paratuberculosis
cgcagguccucggacucgucg

SEQ ID NO: 2914037 - RNA, 13 nt, Mycobacterium avium subsp. paratuberculosis
cgcaggucgaugg

SEQ ID NO: 2914038 - RNA, 15 nt, Mycobacterium avium subsp. paratuberculosis
cgcaggucgauggcg

SEQ ID NO: 2914039 - RNA, 12 nt, Mycobacterium avium subsp. paratuberculosis
cgcaggucgggc

SEQ ID NO: 2914040 - RNA, 16 nt, Mycobacterium avium subsp. paratuberculosis
cgcaggucgggccggc

SEQ ID NO: 2914041 - RNA, 18 nt, Mycobacterium avium subsp. paratuberculosis
cgcaggucgggccggccg

SEQ ID NO: 2914042 - RNA, 20 nt, Mycobacterium avium subsp. paratuberculosis
cgcaggugaucaaagccggu

SEQ ID NO: 2914043 - RNA, 18 nt, Mycobacterium avium subsp. paratuberculosis
cgcaggugaugcggcccg

SEQ ID NO: 2914044 - RNA, 21 nt, Mycobacterium avium subsp. paratuberculosis
cgcaggugaugcggcccgacc

SEQ ID NO: 2914045 - RNA, 15 nt, Mycobacterium avium subsp. paratuberculosis
cgcaggugcagcucc

SEQ ID NO: 2914046 - RNA, 15 nt, Mycobacterium avium subsp. paratuberculosis
cgcaggugccgguga

SEQ ID NO: 2914047 - RNA, 12 nt, Mycobacterium avium subsp. paratuberculosis
cgcaggugcgcc

SEQ ID NO: 2914048 - RNA, 13 nt, Mycobacterium avium subsp. paratuberculosis
cgcaggugcgccg

SEQ ID NO: 2914049 - RNA, 16 nt, Mycobacterium avium subsp. paratuberculosis
cgcaggugcgccgcuc

SEQ ID NO: 2914050 - RNA, 17 nt, Mycobacterium avium subsp. paratuberculosis
cgcaggugcgccgcucg

SEQ ID NO: 2914051 - RNA, 20 nt, Mycobacterium avium subsp. paratuberculosis
cgcaggugcgccgcucgucg

SEQ ID NO: 2914052 - RNA, 18 nt, Mycobacterium avium subsp. paratuberculosis
cgcaggugcucgccggcg

SEQ ID NO: 2914053 - RNA, 15 nt, Mycobacterium avium subsp. paratuberculosis
cgcaggugggcggug

SEQ ID NO: 2914054 - RNA, 16 nt, Mycobacterium avium subsp. paratuberculosis
cgcaggugggcggugc

SEQ ID NO: 2914055 - RNA, 13 nt, Mycobacterium avium subsp. paratuberculosis
cgcaggugguggg

SEQ ID NO: 2914056 - RNA, 16 nt, Mycobacterium avium subsp. paratuberculosis
cgcagguggugggcgu

SEQ ID NO: 2914057 - RNA, 18 nt, Mycobacterium avium subsp. paratuberculosis
cgcagguguccagcccua

SEQ ID NO: 2914058 - RNA, 14 nt, Mycobacterium avium subsp. paratuberculosis
cgcaggugugcggc

SEQ ID NO: 2914059 - RNA, 20 nt, Mycobacterium avium subsp. paratuberculosis
cgcagguucaugugaccggg

SEQ ID NO: 2914060 - RNA, 17 nt, Mycobacterium avium subsp. paratuberculosis
cgcagguuguccagccg

SEQ ID NO: 2914061 - RNA, 19 nt, Mycobacterium avium subsp. paratuberculosis
cgcagguuguccagccggu

SEQ ID NO: 2914062 - RNA, 18 nt, Mycobacterium avium subsp. paratuberculosis
cgcagguugucggccaac

SEQ ID NO: 2914063 - RNA, 17 nt, Mycobacterium avium subsp. paratuberculosis
cgcagguuucucgacca

SEQ ID NO: 2914064 - RNA, 14 nt, Mycobacterium avium subsp. paratuberculosis
cgcaguagccgacg

SEQ ID NO: 2914065 - RNA, 18 nt, Mycobacterium avium subsp. paratuberculosis
cgcaguagccgacgugcc

SEQ ID NO: 2914066 - RNA, 22 nt, Mycobacterium avium subsp. paratuberculosis
cgcaguagccgacgugcccgau

SEQ ID NO: 2914067 - RNA, 22 nt, Mycobacterium avium subsp. paratuberculosis
cgcaguagcgcauaggccgcga

SEQ ID NO: 2914068 - RNA, 22 nt, Mycobacterium avium subsp. paratuberculosis
cgcaguccaaaaacugcgcguc

SEQ ID NO: 2914069 - RNA, 14 nt, Mycobacterium avium subsp. paratuberculosis
cgcagucgaucacc

SEQ ID NO: 2914070 - RNA, 16 nt, Mycobacterium avium subsp. paratuberculosis
cgcagucgaucaccga

SEQ ID NO: 2914071 - RNA, 12 nt, Mycobacterium avium subsp. paratuberculosis
cgcagucgcugg

SEQ ID NO: 2914072 - RNA, 14 nt, Mycobacterium avium subsp. paratuberculosis
cgcagucggccgga

SEQ ID NO: 2914073 - RNA, 18 nt, Mycobacterium avium subsp. paratuberculosis
cgcagucggcgucgcggc

SEQ ID NO: 2914074 - RNA, 22 nt, Mycobacterium avium subsp. paratuberculosis
cgcagucggcgucgcggcgcac

SEQ ID NO: 2914075 - RNA, 14 nt, Mycobacterium avium subsp. paratuberculosis
cgcagucgucgaug

SEQ ID NO: 2914076 - RNA, 17 nt, Mycobacterium avium subsp. paratuberculosis
cgcagucguucggccag

SEQ ID NO: 2914077 - RNA, 18 nt, Mycobacterium avium subsp. paratuberculosis
cgcagucguucggccagc

SEQ ID NO: 2914078 - RNA, 22 nt, Mycobacterium avium subsp. paratuberculosis
cgcagucguucggccagcacca

SEQ ID NO: 2914079 - RNA, 14 nt, Mycobacterium avium subsp. paratuberculosis
cgcagugcccgccc

SEQ ID NO: 2914080 - RNA, 18 nt, Mycobacterium avium subsp. paratuberculosis
cgcagugcccgcccagcu

SEQ ID NO: 2914081 - RNA, 14 nt, Mycobacterium avium subsp. paratuberculosis
cgcagugccgcacc

SEQ ID NO: 2914082 - RNA, 15 nt, Mycobacterium avium subsp. paratuberculosis
cgcagugccgcacca

SEQ ID NO: 2914083 - RNA, 18 nt, Mycobacterium avium subsp. paratuberculosis
cgcagugccgcaccagca

SEQ ID NO: 2914084 - RNA, 21 nt, Mycobacterium avium subsp. paratuberculosis
cgcagugccgcaccagcaccc

SEQ ID NO: 2914085 - RNA, 15 nt, Mycobacterium avium subsp. paratuberculosis
cgcagugccggcgca

SEQ ID NO: 2914086 - RNA, 19 nt, Mycobacterium avium subsp. paratuberculosis
cgcagugccggcgcaccgc

SEQ ID NO: 2914087 - RNA, 22 nt, Mycobacterium avium subsp. paratuberculosis
cgcagugccggugcagcaccuc

SEQ ID NO: 2914088 - RNA, 21 nt, Mycobacterium avium subsp. paratuberculosis
cgcagugcggacgccacaaca

SEQ ID NO: 2914089 - RNA, 16 nt, Mycobacterium avium subsp. paratuberculosis
cgcaguuaccggcgua

SEQ ID NO: 2914090 - RNA, 13 nt, Mycobacterium avium subsp. paratuberculosis
cgcaguucaccga

SEQ ID NO: 2914091 - RNA, 15 nt, Mycobacterium avium subsp. paratuberculosis
cgcaguucaccgaag

SEQ ID NO: 2914092 - RNA, 22 nt, Mycobacterium avium subsp. paratuberculosis
cgcaguucaccgaaguccgcca

SEQ ID NO: 2914093 - RNA, 18 nt, Mycobacterium avium subsp. paratuberculosis
cgcaguucgaccggcacc

SEQ ID NO: 2914094 - RNA, 19 nt, Mycobacterium avium subsp. paratuberculosis
cgcaguucgaccggcacca

SEQ ID NO: 2914095 - RNA, 14 nt, Mycobacterium avium subsp. paratuberculosis
cgcaguucggccgc

SEQ ID NO: 2914096 - RNA, 16 nt, Mycobacterium avium subsp. paratuberculosis
cgcaguucggccgccg

SEQ ID NO: 2914097 - RNA, 18 nt, Mycobacterium avium subsp. paratuberculosis
cgcaguucggccgccgug

SEQ ID NO: 2914098 - RNA, 14 nt, Mycobacterium avium subsp. paratuberculosis
cgcaguucgggauc

SEQ ID NO: 2914099 - RNA, 15 nt, Mycobacterium avium subsp. paratuberculosis
cgcaguucgggaucg

SEQ ID NO: 2914100 - RNA, 23 nt, Mycobacterium avium subsp. paratuberculosis
cgcaguugcgcggcgggcgagcc

SEQ ID NO: 2914101 - RNA, 20 nt, Mycobacterium avium subsp. paratuberculosis
cgcauaccagcgcugguacc

SEQ ID NO: 2914102 - RNA, 15 nt, Mycobacterium avium subsp. paratuberculosis
cgcauaccgcccgcg

SEQ ID NO: 2914103 - RNA, 17 nt, Mycobacterium avium subsp. paratuberculosis
cgcauagcgggagccgg

SEQ ID NO: 2914104 - RNA, 18 nt, Mycobacterium avium subsp. paratuberculosis
cgcauagcgggagccggc

SEQ ID NO: 2914105 - RNA, 14 nt, Mycobacterium avium subsp. paratuberculosis
cgcauagcggucca

SEQ ID NO: 2914106 - RNA, 15 nt, Mycobacterium avium subsp. paratuberculosis
cgcauaggaccggau

SEQ ID NO: 2914107 - RNA, 14 nt, Mycobacterium avium subsp. paratuberculosis
cgcauaggccgcga

SEQ ID NO: 2914108 - RNA, 16 nt, Mycobacterium avium subsp. paratuberculosis
cgcaucaacugcacca

SEQ ID NO: 2914109 - RNA, 17 nt, Mycobacterium avium subsp. paratuberculosis
cgcaucacccggcgcgc

SEQ ID NO: 2914110 - RNA, 20 nt, Mycobacterium avium subsp. paratuberculosis
cgcaucacccggcgcgcgga

SEQ ID NO: 2914111 - RNA, 22 nt, Mycobacterium avium subsp. paratuberculosis
cgcaucaccuucugcgcgccgu

SEQ ID NO: 2914112 - RNA, 23 nt, Mycobacterium avium subsp. paratuberculosis
cgcaucaccuucugcgcgccguc

SEQ ID NO: 2914113 - RNA, 21 nt, Mycobacterium avium subsp. paratuberculosis
cgcaucagcaccuccggcagc

SEQ ID NO: 2914114 - RNA, 22 nt, Mycobacterium avium subsp. paratuberculosis
cgcaucagcaccuccggcagcg

SEQ ID NO: 2914115 - RNA, 13 nt, Mycobacterium avium subsp. paratuberculosis
cgcaucagcgcca

SEQ ID NO: 2914116 - RNA, 16 nt, Mycobacterium avium subsp. paratuberculosis
cgcaucagcgccacca

SEQ ID NO: 2914117 - RNA, 19 nt, Mycobacterium avium subsp. paratuberculosis
cgcaucagcggggcgucca

SEQ ID NO: 2914118 - RNA, 17 nt, Mycobacterium avium subsp. paratuberculosis
cgcaucagcucggcagc

SEQ ID NO: 2914119 - RNA, 20 nt, Mycobacterium avium subsp. paratuberculosis
cgcaucagcucuucgacgau

SEQ ID NO: 2914120 - RNA, 15 nt, Mycobacterium avium subsp. paratuberculosis
cgcaucagggccagc

SEQ ID NO: 2914121 - RNA, 16 nt, Mycobacterium avium subsp. paratuberculosis
cgcaucagggccagcc

SEQ ID NO: 2914122 - RNA, 24 nt, Mycobacterium avium subsp. paratuberculosis
cgcaucagggccagccgaugcgcc

SEQ ID NO: 2914123 - RNA, 14 nt, Mycobacterium avium subsp. paratuberculosis
cgcaucaucgccca

SEQ ID NO: 2914124 - RNA, 20 nt, Mycobacterium avium subsp. paratuberculosis
cgcaucaucgcccagcgcag

SEQ ID NO: 2914125 - RNA, 16 nt, Mycobacterium avium subsp. paratuberculosis
cgcaucaucucggcga

SEQ ID NO: 2914126 - RNA, 21 nt, Mycobacterium avium subsp. paratuberculosis
cgcaucaugcguuugccgucg

SEQ ID NO: 2914127 - RNA, 22 nt, Mycobacterium avium subsp. paratuberculosis
cgcaucaugcguuugccgucga

SEQ ID NO: 2914128 - RNA, 18 nt, Mycobacterium avium subsp. paratuberculosis
cgcauccaccagggcggu

SEQ ID NO: 2914129 - RNA, 20 nt, Mycobacterium avium subsp. paratuberculosis
cgcauccaccagggcgguga

SEQ ID NO: 2914130 - RNA, 17 nt, Mycobacterium avium subsp. paratuberculosis
cgcauccagcgccgcca

SEQ ID NO: 2914131 - RNA, 16 nt, Mycobacterium avium subsp. paratuberculosis
cgcaucccccucggcg

SEQ ID NO: 2914132 - RNA, 18 nt, Mycobacterium avium subsp. paratuberculosis
cgcaucccccucggcggg

SEQ ID NO: 2914133 - RNA, 15 nt, Mycobacterium avium subsp. paratuberculosis
cgcaucccgaucgac

SEQ ID NO: 2914134 - RNA, 18 nt, Mycobacterium avium subsp. paratuberculosis
cgcaucccgaucgacguc

SEQ ID NO: 2914135 - RNA, 19 nt, Mycobacterium avium subsp. paratuberculosis
cgcaucccgucgaccagga

SEQ ID NO: 2914136 - RNA, 11 nt, Mycobacterium avium subsp. paratuberculosis
cgcauccgcac

SEQ ID NO: 2914137 - RNA, 21 nt, Mycobacterium avium subsp. paratuberculosis
cgcauccgccgggcggcgucc

SEQ ID NO: 2914138 - RNA, 21 nt, Mycobacterium avium subsp. paratuberculosis
cgcauccucauagccggccgc

SEQ ID NO: 2914139 - RNA, 16 nt, Mycobacterium avium subsp. paratuberculosis
cgcaucgaaccgccgc

SEQ ID NO: 2914140 - RNA, 18 nt, Mycobacterium avium subsp. paratuberculosis
cgcaucgaaccgccgcgc

SEQ ID NO: 2914141 - RNA, 21 nt, Mycobacterium avium subsp. paratuberculosis
cgcaucgacugcgacacccgc

SEQ ID NO: 2914142 - RNA, 19 nt, Mycobacterium avium subsp. paratuberculosis
cgcaucgccgagagcgucu

SEQ ID NO: 2914143 - RNA, 17 nt, Mycobacterium avium subsp. paratuberculosis
cgcaucgccgagggcga

SEQ ID NO: 2914144 - RNA, 14 nt, Mycobacterium avium subsp. paratuberculosis
cgcaucgccggcgc

SEQ ID NO: 2914145 - RNA, 16 nt, Mycobacterium avium subsp. paratuberculosis
cgcaucgccggcgcgc

SEQ ID NO: 2914146 - RNA, 22 nt, Mycobacterium avium subsp. paratuberculosis
cgcaucgccguccacgggucgc

SEQ ID NO: 2914147 - RNA, 15 nt, Mycobacterium avium subsp. paratuberculosis
cgcaucgccucggcg

SEQ ID NO: 2914148 - RNA, 16 nt, Mycobacterium avium subsp. paratuberculosis
cgcaucgcggcgaugg

SEQ ID NO: 2914149 - RNA, 15 nt, Mycobacterium avium subsp. paratuberculosis
cgcaucgcgggccac

SEQ ID NO: 2914150 - RNA, 18 nt, Mycobacterium avium subsp. paratuberculosis
cgcaucgcgggccaccgg

SEQ ID NO: 2914151 - RNA, 19 nt, Mycobacterium avium subsp. paratuberculosis
cgcaucgcgggccaccggc

SEQ ID NO: 2914152 - RNA, 21 nt, Mycobacterium avium subsp. paratuberculosis
cgcaucgcgggccaccggcgc

SEQ ID NO: 2914153 - RNA, 22 nt, Mycobacterium avium subsp. paratuberculosis
cgcaucgcgggccaccggcgcc

SEQ ID NO: 2914154 - RNA, 12 nt, Mycobacterium avium subsp. paratuberculosis
cgcaucggcgac

SEQ ID NO: 2914155 - RNA, 16 nt, Mycobacterium avium subsp. paratuberculosis
cgcaucggcgacgccg

SEQ ID NO: 2914156 - RNA, 12 nt, Mycobacterium avium subsp. paratuberculosis
cgcaucggcgcc

SEQ ID NO: 2914157 - RNA, 13 nt, Mycobacterium avium subsp. paratuberculosis
cgcaucggcgccg

SEQ ID NO: 2914158 - RNA, 15 nt, Mycobacterium avium subsp. paratuberculosis
cgcaucggcgccgga

SEQ ID NO: 2914159 - RNA, 14 nt, Mycobacterium avium subsp. paratuberculosis
cgcaucgggcgaca

SEQ ID NO: 2914160 - RNA, 20 nt, Mycobacterium avium subsp. paratuberculosis
cgcaucgggcgacaucucgg

SEQ ID NO: 2914161 - RNA, 17 nt, Mycobacterium avium subsp. paratuberculosis
cgcaucggucaccagcu

SEQ ID NO: 2914162 - RNA, 19 nt, Mycobacterium avium subsp. paratuberculosis
cgcaucggucaccagcucc

SEQ ID NO: 2914163 - RNA, 20 nt, Mycobacterium avium subsp. paratuberculosis
cgcaucggucaccagcuccc

SEQ ID NO: 2914164 - RNA, 17 nt, Mycobacterium avium subsp. paratuberculosis
cgcaucguugccggcgg

SEQ ID NO: 2914165 - RNA, 19 nt, Mycobacterium avium subsp. paratuberculosis
cgcaucguugccggcggcg

SEQ ID NO: 2914166 - RNA, 24 nt, Mycobacterium avium subsp. paratuberculosis
cgcaucucgaaugcggcugccggc

SEQ ID NO: 2914167 - RNA, 17 nt, Mycobacterium avium subsp. paratuberculosis
cgcaucugcucggcguc

SEQ ID NO: 2914168 - RNA, 19 nt, Mycobacterium avium subsp. paratuberculosis
cgcaucugcucggcgucca

SEQ ID NO: 2914169 - RNA, 21 nt, Mycobacterium avium subsp. paratuberculosis
cgcaugaccgauccgccggcg

SEQ ID NO: 2914170 - RNA, 23 nt, Mycobacterium avium subsp. paratuberculosis
cgcaugaccgauccgccggcgaa

SEQ ID NO: 2914171 - RNA, 18 nt, Mycobacterium avium subsp. paratuberculosis
cgcaugacggccugcacc

SEQ ID NO: 2914172 - RNA, 16 nt, Mycobacterium avium subsp. paratuberculosis
cgcaugaugcccaggc

SEQ ID NO: 2914173 - RNA, 22 nt, Mycobacterium avium subsp. paratuberculosis
cgcaugaugcccaggcccacca

SEQ ID NO: 2914174 - RNA, 15 nt, Mycobacterium avium subsp. paratuberculosis
cgcaugaugcggcca

SEQ ID NO: 2914175 - RNA, 18 nt, Mycobacterium avium subsp. paratuberculosis
cgcaugccagaccacaag

SEQ ID NO: 2914176 - RNA, 14 nt, Mycobacterium avium subsp. paratuberculosis
cgcaugcccuuguc

SEQ ID NO: 2914177 - RNA, 21 nt, Mycobacterium avium subsp. paratuberculosis
cgcaugcccuugucgcuggcg

SEQ ID NO: 2914178 - RNA, 19 nt, Mycobacterium avium subsp. paratuberculosis
cgcauggagaugcuucagc

SEQ ID NO: 2914179 - RNA, 21 nt, Mycobacterium avium subsp. paratuberculosis
cgcauggagaugcuucagccc

SEQ ID NO: 2914180 - RNA, 13 nt, Mycobacterium avium subsp. paratuberculosis
cgcauggccggcg

SEQ ID NO: 2914181 - RNA, 15 nt, Mycobacterium avium subsp. paratuberculosis
cgcauggccggcgaa

SEQ ID NO: 2914182 - RNA, 22 nt, Mycobacterium avium subsp. paratuberculosis
cgcauggccggcgaaccgccgc

SEQ ID NO: 2914183 - RNA, 15 nt, Mycobacterium avium subsp. paratuberculosis
cgcauggccuugaga

SEQ ID NO: 2914184 - RNA, 15 nt, Mycobacterium avium subsp. paratuberculosis
cgcauggucagguag

SEQ ID NO: 2914185 - RNA, 21 nt, Mycobacterium avium subsp. paratuberculosis
cgcauggucagguaggcgucg

SEQ ID NO: 2914186 - RNA, 20 nt, Mycobacterium avium subsp. paratuberculosis
cgcauguaggacaccccggc

SEQ ID NO: 2914187 - RNA, 15 nt, Mycobacterium avium subsp. paratuberculosis
cgcauguccgccguc

SEQ ID NO: 2914188 - RNA, 16 nt, Mycobacterium avium subsp. paratuberculosis
cgcauguccgccguca

SEQ ID NO: 2914189 - RNA, 19 nt, Mycobacterium avium subsp. paratuberculosis
cgcauguccgccgucaucg

SEQ ID NO: 2914190 - RNA, 19 nt, Mycobacterium avium subsp. paratuberculosis
cgcauguccggggugagca

SEQ ID NO: 2914191 - RNA, 16 nt, Mycobacterium avium subsp. paratuberculosis
cgcaugucgaccucgg

SEQ ID NO: 2914192 - RNA, 20 nt, Mycobacterium avium subsp. paratuberculosis
cgcaugucgaccucggccac

SEQ ID NO: 2914193 - RNA, 15 nt, Mycobacterium avium subsp. paratuberculosis
cgcauguucucgagc

SEQ ID NO: 2914194 - RNA, 14 nt, Mycobacterium avium subsp. paratuberculosis
cgcauguuggugau

SEQ ID NO: 2914195 - RNA, 23 nt, Mycobacterium avium subsp. paratuberculosis
cgcauguuggugaucagccccgc

SEQ ID NO: 2914196 - RNA, 18 nt, Mycobacterium avium subsp. paratuberculosis
cgcauguugugcccgacg

SEQ ID NO: 2914197 - RNA, 18 nt, Mycobacterium avium subsp. paratuberculosis
cgcauucaaugucgcccu

SEQ ID NO: 2914198 - RNA, 14 nt, Mycobacterium avium subsp. paratuberculosis
cgcauucaccagcu

SEQ ID NO: 2914199 - RNA, 17 nt, Mycobacterium avium subsp. paratuberculosis
cgcauuccucggccagc

SEQ ID NO: 2914200 - RNA, 12 nt, Mycobacterium avium subsp. paratuberculosis
cgcauucggccg

SEQ ID NO: 2914201 - RNA, 13 nt, Mycobacterium avium subsp. paratuberculosis
cgcauucggccgc

SEQ ID NO: 2914202 - RNA, 16 nt, Mycobacterium avium subsp. paratuberculosis
cgcauucggccgccac

SEQ ID NO: 2914203 - RNA, 19 nt, Mycobacterium avium subsp. paratuberculosis
cgcauuggugccggccucg

SEQ ID NO: 2914204 - RNA, 13 nt, Mycobacterium avium subsp. paratuberculosis
cgcauuucccgag

SEQ ID NO: 2914205 - RNA, 19 nt, Mycobacterium avium subsp. paratuberculosis
cgcauuugccgacaugcug

SEQ ID NO: 2914206 - RNA, 15 nt, Mycobacterium avium subsp. paratuberculosis
cgccaaaacggggug

SEQ ID NO: 2914207 - RNA, 15 nt, Mycobacterium avium subsp. paratuberculosis
cgccaaacugcgcaa

SEQ ID NO: 2914208 - RNA, 17 nt, Mycobacterium avium subsp. paratuberculosis
cgccaaaucgaucaccc

SEQ ID NO: 2914209 - RNA, 20 nt, Mycobacterium avium subsp. paratuberculosis
cgccaacaacuacgagcagc

SEQ ID NO: 2914210 - RNA, 18 nt, Mycobacterium avium subsp. paratuberculosis
cgccaacaacucagaaca

SEQ ID NO: 2914211 - RNA, 14 nt, Mycobacterium avium subsp. paratuberculosis
cgccaacaacucga

SEQ ID NO: 2914212 - RNA, 23 nt, Mycobacterium avium subsp. paratuberculosis
cgccaacaacucgacgcucggcg

SEQ ID NO: 2914213 - RNA, 14 nt, Mycobacterium avium subsp. paratuberculosis
cgccaaccaggucg

SEQ ID NO: 2914214 - RNA, 22 nt, Mycobacterium avium subsp. paratuberculosis
cgccaaccaggucgcggcgcug

SEQ ID NO: 2914215 - RNA, 22 nt, Mycobacterium avium subsp. paratuberculosis
cgccaacgaggcacggcccgcu

SEQ ID NO: 2914216 - RNA, 19 nt, Mycobacterium avium subsp. paratuberculosis
cgccaacgcuuuugcgggu

SEQ ID NO: 2914217 - RNA, 20 nt, Mycobacterium avium subsp. paratuberculosis
cgccaacggauucagcgucg

SEQ ID NO: 2914218 - RNA, 22 nt, Mycobacterium avium subsp. paratuberculosis
cgccaacugaauuccuggccgg

SEQ ID NO: 2914219 - RNA, 23 nt, Mycobacterium avium subsp. paratuberculosis
cgccaacugaauuccuggccggu

SEQ ID NO: 2914220 - RNA, 19 nt, Mycobacterium avium subsp. paratuberculosis
cgccaacugguccugcggc

SEQ ID NO: 2914221 - RNA, 20 nt, Mycobacterium avium subsp. paratuberculosis
cgccaagaagugggccauca

SEQ ID NO: 2914222 - RNA, 20 nt, Mycobacterium avium subsp. paratuberculosis
cgccaaggggaacaacgcgc

SEQ ID NO: 2914223 - RNA, 17 nt, Mycobacterium avium subsp. paratuberculosis
cgccaaggucgucaacg

SEQ ID NO: 2914224 - RNA, 16 nt, Mycobacterium avium subsp. paratuberculosis
cgccaagugcggugug

SEQ ID NO: 2914225 - RNA, 19 nt, Mycobacterium avium subsp. paratuberculosis
cgccaagugcgguguggcc

SEQ ID NO: 2914226 - RNA, 16 nt, Mycobacterium avium subsp. paratuberculosis
cgccaauaaagcgggc

SEQ ID NO: 2914227 - RNA, 14 nt, Mycobacterium avium subsp. paratuberculosis
cgccaaucaccgcg

SEQ ID NO: 2914228 - RNA, 14 nt, Mycobacterium avium subsp. paratuberculosis
cgccaauccggcgg

SEQ ID NO: 2914229 - RNA, 16 nt, Mycobacterium avium subsp. paratuberculosis
cgccaauccggcgggc

SEQ ID NO: 2914230 - RNA, 20 nt, Mycobacterium avium subsp. paratuberculosis
cgccaauccggcgggccucg

SEQ ID NO: 2914231 - RNA, 23 nt, Mycobacterium avium subsp. paratuberculosis
cgccaauccggcgggccucgccg

SEQ ID NO: 2914232 - RNA, 17 nt, Mycobacterium avium subsp. paratuberculosis
cgccaauugugugacaa

SEQ ID NO: 2914233 - RNA, 16 nt, Mycobacterium avium subsp. paratuberculosis
cgccacaaacagcgcg

SEQ ID NO: 2914234 - RNA, 17 nt, Mycobacterium avium subsp. paratuberculosis
cgccacaaacagcgcgg

SEQ ID NO: 2914235 - RNA, 18 nt, Mycobacterium avium subsp. paratuberculosis
cgccacaaacagcgcggc

SEQ ID NO: 2914236 - RNA, 22 nt, Mycobacterium avium subsp. paratuberculosis
cgccacaaacagcgcggccgga

SEQ ID NO: 2914237 - RNA, 22 nt, Mycobacterium avium subsp. paratuberculosis
cgccacaacagguucgacagcg

SEQ ID NO: 2914238 - RNA, 14 nt, Mycobacterium avium subsp. paratuberculosis
cgccacaacuggcc

SEQ ID NO: 2914239 - RNA, 17 nt, Mycobacterium avium subsp. paratuberculosis
cgccacaacuggccggg

SEQ ID NO: 2914240 - RNA, 20 nt, Mycobacterium avium subsp. paratuberculosis
cgccacaacuggccgggauu

SEQ ID NO: 2914241 - RNA, 16 nt, Mycobacterium avium subsp. paratuberculosis
cgccacaacuggucgu

SEQ ID NO: 2914242 - RNA, 18 nt, Mycobacterium avium subsp. paratuberculosis
cgccacaacuggucgugc

SEQ ID NO: 2914243 - RNA, 19 nt, Mycobacterium avium subsp. paratuberculosis
cgccacaacuggucgugcu

SEQ ID NO: 2914244 - RNA, 23 nt, Mycobacterium avium subsp. paratuberculosis
cgccacaacuggucgugcucguc

SEQ ID NO: 2914245 - RNA, 13 nt, Mycobacterium avium subsp. paratuberculosis
cgccacaccgaag

SEQ ID NO: 2914246 - RNA, 15 nt, Mycobacterium avium subsp. paratuberculosis
cgccacaccucggcg

SEQ ID NO: 2914247 - RNA, 13 nt, Mycobacterium avium subsp. paratuberculosis
cgccacagcgccu

SEQ ID NO: 2914248 - RNA, 15 nt, Mycobacterium avium subsp. paratuberculosis
cgccacagcgccucg

SEQ ID NO: 2914249 - RNA, 21 nt, Mycobacterium avium subsp. paratuberculosis
cgccacagcgucucgaccgcg

SEQ ID NO: 2914250 - RNA, 13 nt, Mycobacterium avium subsp. paratuberculosis
cgccacaucagcu

SEQ ID NO: 2914251 - RNA, 21 nt, Mycobacterium avium subsp. paratuberculosis
cgccacaucagcucggcggcc

SEQ ID NO: 2914252 - RNA, 23 nt, Mycobacterium avium subsp. paratuberculosis
cgccacaucagcucggcggccuc

SEQ ID NO: 2914253 - RNA, 22 nt, Mycobacterium avium subsp. paratuberculosis
cgccacaucgggauuggcggcc

SEQ ID NO: 2914254 - RNA, 11 nt, Mycobacterium avium subsp. paratuberculosis
cgccaccacca

SEQ ID NO: 2914255 - RNA, 18 nt, Mycobacterium avium subsp. paratuberculosis
cgccaccaccacggggcg

SEQ ID NO: 2914256 - RNA, 19 nt, Mycobacterium avium subsp. paratuberculosis
cgccaccaccacggggcgg

SEQ ID NO: 2914257 - RNA, 23 nt, Mycobacterium avium subsp. paratuberculosis
cgccaccaccacggggcgggucg

SEQ ID NO: 2914258 - RNA, 14 nt, Mycobacterium avium subsp. paratuberculosis
cgccaccaccagcg

SEQ ID NO: 2914259 - RNA, 16 nt, Mycobacterium avium subsp. paratuberculosis
cgccaccaccagcggu

SEQ ID NO: 2914260 - RNA, 16 nt, Mycobacterium avium subsp. paratuberculosis
cgccaccacccggcga

SEQ ID NO: 2914261 - RNA, 17 nt, Mycobacterium avium subsp. paratuberculosis
cgccaccacccggcgau

SEQ ID NO: 2914262 - RNA, 13 nt, Mycobacterium avium subsp. paratuberculosis
cgccaccaccgcg

SEQ ID NO: 2914263 - RNA, 14 nt, Mycobacterium avium subsp. paratuberculosis
cgccaccaccgcgc

SEQ ID NO: 2914264 - RNA, 17 nt, Mycobacterium avium subsp. paratuberculosis
cgccaccaccgcgccgu

SEQ ID NO: 2914265 - RNA, 15 nt, Mycobacterium avium subsp. paratuberculosis
cgccaccaccuccuc

SEQ ID NO: 2914266 - RNA, 17 nt, Mycobacterium avium subsp. paratuberculosis
cgccaccaccuccucgc

SEQ ID NO: 2914267 - RNA, 20 nt, Mycobacterium avium subsp. paratuberculosis
cgccaccaccuucaucgccg

SEQ ID NO: 2914268 - RNA, 23 nt, Mycobacterium avium subsp. paratuberculosis
cgccaccaccuucaucgccgucg

SEQ ID NO: 2914269 - RNA, 14 nt, Mycobacterium avium subsp. paratuberculosis
cgccaccacggcgc

SEQ ID NO: 2914270 - RNA, 15 nt, Mycobacterium avium subsp. paratuberculosis
cgccaccacggcguc

SEQ ID NO: 2914271 - RNA, 17 nt, Mycobacterium avium subsp. paratuberculosis
cgccaccacggcgucgc

SEQ ID NO: 2914272 - RNA, 20 nt, Mycobacterium avium subsp. paratuberculosis
cgccaccacggcgucgcuga

SEQ ID NO: 2914273 - RNA, 15 nt, Mycobacterium avium subsp. paratuberculosis
cgccaccagaccggc

SEQ ID NO: 2914274 - RNA, 16 nt, Mycobacterium avium subsp. paratuberculosis
cgccaccagaccggcg

SEQ ID NO: 2914275 - RNA, 19 nt, Mycobacterium avium subsp. paratuberculosis
cgccaccagaccggcgaag

SEQ ID NO: 2914276 - RNA, 13 nt, Mycobacterium avium subsp. paratuberculosis
cgccaccagcacc

SEQ ID NO: 2914277 - RNA, 12 nt, Mycobacterium avium subsp. paratuberculosis
cgccaccagcag

SEQ ID NO: 2914278 - RNA, 13 nt, Mycobacterium avium subsp. paratuberculosis
cgccaccagcagg

SEQ ID NO: 2914279 - RNA, 14 nt, Mycobacterium avium subsp. paratuberculosis
cgccaccagcaggc

SEQ ID NO: 2914280 - RNA, 20 nt, Mycobacterium avium subsp. paratuberculosis
cgccaccagcaggcccaacg

SEQ ID NO: 2914281 - RNA, 22 nt, Mycobacterium avium subsp. paratuberculosis
cgccaccagcaggcccaacgug

SEQ ID NO: 2914282 - RNA, 20 nt, Mycobacterium avium subsp. paratuberculosis
cgccaccagccacaccgccg

SEQ ID NO: 2914283 - RNA, 21 nt, Mycobacterium avium subsp. paratuberculosis
cgccaccagccacaccgccgc

SEQ ID NO: 2914284 - RNA, 23 nt, Mycobacterium avium subsp. paratuberculosis
cgccaccagccacaccgccgcgg

SEQ ID NO: 2914285 - RNA, 17 nt, Mycobacterium avium subsp. paratuberculosis
cgccaccagcgcacaca

SEQ ID NO: 2914286 - RNA, 13 nt, Mycobacterium avium subsp. paratuberculosis
cgccaccaggccg

SEQ ID NO: 2914287 - RNA, 21 nt, Mycobacterium avium subsp. paratuberculosis
cgccaccaggccgugguuggc

SEQ ID NO: 2914288 - RNA, 17 nt, Mycobacterium avium subsp. paratuberculosis
cgccaccaggcgguccg

SEQ ID NO: 2914289 - RNA, 18 nt, Mycobacterium avium subsp. paratuberculosis
cgccaccccaggcgaugc

SEQ ID NO: 2914290 - RNA, 13 nt, Mycobacterium avium subsp. paratuberculosis
cgccaccccgaac

SEQ ID NO: 2914291 - RNA, 22 nt, Mycobacterium avium subsp. paratuberculosis
cgccaccccgaacccggccagc

SEQ ID NO: 2914292 - RNA, 22 nt, Mycobacterium avium subsp. paratuberculosis
cgccaccccgagcucgggcgcg

SEQ ID NO: 2914293 - RNA, 15 nt, Mycobacterium avium subsp. paratuberculosis
cgccaccccgcgcca

SEQ ID NO: 2914294 - RNA, 18 nt, Mycobacterium avium subsp. paratuberculosis
cgccaccccgcgccacgc

SEQ ID NO: 2914295 - RNA, 20 nt, Mycobacterium avium subsp. paratuberculosis
cgccaccccgcgccacgccg

SEQ ID NO: 2914296 - RNA, 22 nt, Mycobacterium avium subsp. paratuberculosis
cgccaccccgggaacgacggug

SEQ ID NO: 2914297 - RNA, 23 nt, Mycobacterium avium subsp. paratuberculosis
cgccaccccgggaacgacggugc

SEQ ID NO: 2914298 - RNA, 12 nt, Mycobacterium avium subsp. paratuberculosis
cgccacccgcac

SEQ ID NO: 2914299 - RNA, 14 nt, Mycobacterium avium subsp. paratuberculosis
cgccacccgcaccu

SEQ ID NO: 2914300 - RNA, 15 nt, Mycobacterium avium subsp. paratuberculosis
cgccacccgcaccuc

SEQ ID NO: 2914301 - RNA, 21 nt, Mycobacterium avium subsp. paratuberculosis
cgccacccgcaccucgcuggc

SEQ ID NO: 2914302 - RNA, 22 nt, Mycobacterium avium subsp. paratuberculosis
cgccacccgcaccucgcuggcg

SEQ ID NO: 2914303 - RNA, 17 nt, Mycobacterium avium subsp. paratuberculosis
cgccaccgacaccaccg

SEQ ID NO: 2914304 - RNA, 19 nt, Mycobacterium avium subsp. paratuberculosis
cgccaccgacaccaccggc

SEQ ID NO: 2914305 - RNA, 22 nt, Mycobacterium avium subsp. paratuberculosis
cgccaccgagaucaugccggcg

SEQ ID NO: 2914306 - RNA, 21 nt, Mycobacterium avium subsp. paratuberculosis
cgccaccgaggugacgucgcg

SEQ ID NO: 2914307 - RNA, 17 nt, Mycobacterium avium subsp. paratuberculosis
cgccaccgagucgcgcg

SEQ ID NO: 2914308 - RNA, 14 nt, Mycobacterium avium subsp. paratuberculosis
cgccaccgaugcgg

SEQ ID NO: 2914309 - RNA, 18 nt, Mycobacterium avium subsp. paratuberculosis
cgccaccgaugcgggcca

SEQ ID NO: 2914310 - RNA, 12 nt, Mycobacterium avium subsp. paratuberculosis
cgccaccgcccg

SEQ ID NO: 2914311 - RNA, 14 nt, Mycobacterium avium subsp. paratuberculosis
cgccaccgcccgcu

SEQ ID NO: 2914312 - RNA, 15 nt, Mycobacterium avium subsp. paratuberculosis
cgccaccgcccgcug

SEQ ID NO: 2914313 - RNA, 20 nt, Mycobacterium avium subsp. paratuberculosis
cgccaccgcccgcugaccgc

SEQ ID NO: 2914314 - RNA, 22 nt, Mycobacterium avium subsp. paratuberculosis
cgccaccgcgaaagcgucggcu

SEQ ID NO: 2914315 - RNA, 13 nt, Mycobacterium avium subsp. paratuberculosis
cgccaccgcgaac

SEQ ID NO: 2914316 - RNA, 12 nt, Mycobacterium avium subsp. paratuberculosis
cgccaccgcgau

SEQ ID NO: 2914317 - RNA, 15 nt, Mycobacterium avium subsp. paratuberculosis
cgccaccgcgcaacc

SEQ ID NO: 2914318 - RNA, 22 nt, Mycobacterium avium subsp. paratuberculosis
cgccaccgcgcaaccgggccgc

SEQ ID NO: 2914319 - RNA, 21 nt, Mycobacterium avium subsp. paratuberculosis
cgccaccgcggggcugggcgc

SEQ ID NO: 2914320 - RNA, 13 nt, Mycobacterium avium subsp. paratuberculosis
cgccaccggcccg

SEQ ID NO: 2914321 - RNA, 19 nt, Mycobacterium avium subsp. paratuberculosis
cgccaccggcccggccggc

SEQ ID NO: 2914322 - RNA, 16 nt, Mycobacterium avium subsp. paratuberculosis
aggcguccagccagcg

SEQ ID NO: 2914323 - RNA, 18 nt, Mycobacterium avium subsp. paratuberculosis
aggcguccagggccaccg

SEQ ID NO: 2914324 - RNA, 19 nt, Mycobacterium avium subsp. paratuberculosis
aggcguccagggccaccgc

SEQ ID NO: 2914325 - RNA, 19 nt, Mycobacterium avium subsp. paratuberculosis
aggcguccgcaagcaccuc

SEQ ID NO: 2914326 - RNA, 14 nt, Mycobacterium avium subsp. paratuberculosis
aggcguccuccucg

SEQ ID NO: 2914327 - RNA, 18 nt, Mycobacterium avium subsp. paratuberculosis
aggcgucgaacgggccgg

SEQ ID NO: 2914328 - RNA, 23 nt, Mycobacterium avium subsp. paratuberculosis
aggcgucgaacgggccgggcacc

SEQ ID NO: 2914329 - RNA, 14 nt, Mycobacterium avium subsp. paratuberculosis
aggcgucgacgcgc

SEQ ID NO: 2914330 - RNA, 18 nt, Mycobacterium avium subsp. paratuberculosis
aggcgucgcgcagcagcg

SEQ ID NO: 2914331 - RNA, 21 nt, Mycobacterium avium subsp. paratuberculosis
aggcgucgcgcagcagcggga

SEQ ID NO: 2914332 - RNA, 13 nt, Mycobacterium avium subsp. paratuberculosis
aggcgucgcgguc

SEQ ID NO: 2914333 - RNA, 20 nt, Mycobacterium avium subsp. paratuberculosis
aggcgucgcggucggcgucg

SEQ ID NO: 2914334 - RNA, 12 nt, Mycobacterium avium subsp. paratuberculosis
aggcgucggcgg

SEQ ID NO: 2914335 - RNA, 14 nt, Mycobacterium avium subsp. paratuberculosis
aggcgucggucagc

SEQ ID NO: 2914336 - RNA, 20 nt, Mycobacterium avium subsp. paratuberculosis
aggcgucggucagcaggcgc

SEQ ID NO: 2914337 - RNA, 23 nt, Mycobacterium avium subsp. paratuberculosis
aggcgucggucagcaggcgccgc

SEQ ID NO: 2914338 - RNA, 16 nt, Mycobacterium avium subsp. paratuberculosis
aggcgucgucggccca

SEQ ID NO: 2914339 - RNA, 16 nt, Mycobacterium avium subsp. paratuberculosis
aggcgugcagcccgca

SEQ ID NO: 2914340 - RNA, 14 nt, Mycobacterium avium subsp. paratuberculosis
aggcgugccgcugg

SEQ ID NO: 2914341 - RNA, 15 nt, Mycobacterium avium subsp. paratuberculosis
aggcgugccgcuggg

SEQ ID NO: 2914342 - RNA, 14 nt, Mycobacterium avium subsp. paratuberculosis
aggcgugcucgauc

SEQ ID NO: 2914343 - RNA, 20 nt, Mycobacterium avium subsp. paratuberculosis
aggcguggguuccgccgucg

SEQ ID NO: 2914344 - RNA, 17 nt, Mycobacterium avium subsp. paratuberculosis
aggcguucgaccccaac

SEQ ID NO: 2914345 - RNA, 15 nt, Mycobacterium avium subsp. paratuberculosis
aggcguugcaccgcg

SEQ ID NO: 2914346 - RNA, 21 nt, Mycobacterium avium subsp. paratuberculosis
aggcguugcgucccgcgccgg

SEQ ID NO: 2914347 - RNA, 17 nt, Mycobacterium avium subsp. paratuberculosis
aggcguuggacuccacc

SEQ ID NO: 2914348 - RNA, 19 nt, Mycobacterium avium subsp. paratuberculosis
aggcguuggacuccaccgc

SEQ ID NO: 2914349 - RNA, 21 nt, Mycobacterium avium subsp. paratuberculosis
aggcguuggacuccaccgcca

SEQ ID NO: 2914350 - RNA, 23 nt, Mycobacterium avium subsp. paratuberculosis
aggcguuggacuccaccgccacc

SEQ ID NO: 2914351 - RNA, 18 nt, Mycobacterium avium subsp. paratuberculosis
aggcguuggagccgacca

SEQ ID NO: 2914352 - RNA, 16 nt, Mycobacterium avium subsp. paratuberculosis
aggcguuggcccgcac

SEQ ID NO: 2914353 - RNA, 21 nt, Mycobacterium avium subsp. paratuberculosis
aggcguuggcccgcacccgcc

SEQ ID NO: 2914354 - RNA, 22 nt, Mycobacterium avium subsp. paratuberculosis
aggcguuggucaccaucagcgg

SEQ ID NO: 2914355 - RNA, 23 nt, Mycobacterium avium subsp. paratuberculosis
aggcucacgcugccaaaguuggc

SEQ ID NO: 2914356 - RNA, 18 nt, Mycobacterium avium subsp. paratuberculosis
aggcucaggccgguggcg

SEQ ID NO: 2914357 - RNA, 13 nt, Mycobacterium avium subsp. paratuberculosis
aggcuccgccgau

SEQ ID NO: 2914358 - RNA, 19 nt, Mycobacterium avium subsp. paratuberculosis
aggcuccgccgauguacuc

SEQ ID NO: 2914359 - RNA, 18 nt, Mycobacterium avium subsp. paratuberculosis
aggcucgcgagggcgggc

SEQ ID NO: 2914360 - RNA, 18 nt, Mycobacterium avium subsp. paratuberculosis
aggcucgcucccgcgcgg

SEQ ID NO: 2914361 - RNA, 15 nt, Mycobacterium avium subsp. paratuberculosis
aggcugaacgucguc

SEQ ID NO: 2914362 - RNA, 16 nt, Mycobacterium avium subsp. paratuberculosis
aggcugaacgucguca

SEQ ID NO: 2914363 - RNA, 19 nt, Mycobacterium avium subsp. paratuberculosis
aggcugaaucccuccggca

SEQ ID NO: 2914364 - RNA, 22 nt, Mycobacterium avium subsp. paratuberculosis
aggcugaaucccuccggcaggc

SEQ ID NO: 2914365 - RNA, 21 nt, Mycobacterium avium subsp. paratuberculosis
aggcugacgcgaccgcgcggc

SEQ ID NO: 2914366 - RNA, 22 nt, Mycobacterium avium subsp. paratuberculosis
aggcugacgcgaccgcgcggcg

SEQ ID NO: 2914367 - RNA, 19 nt, Mycobacterium avium subsp. paratuberculosis
agcggcgccacguggucga

SEQ ID NO: 2914368 - RNA, 16 nt, Mycobacterium avium subsp. paratuberculosis
agcggcgccgcagcuc

SEQ ID NO: 2914369 - RNA, 13 nt, Mycobacterium avium subsp. paratuberculosis
agcggcgccgggu

SEQ ID NO: 2914370 - RNA, 20 nt, Mycobacterium avium subsp. paratuberculosis
agcggcgccgggucaccgga

SEQ ID NO: 2914371 - RNA, 14 nt, Mycobacterium avium subsp. paratuberculosis
agcggcgcgccggg

SEQ ID NO: 2914372 - RNA, 14 nt, Mycobacterium avium subsp. paratuberculosis
agcggcgcgcgccg

SEQ ID NO: 2914373 - RNA, 18 nt, Mycobacterium avium subsp. paratuberculosis
agcggcgcgcgccgcagc

SEQ ID NO: 2914374 - RNA, 12 nt, Mycobacterium avium subsp. paratuberculosis
agcggcgcgguu

SEQ ID NO: 2914375 - RNA, 12 nt, Mycobacterium avium subsp. paratuberculosis
agcggcgcgucc

SEQ ID NO: 2914376 - RNA, 13 nt, Mycobacterium avium subsp. paratuberculosis
agcggcgcugcag

SEQ ID NO: 2914377 - RNA, 18 nt, Mycobacterium avium subsp. paratuberculosis
agcggcgcugcagcagcc

SEQ ID NO: 2914378 - RNA, 20 nt, Mycobacterium avium subsp. paratuberculosis
agcggcgcugcagcagcccg

SEQ ID NO: 2914379 - RNA, 21 nt, Mycobacterium avium subsp. paratuberculosis
agcggcgcugcagcagcccga

SEQ ID NO: 2914380 - RNA, 14 nt, Mycobacterium avium subsp. paratuberculosis
agcggcggcacggu

SEQ ID NO: 2914381 - RNA, 22 nt, Mycobacterium avium subsp. paratuberculosis
agcggcggcacgguuggccggc

SEQ ID NO: 2914382 - RNA, 12 nt, Mycobacterium avium subsp. paratuberculosis
agcggcggccuu

SEQ ID NO: 2914383 - RNA, 15 nt, Mycobacterium avium subsp. paratuberculosis
agcggcgggcccagc

SEQ ID NO: 2914384 - RNA, 13 nt, Mycobacterium avium subsp. paratuberculosis
agcggcggucggc

SEQ ID NO: 2914385 - RNA, 18 nt, Mycobacterium avium subsp. paratuberculosis
agcggcggucggcgccga

SEQ ID NO: 2914386 - RNA, 19 nt, Mycobacterium avium subsp. paratuberculosis
agcggcggucggcgccgau

SEQ ID NO: 2914387 - RNA, 21 nt, Mycobacterium avium subsp. paratuberculosis
agcggcggucggcgccgauca

SEQ ID NO: 2914388 - RNA, 15 nt, Mycobacterium avium subsp. paratuberculosis
agcggcguaccgcgg

SEQ ID NO: 2914389 - RNA, 18 nt, Mycobacterium avium subsp. paratuberculosis
agcggcgucacgcccucu

SEQ ID NO: 2914390 - RNA, 19 nt, Mycobacterium avium subsp. paratuberculosis
agcggcgucaggaugguga

SEQ ID NO: 2914391 - RNA, 14 nt, Mycobacterium avium subsp. paratuberculosis
agcggcgugaccgg

SEQ ID NO: 2914392 - RNA, 17 nt, Mycobacterium avium subsp. paratuberculosis
agcggcgugaccgggaa

SEQ ID NO: 2914393 - RNA, 21 nt, Mycobacterium avium subsp. paratuberculosis
agcggcgugcugcgcagcagc

SEQ ID NO: 2914394 - RNA, 16 nt, Mycobacterium avium subsp. paratuberculosis
agcggcucgccaccuc

SEQ ID NO: 2914395 - RNA, 21 nt, Mycobacterium avium subsp. paratuberculosis
agcggcucgccaccucggaga

SEQ ID NO: 2914396 - RNA, 14 nt, Mycobacterium avium subsp. paratuberculosis
agcggcucgcgggu

SEQ ID NO: 2914397 - RNA, 22 nt, Mycobacterium avium subsp. paratuberculosis
agcggcucgcgggugcggcgcu

SEQ ID NO: 2914398 - RNA, 23 nt, Mycobacterium avium subsp. paratuberculosis
agcggcucgcgggugcggcgcug

SEQ ID NO: 2914399 - RNA, 13 nt, Mycobacterium avium subsp. paratuberculosis
agcggcucggccu

SEQ ID NO: 2914400 - RNA, 18 nt, Mycobacterium avium subsp. paratuberculosis
agcggcugacccgcccgg

SEQ ID NO: 2914401 - RNA, 19 nt, Mycobacterium avium subsp. paratuberculosis
agcggcugacccgcccggg

SEQ ID NO: 2914402 - RNA, 21 nt, Mycobacterium avium subsp. paratuberculosis
agcggcugacccgcccgggug

SEQ ID NO: 2914403 - RNA, 22 nt, Mycobacterium avium subsp. paratuberculosis
agcggcugaccgagcggcgcug

SEQ ID NO: 2914404 - RNA, 12 nt, Mycobacterium avium subsp. paratuberculosis
agcggcugcagc

SEQ ID NO: 2914405 - RNA, 20 nt, Mycobacterium avium subsp. paratuberculosis
agcggcugcagcagaugcgc

SEQ ID NO: 2914406 - RNA, 18 nt, Mycobacterium avium subsp. paratuberculosis
agcggcugcugcagcgcc

SEQ ID NO: 2914407 - RNA, 22 nt, Mycobacterium avium subsp. paratuberculosis
agcggcugcugcagcgcccggg

SEQ ID NO: 2914408 - RNA, 19 nt, Mycobacterium avium subsp. paratuberculosis
agcggcugcuggucgacgu

SEQ ID NO: 2914409 - RNA, 16 nt, Mycobacterium avium subsp. paratuberculosis
agcggcuguagcaccc

SEQ ID NO: 2914410 - RNA, 17 nt, Mycobacterium avium subsp. paratuberculosis
agcggcuguagcacccg

SEQ ID NO: 2914411 - RNA, 18 nt, Mycobacterium avium subsp. paratuberculosis
agcggcuguagcacccgg

SEQ ID NO: 2914412 - RNA, 19 nt, Mycobacterium avium subsp. paratuberculosis
agcggcuguagcacccggc

SEQ ID NO: 2914413 - RNA, 21 nt, Mycobacterium avium subsp. paratuberculosis
agcggcuguagcacccggccg

SEQ ID NO: 2914414 - RNA, 22 nt, Mycobacterium avium subsp. paratuberculosis
agcggcuguagcacccggccgg

SEQ ID NO: 2914415 - RNA, 23 nt, Mycobacterium avium subsp. paratuberculosis
agcggcugucguagcggcccagg

SEQ ID NO: 2914416 - RNA, 15 nt, Mycobacterium avium subsp. paratuberculosis
agcggcuugagccgg

SEQ ID NO: 2914417 - RNA, 19 nt, Mycobacterium avium subsp. paratuberculosis
agcggcuugagccggaucg

SEQ ID NO: 2914418 - RNA, 13 nt, Mycobacterium avium subsp. paratuberculosis
agcggcuuggccg

SEQ ID NO: 2914419 - RNA, 20 nt, Mycobacterium avium subsp. paratuberculosis
agcggcuuggccgugcaggg

SEQ ID NO: 2914420 - RNA, 18 nt, Mycobacterium avium subsp. paratuberculosis
agcggcuuggucaccagc

SEQ ID NO: 2914421 - RNA, 17 nt, Mycobacterium avium subsp. paratuberculosis
agcgggaacgcgucgaa

SEQ ID NO: 2914422 - RNA, 16 nt, Mycobacterium avium subsp. paratuberculosis
agcgggaagccgaggu

SEQ ID NO: 2914423 - RNA, 20 nt, Mycobacterium avium subsp. paratuberculosis
agcgggaagccgaggucgcc

SEQ ID NO: 2914424 - RNA, 14 nt, Mycobacterium avium subsp. paratuberculosis
agcgggacgcgcag

SEQ ID NO: 2914425 - RNA, 17 nt, Mycobacterium avium subsp. paratuberculosis
agcgggacugcagcgcg

SEQ ID NO: 2914426 - RNA, 20 nt, Mycobacterium avium subsp. paratuberculosis
agcgggacugcagcgcggug

SEQ ID NO: 2914427 - RNA, 16 nt, Mycobacterium avium subsp. paratuberculosis
agcgggagccggccag

SEQ ID NO: 2914428 - RNA, 17 nt, Mycobacterium avium subsp. paratuberculosis
agcgggagccggccagg

SEQ ID NO: 2914429 - RNA, 18 nt, Mycobacterium avium subsp. paratuberculosis
agcgggagccggccaggu

SEQ ID NO: 2914430 - RNA, 12 nt, Mycobacterium avium subsp. paratuberculosis
agcgggaucccc

SEQ ID NO: 2914431 - RNA, 17 nt, Mycobacterium avium subsp. paratuberculosis
agcgggauccccaccgu

SEQ ID NO: 2914432 - RNA, 19 nt, Mycobacterium avium subsp. paratuberculosis
agcgggauccccaccguga

SEQ ID NO: 2914433 - RNA, 21 nt, Mycobacterium avium subsp. paratuberculosis
agcgggauccccaccgugacg

SEQ ID NO: 2914434 - RNA, 22 nt, Mycobacterium avium subsp. paratuberculosis
agcgggaucccgcagccgcgac

SEQ ID NO: 2914435 - RNA, 16 nt, Mycobacterium avium subsp. paratuberculosis
agcgggaucugcgccg

SEQ ID NO: 2914436 - RNA, 13 nt, Mycobacterium avium subsp. paratuberculosis
agcgggauggaca

SEQ ID NO: 2914437 - RNA, 18 nt, Mycobacterium avium subsp. paratuberculosis
agcgggauguacuugaug

SEQ ID NO: 2914438 - RNA, 16 nt, Mycobacterium avium subsp. paratuberculosis
agcgggcacgccgccg

SEQ ID NO: 2914439 - RNA, 19 nt, Mycobacterium avium subsp. paratuberculosis
agcgggcacgccgccgcga

SEQ ID NO: 2914440 - RNA, 16 nt, Mycobacterium avium subsp. paratuberculosis
agcgggccaaagagcu

SEQ ID NO: 2914441 - RNA, 12 nt, Mycobacterium avium subsp. paratuberculosis
agcgggccagga

SEQ ID NO: 2914442 - RNA, 19 nt, Mycobacterium avium subsp. paratuberculosis
agcgggccgacagcacgcc

SEQ ID NO: 2914443 - RNA, 14 nt, Mycobacterium avium subsp. paratuberculosis
agcgggccggcguc

SEQ ID NO: 2914444 - RNA, 22 nt, Mycobacterium avium subsp. paratuberculosis
agcgggccggcgucgucgagca

SEQ ID NO: 2914445 - RNA, 15 nt, Mycobacterium avium subsp. paratuberculosis
agcgggccguggcac

SEQ ID NO: 2914446 - RNA, 19 nt, Mycobacterium avium subsp. paratuberculosis
agcgggcgaacgaccgggu

SEQ ID NO: 2914447 - RNA, 16 nt, Mycobacterium avium subsp. paratuberculosis
agcgggcgcgcagcca

SEQ ID NO: 2914448 - RNA, 14 nt, Mycobacterium avium subsp. paratuberculosis
agcgggcggccagc

SEQ ID NO: 2914449 - RNA, 16 nt, Mycobacterium avium subsp. paratuberculosis
agcgggcggccagccg

SEQ ID NO: 2914450 - RNA, 12 nt, Mycobacterium avium subsp. paratuberculosis
agcgggcggccc

SEQ ID NO: 2914451 - RNA, 15 nt, Mycobacterium avium subsp. paratuberculosis
agcgggcggccccgg

SEQ ID NO: 2914452 - RNA, 16 nt, Mycobacterium avium subsp. paratuberculosis
acucgggcggccgcgg

SEQ ID NO: 2914453 - RNA, 22 nt, Mycobacterium avium subsp. paratuberculosis
acucgggguugacccggccggu

SEQ ID NO: 2914454 - RNA, 21 nt, Mycobacterium avium subsp. paratuberculosis
acucgggugaguaguccagca

SEQ ID NO: 2914455 - RNA, 22 nt, Mycobacterium avium subsp. paratuberculosis
acucgggugggggcguggugcu

SEQ ID NO: 2914456 - RNA, 12 nt, Mycobacterium avium subsp. paratuberculosis
acucggucaccu

SEQ ID NO: 2914457 - RNA, 21 nt, Mycobacterium avium subsp. paratuberculosis
acucggugaugccggccagcc

SEQ ID NO: 2914458 - RNA, 22 nt, Mycobacterium avium subsp. paratuberculosis
acucggugaugccggccagccg

SEQ ID NO: 2914459 - RNA, 12 nt, Mycobacterium avium subsp. paratuberculosis
acucgucgacgc

SEQ ID NO: 2914460 - RNA, 16 nt, Mycobacterium avium subsp. paratuberculosis
acucgucgaucgacgc

SEQ ID NO: 2914461 - RNA, 20 nt, Mycobacterium avium subsp. paratuberculosis
acucgucgaucgacgccgac

SEQ ID NO: 2914462 - RNA, 17 nt, Mycobacterium avium subsp. paratuberculosis
acucgucgaugcacgcc

SEQ ID NO: 2914463 - RNA, 18 nt, Mycobacterium avium subsp. paratuberculosis
acucgucgccaccgaugc

SEQ ID NO: 2914464 - RNA, 14 nt, Mycobacterium avium subsp. paratuberculosis
acucgucggcgguu

SEQ ID NO: 2914465 - RNA, 22 nt, Mycobacterium avium subsp. paratuberculosis
acucgucguggcggugcucuug

SEQ ID NO: 2914466 - RNA, 19 nt, Mycobacterium avium subsp. paratuberculosis
acucgucuugcagccgggg

SEQ ID NO: 2914467 - RNA, 15 nt, Mycobacterium avium subsp. paratuberculosis
acucgugcggcgccg

SEQ ID NO: 2914468 - RNA, 16 nt, Mycobacterium avium subsp. paratuberculosis
acucgugcggcgccgc

SEQ ID NO: 2914469 - RNA, 17 nt, Mycobacterium avium subsp. paratuberculosis
acucgugcggcgccgcc

SEQ ID NO: 2914470 - RNA, 18 nt, Mycobacterium avium subsp. paratuberculosis
acucgugcggcgccgccc

SEQ ID NO: 2914471 - RNA, 16 nt, Mycobacterium avium subsp. paratuberculosis
acucguugccagccgg

SEQ ID NO: 2914472 - RNA, 16 nt, Mycobacterium avium subsp. paratuberculosis
acucguuggccggcuc

SEQ ID NO: 2914473 - RNA, 14 nt, Mycobacterium avium subsp. paratuberculosis
acucucccaggaca

SEQ ID NO: 2914474 - RNA, 23 nt, Mycobacterium avium subsp. paratuberculosis
acucugcacucagagcagcgccu

SEQ ID NO: 2914475 - RNA, 19 nt, Mycobacterium avium subsp. paratuberculosis
acucuggcgugacgcucgg

SEQ ID NO: 2914476 - RNA, 20 nt, Mycobacterium avium subsp. paratuberculosis
acucuggcgugacgcucggc

SEQ ID NO: 2914477 - RNA, 23 nt, Mycobacterium avium subsp. paratuberculosis
acucuggcgugacgcucggcgcg

SEQ ID NO: 2914478 - RNA, 20 nt, Mycobacterium avium subsp. paratuberculosis
acucuggcgugacguucggc

SEQ ID NO: 2914479 - RNA, 22 nt, Mycobacterium avium subsp. paratuberculosis
acucuggcgugacguucggcca

SEQ ID NO: 2914480 - RNA, 23 nt, Mycobacterium avium subsp. paratuberculosis
acucuggcgugacguucggccaa

SEQ ID NO: 2914481 - RNA, 18 nt, Mycobacterium avium subsp. paratuberculosis
acugaccgauggccgccc

SEQ ID NO: 2914482 - RNA, 15 nt, Mycobacterium avium subsp. paratuberculosis
acugaccugagaggu

SEQ ID NO: 2914483 - RNA, 19 nt, Mycobacterium avium subsp. paratuberculosis
acugaccuucucccgcggc

SEQ ID NO: 2914484 - RNA, 20 nt, Mycobacterium avium subsp. paratuberculosis
acugaccuucucccgcggca

SEQ ID NO: 2914485 - RNA, 22 nt, Mycobacterium avium subsp. paratuberculosis
acugaccuucucccgcggcagc

SEQ ID NO: 2914486 - RNA, 14 nt, Mycobacterium avium subsp. paratuberculosis
acugagcgcccggu

SEQ ID NO: 2914487 - RNA, 21 nt, Mycobacterium avium subsp. paratuberculosis
acugagcgcccggucgagguc

SEQ ID NO: 2914488 - RNA, 15 nt, Mycobacterium avium subsp. paratuberculosis
acugaucaccgcgcu

SEQ ID NO: 2914489 - RNA, 16 nt, Mycobacterium avium subsp. paratuberculosis
acugaucaccgcgcuc

SEQ ID NO: 2914490 - RNA, 15 nt, Mycobacterium avium subsp. paratuberculosis
acugauccaccaucu

SEQ ID NO: 2914491 - RNA, 20 nt, Mycobacterium avium subsp. paratuberculosis
acugaucgacgagccgggcc

SEQ ID NO: 2914492 - RNA, 16 nt, Mycobacterium avium subsp. paratuberculosis
acugaucgagcucggc

SEQ ID NO: 2914493 - RNA, 17 nt, Mycobacterium avium subsp. paratuberculosis
acugaugaagccgccga

SEQ ID NO: 2914494 - RNA, 18 nt, Mycobacterium avium subsp. paratuberculosis
acugaugaagccgccgac

SEQ ID NO: 2914495 - RNA, 16 nt, Mycobacterium avium subsp. paratuberculosis
acugaugguggcgcgc

SEQ ID NO: 2914496 - RNA, 18 nt, Mycobacterium avium subsp. paratuberculosis
acugcacagugcgucgcc

SEQ ID NO: 2914497 - RNA, 14 nt, Mycobacterium avium subsp. paratuberculosis
acugcaccagcacg

SEQ ID NO: 2914498 - RNA, 15 nt, Mycobacterium avium subsp. paratuberculosis
acugcaccagcacga

SEQ ID NO: 2914499 - RNA, 17 nt, Mycobacterium avium subsp. paratuberculosis
acugcaccagcacgaca

SEQ ID NO: 2914500 - RNA, 17 nt, Mycobacterium avium subsp. paratuberculosis
acugcaccagcggcgcc

SEQ ID NO: 2914501 - RNA, 11 nt, Mycobacterium avium subsp. paratuberculosis
acugcacccga

SEQ ID NO: 2914502 - RNA, 19 nt, Mycobacterium avium subsp. paratuberculosis
acugcacccgaacggaccg

SEQ ID NO: 2914503 - RNA, 15 nt, Mycobacterium avium subsp. paratuberculosis
acugcagcccgaucu

SEQ ID NO: 2914504 - RNA, 20 nt, Mycobacterium avium subsp. paratuberculosis
acugcagcgacuggcccucg

SEQ ID NO: 2914505 - RNA, 20 nt, Mycobacterium avium subsp. paratuberculosis
acugcaggaacaaccgcagc

SEQ ID NO: 2914506 - RNA, 23 nt, Mycobacterium avium subsp. paratuberculosis
acugcaggaacaaccgcagcggc

SEQ ID NO: 2914507 - RNA, 15 nt, Mycobacterium avium subsp. paratuberculosis
acugcaucaugucca

SEQ ID NO: 2914508 - RNA, 14 nt, Mycobacterium avium subsp. paratuberculosis
acugcaucucgacc

SEQ ID NO: 2914509 - RNA, 20 nt, Mycobacterium avium subsp. paratuberculosis
acugcauuucggacggcgac

SEQ ID NO: 2914510 - RNA, 17 nt, Mycobacterium avium subsp. paratuberculosis
acugcccagccaucugc

SEQ ID NO: 2914511 - RNA, 23 nt, Mycobacterium avium subsp. paratuberculosis
acugccccggcgaacgccucggu

SEQ ID NO: 2914512 - RNA, 15 nt, Mycobacterium avium subsp. paratuberculosis
acugcccgaccgcgc

SEQ ID NO: 2914513 - RNA, 17 nt, Mycobacterium avium subsp. paratuberculosis
acugcccgaccgcgccg

SEQ ID NO: 2914514 - RNA, 19 nt, Mycobacterium avium subsp. paratuberculosis
acugcccguagucggcggc

SEQ ID NO: 2914515 - RNA, 16 nt, Mycobacterium avium subsp. paratuberculosis
acugccgacgcauuuc

SEQ ID NO: 2914516 - RNA, 19 nt, Mycobacterium avium subsp. paratuberculosis
acugccgagcaucagcugc

SEQ ID NO: 2914517 - RNA, 20 nt, Mycobacterium avium subsp. paratuberculosis
acugccgagcaucagcugcc

SEQ ID NO: 2914518 - RNA, 23 nt, Mycobacterium avium subsp. paratuberculosis
acugccgagcaucagcugccguc

SEQ ID NO: 2914519 - RNA, 15 nt, Mycobacterium avium subsp. paratuberculosis
acugccgaugcugag

SEQ ID NO: 2914520 - RNA, 14 nt, Mycobacterium avium subsp. paratuberculosis
acugccgccgccca

SEQ ID NO: 2914521 - RNA, 15 nt, Mycobacterium avium subsp. paratuberculosis
acugccgccgcccag

SEQ ID NO: 2914522 - RNA, 16 nt, Mycobacterium avium subsp. paratuberculosis
acugccgcgcacugga

SEQ ID NO: 2914523 - RNA, 17 nt, Mycobacterium avium subsp. paratuberculosis
acugccgcgcacuggag

SEQ ID NO: 2914524 - RNA, 13 nt, Mycobacterium avium subsp. paratuberculosis
acugccgcggcac

SEQ ID NO: 2914525 - RNA, 17 nt, Mycobacterium avium subsp. paratuberculosis
acugccugacccggccg

SEQ ID NO: 2914526 - RNA, 20 nt, Mycobacterium avium subsp. paratuberculosis
acugccugacccggccgugc

SEQ ID NO: 2914527 - RNA, 13 nt, Mycobacterium avium subsp. paratuberculosis
acugcgacccacc

SEQ ID NO: 2914528 - RNA, 18 nt, Mycobacterium avium subsp. paratuberculosis
acugcgacccaccgucga

SEQ ID NO: 2914529 - RNA, 14 nt, Mycobacterium avium subsp. paratuberculosis
acugcgaucgccga

SEQ ID NO: 2914530 - RNA, 15 nt, Mycobacterium avium subsp. paratuberculosis
acugcgaucgccgac

SEQ ID NO: 2914531 - RNA, 16 nt, Mycobacterium avium subsp. paratuberculosis
acugcgaucgccgacg

SEQ ID NO: 2914532 - RNA, 23 nt, Mycobacterium avium subsp. paratuberculosis
acugcgaucgccgacgccagcac

SEQ ID NO: 2914533 - RNA, 22 nt, Mycobacterium avium subsp. paratuberculosis
acugcgaugcuucccauuucgg

SEQ ID NO: 2914534 - RNA, 13 nt, Mycobacterium avium subsp. paratuberculosis
acugcgcaccgcc

SEQ ID NO: 2914535 - RNA, 15 nt, Mycobacterium avium subsp. paratuberculosis
acugcgcaccgccag

SEQ ID NO: 2914536 - RNA, 17 nt, Mycobacterium avium subsp. paratuberculosis
acugcgcaccgccagca

SEQ ID NO: 2914537 - RNA, 19 nt, Mycobacterium avium subsp. paratuberculosis
acugcgcaccgccagcacc

SEQ ID NO: 2914538 - RNA, 21 nt, Mycobacterium avium subsp. paratuberculosis
acugcgccaauacacuucggg

SEQ ID NO: 2914539 - RNA, 12 nt, Mycobacterium avium subsp. paratuberculosis
acugcgccgggg

SEQ ID NO: 2914540 - RNA, 14 nt, Mycobacterium avium subsp. paratuberculosis
acugcgccggggcc

SEQ ID NO: 2914541 - RNA, 18 nt, Mycobacterium avium subsp. paratuberculosis
acugcgccggggccgcgg

SEQ ID NO: 2914542 - RNA, 20 nt, Mycobacterium avium subsp. paratuberculosis
acugcgccggggccgcggcu

SEQ ID NO: 2914543 - RNA, 21 nt, Mycobacterium avium subsp. paratuberculosis
acugcgccgucaucgacaccg

SEQ ID NO: 2914544 - RNA, 17 nt, Mycobacterium avium subsp. paratuberculosis
acugcgcgaccaaacgc

SEQ ID NO: 2914545 - RNA, 14 nt, Mycobacterium avium subsp. paratuberculosis
acugcgcgcccgag

SEQ ID NO: 2914546 - RNA, 15 nt, Mycobacterium avium subsp. paratuberculosis
acugcgcgucggaga

SEQ ID NO: 2914547 - RNA, 20 nt, Mycobacterium avium subsp. paratuberculosis
acugcggcagaccgguggcg

SEQ ID NO: 2914548 - RNA, 14 nt, Mycobacterium avium subsp. paratuberculosis
acugcgguagaggc

SEQ ID NO: 2914549 - RNA, 15 nt, Mycobacterium avium subsp. paratuberculosis
acugcgugcugggca

SEQ ID NO: 2914550 - RNA, 19 nt, Mycobacterium avium subsp. paratuberculosis
acugcgugcugggcaccgu

SEQ ID NO: 2914551 - RNA, 16 nt, Mycobacterium avium subsp. paratuberculosis
acugcguguggcgcac

SEQ ID NO: 2914552 - RNA, 19 nt, Mycobacterium avium subsp. paratuberculosis
acugcguguggcgcacgcc

SEQ ID NO: 2914553 - RNA, 20 nt, Mycobacterium avium subsp. paratuberculosis
acugcucgaccagcccccgc

SEQ ID NO: 2914554 - RNA, 17 nt, Mycobacterium avium subsp. paratuberculosis
acugcucgaccagcgcc

SEQ ID NO: 2914555 - RNA, 16 nt, Mycobacterium avium subsp. paratuberculosis
acugcucggcgcggcu

SEQ ID NO: 2914556 - RNA, 15 nt, Mycobacterium avium subsp. paratuberculosis
acugcugcccgcgac

SEQ ID NO: 2914557 - RNA, 17 nt, Mycobacterium avium subsp. paratuberculosis
acugcugcccgcgacgg

SEQ ID NO: 2914558 - RNA, 21 nt, Mycobacterium avium subsp. paratuberculosis
acugcugcgggugcggccagc

SEQ ID NO: 2914559 - RNA, 24 nt, Mycobacterium avium subsp. paratuberculosis
acugcugcgggugcggccagcgca

SEQ ID NO: 2914560 - RNA, 11 nt, Mycobacterium avium subsp. paratuberculosis
acugcuucggg

SEQ ID NO: 2914561 - RNA, 15 nt, Mycobacterium avium subsp. paratuberculosis
acugcuugccgucga

SEQ ID NO: 2914562 - RNA, 23 nt, Mycobacterium avium subsp. paratuberculosis
acuggacauucacgaggccgggc

SEQ ID NO: 2914563 - RNA, 22 nt, Mycobacterium avium subsp. paratuberculosis
acuggauggcgauggccugcuc

SEQ ID NO: 2914564 - RNA, 15 nt, Mycobacterium avium subsp. paratuberculosis
acuggccaccgcgau

SEQ ID NO: 2914565 - RNA, 15 nt, Mycobacterium avium subsp. paratuberculosis
acuggcccacgcagc

SEQ ID NO: 2914566 - RNA, 20 nt, Mycobacterium avium subsp. paratuberculosis
acuggcccacgcagccgucg

SEQ ID NO: 2914567 - RNA, 14 nt, Mycobacterium avium subsp. paratuberculosis
acuggcgccggucg

SEQ ID NO: 2914568 - RNA, 13 nt, Mycobacterium avium subsp. paratuberculosis
acuggcggccggc

SEQ ID NO: 2914569 - RNA, 14 nt, Mycobacterium avium subsp. paratuberculosis
acuggcggccggcc

SEQ ID NO: 2914570 - RNA, 18 nt, Mycobacterium avium subsp. paratuberculosis
acuggcggccggccgcgc

SEQ ID NO: 2914571 - RNA, 21 nt, Mycobacterium avium subsp. paratuberculosis
acuggcggccggccgcgccca

SEQ ID NO: 2914572 - RNA, 16 nt, Mycobacterium avium subsp. paratuberculosis
acuggcggcggcgguc

SEQ ID NO: 2914573 - RNA, 18 nt, Mycobacterium avium subsp. paratuberculosis
acuggcguugaugcgggc

SEQ ID NO: 2914574 - RNA, 20 nt, Mycobacterium avium subsp. paratuberculosis
acuggcugagcagcacccga

SEQ ID NO: 2914575 - RNA, 15 nt, Mycobacterium avium subsp. paratuberculosis
acuggcuggucaccc

SEQ ID NO: 2914576 - RNA, 13 nt, Mycobacterium avium subsp. paratuberculosis
acugggccgucgc

SEQ ID NO: 2914577 - RNA, 14 nt, Mycobacterium avium subsp. paratuberculosis
acugggccgucgcc

SEQ ID NO: 2914578 - RNA, 15 nt, Mycobacterium avium subsp. paratuberculosis
acugggcgcccaccc

SEQ ID NO: 2914579 - RNA, 12 nt, Mycobacterium avium subsp. paratuberculosis
acugggcgccgc

SEQ ID NO: 2914580 - RNA, 18 nt, Mycobacterium avium subsp. paratuberculosis
acugggcgccgccggcgu

SEQ ID NO: 2914581 - RNA, 17 nt, Mycobacterium avium subsp. paratuberculosis
acugggcggccugcacc

SEQ ID NO: 2914582 - RNA, 18 nt, Mycobacterium avium subsp. paratuberculosis
acugggcguggucgccgu

SEQ ID NO: 2914583 - RNA, 15 nt, Mycobacterium avium subsp. paratuberculosis
acugggugcgcgggc

SEQ ID NO: 2914584 - RNA, 21 nt, Mycobacterium avium subsp. paratuberculosis
acugggugcgcgggcgcccgu

SEQ ID NO: 2914585 - RNA, 13 nt, Mycobacterium avium subsp. paratuberculosis
acugggugggacg

SEQ ID NO: 2914586 - RNA, 23 nt, Mycobacterium avium subsp. paratuberculosis
acugggugggugcggugcggccg

SEQ ID NO: 2914587 - RNA, 20 nt, Mycobacterium avium subsp. paratuberculosis
acuggguggucacaccgcug

SEQ ID NO: 2914588 - RNA, 13 nt, Mycobacterium avium subsp. paratuberculosis
acugguaaccgcc

SEQ ID NO: 2914589 - RNA, 17 nt, Mycobacterium avium subsp. paratuberculosis
acugguccugcggcugg

SEQ ID NO: 2914590 - RNA, 17 nt, Mycobacterium avium subsp. paratuberculosis
acuggucgaacagcgcg

SEQ ID NO: 2914591 - RNA, 17 nt, Mycobacterium avium subsp. paratuberculosis
acuggucgugcucgucg

SEQ ID NO: 2914592 - RNA, 19 nt, Mycobacterium avium subsp. paratuberculosis
acuggucgugcucgucggc

SEQ ID NO: 2914593 - RNA, 18 nt, Mycobacterium avium subsp. paratuberculosis
acuggucgugcuggagcg

SEQ ID NO: 2914594 - RNA, 21 nt, Mycobacterium avium subsp. paratuberculosis
acuggucguugcacacccggu

SEQ ID NO: 2914595 - RNA, 16 nt, Mycobacterium avium subsp. paratuberculosis
acuggugggcgucgug

SEQ ID NO: 2914596 - RNA, 17 nt, Mycobacterium avium subsp. paratuberculosis
acugguuccacaccacc

SEQ ID NO: 2914597 - RNA, 13 nt, Mycobacterium avium subsp. paratuberculosis
acugguugcagau

SEQ ID NO: 2914598 - RNA, 18 nt, Mycobacterium avium subsp. paratuberculosis
acuguccaggccgaggcu

SEQ ID NO: 2914599 - RNA, 19 nt, Mycobacterium avium subsp. paratuberculosis
acuguccaggccgaggcug

SEQ ID NO: 2914600 - RNA, 20 nt, Mycobacterium avium subsp. paratuberculosis
acugucggcgccccgcccgc

SEQ ID NO: 2914601 - RNA, 21 nt, Mycobacterium avium subsp. paratuberculosis
acugucggcgccccgcccgcg

SEQ ID NO: 2914602 - RNA, 23 nt, Mycobacterium avium subsp. paratuberculosis
acugucggcgccccgcccgcgac

SEQ ID NO: 2914603 - RNA, 17 nt, Mycobacterium avium subsp. paratuberculosis
acugucggcgcggacgu

SEQ ID NO: 2914604 - RNA, 22 nt, Mycobacterium avium subsp. paratuberculosis
acugucggcucgccugcgagcg

SEQ ID NO: 2914605 - RNA, 19 nt, Mycobacterium avium subsp. paratuberculosis
acuguucgcggcuggccgc

SEQ ID NO: 2914606 - RNA, 15 nt, Mycobacterium avium subsp. paratuberculosis
acuucacaggccgcc

SEQ ID NO: 2914607 - RNA, 13 nt, Mycobacterium avium subsp. paratuberculosis
acuucacgcucgc

SEQ ID NO: 2914608 - RNA, 14 nt, Mycobacterium avium subsp. paratuberculosis
acuucacgcucggc

SEQ ID NO: 2914609 - RNA, 16 nt, Mycobacterium avium subsp. paratuberculosis
acuucacgcucggcga

SEQ ID NO: 2914610 - RNA, 11 nt, Mycobacterium avium subsp. paratuberculosis
acuucagcugc

SEQ ID NO: 2914611 - RNA, 13 nt, Mycobacterium avium subsp. paratuberculosis
acuucaggucucc

SEQ ID NO: 2914612 - RNA, 15 nt, Mycobacterium avium subsp. paratuberculosis
acuuccagcaccggc

SEQ ID NO: 2914613 - RNA, 15 nt, Mycobacterium avium subsp. paratuberculosis
acuuccgcccggcga

SEQ ID NO: 2914614 - RNA, 12 nt, Mycobacterium avium subsp. paratuberculosis
acuuccuccucu

SEQ ID NO: 2914615 - RNA, 14 nt, Mycobacterium avium subsp. paratuberculosis
acuuccuccucuuc

SEQ ID NO: 2914616 - RNA, 14 nt, Mycobacterium avium subsp. paratuberculosis
acuucgacggcagc

SEQ ID NO: 2914617 - RNA, 16 nt, Mycobacterium avium subsp. paratuberculosis
acuucgacggcagcgg

SEQ ID NO: 2914618 - RNA, 17 nt, Mycobacterium avium subsp. paratuberculosis
acuucgacggcagcggc

SEQ ID NO: 2914619 - RNA, 16 nt, Mycobacterium avium subsp. paratuberculosis
acuucgccagcgggcc

SEQ ID NO: 2914620 - RNA, 16 nt, Mycobacterium avium subsp. paratuberculosis
acuucgcgggcggcgc

SEQ ID NO: 2914621 - RNA, 19 nt, Mycobacterium avium subsp. paratuberculosis
acuucgcgggcggcgcagu

SEQ ID NO: 2914622 - RNA, 13 nt, Mycobacterium avium subsp. paratuberculosis
aaaaaccaugcca

SEQ ID NO: 2914623 - RNA, 22 nt, Mycobacterium avium subsp. paratuberculosis
aaaaaccugcggugccaaugaa

SEQ ID NO: 2914624 - RNA, 21 nt, Mycobacterium avium subsp. paratuberculosis
aaaaagcguugcgccagcagg

SEQ ID NO: 2914625 - RNA, 23 nt, Mycobacterium avium subsp. paratuberculosis
aaaaauaggugaccucgagcagc

SEQ ID NO: 2914626 - RNA, 16 nt, Mycobacterium avium subsp. paratuberculosis
aaaacaacgcgcagcc

SEQ ID NO: 2914627 - RNA, 14 nt, Mycobacterium avium subsp. paratuberculosis
aaaaccugcggugc

SEQ ID NO: 2914628 - RNA, 20 nt, Mycobacterium avium subsp. paratuberculosis
aaaacgagaugccccaggcg

SEQ ID NO: 2914629 - RNA, 16 nt, Mycobacterium avium subsp. paratuberculosis
aaaacgggguggaaua

SEQ ID NO: 2914630 - RNA, 13 nt, Mycobacterium avium subsp. paratuberculosis
aaaagcuucuugc

SEQ ID NO: 2914631 - RNA, 14 nt, Mycobacterium avium subsp. paratuberculosis
aaaagggcccaugc

SEQ ID NO: 2914632 - RNA, 14 nt, Mycobacterium avium subsp. paratuberculosis
aaaauccagaacag

SEQ ID NO: 2914633 - RNA, 20 nt, Mycobacterium avium subsp. paratuberculosis
aaaauguccuccugcgccgg

SEQ ID NO: 2914634 - RNA, 22 nt, Mycobacterium avium subsp. paratuberculosis
aaacacgagcagacccgccgcg

SEQ ID NO: 2914635 - RNA, 13 nt, Mycobacterium avium subsp. paratuberculosis
aaacagcgcggcc

SEQ ID NO: 2914636 - RNA, 13 nt, Mycobacterium avium subsp. paratuberculosis
aaacagguuggcg

SEQ ID NO: 2914637 - RNA, 23 nt, Mycobacterium avium subsp. paratuberculosis
aaacaucgucaaagccguucgcg

SEQ ID NO: 2914638 - RNA, 21 nt, Mycobacterium avium subsp. paratuberculosis
aaaccaccugccgcaacgggc

SEQ ID NO: 2914639 - RNA, 12 nt, Mycobacterium avium subsp. paratuberculosis
aaaccccacccc

SEQ ID NO: 2914640 - RNA, 12 nt, Mycobacterium avium subsp. paratuberculosis
aaaccccgccgu

SEQ ID NO: 2914641 - RNA, 12 nt, Mycobacterium avium subsp. paratuberculosis
aaacccggcgga

SEQ ID NO: 2914642 - RNA, 20 nt, Mycobacterium avium subsp. paratuberculosis
aaacccguugccaacaccag

SEQ ID NO: 2914643 - RNA, 15 nt, Mycobacterium avium subsp. paratuberculosis
aaaccgaccgccgcg

SEQ ID NO: 2914644 - RNA, 15 nt, Mycobacterium avium subsp. paratuberculosis
aaaccgccagcagcg

SEQ ID NO: 2914645 - RNA, 12 nt, Mycobacterium avium subsp. paratuberculosis
aaaccggcgccg

SEQ ID NO: 2914646 - RNA, 16 nt, Mycobacterium avium subsp. paratuberculosis
aaaccgggccugcgcg

SEQ ID NO: 2914647 - RNA, 13 nt, Mycobacterium avium subsp. paratuberculosis
aacacggccucga

SEQ ID NO: 2914648 - RNA, 20 nt, Mycobacterium avium subsp. paratuberculosis
aacacguagcgaucggugaa

SEQ ID NO: 2914649 - RNA, 15 nt, Mycobacterium avium subsp. paratuberculosis
aacacguccuggcgc

SEQ ID NO: 2914650 - RNA, 13 nt, Mycobacterium avium subsp. paratuberculosis
aacacgucggcca

SEQ ID NO: 2914651 - RNA, 17 nt, Mycobacterium avium subsp. paratuberculosis
aacacgucggccagcgc

SEQ ID NO: 2914652 - RNA, 18 nt, Mycobacterium avium subsp. paratuberculosis
aacacgucggccagcgcg

SEQ ID NO: 2914653 - RNA, 17 nt, Mycobacterium avium subsp. paratuberculosis
aacacuuuuaaggagca

SEQ ID NO: 2914654 - RNA, 17 nt, Mycobacterium avium subsp. paratuberculosis
aacagacucagcccggc

SEQ ID NO: 2914655 - RNA, 14 nt, Mycobacterium avium subsp. paratuberculosis
aacagacugaugaa

SEQ ID NO: 2914656 - RNA, 19 nt, Mycobacterium avium subsp. paratuberculosis
aacagagcgggaucccgca

SEQ ID NO: 2914657 - RNA, 13 nt, Mycobacterium avium subsp. paratuberculosis
aacagcaccagca

SEQ ID NO: 2914658 - RNA, 14 nt, Mycobacterium avium subsp. paratuberculosis
aacagcaccagcac

SEQ ID NO: 2914659 - RNA, 12 nt, Mycobacterium avium subsp. paratuberculosis
aacagcaccgcc

SEQ ID NO: 2914660 - RNA, 17 nt, Mycobacterium avium subsp. paratuberculosis
aacagcaccgccacggc

SEQ ID NO: 2914661 - RNA, 17 nt, Mycobacterium avium subsp. paratuberculosis
aacagcacgccggccgg

SEQ ID NO: 2914662 - RNA, 18 nt, Mycobacterium avium subsp. paratuberculosis
aacagcacgccggccggc

SEQ ID NO: 2914663 - RNA, 20 nt, Mycobacterium avium subsp. paratuberculosis
aacagcacgccggccggcgu

SEQ ID NO: 2914664 - RNA, 21 nt, Mycobacterium avium subsp. paratuberculosis
aacagcagcacccgggugauc

SEQ ID NO: 2914665 - RNA, 12 nt, Mycobacterium avium subsp. paratuberculosis
aacagcagcaga

SEQ ID NO: 2914666 - RNA, 20 nt, Mycobacterium avium subsp. paratuberculosis
aacagcagcagaaccagcac

SEQ ID NO: 2914667 - RNA, 14 nt, Mycobacterium avium subsp. paratuberculosis
aacagcagcagcag

SEQ ID NO: 2914668 - RNA, 15 nt, Mycobacterium avium subsp. paratuberculosis
aacagcagcagcagc

SEQ ID NO: 2914669 - RNA, 23 nt, Mycobacterium avium subsp. paratuberculosis
aacagcagcgaacccgccagggc

SEQ ID NO: 2914670 - RNA, 17 nt, Mycobacterium avium subsp. paratuberculosis
aacagcagcgccgcggc

SEQ ID NO: 2914671 - RNA, 22 nt, Mycobacterium avium subsp. paratuberculosis
aacagcaggcccaggccgaugg

SEQ ID NO: 2914672 - RNA, 22 nt, Mycobacterium avium subsp. paratuberculosis
aacagccagucgaagaccacga

SEQ ID NO: 2914673 - RNA, 14 nt, Mycobacterium avium subsp. paratuberculosis
aacagcccgcccug

SEQ ID NO: 2914674 - RNA, 12 nt, Mycobacterium avium subsp. paratuberculosis
aacagccgaccg

SEQ ID NO: 2914675 - RNA, 18 nt, Mycobacterium avium subsp. paratuberculosis
aacagccgggccagcagc

SEQ ID NO: 2914676 - RNA, 19 nt, Mycobacterium avium subsp. paratuberculosis
aacagccgggccagcagcu

SEQ ID NO: 2914677 - RNA, 19 nt, Mycobacterium avium subsp. paratuberculosis
aacagccgggugaacccga

SEQ ID NO: 2914678 - RNA, 20 nt, Mycobacterium avium subsp. paratuberculosis
aacagccgguccgaccgcca

SEQ ID NO: 2914679 - RNA, 21 nt, Mycobacterium avium subsp. paratuberculosis
aacagcgacuccugacgcacc

SEQ ID NO: 2914680 - RNA, 13 nt, Mycobacterium avium subsp. paratuberculosis
aacagcgcccggc

SEQ ID NO: 2914681 - RNA, 13 nt, Mycobacterium avium subsp. paratuberculosis
aacagcgcgccgg

SEQ ID NO: 2914682 - RNA, 15 nt, Mycobacterium avium subsp. paratuberculosis
aacagcgcggccgga

SEQ ID NO: 2914683 - RNA, 18 nt, Mycobacterium avium subsp. paratuberculosis
aacagcggcccgaucacc

SEQ ID NO: 2914684 - RNA, 18 nt, Mycobacterium avium subsp. paratuberculosis
aacagcgggccggcgucg

SEQ ID NO: 2914685 - RNA, 19 nt, Mycobacterium avium subsp. paratuberculosis
aacagcggggugcccacca

SEQ ID NO: 2914686 - RNA, 14 nt, Mycobacterium avium subsp. paratuberculosis
aacagcgucgccga

SEQ ID NO: 2914687 - RNA, 16 nt, Mycobacterium avium subsp. paratuberculosis
aacagcgucucgacgg

SEQ ID NO: 2914688 - RNA, 22 nt, Mycobacterium avium subsp. paratuberculosis
aacagcgucucgacggcgccga

SEQ ID NO: 2914689 - RNA, 12 nt, Mycobacterium avium subsp. paratuberculosis
aacaggcccagc

SEQ ID NO: 2914690 - RNA, 13 nt, Mycobacterium avium subsp. paratuberculosis
aacaggcccagca

SEQ ID NO: 2914691 - RNA, 15 nt, Mycobacterium avium subsp. paratuberculosis
aacaggcccagcagc

SEQ ID NO: 2914692 - RNA, 23 nt, Mycobacterium avium subsp. paratuberculosis
aacagggccgcgcgggcgaccug

SEQ ID NO: 2914693 - RNA, 16 nt, Mycobacterium avium subsp. paratuberculosis
aacagggcgacggcgg

SEQ ID NO: 2914694 - RNA, 19 nt, Mycobacterium avium subsp. paratuberculosis
aacagggcgacggcggcga

SEQ ID NO: 2914695 - RNA, 16 nt, Mycobacterium avium subsp. paratuberculosis
aacagguaggcggcgc

SEQ ID NO: 2914696 - RNA, 14 nt, Mycobacterium avium subsp. paratuberculosis
aacaggucggcgug

SEQ ID NO: 2914697 - RNA, 19 nt, Mycobacterium avium subsp. paratuberculosis
aacaggugcuuggucagcg

SEQ ID NO: 2914698 - RNA, 19 nt, Mycobacterium avium subsp. paratuberculosis
aacagguuucgcucgucgg

SEQ ID NO: 2914699 - RNA, 14 nt, Mycobacterium avium subsp. paratuberculosis
aacagucggccggc

SEQ ID NO: 2914700 - RNA, 19 nt, Mycobacterium avium subsp. paratuberculosis
aacagugcacugccgaccc

SEQ ID NO: 2914701 - RNA, 22 nt, Mycobacterium avium subsp. paratuberculosis
aacauccugguccggcgcccga

SEQ ID NO: 2914702 - RNA, 16 nt, Mycobacterium avium subsp. paratuberculosis
aacaucgagcccaccg

SEQ ID NO: 2914703 - RNA, 18 nt, Mycobacterium avium subsp. paratuberculosis
aacaucgagcccaccgcg

SEQ ID NO: 2914704 - RNA, 19 nt, Mycobacterium avium subsp. paratuberculosis
aacaucgagcccaccgcgc

SEQ ID NO: 2914705 - RNA, 15 nt, Mycobacterium avium subsp. paratuberculosis
aacaucgccagcaac

SEQ ID NO: 2914706 - RNA, 18 nt, Mycobacterium avium subsp. paratuberculosis
aacaucgccagcaacgac

SEQ ID NO: 2914707 - RNA, 13 nt, Mycobacterium avium subsp. paratuberculosis
aacaucgccggug

SEQ ID NO: 2914708 - RNA, 18 nt, Mycobacterium avium subsp. paratuberculosis
aacaucgccucggccgcg

SEQ ID NO: 2914709 - RNA, 23 nt, Mycobacterium avium subsp. paratuberculosis
aacaucggccgggucgcaggcag

SEQ ID NO: 2914710 - RNA, 16 nt, Mycobacterium avium subsp. paratuberculosis
aacaucgucaacaugc

SEQ ID NO: 2914711 - RNA, 14 nt, Mycobacterium avium subsp. paratuberculosis
aacaucuccagcgc

SEQ ID NO: 2914712 - RNA, 15 nt, Mycobacterium avium subsp. paratuberculosis
aacaucuccagcgcg

SEQ ID NO: 2914713 - RNA, 22 nt, Mycobacterium avium subsp. paratuberculosis
aacaucuugaucugggugccgc

SEQ ID NO: 2914714 - RNA, 19 nt, Mycobacterium avium subsp. paratuberculosis
aacaucuuggucagccgcg

SEQ ID NO: 2914715 - RNA, 21 nt, Mycobacterium avium subsp. paratuberculosis
aacaucuuggucagccgcggc

SEQ ID NO: 2914716 - RNA, 14 nt, Mycobacterium avium subsp. paratuberculosis
aacaugaucggcgc

SEQ ID NO: 2914717 - RNA, 15 nt, Mycobacterium avium subsp. paratuberculosis
aacaugaucggcgcg

SEQ ID NO: 2914718 - RNA, 17 nt, Mycobacterium avium subsp. paratuberculosis
aacaugcugccgccggc

SEQ ID NO: 2914719 - RNA, 18 nt, Mycobacterium avium subsp. paratuberculosis
aaccacaccccggccacc

SEQ ID NO: 2914720 - RNA, 13 nt, Mycobacterium avium subsp. paratuberculosis
aaccacagcugcu

SEQ ID NO: 2914721 - RNA, 12 nt, Mycobacterium avium subsp. paratuberculosis
aaccaccgcgcc

SEQ ID NO: 2914722 - RNA, 15 nt, Mycobacterium avium subsp. paratuberculosis
aaccaccgcgcccac

SEQ ID NO: 2914723 - RNA, 19 nt, Mycobacterium avium subsp. paratuberculosis
aaccaccggaaggccaggu

SEQ ID NO: 2914724 - RNA, 23 nt, Mycobacterium avium subsp. paratuberculosis
aaccaccugccgcaacgggccgc

SEQ ID NO: 2914725 - RNA, 14 nt, Mycobacterium avium subsp. paratuberculosis
aaccacgcggcggc

SEQ ID NO: 2914726 - RNA, 17 nt, Mycobacterium avium subsp. paratuberculosis
aaccacgcggcggcggu

SEQ ID NO: 2914727 - RNA, 13 nt, Mycobacterium avium subsp. paratuberculosis
aaccacuucuggc

SEQ ID NO: 2914728 - RNA, 20 nt, Mycobacterium avium subsp. paratuberculosis
aaccacuucuggcgcugcuc

SEQ ID NO: 2914729 - RNA, 13 nt, Mycobacterium avium subsp. paratuberculosis
aaccagcaccgcc

SEQ ID NO: 2914730 - RNA, 15 nt, Mycobacterium avium subsp. paratuberculosis
aaccagcccaggucg

SEQ ID NO: 2914731 - RNA, 19 nt, Mycobacterium avium subsp. paratuberculosis
aaccagcgauucccgccgg

SEQ ID NO: 2914732 - RNA, 13 nt, Mycobacterium avium subsp. paratuberculosis
aaccgggccagga

SEQ ID NO: 2914733 - RNA, 16 nt, Mycobacterium avium subsp. paratuberculosis
aaccgggccaggauga

SEQ ID NO: 2914734 - RNA, 17 nt, Mycobacterium avium subsp. paratuberculosis
aaccgggcccucguccg

SEQ ID NO: 2914735 - RNA, 13 nt, Mycobacterium avium subsp. paratuberculosis
aaccgggccgcac

SEQ ID NO: 2914736 - RNA, 17 nt, Mycobacterium avium subsp. paratuberculosis
aaccgggccgcaccccc

SEQ ID NO: 2914737 - RNA, 18 nt, Mycobacterium avium subsp. paratuberculosis
aaccgggccgcuggccgc

SEQ ID NO: 2914738 - RNA, 13 nt, Mycobacterium avium subsp. paratuberculosis
aaccggggcacca

SEQ ID NO: 2914739 - RNA, 14 nt, Mycobacterium avium subsp. paratuberculosis
aaccggggccgcac

SEQ ID NO: 2914740 - RNA, 14 nt, Mycobacterium avium subsp. paratuberculosis
aaccgggggccguc

SEQ ID NO: 2914741 - RNA, 23 nt, Mycobacterium avium subsp. paratuberculosis
aaccgggugacgaccauggucag

SEQ ID NO: 2914742 - RNA, 18 nt, Mycobacterium avium subsp. paratuberculosis
aaccggucaacggcucgg

SEQ ID NO: 2914743 - RNA, 15 nt, Mycobacterium avium subsp. paratuberculosis
aaccgguccgccguc

SEQ ID NO: 2914744 - RNA, 22 nt, Mycobacterium avium subsp. paratuberculosis
aaccgguucggacacggcgccg

SEQ ID NO: 2914745 - RNA, 16 nt, Mycobacterium avium subsp. paratuberculosis
aaccgucccacacggg

SEQ ID NO: 2914746 - RNA, 12 nt, Mycobacterium avium subsp. paratuberculosis
aaccguucgucg

SEQ ID NO: 2914747 - RNA, 14 nt, Mycobacterium avium subsp. paratuberculosis
aaccguugaccacc

SEQ ID NO: 2914748 - RNA, 17 nt, Mycobacterium avium subsp. paratuberculosis
aaccguugaccaccagg

SEQ ID NO: 2914749 - RNA, 15 nt, Mycobacterium avium subsp. paratuberculosis
aaccguugcagaaca

SEQ ID NO: 2914750 - RNA, 18 nt, Mycobacterium avium subsp. paratuberculosis
aaccguuggacugcaacg

SEQ ID NO: 2914751 - RNA, 19 nt, Mycobacterium avium subsp. paratuberculosis
aaccguuggccugcgcgac

SEQ ID NO: 2914752 - RNA, 18 nt, Mycobacterium avium subsp. paratuberculosis
aaccguugggcaacgcgg

SEQ ID NO: 2914753 - RNA, 20 nt, Mycobacterium avium subsp. paratuberculosis
aaccguuugucccuugggcg

SEQ ID NO: 2914754 - RNA, 20 nt, Mycobacterium avium subsp. paratuberculosis
aaccucgcggcggcgucggc

SEQ ID NO: 2914755 - RNA, 14 nt, Mycobacterium avium subsp. paratuberculosis
aaccucggcggcgg

SEQ ID NO: 2914756 - RNA, 17 nt, Mycobacterium avium subsp. paratuberculosis
aaccucuugcggcgcaa

SEQ ID NO: 2914757 - RNA, 14 nt, Mycobacterium avium subsp. paratuberculosis
aaccuucuuggccg

SEQ ID NO: 2914758 - RNA, 14 nt, Mycobacterium avium subsp. paratuberculosis
aacgacagcgacgg

SEQ ID NO: 2914759 - RNA, 22 nt, Mycobacterium avium subsp. paratuberculosis
aacgacaucaccaccgccgggg

SEQ ID NO: 2914760 - RNA, 13 nt, Mycobacterium avium subsp. paratuberculosis
aacgacccggcca

SEQ ID NO: 2914761 - RNA, 16 nt, Mycobacterium avium subsp. paratuberculosis
aacgacccggccaccg

SEQ ID NO: 2914762 - RNA, 18 nt, Mycobacterium avium subsp. paratuberculosis
aacgacgaccucccccga

SEQ ID NO: 2914763 - RNA, 18 nt, Mycobacterium avium subsp. paratuberculosis
aacgacgccaguucgucg

SEQ ID NO: 2914764 - RNA, 16 nt, Mycobacterium avium subsp. paratuberculosis
aacgacgucgccacca

SEQ ID NO: 2914765 - RNA, 16 nt, Mycobacterium avium subsp. paratuberculosis
aacgagaaggcggcgu

SEQ ID NO: 2914766 - RNA, 17 nt, Mycobacterium avium subsp. paratuberculosis
aacgaggcccggacggc

SEQ ID NO: 2914767 - RNA, 23 nt, Mycobacterium avium subsp. paratuberculosis
aacgaggccgcgccgugcgccag

SEQ ID NO: 2914768 - RNA, 24 nt, Mycobacterium avium subsp. paratuberculosis
aacgaguugccccguguggugucg

SEQ ID NO: 2914769 - RNA, 21 nt, Mycobacterium avium subsp. paratuberculosis
aacgcaaaacggugcggccuc

SEQ ID NO: 2914770 - RNA, 18 nt, Mycobacterium avium subsp. paratuberculosis
aacgcaacagggccaccg

SEQ ID NO: 2914771 - RNA, 21 nt, Mycobacterium avium subsp. paratuberculosis
aacgcaaugcgucgcggcggc

SEQ ID NO: 2914772 - RNA, 14 nt, Mycobacterium avium subsp. paratuberculosis
aacgcaccaccgcg

SEQ ID NO: 2914773 - RNA, 18 nt, Mycobacterium avium subsp. paratuberculosis
aacgccacaaacagcgcg

SEQ ID NO: 2914774 - RNA, 20 nt, Mycobacterium avium subsp. paratuberculosis
aacgccacaaacagcgcggc

SEQ ID NO: 2914775 - RNA, 18 nt, Mycobacterium avium subsp. paratuberculosis
aacgccaccuucaccgcg

SEQ ID NO: 2914776 - RNA, 19 nt, Mycobacterium avium subsp. paratuberculosis
aacgccaccuucaccgcgc

SEQ ID NO: 2914777 - RNA, 23 nt, Mycobacterium avium subsp. paratuberculosis
aacgccaccuucaccgcgccggu

SEQ ID NO: 2914778 - RNA, 12 nt, Mycobacterium avium subsp. paratuberculosis
aacgccacggcg

SEQ ID NO: 2914779 - RNA, 17 nt, Mycobacterium avium subsp. paratuberculosis
aacgccacguagcagca

SEQ ID NO: 2914780 - RNA, 12 nt, Mycobacterium avium subsp. paratuberculosis
aacgccagcagc

SEQ ID NO: 2914781 - RNA, 15 nt, Mycobacterium avium subsp. paratuberculosis
aacgccagcagccgc

SEQ ID NO: 2914782 - RNA, 13 nt, Mycobacterium avium subsp. paratuberculosis
aacgccagcagcu

SEQ ID NO: 2914783 - RNA, 19 nt, Mycobacterium avium subsp. paratuberculosis
aacgccagcagcugcggga

SEQ ID NO: 2914784 - RNA, 13 nt, Mycobacterium avium subsp. paratuberculosis
aacgccagccaga

SEQ ID NO: 2914785 - RNA, 17 nt, Mycobacterium avium subsp. paratuberculosis
aacgccagccagaacac

SEQ ID NO: 2914786 - RNA, 18 nt, Mycobacterium avium subsp. paratuberculosis
aacgccagcgcgacccgc

SEQ ID NO: 2914787 - RNA, 18 nt, Mycobacterium avium subsp. paratuberculosis
aacgccagcgugagcuca

SEQ ID NO: 2914788 - RNA, 20 nt, Mycobacterium avium subsp. paratuberculosis
aacgccagcugggcagccag

SEQ ID NO: 2914789 - RNA, 15 nt, Mycobacterium avium subsp. paratuberculosis
aacgccaucaccagc

SEQ ID NO: 2914790 - RNA, 17 nt, Mycobacterium avium subsp. paratuberculosis
aacgccaucaccagcgc

SEQ ID NO: 2914791 - RNA, 18 nt, Mycobacterium avium subsp. paratuberculosis
aacgccaucaccagcgcg

SEQ ID NO: 2914792 - RNA, 16 nt, Mycobacterium avium subsp. paratuberculosis
aacgccaugggcaucg

SEQ ID NO: 2914793 - RNA, 20 nt, Mycobacterium avium subsp. paratuberculosis
aacgccgaggaggccgcggc

SEQ ID NO: 2914794 - RNA, 15 nt, Mycobacterium avium subsp. paratuberculosis
aacgccgaggugcaa

SEQ ID NO: 2914795 - RNA, 16 nt, Mycobacterium avium subsp. paratuberculosis
aacgccgaucaccgcg

SEQ ID NO: 2914796 - RNA, 16 nt, Mycobacterium avium subsp. paratuberculosis
aacgccgaucaccggc

SEQ ID NO: 2914797 - RNA, 17 nt, Mycobacterium avium subsp. paratuberculosis
aacgccgcccccgccca

SEQ ID NO: 2914798 - RNA, 19 nt, Mycobacterium avium subsp. paratuberculosis
aacgccgccgacagcaccu

SEQ ID NO: 2914799 - RNA, 20 nt, Mycobacterium avium subsp. paratuberculosis
aacgccgccguguaggccgc

SEQ ID NO: 2914800 - RNA, 22 nt, Mycobacterium avium subsp. paratuberculosis
aacgccgccguguaggccgcgc

SEQ ID NO: 2914801 - RNA, 17 nt, Mycobacterium avium subsp. paratuberculosis
aacgccgcgcgcagcac

SEQ ID NO: 2914802 - RNA, 23 nt, Mycobacterium avium subsp. paratuberculosis
aacgccggauuggcgucgguggc

SEQ ID NO: 2914803 - RNA, 18 nt, Mycobacterium avium subsp. paratuberculosis
aacgccggccccggcgac

SEQ ID NO: 2914804 - RNA, 18 nt, Mycobacterium avium subsp. paratuberculosis
aacgccggcgugcacagg

SEQ ID NO: 2914805 - RNA, 22 nt, Mycobacterium avium subsp. paratuberculosis
aacgccggcgugcacaggccgc

SEQ ID NO: 2914806 - RNA, 14 nt, Mycobacterium avium subsp. paratuberculosis
aacgccgggucgac

SEQ ID NO: 2914807 - RNA, 20 nt, Mycobacterium avium subsp. paratuberculosis
aacgccuccgaauccagcgc

SEQ ID NO: 2914808 - RNA, 15 nt, Mycobacterium avium subsp. paratuberculosis
aacgccuccgccgcc

SEQ ID NO: 2914809 - RNA, 14 nt, Mycobacterium avium subsp. paratuberculosis
aacgccucgggccg

SEQ ID NO: 2914810 - RNA, 19 nt, Mycobacterium avium subsp. paratuberculosis
aacgccucgggccggcagc

SEQ ID NO: 2914811 - RNA, 18 nt, Mycobacterium avium subsp. paratuberculosis
aacgccucgguggucgac

SEQ ID NO: 2914812 - RNA, 13 nt, Mycobacterium avium subsp. paratuberculosis
aacgccucgucga

SEQ ID NO: 2914813 - RNA, 15 nt, Mycobacterium avium subsp. paratuberculosis
aacgccucgucgacc

SEQ ID NO: 2914814 - RNA, 20 nt, Mycobacterium avium subsp. paratuberculosis
aacgccucgucgaccgcggc

SEQ ID NO: 2914815 - RNA, 19 nt, Mycobacterium avium subsp. paratuberculosis
aacgccugccggcgccgga

SEQ ID NO: 2914816 - RNA, 15 nt, Mycobacterium avium subsp. paratuberculosis
aacgccugcgccgcc

SEQ ID NO: 2914817 - RNA, 23 nt, Mycobacterium avium subsp. paratuberculosis
aagaucgcagcggugacacccag

SEQ ID NO: 2914818 - RNA, 15 nt, Mycobacterium avium subsp. paratuberculosis
aagaucgcccgccgc

SEQ ID NO: 2914819 - RNA, 21 nt, Mycobacterium avium subsp. paratuberculosis
aagaucgcccgccgcgagccg

SEQ ID NO: 2914820 - RNA, 17 nt, Mycobacterium avium subsp. paratuberculosis
aagaucgucuugaccgc

SEQ ID NO: 2914821 - RNA, 21 nt, Mycobacterium avium subsp. paratuberculosis
aagaucuccgggaacgcggcg

SEQ ID NO: 2914822 - RNA, 21 nt, Mycobacterium avium subsp. paratuberculosis
aagaugccgaucaggcuggac

SEQ ID NO: 2914823 - RNA, 21 nt, Mycobacterium avium subsp. paratuberculosis
aagauggccagcgcggcguca

SEQ ID NO: 2914824 - RNA, 18 nt, Mycobacterium avium subsp. paratuberculosis
aagauggcgugccacagc

SEQ ID NO: 2914825 - RNA, 19 nt, Mycobacterium avium subsp. paratuberculosis
aagauggcgugccacagca

SEQ ID NO: 2914826 - RNA, 22 nt, Mycobacterium avium subsp. paratuberculosis
aagauggcgugccacagcauga

SEQ ID NO: 2914827 - RNA, 23 nt, Mycobacterium avium subsp. paratuberculosis
aagauguaucaggaucugcgcaa

SEQ ID NO: 2914828 - RNA, 19 nt, Mycobacterium avium subsp. paratuberculosis
aagaugucgccguacauca

SEQ ID NO: 2914829 - RNA, 12 nt, Mycobacterium avium subsp. paratuberculosis
aagauugggcca

SEQ ID NO: 2914830 - RNA, 12 nt, Mycobacterium avium subsp. paratuberculosis
aagcaccaggcu

SEQ ID NO: 2914831 - RNA, 16 nt, Mycobacterium avium subsp. paratuberculosis
aagcacgaccacaccc

SEQ ID NO: 2914832 - RNA, 23 nt, Mycobacterium avium subsp. paratuberculosis
aagcagaacgccaucaccagcgc

SEQ ID NO: 2914833 - RNA, 14 nt, Mycobacterium avium subsp. paratuberculosis
aagcagccuucuug

SEQ ID NO: 2914834 - RNA, 13 nt, Mycobacterium avium subsp. paratuberculosis
aagcagcggcagc

SEQ ID NO: 2914835 - RNA, 14 nt, Mycobacterium avium subsp. paratuberculosis
aagcagcucgcgua

SEQ ID NO: 2914836 - RNA, 22 nt, Mycobacterium avium subsp. paratuberculosis
aagcagcucgcguagcgaggug

SEQ ID NO: 2914837 - RNA, 13 nt, Mycobacterium avium subsp. paratuberculosis
aagcaucaauacg

SEQ ID NO: 2914838 - RNA, 13 nt, Mycobacterium avium subsp. paratuberculosis
aagcauuggccca

SEQ ID NO: 2914839 - RNA, 15 nt, Mycobacterium avium subsp. paratuberculosis
aagcauuggcccaca

SEQ ID NO: 2914840 - RNA, 13 nt, Mycobacterium avium subsp. paratuberculosis
aagccaugccggg

SEQ ID NO: 2914841 - RNA, 15 nt, Mycobacterium avium subsp. paratuberculosis
aagccauuucagcag

SEQ ID NO: 2914842 - RNA, 15 nt, Mycobacterium avium subsp. paratuberculosis
aagcccaccgccguu

SEQ ID NO: 2914843 - RNA, 22 nt, Mycobacterium avium subsp. paratuberculosis
aagcccaccgcggugaccgccc

SEQ ID NO: 2914844 - RNA, 12 nt, Mycobacterium avium subsp. paratuberculosis
aagcccaggccc

SEQ ID NO: 2914845 - RNA, 13 nt, Mycobacterium avium subsp. paratuberculosis
aagccccaggccc

SEQ ID NO: 2914846 - RNA, 19 nt, Mycobacterium avium subsp. paratuberculosis
aagcccccaaugucacggc

SEQ ID NO: 2914847 - RNA, 17 nt, Mycobacterium avium subsp. paratuberculosis
aagccccgguuccaacc

SEQ ID NO: 2914848 - RNA, 21 nt, Mycobacterium avium subsp. paratuberculosis
aagccccgguuccaaccaccg

SEQ ID NO: 2914849 - RNA, 20 nt, Mycobacterium avium subsp. paratuberculosis
aagcccggguauuucgagca

SEQ ID NO: 2914850 - RNA, 23 nt, Mycobacterium avium subsp. paratuberculosis
aagcccgugccgaugccggccug

SEQ ID NO: 2914851 - RNA, 13 nt, Mycobacterium avium subsp. paratuberculosis
aagcccucgucga

SEQ ID NO: 2914852 - RNA, 16 nt, Mycobacterium avium subsp. paratuberculosis
aagcccucgucgaagc

SEQ ID NO: 2914853 - RNA, 18 nt, Mycobacterium avium subsp. paratuberculosis
aagcccuucaccucggcc

SEQ ID NO: 2914854 - RNA, 19 nt, Mycobacterium avium subsp. paratuberculosis
aagcccuugcagcacaccg

SEQ ID NO: 2914855 - RNA, 17 nt, Mycobacterium avium subsp. paratuberculosis
aagccgacgucgaccag

SEQ ID NO: 2914856 - RNA, 16 nt, Mycobacterium avium subsp. paratuberculosis
aagccgaggucgccga

SEQ ID NO: 2914857 - RNA, 17 nt, Mycobacterium avium subsp. paratuberculosis
aagccgaucaccggcgc

SEQ ID NO: 2914858 - RNA, 21 nt, Mycobacterium avium subsp. paratuberculosis
aagccgaucgcggcgaucagc

SEQ ID NO: 2914859 - RNA, 22 nt, Mycobacterium avium subsp. paratuberculosis
aagccgccguccccgcgcggcu

SEQ ID NO: 2914860 - RNA, 10 nt, Mycobacterium avium subsp. paratuberculosis
aagccgcgga

SEQ ID NO: 2914861 - RNA, 17 nt, Mycobacterium avium subsp. paratuberculosis
aagccgcggacggcgaa

SEQ ID NO: 2914862 - RNA, 14 nt, Mycobacterium avium subsp. paratuberculosis
aagccggagaaggc

SEQ ID NO: 2914863 - RNA, 15 nt, Mycobacterium avium subsp. paratuberculosis
aagccggccagcagc

SEQ ID NO: 2914864 - RNA, 16 nt, Mycobacterium avium subsp. paratuberculosis
aagccggccagcagcg

SEQ ID NO: 2914865 - RNA, 21 nt, Mycobacterium avium subsp. paratuberculosis
aagccggccaggcccagccca

SEQ ID NO: 2914866 - RNA, 19 nt, Mycobacterium avium subsp. paratuberculosis
aagccggcgaacuccaccc

SEQ ID NO: 2914867 - RNA, 16 nt, Mycobacterium avium subsp. paratuberculosis
aagccggcgacgaccg

SEQ ID NO: 2914868 - RNA, 23 nt, Mycobacterium avium subsp. paratuberculosis
aagccggcgucgaugaugccggc

SEQ ID NO: 2914869 - RNA, 17 nt, Mycobacterium avium subsp. paratuberculosis
aagccgggcggcagcag

SEQ ID NO: 2914870 - RNA, 18 nt, Mycobacterium avium subsp. paratuberculosis
aagccgggcggcagcagc

SEQ ID NO: 2914871 - RNA, 19 nt, Mycobacterium avium subsp. paratuberculosis
aagccgggcggcagcagcu

SEQ ID NO: 2914872 - RNA, 22 nt, Mycobacterium avium subsp. paratuberculosis
aagccgggcggcagcagcugcg

SEQ ID NO: 2914873 - RNA, 22 nt, Mycobacterium avium subsp. paratuberculosis
aagccggucuugggcucggcgc

SEQ ID NO: 2914874 - RNA, 19 nt, Mycobacterium avium subsp. paratuberculosis
aagccguagcgcaacaccg

SEQ ID NO: 2914875 - RNA, 19 nt, Mycobacterium avium subsp. paratuberculosis
aagccgucgaccccgccgg

SEQ ID NO: 2914876 - RNA, 22 nt, Mycobacterium avium subsp. paratuberculosis
aagccgugggugccgacgagcu

SEQ ID NO: 2914877 - RNA, 15 nt, Mycobacterium avium subsp. paratuberculosis
aagccguugccgccg

SEQ ID NO: 2914878 - RNA, 21 nt, Mycobacterium avium subsp. paratuberculosis
aagccguugccgccgcgcgcg

SEQ ID NO: 2914879 - RNA, 21 nt, Mycobacterium avium subsp. paratuberculosis
aagcgaauaccaucaacccga

SEQ ID NO: 2914880 - RNA, 21 nt, Mycobacterium avium subsp. paratuberculosis
aagcgacgaggugaugccguc

SEQ ID NO: 2914881 - RNA, 19 nt, Mycobacterium avium subsp. paratuberculosis
aagcgcagaucgcgcauca

SEQ ID NO: 2914882 - RNA, 17 nt, Mycobacterium avium subsp. paratuberculosis
aagcgcaucgccggcgc

SEQ ID NO: 2914883 - RNA, 23 nt, Mycobacterium avium subsp. paratuberculosis
aagcgcaugccgaacaacagggc

SEQ ID NO: 2914884 - RNA, 17 nt, Mycobacterium avium subsp. paratuberculosis
aagcgcgcauagaggcg

SEQ ID NO: 2914885 - RNA, 22 nt, Mycobacterium avium subsp. paratuberculosis
aagcgcgcaucgcgggccaccg

SEQ ID NO: 2914886 - RNA, 14 nt, Mycobacterium avium subsp. paratuberculosis
aagcgcugaaccgg

SEQ ID NO: 2914887 - RNA, 16 nt, Mycobacterium avium subsp. paratuberculosis
aagcgcuuucgccgaa

SEQ ID NO: 2914888 - RNA, 15 nt, Mycobacterium avium subsp. paratuberculosis
aagcgggccaaagag

SEQ ID NO: 2914889 - RNA, 22 nt, Mycobacterium avium subsp. paratuberculosis
aagcgggcggcgaacaccagca

SEQ ID NO: 2914890 - RNA, 19 nt, Mycobacterium avium subsp. paratuberculosis
aagcgggugaccgacagca

SEQ ID NO: 2914891 - RNA, 23 nt, Mycobacterium avium subsp. paratuberculosis
aagcggucgcggaaccggccggg

SEQ ID NO: 2914892 - RNA, 13 nt, Mycobacterium avium subsp. paratuberculosis
aagcguacccagg

SEQ ID NO: 2914893 - RNA, 19 nt, Mycobacterium avium subsp. paratuberculosis
aagcguauccggccagccg

SEQ ID NO: 2914894 - RNA, 16 nt, Mycobacterium avium subsp. paratuberculosis
aagcguucguagaacc

SEQ ID NO: 2914895 - RNA, 15 nt, Mycobacterium avium subsp. paratuberculosis
aagcuagcuucacgc

SEQ ID NO: 2914896 - RNA, 22 nt, Mycobacterium avium subsp. paratuberculosis
aagcuagcuucacgcucggcgc

SEQ ID NO: 2914897 - RNA, 16 nt, Mycobacterium avium subsp. paratuberculosis
aagcucgccaggaugu

SEQ ID NO: 2914898 - RNA, 14 nt, Mycobacterium avium subsp. paratuberculosis
aagcucgcgucgac

SEQ ID NO: 2914899 - RNA, 20 nt, Mycobacterium avium subsp. paratuberculosis
aagcugccguugcgccagcg

SEQ ID NO: 2914900 - RNA, 14 nt, Mycobacterium avium subsp. paratuberculosis
aagcugcgcagccg

SEQ ID NO: 2914901 - RNA, 20 nt, Mycobacterium avium subsp. paratuberculosis
aaguucggcgggggcaggga

SEQ ID NO: 2914902 - RNA, 13 nt, Mycobacterium avium subsp. paratuberculosis
aaguugcccaacu

SEQ ID NO: 2914903 - RNA, 21 nt, Mycobacterium avium subsp. paratuberculosis
aaguuggccaccggggucacc

SEQ ID NO: 2914904 - RNA, 16 nt, Mycobacterium avium subsp. paratuberculosis
aaguuggucaccacca

SEQ ID NO: 2914905 - RNA, 20 nt, Mycobacterium avium subsp. paratuberculosis
aauaagaucgugcuugagca

SEQ ID NO: 2914906 - RNA, 22 nt, Mycobacterium avium subsp. paratuberculosis
aauacccgaccagcaccgcggc

SEQ ID NO: 2914907 - RNA, 14 nt, Mycobacterium avium subsp. paratuberculosis
aauaccgccggccg

SEQ ID NO: 2914908 - RNA, 17 nt, Mycobacterium avium subsp. paratuberculosis
aauaccgccggccgcgc

SEQ ID NO: 2914909 - RNA, 17 nt, Mycobacterium avium subsp. paratuberculosis
aauacggugcccgccgc

SEQ ID NO: 2914910 - RNA, 17 nt, Mycobacterium avium subsp. paratuberculosis
aauagccgcgccgcggu

SEQ ID NO: 2914911 - RNA, 11 nt, Mycobacterium avium subsp. paratuberculosis
aaucaacgcgc

SEQ ID NO: 2914912 - RNA, 23 nt, Mycobacterium avium subsp. paratuberculosis
aaucaccgcgguguugagcgcgu

SEQ ID NO: 2914913 - RNA, 17 nt, Mycobacterium avium subsp. paratuberculosis
aauccaaggagaaggcc

SEQ ID NO: 2914914 - RNA, 21 nt, Mycobacterium avium subsp. paratuberculosis
aauccaaggagaaggccgcgc

SEQ ID NO: 2914915 - RNA, 16 nt, Mycobacterium avium subsp. paratuberculosis
aauccagaacagccag

SEQ ID NO: 2914916 - RNA, 16 nt, Mycobacterium avium subsp. paratuberculosis
aauccgcgcagcagcg

SEQ ID NO: 2914917 - RNA, 16 nt, Mycobacterium avium subsp. paratuberculosis
aauccggccggagacc

SEQ ID NO: 2914918 - RNA, 20 nt, Mycobacterium avium subsp. paratuberculosis
aauccggccggagaccgccg

SEQ ID NO: 2914919 - RNA, 11 nt, Mycobacterium avium subsp. paratuberculosis
aauccggcggc

SEQ ID NO: 2914920 - RNA, 17 nt, Mycobacterium avium subsp. paratuberculosis
aauccucgccgagcaga

SEQ ID NO: 2914921 - RNA, 18 nt, Mycobacterium avium subsp. paratuberculosis
aaucgacaccgcacggcc

SEQ ID NO: 2914922 - RNA, 20 nt, Mycobacterium avium subsp. paratuberculosis
aaucgacaccgcacggccca

SEQ ID NO: 2914923 - RNA, 12 nt, Mycobacterium avium subsp. paratuberculosis
aaucgagccgcc

SEQ ID NO: 2914924 - RNA, 21 nt, Mycobacterium avium subsp. paratuberculosis
aaucgagccgccugcgcgccg

SEQ ID NO: 2914925 - RNA, 16 nt, Mycobacterium avium subsp. paratuberculosis
aaucgcaaccagugca

SEQ ID NO: 2914926 - RNA, 20 nt, Mycobacterium avium subsp. paratuberculosis
aaucgcgggaucggccggcg

SEQ ID NO: 2914927 - RNA, 16 nt, Mycobacterium avium subsp. paratuberculosis
aaucgcugcgcccgcc

SEQ ID NO: 2914928 - RNA, 12 nt, Mycobacterium avium subsp. paratuberculosis
aaucggacccag

SEQ ID NO: 2914929 - RNA, 16 nt, Mycobacterium avium subsp. paratuberculosis
aaucggacccagcccg

SEQ ID NO: 2914930 - RNA, 14 nt, Mycobacterium avium subsp. paratuberculosis
aaucgggacgccac

SEQ ID NO: 2914931 - RNA, 16 nt, Mycobacterium avium subsp. paratuberculosis
aaucggugaagccgac

SEQ ID NO: 2914932 - RNA, 17 nt, Mycobacterium avium subsp. paratuberculosis
aaucggugaagccgacg

SEQ ID NO: 2914933 - RNA, 14 nt, Mycobacterium avium subsp. paratuberculosis
aaucgguucggcca

SEQ ID NO: 2914934 - RNA, 13 nt, Mycobacterium avium subsp. paratuberculosis
aaucgucgggccg

SEQ ID NO: 2914935 - RNA, 15 nt, Mycobacterium avium subsp. paratuberculosis
aaucguugagcacca

SEQ ID NO: 2914936 - RNA, 19 nt, Mycobacterium avium subsp. paratuberculosis
aaucucucgaccuugccgu

SEQ ID NO: 2914937 - RNA, 22 nt, Mycobacterium avium subsp. paratuberculosis
aaucuucgccuccgggaaggcg

SEQ ID NO: 2914938 - RNA, 17 nt, Mycobacterium avium subsp. paratuberculosis
aaugauggucagccgca

SEQ ID NO: 2914939 - RNA, 21 nt, Mycobacterium avium subsp. paratuberculosis
aaugauggucagccgcaccag

SEQ ID NO: 2914940 - RNA, 22 nt, Mycobacterium avium subsp. paratuberculosis
aaugauggucagccgcaccagg

SEQ ID NO: 2914941 - RNA, 16 nt, Mycobacterium avium subsp. paratuberculosis
aaugcaucgcgaucga

SEQ ID NO: 2914942 - RNA, 19 nt, Mycobacterium avium subsp. paratuberculosis
aaugcccucguagcggccg

SEQ ID NO: 2914943 - RNA, 13 nt, Mycobacterium avium subsp. paratuberculosis
aaugccgccgcga

SEQ ID NO: 2914944 - RNA, 17 nt, Mycobacterium avium subsp. paratuberculosis
aaugccguagaucucgc

SEQ ID NO: 2914945 - RNA, 16 nt, Mycobacterium avium subsp. paratuberculosis
aaugccgugccagccg

SEQ ID NO: 2914946 - RNA, 17 nt, Mycobacterium avium subsp. paratuberculosis
aaugccuuggcggcgug

SEQ ID NO: 2914947 - RNA, 22 nt, Mycobacterium avium subsp. paratuberculosis
aaugccuuugccguggcggcgg

SEQ ID NO: 2914948 - RNA, 22 nt, Mycobacterium avium subsp. paratuberculosis
aaugcgaugagcucgcgcugca

SEQ ID NO: 2914949 - RNA, 17 nt, Mycobacterium avium subsp. paratuberculosis
aaugcgccggcggccgc

SEQ ID NO: 2914950 - RNA, 23 nt, Mycobacterium avium subsp. paratuberculosis
aaugcggccauguccccgccggu

SEQ ID NO: 2914951 - RNA, 19 nt, Mycobacterium avium subsp. paratuberculosis
aaugcgggcgauggcgggc

SEQ ID NO: 2914952 - RNA, 18 nt, Mycobacterium avium subsp. paratuberculosis
aaugcgucgcggcggcgc

SEQ ID NO: 2914953 - RNA, 18 nt, Mycobacterium avium subsp. paratuberculosis
aaugcugcacccaccggc

SEQ ID NO: 2914954 - RNA, 17 nt, Mycobacterium avium subsp. paratuberculosis
aauggauccgaucagca

SEQ ID NO: 2914955 - RNA, 20 nt, Mycobacterium avium subsp. paratuberculosis
aauggauccgaucagcagca

SEQ ID NO: 2914956 - RNA, 16 nt, Mycobacterium avium subsp. paratuberculosis
aaugggcugcgcgucg

SEQ ID NO: 2914957 - RNA, 18 nt, Mycobacterium avium subsp. paratuberculosis
aaugggcugcgcgucgag

SEQ ID NO: 2914958 - RNA, 21 nt, Mycobacterium avium subsp. paratuberculosis
aaugguuuucgucgaucagca

SEQ ID NO: 2914959 - RNA, 19 nt, Mycobacterium avium subsp. paratuberculosis
aauguccuccugcgccggc

SEQ ID NO: 2914960 - RNA, 19 nt, Mycobacterium avium subsp. paratuberculosis
aaugucgcgcagcauccgc

SEQ ID NO: 2914961 - RNA, 21 nt, Mycobacterium avium subsp. paratuberculosis
aaugucgcgcagcauccgcac

SEQ ID NO: 2914962 - RNA, 17 nt, Mycobacterium avium subsp. paratuberculosis
aauuacaacuguuaaga

SEQ ID NO: 2914963 - RNA, 23 nt, Mycobacterium avium subsp. paratuberculosis
aauucagugaggccagcacccgg

SEQ ID NO: 2914964 - RNA, 10 nt, Mycobacterium avium subsp. paratuberculosis
aauuccagcg

SEQ ID NO: 2914965 - RNA, 12 nt, Mycobacterium avium subsp. paratuberculosis
aauuccggcgcg

SEQ ID NO: 2914966 - RNA, 11 nt, Mycobacterium avium subsp. paratuberculosis
aauucgacugc

SEQ ID NO: 2914967 - RNA, 14 nt, Mycobacterium avium subsp. paratuberculosis
aauucggagaccag

SEQ ID NO: 2914968 - RNA, 14 nt, Mycobacterium avium subsp. paratuberculosis
aauugaacgccgcc

SEQ ID NO: 2914969 - RNA, 18 nt, Mycobacterium avium subsp. paratuberculosis
aauugaagcccugcucgg

SEQ ID NO: 2914970 - RNA, 13 nt, Mycobacterium avium subsp. paratuberculosis
aauugacgccgac

SEQ ID NO: 2914971 - RNA, 19 nt, Mycobacterium avium subsp. paratuberculosis
aauugagguagucggccca

SEQ ID NO: 2914972 - RNA, 17 nt, Mycobacterium avium subsp. paratuberculosis
aauugccuugcuccaca

SEQ ID NO: 2914973 - RNA, 23 nt, Mycobacterium avium subsp. paratuberculosis
aauugccuugcuccacacuggcu

SEQ ID NO: 2914974 - RNA, 15 nt, Mycobacterium avium subsp. paratuberculosis
aauugcgccagcagc

SEQ ID NO: 2914975 - RNA, 16 nt, Mycobacterium avium subsp. paratuberculosis
aauugcgccagcagca

SEQ ID NO: 2914976 - RNA, 13 nt, Mycobacterium avium subsp. paratuberculosis
aauugcgcugcac

SEQ ID NO: 2914977 - RNA, 20 nt, Mycobacterium avium subsp. paratuberculosis
aauuguucggccaccgcgcg

SEQ ID NO: 2914978 - RNA, 19 nt, Mycobacterium avium subsp. paratuberculosis
acaaaagcgcccgauuccc

SEQ ID NO: 2914979 - RNA, 14 nt, Mycobacterium avium subsp. paratuberculosis
acaaagaucacagc

SEQ ID NO: 2914980 - RNA, 14 nt, Mycobacterium avium subsp. paratuberculosis
acaaagccggucac

SEQ ID NO: 2914981 - RNA, 16 nt, Mycobacterium avium subsp. paratuberculosis
acaaagccggucacgc

SEQ ID NO: 2914982 - RNA, 13 nt, Mycobacterium avium subsp. paratuberculosis
acaaagccggucu

SEQ ID NO: 2914983 - RNA, 23 nt, Mycobacterium avium subsp. paratuberculosis
acaacacggggcuauccgggguc

SEQ ID NO: 2914984 - RNA, 16 nt, Mycobacterium avium subsp. paratuberculosis
acaacacgucuggcag

SEQ ID NO: 2914985 - RNA, 16 nt, Mycobacterium avium subsp. paratuberculosis
acaacagcacgaacag

SEQ ID NO: 2914986 - RNA, 21 nt, Mycobacterium avium subsp. paratuberculosis
acacccuuuuccaucugggcg

SEQ ID NO: 2914987 - RNA, 19 nt, Mycobacterium avium subsp. paratuberculosis
acaccgaaagccgacaccu

SEQ ID NO: 2914988 - RNA, 14 nt, Mycobacterium avium subsp. paratuberculosis
acaccgaaagccgu

SEQ ID NO: 2914989 - RNA, 21 nt, Mycobacterium avium subsp. paratuberculosis
acaccgaacccaccagcgccu

SEQ ID NO: 2914990 - RNA, 11 nt, Mycobacterium avium subsp. paratuberculosis
acaccgaaccg

SEQ ID NO: 2914991 - RNA, 16 nt, Mycobacterium avium subsp. paratuberculosis
acaccgaacgccgagg

SEQ ID NO: 2914992 - RNA, 17 nt, Mycobacterium avium subsp. paratuberculosis
acaccgacaccggccgg

SEQ ID NO: 2914993 - RNA, 16 nt, Mycobacterium avium subsp. paratuberculosis
acaccgagccggcggc

SEQ ID NO: 2914994 - RNA, 16 nt, Mycobacterium avium subsp. paratuberculosis
acaccgagccggggcu

SEQ ID NO: 2914995 - RNA, 19 nt, Mycobacterium avium subsp. paratuberculosis
acaccgaucagcaugccgg

SEQ ID NO: 2914996 - RNA, 20 nt, Mycobacterium avium subsp. paratuberculosis
acaccgaucagcaugccggu

SEQ ID NO: 2914997 - RNA, 16 nt, Mycobacterium avium subsp. paratuberculosis
acaccgcauggccggc

SEQ ID NO: 2914998 - RNA, 14 nt, Mycobacterium avium subsp. paratuberculosis
acaccgccagcacc

SEQ ID NO: 2914999 - RNA, 15 nt, Mycobacterium avium subsp. paratuberculosis
acaccgccagcaccg

SEQ ID NO: 2915000 - RNA, 19 nt, Mycobacterium avium subsp. paratuberculosis
acaccgccagcaccgccac

SEQ ID NO: 2915001 - RNA, 14 nt, Mycobacterium avium subsp. paratuberculosis
acaccgccagcagc

SEQ ID NO: 2915002 - RNA, 19 nt, Mycobacterium avium subsp. paratuberculosis
acaccgccagcagcgccgc

SEQ ID NO: 2915003 - RNA, 18 nt, Mycobacterium avium subsp. paratuberculosis
acaccgccccgccgcgcc

SEQ ID NO: 2915004 - RNA, 13 nt, Mycobacterium avium subsp. paratuberculosis
acaccgccgcggc

SEQ ID NO: 2915005 - RNA, 15 nt, Mycobacterium avium subsp. paratuberculosis
acaccgccggccacg

SEQ ID NO: 2915006 - RNA, 19 nt, Mycobacterium avium subsp. paratuberculosis
acaccgccggcgcggacgg

SEQ ID NO: 2915007 - RNA, 21 nt, Mycobacterium avium subsp. paratuberculosis
acaccgccuucgacggccggc

SEQ ID NO: 2915008 - RNA, 18 nt, Mycobacterium avium subsp. paratuberculosis
acaccgcgaguucgcgca

SEQ ID NO: 2915009 - RNA, 20 nt, Mycobacterium avium subsp. paratuberculosis
acaccgcgaguucgcgcacg

SEQ ID NO: 2915010 - RNA, 18 nt, Mycobacterium avium subsp. paratuberculosis
acaccgcggaccaccgcg

SEQ ID NO: 2915011 - RNA, 21 nt, Mycobacterium avium subsp. paratuberculosis
acaccgcggaccaccgcgugc

SEQ ID NO: 2915012 - RNA, 16 nt, Mycobacterium avium subsp. paratuberculosis
acaccgcggcgacguc

SEQ ID NO: 2915013 - RNA, 13 nt, Mycobacterium avium subsp. paratuberculosis
acaccgcggcggc

SEQ ID NO: 2915014 - RNA, 16 nt, Mycobacterium avium subsp. paratuberculosis
acaccgcggcggcguc

SEQ ID NO: 2915015 - RNA, 19 nt, Mycobacterium avium subsp. paratuberculosis
acaccgcguuggccgccac

SEQ ID NO: 2915016 - RNA, 23 nt, Mycobacterium avium subsp. paratuberculosis
acaccgcuuugugaggcgcgccg

SEQ ID NO: 2915017 - RNA, 14 nt, Mycobacterium avium subsp. paratuberculosis
acaccggcagcgcc

SEQ ID NO: 2915018 - RNA, 14 nt, Mycobacterium avium subsp. paratuberculosis
acaccggcgcgacc

SEQ ID NO: 2915019 - RNA, 17 nt, Mycobacterium avium subsp. paratuberculosis
acaccggcgcugcccgc

SEQ ID NO: 2915020 - RNA, 13 nt, Mycobacterium avium subsp. paratuberculosis
acaccggcggcga

SEQ ID NO: 2915021 - RNA, 15 nt, Mycobacterium avium subsp. paratuberculosis
acaccggcggcgacg

SEQ ID NO: 2915022 - RNA, 18 nt, Mycobacterium avium subsp. paratuberculosis
acaccggcggcgacggca

SEQ ID NO: 2915023 - RNA, 19 nt, Mycobacterium avium subsp. paratuberculosis
acaccggcggcgacggcac

SEQ ID NO: 2915024 - RNA, 13 nt, Mycobacterium avium subsp. paratuberculosis
acaccggcgguca

SEQ ID NO: 2915025 - RNA, 15 nt, Mycobacterium avium subsp. paratuberculosis
acaccggcucgcuga

SEQ ID NO: 2915026 - RNA, 19 nt, Mycobacterium avium subsp. paratuberculosis
acaccggcucgcugaucug

SEQ ID NO: 2915027 - RNA, 18 nt, Mycobacterium avium subsp. paratuberculosis
acaccggcugaccggcgg

SEQ ID NO: 2915028 - RNA, 18 nt, Mycobacterium avium subsp. paratuberculosis
acaccgggauccggcgcg

SEQ ID NO: 2915029 - RNA, 21 nt, Mycobacterium avium subsp. paratuberculosis
acaccgggauccggcgcgccg

SEQ ID NO: 2915030 - RNA, 16 nt, Mycobacterium avium subsp. paratuberculosis
acaccgggaucggcgg

SEQ ID NO: 2915031 - RNA, 18 nt, Mycobacterium avium subsp. paratuberculosis
acaccgggaucggcggcg

SEQ ID NO: 2915032 - RNA, 20 nt, Mycobacterium avium subsp. paratuberculosis
acaccgggaucggggugccg

SEQ ID NO: 2915033 - RNA, 19 nt, Mycobacterium avium subsp. paratuberculosis
acaccgggcaccgacauca

SEQ ID NO: 2915034 - RNA, 20 nt, Mycobacterium avium subsp. paratuberculosis
acaccgggucccccgccgac

SEQ ID NO: 2915035 - RNA, 23 nt, Mycobacterium avium subsp. paratuberculosis
acaccgguggcguugcgggcgaa

SEQ ID NO: 2915036 - RNA, 15 nt, Mycobacterium avium subsp. paratuberculosis
acaccguccagcuca

SEQ ID NO: 2915037 - RNA, 22 nt, Mycobacterium avium subsp. paratuberculosis
acaccguccagcucagcgcgca

SEQ ID NO: 2915038 - RNA, 13 nt, Mycobacterium avium subsp. paratuberculosis
acaccgucgcccg

SEQ ID NO: 2915039 - RNA, 15 nt, Mycobacterium avium subsp. paratuberculosis
acaccgucgcccgcc

SEQ ID NO: 2915040 - RNA, 17 nt, Mycobacterium avium subsp. paratuberculosis
acaccgucgcgcaccca

SEQ ID NO: 2915041 - RNA, 19 nt, Mycobacterium avium subsp. paratuberculosis
acaccgugcccgagccgau

SEQ ID NO: 2915042 - RNA, 23 nt, Mycobacterium avium subsp. paratuberculosis
acaccgugugacgaugcugagca

SEQ ID NO: 2915043 - RNA, 15 nt, Mycobacterium avium subsp. paratuberculosis
acaccguucccaccg

SEQ ID NO: 2915044 - RNA, 22 nt, Mycobacterium avium subsp. paratuberculosis
acaccuccuuggguucggcggc

SEQ ID NO: 2915045 - RNA, 22 nt, Mycobacterium avium subsp. paratuberculosis
acaccucgccguccuugacgaa

SEQ ID NO: 2915046 - RNA, 22 nt, Mycobacterium avium subsp. paratuberculosis
acaccucgcuacgcgagcugcu

SEQ ID NO: 2915047 - RNA, 17 nt, Mycobacterium avium subsp. paratuberculosis
acaccucggccagcgcc

SEQ ID NO: 2915048 - RNA, 19 nt, Mycobacterium avium subsp. paratuberculosis
acaccucggccagcgccgc

SEQ ID NO: 2915049 - RNA, 21 nt, Mycobacterium avium subsp. paratuberculosis
acaccucggccagcgccgcgc

SEQ ID NO: 2915050 - RNA, 13 nt, Mycobacterium avium subsp. paratuberculosis
acaccucggcgac

SEQ ID NO: 2915051 - RNA, 15 nt, Mycobacterium avium subsp. paratuberculosis
acaccucggcgacgu

SEQ ID NO: 2915052 - RNA, 12 nt, Mycobacterium avium subsp. paratuberculosis
acaccucgggau

SEQ ID NO: 2915053 - RNA, 23 nt, Mycobacterium avium subsp. paratuberculosis
acaccucggugaucucaccggcg

SEQ ID NO: 2915054 - RNA, 21 nt, Mycobacterium avium subsp. paratuberculosis
acaccucgucgaucuucgcgg

SEQ ID NO: 2915055 - RNA, 14 nt, Mycobacterium avium subsp. paratuberculosis
acaccugccgcaca

SEQ ID NO: 2915056 - RNA, 15 nt, Mycobacterium avium subsp. paratuberculosis
acaccugcggcggca

SEQ ID NO: 2915057 - RNA, 16 nt, Mycobacterium avium subsp. paratuberculosis
acaccuuccaccaccg

SEQ ID NO: 2915058 - RNA, 20 nt, Mycobacterium avium subsp. paratuberculosis
acaccuuccaccaccgcggc

SEQ ID NO: 2915059 - RNA, 22 nt, Mycobacterium avium subsp. paratuberculosis
acaccuuccaccaccgcggcgc

SEQ ID NO: 2915060 - RNA, 20 nt, Mycobacterium avium subsp. paratuberculosis
acaccuucgcggucggcaac

SEQ ID NO: 2915061 - RNA, 22 nt, Mycobacterium avium subsp. paratuberculosis
acaccuuggcggccaccaucuc

SEQ ID NO: 2915062 - RNA, 15 nt, Mycobacterium avium subsp. paratuberculosis
acaccuugucggcga

SEQ ID NO: 2915063 - RNA, 15 nt, Mycobacterium avium subsp. paratuberculosis
acaccuuucggccgc

SEQ ID NO: 2915064 - RNA, 16 nt, Mycobacterium avium subsp. paratuberculosis
acaccuuucggccgcg

SEQ ID NO: 2915065 - RNA, 19 nt, Mycobacterium avium subsp. paratuberculosis
acacgaacaccggcggauc

SEQ ID NO: 2915066 - RNA, 17 nt, Mycobacterium avium subsp. paratuberculosis
acacgaacccggcggcc

SEQ ID NO: 2915067 - RNA, 14 nt, Mycobacterium avium subsp. paratuberculosis
acacgaacggcgcc

SEQ ID NO: 2915068 - RNA, 13 nt, Mycobacterium avium subsp. paratuberculosis
acacgaagccggu

SEQ ID NO: 2915069 - RNA, 13 nt, Mycobacterium avium subsp. paratuberculosis
acacgaucggcau

SEQ ID NO: 2915070 - RNA, 22 nt, Mycobacterium avium subsp. paratuberculosis
acacgaucucggucgccagcac

SEQ ID NO: 2915071 - RNA, 15 nt, Mycobacterium avium subsp. paratuberculosis
acagcaccgccgcgg

SEQ ID NO: 2915072 - RNA, 17 nt, Mycobacterium avium subsp. paratuberculosis
acagcaccgccgcgggc

SEQ ID NO: 2915073 - RNA, 15 nt, Mycobacterium avium subsp. paratuberculosis
acagcaccggcgucg

SEQ ID NO: 2915074 - RNA, 20 nt, Mycobacterium avium subsp. paratuberculosis
acagcaccggcgucgacagc

SEQ ID NO: 2915075 - RNA, 13 nt, Mycobacterium avium subsp. paratuberculosis
acagcaccucgcc

SEQ ID NO: 2915076 - RNA, 15 nt, Mycobacterium avium subsp. paratuberculosis
acagcaccucgucgc

SEQ ID NO: 2915077 - RNA, 20 nt, Mycobacterium avium subsp. paratuberculosis
acagcaccucgucgcccggc

SEQ ID NO: 2915078 - RNA, 23 nt, Mycobacterium avium subsp. paratuberculosis
acagcaccucgucgcccggcguc

SEQ ID NO: 2915079 - RNA, 13 nt, Mycobacterium avium subsp. paratuberculosis
acagcacgccggg

SEQ ID NO: 2915080 - RNA, 14 nt, Mycobacterium avium subsp. paratuberculosis
acagcacgccgggc

SEQ ID NO: 2915081 - RNA, 18 nt, Mycobacterium avium subsp. paratuberculosis
acagcacguaggucccgg

SEQ ID NO: 2915082 - RNA, 17 nt, Mycobacterium avium subsp. paratuberculosis
acagcacgugcccgccg

SEQ ID NO: 2915083 - RNA, 22 nt, Mycobacterium avium subsp. paratuberculosis
acagcacgugcccgccgugcgc

SEQ ID NO: 2915084 - RNA, 20 nt, Mycobacterium avium subsp. paratuberculosis
acagcacguuguucaggucg

SEQ ID NO: 2915085 - RNA, 14 nt, Mycobacterium avium subsp. paratuberculosis
acagcagcaccagc

SEQ ID NO: 2915086 - RNA, 17 nt, Mycobacterium avium subsp. paratuberculosis
acagcagcaccagcgcg

SEQ ID NO: 2915087 - RNA, 16 nt, Mycobacterium avium subsp. paratuberculosis
acagcagcaccggcac

SEQ ID NO: 2915088 - RNA, 22 nt, Mycobacterium avium subsp. paratuberculosis
acagcagcaccggcaccgcggc

SEQ ID NO: 2915089 - RNA, 23 nt, Mycobacterium avium subsp. paratuberculosis
acagcagcacguugucgcccggg

SEQ ID NO: 2915090 - RNA, 16 nt, Mycobacterium avium subsp. paratuberculosis
acagcagcagcaccag

SEQ ID NO: 2915091 - RNA, 14 nt, Mycobacterium avium subsp. paratuberculosis
acagcagcagcucc

SEQ ID NO: 2915092 - RNA, 19 nt, Mycobacterium avium subsp. paratuberculosis
acagcagccacgacaccag

SEQ ID NO: 2915093 - RNA, 13 nt, Mycobacterium avium subsp. paratuberculosis
acagcagcgaggc

SEQ ID NO: 2915094 - RNA, 12 nt, Mycobacterium avium subsp. paratuberculosis
acagcagcgccg

SEQ ID NO: 2915095 - RNA, 12 nt, Mycobacterium avium subsp. paratuberculosis
acagcagcgcgc

SEQ ID NO: 2915096 - RNA, 12 nt, Mycobacterium avium subsp. paratuberculosis
acagcagcggca

SEQ ID NO: 2915097 - RNA, 20 nt, Mycobacterium avium subsp. paratuberculosis
acagcagcucauacagcggc

SEQ ID NO: 2915098 - RNA, 17 nt, Mycobacterium avium subsp. paratuberculosis
acagcaggaucuccggc

SEQ ID NO: 2915099 - RNA, 12 nt, Mycobacterium avium subsp. paratuberculosis
acagcaggccca

SEQ ID NO: 2915100 - RNA, 19 nt, Mycobacterium avium subsp. paratuberculosis
acagcagggcaccgacggc

SEQ ID NO: 2915101 - RNA, 23 nt, Mycobacterium avium subsp. paratuberculosis
acagcagggcaccgacggccgca

SEQ ID NO: 2915102 - RNA, 21 nt, Mycobacterium avium subsp. paratuberculosis
acagcagggucgagaucagca

SEQ ID NO: 2915103 - RNA, 17 nt, Mycobacterium avium subsp. paratuberculosis
acagcaguuccgacauc

SEQ ID NO: 2915104 - RNA, 20 nt, Mycobacterium avium subsp. paratuberculosis
acagccaaacagguuggcgc

SEQ ID NO: 2915105 - RNA, 21 nt, Mycobacterium avium subsp. paratuberculosis
acagccaaagccuacggcgcc

SEQ ID NO: 2915106 - RNA, 22 nt, Mycobacterium avium subsp. paratuberculosis
acagccaaagccuacggcgccg

SEQ ID NO: 2915107 - RNA, 23 nt, Mycobacterium avium subsp. paratuberculosis
acagccaaagccuacggcgccgg

SEQ ID NO: 2915108 - RNA, 15 nt, Mycobacterium avium subsp. paratuberculosis
acagccaaucgccga

SEQ ID NO: 2915109 - RNA, 17 nt, Mycobacterium avium subsp. paratuberculosis
acagccacagcucgggc

SEQ ID NO: 2915110 - RNA, 14 nt, Mycobacterium avium subsp. paratuberculosis
acagccaccgugcc

SEQ ID NO: 2915111 - RNA, 23 nt, Mycobacterium avium subsp. paratuberculosis
acagccagcccguggccagcgcc

SEQ ID NO: 2915112 - RNA, 21 nt, Mycobacterium avium subsp. paratuberculosis
acagccaggugugcggcacga

SEQ ID NO: 2915113 - RNA, 22 nt, Mycobacterium avium subsp. paratuberculosis
acagccagucgaagaccacgaa

SEQ ID NO: 2915114 - RNA, 21 nt, Mycobacterium avium subsp. paratuberculosis
acagcccccacgcucggcgca

SEQ ID NO: 2915115 - RNA, 16 nt, Mycobacterium avium subsp. paratuberculosis
acagcccccgcagccc

SEQ ID NO: 2915116 - RNA, 16 nt, Mycobacterium avium subsp. paratuberculosis
acagccccgagccgcg

SEQ ID NO: 2915117 - RNA, 14 nt, Mycobacterium avium subsp. paratuberculosis
acagccgcaccaga

SEQ ID NO: 2915118 - RNA, 17 nt, Mycobacterium avium subsp. paratuberculosis
acagccgcaccggcgcc

SEQ ID NO: 2915119 - RNA, 20 nt, Mycobacterium avium subsp. paratuberculosis
acagccgcaccggcgccgcc

SEQ ID NO: 2915120 - RNA, 15 nt, Mycobacterium avium subsp. paratuberculosis
acagccgcagcagcc

SEQ ID NO: 2915121 - RNA, 22 nt, Mycobacterium avium subsp. paratuberculosis
acagccgcauguugugcccgac

SEQ ID NO: 2915122 - RNA, 23 nt, Mycobacterium avium subsp. paratuberculosis
acagccgcauguugugcccgacg

SEQ ID NO: 2915123 - RNA, 13 nt, Mycobacterium avium subsp. paratuberculosis
acagccgccccga

SEQ ID NO: 2915124 - RNA, 14 nt, Mycobacterium avium subsp. paratuberculosis
acagccgcccggcg

SEQ ID NO: 2915125 - RNA, 16 nt, Mycobacterium avium subsp. paratuberculosis
acagccgcccggcgcc

SEQ ID NO: 2915126 - RNA, 14 nt, Mycobacterium avium subsp. paratuberculosis
acagccgcgauagc

SEQ ID NO: 2915127 - RNA, 13 nt, Mycobacterium avium subsp. paratuberculosis
acagccgcgccga

SEQ ID NO: 2915128 - RNA, 22 nt, Mycobacterium avium subsp. paratuberculosis
acagccgcgccgacagaugcgg

SEQ ID NO: 2915129 - RNA, 15 nt, Mycobacterium avium subsp. paratuberculosis
acagccgcuuggcgc

SEQ ID NO: 2915130 - RNA, 20 nt, Mycobacterium avium subsp. paratuberculosis
acagccgcuuggcgcgccgc

SEQ ID NO: 2915131 - RNA, 21 nt, Mycobacterium avium subsp. paratuberculosis
acagccggacgggaucggcgc

SEQ ID NO: 2915132 - RNA, 22 nt, Mycobacterium avium subsp. paratuberculosis
acagccggacgggaucggcgcg

SEQ ID NO: 2915133 - RNA, 13 nt, Mycobacterium avium subsp. paratuberculosis
acagccggcccga

SEQ ID NO: 2915134 - RNA, 12 nt, Mycobacterium avium subsp. paratuberculosis
acagccggcggc

SEQ ID NO: 2915135 - RNA, 15 nt, Mycobacterium avium subsp. paratuberculosis
acagccggcggcggc

SEQ ID NO: 2915136 - RNA, 13 nt, Mycobacterium avium subsp. paratuberculosis
acagccggcggcu

SEQ ID NO: 2915137 - RNA, 17 nt, Mycobacterium avium subsp. paratuberculosis
acagccgggccagcagc

SEQ ID NO: 2915138 - RNA, 18 nt, Mycobacterium avium subsp. paratuberculosis
acagccgggccagcagcu

SEQ ID NO: 2915139 - RNA, 18 nt, Mycobacterium avium subsp. paratuberculosis
acagccgggccgcccgcg

SEQ ID NO: 2915140 - RNA, 19 nt, Mycobacterium avium subsp. paratuberculosis
acagccgggccgcccgcgc

SEQ ID NO: 2915141 - RNA, 20 nt, Mycobacterium avium subsp. paratuberculosis
acagccgggccgcccgcgcg

SEQ ID NO: 2915142 - RNA, 18 nt, Mycobacterium avium subsp. paratuberculosis
acagccggggcagcugcu

SEQ ID NO: 2915143 - RNA, 17 nt, Mycobacterium avium subsp. paratuberculosis
acagccgggugaacccg

SEQ ID NO: 2915144 - RNA, 23 nt, Mycobacterium avium subsp. paratuberculosis
acagccgguccgaccgccaccac

SEQ ID NO: 2915145 - RNA, 17 nt, Mycobacterium avium subsp. paratuberculosis
acagccgguccugggcc

SEQ ID NO: 2915146 - RNA, 16 nt, Mycobacterium avium subsp. paratuberculosis
acagccggucgacgaa

SEQ ID NO: 2915147 - RNA, 17 nt, Mycobacterium avium subsp. paratuberculosis
acagccggucgcgcauc

SEQ ID NO: 2915148 - RNA, 23 nt, Mycobacterium avium subsp. paratuberculosis
acagcgaaagcgcuuggcggaga

SEQ ID NO: 2915149 - RNA, 21 nt, Mycobacterium avium subsp. paratuberculosis
acagcgacaaucucgggcacc

SEQ ID NO: 2915150 - RNA, 17 nt, Mycobacterium avium subsp. paratuberculosis
acagcgacagggugccg

SEQ ID NO: 2915151 - RNA, 17 nt, Mycobacterium avium subsp. paratuberculosis
acagcgaccagucggcg

SEQ ID NO: 2915152 - RNA, 17 nt, Mycobacterium avium subsp. paratuberculosis
acagcgacgggccgggc

SEQ ID NO: 2915153 - RNA, 14 nt, Mycobacterium avium subsp. paratuberculosis
acagcgacgucugc

SEQ ID NO: 2915154 - RNA, 15 nt, Mycobacterium avium subsp. paratuberculosis
acagcgacgucugcg

SEQ ID NO: 2915155 - RNA, 23 nt, Mycobacterium avium subsp. paratuberculosis
acagcgacgucugcggcucggcg

SEQ ID NO: 2915156 - RNA, 21 nt, Mycobacterium avium subsp. paratuberculosis
acagcuaggucguggcgccga

SEQ ID NO: 2915157 - RNA, 23 nt, Mycobacterium avium subsp. paratuberculosis
acagcuaggucguggcgccgagg

SEQ ID NO: 2915158 - RNA, 24 nt, Mycobacterium avium subsp. paratuberculosis
acagcucaccugcgugccuugcac

SEQ ID NO: 2915159 - RNA, 14 nt, Mycobacterium avium subsp. paratuberculosis
acagcuccaacagc

SEQ ID NO: 2915160 - RNA, 15 nt, Mycobacterium avium subsp. paratuberculosis
acagcucgaccagcc

SEQ ID NO: 2915161 - RNA, 20 nt, Mycobacterium avium subsp. paratuberculosis
acagcucgaccagccggguc

SEQ ID NO: 2915162 - RNA, 13 nt, Mycobacterium avium subsp. paratuberculosis
acagcucgccggc

SEQ ID NO: 2915163 - RNA, 16 nt, Mycobacterium avium subsp. paratuberculosis
acagcucgccggccgc

SEQ ID NO: 2915164 - RNA, 20 nt, Mycobacterium avium subsp. paratuberculosis
acagcucgcgggccugcucg

SEQ ID NO: 2915165 - RNA, 16 nt, Mycobacterium avium subsp. paratuberculosis
acagcugacgggccgg

SEQ ID NO: 2915166 - RNA, 17 nt, Mycobacterium avium subsp. paratuberculosis
acagcugacgggccggc

SEQ ID NO: 2915167 - RNA, 19 nt, Mycobacterium avium subsp. paratuberculosis
acagcugacgggccggcgg

SEQ ID NO: 2915168 - RNA, 15 nt, Mycobacterium avium subsp. paratuberculosis
acagcugagcagccc

SEQ ID NO: 2915169 - RNA, 23 nt, Mycobacterium avium subsp. paratuberculosis
acagcugagcagcccgaccaccu

SEQ ID NO: 2915170 - RNA, 15 nt, Mycobacterium avium subsp. paratuberculosis
acagcugccggccgu

SEQ ID NO: 2915171 - RNA, 23 nt, Mycobacterium avium subsp. paratuberculosis
acagcugcgcgggcgcggccagc

SEQ ID NO: 2915172 - RNA, 15 nt, Mycobacterium avium subsp. paratuberculosis
acagcuggcggucgc

SEQ ID NO: 2915173 - RNA, 18 nt, Mycobacterium avium subsp. paratuberculosis
acagcugguccggccggc

SEQ ID NO: 2915174 - RNA, 20 nt, Mycobacterium avium subsp. paratuberculosis
acagcugguccggccggccg

SEQ ID NO: 2915175 - RNA, 13 nt, Mycobacterium avium subsp. paratuberculosis
acagcuucggcgc

SEQ ID NO: 2915176 - RNA, 15 nt, Mycobacterium avium subsp. paratuberculosis
acagcuucggcgccg

SEQ ID NO: 2915177 - RNA, 16 nt, Mycobacterium avium subsp. paratuberculosis
acagcuucggcgccga

SEQ ID NO: 2915178 - RNA, 15 nt, Mycobacterium avium subsp. paratuberculosis
acagcuuggcgcagc

SEQ ID NO: 2915179 - RNA, 22 nt, Mycobacterium avium subsp. paratuberculosis
acagcuuugggaagaggcgcgc

SEQ ID NO: 2915180 - RNA, 12 nt, Mycobacterium avium subsp. paratuberculosis
acaggaacgcga

SEQ ID NO: 2915181 - RNA, 14 nt, Mycobacterium avium subsp. paratuberculosis
acaggaacgcgacg

SEQ ID NO: 2915182 - RNA, 23 nt, Mycobacterium avium subsp. paratuberculosis
acaggaacgcgucgaccgccgcg

SEQ ID NO: 2915183 - RNA, 18 nt, Mycobacterium avium subsp. paratuberculosis
acaggacguugaggcggc

SEQ ID NO: 2915184 - RNA, 20 nt, Mycobacterium avium subsp. paratuberculosis
acaggaggguuuucggggcg

SEQ ID NO: 2915185 - RNA, 18 nt, Mycobacterium avium subsp. paratuberculosis
acaggaucuggacgaucg

SEQ ID NO: 2915186 - RNA, 17 nt, Mycobacterium avium subsp. paratuberculosis
acaggaugcccaacagc

SEQ ID NO: 2915187 - RNA, 19 nt, Mycobacterium avium subsp. paratuberculosis
acaggaugcguucggccag

SEQ ID NO: 2915188 - RNA, 22 nt, Mycobacterium avium subsp. paratuberculosis
acaggaugcuggggucggccag

SEQ ID NO: 2915189 - RNA, 23 nt, Mycobacterium avium subsp. paratuberculosis
acaggcacacgaacaccggcgga

SEQ ID NO: 2915190 - RNA, 20 nt, Mycobacterium avium subsp. paratuberculosis
acaggcacucgcccagggcg

SEQ ID NO: 2915191 - RNA, 23 nt, Mycobacterium avium subsp. paratuberculosis
acaggcccacccacucggacagg

SEQ ID NO: 2915192 - RNA, 12 nt, Mycobacterium avium subsp. paratuberculosis
acaggcccagcg

SEQ ID NO: 2915193 - RNA, 14 nt, Mycobacterium avium subsp. paratuberculosis
acaggccccacgcg

SEQ ID NO: 2915194 - RNA, 20 nt, Mycobacterium avium subsp. paratuberculosis
acaggccccacgcgcucagc

SEQ ID NO: 2915195 - RNA, 21 nt, Mycobacterium avium subsp. paratuberculosis
acaggcccugcugcagcgcga

SEQ ID NO: 2915196 - RNA, 15 nt, Mycobacterium avium subsp. paratuberculosis
acaggccgagcgcgc

SEQ ID NO: 2915197 - RNA, 17 nt, Mycobacterium avium subsp. paratuberculosis
acaggccgagcgcgcug

SEQ ID NO: 2915198 - RNA, 22 nt, Mycobacterium avium subsp. paratuberculosis
acaggccgccgcauuccucggc

SEQ ID NO: 2915199 - RNA, 14 nt, Mycobacterium avium subsp. paratuberculosis
acaggccggccgcu

SEQ ID NO: 2915200 - RNA, 21 nt, Mycobacterium avium subsp. paratuberculosis
acaggcgaaucggcgcacagc

SEQ ID NO: 2915201 - RNA, 19 nt, Mycobacterium avium subsp. paratuberculosis
acaggcuggccagcucggc

SEQ ID NO: 2915202 - RNA, 20 nt, Mycobacterium avium subsp. paratuberculosis
acaggcuggccagcucggcg

SEQ ID NO: 2915203 - RNA, 20 nt, Mycobacterium avium subsp. paratuberculosis
acagggaggacagcaccgcc

SEQ ID NO: 2915204 - RNA, 14 nt, Mycobacterium avium subsp. paratuberculosis
acagggccagcgcc

SEQ ID NO: 2915205 - RNA, 16 nt, Mycobacterium avium subsp. paratuberculosis
acagggccgcgcgggc

SEQ ID NO: 2915206 - RNA, 13 nt, Mycobacterium avium subsp. paratuberculosis
acagggcgacauc

SEQ ID NO: 2915207 - RNA, 18 nt, Mycobacterium avium subsp. paratuberculosis
acagggcgacggcggcga

SEQ ID NO: 2915208 - RNA, 20 nt, Mycobacterium avium subsp. paratuberculosis
acagggcggcgggcccggcg

SEQ ID NO: 2915209 - RNA, 15 nt, Mycobacterium avium subsp. paratuberculosis
acaggggcagcagca

SEQ ID NO: 2915210 - RNA, 15 nt, Mycobacterium avium subsp. paratuberculosis
acagguagcgcauca

SEQ ID NO: 2915211 - RNA, 23 nt, Mycobacterium avium subsp. paratuberculosis
acagguagcggugcucgauguac

SEQ ID NO: 2915212 - RNA, 13 nt, Mycobacterium avium subsp. paratuberculosis
acagguaggcggc

SEQ ID NO: 2915213 - RNA, 15 nt, Mycobacterium avium subsp. paratuberculosis
acagguaggcggcgc

SEQ ID NO: 2915214 - RNA, 16 nt, Mycobacterium avium subsp. paratuberculosis
acagguaguagcgcgc

SEQ ID NO: 2915215 - RNA, 20 nt, Mycobacterium avium subsp. paratuberculosis
acagguaguagcgcgccggg

SEQ ID NO: 2915216 - RNA, 23 nt, Mycobacterium avium subsp. paratuberculosis
acagguaguagcgcgccgggguc

SEQ ID NO: 2915217 - RNA, 22 nt, Mycobacterium avium subsp. paratuberculosis
acaggucgaccaucugccggcg

SEQ ID NO: 2915218 - RNA, 22 nt, Mycobacterium avium subsp. paratuberculosis
acaggucgaugauguugccccg

SEQ ID NO: 2915219 - RNA, 21 nt, Mycobacterium avium subsp. paratuberculosis
acaggucgcccggcucgccgg

SEQ ID NO: 2915220 - RNA, 15 nt, Mycobacterium avium subsp. paratuberculosis
acaggucgcgguagc

SEQ ID NO: 2915221 - RNA, 18 nt, Mycobacterium avium subsp. paratuberculosis
acaggucgcugcccggcg

SEQ ID NO: 2915222 - RNA, 21 nt, Mycobacterium avium subsp. paratuberculosis
acaggugcagcagcagccacg

SEQ ID NO: 2915223 - RNA, 15 nt, Mycobacterium avium subsp. paratuberculosis
acaggugccggcggc

SEQ ID NO: 2915224 - RNA, 16 nt, Mycobacterium avium subsp. paratuberculosis
acaggugccggcggcg

SEQ ID NO: 2915225 - RNA, 20 nt, Mycobacterium avium subsp. paratuberculosis
acaggugccggcggcgcggc

SEQ ID NO: 2915226 - RNA, 22 nt, Mycobacterium avium subsp. paratuberculosis
acaggugcuuggucagcgcggc

SEQ ID NO: 2915227 - RNA, 15 nt, Mycobacterium avium subsp. paratuberculosis
acagguggccgauca

SEQ ID NO: 2915228 - RNA, 15 nt, Mycobacterium avium subsp. paratuberculosis
acagguggggcacca

SEQ ID NO: 2915229 - RNA, 16 nt, Mycobacterium avium subsp. paratuberculosis
acagguggggcaccag

SEQ ID NO: 2915230 - RNA, 21 nt, Mycobacterium avium subsp. paratuberculosis
acagguucuuggcggccugcu

SEQ ID NO: 2915231 - RNA, 15 nt, Mycobacterium avium subsp. paratuberculosis
acagguuggcgccga

SEQ ID NO: 2915232 - RNA, 16 nt, Mycobacterium avium subsp. paratuberculosis
acagguuggcgccgaa

SEQ ID NO: 2915233 - RNA, 20 nt, Mycobacterium avium subsp. paratuberculosis
acagucgaccucgcgcguca

SEQ ID NO: 2915234 - RNA, 20 nt, Mycobacterium avium subsp. paratuberculosis
acagucgcgggcgagccgac

SEQ ID NO: 2915235 - RNA, 13 nt, Mycobacterium avium subsp. paratuberculosis
acagucggccggc

SEQ ID NO: 2915236 - RNA, 16 nt, Mycobacterium avium subsp. paratuberculosis
acagugcacugccgac

SEQ ID NO: 2915237 - RNA, 16 nt, Mycobacterium avium subsp. paratuberculosis
acagugcgcaggcggc

SEQ ID NO: 2915238 - RNA, 18 nt, Mycobacterium avium subsp. paratuberculosis
acagugcgcaggcggcgc

SEQ ID NO: 2915239 - RNA, 21 nt, Mycobacterium avium subsp. paratuberculosis
acagugcgcaggcggcgcgca

SEQ ID NO: 2915240 - RNA, 22 nt, Mycobacterium avium subsp. paratuberculosis
acauggccuugaacucggccag

SEQ ID NO: 2915241 - RNA, 21 nt, Mycobacterium avium subsp. paratuberculosis
acauggcgcagaacaccacgg

SEQ ID NO: 2915242 - RNA, 14 nt, Mycobacterium avium subsp. paratuberculosis
acauggcgcccgcg

SEQ ID NO: 2915243 - RNA, 15 nt, Mycobacterium avium subsp. paratuberculosis
acauggcggccagcc

SEQ ID NO: 2915244 - RNA, 16 nt, Mycobacterium avium subsp. paratuberculosis
acauggcggccagccg

SEQ ID NO: 2915245 - RNA, 18 nt, Mycobacterium avium subsp. paratuberculosis
acauguucuccucgucgc

SEQ ID NO: 2915246 - RNA, 21 nt, Mycobacterium avium subsp. paratuberculosis
acauguucuccucgucgcggg

SEQ ID NO: 2915247 - RNA, 16 nt, Mycobacterium avium subsp. paratuberculosis
acauuggcgaccgcgg

SEQ ID NO: 2915248 - RNA, 18 nt, Mycobacterium avium subsp. paratuberculosis
accaaacgaagugaugcu

SEQ ID NO: 2915249 - RNA, 20 nt, Mycobacterium avium subsp. paratuberculosis
accaaacgcagcgucuucuu

SEQ ID NO: 2915250 - RNA, 20 nt, Mycobacterium avium subsp. paratuberculosis
accaacacccuugcgccgcu

SEQ ID NO: 2915251 - RNA, 12 nt, Mycobacterium avium subsp. paratuberculosis
accaacagcagc

SEQ ID NO: 2915252 - RNA, 13 nt, Mycobacterium avium subsp. paratuberculosis
accaacagcagcg

SEQ ID NO: 2915253 - RNA, 13 nt, Mycobacterium avium subsp. paratuberculosis
accaacagcggcc

SEQ ID NO: 2915254 - RNA, 14 nt, Mycobacterium avium subsp. paratuberculosis
accaacagcggccc

SEQ ID NO: 2915255 - RNA, 17 nt, Mycobacterium avium subsp. paratuberculosis
accaacaggucggcgug

SEQ ID NO: 2915256 - RNA, 16 nt, Mycobacterium avium subsp. paratuberculosis
accaacgccacguagc

SEQ ID NO: 2915257 - RNA, 12 nt, Mycobacterium avium subsp. paratuberculosis
accaacgccaug

SEQ ID NO: 2915258 - RNA, 17 nt, Mycobacterium avium subsp. paratuberculosis
accaacgccgccuccga

SEQ ID NO: 2915259 - RNA, 15 nt, Mycobacterium avium subsp. paratuberculosis
accaacgcggcgccg

SEQ ID NO: 2915260 - RNA, 17 nt, Mycobacterium avium subsp. paratuberculosis
accaacgcggcgccggu

SEQ ID NO: 2915261 - RNA, 16 nt, Mycobacterium avium subsp. paratuberculosis
accaacggcucgccgc

SEQ ID NO: 2915262 - RNA, 16 nt, Mycobacterium avium subsp. paratuberculosis
accaacugagcgcggc

SEQ ID NO: 2915263 - RNA, 15 nt, Mycobacterium avium subsp. paratuberculosis
accaagaccgcgguc

SEQ ID NO: 2915264 - RNA, 13 nt, Mycobacterium avium subsp. paratuberculosis
accaagcgcgaca

SEQ ID NO: 2915265 - RNA, 22 nt, Mycobacterium avium subsp. paratuberculosis
accaaggcaaucaggcggucga

SEQ ID NO: 2915266 - RNA, 14 nt, Mycobacterium avium subsp. paratuberculosis
accaaugcgccggc

SEQ ID NO: 2915267 - RNA, 20 nt, Mycobacterium avium subsp. paratuberculosis
accaaugcgccggcggccgc

SEQ ID NO: 2915268 - RNA, 16 nt, Mycobacterium avium subsp. paratuberculosis
accaauggcggccacg

SEQ ID NO: 2915269 - RNA, 15 nt, Mycobacterium avium subsp. paratuberculosis
accaauucgcgcugc

SEQ ID NO: 2915270 - RNA, 21 nt, Mycobacterium avium subsp. paratuberculosis
accaauucgcgcugccagggc

SEQ ID NO: 2915271 - RNA, 17 nt, Mycobacterium avium subsp. paratuberculosis
accacacccagcgccag

SEQ ID NO: 2915272 - RNA, 21 nt, Mycobacterium avium subsp. paratuberculosis
accacacccgcacgcugucgg

SEQ ID NO: 2915273 - RNA, 13 nt, Mycobacterium avium subsp. paratuberculosis
accacaccgccgg

SEQ ID NO: 2915274 - RNA, 13 nt, Mycobacterium avium subsp. paratuberculosis
accacaccggcgc

SEQ ID NO: 2915275 - RNA, 14 nt, Mycobacterium avium subsp. paratuberculosis
accacaccggcgcu

SEQ ID NO: 2915276 - RNA, 18 nt, Mycobacterium avium subsp. paratuberculosis
accacaccggcgcugccc

SEQ ID NO: 2915277 - RNA, 22 nt, Mycobacterium avium subsp. paratuberculosis
accacacgugcggauggccccg

SEQ ID NO: 2915278 - RNA, 19 nt, Mycobacterium avium subsp. paratuberculosis
accacagcugcuggcugcg

SEQ ID NO: 2915279 - RNA, 18 nt, Mycobacterium avium subsp. paratuberculosis
accacaucggauucgucg

SEQ ID NO: 2915280 - RNA, 24 nt, Mycobacterium avium subsp. paratuberculosis
accacaucgguugcuccggcgucg

SEQ ID NO: 2915281 - RNA, 14 nt, Mycobacterium avium subsp. paratuberculosis
accacaugccguug

SEQ ID NO: 2915282 - RNA, 21 nt, Mycobacterium avium subsp. paratuberculosis
accacaugccguugccaggcc

SEQ ID NO: 2915283 - RNA, 17 nt, Mycobacterium avium subsp. paratuberculosis
accacauucccgccgcc

SEQ ID NO: 2915284 - RNA, 19 nt, Mycobacterium avium subsp. paratuberculosis
accacauucccgccgccgc

SEQ ID NO: 2915285 - RNA, 18 nt, Mycobacterium avium subsp. paratuberculosis
accacauuggcgaccgcg

SEQ ID NO: 2915286 - RNA, 23 nt, Mycobacterium avium subsp. paratuberculosis
accacauuggcgaccgcggccgc

SEQ ID NO: 2915287 - RNA, 17 nt, Mycobacterium avium subsp. paratuberculosis
accaccaacagcagcga

SEQ ID NO: 2915288 - RNA, 13 nt, Mycobacterium avium subsp. paratuberculosis
accaccaacgcca

SEQ ID NO: 2915289 - RNA, 17 nt, Mycobacterium avium subsp. paratuberculosis
accaccaacggcucgcc

SEQ ID NO: 2915290 - RNA, 16 nt, Mycobacterium avium subsp. paratuberculosis
accaccacacccagcg

SEQ ID NO: 2915291 - RNA, 17 nt, Mycobacterium avium subsp. paratuberculosis
accaccacacccagcgc

SEQ ID NO: 2915292 - RNA, 14 nt, Mycobacterium avium subsp. paratuberculosis
accaccacccccga

SEQ ID NO: 2915293 - RNA, 13 nt, Mycobacterium avium subsp. paratuberculosis
accaccaccgagc

SEQ ID NO: 2915294 - RNA, 18 nt, Mycobacterium avium subsp. paratuberculosis
accaccaccgcccacagc

SEQ ID NO: 2915295 - RNA, 22 nt, Mycobacterium avium subsp. paratuberculosis
accaccacgaccagugcccggc

SEQ ID NO: 2915296 - RNA, 14 nt, Mycobacterium avium subsp. paratuberculosis
accaccacggccau

SEQ ID NO: 2915297 - RNA, 15 nt, Mycobacterium avium subsp. paratuberculosis
accaccacggccgcc

SEQ ID NO: 2915298 - RNA, 17 nt, Mycobacterium avium subsp. paratuberculosis
accaccacggccgccga

SEQ ID NO: 2915299 - RNA, 19 nt, Mycobacterium avium subsp. paratuberculosis
accaccacggccgccgagg

SEQ ID NO: 2915300 - RNA, 20 nt, Mycobacterium avium subsp. paratuberculosis
accaccacggccgccgaggc

SEQ ID NO: 2915301 - RNA, 18 nt, Mycobacterium avium subsp. paratuberculosis
accaccacggggcggguc

SEQ ID NO: 2915302 - RNA, 15 nt, Mycobacterium avium subsp. paratuberculosis
accaccacgguggcg

SEQ ID NO: 2915303 - RNA, 22 nt, Mycobacterium avium subsp. paratuberculosis
accaccacgugccccuccucgg

SEQ ID NO: 2915304 - RNA, 15 nt, Mycobacterium avium subsp. paratuberculosis
accaccagccgcagg

SEQ ID NO: 2915305 - RNA, 23 nt, Mycobacterium avium subsp. paratuberculosis
accaccagccgcaggugcucgcc

SEQ ID NO: 2915306 - RNA, 14 nt, Mycobacterium avium subsp. paratuberculosis
accaccagcgaggu

SEQ ID NO: 2915307 - RNA, 14 nt, Mycobacterium avium subsp. paratuberculosis
accaccagcgggcu

SEQ ID NO: 2915308 - RNA, 22 nt, Mycobacterium avium subsp. paratuberculosis
accaccagcgggcugugccggc

SEQ ID NO: 2915309 - RNA, 20 nt, Mycobacterium avium subsp. paratuberculosis
accaccagcgguaaccaccc

SEQ ID NO: 2915310 - RNA, 16 nt, Mycobacterium avium subsp. paratuberculosis
accaccagcguguggc

SEQ ID NO: 2915311 - RNA, 21 nt, Mycobacterium avium subsp. paratuberculosis
accaccagcguguggcccugc

SEQ ID NO: 2915312 - RNA, 14 nt, Mycobacterium avium subsp. paratuberculosis
accaccaggugcgg

SEQ ID NO: 2915313 - RNA, 15 nt, Mycobacterium avium subsp. paratuberculosis
accaccagucggcgc

SEQ ID NO: 2915314 - RNA, 17 nt, Mycobacterium avium subsp. paratuberculosis
accaccaguuccaccag

SEQ ID NO: 2915315 - RNA, 13 nt, Mycobacterium avium subsp. paratuberculosis
accaccaugaugu

SEQ ID NO: 2915316 - RNA, 22 nt, Mycobacterium avium subsp. paratuberculosis
accaccaugauguagcggcggu

SEQ ID NO: 2915317 - RNA, 15 nt, Mycobacterium avium subsp. paratuberculosis
accaccaugucguug

SEQ ID NO: 2915318 - RNA, 13 nt, Mycobacterium avium subsp. paratuberculosis
accacccagcccu

SEQ ID NO: 2915319 - RNA, 16 nt, Mycobacterium avium subsp. paratuberculosis
accacccaggccaccc

SEQ ID NO: 2915320 - RNA, 19 nt, Mycobacterium avium subsp. paratuberculosis
accacccccagcccgccgg

SEQ ID NO: 2915321 - RNA, 22 nt, Mycobacterium avium subsp. paratuberculosis
accacccccagcccgccgggcu

SEQ ID NO: 2915322 - RNA, 19 nt, Mycobacterium avium subsp. paratuberculosis
accacccccgacccgaagc

SEQ ID NO: 2915323 - RNA, 23 nt, Mycobacterium avium subsp. paratuberculosis
accacccccgacccgaagcccau

SEQ ID NO: 2915324 - RNA, 21 nt, Mycobacterium avium subsp. paratuberculosis
accacccgcaccucgcccggc

SEQ ID NO: 2915325 - RNA, 17 nt, Mycobacterium avium subsp. paratuberculosis
accacgaagcgggcggc

SEQ ID NO: 2915326 - RNA, 17 nt, Mycobacterium avium subsp. paratuberculosis
accacgaagggcgccag

SEQ ID NO: 2915327 - RNA, 21 nt, Mycobacterium avium subsp. paratuberculosis
accacgaagggcgccagcacc

SEQ ID NO: 2915328 - RNA, 19 nt, Mycobacterium avium subsp. paratuberculosis
accacgaccagugcccggc

SEQ ID NO: 2915329 - RNA, 15 nt, Mycobacterium avium subsp. paratuberculosis
accacgaccgggucu

SEQ ID NO: 2915330 - RNA, 23 nt, Mycobacterium avium subsp. paratuberculosis
accacgaccgggucugccacgcc

SEQ ID NO: 2915331 - RNA, 14 nt, Mycobacterium avium subsp. paratuberculosis
accacgagcagccg

SEQ ID NO: 2915332 - RNA, 16 nt, Mycobacterium avium subsp. paratuberculosis
accacgagcagccgau

SEQ ID NO: 2915333 - RNA, 18 nt, Mycobacterium avium subsp. paratuberculosis
accacgaggaccagcaug

SEQ ID NO: 2915334 - RNA, 17 nt, Mycobacterium avium subsp. paratuberculosis
accacgaucagcgcguc

SEQ ID NO: 2915335 - RNA, 16 nt, Mycobacterium avium subsp. paratuberculosis
accacgaugaagccgu

SEQ ID NO: 2915336 - RNA, 18 nt, Mycobacterium avium subsp. paratuberculosis
accacgaugaagccgugc

SEQ ID NO: 2915337 - RNA, 15 nt, Mycobacterium avium subsp. paratuberculosis
accacgcacaccacc

SEQ ID NO: 2915338 - RNA, 20 nt, Mycobacterium avium subsp. paratuberculosis
accacgcccgacgacgacgu

SEQ ID NO: 2915339 - RNA, 14 nt, Mycobacterium avium subsp. paratuberculosis
accacgccgcgcuu

SEQ ID NO: 2915340 - RNA, 13 nt, Mycobacterium avium subsp. paratuberculosis
accacgccgcggu

SEQ ID NO: 2915341 - RNA, 15 nt, Mycobacterium avium subsp. paratuberculosis
accacgccgcggucg

SEQ ID NO: 2915342 - RNA, 20 nt, Mycobacterium avium subsp. paratuberculosis
accacgccgcggucgcugac

SEQ ID NO: 2915343 - RNA, 12 nt, Mycobacterium avium subsp. paratuberculosis
accacgccgucg

SEQ ID NO: 2915344 - RNA, 13 nt, Mycobacterium avium subsp. paratuberculosis
accacgccgucga

SEQ ID NO: 2915345 - RNA, 16 nt, Mycobacterium avium subsp. paratuberculosis
accacgccgucgacga

SEQ ID NO: 2915346 - RNA, 13 nt, Mycobacterium avium subsp. paratuberculosis
accacgccgugcc

SEQ ID NO: 2915347 - RNA, 20 nt, Mycobacterium avium subsp. paratuberculosis
accacgccgugcccggcgcc

SEQ ID NO: 2915348 - RNA, 17 nt, Mycobacterium avium subsp. paratuberculosis
accacgcgaucaggucc

SEQ ID NO: 2915349 - RNA, 15 nt, Mycobacterium avium subsp. paratuberculosis
accacgcggcggcgg

SEQ ID NO: 2915350 - RNA, 20 nt, Mycobacterium avium subsp. paratuberculosis
accacgcugagcaaccgccg

SEQ ID NO: 2915351 - RNA, 22 nt, Mycobacterium avium subsp. paratuberculosis
accacgcuguagggccaccacg

SEQ ID NO: 2915352 - RNA, 14 nt, Mycobacterium avium subsp. paratuberculosis
accacggagcgccc

SEQ ID NO: 2915353 - RNA, 16 nt, Mycobacterium avium subsp. paratuberculosis
accacggagcgcccgg

SEQ ID NO: 2915354 - RNA, 17 nt, Mycobacterium avium subsp. paratuberculosis
accacggagcgcccggc

SEQ ID NO: 2915355 - RNA, 20 nt, Mycobacterium avium subsp. paratuberculosis
accacggagcgcccggccag

SEQ ID NO: 2915356 - RNA, 14 nt, Mycobacterium avium subsp. paratuberculosis
accacggcaccgcc

SEQ ID NO: 2915357 - RNA, 17 nt, Mycobacterium avium subsp. paratuberculosis
accacggcaccgccgcg

SEQ ID NO: 2915358 - RNA, 18 nt, Mycobacterium avium subsp. paratuberculosis
accacggcaccgccgcgc

SEQ ID NO: 2915359 - RNA, 19 nt, Mycobacterium avium subsp. paratuberculosis
accacggcaccgccgcgcg

SEQ ID NO: 2915360 - RNA, 24 nt, Mycobacterium avium subsp. paratuberculosis
accacggccaggaagccggcgacg

SEQ ID NO: 2915361 - RNA, 13 nt, Mycobacterium avium subsp. paratuberculosis
accacggccccag

SEQ ID NO: 2915362 - RNA, 14 nt, Mycobacterium avium subsp. paratuberculosis
accacggccccagc

SEQ ID NO: 2915363 - RNA, 15 nt, Mycobacterium avium subsp. paratuberculosis
accacggccccagcc

SEQ ID NO: 2915364 - RNA, 16 nt, Mycobacterium avium subsp. paratuberculosis
accacggccccagccg

SEQ ID NO: 2915365 - RNA, 17 nt, Mycobacterium avium subsp. paratuberculosis
accacggccccagccgc

SEQ ID NO: 2915366 - RNA, 18 nt, Mycobacterium avium subsp. paratuberculosis
accacggccccagccgcc

SEQ ID NO: 2915367 - RNA, 20 nt, Mycobacterium avium subsp. paratuberculosis
accacggccccagccgccgc

SEQ ID NO: 2915368 - RNA, 18 nt, Mycobacterium avium subsp. paratuberculosis
accacggcccgcgccccg

SEQ ID NO: 2915369 - RNA, 22 nt, Mycobacterium avium subsp. paratuberculosis
accacggcccgcgccccggcgg

SEQ ID NO: 2915370 - RNA, 14 nt, Mycobacterium avium subsp. paratuberculosis
accacggccgcagc

SEQ ID NO: 2915371 - RNA, 16 nt, Mycobacterium avium subsp. paratuberculosis
accacggccgcagcgg

SEQ ID NO: 2915372 - RNA, 18 nt, Mycobacterium avium subsp. paratuberculosis
accacggccgcagcggca

SEQ ID NO: 2915373 - RNA, 14 nt, Mycobacterium avium subsp. paratuberculosis
accacggccgccga

SEQ ID NO: 2915374 - RNA, 13 nt, Mycobacterium avium subsp. paratuberculosis
accacggccggca

SEQ ID NO: 2915375 - RNA, 14 nt, Mycobacterium avium subsp. paratuberculosis
accacggccggcaa

SEQ ID NO: 2915376 - RNA, 12 nt, Mycobacterium avium subsp. paratuberculosis
accacggcgccc

SEQ ID NO: 2915377 - RNA, 14 nt, Mycobacterium avium subsp. paratuberculosis
accacggcgcccuc

SEQ ID NO: 2915378 - RNA, 15 nt, Mycobacterium avium subsp. paratuberculosis
accacggcgcccucg

SEQ ID NO: 2915379 - RNA, 12 nt, Mycobacterium avium subsp. paratuberculosis
accacggcgcgg

SEQ ID NO: 2915380 - RNA, 20 nt, Mycobacterium avium subsp. paratuberculosis
accacgggucggucggcccg

SEQ ID NO: 2915381 - RNA, 22 nt, Mycobacterium avium subsp. paratuberculosis
accacgggucggucggcccgcu

SEQ ID NO: 2915382 - RNA, 17 nt, Mycobacterium avium subsp. paratuberculosis
accacggucacagccgc

SEQ ID NO: 2915383 - RNA, 18 nt, Mycobacterium avium subsp. paratuberculosis
accacggucacagccgcg

SEQ ID NO: 2915384 - RNA, 17 nt, Mycobacterium avium subsp. paratuberculosis
accacggucagggccag

SEQ ID NO: 2915385 - RNA, 19 nt, Mycobacterium avium subsp. paratuberculosis
accacggucagggccagca

SEQ ID NO: 2915386 - RNA, 23 nt, Mycobacterium avium subsp. paratuberculosis
accacggucagggccagcaacac

SEQ ID NO: 2915387 - RNA, 16 nt, Mycobacterium avium subsp. paratuberculosis
accacgguccccgcgc

SEQ ID NO: 2915388 - RNA, 17 nt, Mycobacterium avium subsp. paratuberculosis
accacgguccccgcgcc

SEQ ID NO: 2915389 - RNA, 21 nt, Mycobacterium avium subsp. paratuberculosis
accacgguccccgcgcccgcc

SEQ ID NO: 2915390 - RNA, 22 nt, Mycobacterium avium subsp. paratuberculosis
accacgguccccgcgcccgccg

SEQ ID NO: 2915391 - RNA, 17 nt, Mycobacterium avium subsp. paratuberculosis
accacggucgccgcgcc

SEQ ID NO: 2915392 - RNA, 19 nt, Mycobacterium avium subsp. paratuberculosis
accacggucgccgcgccgc

SEQ ID NO: 2915393 - RNA, 16 nt, Mycobacterium avium subsp. paratuberculosis
accacggucggcgggu

SEQ ID NO: 2915394 - RNA, 17 nt, Mycobacterium avium subsp. paratuberculosis
accacggugaacgggcc

SEQ ID NO: 2915395 - RNA, 21 nt, Mycobacterium avium subsp. paratuberculosis
accacggugaacgggccgcac

SEQ ID NO: 2915396 - RNA, 19 nt, Mycobacterium avium subsp. paratuberculosis
accacggugaucucgccga

SEQ ID NO: 2915397 - RNA, 16 nt, Mycobacterium avium subsp. paratuberculosis
accacgguggccgcga

SEQ ID NO: 2915398 - RNA, 21 nt, Mycobacterium avium subsp. paratuberculosis
accacgguggcgccgcgcagc

SEQ ID NO: 2915399 - RNA, 23 nt, Mycobacterium avium subsp. paratuberculosis
accacgguggcgccgcgcagcca

SEQ ID NO: 2915400 - RNA, 18 nt, Mycobacterium avium subsp. paratuberculosis
accacgguggcgccggca

SEQ ID NO: 2915401 - RNA, 23 nt, Mycobacterium avium subsp. paratuberculosis
accacgguggcgccggcaucgac

SEQ ID NO: 2915402 - RNA, 18 nt, Mycobacterium avium subsp. paratuberculosis
accacguacuccugcgcg

SEQ ID NO: 2915403 - RNA, 14 nt, Mycobacterium avium subsp. paratuberculosis
accacguagccgac

SEQ ID NO: 2915404 - RNA, 15 nt, Mycobacterium avium subsp. paratuberculosis
accacguagccgacc

SEQ ID NO: 2915405 - RNA, 14 nt, Mycobacterium avium subsp. paratuberculosis
accacguaggcgau

SEQ ID NO: 2915406 - RNA, 22 nt, Mycobacterium avium subsp. paratuberculosis
accacguccagcugggcugcca

SEQ ID NO: 2915407 - RNA, 18 nt, Mycobacterium avium subsp. paratuberculosis
accacguccgcggugagc

SEQ ID NO: 2915408 - RNA, 21 nt, Mycobacterium avium subsp. paratuberculosis
accacgucggguucgccggug

SEQ ID NO: 2915409 - RNA, 16 nt, Mycobacterium avium subsp. paratuberculosis
accacgucggugccgc

SEQ ID NO: 2915410 - RNA, 15 nt, Mycobacterium avium subsp. paratuberculosis
accagcccgucgucc

SEQ ID NO: 2915411 - RNA, 15 nt, Mycobacterium avium subsp. paratuberculosis
accagccgcaggugc

SEQ ID NO: 2915412 - RNA, 21 nt, Mycobacterium avium subsp. paratuberculosis
accagccgcggacggccagcc

SEQ ID NO: 2915413 - RNA, 16 nt, Mycobacterium avium subsp. paratuberculosis
accagccggccggcga

SEQ ID NO: 2915414 - RNA, 15 nt, Mycobacterium avium subsp. paratuberculosis
accagcgacgccagc

SEQ ID NO: 2915415 - RNA, 17 nt, Mycobacterium avium subsp. paratuberculosis
accagcgacgccagcgg

SEQ ID NO: 2915416 - RNA, 21 nt, Mycobacterium avium subsp. paratuberculosis
accagcgacgccagcggcagc

SEQ ID NO: 2915417 - RNA, 19 nt, Mycobacterium avium subsp. paratuberculosis
accagcgagcccagcugcg

SEQ ID NO: 2915418 - RNA, 20 nt, Mycobacterium avium subsp. paratuberculosis
accagcgauccggcgcguuc

SEQ ID NO: 2915419 - RNA, 18 nt, Mycobacterium avium subsp. paratuberculosis
accagcgauucccgccgg

SEQ ID NO: 2915420 - RNA, 16 nt, Mycobacterium avium subsp. paratuberculosis
accagcgcaaccgcgg

SEQ ID NO: 2915421 - RNA, 17 nt, Mycobacterium avium subsp. paratuberculosis
accagcgcaaccgcggc

SEQ ID NO: 2915422 - RNA, 20 nt, Mycobacterium avium subsp. paratuberculosis
accagcgcaaccgcggcggc

SEQ ID NO: 2915423 - RNA, 15 nt, Mycobacterium avium subsp. paratuberculosis
accagcgcccccgac

SEQ ID NO: 2915424 - RNA, 14 nt, Mycobacterium avium subsp. paratuberculosis
accagcgcccgccc

SEQ ID NO: 2915425 - RNA, 23 nt, Mycobacterium avium subsp. paratuberculosis
accagcgcccgcccggacacccc

SEQ ID NO: 2915426 - RNA, 21 nt, Mycobacterium avium subsp. paratuberculosis
accagcgccgagaccagccag

SEQ ID NO: 2915427 - RNA, 16 nt, Mycobacterium avium subsp. paratuberculosis
accagcgccgcgauga

SEQ ID NO: 2915428 - RNA, 17 nt, Mycobacterium avium subsp. paratuberculosis
accagcgccucgcgggu

SEQ ID NO: 2915429 - RNA, 19 nt, Mycobacterium avium subsp. paratuberculosis
accagcgccucgcgggugc

SEQ ID NO: 2915430 - RNA, 14 nt, Mycobacterium avium subsp. paratuberculosis
accagcgccucggc

SEQ ID NO: 2915431 - RNA, 18 nt, Mycobacterium avium subsp. paratuberculosis
accagcgccucggccugc

SEQ ID NO: 2915432 - RNA, 20 nt, Mycobacterium avium subsp. paratuberculosis
accagcgccucggccugcgc

SEQ ID NO: 2915433 - RNA, 17 nt, Mycobacterium avium subsp. paratuberculosis
accagcgccugggcgua

SEQ ID NO: 2915434 - RNA, 18 nt, Mycobacterium avium subsp. paratuberculosis
accagcgcgaacagcgcg

SEQ ID NO: 2915435 - RNA, 22 nt, Mycobacterium avium subsp. paratuberculosis
accagcgcgaacagcgcggcca

SEQ ID NO: 2915436 - RNA, 12 nt, Mycobacterium avium subsp. paratuberculosis
accagcgcgcac

SEQ ID NO: 2915437 - RNA, 13 nt, Mycobacterium avium subsp. paratuberculosis
accagcgcgccgc

SEQ ID NO: 2915438 - RNA, 18 nt, Mycobacterium avium subsp. paratuberculosis
accagcgcgccgcccagc

SEQ ID NO: 2915439 - RNA, 13 nt, Mycobacterium avium subsp. paratuberculosis
accagcgcgcggg

SEQ ID NO: 2915440 - RNA, 18 nt, Mycobacterium avium subsp. paratuberculosis
accagcgcggccaccacc

SEQ ID NO: 2915441 - RNA, 22 nt, Mycobacterium avium subsp. paratuberculosis
accagcgcggugaugugcagga

SEQ ID NO: 2915442 - RNA, 13 nt, Mycobacterium avium subsp. paratuberculosis
accagcgcggugc

SEQ ID NO: 2915443 - RNA, 18 nt, Mycobacterium avium subsp. paratuberculosis
accagcgcguagagcauc

SEQ ID NO: 2915444 - RNA, 23 nt, Mycobacterium avium subsp. paratuberculosis
accagcgcguagagcaucagguc

SEQ ID NO: 2915445 - RNA, 21 nt, Mycobacterium avium subsp. paratuberculosis
accagcgcuuucgcgcacgcc

SEQ ID NO: 2915446 - RNA, 12 nt, Mycobacterium avium subsp. paratuberculosis
accagcggcagc

SEQ ID NO: 2915447 - RNA, 14 nt, Mycobacterium avium subsp. paratuberculosis
accagcggcagcag

SEQ ID NO: 2915448 - RNA, 16 nt, Mycobacterium avium subsp. paratuberculosis
accagcggcagcagca

SEQ ID NO: 2915449 - RNA, 12 nt, Mycobacterium avium subsp. paratuberculosis
accagcggcccg

SEQ ID NO: 2915450 - RNA, 13 nt, Mycobacterium avium subsp. paratuberculosis
accagcggccguc

SEQ ID NO: 2915451 - RNA, 14 nt, Mycobacterium avium subsp. paratuberculosis
accagcggccgucg

SEQ ID NO: 2915452 - RNA, 16 nt, Mycobacterium avium subsp. paratuberculosis
accagcggccgucgcc

SEQ ID NO: 2915453 - RNA, 21 nt, Mycobacterium avium subsp. paratuberculosis
accagcggccgucgccgggcg

SEQ ID NO: 2915454 - RNA, 12 nt, Mycobacterium avium subsp. paratuberculosis
accagcggcgcc

SEQ ID NO: 2915455 - RNA, 17 nt, Mycobacterium avium subsp. paratuberculosis
accagcggcgcgccggg

SEQ ID NO: 2915456 - RNA, 19 nt, Mycobacterium avium subsp. paratuberculosis
accagcggcgcgccgggca

SEQ ID NO: 2915457 - RNA, 19 nt, Mycobacterium avium subsp. paratuberculosis
accagcggcgcgucgcugg

SEQ ID NO: 2915458 - RNA, 22 nt, Mycobacterium avium subsp. paratuberculosis
accagcggcgcgucgcugggca

SEQ ID NO: 2915459 - RNA, 16 nt, Mycobacterium avium subsp. paratuberculosis
accagcggcugcagca

SEQ ID NO: 2915460 - RNA, 23 nt, Mycobacterium avium subsp. paratuberculosis
accagcggcugcagcagaugcgc

SEQ ID NO: 2915461 - RNA, 21 nt, Mycobacterium avium subsp. paratuberculosis
accagcgggaugaaggcaccc

SEQ ID NO: 2915462 - RNA, 17 nt, Mycobacterium avium subsp. paratuberculosis
accagcgggccgacagc

SEQ ID NO: 2915463 - RNA, 21 nt, Mycobacterium avium subsp. paratuberculosis
accagcgggccgacagcacgc

SEQ ID NO: 2915464 - RNA, 16 nt, Mycobacterium avium subsp. paratuberculosis
accagcgggcugugcc

SEQ ID NO: 2915465 - RNA, 21 nt, Mycobacterium avium subsp. paratuberculosis
accagcgggcugugccggcgg

SEQ ID NO: 2915466 - RNA, 22 nt, Mycobacterium avium subsp. paratuberculosis
accagcgggguguucaccgcgc

SEQ ID NO: 2915467 - RNA, 23 nt, Mycobacterium avium subsp. paratuberculosis
accagcgggguguucaccgcgcc

SEQ ID NO: 2915468 - RNA, 17 nt, Mycobacterium avium subsp. paratuberculosis
accagcgugacgcugaa

SEQ ID NO: 2915469 - RNA, 18 nt, Mycobacterium avium subsp. paratuberculosis
accagcgugcugccggac

SEQ ID NO: 2915470 - RNA, 16 nt, Mycobacterium avium subsp. paratuberculosis
accagcguggccggca

SEQ ID NO: 2915471 - RNA, 17 nt, Mycobacterium avium subsp. paratuberculosis
accagcguggccggcag

SEQ ID NO: 2915472 - RNA, 18 nt, Mycobacterium avium subsp. paratuberculosis
accagcguggugcgcccg

SEQ ID NO: 2915473 - RNA, 17 nt, Mycobacterium avium subsp. paratuberculosis
accagcgugucgccggg

SEQ ID NO: 2915474 - RNA, 20 nt, Mycobacterium avium subsp. paratuberculosis
accagcguucgucgccggug

SEQ ID NO: 2915475 - RNA, 19 nt, Mycobacterium avium subsp. paratuberculosis
accagcucgaugccguucg

SEQ ID NO: 2915476 - RNA, 15 nt, Mycobacterium avium subsp. paratuberculosis
accagcucggcgcug

SEQ ID NO: 2915477 - RNA, 18 nt, Mycobacterium avium subsp. paratuberculosis
accagcucggcgcugucg

SEQ ID NO: 2915478 - RNA, 19 nt, Mycobacterium avium subsp. paratuberculosis
accagcucggcgcugucgg

SEQ ID NO: 2915479 - RNA, 16 nt, Mycobacterium avium subsp. paratuberculosis
accagcucggugauca

SEQ ID NO: 2915480 - RNA, 16 nt, Mycobacterium avium subsp. paratuberculosis
accagcucgucgccga

SEQ ID NO: 2915481 - RNA, 17 nt, Mycobacterium avium subsp. paratuberculosis
accagcucgucgccgac

SEQ ID NO: 2915482 - RNA, 14 nt, Mycobacterium avium subsp. paratuberculosis
accagcugauucgc

SEQ ID NO: 2915483 - RNA, 22 nt, Mycobacterium avium subsp. paratuberculosis
accagcugauucgcgguggcga

SEQ ID NO: 2915484 - RNA, 17 nt, Mycobacterium avium subsp. paratuberculosis
accagcugcccaccagc

SEQ ID NO: 2915485 - RNA, 19 nt, Mycobacterium avium subsp. paratuberculosis
accagcugcccaccagcag

SEQ ID NO: 2915486 - RNA, 20 nt, Mycobacterium avium subsp. paratuberculosis
accagcugcccaccagcagg

SEQ ID NO: 2915487 - RNA, 20 nt, Mycobacterium avium subsp. paratuberculosis
accagcugcgaaucgucggc

SEQ ID NO: 2915488 - RNA, 21 nt, Mycobacterium avium subsp. paratuberculosis
accagcugcgaaucgucggcg

SEQ ID NO: 2915489 - RNA, 23 nt, Mycobacterium avium subsp. paratuberculosis
accagcugcggaaaugcccgcgc

SEQ ID NO: 2915490 - RNA, 18 nt, Mycobacterium avium subsp. paratuberculosis
accagcuggauggcgccc

SEQ ID NO: 2915491 - RNA, 21 nt, Mycobacterium avium subsp. paratuberculosis
accagcuggauggcgcccagc

SEQ ID NO: 2915492 - RNA, 22 nt, Mycobacterium avium subsp. paratuberculosis
accagcuggauggcgcccagcc

SEQ ID NO: 2915493 - RNA, 23 nt, Mycobacterium avium subsp. paratuberculosis
accagcuggauggcgcccagccc

SEQ ID NO: 2915494 - RNA, 18 nt, Mycobacterium avium subsp. paratuberculosis
accaggguggucagcguc

SEQ ID NO: 2915495 - RNA, 20 nt, Mycobacterium avium subsp. paratuberculosis
accagggugucgucgcgcac

SEQ ID NO: 2915496 - RNA, 21 nt, Mycobacterium avium subsp. paratuberculosis
accagggugucgucgcgcacc

SEQ ID NO: 2915497 - RNA, 16 nt, Mycobacterium avium subsp. paratuberculosis
accagguaccggcggg

SEQ ID NO: 2915498 - RNA, 19 nt, Mycobacterium avium subsp. paratuberculosis
accagguaccggcgggcga

SEQ ID NO: 2915499 - RNA, 20 nt, Mycobacterium avium subsp. paratuberculosis
accagguagauggugaucga

SEQ ID NO: 2915500 - RNA, 19 nt, Mycobacterium avium subsp. paratuberculosis
accagguaggcgguggcgc

SEQ ID NO: 2915501 - RNA, 17 nt, Mycobacterium avium subsp. paratuberculosis
accagguagguggccgu

SEQ ID NO: 2915502 - RNA, 19 nt, Mycobacterium avium subsp. paratuberculosis
accagguagguggccgucg

SEQ ID NO: 2915503 - RNA, 19 nt, Mycobacterium avium subsp. paratuberculosis
accagguauucaucgcggc

SEQ ID NO: 2915504 - RNA, 20 nt, Mycobacterium avium subsp. paratuberculosis
accagguccaccccgccaau

SEQ ID NO: 2915505 - RNA, 21 nt, Mycobacterium avium subsp. paratuberculosis
accagguccgguucgaccggc

SEQ ID NO: 2915506 - RNA, 15 nt, Mycobacterium avium subsp. paratuberculosis
accaggucgaggguc

SEQ ID NO: 2915507 - RNA, 16 nt, Mycobacterium avium subsp. paratuberculosis
accaggucgcacacca

SEQ ID NO: 2915508 - RNA, 23 nt, Mycobacterium avium subsp. paratuberculosis
accaggucgcacaccagcacggc

SEQ ID NO: 2915509 - RNA, 19 nt, Mycobacterium avium subsp. paratuberculosis
accaggucgccggcggccg

SEQ ID NO: 2915510 - RNA, 14 nt, Mycobacterium avium subsp. paratuberculosis
accaggucgcggcg

SEQ ID NO: 2915511 - RNA, 16 nt, Mycobacterium avium subsp. paratuberculosis
accaggucgcggcgcu

SEQ ID NO: 2915512 - RNA, 17 nt, Mycobacterium avium subsp. paratuberculosis
accaggucgcggcgcug

SEQ ID NO: 2915513 - RNA, 15 nt, Mycobacterium avium subsp. paratuberculosis
accaggucggccuuc

SEQ ID NO: 2915514 - RNA, 21 nt, Mycobacterium avium subsp. paratuberculosis
accaggucggccuucagcguc

SEQ ID NO: 2915515 - RNA, 20 nt, Mycobacterium avium subsp. paratuberculosis
accaggucguugccggugcc

SEQ ID NO: 2915516 - RNA, 22 nt, Mycobacterium avium subsp. paratuberculosis
accaggucguugccggugccga

SEQ ID NO: 2915517 - RNA, 16 nt, Mycobacterium avium subsp. paratuberculosis
accaggucuccgucgg

SEQ ID NO: 2915518 - RNA, 14 nt, Mycobacterium avium subsp. paratuberculosis
accaggugaccggc

SEQ ID NO: 2915519 - RNA, 16 nt, Mycobacterium avium subsp. paratuberculosis
accaggugaccggccu

SEQ ID NO: 2915520 - RNA, 22 nt, Mycobacterium avium subsp. paratuberculosis
accaggugggcggccaccacuu

SEQ ID NO: 2915521 - RNA, 20 nt, Mycobacterium avium subsp. paratuberculosis
accagguugucgccgcgcca

SEQ ID NO: 2915522 - RNA, 22 nt, Mycobacterium avium subsp. paratuberculosis
accagguugucgccgcgccagc

SEQ ID NO: 2915523 - RNA, 14 nt, Mycobacterium avium subsp. paratuberculosis
accaguaccgggcc

SEQ ID NO: 2915524 - RNA, 18 nt, Mycobacterium avium subsp. paratuberculosis
accaguaggccagcaucu

SEQ ID NO: 2915525 - RNA, 13 nt, Mycobacterium avium subsp. paratuberculosis
accagucggccau

SEQ ID NO: 2915526 - RNA, 13 nt, Mycobacterium avium subsp. paratuberculosis
accagucggcgcg

SEQ ID NO: 2915527 - RNA, 20 nt, Mycobacterium avium subsp. paratuberculosis
accagugcacgcucggcggg

SEQ ID NO: 2915528 - RNA, 16 nt, Mycobacterium avium subsp. paratuberculosis
accagugcagagcgau

SEQ ID NO: 2915529 - RNA, 14 nt, Mycobacterium avium subsp. paratuberculosis
accagugcccggcc

SEQ ID NO: 2915530 - RNA, 16 nt, Mycobacterium avium subsp. paratuberculosis
accaguguccgggcgc

SEQ ID NO: 2915531 - RNA, 20 nt, Mycobacterium avium subsp. paratuberculosis
accaguuccugcaugccggg

SEQ ID NO: 2915532 - RNA, 15 nt, Mycobacterium avium subsp. paratuberculosis
accaguucgccacca

SEQ ID NO: 2915533 - RNA, 19 nt, Mycobacterium avium subsp. paratuberculosis
accaguucgcccuggccgc

SEQ ID NO: 2915534 - RNA, 20 nt, Mycobacterium avium subsp. paratuberculosis
accaguucgcguacccgcgc

SEQ ID NO: 2915535 - RNA, 23 nt, Mycobacterium avium subsp. paratuberculosis
accaguucgcguacccgcgcggc

SEQ ID NO: 2915536 - RNA, 20 nt, Mycobacterium avium subsp. paratuberculosis
accaguucggccaccgcguc

SEQ ID NO: 2915537 - RNA, 21 nt, Mycobacterium avium subsp. paratuberculosis
accaguucggccaccgcgucc

SEQ ID NO: 2915538 - RNA, 21 nt, Mycobacterium avium subsp. paratuberculosis
accaguucuucgaugacggcc

SEQ ID NO: 2915539 - RNA, 16 nt, Mycobacterium avium subsp. paratuberculosis
accaguugcaccggca

SEQ ID NO: 2915540 - RNA, 22 nt, Mycobacterium avium subsp. paratuberculosis
accaucaacccgagcaccgggc

SEQ ID NO: 2915541 - RNA, 13 nt, Mycobacterium avium subsp. paratuberculosis
accaucacgcaga

SEQ ID NO: 2915542 - RNA, 17 nt, Mycobacterium avium subsp. paratuberculosis
accaucacgucgcgcuu

SEQ ID NO: 2915543 - RNA, 15 nt, Mycobacterium avium subsp. paratuberculosis
accaucagcccggug

SEQ ID NO: 2915544 - RNA, 19 nt, Mycobacterium avium subsp. paratuberculosis
accaucagcccggugacga

SEQ ID NO: 2915545 - RNA, 17 nt, Mycobacterium avium subsp. paratuberculosis
accaucagccugcggug

SEQ ID NO: 2915546 - RNA, 21 nt, Mycobacterium avium subsp. paratuberculosis
accaucagccugcggugaugc

SEQ ID NO: 2915547 - RNA, 14 nt, Mycobacterium avium subsp. paratuberculosis
accaucagcgcccg

SEQ ID NO: 2915548 - RNA, 13 nt, Mycobacterium avium subsp. paratuberculosis
accaucagcggcu

SEQ ID NO: 2915549 - RNA, 14 nt, Mycobacterium avium subsp. paratuberculosis
accaucagcggcuc

SEQ ID NO: 2915550 - RNA, 16 nt, Mycobacterium avium subsp. paratuberculosis
accaucagcggcucgc

SEQ ID NO: 2915551 - RNA, 14 nt, Mycobacterium avium subsp. paratuberculosis
accaucaggccggc

SEQ ID NO: 2915552 - RNA, 17 nt, Mycobacterium avium subsp. paratuberculosis
accaucaggccggccug

SEQ ID NO: 2915553 - RNA, 21 nt, Mycobacterium avium subsp. paratuberculosis
accaucaggccggccugccac

SEQ ID NO: 2915554 - RNA, 13 nt, Mycobacterium avium subsp. paratuberculosis
accaucccgccgc

SEQ ID NO: 2915555 - RNA, 17 nt, Mycobacterium avium subsp. paratuberculosis
accaucccgccgccgaa

SEQ ID NO: 2915556 - RNA, 16 nt, Mycobacterium avium subsp. paratuberculosis
accauccgguccagau

SEQ ID NO: 2915557 - RNA, 18 nt, Mycobacterium avium subsp. paratuberculosis
accaucgcgauggaagcg

SEQ ID NO: 2915558 - RNA, 19 nt, Mycobacterium avium subsp. paratuberculosis
accaucgggucgucggcgu

SEQ ID NO: 2915559 - RNA, 16 nt, Mycobacterium avium subsp. paratuberculosis
accaucugccggcgcu

SEQ ID NO: 2915560 - RNA, 13 nt, Mycobacterium avium subsp. paratuberculosis
accaugaagccgu

SEQ ID NO: 2915561 - RNA, 14 nt, Mycobacterium avium subsp. paratuberculosis
accaugacccacgg

SEQ ID NO: 2915562 - RNA, 16 nt, Mycobacterium avium subsp. paratuberculosis
accaugaucagcgccg

SEQ ID NO: 2915563 - RNA, 17 nt, Mycobacterium avium subsp. paratuberculosis
accaugaucagcgccgu

SEQ ID NO: 2915564 - RNA, 21 nt, Mycobacterium avium subsp. paratuberculosis
accaugaucagcgccguggcc

SEQ ID NO: 2915565 - RNA, 17 nt, Mycobacterium avium subsp. paratuberculosis
accaugauguagcggcg

SEQ ID NO: 2915566 - RNA, 15 nt, Mycobacterium avium subsp. paratuberculosis
accaugcccagcagu

SEQ ID NO: 2915567 - RNA, 14 nt, Mycobacterium avium subsp. paratuberculosis
accaugcccggcgc

SEQ ID NO: 2915568 - RNA, 13 nt, Mycobacterium avium subsp. paratuberculosis
accaugccgcggg

SEQ ID NO: 2915569 - RNA, 17 nt, Mycobacterium avium subsp. paratuberculosis
accaugccgcgggccag

SEQ ID NO: 2915570 - RNA, 17 nt, Mycobacterium avium subsp. paratuberculosis
accaugccggcguccag

SEQ ID NO: 2915571 - RNA, 18 nt, Mycobacterium avium subsp. paratuberculosis
accaugccggcguccagu

SEQ ID NO: 2915572 - RNA, 19 nt, Mycobacterium avium subsp. paratuberculosis
accaugccguagcggucgc

SEQ ID NO: 2915573 - RNA, 17 nt, Mycobacterium avium subsp. paratuberculosis
accauggcgcggcggcc

SEQ ID NO: 2915574 - RNA, 18 nt, Mycobacterium avium subsp. paratuberculosis
accauggcgcggcggccg

SEQ ID NO: 2915575 - RNA, 21 nt, Mycobacterium avium subsp. paratuberculosis
accauggcgcggcggccggcc

SEQ ID NO: 2915576 - RNA, 23 nt, Mycobacterium avium subsp. paratuberculosis
accauggcgcggcggccggccag

SEQ ID NO: 2915577 - RNA, 14 nt, Mycobacterium avium subsp. paratuberculosis
accauggcuuccgc

SEQ ID NO: 2915578 - RNA, 18 nt, Mycobacterium avium subsp. paratuberculosis
accauggcuuccgccgag

SEQ ID NO: 2915579 - RNA, 16 nt, Mycobacterium avium subsp. paratuberculosis
accccacggccgcaac

SEQ ID NO: 2915580 - RNA, 14 nt, Mycobacterium avium subsp. paratuberculosis
accccagccggccg

SEQ ID NO: 2915581 - RNA, 17 nt, Mycobacterium avium subsp. paratuberculosis
accccagccggccgagc

SEQ ID NO: 2915582 - RNA, 17 nt, Mycobacterium avium subsp. paratuberculosis
accccagcgcgaccagu

SEQ ID NO: 2915583 - RNA, 21 nt, Mycobacterium avium subsp. paratuberculosis
accccagcgugacgucgacgu

SEQ ID NO: 2915584 - RNA, 12 nt, Mycobacterium avium subsp. paratuberculosis
accccagcuccg

SEQ ID NO: 2915585 - RNA, 21 nt, Mycobacterium avium subsp. paratuberculosis
accccaggcgaugccgccgac

SEQ ID NO: 2915586 - RNA, 22 nt, Mycobacterium avium subsp. paratuberculosis
accccagugcaggcugacgcga

SEQ ID NO: 2915587 - RNA, 20 nt, Mycobacterium avium subsp. paratuberculosis
acccccaauugccgggccag

SEQ ID NO: 2915588 - RNA, 13 nt, Mycobacterium avium subsp. paratuberculosis
acccccaccgcga

SEQ ID NO: 2915589 - RNA, 18 nt, Mycobacterium avium subsp. paratuberculosis
acccccagcccgccgggc

SEQ ID NO: 2915590 - RNA, 22 nt, Mycobacterium avium subsp. paratuberculosis
acccccagcccgccgggcugac

SEQ ID NO: 2915591 - RNA, 12 nt, Mycobacterium avium subsp. paratuberculosis
acccccagcucg

SEQ ID NO: 2915592 - RNA, 17 nt, Mycobacterium avium subsp. paratuberculosis
acccccagcucgacgac

SEQ ID NO: 2915593 - RNA, 23 nt, Mycobacterium avium subsp. paratuberculosis
acccccagcucgacgacuucggc

SEQ ID NO: 2915594 - RNA, 14 nt, Mycobacterium avium subsp. paratuberculosis
accccccacgcucg

SEQ ID NO: 2915595 - RNA, 19 nt, Mycobacterium avium subsp. paratuberculosis
accccccuuggcggcaagc

SEQ ID NO: 2915596 - RNA, 17 nt, Mycobacterium avium subsp. paratuberculosis
acccccgcacgccagca

SEQ ID NO: 2915597 - RNA, 14 nt, Mycobacterium avium subsp. paratuberculosis
acccccggcgcgac

SEQ ID NO: 2915598 - RNA, 23 nt, Mycobacterium avium subsp. paratuberculosis
acccccgggaugccugcccgcgc

SEQ ID NO: 2915599 - RNA, 21 nt, Mycobacterium avium subsp. paratuberculosis
acccccggggccuccagccag

SEQ ID NO: 2915600 - RNA, 21 nt, Mycobacterium avium subsp. paratuberculosis
acccccggugucugaccucgc

SEQ ID NO: 2915601 - RNA, 20 nt, Mycobacterium avium subsp. paratuberculosis
acccccuacgccguggccug

SEQ ID NO: 2915602 - RNA, 13 nt, Mycobacterium avium subsp. paratuberculosis
acccccucggggc

SEQ ID NO: 2915603 - RNA, 14 nt, Mycobacterium avium subsp. paratuberculosis
acccccucggggcu

SEQ ID NO: 2915604 - RNA, 17 nt, Mycobacterium avium subsp. paratuberculosis
acccccucggggcucac

SEQ ID NO: 2915605 - RNA, 19 nt, Mycobacterium avium subsp. paratuberculosis
acccccucggggcucacca

SEQ ID NO: 2915606 - RNA, 13 nt, Mycobacterium avium subsp. paratuberculosis
accccgaaccagu

SEQ ID NO: 2915607 - RNA, 11 nt, Mycobacterium avium subsp. paratuberculosis
accccgaaccc

SEQ ID NO: 2915608 - RNA, 15 nt, Mycobacterium avium subsp. paratuberculosis
accccgaacccggcc

SEQ ID NO: 2915609 - RNA, 16 nt, Mycobacterium avium subsp. paratuberculosis
accccgaacccggcca

SEQ ID NO: 2915610 - RNA, 17 nt, Mycobacterium avium subsp. paratuberculosis
accccgaacccggccag

SEQ ID NO: 2915611 - RNA, 18 nt, Mycobacterium avium subsp. paratuberculosis
accccgaacccggccagc

SEQ ID NO: 2915612 - RNA, 19 nt, Mycobacterium avium subsp. paratuberculosis
accccgaacccggccagcg

SEQ ID NO: 2915613 - RNA, 16 nt, Mycobacterium avium subsp. paratuberculosis
accccgaaccgcccgc

SEQ ID NO: 2915614 - RNA, 21 nt, Mycobacterium avium subsp. paratuberculosis
accccgaaccgcccgcccggc

SEQ ID NO: 2915615 - RNA, 16 nt, Mycobacterium avium subsp. paratuberculosis
accccgaagcucauca

SEQ ID NO: 2915616 - RNA, 16 nt, Mycobacterium avium subsp. paratuberculosis
accccgacggcgccgc

SEQ ID NO: 2915617 - RNA, 18 nt, Mycobacterium avium subsp. paratuberculosis
accccgacggcgccgcgg

SEQ ID NO: 2915618 - RNA, 16 nt, Mycobacterium avium subsp. paratuberculosis
accccgagcaggcgga

SEQ ID NO: 2915619 - RNA, 16 nt, Mycobacterium avium subsp. paratuberculosis
accccgaguucggcca

SEQ ID NO: 2915620 - RNA, 23 nt, Mycobacterium avium subsp. paratuberculosis
accccgaguucggccagaucggc

SEQ ID NO: 2915621 - RNA, 14 nt, Mycobacterium avium subsp. paratuberculosis
accccgaucggggc

SEQ ID NO: 2915622 - RNA, 15 nt, Mycobacterium avium subsp. paratuberculosis
accccgaucggggcc

SEQ ID NO: 2915623 - RNA, 14 nt, Mycobacterium avium subsp. paratuberculosis
accccgaugccgaa

SEQ ID NO: 2915624 - RNA, 16 nt, Mycobacterium avium subsp. paratuberculosis
accccgaugccgaacu

SEQ ID NO: 2915625 - RNA, 16 nt, Mycobacterium avium subsp. paratuberculosis
accccgaugcgcucac

SEQ ID NO: 2915626 - RNA, 20 nt, Mycobacterium avium subsp. paratuberculosis
accccgaugcgcucgccgau

SEQ ID NO: 2915627 - RNA, 14 nt, Mycobacterium avium subsp. paratuberculosis
accccgaugcggug

SEQ ID NO: 2915628 - RNA, 20 nt, Mycobacterium avium subsp. paratuberculosis
accccgaugcggugccgggc

SEQ ID NO: 2915629 - RNA, 14 nt, Mycobacterium avium subsp. paratuberculosis
accccgcagaacac

SEQ ID NO: 2915630 - RNA, 19 nt, Mycobacterium avium subsp. paratuberculosis
accccgccaaucaccgcgg

SEQ ID NO: 2915631 - RNA, 21 nt, Mycobacterium avium subsp. paratuberculosis
accccgccaaucaccgcggug

SEQ ID NO: 2915632 - RNA, 14 nt, Mycobacterium avium subsp. paratuberculosis
accccgccagcacc

SEQ ID NO: 2915633 - RNA, 17 nt, Mycobacterium avium subsp. paratuberculosis
accccgccagcaccgac

SEQ ID NO: 2915634 - RNA, 23 nt, Mycobacterium avium subsp. paratuberculosis
accccgcccacgaagaugaucag

SEQ ID NO: 2915635 - RNA, 15 nt, Mycobacterium avium subsp. paratuberculosis
accccgccgcagccc

SEQ ID NO: 2915636 - RNA, 21 nt, Mycobacterium avium subsp. paratuberculosis
accccgccgcagcccaggccc

SEQ ID NO: 2915637 - RNA, 21 nt, Mycobacterium avium subsp. paratuberculosis
accccgccggcccggucgacu

SEQ ID NO: 2915638 - RNA, 13 nt, Mycobacterium avium subsp. paratuberculosis
accccgccgucga

SEQ ID NO: 2915639 - RNA, 13 nt, Mycobacterium avium subsp. paratuberculosis
accccgccguucc

SEQ ID NO: 2915640 - RNA, 15 nt, Mycobacterium avium subsp. paratuberculosis
accccgcgccacgcc

SEQ ID NO: 2915641 - RNA, 15 nt, Mycobacterium avium subsp. paratuberculosis
accccgcgccgggcg

SEQ ID NO: 2915642 - RNA, 14 nt, Mycobacterium avium subsp. paratuberculosis
accccgcgcgcggg

SEQ ID NO: 2915643 - RNA, 15 nt, Mycobacterium avium subsp. paratuberculosis
accccgcgcgcgggc

SEQ ID NO: 2915644 - RNA, 18 nt, Mycobacterium avium subsp. paratuberculosis
accccgcgcgcgggccag

SEQ ID NO: 2915645 - RNA, 20 nt, Mycobacterium avium subsp. paratuberculosis
accccgcgggaguccacgcc

SEQ ID NO: 2915646 - RNA, 10 nt, Mycobacterium avium subsp. paratuberculosis
accccgcucg

SEQ ID NO: 2915647 - RNA, 14 nt, Mycobacterium avium subsp. paratuberculosis
accccgcucggcca

SEQ ID NO: 2915648 - RNA, 15 nt, Mycobacterium avium subsp. paratuberculosis
accccgcucggccag

SEQ ID NO: 2915649 - RNA, 18 nt, Mycobacterium avium subsp. paratuberculosis
accccgcucggccagcgc

SEQ ID NO: 2915650 - RNA, 19 nt, Mycobacterium avium subsp. paratuberculosis
accccgcucggccagcgcg

SEQ ID NO: 2915651 - RNA, 22 nt, Mycobacterium avium subsp. paratuberculosis
accccgcucggccagcgcgccg

SEQ ID NO: 2915652 - RNA, 20 nt, Mycobacterium avium subsp. paratuberculosis
accccgcucggcguggcgcu

SEQ ID NO: 2915653 - RNA, 21 nt, Mycobacterium avium subsp. paratuberculosis
accccgcucggcguggcgcuc

SEQ ID NO: 2915654 - RNA, 24 nt, Mycobacterium avium subsp. paratuberculosis
accccgcucggcguggcgcucagc

SEQ ID NO: 2915655 - RNA, 16 nt, Mycobacterium avium subsp. paratuberculosis
accccgcugcucuugu

SEQ ID NO: 2915656 - RNA, 21 nt, Mycobacterium avium subsp. paratuberculosis
accccgcuugcgcagcgucgu

SEQ ID NO: 2915657 - RNA, 22 nt, Mycobacterium avium subsp. paratuberculosis
accccgcuugcgcagcgucgug

SEQ ID NO: 2915658 - RNA, 14 nt, Mycobacterium avium subsp. paratuberculosis
accccggaccgcgg

SEQ ID NO: 2915659 - RNA, 19 nt, Mycobacterium avium subsp. paratuberculosis
accccggagauccggccgc

SEQ ID NO: 2915660 - RNA, 20 nt, Mycobacterium avium subsp. paratuberculosis
accccggagauccggccgcu

SEQ ID NO: 2915661 - RNA, 14 nt, Mycobacterium avium subsp. paratuberculosis
accccggccaccag

SEQ ID NO: 2915662 - RNA, 19 nt, Mycobacterium avium subsp. paratuberculosis
accccggccaccagggcga

SEQ ID NO: 2915663 - RNA, 18 nt, Mycobacterium avium subsp. paratuberculosis
accccggccagggugccg

SEQ ID NO: 2915664 - RNA, 24 nt, Mycobacterium avium subsp. paratuberculosis
acccgagcaccccggcggccgcgu

SEQ ID NO: 2915665 - RNA, 17 nt, Mycobacterium avium subsp. paratuberculosis
acccgagcaccgggccg

SEQ ID NO: 2915666 - RNA, 18 nt, Mycobacterium avium subsp. paratuberculosis
acccgaggccguucaggu

SEQ ID NO: 2915667 - RNA, 20 nt, Mycobacterium avium subsp. paratuberculosis
acccgauccagggcccgcuc

SEQ ID NO: 2915668 - RNA, 13 nt, Mycobacterium avium subsp. paratuberculosis
acccgaucgccga

SEQ ID NO: 2915669 - RNA, 14 nt, Mycobacterium avium subsp. paratuberculosis
acccgaucgccgag

SEQ ID NO: 2915670 - RNA, 14 nt, Mycobacterium avium subsp. paratuberculosis
acccgaucggcccg

SEQ ID NO: 2915671 - RNA, 16 nt, Mycobacterium avium subsp. paratuberculosis
acccgaucggcccggc

SEQ ID NO: 2915672 - RNA, 17 nt, Mycobacterium avium subsp. paratuberculosis
acccgaugaccggcccg

SEQ ID NO: 2915673 - RNA, 21 nt, Mycobacterium avium subsp. paratuberculosis
acccgaugaccggcccggcgg

SEQ ID NO: 2915674 - RNA, 23 nt, Mycobacterium avium subsp. paratuberculosis
acccgaugaccggcccggcggcc

SEQ ID NO: 2915675 - RNA, 20 nt, Mycobacterium avium subsp. paratuberculosis
acccgaugcucgaugcgcac

SEQ ID NO: 2915676 - RNA, 14 nt, Mycobacterium avium subsp. paratuberculosis
acccgcaacaccac

SEQ ID NO: 2915677 - RNA, 19 nt, Mycobacterium avium subsp. paratuberculosis
acccgcaacaccacgucgg

SEQ ID NO: 2915678 - RNA, 13 nt, Mycobacterium avium subsp. paratuberculosis
acccgcaacgcgc

SEQ ID NO: 2915679 - RNA, 18 nt, Mycobacterium avium subsp. paratuberculosis
acccgcaacgcgcgcgac

SEQ ID NO: 2915680 - RNA, 23 nt, Mycobacterium avium subsp. paratuberculosis
acccgcaacgcgcgcgacggcgc

SEQ ID NO: 2915681 - RNA, 19 nt, Mycobacterium avium subsp. paratuberculosis
acccgcaacgcugaccgca

SEQ ID NO: 2915682 - RNA, 22 nt, Mycobacterium avium subsp. paratuberculosis
acccgcaacucgggcucgucgu

SEQ ID NO: 2915683 - RNA, 16 nt, Mycobacterium avium subsp. paratuberculosis
acccgcaaggccgcca

SEQ ID NO: 2915684 - RNA, 13 nt, Mycobacterium avium subsp. paratuberculosis
acccgcaccaccg

SEQ ID NO: 2915685 - RNA, 15 nt, Mycobacterium avium subsp. paratuberculosis
acccgcaccaccgcc

SEQ ID NO: 2915686 - RNA, 18 nt, Mycobacterium avium subsp. paratuberculosis
acccgcaccucgcccggc

SEQ ID NO: 2915687 - RNA, 19 nt, Mycobacterium avium subsp. paratuberculosis
acccgcaccucgcccggcu

SEQ ID NO: 2915688 - RNA, 21 nt, Mycobacterium avium subsp. paratuberculosis
acccgcaccucgcccggcucg

SEQ ID NO: 2915689 - RNA, 22 nt, Mycobacterium avium subsp. paratuberculosis
acccgcaccucgcuggcggcgc

SEQ ID NO: 2915690 - RNA, 22 nt, Mycobacterium avium subsp. paratuberculosis
acccgcacgaaaugcgggcgau

SEQ ID NO: 2915691 - RNA, 17 nt, Mycobacterium avium subsp. paratuberculosis
acccgcacgaugccgcg

SEQ ID NO: 2915692 - RNA, 15 nt, Mycobacterium avium subsp. paratuberculosis
acccgcacgcccggg

SEQ ID NO: 2915693 - RNA, 16 nt, Mycobacterium avium subsp. paratuberculosis
acccgcacgcccgggc

SEQ ID NO: 2915694 - RNA, 16 nt, Mycobacterium avium subsp. paratuberculosis
acccgcacgcugucgg

SEQ ID NO: 2915695 - RNA, 12 nt, Mycobacterium avium subsp. paratuberculosis
acccgcagcccg

SEQ ID NO: 2915696 - RNA, 14 nt, Mycobacterium avium subsp. paratuberculosis
acccgcagcccgac

SEQ ID NO: 2915697 - RNA, 14 nt, Mycobacterium avium subsp. paratuberculosis
acccgcagccgcga

SEQ ID NO: 2915698 - RNA, 19 nt, Mycobacterium avium subsp. paratuberculosis
acccgcagccgcgagucga

SEQ ID NO: 2915699 - RNA, 22 nt, Mycobacterium avium subsp. paratuberculosis
acccgcagccgcgagucgaggu

SEQ ID NO: 2915700 - RNA, 16 nt, Mycobacterium avium subsp. paratuberculosis
acccgcagcgaggcga

SEQ ID NO: 2915701 - RNA, 14 nt, Mycobacterium avium subsp. paratuberculosis
acccgcagcgcggc

SEQ ID NO: 2915702 - RNA, 16 nt, Mycobacterium avium subsp. paratuberculosis
acccgcagcgcggcgg

SEQ ID NO: 2915703 - RNA, 14 nt, Mycobacterium avium subsp. paratuberculosis
acccgcagcucgcc

SEQ ID NO: 2915704 - RNA, 19 nt, Mycobacterium avium subsp. paratuberculosis
acccgcagcucgccgagcg

SEQ ID NO: 2915705 - RNA, 18 nt, Mycobacterium avium subsp. paratuberculosis
acccgcagcucgccggug

SEQ ID NO: 2915706 - RNA, 14 nt, Mycobacterium avium subsp. paratuberculosis
acccgcaggccaug

SEQ ID NO: 2915707 - RNA, 15 nt, Mycobacterium avium subsp. paratuberculosis
acccgcaggccauga

SEQ ID NO: 2915708 - RNA, 17 nt, Mycobacterium avium subsp. paratuberculosis
acccgcagggcgccggu

SEQ ID NO: 2915709 - RNA, 18 nt, Mycobacterium avium subsp. paratuberculosis
acccgcagggcgccggug

SEQ ID NO: 2915710 - RNA, 20 nt, Mycobacterium avium subsp. paratuberculosis
acccgcaucaacugcaccag

SEQ ID NO: 2915711 - RNA, 15 nt, Mycobacterium avium subsp. paratuberculosis
acccgcauccgccgg

SEQ ID NO: 2915712 - RNA, 17 nt, Mycobacterium avium subsp. paratuberculosis
acccgcauccgccgggc

SEQ ID NO: 2915713 - RNA, 18 nt, Mycobacterium avium subsp. paratuberculosis
acccgcauccgccgggcg

SEQ ID NO: 2915714 - RNA, 20 nt, Mycobacterium avium subsp. paratuberculosis
acccgcauccgccgggcggc

SEQ ID NO: 2915715 - RNA, 13 nt, Mycobacterium avium subsp. paratuberculosis
acccgccagcccg

SEQ ID NO: 2915716 - RNA, 20 nt, Mycobacterium avium subsp. paratuberculosis
acccgccagcccgcgucgug

SEQ ID NO: 2915717 - RNA, 16 nt, Mycobacterium avium subsp. paratuberculosis
acccgccauggcggca

SEQ ID NO: 2915718 - RNA, 14 nt, Mycobacterium avium subsp. paratuberculosis
acccgcccagcacc

SEQ ID NO: 2915719 - RNA, 23 nt, Mycobacterium avium subsp. paratuberculosis
acccgccccgacagcaacgccag

SEQ ID NO: 2915720 - RNA, 15 nt, Mycobacterium avium subsp. paratuberculosis
acccgcccgccgggc

SEQ ID NO: 2915721 - RNA, 20 nt, Mycobacterium avium subsp. paratuberculosis
acccgcccgccgggcacccg

SEQ ID NO: 2915722 - RNA, 14 nt, Mycobacterium avium subsp. paratuberculosis
acccgcccggacgc

SEQ ID NO: 2915723 - RNA, 15 nt, Mycobacterium avium subsp. paratuberculosis
acccgcccggagaac

SEQ ID NO: 2915724 - RNA, 21 nt, Mycobacterium avium subsp. paratuberculosis
acccgcccgggugugggcgcc

SEQ ID NO: 2915725 - RNA, 15 nt, Mycobacterium avium subsp. paratuberculosis
acccgccgagcguga

SEQ ID NO: 2915726 - RNA, 12 nt, Mycobacterium avium subsp. paratuberculosis
acccgccgcaac

SEQ ID NO: 2915727 - RNA, 18 nt, Mycobacterium avium subsp. paratuberculosis
acccgccgcggcaacgcc

SEQ ID NO: 2915728 - RNA, 21 nt, Mycobacterium avium subsp. paratuberculosis
acccgccgcggcaacgccagc

SEQ ID NO: 2915729 - RNA, 23 nt, Mycobacterium avium subsp. paratuberculosis
acccgccgcggcaacgccagcca

SEQ ID NO: 2915730 - RNA, 13 nt, Mycobacterium avium subsp. paratuberculosis
acccgccgcggcc

SEQ ID NO: 2915731 - RNA, 18 nt, Mycobacterium avium subsp. paratuberculosis
acccgccgcggccgaacc

SEQ ID NO: 2915732 - RNA, 15 nt, Mycobacterium avium subsp. paratuberculosis
acccgccggguggcc

SEQ ID NO: 2915733 - RNA, 20 nt, Mycobacterium avium subsp. paratuberculosis
acccgccggguggccgccac

SEQ ID NO: 2915734 - RNA, 20 nt, Mycobacterium avium subsp. paratuberculosis
acccgccuggccaccucgac

SEQ ID NO: 2915735 - RNA, 15 nt, Mycobacterium avium subsp. paratuberculosis
acccgcgaccccucc

SEQ ID NO: 2915736 - RNA, 21 nt, Mycobacterium avium subsp. paratuberculosis
acccgcgauggcacacagcgu

SEQ ID NO: 2915737 - RNA, 16 nt, Mycobacterium avium subsp. paratuberculosis
acccgcgcacgcucgc

SEQ ID NO: 2915738 - RNA, 23 nt, Mycobacterium avium subsp. paratuberculosis
acccgcgcccccugggacagcga

SEQ ID NO: 2915739 - RNA, 14 nt, Mycobacterium avium subsp. paratuberculosis
acccgcgcccgcau

SEQ ID NO: 2915740 - RNA, 12 nt, Mycobacterium avium subsp. paratuberculosis
acccgcgccggc

SEQ ID NO: 2915741 - RNA, 13 nt, Mycobacterium avium subsp. paratuberculosis
acccgcgccggca

SEQ ID NO: 2915742 - RNA, 23 nt, Mycobacterium avium subsp. paratuberculosis
acccgcgccuccauucgggccag

SEQ ID NO: 2915743 - RNA, 19 nt, Mycobacterium avium subsp. paratuberculosis
acccgcgcgacaucaccgc

SEQ ID NO: 2915744 - RNA, 13 nt, Mycobacterium avium subsp. paratuberculosis
acccgcgcggcgc

SEQ ID NO: 2915745 - RNA, 14 nt, Mycobacterium avium subsp. paratuberculosis
acccgcgcggcgca

SEQ ID NO: 2915746 - RNA, 13 nt, Mycobacterium avium subsp. paratuberculosis
acccgcgcggcgu

SEQ ID NO: 2915747 - RNA, 14 nt, Mycobacterium avium subsp. paratuberculosis
acccgcgcggcguc

SEQ ID NO: 2915748 - RNA, 15 nt, Mycobacterium avium subsp. paratuberculosis
acccgcgcggcgucg

SEQ ID NO: 2915749 - RNA, 18 nt, Mycobacterium avium subsp. paratuberculosis
acccggcccuauggcauc

SEQ ID NO: 2915750 - RNA, 15 nt, Mycobacterium avium subsp. paratuberculosis
acccggccgagcgcg

SEQ ID NO: 2915751 - RNA, 16 nt, Mycobacterium avium subsp. paratuberculosis
acccggccgagcgcgc

SEQ ID NO: 2915752 - RNA, 19 nt, Mycobacterium avium subsp. paratuberculosis
acccggccgauggugugga

SEQ ID NO: 2915753 - RNA, 12 nt, Mycobacterium avium subsp. paratuberculosis
acccggccgcac

SEQ ID NO: 2915754 - RNA, 15 nt, Mycobacterium avium subsp. paratuberculosis
acccggccgcacacc

SEQ ID NO: 2915755 - RNA, 19 nt, Mycobacterium avium subsp. paratuberculosis
acccggccgcacaccacca

SEQ ID NO: 2915756 - RNA, 20 nt, Mycobacterium avium subsp. paratuberculosis
acccggccgcacaccaccac

SEQ ID NO: 2915757 - RNA, 12 nt, Mycobacterium avium subsp. paratuberculosis
acccggccgcga

SEQ ID NO: 2915758 - RNA, 21 nt, Mycobacterium avium subsp. paratuberculosis
acccggccgcgauccagcgcu

SEQ ID NO: 2915759 - RNA, 13 nt, Mycobacterium avium subsp. paratuberculosis
acccggccgcgcc

SEQ ID NO: 2915760 - RNA, 11 nt, Mycobacterium avium subsp. paratuberculosis
acccggccggc

SEQ ID NO: 2915761 - RNA, 15 nt, Mycobacterium avium subsp. paratuberculosis
acccggccggucgcc

SEQ ID NO: 2915762 - RNA, 13 nt, Mycobacterium avium subsp. paratuberculosis
acccggccgugga

SEQ ID NO: 2915763 - RNA, 19 nt, Mycobacterium avium subsp. paratuberculosis
acccggccguugggccagc

SEQ ID NO: 2915764 - RNA, 20 nt, Mycobacterium avium subsp. paratuberculosis
acccggccguugggccagcg

SEQ ID NO: 2915765 - RNA, 21 nt, Mycobacterium avium subsp. paratuberculosis
acccggccguugggccagcgg

SEQ ID NO: 2915766 - RNA, 23 nt, Mycobacterium avium subsp. paratuberculosis
acccggcgauuaggucgguggcc

SEQ ID NO: 2915767 - RNA, 14 nt, Mycobacterium avium subsp. paratuberculosis
acccggcgcccggc

SEQ ID NO: 2915768 - RNA, 15 nt, Mycobacterium avium subsp. paratuberculosis
acccggcgcccggcc

SEQ ID NO: 2915769 - RNA, 16 nt, Mycobacterium avium subsp. paratuberculosis
acccggcgcccggccg

SEQ ID NO: 2915770 - RNA, 17 nt, Mycobacterium avium subsp. paratuberculosis
acccggcgcccggccgg

SEQ ID NO: 2915771 - RNA, 15 nt, Mycobacterium avium subsp. paratuberculosis
acccggcgcggccgc

SEQ ID NO: 2915772 - RNA, 17 nt, Mycobacterium avium subsp. paratuberculosis
acccggcgcggccgccc

SEQ ID NO: 2915773 - RNA, 20 nt, Mycobacterium avium subsp. paratuberculosis
acccggcgcggccgcccagc

SEQ ID NO: 2915774 - RNA, 14 nt, Mycobacterium avium subsp. paratuberculosis
acccggcggcaccg

SEQ ID NO: 2915775 - RNA, 16 nt, Mycobacterium avium subsp. paratuberculosis
acccggcggcaccgcg

SEQ ID NO: 2915776 - RNA, 14 nt, Mycobacterium avium subsp. paratuberculosis
acccggcgggccag

SEQ ID NO: 2915777 - RNA, 18 nt, Mycobacterium avium subsp. paratuberculosis
acccggcguaguucgucg

SEQ ID NO: 2915778 - RNA, 22 nt, Mycobacterium avium subsp. paratuberculosis
acccggcgugcuccagcaggcg

SEQ ID NO: 2915779 - RNA, 12 nt, Mycobacterium avium subsp. paratuberculosis
acccggcuucgc

SEQ ID NO: 2915780 - RNA, 16 nt, Mycobacterium avium subsp. paratuberculosis
acccggcuucgcugcg

SEQ ID NO: 2915781 - RNA, 22 nt, Mycobacterium avium subsp. paratuberculosis
acccggcuucgcugcgccggcg

SEQ ID NO: 2915782 - RNA, 17 nt, Mycobacterium avium subsp. paratuberculosis
acccgggacccggaacc

SEQ ID NO: 2915783 - RNA, 14 nt, Mycobacterium avium subsp. paratuberculosis
acccgggaugccga

SEQ ID NO: 2915784 - RNA, 16 nt, Mycobacterium avium subsp. paratuberculosis
acccgggaugccgagg

SEQ ID NO: 2915785 - RNA, 17 nt, Mycobacterium avium subsp. paratuberculosis
acccgggaugccgaggu

SEQ ID NO: 2915786 - RNA, 17 nt, Mycobacterium avium subsp. paratuberculosis
acccgggcagcuuccgc

SEQ ID NO: 2915787 - RNA, 23 nt, Mycobacterium avium subsp. paratuberculosis
acccgggcagcuuccgccucggc

SEQ ID NO: 2915788 - RNA, 15 nt, Mycobacterium avium subsp. paratuberculosis
acccgggccagcagg

SEQ ID NO: 2915789 - RNA, 14 nt, Mycobacterium avium subsp. paratuberculosis
acccgggcccgguc

SEQ ID NO: 2915790 - RNA, 22 nt, Mycobacterium avium subsp. paratuberculosis
acccgggcccggucgucgccgg

SEQ ID NO: 2915791 - RNA, 19 nt, Mycobacterium avium subsp. paratuberculosis
acccgggccgccacggcgc

SEQ ID NO: 2915792 - RNA, 21 nt, Mycobacterium avium subsp. paratuberculosis
acccgggccgccacggcgcca

SEQ ID NO: 2915793 - RNA, 22 nt, Mycobacterium avium subsp. paratuberculosis
acccgggccgccacggcgccau

SEQ ID NO: 2915794 - RNA, 14 nt, Mycobacterium avium subsp. paratuberculosis
acccgggccugcgg

SEQ ID NO: 2915795 - RNA, 19 nt, Mycobacterium avium subsp. paratuberculosis
acccgggccugcggcggcc

SEQ ID NO: 2915796 - RNA, 21 nt, Mycobacterium avium subsp. paratuberculosis
acccgggcgacaugcccgcgg

SEQ ID NO: 2915797 - RNA, 15 nt, Mycobacterium avium subsp. paratuberculosis
acccgggcgauggug

SEQ ID NO: 2915798 - RNA, 19 nt, Mycobacterium avium subsp. paratuberculosis
acccgggcgauggugccgc

SEQ ID NO: 2915799 - RNA, 23 nt, Mycobacterium avium subsp. paratuberculosis
acccgggcgauggugccgccggu

SEQ ID NO: 2915800 - RNA, 13 nt, Mycobacterium avium subsp. paratuberculosis
acccgggcgccau

SEQ ID NO: 2915801 - RNA, 20 nt, Mycobacterium avium subsp. paratuberculosis
acccgggcgccauccgcagc

SEQ ID NO: 2915802 - RNA, 12 nt, Mycobacterium avium subsp. paratuberculosis
acccgggcgccg

SEQ ID NO: 2915803 - RNA, 14 nt, Mycobacterium avium subsp. paratuberculosis
acccgggcgccggc

SEQ ID NO: 2915804 - RNA, 15 nt, Mycobacterium avium subsp. paratuberculosis
acccgggcgccggcg

SEQ ID NO: 2915805 - RNA, 16 nt, Mycobacterium avium subsp. paratuberculosis
acccgggcgcgacggu

SEQ ID NO: 2915806 - RNA, 16 nt, Mycobacterium avium subsp. paratuberculosis
acccgggcgcgcccac

SEQ ID NO: 2915807 - RNA, 21 nt, Mycobacterium avium subsp. paratuberculosis
acccgggcgcgcccacccgcg

SEQ ID NO: 2915808 - RNA, 22 nt, Mycobacterium avium subsp. paratuberculosis
acccgggcgcgcccacccgcgc

SEQ ID NO: 2915809 - RNA, 17 nt, Mycobacterium avium subsp. paratuberculosis
acccgggcuagacgcgc

SEQ ID NO: 2915810 - RNA, 19 nt, Mycobacterium avium subsp. paratuberculosis
acccgggcuagacgcgcac

SEQ ID NO: 2915811 - RNA, 22 nt, Mycobacterium avium subsp. paratuberculosis
acccgggcugcccggcgccggu

SEQ ID NO: 2915812 - RNA, 23 nt, Mycobacterium avium subsp. paratuberculosis
acccgggcugcccggcgccgguc

SEQ ID NO: 2915813 - RNA, 18 nt, Mycobacterium avium subsp. paratuberculosis
acccgggucgagcggccc

SEQ ID NO: 2915814 - RNA, 15 nt, Mycobacterium avium subsp. paratuberculosis
acccgggugcccggc

SEQ ID NO: 2915815 - RNA, 22 nt, Mycobacterium avium subsp. paratuberculosis
acccggguggacaccgcgauca

SEQ ID NO: 2915816 - RNA, 13 nt, Mycobacterium avium subsp. paratuberculosis
acccggguggccc

SEQ ID NO: 2915817 - RNA, 17 nt, Mycobacterium avium subsp. paratuberculosis
acccggguggcccgcac

SEQ ID NO: 2915818 - RNA, 18 nt, Mycobacterium avium subsp. paratuberculosis
acccggguugcgugcagc

SEQ ID NO: 2915819 - RNA, 18 nt, Mycobacterium avium subsp. paratuberculosis
acccgguagcgcagcacc

SEQ ID NO: 2915820 - RNA, 18 nt, Mycobacterium avium subsp. paratuberculosis
acccggucagcucgccgu

SEQ ID NO: 2915821 - RNA, 15 nt, Mycobacterium avium subsp. paratuberculosis
acccgguccggcccg

SEQ ID NO: 2915822 - RNA, 18 nt, Mycobacterium avium subsp. paratuberculosis
acccgguccggcccgggg

SEQ ID NO: 2915823 - RNA, 18 nt, Mycobacterium avium subsp. paratuberculosis
acccggucgacgauggcc

SEQ ID NO: 2915824 - RNA, 23 nt, Mycobacterium avium subsp. paratuberculosis
acccggucgacgauggcccgggc

SEQ ID NO: 2915825 - RNA, 20 nt, Mycobacterium avium subsp. paratuberculosis
acccggucgaugugcgcgcu

SEQ ID NO: 2915826 - RNA, 21 nt, Mycobacterium avium subsp. paratuberculosis
acccggucgaugugcgcgcug

SEQ ID NO: 2915827 - RNA, 16 nt, Mycobacterium avium subsp. paratuberculosis
acccggucgcggccgu

SEQ ID NO: 2915828 - RNA, 14 nt, Mycobacterium avium subsp. paratuberculosis
acccggucggccgc

SEQ ID NO: 2915829 - RNA, 15 nt, Mycobacterium avium subsp. paratuberculosis
acccggucggccgcg

SEQ ID NO: 2915830 - RNA, 16 nt, Mycobacterium avium subsp. paratuberculosis
acccggucggccgcgu

SEQ ID NO: 2915831 - RNA, 23 nt, Mycobacterium avium subsp. paratuberculosis
acccggucugaucgcccagcacc

SEQ ID NO: 2915832 - RNA, 13 nt, Mycobacterium avium subsp. paratuberculosis
acccggugccggc

SEQ ID NO: 2915833 - RNA, 18 nt, Mycobacterium avium subsp. paratuberculosis
acccggugccggccgggu

SEQ ID NO: 2915834 - RNA, 21 nt, Mycobacterium avium subsp. paratuberculosis
accgaauuguccagcaguuug

SEQ ID NO: 2915835 - RNA, 17 nt, Mycobacterium avium subsp. paratuberculosis
accgacaagggccgggc

SEQ ID NO: 2915836 - RNA, 19 nt, Mycobacterium avium subsp. paratuberculosis
accgacaagggccgggcgc

SEQ ID NO: 2915837 - RNA, 21 nt, Mycobacterium avium subsp. paratuberculosis
accgacaagggccgggcgcug

SEQ ID NO: 2915838 - RNA, 13 nt, Mycobacterium avium subsp. paratuberculosis
accgacaccaccg

SEQ ID NO: 2915839 - RNA, 14 nt, Mycobacterium avium subsp. paratuberculosis
accgacaccaccgg

SEQ ID NO: 2915840 - RNA, 15 nt, Mycobacterium avium subsp. paratuberculosis
accgacaccaccggc

SEQ ID NO: 2915841 - RNA, 15 nt, Mycobacterium avium subsp. paratuberculosis
accgacaccggccgg

SEQ ID NO: 2915842 - RNA, 16 nt, Mycobacterium avium subsp. paratuberculosis
accgacaccucgccgu

SEQ ID NO: 2915843 - RNA, 20 nt, Mycobacterium avium subsp. paratuberculosis
accgacagcaaaccgaccgc

SEQ ID NO: 2915844 - RNA, 18 nt, Mycobacterium avium subsp. paratuberculosis
accgacagcacccggccc

SEQ ID NO: 2915845 - RNA, 16 nt, Mycobacterium avium subsp. paratuberculosis
accgacagccgcacca

SEQ ID NO: 2915846 - RNA, 14 nt, Mycobacterium avium subsp. paratuberculosis
accgacagccggac

SEQ ID NO: 2915847 - RNA, 15 nt, Mycobacterium avium subsp. paratuberculosis
accgacagccggacg

SEQ ID NO: 2915848 - RNA, 15 nt, Mycobacterium avium subsp. paratuberculosis
accgacagggccagc

SEQ ID NO: 2915849 - RNA, 19 nt, Mycobacterium avium subsp. paratuberculosis
accgacaggucgaagggca

SEQ ID NO: 2915850 - RNA, 17 nt, Mycobacterium avium subsp. paratuberculosis
accgacaguucggcgcg

SEQ ID NO: 2915851 - RNA, 18 nt, Mycobacterium avium subsp. paratuberculosis
accgacaguucggcgcgc

SEQ ID NO: 2915852 - RNA, 14 nt, Mycobacterium avium subsp. paratuberculosis
accgacauggccag

SEQ ID NO: 2915853 - RNA, 15 nt, Mycobacterium avium subsp. paratuberculosis
accgacauggccagc

SEQ ID NO: 2915854 - RNA, 16 nt, Mycobacterium avium subsp. paratuberculosis
accgacauggccagca

SEQ ID NO: 2915855 - RNA, 16 nt, Mycobacterium avium subsp. paratuberculosis
accgaccccucggcgg

SEQ ID NO: 2915856 - RNA, 18 nt, Mycobacterium avium subsp. paratuberculosis
accgaccccucggcggcc

SEQ ID NO: 2915857 - RNA, 13 nt, Mycobacterium avium subsp. paratuberculosis
accgacccggcca

SEQ ID NO: 2915858 - RNA, 15 nt, Mycobacterium avium subsp. paratuberculosis
accgacccggccagc

SEQ ID NO: 2915859 - RNA, 13 nt, Mycobacterium avium subsp. paratuberculosis
accgaccgccgcg

SEQ ID NO: 2915860 - RNA, 16 nt, Mycobacterium avium subsp. paratuberculosis
accgaccgccgcggcc

SEQ ID NO: 2915861 - RNA, 13 nt, Mycobacterium avium subsp. paratuberculosis
accgaccggcucu

SEQ ID NO: 2915862 - RNA, 15 nt, Mycobacterium avium subsp. paratuberculosis
accgaccuguccgau

SEQ ID NO: 2915863 - RNA, 22 nt, Mycobacterium avium subsp. paratuberculosis
accgacgaaaucgucgggcacc

SEQ ID NO: 2915864 - RNA, 19 nt, Mycobacterium avium subsp. paratuberculosis
accgacgacgugacgaccu

SEQ ID NO: 2915865 - RNA, 23 nt, Mycobacterium avium subsp. paratuberculosis
accgacgagaucagcaccaggug

SEQ ID NO: 2915866 - RNA, 13 nt, Mycobacterium avium subsp. paratuberculosis
accgacgccagcg

SEQ ID NO: 2915867 - RNA, 14 nt, Mycobacterium avium subsp. paratuberculosis
accgacgccagcgg

SEQ ID NO: 2915868 - RNA, 18 nt, Mycobacterium avium subsp. paratuberculosis
accgacgccagcgggccg

SEQ ID NO: 2915869 - RNA, 21 nt, Mycobacterium avium subsp. paratuberculosis
accgacgcccggcuucgccgc

SEQ ID NO: 2915870 - RNA, 12 nt, Mycobacterium avium subsp. paratuberculosis
accgacgcgccg

SEQ ID NO: 2915871 - RNA, 13 nt, Mycobacterium avium subsp. paratuberculosis
accgacgcggcga

SEQ ID NO: 2915872 - RNA, 14 nt, Mycobacterium avium subsp. paratuberculosis
accgacgcggucac

SEQ ID NO: 2915873 - RNA, 19 nt, Mycobacterium avium subsp. paratuberculosis
accgacgcggucaccggcu

SEQ ID NO: 2915874 - RNA, 17 nt, Mycobacterium avium subsp. paratuberculosis
accgacgcgucgcggcg

SEQ ID NO: 2915875 - RNA, 22 nt, Mycobacterium avium subsp. paratuberculosis
accgacgcucgccaccccgcgc

SEQ ID NO: 2915876 - RNA, 17 nt, Mycobacterium avium subsp. paratuberculosis
accgacggagccgagca

SEQ ID NO: 2915877 - RNA, 18 nt, Mycobacterium avium subsp. paratuberculosis
accgacggcaccucucgg

SEQ ID NO: 2915878 - RNA, 20 nt, Mycobacterium avium subsp. paratuberculosis
accgacggccgcaccccacc

SEQ ID NO: 2915879 - RNA, 22 nt, Mycobacterium avium subsp. paratuberculosis
accgacggccgcaccccacccg

SEQ ID NO: 2915880 - RNA, 23 nt, Mycobacterium avium subsp. paratuberculosis
accgacggccgcaccccacccgc

SEQ ID NO: 2915881 - RNA, 14 nt, Mycobacterium avium subsp. paratuberculosis
accgacuccuccgg

SEQ ID NO: 2915882 - RNA, 17 nt, Mycobacterium avium subsp. paratuberculosis
accgacuccuccggccc

SEQ ID NO: 2915883 - RNA, 15 nt, Mycobacterium avium subsp. paratuberculosis
accgacugcggcgcu

SEQ ID NO: 2915884 - RNA, 22 nt, Mycobacterium avium subsp. paratuberculosis
accgacuguuugaugccgucgg

SEQ ID NO: 2915885 - RNA, 17 nt, Mycobacterium avium subsp. paratuberculosis
accgacuucauggcgaa

SEQ ID NO: 2915886 - RNA, 19 nt, Mycobacterium avium subsp. paratuberculosis
accgagaccaugccgccga

SEQ ID NO: 2915887 - RNA, 17 nt, Mycobacterium avium subsp. paratuberculosis
accgagaucaugccggc

SEQ ID NO: 2915888 - RNA, 14 nt, Mycobacterium avium subsp. paratuberculosis
accgagauggccac

SEQ ID NO: 2915889 - RNA, 20 nt, Mycobacterium avium subsp. paratuberculosis
accgagauggccaccaucag

SEQ ID NO: 2915890 - RNA, 20 nt, Mycobacterium avium subsp. paratuberculosis
accgagauggugaagugccg

SEQ ID NO: 2915891 - RNA, 13 nt, Mycobacterium avium subsp. paratuberculosis
accgagcagcggg

SEQ ID NO: 2915892 - RNA, 16 nt, Mycobacterium avium subsp. paratuberculosis
accgagcagcggggug

SEQ ID NO: 2915893 - RNA, 19 nt, Mycobacterium avium subsp. paratuberculosis
accgagcagcggggugagc

SEQ ID NO: 2915894 - RNA, 13 nt, Mycobacterium avium subsp. paratuberculosis
accgagcagcugc

SEQ ID NO: 2915895 - RNA, 13 nt, Mycobacterium avium subsp. paratuberculosis
accgagcccguuc

SEQ ID NO: 2915896 - RNA, 15 nt, Mycobacterium avium subsp. paratuberculosis
accgagccgcgcgcc

SEQ ID NO: 2915897 - RNA, 17 nt, Mycobacterium avium subsp. paratuberculosis
accgagccgcgcgccga

SEQ ID NO: 2915898 - RNA, 18 nt, Mycobacterium avium subsp. paratuberculosis
accgagccgcgcgccgag

SEQ ID NO: 2915899 - RNA, 11 nt, Mycobacterium avium subsp. paratuberculosis
accgagccggc

SEQ ID NO: 2915900 - RNA, 14 nt, Mycobacterium avium subsp. paratuberculosis
accgagccggcguc

SEQ ID NO: 2915901 - RNA, 12 nt, Mycobacterium avium subsp. paratuberculosis
accgagccgggc

SEQ ID NO: 2915902 - RNA, 14 nt, Mycobacterium avium subsp. paratuberculosis
accgagccggggcu

SEQ ID NO: 2915903 - RNA, 18 nt, Mycobacterium avium subsp. paratuberculosis
accgagccggugccgccc

SEQ ID NO: 2915904 - RNA, 20 nt, Mycobacterium avium subsp. paratuberculosis
accgagccugggauugccgg

SEQ ID NO: 2915905 - RNA, 22 nt, Mycobacterium avium subsp. paratuberculosis
accgagccugggauugccgggc

SEQ ID NO: 2915906 - RNA, 16 nt, Mycobacterium avium subsp. paratuberculosis
accgagcggccgucca

SEQ ID NO: 2915907 - RNA, 14 nt, Mycobacterium avium subsp. paratuberculosis
accgagcggcgcug

SEQ ID NO: 2915908 - RNA, 22 nt, Mycobacterium avium subsp. paratuberculosis
accgagcggcgcugcagcagcc

SEQ ID NO: 2915909 - RNA, 15 nt, Mycobacterium avium subsp. paratuberculosis
accgagcggggugug

SEQ ID NO: 2915910 - RNA, 21 nt, Mycobacterium avium subsp. paratuberculosis
accgagcgucacgcuggcgug

SEQ ID NO: 2915911 - RNA, 16 nt, Mycobacterium avium subsp. paratuberculosis
accgagcugggccggc

SEQ ID NO: 2915912 - RNA, 18 nt, Mycobacterium avium subsp. paratuberculosis
accgagcugggccggcgc

SEQ ID NO: 2915913 - RNA, 20 nt, Mycobacterium avium subsp. paratuberculosis
accgagcugggccggcgccg

SEQ ID NO: 2915914 - RNA, 21 nt, Mycobacterium avium subsp. paratuberculosis
accgaggaugaccgcggcgaa

SEQ ID NO: 2915915 - RNA, 17 nt, Mycobacterium avium subsp. paratuberculosis
accgaggcgaagguggc

SEQ ID NO: 2915916 - RNA, 22 nt, Mycobacterium avium subsp. paratuberculosis
accgagggcgcgggaucggugc

SEQ ID NO: 2915917 - RNA, 15 nt, Mycobacterium avium subsp. paratuberculosis
accgaggucaccgcg

SEQ ID NO: 2915918 - RNA, 14 nt, Mycobacterium avium subsp. paratuberculosis
accgaggucgacgc

SEQ ID NO: 2915919 - RNA, 22 nt, Mycobacterium avium subsp. paratuberculosis
accgcauucggccgccaccgag

SEQ ID NO: 2915920 - RNA, 17 nt, Mycobacterium avium subsp. paratuberculosis
accgcauuugccgacau

SEQ ID NO: 2915921 - RNA, 13 nt, Mycobacterium avium subsp. paratuberculosis
accgccaccaccc

SEQ ID NO: 2915922 - RNA, 20 nt, Mycobacterium avium subsp. paratuberculosis
accgccaccacccggcgauu

SEQ ID NO: 2915923 - RNA, 15 nt, Mycobacterium avium subsp. paratuberculosis
accgccaccagaucg

SEQ ID NO: 2915924 - RNA, 15 nt, Mycobacterium avium subsp. paratuberculosis
accgccaccagcagg

SEQ ID NO: 2915925 - RNA, 18 nt, Mycobacterium avium subsp. paratuberculosis
accgccaccagcaggccc

SEQ ID NO: 2915926 - RNA, 16 nt, Mycobacterium avium subsp. paratuberculosis
accgccaccagcgcac

SEQ ID NO: 2915927 - RNA, 17 nt, Mycobacterium avium subsp. paratuberculosis
accgccaccgcccgcug

SEQ ID NO: 2915928 - RNA, 14 nt, Mycobacterium avium subsp. paratuberculosis
accgccaccggccc

SEQ ID NO: 2915929 - RNA, 16 nt, Mycobacterium avium subsp. paratuberculosis
accgccaccggcccgg

SEQ ID NO: 2915930 - RNA, 17 nt, Mycobacterium avium subsp. paratuberculosis
accgccaccggcccggc

SEQ ID NO: 2915931 - RNA, 22 nt, Mycobacterium avium subsp. paratuberculosis
accgccaccucgagcucaccga

SEQ ID NO: 2915932 - RNA, 16 nt, Mycobacterium avium subsp. paratuberculosis
accgccacgacgcggc

SEQ ID NO: 2915933 - RNA, 20 nt, Mycobacterium avium subsp. paratuberculosis
accgccacgacgcggcgauc

SEQ ID NO: 2915934 - RNA, 22 nt, Mycobacterium avium subsp. paratuberculosis
accgccacggcgacgaccacca

SEQ ID NO: 2915935 - RNA, 23 nt, Mycobacterium avium subsp. paratuberculosis
accgccacggcgacgaccaccag

SEQ ID NO: 2915936 - RNA, 19 nt, Mycobacterium avium subsp. paratuberculosis
accgccacgucgaacccga

SEQ ID NO: 2915937 - RNA, 23 nt, Mycobacterium avium subsp. paratuberculosis
accgccagacugaugcccucgcc

SEQ ID NO: 2915938 - RNA, 14 nt, Mycobacterium avium subsp. paratuberculosis
accgccagcaccga

SEQ ID NO: 2915939 - RNA, 15 nt, Mycobacterium avium subsp. paratuberculosis
accgccagcaccgac

SEQ ID NO: 2915940 - RNA, 15 nt, Mycobacterium avium subsp. paratuberculosis
accgccagcaccgcc

SEQ ID NO: 2915941 - RNA, 17 nt, Mycobacterium avium subsp. paratuberculosis
accgccagcaccgccac

SEQ ID NO: 2915942 - RNA, 18 nt, Mycobacterium avium subsp. paratuberculosis
accgccagcaccgcgggg

SEQ ID NO: 2915943 - RNA, 13 nt, Mycobacterium avium subsp. paratuberculosis
accgccagcagca

SEQ ID NO: 2915944 - RNA, 22 nt, Mycobacterium avium subsp. paratuberculosis
accgccagcagcagccgcgccg

SEQ ID NO: 2915945 - RNA, 14 nt, Mycobacterium avium subsp. paratuberculosis
accgccagcagcgc

SEQ ID NO: 2915946 - RNA, 15 nt, Mycobacterium avium subsp. paratuberculosis
accgccagcagcgca

SEQ ID NO: 2915947 - RNA, 15 nt, Mycobacterium avium subsp. paratuberculosis
accgccagcagcgcc

SEQ ID NO: 2915948 - RNA, 16 nt, Mycobacterium avium subsp. paratuberculosis
accgccagcagcgccg

SEQ ID NO: 2915949 - RNA, 20 nt, Mycobacterium avium subsp. paratuberculosis
accgccagcagcgccgcuuc

SEQ ID NO: 2915950 - RNA, 16 nt, Mycobacterium avium subsp. paratuberculosis
accgccagcgcgccga

SEQ ID NO: 2915951 - RNA, 17 nt, Mycobacterium avium subsp. paratuberculosis
accgccagcgcgccgau

SEQ ID NO: 2915952 - RNA, 13 nt, Mycobacterium avium subsp. paratuberculosis
accgccagcgcgg

SEQ ID NO: 2915953 - RNA, 14 nt, Mycobacterium avium subsp. paratuberculosis
accgccagcgcggc

SEQ ID NO: 2915954 - RNA, 17 nt, Mycobacterium avium subsp. paratuberculosis
accgccagcgcggcggc

SEQ ID NO: 2915955 - RNA, 20 nt, Mycobacterium avium subsp. paratuberculosis
accgccagcgcggcggcgcc

SEQ ID NO: 2915956 - RNA, 23 nt, Mycobacterium avium subsp. paratuberculosis
accgccagcgcggcggcgccguc

SEQ ID NO: 2915957 - RNA, 14 nt, Mycobacterium avium subsp. paratuberculosis
accgccaggaagac

SEQ ID NO: 2915958 - RNA, 22 nt, Mycobacterium avium subsp. paratuberculosis
accgccaggaaggccaguucga

SEQ ID NO: 2915959 - RNA, 14 nt, Mycobacterium avium subsp. paratuberculosis
accgccaggaccac

SEQ ID NO: 2915960 - RNA, 16 nt, Mycobacterium avium subsp. paratuberculosis
accgccaggaccaccc

SEQ ID NO: 2915961 - RNA, 15 nt, Mycobacterium avium subsp. paratuberculosis
accgccaggcuggcc

SEQ ID NO: 2915962 - RNA, 14 nt, Mycobacterium avium subsp. paratuberculosis
accgccagucugag

SEQ ID NO: 2915963 - RNA, 21 nt, Mycobacterium avium subsp. paratuberculosis
accgccagucugagcccgggc

SEQ ID NO: 2915964 - RNA, 18 nt, Mycobacterium avium subsp. paratuberculosis
accgccaugcuugccaac

SEQ ID NO: 2915965 - RNA, 13 nt, Mycobacterium avium subsp. paratuberculosis
accgcccacagca

SEQ ID NO: 2915966 - RNA, 17 nt, Mycobacterium avium subsp. paratuberculosis
accgcccacagcaacga

SEQ ID NO: 2915967 - RNA, 23 nt, Mycobacterium avium subsp. paratuberculosis
accgcccacgaacgucaggccgu

SEQ ID NO: 2915968 - RNA, 12 nt, Mycobacterium avium subsp. paratuberculosis
accgcccagcgg

SEQ ID NO: 2915969 - RNA, 14 nt, Mycobacterium avium subsp. paratuberculosis
accgcccagcggcu

SEQ ID NO: 2915970 - RNA, 15 nt, Mycobacterium avium subsp. paratuberculosis
accgccccagccgac

SEQ ID NO: 2915971 - RNA, 14 nt, Mycobacterium avium subsp. paratuberculosis
accgcccccgcggc

SEQ ID NO: 2915972 - RNA, 15 nt, Mycobacterium avium subsp. paratuberculosis
accgcccccgcggcg

SEQ ID NO: 2915973 - RNA, 16 nt, Mycobacterium avium subsp. paratuberculosis
accgcccccgcggcgg

SEQ ID NO: 2915974 - RNA, 18 nt, Mycobacterium avium subsp. paratuberculosis
accgcccccgcggcggcc

SEQ ID NO: 2915975 - RNA, 22 nt, Mycobacterium avium subsp. paratuberculosis
accgccccgacgaucgcgccgg

SEQ ID NO: 2915976 - RNA, 16 nt, Mycobacterium avium subsp. paratuberculosis
accgccccgccgcgcc

SEQ ID NO: 2915977 - RNA, 17 nt, Mycobacterium avium subsp. paratuberculosis
accgccccgccgcgccg

SEQ ID NO: 2915978 - RNA, 19 nt, Mycobacterium avium subsp. paratuberculosis
accgccccgccgcgccggg

SEQ ID NO: 2915979 - RNA, 13 nt, Mycobacterium avium subsp. paratuberculosis
accgccccgcgcg

SEQ ID NO: 2915980 - RNA, 22 nt, Mycobacterium avium subsp. paratuberculosis
accgccccggucaccccggcca

SEQ ID NO: 2915981 - RNA, 15 nt, Mycobacterium avium subsp. paratuberculosis
accgcccgaaccgcg

SEQ ID NO: 2915982 - RNA, 15 nt, Mycobacterium avium subsp. paratuberculosis
accgcccgcccggca

SEQ ID NO: 2915983 - RNA, 16 nt, Mycobacterium avium subsp. paratuberculosis
accgcccgcccggcac

SEQ ID NO: 2915984 - RNA, 18 nt, Mycobacterium avium subsp. paratuberculosis
accgcccgcccggcacga

SEQ ID NO: 2915985 - RNA, 12 nt, Mycobacterium avium subsp. paratuberculosis
accgcccgcgcg

SEQ ID NO: 2915986 - RNA, 13 nt, Mycobacterium avium subsp. paratuberculosis
accgcccgcgcga

SEQ ID NO: 2915987 - RNA, 14 nt, Mycobacterium avium subsp. paratuberculosis
accgcccgcgcugg

SEQ ID NO: 2915988 - RNA, 16 nt, Mycobacterium avium subsp. paratuberculosis
accgcccgcgcuggug

SEQ ID NO: 2915989 - RNA, 13 nt, Mycobacterium avium subsp. paratuberculosis
accgcccgcggug

SEQ ID NO: 2915990 - RNA, 23 nt, Mycobacterium avium subsp. paratuberculosis
accgcccgcggugugcuggccag

SEQ ID NO: 2915991 - RNA, 22 nt, Mycobacterium avium subsp. paratuberculosis
accgcccgcugaccgccgcgcu

SEQ ID NO: 2915992 - RNA, 16 nt, Mycobacterium avium subsp. paratuberculosis
accgcccgcuguucgu

SEQ ID NO: 2915993 - RNA, 13 nt, Mycobacterium avium subsp. paratuberculosis
accgcccggaccg

SEQ ID NO: 2915994 - RNA, 20 nt, Mycobacterium avium subsp. paratuberculosis
accgcccggaugccggcgcc

SEQ ID NO: 2915995 - RNA, 11 nt, Mycobacterium avium subsp. paratuberculosis
accgcccggcg

SEQ ID NO: 2915996 - RNA, 12 nt, Mycobacterium avium subsp. paratuberculosis
accgcccggcgc

SEQ ID NO: 2915997 - RNA, 14 nt, Mycobacterium avium subsp. paratuberculosis
accgcccggcgccg

SEQ ID NO: 2915998 - RNA, 16 nt, Mycobacterium avium subsp. paratuberculosis
accgcccggcgccgau

SEQ ID NO: 2915999 - RNA, 19 nt, Mycobacterium avium subsp. paratuberculosis
accgcccgggccaggcgcg

SEQ ID NO: 2916000 - RNA, 18 nt, Mycobacterium avium subsp. paratuberculosis
accgcccggggcgcggac

SEQ ID NO: 2916001 - RNA, 22 nt, Mycobacterium avium subsp. paratuberculosis
accgcccgggugauggucuccc

SEQ ID NO: 2916002 - RNA, 20 nt, Mycobacterium avium subsp. paratuberculosis
accgcccggguugucgacgu

SEQ ID NO: 2916003 - RNA, 16 nt, Mycobacterium avium subsp. paratuberculosis
accgcccuuccagcac

SEQ ID NO: 2916004 - RNA, 19 nt, Mycobacterium avium subsp. paratuberculosis
accgccugcgcgaucgccg

SEQ ID NO: 2916005 - RNA, 12 nt, Mycobacterium avium subsp. paratuberculosis
accgccugcuug

SEQ ID NO: 2916006 - RNA, 22 nt, Mycobacterium avium subsp. paratuberculosis
accgccugcuugagguugacgu

SEQ ID NO: 2916007 - RNA, 22 nt, Mycobacterium avium subsp. paratuberculosis
accgccugucaguuugcgcgac

SEQ ID NO: 2916008 - RNA, 12 nt, Mycobacterium avium subsp. paratuberculosis
accgccugugcg

SEQ ID NO: 2916009 - RNA, 15 nt, Mycobacterium avium subsp. paratuberculosis
accgccuuccgccac

SEQ ID NO: 2916010 - RNA, 21 nt, Mycobacterium avium subsp. paratuberculosis
accgccuucgacggccggccc

SEQ ID NO: 2916011 - RNA, 13 nt, Mycobacterium avium subsp. paratuberculosis
accgccuugcccg

SEQ ID NO: 2916012 - RNA, 21 nt, Mycobacterium avium subsp. paratuberculosis
accgccuugcccggcucggug

SEQ ID NO: 2916013 - RNA, 22 nt, Mycobacterium avium subsp. paratuberculosis
accgccuugcccggcucggugc

SEQ ID NO: 2916014 - RNA, 14 nt, Mycobacterium avium subsp. paratuberculosis
accgccuuggccac

SEQ ID NO: 2916015 - RNA, 15 nt, Mycobacterium avium subsp. paratuberculosis
accgccuuggccacg

SEQ ID NO: 2916016 - RNA, 16 nt, Mycobacterium avium subsp. paratuberculosis
accgccuuggccacgu

SEQ ID NO: 2916017 - RNA, 22 nt, Mycobacterium avium subsp. paratuberculosis
accgccuuggccacgucgaagc

SEQ ID NO: 2916018 - RNA, 14 nt, Mycobacterium avium subsp. paratuberculosis
accgccuuggcgcg

SEQ ID NO: 2916019 - RNA, 17 nt, Mycobacterium avium subsp. paratuberculosis
accgccuuggcgcgcuc

SEQ ID NO: 2916020 - RNA, 21 nt, Mycobacterium avium subsp. paratuberculosis
accgccuuggcgcgcucggug

SEQ ID NO: 2916021 - RNA, 13 nt, Mycobacterium avium subsp. paratuberculosis
accgccuugucgg

SEQ ID NO: 2916022 - RNA, 16 nt, Mycobacterium avium subsp. paratuberculosis
accgccuugucggcga

SEQ ID NO: 2916023 - RNA, 14 nt, Mycobacterium avium subsp. paratuberculosis
accgcgaaaacagc

SEQ ID NO: 2916024 - RNA, 16 nt, Mycobacterium avium subsp. paratuberculosis
accgcgaaaacagcga

SEQ ID NO: 2916025 - RNA, 20 nt, Mycobacterium avium subsp. paratuberculosis
accgcgaaagcgucggcuag

SEQ ID NO: 2916026 - RNA, 20 nt, Mycobacterium avium subsp. paratuberculosis
accgcgaaagugcaacuggc

SEQ ID NO: 2916027 - RNA, 14 nt, Mycobacterium avium subsp. paratuberculosis
accgcgaacagcac

SEQ ID NO: 2916028 - RNA, 17 nt, Mycobacterium avium subsp. paratuberculosis
accgcgaacaucgccag

SEQ ID NO: 2916029 - RNA, 19 nt, Mycobacterium avium subsp. paratuberculosis
accgcgaacaucgccagca

SEQ ID NO: 2916030 - RNA, 18 nt, Mycobacterium avium subsp. paratuberculosis
accgcgaacucgucgaug

SEQ ID NO: 2916031 - RNA, 19 nt, Mycobacterium avium subsp. paratuberculosis
accgcgaacucgucgaugc

SEQ ID NO: 2916032 - RNA, 19 nt, Mycobacterium avium subsp. paratuberculosis
accgcgaagguggcacgcc

SEQ ID NO: 2916033 - RNA, 22 nt, Mycobacterium avium subsp. paratuberculosis
accgcgaagguggcacgccacu

SEQ ID NO: 2916034 - RNA, 15 nt, Mycobacterium avium subsp. paratuberculosis
accgcgaauugaggu

SEQ ID NO: 2916035 - RNA, 16 nt, Mycobacterium avium subsp. paratuberculosis
accgcgacacgucgac

SEQ ID NO: 2916036 - RNA, 23 nt, Mycobacterium avium subsp. paratuberculosis
accgcgacacgucgacacgccgg

SEQ ID NO: 2916037 - RNA, 14 nt, Mycobacterium avium subsp. paratuberculosis
accgcgaccacgcc

SEQ ID NO: 2916038 - RNA, 16 nt, Mycobacterium avium subsp. paratuberculosis
accgcgaccacgccgc

SEQ ID NO: 2916039 - RNA, 18 nt, Mycobacterium avium subsp. paratuberculosis
accgcgaccacgccgcgg

SEQ ID NO: 2916040 - RNA, 18 nt, Mycobacterium avium subsp. paratuberculosis
accgcgaccagcucgggc

SEQ ID NO: 2916041 - RNA, 17 nt, Mycobacterium avium subsp. paratuberculosis
accgcgacccaggccgc

SEQ ID NO: 2916042 - RNA, 16 nt, Mycobacterium avium subsp. paratuberculosis
accgcgacccggccga

SEQ ID NO: 2916043 - RNA, 17 nt, Mycobacterium avium subsp. paratuberculosis
accgcgacccggccgag

SEQ ID NO: 2916044 - RNA, 13 nt, Mycobacterium avium subsp. paratuberculosis
accgcgaccgccu

SEQ ID NO: 2916045 - RNA, 20 nt, Mycobacterium avium subsp. paratuberculosis
accgcgaccgguccgugcca

SEQ ID NO: 2916046 - RNA, 20 nt, Mycobacterium avium subsp. paratuberculosis
accgcgaccgucaucuuggu

SEQ ID NO: 2916047 - RNA, 17 nt, Mycobacterium avium subsp. paratuberculosis
accgcgacgaccucgcc

SEQ ID NO: 2916048 - RNA, 17 nt, Mycobacterium avium subsp. paratuberculosis
accgcgacgaucgcgac

SEQ ID NO: 2916049 - RNA, 19 nt, Mycobacterium avium subsp. paratuberculosis
accgcgacgaucgcgacgg

SEQ ID NO: 2916050 - RNA, 20 nt, Mycobacterium avium subsp. paratuberculosis
accgcgacgaucgcgacggc

SEQ ID NO: 2916051 - RNA, 16 nt, Mycobacterium avium subsp. paratuberculosis
accgcgacgcccaggu

SEQ ID NO: 2916052 - RNA, 15 nt, Mycobacterium avium subsp. paratuberculosis
accgcgacgcgaucg

SEQ ID NO: 2916053 - RNA, 16 nt, Mycobacterium avium subsp. paratuberculosis
accgcgacgcgaucga

SEQ ID NO: 2916054 - RNA, 17 nt, Mycobacterium avium subsp. paratuberculosis
accgcgacgcugccggu

SEQ ID NO: 2916055 - RNA, 18 nt, Mycobacterium avium subsp. paratuberculosis
accgcgacgcugccggug

SEQ ID NO: 2916056 - RNA, 13 nt, Mycobacterium avium subsp. paratuberculosis
accgcgacggcgc

SEQ ID NO: 2916057 - RNA, 15 nt, Mycobacterium avium subsp. paratuberculosis
accgcgacggcgccc

SEQ ID NO: 2916058 - RNA, 16 nt, Mycobacterium avium subsp. paratuberculosis
accgcgacggcgcccg

SEQ ID NO: 2916059 - RNA, 20 nt, Mycobacterium avium subsp. paratuberculosis
accgcgacggcgcccgcccc

SEQ ID NO: 2916060 - RNA, 23 nt, Mycobacterium avium subsp. paratuberculosis
accgcgacggcgcccgccccgac

SEQ ID NO: 2916061 - RNA, 13 nt, Mycobacterium avium subsp. paratuberculosis
accgcgacgggcu

SEQ ID NO: 2916062 - RNA, 15 nt, Mycobacterium avium subsp. paratuberculosis
accgcgacggugagc

SEQ ID NO: 2916063 - RNA, 17 nt, Mycobacterium avium subsp. paratuberculosis
accgcgacggugagcaa

SEQ ID NO: 2916064 - RNA, 16 nt, Mycobacterium avium subsp. paratuberculosis
accgcgagacccgguc

SEQ ID NO: 2916065 - RNA, 17 nt, Mycobacterium avium subsp. paratuberculosis
accgcgagacccggucc

SEQ ID NO: 2916066 - RNA, 18 nt, Mycobacterium avium subsp. paratuberculosis
accgcgagaucagcgcca

SEQ ID NO: 2916067 - RNA, 17 nt, Mycobacterium avium subsp. paratuberculosis
accgcgagcagacgcga

SEQ ID NO: 2916068 - RNA, 16 nt, Mycobacterium avium subsp. paratuberculosis
accgcgagcgcgcggu

SEQ ID NO: 2916069 - RNA, 14 nt, Mycobacterium avium subsp. paratuberculosis
accgcgagcgggug

SEQ ID NO: 2916070 - RNA, 15 nt, Mycobacterium avium subsp. paratuberculosis
accgcgagcggguga

SEQ ID NO: 2916071 - RNA, 19 nt, Mycobacterium avium subsp. paratuberculosis
accgcgaguucgcgcacgc

SEQ ID NO: 2916072 - RNA, 14 nt, Mycobacterium avium subsp. paratuberculosis
accgcgaucaccac

SEQ ID NO: 2916073 - RNA, 13 nt, Mycobacterium avium subsp. paratuberculosis
accgcgaucaccg

SEQ ID NO: 2916074 - RNA, 14 nt, Mycobacterium avium subsp. paratuberculosis
accgcgaucaccga

SEQ ID NO: 2916075 - RNA, 13 nt, Mycobacterium avium subsp. paratuberculosis
accgcgaucagcc

SEQ ID NO: 2916076 - RNA, 23 nt, Mycobacterium avium subsp. paratuberculosis
accgcgaucagggccgcggccgc

SEQ ID NO: 2916077 - RNA, 15 nt, Mycobacterium avium subsp. paratuberculosis
accgcgaucgccgac

SEQ ID NO: 2916078 - RNA, 17 nt, Mycobacterium avium subsp. paratuberculosis
accgcgaucgccgacgu

SEQ ID NO: 2916079 - RNA, 14 nt, Mycobacterium avium subsp. paratuberculosis
accgcgaucucgau

SEQ ID NO: 2916080 - RNA, 18 nt, Mycobacterium avium subsp. paratuberculosis
accgcgaucugcucggug

SEQ ID NO: 2916081 - RNA, 19 nt, Mycobacterium avium subsp. paratuberculosis
accgcgaucuugcccucgu

SEQ ID NO: 2916082 - RNA, 20 nt, Mycobacterium avium subsp. paratuberculosis
accgcgaugauggcgucgac

SEQ ID NO: 2916083 - RNA, 17 nt, Mycobacterium avium subsp. paratuberculosis
accgcgaugcgacaccg

SEQ ID NO: 2916084 - RNA, 21 nt, Mycobacterium avium subsp. paratuberculosis
accgcgaugcgacaccgcguc

SEQ ID NO: 2916085 - RNA, 17 nt, Mycobacterium avium subsp. paratuberculosis
accgcgauggcccgcgc

SEQ ID NO: 2916086 - RNA, 19 nt, Mycobacterium avium subsp. paratuberculosis
accgcgauggcccgcgcga

SEQ ID NO: 2916087 - RNA, 16 nt, Mycobacterium avium subsp. paratuberculosis
accgcgaugguggcgu

SEQ ID NO: 2916088 - RNA, 18 nt, Mycobacterium avium subsp. paratuberculosis
accgcgaugguggcguca

SEQ ID NO: 2916089 - RNA, 12 nt, Mycobacterium avium subsp. paratuberculosis
accgcggccagc

SEQ ID NO: 2916090 - RNA, 14 nt, Mycobacterium avium subsp. paratuberculosis
accgcggccagcgc

SEQ ID NO: 2916091 - RNA, 17 nt, Mycobacterium avium subsp. paratuberculosis
accgcggccagcgcgcg

SEQ ID NO: 2916092 - RNA, 13 nt, Mycobacterium avium subsp. paratuberculosis
accgcggccgcga

SEQ ID NO: 2916093 - RNA, 15 nt, Mycobacterium avium subsp. paratuberculosis
accgcggccgcgacg

SEQ ID NO: 2916094 - RNA, 14 nt, Mycobacterium avium subsp. paratuberculosis
accgcggccgucgc

SEQ ID NO: 2916095 - RNA, 22 nt, Mycobacterium avium subsp. paratuberculosis
accgcggccucggcgucgaagc

SEQ ID NO: 2916096 - RNA, 13 nt, Mycobacterium avium subsp. paratuberculosis
accgcggccucgu

SEQ ID NO: 2916097 - RNA, 14 nt, Mycobacterium avium subsp. paratuberculosis
accgcggccucguc

SEQ ID NO: 2916098 - RNA, 19 nt, Mycobacterium avium subsp. paratuberculosis
accgcggccucgucgaggu

SEQ ID NO: 2916099 - RNA, 19 nt, Mycobacterium avium subsp. paratuberculosis
accgcggcgaauccgagca

SEQ ID NO: 2916100 - RNA, 16 nt, Mycobacterium avium subsp. paratuberculosis
accgcggcgacgucgu

SEQ ID NO: 2916101 - RNA, 14 nt, Mycobacterium avium subsp. paratuberculosis
accgcggcgaucgc

SEQ ID NO: 2916102 - RNA, 13 nt, Mycobacterium avium subsp. paratuberculosis
accgcggcgauga

SEQ ID NO: 2916103 - RNA, 19 nt, Mycobacterium avium subsp. paratuberculosis
accgcggcgaugaucacga

SEQ ID NO: 2916104 - RNA, 12 nt, Mycobacterium avium subsp. paratuberculosis
accgcggcgccg

SEQ ID NO: 2916105 - RNA, 16 nt, Mycobacterium avium subsp. paratuberculosis
accgcggcgccgucga

SEQ ID NO: 2916106 - RNA, 15 nt, Mycobacterium avium subsp. paratuberculosis
accgcggcgcgcauc

SEQ ID NO: 2916107 - RNA, 23 nt, Mycobacterium avium subsp. paratuberculosis
accgcggcgcgcaucgccgucca

SEQ ID NO: 2916108 - RNA, 13 nt, Mycobacterium avium subsp. paratuberculosis
accgcggcgcgcg

SEQ ID NO: 2916109 - RNA, 17 nt, Mycobacterium avium subsp. paratuberculosis
accgcggcgcgcggccg

SEQ ID NO: 2916110 - RNA, 20 nt, Mycobacterium avium subsp. paratuberculosis
accgcggcgcgcggccgcga

SEQ ID NO: 2916111 - RNA, 12 nt, Mycobacterium avium subsp. paratuberculosis
accgcggcggcc

SEQ ID NO: 2916112 - RNA, 13 nt, Mycobacterium avium subsp. paratuberculosis
accgcggcggcca

SEQ ID NO: 2916113 - RNA, 17 nt, Mycobacterium avium subsp. paratuberculosis
accgcggcggcgucgac

SEQ ID NO: 2916114 - RNA, 18 nt, Mycobacterium avium subsp. paratuberculosis
accgcggcggcgucgacc

SEQ ID NO: 2916115 - RNA, 22 nt, Mycobacterium avium subsp. paratuberculosis
accgcggcggcgucgaccgccc

SEQ ID NO: 2916116 - RNA, 17 nt, Mycobacterium avium subsp. paratuberculosis
accgcggcggcgucggc

SEQ ID NO: 2916117 - RNA, 12 nt, Mycobacterium avium subsp. paratuberculosis
accgcggcgggc

SEQ ID NO: 2916118 - RNA, 17 nt, Mycobacterium avium subsp. paratuberculosis
accgcggcggucgccac

SEQ ID NO: 2916119 - RNA, 23 nt, Mycobacterium avium subsp. paratuberculosis
accgcggcggugucggcgccccg

SEQ ID NO: 2916120 - RNA, 16 nt, Mycobacterium avium subsp. paratuberculosis
accgcggcguagcgcc

SEQ ID NO: 2916121 - RNA, 18 nt, Mycobacterium avium subsp. paratuberculosis
accgcggcguagcgccag

SEQ ID NO: 2916122 - RNA, 15 nt, Mycobacterium avium subsp. paratuberculosis
accgcggcgugcgcc

SEQ ID NO: 2916123 - RNA, 17 nt, Mycobacterium avium subsp. paratuberculosis
accgcggcgugcgccag

SEQ ID NO: 2916124 - RNA, 19 nt, Mycobacterium avium subsp. paratuberculosis
accgcggcuccggccgcgc

SEQ ID NO: 2916125 - RNA, 20 nt, Mycobacterium avium subsp. paratuberculosis
accgcggcuccggccgcgcc

SEQ ID NO: 2916126 - RNA, 23 nt, Mycobacterium avium subsp. paratuberculosis
accgcggcuccggccgcgccggc

SEQ ID NO: 2916127 - RNA, 18 nt, Mycobacterium avium subsp. paratuberculosis
accgcgggaauggccgcg

SEQ ID NO: 2916128 - RNA, 19 nt, Mycobacterium avium subsp. paratuberculosis
accgcgggaauggccgcgc

SEQ ID NO: 2916129 - RNA, 22 nt, Mycobacterium avium subsp. paratuberculosis
accgcgggaauggccgcgccgu

SEQ ID NO: 2916130 - RNA, 15 nt, Mycobacterium avium subsp. paratuberculosis
accgcgggcagcagc

SEQ ID NO: 2916131 - RNA, 12 nt, Mycobacterium avium subsp. paratuberculosis
accgcgggccag

SEQ ID NO: 2916132 - RNA, 14 nt, Mycobacterium avium subsp. paratuberculosis
accgcgggccaggc

SEQ ID NO: 2916133 - RNA, 16 nt, Mycobacterium avium subsp. paratuberculosis
accgcgggccaggccc

SEQ ID NO: 2916134 - RNA, 17 nt, Mycobacterium avium subsp. paratuberculosis
accgcgggccaggccca

SEQ ID NO: 2916135 - RNA, 18 nt, Mycobacterium avium subsp. paratuberculosis
accgcgggccaggcccac

SEQ ID NO: 2916136 - RNA, 14 nt, Mycobacterium avium subsp. paratuberculosis
accgcgggcccgcc

SEQ ID NO: 2916137 - RNA, 12 nt, Mycobacterium avium subsp. paratuberculosis
accgcgggcgca

SEQ ID NO: 2916138 - RNA, 23 nt, Mycobacterium avium subsp. paratuberculosis
accgcgggcgcauaccagcgcug

SEQ ID NO: 2916139 - RNA, 13 nt, Mycobacterium avium subsp. paratuberculosis
accgcgggcgcgc

SEQ ID NO: 2916140 - RNA, 14 nt, Mycobacterium avium subsp. paratuberculosis
accgcgggcgcgcc

SEQ ID NO: 2916141 - RNA, 17 nt, Mycobacterium avium subsp. paratuberculosis
accgcgggcgcgccguc

SEQ ID NO: 2916142 - RNA, 18 nt, Mycobacterium avium subsp. paratuberculosis
accgcgggcgcgccgucc

SEQ ID NO: 2916143 - RNA, 22 nt, Mycobacterium avium subsp. paratuberculosis
accgcgggggcggccgggccgc

SEQ ID NO: 2916144 - RNA, 17 nt, Mycobacterium avium subsp. paratuberculosis
accgcggggugcccggc

SEQ ID NO: 2916145 - RNA, 19 nt, Mycobacterium avium subsp. paratuberculosis
accgcggggugcccggcga

SEQ ID NO: 2916146 - RNA, 20 nt, Mycobacterium avium subsp. paratuberculosis
accgcggggugcccggcgag

SEQ ID NO: 2916147 - RNA, 22 nt, Mycobacterium avium subsp. paratuberculosis
accgcgggugaggggcgcgcgc

SEQ ID NO: 2916148 - RNA, 11 nt, Mycobacterium avium subsp. paratuberculosis
accgcggucac

SEQ ID NO: 2916149 - RNA, 17 nt, Mycobacterium avium subsp. paratuberculosis
accgcggucgcggcgcc

SEQ ID NO: 2916150 - RNA, 18 nt, Mycobacterium avium subsp. paratuberculosis
accgcggucgcggcgccg

SEQ ID NO: 2916151 - RNA, 20 nt, Mycobacterium avium subsp. paratuberculosis
accgcggucgcggcgccggu

SEQ ID NO: 2916152 - RNA, 21 nt, Mycobacterium avium subsp. paratuberculosis
accgcggucgcggcgccgguu

SEQ ID NO: 2916153 - RNA, 18 nt, Mycobacterium avium subsp. paratuberculosis
accgcggucgggucccgg

SEQ ID NO: 2916154 - RNA, 22 nt, Mycobacterium avium subsp. paratuberculosis
accgcggucgggucccggcaac

SEQ ID NO: 2916155 - RNA, 17 nt, Mycobacterium avium subsp. paratuberculosis
accgcggucugcgccag

SEQ ID NO: 2916156 - RNA, 18 nt, Mycobacterium avium subsp. paratuberculosis
accgcggucugcgccagc

SEQ ID NO: 2916157 - RNA, 19 nt, Mycobacterium avium subsp. paratuberculosis
accgcggucugcgccagcu

SEQ ID NO: 2916158 - RNA, 20 nt, Mycobacterium avium subsp. paratuberculosis
accgcggucugcgccagcuc

SEQ ID NO: 2916159 - RNA, 16 nt, Mycobacterium avium subsp. paratuberculosis
accgcggugaccgccc

SEQ ID NO: 2916160 - RNA, 17 nt, Mycobacterium avium subsp. paratuberculosis
accgcggugaccgcccg

SEQ ID NO: 2916161 - RNA, 20 nt, Mycobacterium avium subsp. paratuberculosis
accgcggugaccgcccgcuc

SEQ ID NO: 2916162 - RNA, 17 nt, Mycobacterium avium subsp. paratuberculosis
accgcggugagcggccg

SEQ ID NO: 2916163 - RNA, 18 nt, Mycobacterium avium subsp. paratuberculosis
accgcggugagcggccgc

SEQ ID NO: 2916164 - RNA, 21 nt, Mycobacterium avium subsp. paratuberculosis
accgcggugagcggccgcagc

SEQ ID NO: 2916165 - RNA, 24 nt, Mycobacterium avium subsp. paratuberculosis
accgcggugagcggccgcagcgca

SEQ ID NO: 2916166 - RNA, 20 nt, Mycobacterium avium subsp. paratuberculosis
accgcguacagggcgucgga

SEQ ID NO: 2916167 - RNA, 19 nt, Mycobacterium avium subsp. paratuberculosis
accgcguagcgccgcccgu

SEQ ID NO: 2916168 - RNA, 23 nt, Mycobacterium avium subsp. paratuberculosis
accgcguagcgccgcccguccag

SEQ ID NO: 2916169 - RNA, 16 nt, Mycobacterium avium subsp. paratuberculosis
accgcgucagcagcgc

SEQ ID NO: 2916170 - RNA, 17 nt, Mycobacterium avium subsp. paratuberculosis
accgcguccgcgucguc

SEQ ID NO: 2916171 - RNA, 16 nt, Mycobacterium avium subsp. paratuberculosis
accgcguccugcaggc

SEQ ID NO: 2916172 - RNA, 18 nt, Mycobacterium avium subsp. paratuberculosis
accgcguccugcaggcag

SEQ ID NO: 2916173 - RNA, 23 nt, Mycobacterium avium subsp. paratuberculosis
accgcguccugcaggcaggccgg

SEQ ID NO: 2916174 - RNA, 19 nt, Mycobacterium avium subsp. paratuberculosis
accggaccgccgcggcgcc

SEQ ID NO: 2916175 - RNA, 22 nt, Mycobacterium avium subsp. paratuberculosis
accggaccgccgcggcgcccgg

SEQ ID NO: 2916176 - RNA, 14 nt, Mycobacterium avium subsp. paratuberculosis
accggaccggccag

SEQ ID NO: 2916177 - RNA, 13 nt, Mycobacterium avium subsp. paratuberculosis
accggacgaacau

SEQ ID NO: 2916178 - RNA, 21 nt, Mycobacterium avium subsp. paratuberculosis
accggacgaacaucgagccca

SEQ ID NO: 2916179 - RNA, 18 nt, Mycobacterium avium subsp. paratuberculosis
accggacgcagcgaucgg

SEQ ID NO: 2916180 - RNA, 19 nt, Mycobacterium avium subsp. paratuberculosis
accggacugcuugggcgcc

SEQ ID NO: 2916181 - RNA, 20 nt, Mycobacterium avium subsp. paratuberculosis
accggacugcuugggcgccu

SEQ ID NO: 2916182 - RNA, 14 nt, Mycobacterium avium subsp. paratuberculosis
accggagccuuggu

SEQ ID NO: 2916183 - RNA, 14 nt, Mycobacterium avium subsp. paratuberculosis
accggagcggcggu

SEQ ID NO: 2916184 - RNA, 14 nt, Mycobacterium avium subsp. paratuberculosis
accggaggccgcgg

SEQ ID NO: 2916185 - RNA, 15 nt, Mycobacterium avium subsp. paratuberculosis
accggaucaugucgg

SEQ ID NO: 2916186 - RNA, 17 nt, Mycobacterium avium subsp. paratuberculosis
accggaucgaccaacuc

SEQ ID NO: 2916187 - RNA, 22 nt, Mycobacterium avium subsp. paratuberculosis
accggaucgaccaacuccaccg

SEQ ID NO: 2916188 - RNA, 14 nt, Mycobacterium avium subsp. paratuberculosis
accggaucggccag

SEQ ID NO: 2916189 - RNA, 15 nt, Mycobacterium avium subsp. paratuberculosis
accggaucggccagc

SEQ ID NO: 2916190 - RNA, 19 nt, Mycobacterium avium subsp. paratuberculosis
accggaucggcuagcagcu

SEQ ID NO: 2916191 - RNA, 20 nt, Mycobacterium avium subsp. paratuberculosis
accggaucggcuagcagcuc

SEQ ID NO: 2916192 - RNA, 21 nt, Mycobacterium avium subsp. paratuberculosis
accggaugaaggacuggccca

SEQ ID NO: 2916193 - RNA, 14 nt, Mycobacterium avium subsp. paratuberculosis
accggaugcacgug

SEQ ID NO: 2916194 - RNA, 17 nt, Mycobacterium avium subsp. paratuberculosis
accggaugcacgugcac

SEQ ID NO: 2916195 - RNA, 14 nt, Mycobacterium avium subsp. paratuberculosis
accggaugcucacc

SEQ ID NO: 2916196 - RNA, 16 nt, Mycobacterium avium subsp. paratuberculosis
accggaugcucaccgg

SEQ ID NO: 2916197 - RNA, 15 nt, Mycobacterium avium subsp. paratuberculosis
accggauggcgcccg

SEQ ID NO: 2916198 - RNA, 16 nt, Mycobacterium avium subsp. paratuberculosis
accggauggcgcccgg

SEQ ID NO: 2916199 - RNA, 19 nt, Mycobacterium avium subsp. paratuberculosis
accggauggcgcccggcag

SEQ ID NO: 2916200 - RNA, 14 nt, Mycobacterium avium subsp. paratuberculosis
accggcaaccgcca

SEQ ID NO: 2916201 - RNA, 19 nt, Mycobacterium avium subsp. paratuberculosis
accggcaaggugccguccg

SEQ ID NO: 2916202 - RNA, 17 nt, Mycobacterium avium subsp. paratuberculosis
accggcaaucgggacgc

SEQ ID NO: 2916203 - RNA, 20 nt, Mycobacterium avium subsp. paratuberculosis
accggcaaucgggacgccac

SEQ ID NO: 2916204 - RNA, 10 nt, Mycobacterium avium subsp. paratuberculosis
accggcacca

SEQ ID NO: 2916205 - RNA, 14 nt, Mycobacterium avium subsp. paratuberculosis
accggcaccacgau

SEQ ID NO: 2916206 - RNA, 14 nt, Mycobacterium avium subsp. paratuberculosis
accggcaccagcag

SEQ ID NO: 2916207 - RNA, 15 nt, Mycobacterium avium subsp. paratuberculosis
accggcaccagcagc

SEQ ID NO: 2916208 - RNA, 20 nt, Mycobacterium avium subsp. paratuberculosis
accggcaccagcaggccccg

SEQ ID NO: 2916209 - RNA, 14 nt, Mycobacterium avium subsp. paratuberculosis
accggcaccgccag

SEQ ID NO: 2916210 - RNA, 15 nt, Mycobacterium avium subsp. paratuberculosis
accggcaccgccagc

SEQ ID NO: 2916211 - RNA, 21 nt, Mycobacterium avium subsp. paratuberculosis
accggcaccgccagccaccac

SEQ ID NO: 2916212 - RNA, 12 nt, Mycobacterium avium subsp. paratuberculosis
accggcaccgcg

SEQ ID NO: 2916213 - RNA, 14 nt, Mycobacterium avium subsp. paratuberculosis
accggcaccgcggu

SEQ ID NO: 2916214 - RNA, 18 nt, Mycobacterium avium subsp. paratuberculosis
accggcaccgcggucugc

SEQ ID NO: 2916215 - RNA, 17 nt, Mycobacterium avium subsp. paratuberculosis
accggcacgaucgucgc

SEQ ID NO: 2916216 - RNA, 16 nt, Mycobacterium avium subsp. paratuberculosis
accggcacggcaccgc

SEQ ID NO: 2916217 - RNA, 18 nt, Mycobacterium avium subsp. paratuberculosis
accggcacggcaccgcga

SEQ ID NO: 2916218 - RNA, 20 nt, Mycobacterium avium subsp. paratuberculosis
accggcacggcaccgcgagc

SEQ ID NO: 2916219 - RNA, 14 nt, Mycobacterium avium subsp. paratuberculosis
accggcacggugca

SEQ ID NO: 2916220 - RNA, 19 nt, Mycobacterium avium subsp. paratuberculosis
accggcacggugcacacgc

SEQ ID NO: 2916221 - RNA, 17 nt, Mycobacterium avium subsp. paratuberculosis
accggcacgucgagcuc

SEQ ID NO: 2916222 - RNA, 16 nt, Mycobacterium avium subsp. paratuberculosis
accggcacgucggcca

SEQ ID NO: 2916223 - RNA, 20 nt, Mycobacterium avium subsp. paratuberculosis
accggcacgucggccacgcc

SEQ ID NO: 2916224 - RNA, 21 nt, Mycobacterium avium subsp. paratuberculosis
accggcacgucggccacgccg

SEQ ID NO: 2916225 - RNA, 17 nt, Mycobacterium avium subsp. paratuberculosis
accggcacgugcggguu

SEQ ID NO: 2916226 - RNA, 18 nt, Mycobacterium avium subsp. paratuberculosis
accggcagcaaccgcgaa

SEQ ID NO: 2916227 - RNA, 18 nt, Mycobacterium avium subsp. paratuberculosis
accggcagcaccgccgag

SEQ ID NO: 2916228 - RNA, 15 nt, Mycobacterium avium subsp. paratuberculosis
accggcagcaccggc

SEQ ID NO: 2916229 - RNA, 19 nt, Mycobacterium avium subsp. paratuberculosis
accggcagcaccggccgga

SEQ ID NO: 2916230 - RNA, 13 nt, Mycobacterium avium subsp. paratuberculosis
accggcagcagcg

SEQ ID NO: 2916231 - RNA, 15 nt, Mycobacterium avium subsp. paratuberculosis
accggcagcagcgcg

SEQ ID NO: 2916232 - RNA, 16 nt, Mycobacterium avium subsp. paratuberculosis
accggcagcagcgcgu

SEQ ID NO: 2916233 - RNA, 17 nt, Mycobacterium avium subsp. paratuberculosis
accggcagcagcgcguc

SEQ ID NO: 2916234 - RNA, 20 nt, Mycobacterium avium subsp. paratuberculosis
accggcagcagcgcgucgug

SEQ ID NO: 2916235 - RNA, 14 nt, Mycobacterium avium subsp. paratuberculosis
accggcagcaggug

SEQ ID NO: 2916236 - RNA, 13 nt, Mycobacterium avium subsp. paratuberculosis
accggcagccgca

SEQ ID NO: 2916237 - RNA, 16 nt, Mycobacterium avium subsp. paratuberculosis
accggcagccgcgccc

SEQ ID NO: 2916238 - RNA, 18 nt, Mycobacterium avium subsp. paratuberculosis
accggcagccgcgcccac

SEQ ID NO: 2916239 - RNA, 22 nt, Mycobacterium avium subsp. paratuberculosis
accggcagccgcgcccacccgc

SEQ ID NO: 2916240 - RNA, 12 nt, Mycobacterium avium subsp. paratuberculosis
accggcagccgg

SEQ ID NO: 2916241 - RNA, 14 nt, Mycobacterium avium subsp. paratuberculosis
accggcagccggcg

SEQ ID NO: 2916242 - RNA, 15 nt, Mycobacterium avium subsp. paratuberculosis
accggcagccggcgu

SEQ ID NO: 2916243 - RNA, 18 nt, Mycobacterium avium subsp. paratuberculosis
accggcagcgccaccagc

SEQ ID NO: 2916244 - RNA, 19 nt, Mycobacterium avium subsp. paratuberculosis
accggcagcgccaccagcu

SEQ ID NO: 2916245 - RNA, 16 nt, Mycobacterium avium subsp. paratuberculosis
accggcaggcgguagc

SEQ ID NO: 2916246 - RNA, 15 nt, Mycobacterium avium subsp. paratuberculosis
accggcaugugccac

SEQ ID NO: 2916247 - RNA, 17 nt, Mycobacterium avium subsp. paratuberculosis
accggcaugugccacag

SEQ ID NO: 2916248 - RNA, 19 nt, Mycobacterium avium subsp. paratuberculosis
accggcaugugccacaggu

SEQ ID NO: 2916249 - RNA, 18 nt, Mycobacterium avium subsp. paratuberculosis
accggcauucguguggcg

SEQ ID NO: 2916250 - RNA, 20 nt, Mycobacterium avium subsp. paratuberculosis
accggcauucguguggcgca

SEQ ID NO: 2916251 - RNA, 14 nt, Mycobacterium avium subsp. paratuberculosis
accggccaccacgu

SEQ ID NO: 2916252 - RNA, 21 nt, Mycobacterium avium subsp. paratuberculosis
accggccaccacgugcgcguu

SEQ ID NO: 2916253 - RNA, 22 nt, Mycobacterium avium subsp. paratuberculosis
accggccaccacgugcgcguug

SEQ ID NO: 2916254 - RNA, 23 nt, Mycobacterium avium subsp. paratuberculosis
accggccagcacgaacaccacgu

SEQ ID NO: 2916255 - RNA, 21 nt, Mycobacterium avium subsp. paratuberculosis
accggccagcagcagcccgcc

SEQ ID NO: 2916256 - RNA, 18 nt, Mycobacterium avium subsp. paratuberculosis
accggccagggccgccgc

SEQ ID NO: 2916257 - RNA, 18 nt, Mycobacterium avium subsp. paratuberculosis
accggccauccgcugcgc

SEQ ID NO: 2916258 - RNA, 13 nt, Mycobacterium avium subsp. paratuberculosis
accggcccagccg

SEQ ID NO: 2916259 - RNA, 21 nt, Mycobacterium avium subsp. paratuberculosis
accggcgucauggugcgcggg

SEQ ID NO: 2916260 - RNA, 13 nt, Mycobacterium avium subsp. paratuberculosis
accggcgucgaca

SEQ ID NO: 2916261 - RNA, 20 nt, Mycobacterium avium subsp. paratuberculosis
accggcgucgacagccgguc

SEQ ID NO: 2916262 - RNA, 22 nt, Mycobacterium avium subsp. paratuberculosis
accggcgucgacagccggucgc

SEQ ID NO: 2916263 - RNA, 19 nt, Mycobacterium avium subsp. paratuberculosis
accggcgugaugacggcgg

SEQ ID NO: 2916264 - RNA, 16 nt, Mycobacterium avium subsp. paratuberculosis
accggcucagcccggc

SEQ ID NO: 2916265 - RNA, 18 nt, Mycobacterium avium subsp. paratuberculosis
accggcucagcccggcgc

SEQ ID NO: 2916266 - RNA, 17 nt, Mycobacterium avium subsp. paratuberculosis
accggcuccuugcgccg

SEQ ID NO: 2916267 - RNA, 18 nt, Mycobacterium avium subsp. paratuberculosis
accggcuccuugcgccgc

SEQ ID NO: 2916268 - RNA, 13 nt, Mycobacterium avium subsp. paratuberculosis
accggcucgccgg

SEQ ID NO: 2916269 - RNA, 16 nt, Mycobacterium avium subsp. paratuberculosis
accggcucgccggcgc

SEQ ID NO: 2916270 - RNA, 18 nt, Mycobacterium avium subsp. paratuberculosis
accggcucgccggcgcgc

SEQ ID NO: 2916271 - RNA, 16 nt, Mycobacterium avium subsp. paratuberculosis
accggcucgcggggug

SEQ ID NO: 2916272 - RNA, 14 nt, Mycobacterium avium subsp. paratuberculosis
accggcucggcccg

SEQ ID NO: 2916273 - RNA, 15 nt, Mycobacterium avium subsp. paratuberculosis
accggcucggcccgg

SEQ ID NO: 2916274 - RNA, 21 nt, Mycobacterium avium subsp. paratuberculosis
accggcucgggaacggucagc

SEQ ID NO: 2916275 - RNA, 18 nt, Mycobacterium avium subsp. paratuberculosis
accggcucucagccggaa

SEQ ID NO: 2916276 - RNA, 13 nt, Mycobacterium avium subsp. paratuberculosis
accggcugaccgg

SEQ ID NO: 2916277 - RNA, 20 nt, Mycobacterium avium subsp. paratuberculosis
accggcugaccggcggugcc

SEQ ID NO: 2916278 - RNA, 14 nt, Mycobacterium avium subsp. paratuberculosis
accggcugccccag

SEQ ID NO: 2916279 - RNA, 21 nt, Mycobacterium avium subsp. paratuberculosis
accggcugcccgacccgcacc

SEQ ID NO: 2916280 - RNA, 17 nt, Mycobacterium avium subsp. paratuberculosis
accggcugcucgcgcug

SEQ ID NO: 2916281 - RNA, 16 nt, Mycobacterium avium subsp. paratuberculosis
accggcuggacacccc

SEQ ID NO: 2916282 - RNA, 13 nt, Mycobacterium avium subsp. paratuberculosis
accggcuggccga

SEQ ID NO: 2916283 - RNA, 17 nt, Mycobacterium avium subsp. paratuberculosis
accggcuggccgagcgg

SEQ ID NO: 2916284 - RNA, 19 nt, Mycobacterium avium subsp. paratuberculosis
accggcuggccgagcggcu

SEQ ID NO: 2916285 - RNA, 13 nt, Mycobacterium avium subsp. paratuberculosis
accggcuggccgg

SEQ ID NO: 2916286 - RNA, 12 nt, Mycobacterium avium subsp. paratuberculosis
accggcuggucg

SEQ ID NO: 2916287 - RNA, 13 nt, Mycobacterium avium subsp. paratuberculosis
accggcuggugca

SEQ ID NO: 2916288 - RNA, 15 nt, Mycobacterium avium subsp. paratuberculosis
accggcuggugcagc

SEQ ID NO: 2916289 - RNA, 22 nt, Mycobacterium avium subsp. paratuberculosis
accggcuucgggaucagcggga

SEQ ID NO: 2916290 - RNA, 14 nt, Mycobacterium avium subsp. paratuberculosis
accggcuucuccuc

SEQ ID NO: 2916291 - RNA, 22 nt, Mycobacterium avium subsp. paratuberculosis
accggcuugccgaucgccgcgg

SEQ ID NO: 2916292 - RNA, 16 nt, Mycobacterium avium subsp. paratuberculosis
accggcuuggccacga

SEQ ID NO: 2916293 - RNA, 17 nt, Mycobacterium avium subsp. paratuberculosis
accggcuuggccacgau

SEQ ID NO: 2916294 - RNA, 14 nt, Mycobacterium avium subsp. paratuberculosis
accggcuuggcggu

SEQ ID NO: 2916295 - RNA, 15 nt, Mycobacterium avium subsp. paratuberculosis
accggcuuggcggug

SEQ ID NO: 2916296 - RNA, 19 nt, Mycobacterium avium subsp. paratuberculosis
accgggaacagccaggcga

SEQ ID NO: 2916297 - RNA, 15 nt, Mycobacterium avium subsp. paratuberculosis
accgggaagccgagc

SEQ ID NO: 2916298 - RNA, 21 nt, Mycobacterium avium subsp. paratuberculosis
accgggaaggugucggccggg

SEQ ID NO: 2916299 - RNA, 22 nt, Mycobacterium avium subsp. paratuberculosis
accgggaaggugucggccggga

SEQ ID NO: 2916300 - RNA, 20 nt, Mycobacterium avium subsp. paratuberculosis
accgggaaguagggcagccc

SEQ ID NO: 2916301 - RNA, 17 nt, Mycobacterium avium subsp. paratuberculosis
accgggacagccgcgcc

SEQ ID NO: 2916302 - RNA, 12 nt, Mycobacterium avium subsp. paratuberculosis
accgggacaucg

SEQ ID NO: 2916303 - RNA, 16 nt, Mycobacterium avium subsp. paratuberculosis
accgggacaucgucgc

SEQ ID NO: 2916304 - RNA, 18 nt, Mycobacterium avium subsp. paratuberculosis
accgggacaucgucgcgc

SEQ ID NO: 2916305 - RNA, 15 nt, Mycobacterium avium subsp. paratuberculosis
accgggaccagcgcg

SEQ ID NO: 2916306 - RNA, 18 nt, Mycobacterium avium subsp. paratuberculosis
accgggaccagcgcggug

SEQ ID NO: 2916307 - RNA, 20 nt, Mycobacterium avium subsp. paratuberculosis
accgggaccagcgcggugcc

SEQ ID NO: 2916308 - RNA, 16 nt, Mycobacterium avium subsp. paratuberculosis
accgggaccgucggga

SEQ ID NO: 2916309 - RNA, 14 nt, Mycobacterium avium subsp. paratuberculosis
accgggaccugcug

SEQ ID NO: 2916310 - RNA, 16 nt, Mycobacterium avium subsp. paratuberculosis
accgggacgacggcgc

SEQ ID NO: 2916311 - RNA, 17 nt, Mycobacterium avium subsp. paratuberculosis
accgggacgacggcgcc

SEQ ID NO: 2916312 - RNA, 18 nt, Mycobacterium avium subsp. paratuberculosis
accgggacgacggcgccg

SEQ ID NO: 2916313 - RNA, 21 nt, Mycobacterium avium subsp. paratuberculosis
accgggacgacggcgccgccc

SEQ ID NO: 2916314 - RNA, 22 nt, Mycobacterium avium subsp. paratuberculosis
accgggacgggggugccgaccg

SEQ ID NO: 2916315 - RNA, 16 nt, Mycobacterium avium subsp. paratuberculosis
accgggauaccgcgac

SEQ ID NO: 2916316 - RNA, 17 nt, Mycobacterium avium subsp. paratuberculosis
accgggauccggcgcgc

SEQ ID NO: 2916317 - RNA, 18 nt, Mycobacterium avium subsp. paratuberculosis
accgggauccggcgcgcc

SEQ ID NO: 2916318 - RNA, 19 nt, Mycobacterium avium subsp. paratuberculosis
accgggauccggcgcgccg

SEQ ID NO: 2916319 - RNA, 21 nt, Mycobacterium avium subsp. paratuberculosis
accgggauccggcgcgccgcg

SEQ ID NO: 2916320 - RNA, 14 nt, Mycobacterium avium subsp. paratuberculosis
accgggaucgacag

SEQ ID NO: 2916321 - RNA, 22 nt, Mycobacterium avium subsp. paratuberculosis
accgggaucguguggccgcccu

SEQ ID NO: 2916322 - RNA, 23 nt, Mycobacterium avium subsp. paratuberculosis
accgggauggcguucugcaccga

SEQ ID NO: 2916323 - RNA, 19 nt, Mycobacterium avium subsp. paratuberculosis
accgggcacccggcgcggc

SEQ ID NO: 2916324 - RNA, 21 nt, Mycobacterium avium subsp. paratuberculosis
accgggcacccggcgcggccg

SEQ ID NO: 2916325 - RNA, 20 nt, Mycobacterium avium subsp. paratuberculosis
accgggcagccgcacaccgc

SEQ ID NO: 2916326 - RNA, 16 nt, Mycobacterium avium subsp. paratuberculosis
accgggcaggcacggu

SEQ ID NO: 2916327 - RNA, 20 nt, Mycobacterium avium subsp. paratuberculosis
accgggcaguuccuugcgca

SEQ ID NO: 2916328 - RNA, 22 nt, Mycobacterium avium subsp. paratuberculosis
accgggcaguuccuugcgcagc

SEQ ID NO: 2916329 - RNA, 14 nt, Mycobacterium avium subsp. paratuberculosis
accgggccaggaug

SEQ ID NO: 2916330 - RNA, 13 nt, Mycobacterium avium subsp. paratuberculosis
accgggcccagcu

SEQ ID NO: 2916331 - RNA, 14 nt, Mycobacterium avium subsp. paratuberculosis
accgggcccagcuc

SEQ ID NO: 2916332 - RNA, 18 nt, Mycobacterium avium subsp. paratuberculosis
accgggcccgcccgcagc

SEQ ID NO: 2916333 - RNA, 22 nt, Mycobacterium avium subsp. paratuberculosis
accgggcccgcccgcagcggcg

SEQ ID NO: 2916334 - RNA, 12 nt, Mycobacterium avium subsp. paratuberculosis
accgggcccggc

SEQ ID NO: 2916335 - RNA, 14 nt, Mycobacterium avium subsp. paratuberculosis
accgggcccggcgc

SEQ ID NO: 2916336 - RNA, 17 nt, Mycobacterium avium subsp. paratuberculosis
accgggcccggcgccaa

SEQ ID NO: 2916337 - RNA, 13 nt, Mycobacterium avium subsp. paratuberculosis
accgggcccguag

SEQ ID NO: 2916338 - RNA, 14 nt, Mycobacterium avium subsp. paratuberculosis
accgggcccguagg

SEQ ID NO: 2916339 - RNA, 20 nt, Mycobacterium avium subsp. paratuberculosis
accgggccgaaggcggcgcc

SEQ ID NO: 2916340 - RNA, 22 nt, Mycobacterium avium subsp. paratuberculosis
accgggccgaaggcggcgccgg

SEQ ID NO: 2916341 - RNA, 23 nt, Mycobacterium avium subsp. paratuberculosis
accgggccgaaggcggcgccggc

SEQ ID NO: 2916342 - RNA, 22 nt, Mycobacterium avium subsp. paratuberculosis
accgggccgaggaagacgucga

SEQ ID NO: 2916343 - RNA, 22 nt, Mycobacterium avium subsp. paratuberculosis
accgggccgcacccccuccaca

SEQ ID NO: 2916344 - RNA, 20 nt, Mycobacterium avium subsp. paratuberculosis
accggugcacgagcgucgug

SEQ ID NO: 2916345 - RNA, 22 nt, Mycobacterium avium subsp. paratuberculosis
accggugcggucccggucgaac

SEQ ID NO: 2916346 - RNA, 18 nt, Mycobacterium avium subsp. paratuberculosis
accgguggccgcgucgac

SEQ ID NO: 2916347 - RNA, 14 nt, Mycobacterium avium subsp. paratuberculosis
accgguggccggga

SEQ ID NO: 2916348 - RNA, 13 nt, Mycobacterium avium subsp. paratuberculosis
accggugucacgc

SEQ ID NO: 2916349 - RNA, 20 nt, Mycobacterium avium subsp. paratuberculosis
accggugucacgcuggcgug

SEQ ID NO: 2916350 - RNA, 15 nt, Mycobacterium avium subsp. paratuberculosis
accggugugccuggc

SEQ ID NO: 2916351 - RNA, 17 nt, Mycobacterium avium subsp. paratuberculosis
accgguuccgggcgacc

SEQ ID NO: 2916352 - RNA, 15 nt, Mycobacterium avium subsp. paratuberculosis
accgguucggacacg

SEQ ID NO: 2916353 - RNA, 21 nt, Mycobacterium avium subsp. paratuberculosis
accgguucggacacggcgccg

SEQ ID NO: 2916354 - RNA, 22 nt, Mycobacterium avium subsp. paratuberculosis
accgguucggacacggcgccgu

SEQ ID NO: 2916355 - RNA, 16 nt, Mycobacterium avium subsp. paratuberculosis
accgguugcgccgagg

SEQ ID NO: 2916356 - RNA, 22 nt, Mycobacterium avium subsp. paratuberculosis
accgguugcggcgaacgcgucc

SEQ ID NO: 2916357 - RNA, 20 nt, Mycobacterium avium subsp. paratuberculosis
accguaccgaggaugaccgc

SEQ ID NO: 2916358 - RNA, 13 nt, Mycobacterium avium subsp. paratuberculosis
accguacggcccg

SEQ ID NO: 2916359 - RNA, 14 nt, Mycobacterium avium subsp. paratuberculosis
accguagaccaccu

SEQ ID NO: 2916360 - RNA, 22 nt, Mycobacterium avium subsp. paratuberculosis
accguagccggucggcccgcuc

SEQ ID NO: 2916361 - RNA, 17 nt, Mycobacterium avium subsp. paratuberculosis
accgucacccccggcgc

SEQ ID NO: 2916362 - RNA, 18 nt, Mycobacterium avium subsp. paratuberculosis
accgucacccccggcgcg

SEQ ID NO: 2916363 - RNA, 20 nt, Mycobacterium avium subsp. paratuberculosis
accgucacccccggcgcgac

SEQ ID NO: 2916364 - RNA, 13 nt, Mycobacterium avium subsp. paratuberculosis
accgucaccgccg

SEQ ID NO: 2916365 - RNA, 14 nt, Mycobacterium avium subsp. paratuberculosis
accgucaccgccgc

SEQ ID NO: 2916366 - RNA, 23 nt, Mycobacterium avium subsp. paratuberculosis
accgucaccgccgcaccgucgug

SEQ ID NO: 2916367 - RNA, 14 nt, Mycobacterium avium subsp. paratuberculosis
accgucaccgccuc

SEQ ID NO: 2916368 - RNA, 16 nt, Mycobacterium avium subsp. paratuberculosis
accgucaccguggcgg

SEQ ID NO: 2916369 - RNA, 20 nt, Mycobacterium avium subsp. paratuberculosis
accgucacgcuggcgugaca

SEQ ID NO: 2916370 - RNA, 21 nt, Mycobacterium avium subsp. paratuberculosis
accgucacgcuggcgugacac

SEQ ID NO: 2916371 - RNA, 20 nt, Mycobacterium avium subsp. paratuberculosis
accgucagcagggccucgcc

SEQ ID NO: 2916372 - RNA, 17 nt, Mycobacterium avium subsp. paratuberculosis
accgucagcgucagcac

SEQ ID NO: 2916373 - RNA, 19 nt, Mycobacterium avium subsp. paratuberculosis
accgucagcgucagcacgu

SEQ ID NO: 2916374 - RNA, 14 nt, Mycobacterium avium subsp. paratuberculosis
accgucagggugac

SEQ ID NO: 2916375 - RNA, 20 nt, Mycobacterium avium subsp. paratuberculosis
accgucagggugacguggcg

SEQ ID NO: 2916376 - RNA, 21 nt, Mycobacterium avium subsp. paratuberculosis
accgucagggugacguggcgg

SEQ ID NO: 2916377 - RNA, 23 nt, Mycobacterium avium subsp. paratuberculosis
accgucaguucguagaucacggc

SEQ ID NO: 2916378 - RNA, 21 nt, Mycobacterium avium subsp. paratuberculosis
accgucaucgugugggcgccc

SEQ ID NO: 2916379 - RNA, 16 nt, Mycobacterium avium subsp. paratuberculosis
accgucaugccguuga

SEQ ID NO: 2916380 - RNA, 18 nt, Mycobacterium avium subsp. paratuberculosis
accguccacagccggcgg

SEQ ID NO: 2916381 - RNA, 19 nt, Mycobacterium avium subsp. paratuberculosis
accguccacagccggcggc

SEQ ID NO: 2916382 - RNA, 20 nt, Mycobacterium avium subsp. paratuberculosis
accguccacagccggcggcu

SEQ ID NO: 2916383 - RNA, 17 nt, Mycobacterium avium subsp. paratuberculosis
accguccagcucagcgc

SEQ ID NO: 2916384 - RNA, 19 nt, Mycobacterium avium subsp. paratuberculosis
accgucccggugucgccgu

SEQ ID NO: 2916385 - RNA, 22 nt, Mycobacterium avium subsp. paratuberculosis
accgucccggugucgccgucgc

SEQ ID NO: 2916386 - RNA, 13 nt, Mycobacterium avium subsp. paratuberculosis
accguccgcgccc

SEQ ID NO: 2916387 - RNA, 20 nt, Mycobacterium avium subsp. paratuberculosis
accguccuuguaggugaucg

SEQ ID NO: 2916388 - RNA, 18 nt, Mycobacterium avium subsp. paratuberculosis
accgucgaagagugcgau

SEQ ID NO: 2916389 - RNA, 17 nt, Mycobacterium avium subsp. paratuberculosis
accgucgauggacaggg

SEQ ID NO: 2916390 - RNA, 16 nt, Mycobacterium avium subsp. paratuberculosis
accgucgcccgcccag

SEQ ID NO: 2916391 - RNA, 21 nt, Mycobacterium avium subsp. paratuberculosis
accgucgcccgcccaggccgc

SEQ ID NO: 2916392 - RNA, 23 nt, Mycobacterium avium subsp. paratuberculosis
accgucgcccgcccaggccgcca

SEQ ID NO: 2916393 - RNA, 12 nt, Mycobacterium avium subsp. paratuberculosis
accgucgccgac

SEQ ID NO: 2916394 - RNA, 14 nt, Mycobacterium avium subsp. paratuberculosis
accgucgccgacca

SEQ ID NO: 2916395 - RNA, 19 nt, Mycobacterium avium subsp. paratuberculosis
accgucgccgaccagccga

SEQ ID NO: 2916396 - RNA, 14 nt, Mycobacterium avium subsp. paratuberculosis
accgucgccggcgg

SEQ ID NO: 2916397 - RNA, 17 nt, Mycobacterium avium subsp. paratuberculosis
accgucgccggcggggc

SEQ ID NO: 2916398 - RNA, 13 nt, Mycobacterium avium subsp. paratuberculosis
accgucgccggcu

SEQ ID NO: 2916399 - RNA, 19 nt, Mycobacterium avium subsp. paratuberculosis
accgucgccggcugacugc

SEQ ID NO: 2916400 - RNA, 14 nt, Mycobacterium avium subsp. paratuberculosis
accgucgcgcagcc

SEQ ID NO: 2916401 - RNA, 16 nt, Mycobacterium avium subsp. paratuberculosis
accgucgcgcagcccg

SEQ ID NO: 2916402 - RNA, 17 nt, Mycobacterium avium subsp. paratuberculosis
accgucgcgcagcccga

SEQ ID NO: 2916403 - RNA, 16 nt, Mycobacterium avium subsp. paratuberculosis
accgucggcaguugca

SEQ ID NO: 2916404 - RNA, 12 nt, Mycobacterium avium subsp. paratuberculosis
accgucggcccg

SEQ ID NO: 2916405 - RNA, 13 nt, Mycobacterium avium subsp. paratuberculosis
accgucggcgauc

SEQ ID NO: 2916406 - RNA, 16 nt, Mycobacterium avium subsp. paratuberculosis
accgucgggacggcca

SEQ ID NO: 2916407 - RNA, 17 nt, Mycobacterium avium subsp. paratuberculosis
accgucgggacggccag

SEQ ID NO: 2916408 - RNA, 19 nt, Mycobacterium avium subsp. paratuberculosis
accgucgggacggccagca

SEQ ID NO: 2916409 - RNA, 21 nt, Mycobacterium avium subsp. paratuberculosis
accgucgggacggccagcagg

SEQ ID NO: 2916410 - RNA, 16 nt, Mycobacterium avium subsp. paratuberculosis
accgucgggcguugcg

SEQ ID NO: 2916411 - RNA, 18 nt, Mycobacterium avium subsp. paratuberculosis
accgucggugcggggcgg

SEQ ID NO: 2916412 - RNA, 20 nt, Mycobacterium avium subsp. paratuberculosis
accgucguacucgaccgcga

SEQ ID NO: 2916413 - RNA, 21 nt, Mycobacterium avium subsp. paratuberculosis
accgucguacucgaccgcgac

SEQ ID NO: 2916414 - RNA, 22 nt, Mycobacterium avium subsp. paratuberculosis
accgucguacucgaccgcgacu

SEQ ID NO: 2916415 - RNA, 15 nt, Mycobacterium avium subsp. paratuberculosis
accgucguccacgcc

SEQ ID NO: 2916416 - RNA, 19 nt, Mycobacterium avium subsp. paratuberculosis
accgucguccacgcccagc

SEQ ID NO: 2916417 - RNA, 22 nt, Mycobacterium avium subsp. paratuberculosis
accgucguccacgcccagcgcc

SEQ ID NO: 2916418 - RNA, 23 nt, Mycobacterium avium subsp. paratuberculosis
accgucgucccggugaugacggg

SEQ ID NO: 2916419 - RNA, 13 nt, Mycobacterium avium subsp. paratuberculosis
accgucgucgagc

SEQ ID NO: 2916420 - RNA, 17 nt, Mycobacterium avium subsp. paratuberculosis
accgucgucgcaccggc

SEQ ID NO: 2916421 - RNA, 19 nt, Mycobacterium avium subsp. paratuberculosis
accgucgucgcaccggcag

SEQ ID NO: 2916422 - RNA, 14 nt, Mycobacterium avium subsp. paratuberculosis
accgucuccggcgc

SEQ ID NO: 2916423 - RNA, 18 nt, Mycobacterium avium subsp. paratuberculosis
accgucuccggcgcgguu

SEQ ID NO: 2916424 - RNA, 14 nt, Mycobacterium avium subsp. paratuberculosis
accgucugcgccgu

SEQ ID NO: 2916425 - RNA, 16 nt, Mycobacterium avium subsp. paratuberculosis
accgucugcgccguca

SEQ ID NO: 2916426 - RNA, 18 nt, Mycobacterium avium subsp. paratuberculosis
accgucugcgccgucacc

SEQ ID NO: 2916427 - RNA, 23 nt, Mycobacterium avium subsp. paratuberculosis
accgucugcgccgucaccggcug

SEQ ID NO: 2916428 - RNA, 22 nt, Mycobacterium avium subsp. paratuberculosis
accuccgugccgauggccaccg

SEQ ID NO: 2916429 - RNA, 23 nt, Mycobacterium avium subsp. paratuberculosis
accuccuccaaagcggcuaagcc

SEQ ID NO: 2916430 - RNA, 23 nt, Mycobacterium avium subsp. paratuberculosis
accuccugcaaggcccccgccuc

SEQ ID NO: 2916431 - RNA, 13 nt, Mycobacterium avium subsp. paratuberculosis
accuccugcaccc

SEQ ID NO: 2916432 - RNA, 15 nt, Mycobacterium avium subsp. paratuberculosis
accuccugcacccgu

SEQ ID NO: 2916433 - RNA, 23 nt, Mycobacterium avium subsp. paratuberculosis
accuccugcuggcguucgccgag

SEQ ID NO: 2916434 - RNA, 17 nt, Mycobacterium avium subsp. paratuberculosis
accuccuugcccagcgc

SEQ ID NO: 2916435 - RNA, 22 nt, Mycobacterium avium subsp. paratuberculosis
accucgaacacaucguggcgca

SEQ ID NO: 2916436 - RNA, 15 nt, Mycobacterium avium subsp. paratuberculosis
accucgaacgccggu

SEQ ID NO: 2916437 - RNA, 19 nt, Mycobacterium avium subsp. paratuberculosis
accucgaacuugaccgggc

SEQ ID NO: 2916438 - RNA, 22 nt, Mycobacterium avium subsp. paratuberculosis
accucgaagauggucgcgccgc

SEQ ID NO: 2916439 - RNA, 20 nt, Mycobacterium avium subsp. paratuberculosis
accucgaagcagccuucuug

SEQ ID NO: 2916440 - RNA, 16 nt, Mycobacterium avium subsp. paratuberculosis
accucgaagccgacgu

SEQ ID NO: 2916441 - RNA, 18 nt, Mycobacterium avium subsp. paratuberculosis
accucgaagccgaucgcg

SEQ ID NO: 2916442 - RNA, 23 nt, Mycobacterium avium subsp. paratuberculosis
accucgaagccgaucgcggcgau

SEQ ID NO: 2916443 - RNA, 13 nt, Mycobacterium avium subsp. paratuberculosis
accucgacacggg

SEQ ID NO: 2916444 - RNA, 17 nt, Mycobacterium avium subsp. paratuberculosis
accucgacacgggccgc

SEQ ID NO: 2916445 - RNA, 19 nt, Mycobacterium avium subsp. paratuberculosis
accucgacacgggccgcgc

SEQ ID NO: 2916446 - RNA, 16 nt, Mycobacterium avium subsp. paratuberculosis
accucgaccagccggu

SEQ ID NO: 2916447 - RNA, 17 nt, Mycobacterium avium subsp. paratuberculosis
accucgacggcgugguc

SEQ ID NO: 2916448 - RNA, 21 nt, Mycobacterium avium subsp. paratuberculosis
accucgacggcguggucggcg

SEQ ID NO: 2916449 - RNA, 18 nt, Mycobacterium avium subsp. paratuberculosis
accucgacggugcugccg

SEQ ID NO: 2916450 - RNA, 18 nt, Mycobacterium avium subsp. paratuberculosis
accucgagauucugcagc

SEQ ID NO: 2916451 - RNA, 20 nt, Mycobacterium avium subsp. paratuberculosis
accucgagauucugcagccg

SEQ ID NO: 2916452 - RNA, 15 nt, Mycobacterium avium subsp. paratuberculosis
accucgagcaaccgc

SEQ ID NO: 2916453 - RNA, 17 nt, Mycobacterium avium subsp. paratuberculosis
accucgagcaccggcgg

SEQ ID NO: 2916454 - RNA, 22 nt, Mycobacterium avium subsp. paratuberculosis
accucgagcacgcccugcggcu

SEQ ID NO: 2916455 - RNA, 20 nt, Mycobacterium avium subsp. paratuberculosis
accucgagcagcgcgcgcuu

SEQ ID NO: 2916456 - RNA, 21 nt, Mycobacterium avium subsp. paratuberculosis
accucgagcagcgcgcgcuug

SEQ ID NO: 2916457 - RNA, 20 nt, Mycobacterium avium subsp. paratuberculosis
accucgagcgucacgcuggc

SEQ ID NO: 2916458 - RNA, 22 nt, Mycobacterium avium subsp. paratuberculosis
accucgaggaacuugcgccggg

SEQ ID NO: 2916459 - RNA, 18 nt, Mycobacterium avium subsp. paratuberculosis
accucgaucaccgggcgg

SEQ ID NO: 2916460 - RNA, 22 nt, Mycobacterium avium subsp. paratuberculosis
accucgaucaccgggcggccgu

SEQ ID NO: 2916461 - RNA, 18 nt, Mycobacterium avium subsp. paratuberculosis
accucgaucagcggcauc

SEQ ID NO: 2916462 - RNA, 20 nt, Mycobacterium avium subsp. paratuberculosis
accucgaucagcggcaucga

SEQ ID NO: 2916463 - RNA, 14 nt, Mycobacterium avium subsp. paratuberculosis
accucgauggcgac

SEQ ID NO: 2916464 - RNA, 16 nt, Mycobacterium avium subsp. paratuberculosis
accucgauggcgacgc

SEQ ID NO: 2916465 - RNA, 22 nt, Mycobacterium avium subsp. paratuberculosis
accucgauggguucuucgacca

SEQ ID NO: 2916466 - RNA, 23 nt, Mycobacterium avium subsp. paratuberculosis
accucgauggguucuucgaccac

SEQ ID NO: 2916467 - RNA, 14 nt, Mycobacterium avium subsp. paratuberculosis
accucgcccgccgc

SEQ ID NO: 2916468 - RNA, 20 nt, Mycobacterium avium subsp. paratuberculosis
accucgcccugcagccgggu

SEQ ID NO: 2916469 - RNA, 13 nt, Mycobacterium avium subsp. paratuberculosis
accucgccgacgu

SEQ ID NO: 2916470 - RNA, 22 nt, Mycobacterium avium subsp. paratuberculosis
accucgccgacgucccagcaca

SEQ ID NO: 2916471 - RNA, 15 nt, Mycobacterium avium subsp. paratuberculosis
accucgccgagcagc

SEQ ID NO: 2916472 - RNA, 14 nt, Mycobacterium avium subsp. paratuberculosis
accucgccgcaggc

SEQ ID NO: 2916473 - RNA, 15 nt, Mycobacterium avium subsp. paratuberculosis
accucgccgcccucg

SEQ ID NO: 2916474 - RNA, 13 nt, Mycobacterium avium subsp. paratuberculosis
accucgccggccg

SEQ ID NO: 2916475 - RNA, 14 nt, Mycobacterium avium subsp. paratuberculosis
accucgccggccgc

SEQ ID NO: 2916476 - RNA, 21 nt, Mycobacterium avium subsp. paratuberculosis
accucgccggccgccguggcc

SEQ ID NO: 2916477 - RNA, 22 nt, Mycobacterium avium subsp. paratuberculosis
accucgccggccgccguggccc

SEQ ID NO: 2916478 - RNA, 15 nt, Mycobacterium avium subsp. paratuberculosis
accucgccggccggg

SEQ ID NO: 2916479 - RNA, 21 nt, Mycobacterium avium subsp. paratuberculosis
accucgccguccuugacgaac

SEQ ID NO: 2916480 - RNA, 18 nt, Mycobacterium avium subsp. paratuberculosis
accucgcgcaccggcugc

SEQ ID NO: 2916481 - RNA, 22 nt, Mycobacterium avium subsp. paratuberculosis
accucgcgcaccggcugcccca

SEQ ID NO: 2916482 - RNA, 15 nt, Mycobacterium avium subsp. paratuberculosis
accucgcgcagcccc

SEQ ID NO: 2916483 - RNA, 17 nt, Mycobacterium avium subsp. paratuberculosis
accucgcgcagcccccg

SEQ ID NO: 2916484 - RNA, 14 nt, Mycobacterium avium subsp. paratuberculosis
accucgcgcccggc

SEQ ID NO: 2916485 - RNA, 21 nt, Mycobacterium avium subsp. paratuberculosis
accucgcgcccggcgccggcc

SEQ ID NO: 2916486 - RNA, 14 nt, Mycobacterium avium subsp. paratuberculosis
accucgcgccgcga

SEQ ID NO: 2916487 - RNA, 16 nt, Mycobacterium avium subsp. paratuberculosis
accucgcgccgcgauc

SEQ ID NO: 2916488 - RNA, 13 nt, Mycobacterium avium subsp. paratuberculosis
accucgcgcgggg

SEQ ID NO: 2916489 - RNA, 18 nt, Mycobacterium avium subsp. paratuberculosis
accucgcgcggggcggcc

SEQ ID NO: 2916490 - RNA, 21 nt, Mycobacterium avium subsp. paratuberculosis
accucgcgcggggcggccgcc

SEQ ID NO: 2916491 - RNA, 16 nt, Mycobacterium avium subsp. paratuberculosis
accucgcgcgucacgc

SEQ ID NO: 2916492 - RNA, 19 nt, Mycobacterium avium subsp. paratuberculosis
accucgcgcgucacgcugg

SEQ ID NO: 2916493 - RNA, 24 nt, Mycobacterium avium subsp. paratuberculosis
accucgcgcucuugggcggccggc

SEQ ID NO: 2916494 - RNA, 16 nt, Mycobacterium avium subsp. paratuberculosis
accucgcggcggcguc

SEQ ID NO: 2916495 - RNA, 17 nt, Mycobacterium avium subsp. paratuberculosis
accucgcggcggcgucg

SEQ ID NO: 2916496 - RNA, 20 nt, Mycobacterium avium subsp. paratuberculosis
accucgcuacgcgagcugcu

SEQ ID NO: 2916497 - RNA, 14 nt, Mycobacterium avium subsp. paratuberculosis
accucgcucagccc

SEQ ID NO: 2916498 - RNA, 15 nt, Mycobacterium avium subsp. paratuberculosis
accucgcucagcccg

SEQ ID NO: 2916499 - RNA, 16 nt, Mycobacterium avium subsp. paratuberculosis
accucgcugacgucga

SEQ ID NO: 2916500 - RNA, 20 nt, Mycobacterium avium subsp. paratuberculosis
accucgcuggaaaccucuug

SEQ ID NO: 2916501 - RNA, 14 nt, Mycobacterium avium subsp. paratuberculosis
accucgcuggcggc

SEQ ID NO: 2916502 - RNA, 17 nt, Mycobacterium avium subsp. paratuberculosis
accucgcuggcggcgcg

SEQ ID NO: 2916503 - RNA, 22 nt, Mycobacterium avium subsp. paratuberculosis
accucggagaugauggccgcgc

SEQ ID NO: 2916504 - RNA, 23 nt, Mycobacterium avium subsp. paratuberculosis
accucggagaugauggccgcgcc

SEQ ID NO: 2916505 - RNA, 17 nt, Mycobacterium avium subsp. paratuberculosis
accucggccaccaccuc

SEQ ID NO: 2916506 - RNA, 18 nt, Mycobacterium avium subsp. paratuberculosis
accucggccaccaccucg

SEQ ID NO: 2916507 - RNA, 14 nt, Mycobacterium avium subsp. paratuberculosis
accucggccagcgc

SEQ ID NO: 2916508 - RNA, 16 nt, Mycobacterium avium subsp. paratuberculosis
accucggccagcgccg

SEQ ID NO: 2916509 - RNA, 17 nt, Mycobacterium avium subsp. paratuberculosis
accucggccagcgccgc

SEQ ID NO: 2916510 - RNA, 15 nt, Mycobacterium avium subsp. paratuberculosis
accucggccagcgug

SEQ ID NO: 2916511 - RNA, 13 nt, Mycobacterium avium subsp. paratuberculosis
accucggccaggu

SEQ ID NO: 2916512 - RNA, 19 nt, Mycobacterium avium subsp. paratuberculosis
accugcggcucgucggcga

SEQ ID NO: 2916513 - RNA, 17 nt, Mycobacterium avium subsp. paratuberculosis
accugcgggcccaccgc

SEQ ID NO: 2916514 - RNA, 20 nt, Mycobacterium avium subsp. paratuberculosis
accugcgggcccaccgcgcg

SEQ ID NO: 2916515 - RNA, 23 nt, Mycobacterium avium subsp. paratuberculosis
accugcgggcccaccgcgcgcug

SEQ ID NO: 2916516 - RNA, 22 nt, Mycobacterium avium subsp. paratuberculosis
accugcgguucgucgcggcggc

SEQ ID NO: 2916517 - RNA, 21 nt, Mycobacterium avium subsp. paratuberculosis
accugcguccgauaccagccg

SEQ ID NO: 2916518 - RNA, 22 nt, Mycobacterium avium subsp. paratuberculosis
accugcguccgauaccagccgc

SEQ ID NO: 2916519 - RNA, 23 nt, Mycobacterium avium subsp. paratuberculosis
accugcgugccuugcacccagcg

SEQ ID NO: 2916520 - RNA, 15 nt, Mycobacterium avium subsp. paratuberculosis
accugcguugcggca

SEQ ID NO: 2916521 - RNA, 15 nt, Mycobacterium avium subsp. paratuberculosis
accugcucaccgagc

SEQ ID NO: 2916522 - RNA, 21 nt, Mycobacterium avium subsp. paratuberculosis
accugcucgaugcgcgccagc

SEQ ID NO: 2916523 - RNA, 22 nt, Mycobacterium avium subsp. paratuberculosis
accugcucgucggugacggugu

SEQ ID NO: 2916524 - RNA, 17 nt, Mycobacterium avium subsp. paratuberculosis
accugcugggcggcacc

SEQ ID NO: 2916525 - RNA, 22 nt, Mycobacterium avium subsp. paratuberculosis
accugcugggcggcaccacccg

SEQ ID NO: 2916526 - RNA, 15 nt, Mycobacterium avium subsp. paratuberculosis
accugcugggcgggc

SEQ ID NO: 2916527 - RNA, 21 nt, Mycobacterium avium subsp. paratuberculosis
accugcuugagcccgucgacg

SEQ ID NO: 2916528 - RNA, 17 nt, Mycobacterium avium subsp. paratuberculosis
accugcuuggcggccug

SEQ ID NO: 2916529 - RNA, 22 nt, Mycobacterium avium subsp. paratuberculosis
accugcuuguugagggugacgg

SEQ ID NO: 2916530 - RNA, 17 nt, Mycobacterium avium subsp. paratuberculosis
accuggaagcgcaucgc

SEQ ID NO: 2916531 - RNA, 21 nt, Mycobacterium avium subsp. paratuberculosis
accuggaagcgcaucgccggc

SEQ ID NO: 2916532 - RNA, 17 nt, Mycobacterium avium subsp. paratuberculosis
accuggacgccgcacgc

SEQ ID NO: 2916533 - RNA, 23 nt, Mycobacterium avium subsp. paratuberculosis
accuggacgguuucaccgccguc

SEQ ID NO: 2916534 - RNA, 20 nt, Mycobacterium avium subsp. paratuberculosis
accuggaggccaacgagcgc

SEQ ID NO: 2916535 - RNA, 18 nt, Mycobacterium avium subsp. paratuberculosis
accuggcagcauccgccg

SEQ ID NO: 2916536 - RNA, 20 nt, Mycobacterium avium subsp. paratuberculosis
accuggcagcauccgccgac

SEQ ID NO: 2916537 - RNA, 23 nt, Mycobacterium avium subsp. paratuberculosis
accuggcagcauccgccgacgau

SEQ ID NO: 2916538 - RNA, 12 nt, Mycobacterium avium subsp. paratuberculosis
accuggccacca

SEQ ID NO: 2916539 - RNA, 16 nt, Mycobacterium avium subsp. paratuberculosis
accuggccaccagcag

SEQ ID NO: 2916540 - RNA, 16 nt, Mycobacterium avium subsp. paratuberculosis
accuggccggccucga

SEQ ID NO: 2916541 - RNA, 19 nt, Mycobacterium avium subsp. paratuberculosis
accuggccggccucgaugu

SEQ ID NO: 2916542 - RNA, 13 nt, Mycobacterium avium subsp. paratuberculosis
accuggccgucgg

SEQ ID NO: 2916543 - RNA, 17 nt, Mycobacterium avium subsp. paratuberculosis
accuggcgcaccgccgc

SEQ ID NO: 2916544 - RNA, 18 nt, Mycobacterium avium subsp. paratuberculosis
accuggcgcaccgccgcg

SEQ ID NO: 2916545 - RNA, 19 nt, Mycobacterium avium subsp. paratuberculosis
accuggcgcaccgccgcgg

SEQ ID NO: 2916546 - RNA, 14 nt, Mycobacterium avium subsp. paratuberculosis
accuggcggccgga

SEQ ID NO: 2916547 - RNA, 16 nt, Mycobacterium avium subsp. paratuberculosis
accuggcgggccagcu

SEQ ID NO: 2916548 - RNA, 23 nt, Mycobacterium avium subsp. paratuberculosis
accugggaugucuagccgccgag

SEQ ID NO: 2916549 - RNA, 15 nt, Mycobacterium avium subsp. paratuberculosis
accugggcgccgucg

SEQ ID NO: 2916550 - RNA, 16 nt, Mycobacterium avium subsp. paratuberculosis
accugggcgccgucgc

SEQ ID NO: 2916551 - RNA, 21 nt, Mycobacterium avium subsp. paratuberculosis
accugggcgccgucgccgacg

SEQ ID NO: 2916552 - RNA, 22 nt, Mycobacterium avium subsp. paratuberculosis
accugggcgccgucgccgacgu

SEQ ID NO: 2916553 - RNA, 21 nt, Mycobacterium avium subsp. paratuberculosis
accugggcggccaccgcgccc

SEQ ID NO: 2916554 - RNA, 14 nt, Mycobacterium avium subsp. paratuberculosis
accugggcggcggc

SEQ ID NO: 2916555 - RNA, 13 nt, Mycobacterium avium subsp. paratuberculosis
accugggcgucgu

SEQ ID NO: 2916556 - RNA, 20 nt, Mycobacterium avium subsp. paratuberculosis
accugggcgucgucggccgg

SEQ ID NO: 2916557 - RNA, 21 nt, Mycobacterium avium subsp. paratuberculosis
accugggcgucgucggccggc

SEQ ID NO: 2916558 - RNA, 22 nt, Mycobacterium avium subsp. paratuberculosis
accugggcgucgucggccggcu

SEQ ID NO: 2916559 - RNA, 16 nt, Mycobacterium avium subsp. paratuberculosis
accugggucaucaccu

SEQ ID NO: 2916560 - RNA, 17 nt, Mycobacterium avium subsp. paratuberculosis
accugggucaucaccuu

SEQ ID NO: 2916561 - RNA, 19 nt, Mycobacterium avium subsp. paratuberculosis
accugggucaucaccuugu

SEQ ID NO: 2916562 - RNA, 15 nt, Mycobacterium avium subsp. paratuberculosis
accugggucugcggc

SEQ ID NO: 2916563 - RNA, 19 nt, Mycobacterium avium subsp. paratuberculosis
accugggucugcggccggg

SEQ ID NO: 2916564 - RNA, 20 nt, Mycobacterium avium subsp. paratuberculosis
accugggugaucuuggugaa

SEQ ID NO: 2916565 - RNA, 14 nt, Mycobacterium avium subsp. paratuberculosis
accugggugcgcca

SEQ ID NO: 2916566 - RNA, 23 nt, Mycobacterium avium subsp. paratuberculosis
accugguccaccgcggcggccag

SEQ ID NO: 2916567 - RNA, 13 nt, Mycobacterium avium subsp. paratuberculosis
accuggucgccga

SEQ ID NO: 2916568 - RNA, 14 nt, Mycobacterium avium subsp. paratuberculosis
accuggucgccgaa

SEQ ID NO: 2916569 - RNA, 17 nt, Mycobacterium avium subsp. paratuberculosis
accuggucgccgccguc

SEQ ID NO: 2916570 - RNA, 19 nt, Mycobacterium avium subsp. paratuberculosis
accugguucucccgucgcg

SEQ ID NO: 2916571 - RNA, 15 nt, Mycobacterium avium subsp. paratuberculosis
accugguugccgccc

SEQ ID NO: 2916572 - RNA, 16 nt, Mycobacterium avium subsp. paratuberculosis
accugguugccgcccu

SEQ ID NO: 2916573 - RNA, 20 nt, Mycobacterium avium subsp. paratuberculosis
accugguugccgcccucggc

SEQ ID NO: 2916574 - RNA, 17 nt, Mycobacterium avium subsp. paratuberculosis
accugguuggcccgcac

SEQ ID NO: 2916575 - RNA, 20 nt, Mycobacterium avium subsp. paratuberculosis
accuguacgugucccugcgg

SEQ ID NO: 2916576 - RNA, 21 nt, Mycobacterium avium subsp. paratuberculosis
accuguuuggcugucgcgcug

SEQ ID NO: 2916577 - RNA, 14 nt, Mycobacterium avium subsp. paratuberculosis
accuucaccgacca

SEQ ID NO: 2916578 - RNA, 18 nt, Mycobacterium avium subsp. paratuberculosis
accuucaccgaccagcug

SEQ ID NO: 2916579 - RNA, 23 nt, Mycobacterium avium subsp. paratuberculosis
accuucaccgcgccgguccggcc

SEQ ID NO: 2916580 - RNA, 14 nt, Mycobacterium avium subsp. paratuberculosis
accuucagcgggcg

SEQ ID NO: 2916581 - RNA, 18 nt, Mycobacterium avium subsp. paratuberculosis
accuucagcgggcgcagc

SEQ ID NO: 2916582 - RNA, 12 nt, Mycobacterium avium subsp. paratuberculosis
accuucaucgcc

SEQ ID NO: 2916583 - RNA, 22 nt, Mycobacterium avium subsp. paratuberculosis
accuucaucgccgucgccaccg

SEQ ID NO: 2916584 - RNA, 17 nt, Mycobacterium avium subsp. paratuberculosis
accuuccaccaccgcgg

SEQ ID NO: 2916585 - RNA, 20 nt, Mycobacterium avium subsp. paratuberculosis
accuucgagccgccgccggc

SEQ ID NO: 2916586 - RNA, 18 nt, Mycobacterium avium subsp. paratuberculosis
accuucggagacguggcg

SEQ ID NO: 2916587 - RNA, 22 nt, Mycobacterium avium subsp. paratuberculosis
accuucucgaccaggcucacgc

SEQ ID NO: 2916588 - RNA, 13 nt, Mycobacterium avium subsp. paratuberculosis
accuucuuggccg

SEQ ID NO: 2916589 - RNA, 13 nt, Mycobacterium avium subsp. paratuberculosis
accuugaccaccg

SEQ ID NO: 2916590 - RNA, 20 nt, Mycobacterium avium subsp. paratuberculosis
accuugaccaccgagccggg

SEQ ID NO: 2916591 - RNA, 13 nt, Mycobacterium avium subsp. paratuberculosis
accuugaccagcu

SEQ ID NO: 2916592 - RNA, 15 nt, Mycobacterium avium subsp. paratuberculosis
accuugaccagcuug

SEQ ID NO: 2916593 - RNA, 18 nt, Mycobacterium avium subsp. paratuberculosis
accuugaucggccccuug

SEQ ID NO: 2916594 - RNA, 19 nt, Mycobacterium avium subsp. paratuberculosis
accuugaucggccccuugg

SEQ ID NO: 2916595 - RNA, 20 nt, Mycobacterium avium subsp. paratuberculosis
accuugaucggccccuuggc

SEQ ID NO: 2916596 - RNA, 18 nt, Mycobacterium avium subsp. paratuberculosis
acgaccagguccaccccg

SEQ ID NO: 2916597 - RNA, 19 nt, Mycobacterium avium subsp. paratuberculosis
acgaccagguccaccccgc

SEQ ID NO: 2916598 - RNA, 21 nt, Mycobacterium avium subsp. paratuberculosis
acgaccagguccaccccgcca

SEQ ID NO: 2916599 - RNA, 11 nt, Mycobacterium avium subsp. paratuberculosis
acgaccagugc

SEQ ID NO: 2916600 - RNA, 18 nt, Mycobacterium avium subsp. paratuberculosis
acgaccagugcccggcca

SEQ ID NO: 2916601 - RNA, 19 nt, Mycobacterium avium subsp. paratuberculosis
acgaccagugcccggccaa

SEQ ID NO: 2916602 - RNA, 13 nt, Mycobacterium avium subsp. paratuberculosis
acgaccaucagcg

SEQ ID NO: 2916603 - RNA, 15 nt, Mycobacterium avium subsp. paratuberculosis
acgaccaucagcgcc

SEQ ID NO: 2916604 - RNA, 23 nt, Mycobacterium avium subsp. paratuberculosis
acgaccaugucggcgacccgcac

SEQ ID NO: 2916605 - RNA, 17 nt, Mycobacterium avium subsp. paratuberculosis
acgaccccgcccacgaa

SEQ ID NO: 2916606 - RNA, 13 nt, Mycobacterium avium subsp. paratuberculosis
acgaccccggcgg

SEQ ID NO: 2916607 - RNA, 13 nt, Mycobacterium avium subsp. paratuberculosis
acgacccggccac

SEQ ID NO: 2916608 - RNA, 14 nt, Mycobacterium avium subsp. paratuberculosis
acgacccggccacc

SEQ ID NO: 2916609 - RNA, 22 nt, Mycobacterium avium subsp. paratuberculosis
acgacccggccaccgccgccag

SEQ ID NO: 2916610 - RNA, 15 nt, Mycobacterium avium subsp. paratuberculosis
acgaccgcaccgacc

SEQ ID NO: 2916611 - RNA, 16 nt, Mycobacterium avium subsp. paratuberculosis
acgaccgcaccgacca

SEQ ID NO: 2916612 - RNA, 17 nt, Mycobacterium avium subsp. paratuberculosis
acgaccgcaccgaccag

SEQ ID NO: 2916613 - RNA, 23 nt, Mycobacterium avium subsp. paratuberculosis
acgaccgccagcagcagccgcgc

SEQ ID NO: 2916614 - RNA, 15 nt, Mycobacterium avium subsp. paratuberculosis
acgaccgcgacggcg

SEQ ID NO: 2916615 - RNA, 18 nt, Mycobacterium avium subsp. paratuberculosis
acgaccgcgacggcgccc

SEQ ID NO: 2916616 - RNA, 20 nt, Mycobacterium avium subsp. paratuberculosis
acgaccgcgacggcgcccgc

SEQ ID NO: 2916617 - RNA, 22 nt, Mycobacterium avium subsp. paratuberculosis
acgaccgcgacggcgcccgccc

SEQ ID NO: 2916618 - RNA, 14 nt, Mycobacterium avium subsp. paratuberculosis
acgaccgcgacgug

SEQ ID NO: 2916619 - RNA, 23 nt, Mycobacterium avium subsp. paratuberculosis
acgaccgcguccgaggcgguucc

SEQ ID NO: 2916620 - RNA, 12 nt, Mycobacterium avium subsp. paratuberculosis
acgaccggcagc

SEQ ID NO: 2916621 - RNA, 19 nt, Mycobacterium avium subsp. paratuberculosis
acgaccggcagcaccggcc

SEQ ID NO: 2916622 - RNA, 17 nt, Mycobacterium avium subsp. paratuberculosis
acgaccggcagccgcgc

SEQ ID NO: 2916623 - RNA, 22 nt, Mycobacterium avium subsp. paratuberculosis
acgaccgucaucaucaccggga

SEQ ID NO: 2916624 - RNA, 13 nt, Mycobacterium avium subsp. paratuberculosis
acgaccucccccg

SEQ ID NO: 2916625 - RNA, 22 nt, Mycobacterium avium subsp. paratuberculosis
acgaccucccccgacgccgaca

SEQ ID NO: 2916626 - RNA, 16 nt, Mycobacterium avium subsp. paratuberculosis
acgaccuccgugccga

SEQ ID NO: 2916627 - RNA, 22 nt, Mycobacterium avium subsp. paratuberculosis
acgaccucgaagaagagggcgu

SEQ ID NO: 2916628 - RNA, 13 nt, Mycobacterium avium subsp. paratuberculosis
acgaccucgccga

SEQ ID NO: 2916629 - RNA, 15 nt, Mycobacterium avium subsp. paratuberculosis
acgaccucgccgacg

SEQ ID NO: 2916630 - RNA, 16 nt, Mycobacterium avium subsp. paratuberculosis
acgaccucgccgacgu

SEQ ID NO: 2916631 - RNA, 13 nt, Mycobacterium avium subsp. paratuberculosis
acgaccucggggu

SEQ ID NO: 2916632 - RNA, 23 nt, Mycobacterium avium subsp. paratuberculosis
acgaccucggugucgaggucguc

SEQ ID NO: 2916633 - RNA, 13 nt, Mycobacterium avium subsp. paratuberculosis
acgaccucgucgu

SEQ ID NO: 2916634 - RNA, 14 nt, Mycobacterium avium subsp. paratuberculosis
acgaccuggcgggc

SEQ ID NO: 2916635 - RNA, 18 nt, Mycobacterium avium subsp. paratuberculosis
acgaccuggcgggccagc

SEQ ID NO: 2916636 - RNA, 19 nt, Mycobacterium avium subsp. paratuberculosis
acgaccugggcgccgucgc

SEQ ID NO: 2916637 - RNA, 16 nt, Mycobacterium avium subsp. paratuberculosis
acgaccuggucgccgc

SEQ ID NO: 2916638 - RNA, 21 nt, Mycobacterium avium subsp. paratuberculosis
acgaccugguugacaccaccg

SEQ ID NO: 2916639 - RNA, 15 nt, Mycobacterium avium subsp. paratuberculosis
acgaccuugucgcgc

SEQ ID NO: 2916640 - RNA, 17 nt, Mycobacterium avium subsp. paratuberculosis
acgaccuugucgcgcac

SEQ ID NO: 2916641 - RNA, 23 nt, Mycobacterium avium subsp. paratuberculosis
acgaccuugucgcgcacccgcac

SEQ ID NO: 2916642 - RNA, 13 nt, Mycobacterium avium subsp. paratuberculosis
acgacgaacuccg

SEQ ID NO: 2916643 - RNA, 18 nt, Mycobacterium avium subsp. paratuberculosis
acgacgaagucggucagc

SEQ ID NO: 2916644 - RNA, 21 nt, Mycobacterium avium subsp. paratuberculosis
acgacgaagucggucagcguc

SEQ ID NO: 2916645 - RNA, 22 nt, Mycobacterium avium subsp. paratuberculosis
acgacgaagucggucagcgucg

SEQ ID NO: 2916646 - RNA, 24 nt, Mycobacterium avium subsp. paratuberculosis
acgacgaaucccgccucggugagc

SEQ ID NO: 2916647 - RNA, 17 nt, Mycobacterium avium subsp. paratuberculosis
acgacgacaggucgagc

SEQ ID NO: 2916648 - RNA, 15 nt, Mycobacterium avium subsp. paratuberculosis
acgacgaccgcgacg

SEQ ID NO: 2916649 - RNA, 17 nt, Mycobacterium avium subsp. paratuberculosis
acgacgaccgcgacggc

SEQ ID NO: 2916650 - RNA, 14 nt, Mycobacterium avium subsp. paratuberculosis
acgacgaccgcguc

SEQ ID NO: 2916651 - RNA, 18 nt, Mycobacterium avium subsp. paratuberculosis
acgacgaccucccccgac

SEQ ID NO: 2916652 - RNA, 14 nt, Mycobacterium avium subsp. paratuberculosis
acgacgagccgucg

SEQ ID NO: 2916653 - RNA, 15 nt, Mycobacterium avium subsp. paratuberculosis
acgacgagccgucga

SEQ ID NO: 2916654 - RNA, 15 nt, Mycobacterium avium subsp. paratuberculosis
acgacgccaccaucg

SEQ ID NO: 2916655 - RNA, 16 nt, Mycobacterium avium subsp. paratuberculosis
acgacgccaccaucga

SEQ ID NO: 2916656 - RNA, 13 nt, Mycobacterium avium subsp. paratuberculosis
acgacgccaccgc

SEQ ID NO: 2916657 - RNA, 19 nt, Mycobacterium avium subsp. paratuberculosis
acgacgccagcugccgcga

SEQ ID NO: 2916658 - RNA, 20 nt, Mycobacterium avium subsp. paratuberculosis
acgacgccagcugccgcgac

SEQ ID NO: 2916659 - RNA, 21 nt, Mycobacterium avium subsp. paratuberculosis
acgacgccaguucgucggccg

SEQ ID NO: 2916660 - RNA, 13 nt, Mycobacterium avium subsp. paratuberculosis
acgacgccgaucc

SEQ ID NO: 2916661 - RNA, 17 nt, Mycobacterium avium subsp. paratuberculosis
acgacgccgauccgcag

SEQ ID NO: 2916662 - RNA, 20 nt, Mycobacterium avium subsp. paratuberculosis
acgacgccgauccgcagccg

SEQ ID NO: 2916663 - RNA, 15 nt, Mycobacterium avium subsp. paratuberculosis
acgacgccgccgagg

SEQ ID NO: 2916664 - RNA, 19 nt, Mycobacterium avium subsp. paratuberculosis
acgacgccgccgaggggga

SEQ ID NO: 2916665 - RNA, 15 nt, Mycobacterium avium subsp. paratuberculosis
acgacgccgcugggc

SEQ ID NO: 2916666 - RNA, 18 nt, Mycobacterium avium subsp. paratuberculosis
acgacgccgcugggcgug

SEQ ID NO: 2916667 - RNA, 13 nt, Mycobacterium avium subsp. paratuberculosis
acgacgcgccacg

SEQ ID NO: 2916668 - RNA, 13 nt, Mycobacterium avium subsp. paratuberculosis
acgacgcggcacg

SEQ ID NO: 2916669 - RNA, 14 nt, Mycobacterium avium subsp. paratuberculosis
acgacgcggcacgc

SEQ ID NO: 2916670 - RNA, 21 nt, Mycobacterium avium subsp. paratuberculosis
acgacgcggcacgccgcucgu

SEQ ID NO: 2916671 - RNA, 15 nt, Mycobacterium avium subsp. paratuberculosis
acgacgcggcgcgcg

SEQ ID NO: 2916672 - RNA, 16 nt, Mycobacterium avium subsp. paratuberculosis
acgacgcggucgucgu

SEQ ID NO: 2916673 - RNA, 18 nt, Mycobacterium avium subsp. paratuberculosis
acgacgcggucugcggug

SEQ ID NO: 2916674 - RNA, 15 nt, Mycobacterium avium subsp. paratuberculosis
acgacggccaccgcg

SEQ ID NO: 2916675 - RNA, 16 nt, Mycobacterium avium subsp. paratuberculosis
acgacggccaccgcga

SEQ ID NO: 2916676 - RNA, 17 nt, Mycobacterium avium subsp. paratuberculosis
acgacggccaccgcgac

SEQ ID NO: 2916677 - RNA, 20 nt, Mycobacterium avium subsp. paratuberculosis
acgacggccaccgcgacgcu

SEQ ID NO: 2916678 - RNA, 12 nt, Mycobacterium avium subsp. paratuberculosis
acgacggcgccg

SEQ ID NO: 2916679 - RNA, 18 nt, Mycobacterium avium subsp. paratuberculosis
acgacggcgccgcccggg

SEQ ID NO: 2916680 - RNA, 15 nt, Mycobacterium avium subsp. paratuberculosis
acgacggcgccgcgu

SEQ ID NO: 2916681 - RNA, 17 nt, Mycobacterium avium subsp. paratuberculosis
acgaucccagacccagc

SEQ ID NO: 2916682 - RNA, 23 nt, Mycobacterium avium subsp. paratuberculosis
acgaucccagacccagcaucgcc

SEQ ID NO: 2916683 - RNA, 16 nt, Mycobacterium avium subsp. paratuberculosis
acgaucccgccgcccg

SEQ ID NO: 2916684 - RNA, 18 nt, Mycobacterium avium subsp. paratuberculosis
acgaucccgccgcccgcc

SEQ ID NO: 2916685 - RNA, 13 nt, Mycobacterium avium subsp. paratuberculosis
acgauccgcgccg

SEQ ID NO: 2916686 - RNA, 14 nt, Mycobacterium avium subsp. paratuberculosis
acgauccgcgccgc

SEQ ID NO: 2916687 - RNA, 13 nt, Mycobacterium avium subsp. paratuberculosis
acgauccgggcgc

SEQ ID NO: 2916688 - RNA, 15 nt, Mycobacterium avium subsp. paratuberculosis
acgauccgggcgccc

SEQ ID NO: 2916689 - RNA, 14 nt, Mycobacterium avium subsp. paratuberculosis
acgaucgagccggu

SEQ ID NO: 2916690 - RNA, 16 nt, Mycobacterium avium subsp. paratuberculosis
acgaucgcgacggccg

SEQ ID NO: 2916691 - RNA, 17 nt, Mycobacterium avium subsp. paratuberculosis
acgaucgcgaucgccga

SEQ ID NO: 2916692 - RNA, 18 nt, Mycobacterium avium subsp. paratuberculosis
acgaucgcgaucgccgau

SEQ ID NO: 2916693 - RNA, 12 nt, Mycobacterium avium subsp. paratuberculosis
acgaucgcggcc

SEQ ID NO: 2916694 - RNA, 15 nt, Mycobacterium avium subsp. paratuberculosis
acgaucgcggccagc

SEQ ID NO: 2916695 - RNA, 12 nt, Mycobacterium avium subsp. paratuberculosis
acgaucgcggug

SEQ ID NO: 2916696 - RNA, 21 nt, Mycobacterium avium subsp. paratuberculosis
acgaucgcggugacgcgccgg

SEQ ID NO: 2916697 - RNA, 21 nt, Mycobacterium avium subsp. paratuberculosis
acgaucggcuccagcgcccgc

SEQ ID NO: 2916698 - RNA, 20 nt, Mycobacterium avium subsp. paratuberculosis
acgaucggcuugaugaacgc

SEQ ID NO: 2916699 - RNA, 22 nt, Mycobacterium avium subsp. paratuberculosis
acgaucggguagacgucgggcu

SEQ ID NO: 2916700 - RNA, 14 nt, Mycobacterium avium subsp. paratuberculosis
acgaucgucgccgc

SEQ ID NO: 2916701 - RNA, 15 nt, Mycobacterium avium subsp. paratuberculosis
acgaucgucuggccg

SEQ ID NO: 2916702 - RNA, 18 nt, Mycobacterium avium subsp. paratuberculosis
acgaucucccaacgcagc

SEQ ID NO: 2916703 - RNA, 15 nt, Mycobacterium avium subsp. paratuberculosis
acgaucucggcgguc

SEQ ID NO: 2916704 - RNA, 18 nt, Mycobacterium avium subsp. paratuberculosis
acgaucucguagguggcc

SEQ ID NO: 2916705 - RNA, 20 nt, Mycobacterium avium subsp. paratuberculosis
acgaucugcacacgggcccg

SEQ ID NO: 2916706 - RNA, 20 nt, Mycobacterium avium subsp. paratuberculosis
acgaucugcaggccgaggcu

SEQ ID NO: 2916707 - RNA, 23 nt, Mycobacterium avium subsp. paratuberculosis
acgaucuggcgcaucagcggggc

SEQ ID NO: 2916708 - RNA, 21 nt, Mycobacterium avium subsp. paratuberculosis
acgaucuugccgaacaggcgc

SEQ ID NO: 2916709 - RNA, 15 nt, Mycobacterium avium subsp. paratuberculosis
acgaugaaaccccag

SEQ ID NO: 2916710 - RNA, 17 nt, Mycobacterium avium subsp. paratuberculosis
acgaugaaaccccagcc

SEQ ID NO: 2916711 - RNA, 19 nt, Mycobacterium avium subsp. paratuberculosis
acgaugaacuccucgaucg

SEQ ID NO: 2916712 - RNA, 19 nt, Mycobacterium avium subsp. paratuberculosis
acgaugaagccgugcccgc

SEQ ID NO: 2916713 - RNA, 16 nt, Mycobacterium avium subsp. paratuberculosis
acgaugacgaccgggu

SEQ ID NO: 2916714 - RNA, 15 nt, Mycobacterium avium subsp. paratuberculosis
acgaugaugcccccg

SEQ ID NO: 2916715 - RNA, 16 nt, Mycobacterium avium subsp. paratuberculosis
acgaugaugcccccga

SEQ ID NO: 2916716 - RNA, 18 nt, Mycobacterium avium subsp. paratuberculosis
acgaugaugucgcccggc

SEQ ID NO: 2916717 - RNA, 18 nt, Mycobacterium avium subsp. paratuberculosis
acgaugaugucggccggc

SEQ ID NO: 2916718 - RNA, 12 nt, Mycobacterium avium subsp. paratuberculosis
acgaugcccguc

SEQ ID NO: 2916719 - RNA, 21 nt, Mycobacterium avium subsp. paratuberculosis
acgaugcccuuggccagcagu

SEQ ID NO: 2916720 - RNA, 14 nt, Mycobacterium avium subsp. paratuberculosis
acgaugccgcgcuc

SEQ ID NO: 2916721 - RNA, 16 nt, Mycobacterium avium subsp. paratuberculosis
acgaugccgcgcucga

SEQ ID NO: 2916722 - RNA, 16 nt, Mycobacterium avium subsp. paratuberculosis
acgaugccggcgucgu

SEQ ID NO: 2916723 - RNA, 12 nt, Mycobacterium avium subsp. paratuberculosis
acgaugccgggc

SEQ ID NO: 2916724 - RNA, 15 nt, Mycobacterium avium subsp. paratuberculosis
acgaugcgcaccccc

SEQ ID NO: 2916725 - RNA, 21 nt, Mycobacterium avium subsp. paratuberculosis
acgaugcgcugugcgggugag

SEQ ID NO: 2916726 - RNA, 14 nt, Mycobacterium avium subsp. paratuberculosis
acgaugcggccggc

SEQ ID NO: 2916727 - RNA, 19 nt, Mycobacterium avium subsp. paratuberculosis
acgaugcggccggcgggca

SEQ ID NO: 2916728 - RNA, 20 nt, Mycobacterium avium subsp. paratuberculosis
acgaugcggggccggcggcg

SEQ ID NO: 2916729 - RNA, 19 nt, Mycobacterium avium subsp. paratuberculosis
acgaugcugauacccgcgc

SEQ ID NO: 2916730 - RNA, 20 nt, Mycobacterium avium subsp. paratuberculosis
acgaugcugauacccgcgcg

SEQ ID NO: 2916731 - RNA, 23 nt, Mycobacterium avium subsp. paratuberculosis
acgaugcugauacccgcgcggcg

SEQ ID NO: 2916732 - RNA, 21 nt, Mycobacterium avium subsp. paratuberculosis
acgauggccaggcccagcccg

SEQ ID NO: 2916733 - RNA, 20 nt, Mycobacterium avium subsp. paratuberculosis
acgauggcccggaccgccgc

SEQ ID NO: 2916734 - RNA, 22 nt, Mycobacterium avium subsp. paratuberculosis
acgauggcccggaccgccgcgg

SEQ ID NO: 2916735 - RNA, 18 nt, Mycobacterium avium subsp. paratuberculosis
acgauggcgaccgcgcag

SEQ ID NO: 2916736 - RNA, 13 nt, Mycobacterium avium subsp. paratuberculosis
acgauggcgcggc

SEQ ID NO: 2916737 - RNA, 14 nt, Mycobacterium avium subsp. paratuberculosis
acgauggcgcggcg

SEQ ID NO: 2916738 - RNA, 16 nt, Mycobacterium avium subsp. paratuberculosis
acgauggcggcccaga

SEQ ID NO: 2916739 - RNA, 15 nt, Mycobacterium avium subsp. paratuberculosis
acgauggcguccacc

SEQ ID NO: 2916740 - RNA, 15 nt, Mycobacterium avium subsp. paratuberculosis
acgaugggccgcccg

SEQ ID NO: 2916741 - RNA, 18 nt, Mycobacterium avium subsp. paratuberculosis
acgaugggccgcccgcug

SEQ ID NO: 2916742 - RNA, 19 nt, Mycobacterium avium subsp. paratuberculosis
acgauggggacgucgacgu

SEQ ID NO: 2916743 - RNA, 23 nt, Mycobacterium avium subsp. paratuberculosis
acgaugggucaggucaaccaggc

SEQ ID NO: 2916744 - RNA, 19 nt, Mycobacterium avium subsp. paratuberculosis
acgaugguguaguccugcu

SEQ ID NO: 2916745 - RNA, 19 nt, Mycobacterium avium subsp. paratuberculosis
acgauguccgccggccggu

SEQ ID NO: 2916746 - RNA, 18 nt, Mycobacterium avium subsp. paratuberculosis
acgaugucgacccgcggc

SEQ ID NO: 2916747 - RNA, 20 nt, Mycobacterium avium subsp. paratuberculosis
acgaugucgaugacggcggc

SEQ ID NO: 2916748 - RNA, 18 nt, Mycobacterium avium subsp. paratuberculosis
acgauguugaugucgcgc

SEQ ID NO: 2916749 - RNA, 17 nt, Mycobacterium avium subsp. paratuberculosis
acgauguugggccaugc

SEQ ID NO: 2916750 - RNA, 19 nt, Mycobacterium avium subsp. paratuberculosis
acgauucacccagcgagcu

SEQ ID NO: 2916751 - RNA, 15 nt, Mycobacterium avium subsp. paratuberculosis
acgcaaaagccccgc

SEQ ID NO: 2916752 - RNA, 19 nt, Mycobacterium avium subsp. paratuberculosis
acgcaaaagccccgcgaca

SEQ ID NO: 2916753 - RNA, 21 nt, Mycobacterium avium subsp. paratuberculosis
acgcaaaagccccgcgacacg

SEQ ID NO: 2916754 - RNA, 15 nt, Mycobacterium avium subsp. paratuberculosis
acgcaaugcgucgcg

SEQ ID NO: 2916755 - RNA, 19 nt, Mycobacterium avium subsp. paratuberculosis
acgcaaugcgucgcggcgg

SEQ ID NO: 2916756 - RNA, 20 nt, Mycobacterium avium subsp. paratuberculosis
acgcaaugcgucgcggcggc

SEQ ID NO: 2916757 - RNA, 23 nt, Mycobacterium avium subsp. paratuberculosis
acgcaaugcgucgcggcggcgcu

SEQ ID NO: 2916758 - RNA, 23 nt, Mycobacterium avium subsp. paratuberculosis
acgcacaccaccgacgcgucgcg

SEQ ID NO: 2916759 - RNA, 16 nt, Mycobacterium avium subsp. paratuberculosis
acgcaccacgagcagc

SEQ ID NO: 2916760 - RNA, 20 nt, Mycobacterium avium subsp. paratuberculosis
acgcaccacgagcagccgau

SEQ ID NO: 2916761 - RNA, 16 nt, Mycobacterium avium subsp. paratuberculosis
acgcaccucgcucagc

SEQ ID NO: 2916762 - RNA, 16 nt, Mycobacterium avium subsp. paratuberculosis
acgcaccucggccggg

SEQ ID NO: 2916763 - RNA, 22 nt, Mycobacterium avium subsp. paratuberculosis
acgcaccucggccggguccugg

SEQ ID NO: 2916764 - RNA, 17 nt, Mycobacterium avium subsp. paratuberculosis
acgcacgaaaccgcgug

SEQ ID NO: 2916765 - RNA, 23 nt, Mycobacterium avium subsp. paratuberculosis
acgccaguucgucggccgucggc

SEQ ID NO: 2916766 - RNA, 15 nt, Mycobacterium avium subsp. paratuberculosis
acgccaucaccagcg

SEQ ID NO: 2916767 - RNA, 18 nt, Mycobacterium avium subsp. paratuberculosis
acgccaucaccagcgcgu

SEQ ID NO: 2916768 - RNA, 17 nt, Mycobacterium avium subsp. paratuberculosis
acgccaucgccucggcc

SEQ ID NO: 2916769 - RNA, 18 nt, Mycobacterium avium subsp. paratuberculosis
acgccaucgccucggcca

SEQ ID NO: 2916770 - RNA, 19 nt, Mycobacterium avium subsp. paratuberculosis
acgccaugaacucguccac

SEQ ID NO: 2916771 - RNA, 21 nt, Mycobacterium avium subsp. paratuberculosis
acgccaugaacucguccaccg

SEQ ID NO: 2916772 - RNA, 16 nt, Mycobacterium avium subsp. paratuberculosis
acgccaugggcccagc

SEQ ID NO: 2916773 - RNA, 15 nt, Mycobacterium avium subsp. paratuberculosis
acgccaugucgaugu

SEQ ID NO: 2916774 - RNA, 19 nt, Mycobacterium avium subsp. paratuberculosis
acgccaugucgaugucgac

SEQ ID NO: 2916775 - RNA, 20 nt, Mycobacterium avium subsp. paratuberculosis
acgccaugugccggcgcucg

SEQ ID NO: 2916776 - RNA, 22 nt, Mycobacterium avium subsp. paratuberculosis
acgccaugugccggcgcucguc

SEQ ID NO: 2916777 - RNA, 24 nt, Mycobacterium avium subsp. paratuberculosis
acgccaugugccggcgcucgucgu

SEQ ID NO: 2916778 - RNA, 12 nt, Mycobacterium avium subsp. paratuberculosis
acgcccaacuac

SEQ ID NO: 2916779 - RNA, 17 nt, Mycobacterium avium subsp. paratuberculosis
acgcccaacuacccgcc

SEQ ID NO: 2916780 - RNA, 21 nt, Mycobacterium avium subsp. paratuberculosis
acgcccaacuacccgccgacg

SEQ ID NO: 2916781 - RNA, 14 nt, Mycobacterium avium subsp. paratuberculosis
acgcccacagcgcc

SEQ ID NO: 2916782 - RNA, 18 nt, Mycobacterium avium subsp. paratuberculosis
acgcccacagcgccagca

SEQ ID NO: 2916783 - RNA, 14 nt, Mycobacterium avium subsp. paratuberculosis
acgcccacagcuga

SEQ ID NO: 2916784 - RNA, 23 nt, Mycobacterium avium subsp. paratuberculosis
acgcccacagcugacgggccggc

SEQ ID NO: 2916785 - RNA, 21 nt, Mycobacterium avium subsp. paratuberculosis
acgcccaccugguuggcccgc

SEQ ID NO: 2916786 - RNA, 22 nt, Mycobacterium avium subsp. paratuberculosis
acgcccaccugguuggcccgca

SEQ ID NO: 2916787 - RNA, 19 nt, Mycobacterium avium subsp. paratuberculosis
acgcccagaucgacgccga

SEQ ID NO: 2916788 - RNA, 12 nt, Mycobacterium avium subsp. paratuberculosis
acgcccagcccg

SEQ ID NO: 2916789 - RNA, 17 nt, Mycobacterium avium subsp. paratuberculosis
acgcccagcccgcgggc

SEQ ID NO: 2916790 - RNA, 20 nt, Mycobacterium avium subsp. paratuberculosis
acgcccagcccgcgggcggc

SEQ ID NO: 2916791 - RNA, 13 nt, Mycobacterium avium subsp. paratuberculosis
acgcccagcgccc

SEQ ID NO: 2916792 - RNA, 13 nt, Mycobacterium avium subsp. paratuberculosis
acgcccagcgcgg

SEQ ID NO: 2916793 - RNA, 15 nt, Mycobacterium avium subsp. paratuberculosis
acgcccagcgcggcg

SEQ ID NO: 2916794 - RNA, 13 nt, Mycobacterium avium subsp. paratuberculosis
acgcccaggcuca

SEQ ID NO: 2916795 - RNA, 13 nt, Mycobacterium avium subsp. paratuberculosis
acgcccaggugca

SEQ ID NO: 2916796 - RNA, 21 nt, Mycobacterium avium subsp. paratuberculosis
acgccccauugccgcgccggg

SEQ ID NO: 2916797 - RNA, 21 nt, Mycobacterium avium subsp. paratuberculosis
acgcccccgcuggcccggcgu

SEQ ID NO: 2916798 - RNA, 22 nt, Mycobacterium avium subsp. paratuberculosis
acgcccccgcuggcccggcguu

SEQ ID NO: 2916799 - RNA, 22 nt, Mycobacterium avium subsp. paratuberculosis
acgcccccggugacgauccggu

SEQ ID NO: 2916800 - RNA, 14 nt, Mycobacterium avium subsp. paratuberculosis
acgccccggcgucg

SEQ ID NO: 2916801 - RNA, 22 nt, Mycobacterium avium subsp. paratuberculosis
acgccccguggaucaucccgac

SEQ ID NO: 2916802 - RNA, 15 nt, Mycobacterium avium subsp. paratuberculosis
acgcccgacgacgac

SEQ ID NO: 2916803 - RNA, 15 nt, Mycobacterium avium subsp. paratuberculosis
acgcccgcaccacga

SEQ ID NO: 2916804 - RNA, 14 nt, Mycobacterium avium subsp. paratuberculosis
acgcccgcagcgca

SEQ ID NO: 2916805 - RNA, 15 nt, Mycobacterium avium subsp. paratuberculosis
acgcccgcgacccga

SEQ ID NO: 2916806 - RNA, 14 nt, Mycobacterium avium subsp. paratuberculosis
acgcccgcgaggug

SEQ ID NO: 2916807 - RNA, 19 nt, Mycobacterium avium subsp. paratuberculosis
acgcccgcgaggugucgac

SEQ ID NO: 2916808 - RNA, 15 nt, Mycobacterium avium subsp. paratuberculosis
acgcccgcgaucggc

SEQ ID NO: 2916809 - RNA, 13 nt, Mycobacterium avium subsp. paratuberculosis
acgcccgcucgau

SEQ ID NO: 2916810 - RNA, 21 nt, Mycobacterium avium subsp. paratuberculosis
acgcccggacccgcucgccga

SEQ ID NO: 2916811 - RNA, 12 nt, Mycobacterium avium subsp. paratuberculosis
acgcccggccac

SEQ ID NO: 2916812 - RNA, 16 nt, Mycobacterium avium subsp. paratuberculosis
acgcccggccaccugg

SEQ ID NO: 2916813 - RNA, 14 nt, Mycobacterium avium subsp. paratuberculosis
acgcccggcgagug

SEQ ID NO: 2916814 - RNA, 22 nt, Mycobacterium avium subsp. paratuberculosis
acgcccggcgaguggaagucag

SEQ ID NO: 2916815 - RNA, 17 nt, Mycobacterium avium subsp. paratuberculosis
acgcccggcgccggcgg

SEQ ID NO: 2916816 - RNA, 19 nt, Mycobacterium avium subsp. paratuberculosis
acgcccggguacaccgacu

SEQ ID NO: 2916817 - RNA, 13 nt, Mycobacterium avium subsp. paratuberculosis
acgcccggucgac

SEQ ID NO: 2916818 - RNA, 14 nt, Mycobacterium avium subsp. paratuberculosis
acgcccggucgacc

SEQ ID NO: 2916819 - RNA, 17 nt, Mycobacterium avium subsp. paratuberculosis
acgcccgucccgccgac

SEQ ID NO: 2916820 - RNA, 18 nt, Mycobacterium avium subsp. paratuberculosis
acgcccgucccugcgcgg

SEQ ID NO: 2916821 - RNA, 20 nt, Mycobacterium avium subsp. paratuberculosis
acgcccguucgagcgccgga

SEQ ID NO: 2916822 - RNA, 21 nt, Mycobacterium avium subsp. paratuberculosis
acgcccguucgagcgccggac

SEQ ID NO: 2916823 - RNA, 17 nt, Mycobacterium avium subsp. paratuberculosis
acgcccuagcgggccag

SEQ ID NO: 2916824 - RNA, 19 nt, Mycobacterium avium subsp. paratuberculosis
acgcccuagcgggccagga

SEQ ID NO: 2916825 - RNA, 13 nt, Mycobacterium avium subsp. paratuberculosis
acgcccuccuggc

SEQ ID NO: 2916826 - RNA, 21 nt, Mycobacterium avium subsp. paratuberculosis
acgcccucgucuuccgcggcg

SEQ ID NO: 2916827 - RNA, 14 nt, Mycobacterium avium subsp. paratuberculosis
acgcccugccacag

SEQ ID NO: 2916828 - RNA, 19 nt, Mycobacterium avium subsp. paratuberculosis
acgcccuggaaggcgauca

SEQ ID NO: 2916829 - RNA, 13 nt, Mycobacterium avium subsp. paratuberculosis
acgcccuggccgc

SEQ ID NO: 2916830 - RNA, 21 nt, Mycobacterium avium subsp. paratuberculosis
acgcccuggccgccggccgcg

SEQ ID NO: 2916831 - RNA, 19 nt, Mycobacterium avium subsp. paratuberculosis
acgcccuuggcgcccagcg

SEQ ID NO: 2916832 - RNA, 14 nt, Mycobacterium avium subsp. paratuberculosis
acgccgaacugccg

SEQ ID NO: 2916833 - RNA, 17 nt, Mycobacterium avium subsp. paratuberculosis
acgccgaacugccggac

SEQ ID NO: 2916834 - RNA, 18 nt, Mycobacterium avium subsp. paratuberculosis
acgccgaacugccggacc

SEQ ID NO: 2916835 - RNA, 20 nt, Mycobacterium avium subsp. paratuberculosis
acgccgaacugccggaccag

SEQ ID NO: 2916836 - RNA, 20 nt, Mycobacterium avium subsp. paratuberculosis
acgccgaagaucagcgcguc

SEQ ID NO: 2916837 - RNA, 21 nt, Mycobacterium avium subsp. paratuberculosis
acgccgaagaucagcgcgucc

SEQ ID NO: 2916838 - RNA, 18 nt, Mycobacterium avium subsp. paratuberculosis
acgccgaauccgggcaug

SEQ ID NO: 2916839 - RNA, 17 nt, Mycobacterium avium subsp. paratuberculosis
acgccgacaccagcgcg

SEQ ID NO: 2916840 - RNA, 16 nt, Mycobacterium avium subsp. paratuberculosis
acgccgacaccgucgc

SEQ ID NO: 2916841 - RNA, 12 nt, Mycobacterium avium subsp. paratuberculosis
acgccgacagcg

SEQ ID NO: 2916842 - RNA, 19 nt, Mycobacterium avium subsp. paratuberculosis
acgccgaccacccccagcc

SEQ ID NO: 2916843 - RNA, 16 nt, Mycobacterium avium subsp. paratuberculosis
acgccgaccagguccg

SEQ ID NO: 2916844 - RNA, 15 nt, Mycobacterium avium subsp. paratuberculosis
acgccgaccgcgguc

SEQ ID NO: 2916845 - RNA, 21 nt, Mycobacterium avium subsp. paratuberculosis
acgccgaccgcggucgcggcg

SEQ ID NO: 2916846 - RNA, 18 nt, Mycobacterium avium subsp. paratuberculosis
acgccgacgauccgcgcc

SEQ ID NO: 2916847 - RNA, 19 nt, Mycobacterium avium subsp. paratuberculosis
acgccgacgauccgcgccg

SEQ ID NO: 2916848 - RNA, 16 nt, Mycobacterium avium subsp. paratuberculosis
acgccgacgcccagcg

SEQ ID NO: 2916849 - RNA, 17 nt, Mycobacterium avium subsp. paratuberculosis
acgccgacgcccagcgc

SEQ ID NO: 2916850 - RNA, 12 nt, Mycobacterium avium subsp. paratuberculosis
acgccgcucggc

SEQ ID NO: 2916851 - RNA, 13 nt, Mycobacterium avium subsp. paratuberculosis
acgccgcucggcc

SEQ ID NO: 2916852 - RNA, 15 nt, Mycobacterium avium subsp. paratuberculosis
acgccgcucggccag

SEQ ID NO: 2916853 - RNA, 21 nt, Mycobacterium avium subsp. paratuberculosis
acgccgcucggccagcgcagc

SEQ ID NO: 2916854 - RNA, 17 nt, Mycobacterium avium subsp. paratuberculosis
acgccgcucgucgggca

SEQ ID NO: 2916855 - RNA, 13 nt, Mycobacterium avium subsp. paratuberculosis
acgccggacagcu

SEQ ID NO: 2916856 - RNA, 12 nt, Mycobacterium avium subsp. paratuberculosis
acgccggacccc

SEQ ID NO: 2916857 - RNA, 14 nt, Mycobacterium avium subsp. paratuberculosis
acgccggaccccac

SEQ ID NO: 2916858 - RNA, 22 nt, Mycobacterium avium subsp. paratuberculosis
acgccggaccccacagcgcgcc

SEQ ID NO: 2916859 - RNA, 12 nt, Mycobacterium avium subsp. paratuberculosis
acgccggacgug

SEQ ID NO: 2916860 - RNA, 19 nt, Mycobacterium avium subsp. paratuberculosis
acgccggauuggcgucggu

SEQ ID NO: 2916861 - RNA, 22 nt, Mycobacterium avium subsp. paratuberculosis
acgccggauuggcgucgguggc

SEQ ID NO: 2916862 - RNA, 20 nt, Mycobacterium avium subsp. paratuberculosis
acgccggcaucagcgagacg

SEQ ID NO: 2916863 - RNA, 14 nt, Mycobacterium avium subsp. paratuberculosis
acgccggccccggc

SEQ ID NO: 2916864 - RNA, 17 nt, Mycobacterium avium subsp. paratuberculosis
acgccggccccggcgac

SEQ ID NO: 2916865 - RNA, 19 nt, Mycobacterium avium subsp. paratuberculosis
acgccggccccggcgacgg

SEQ ID NO: 2916866 - RNA, 13 nt, Mycobacterium avium subsp. paratuberculosis
acgccggccggcg

SEQ ID NO: 2916867 - RNA, 14 nt, Mycobacterium avium subsp. paratuberculosis
acgccggccggcgu

SEQ ID NO: 2916868 - RNA, 19 nt, Mycobacterium avium subsp. paratuberculosis
acgccggccguucgccggc

SEQ ID NO: 2916869 - RNA, 22 nt, Mycobacterium avium subsp. paratuberculosis
acgccggccguucgccggccag

SEQ ID NO: 2916870 - RNA, 12 nt, Mycobacterium avium subsp. paratuberculosis
acgccggccucu

SEQ ID NO: 2916871 - RNA, 18 nt, Mycobacterium avium subsp. paratuberculosis
acgccggccucucgucga

SEQ ID NO: 2916872 - RNA, 15 nt, Mycobacterium avium subsp. paratuberculosis
acgccgggcagcgcg

SEQ ID NO: 2916873 - RNA, 16 nt, Mycobacterium avium subsp. paratuberculosis
acgccgggcagcgcgc

SEQ ID NO: 2916874 - RNA, 17 nt, Mycobacterium avium subsp. paratuberculosis
acgccgggcagcgcgcg

SEQ ID NO: 2916875 - RNA, 12 nt, Mycobacterium avium subsp. paratuberculosis
acgccgggccgc

SEQ ID NO: 2916876 - RNA, 18 nt, Mycobacterium avium subsp. paratuberculosis
acgccgggccgccgcggc

SEQ ID NO: 2916877 - RNA, 19 nt, Mycobacterium avium subsp. paratuberculosis
acgccgggccgccgcggcc

SEQ ID NO: 2916878 - RNA, 15 nt, Mycobacterium avium subsp. paratuberculosis
acgccgggcgcccgc

SEQ ID NO: 2916879 - RNA, 15 nt, Mycobacterium avium subsp. paratuberculosis
acgccgggguagagg

SEQ ID NO: 2916880 - RNA, 21 nt, Mycobacterium avium subsp. paratuberculosis
acgccgggguagaggccgcgg

SEQ ID NO: 2916881 - RNA, 18 nt, Mycobacterium avium subsp. paratuberculosis
acgccgggucccagugcc

SEQ ID NO: 2916882 - RNA, 14 nt, Mycobacterium avium subsp. paratuberculosis
acgccgggucgacg

SEQ ID NO: 2916883 - RNA, 21 nt, Mycobacterium avium subsp. paratuberculosis
acgccgggucgacgccgagua

SEQ ID NO: 2916884 - RNA, 23 nt, Mycobacterium avium subsp. paratuberculosis
acgccggguugggcggcggccac

SEQ ID NO: 2916885 - RNA, 16 nt, Mycobacterium avium subsp. paratuberculosis
acgccggguuuguccg

SEQ ID NO: 2916886 - RNA, 21 nt, Mycobacterium avium subsp. paratuberculosis
acgccggguuuguccggccag

SEQ ID NO: 2916887 - RNA, 23 nt, Mycobacterium avium subsp. paratuberculosis
acgccggguuuguccggccaggu

SEQ ID NO: 2916888 - RNA, 16 nt, Mycobacterium avium subsp. paratuberculosis
acgccgguagccgcuc

SEQ ID NO: 2916889 - RNA, 19 nt, Mycobacterium avium subsp. paratuberculosis
acgccgguagccgcucgcc

SEQ ID NO: 2916890 - RNA, 23 nt, Mycobacterium avium subsp. paratuberculosis
acgccgguagccgcucgcccagc

SEQ ID NO: 2916891 - RNA, 20 nt, Mycobacterium avium subsp. paratuberculosis
acgccggucagcaccauggc

SEQ ID NO: 2916892 - RNA, 23 nt, Mycobacterium avium subsp. paratuberculosis
acgccggucagcaccauggcguc

SEQ ID NO: 2916893 - RNA, 21 nt, Mycobacterium avium subsp. paratuberculosis
acgccggucucgaacacgccg

SEQ ID NO: 2916894 - RNA, 12 nt, Mycobacterium avium subsp. paratuberculosis
acgccggugacc

SEQ ID NO: 2916895 - RNA, 23 nt, Mycobacterium avium subsp. paratuberculosis
acgccggugagcacgaccgccag

SEQ ID NO: 2916896 - RNA, 14 nt, Mycobacterium avium subsp. paratuberculosis
acgccggugaggug

SEQ ID NO: 2916897 - RNA, 16 nt, Mycobacterium avium subsp. paratuberculosis
acgccgguggacaggu

SEQ ID NO: 2916898 - RNA, 16 nt, Mycobacterium avium subsp. paratuberculosis
acgccguacccgaagc

SEQ ID NO: 2916899 - RNA, 20 nt, Mycobacterium avium subsp. paratuberculosis
acgccguagaucacgccggu

SEQ ID NO: 2916900 - RNA, 21 nt, Mycobacterium avium subsp. paratuberculosis
acgccguagaucacgccggug

SEQ ID NO: 2916901 - RNA, 16 nt, Mycobacterium avium subsp. paratuberculosis
acgccguauucgccga

SEQ ID NO: 2916902 - RNA, 19 nt, Mycobacterium avium subsp. paratuberculosis
acgccguauucgccgacgg

SEQ ID NO: 2916903 - RNA, 14 nt, Mycobacterium avium subsp. paratuberculosis
acgccguccgacgu

SEQ ID NO: 2916904 - RNA, 15 nt, Mycobacterium avium subsp. paratuberculosis
acgccguccuuggcc

SEQ ID NO: 2916905 - RNA, 20 nt, Mycobacterium avium subsp. paratuberculosis
acgccgucgacgaucugcac

SEQ ID NO: 2916906 - RNA, 13 nt, Mycobacterium avium subsp. paratuberculosis
acgccgucgucgu

SEQ ID NO: 2916907 - RNA, 20 nt, Mycobacterium avium subsp. paratuberculosis
acgccgucgugcucggcgag

SEQ ID NO: 2916908 - RNA, 22 nt, Mycobacterium avium subsp. paratuberculosis
acgccgucgugcucggcgagca

SEQ ID NO: 2916909 - RNA, 23 nt, Mycobacterium avium subsp. paratuberculosis
acgccgucgugcucggcgagcac

SEQ ID NO: 2916910 - RNA, 13 nt, Mycobacterium avium subsp. paratuberculosis
acgccgucugguc

SEQ ID NO: 2916911 - RNA, 14 nt, Mycobacterium avium subsp. paratuberculosis
acgccgugcccggc

SEQ ID NO: 2916912 - RNA, 16 nt, Mycobacterium avium subsp. paratuberculosis
acgccgugcccggcgc

SEQ ID NO: 2916913 - RNA, 20 nt, Mycobacterium avium subsp. paratuberculosis
acgccgugcccggcgcccug

SEQ ID NO: 2916914 - RNA, 16 nt, Mycobacterium avium subsp. paratuberculosis
acgccguggcccgccc

SEQ ID NO: 2916915 - RNA, 19 nt, Mycobacterium avium subsp. paratuberculosis
acgccguggcccgcccagc

SEQ ID NO: 2916916 - RNA, 21 nt, Mycobacterium avium subsp. paratuberculosis
acgccguggcccgcccagcgc

SEQ ID NO: 2916917 - RNA, 22 nt, Mycobacterium avium subsp. paratuberculosis
acgccguggcccgcccagcgca

SEQ ID NO: 2916918 - RNA, 17 nt, Mycobacterium avium subsp. paratuberculosis
acgccguggcggcgggc

SEQ ID NO: 2916919 - RNA, 17 nt, Mycobacterium avium subsp. paratuberculosis
acgccgugguccagccg

SEQ ID NO: 2916920 - RNA, 18 nt, Mycobacterium avium subsp. paratuberculosis
acgccguugacaccgggu

SEQ ID NO: 2916921 - RNA, 21 nt, Mycobacterium avium subsp. paratuberculosis
acgccguugacaccgggugcg

SEQ ID NO: 2916922 - RNA, 21 nt, Mycobacterium avium subsp. paratuberculosis
acgccguugaccccgacggcg

SEQ ID NO: 2916923 - RNA, 22 nt, Mycobacterium avium subsp. paratuberculosis
acgccguugaccccgacggcgc

SEQ ID NO: 2916924 - RNA, 17 nt, Mycobacterium avium subsp. paratuberculosis
acgccucaccccagcgc

SEQ ID NO: 2916925 - RNA, 19 nt, Mycobacterium avium subsp. paratuberculosis
acgccucaccccagcgcga

SEQ ID NO: 2916926 - RNA, 21 nt, Mycobacterium avium subsp. paratuberculosis
acgccucaccccagcgcgacc

SEQ ID NO: 2916927 - RNA, 18 nt, Mycobacterium avium subsp. paratuberculosis
acgccucaggcgagcacc

SEQ ID NO: 2916928 - RNA, 15 nt, Mycobacterium avium subsp. paratuberculosis
acgccuccacauacg

SEQ ID NO: 2916929 - RNA, 19 nt, Mycobacterium avium subsp. paratuberculosis
acgccuccacauacgcggc

SEQ ID NO: 2916930 - RNA, 20 nt, Mycobacterium avium subsp. paratuberculosis
acgccuccacauacgcggcg

SEQ ID NO: 2916931 - RNA, 21 nt, Mycobacterium avium subsp. paratuberculosis
acgccuccacauacgcggcgg

SEQ ID NO: 2916932 - RNA, 21 nt, Mycobacterium avium subsp. paratuberculosis
acgccucccccacccgcacgg

SEQ ID NO: 2916933 - RNA, 22 nt, Mycobacterium avium subsp. paratuberculosis
acgccucccccacccgcacggu

SEQ ID NO: 2916934 - RNA, 18 nt, Mycobacterium avium subsp. paratuberculosis
acgccuccgaauccagcg

SEQ ID NO: 2916935 - RNA, 23 nt, Mycobacterium avium subsp. paratuberculosis
acgccuccgaauccagcgcgccg

SEQ ID NO: 2916936 - RNA, 13 nt, Mycobacterium avium subsp. paratuberculosis
acgccuccggcag

SEQ ID NO: 2916937 - RNA, 15 nt, Mycobacterium avium subsp. paratuberculosis
acgccucgagcgccc

SEQ ID NO: 2916938 - RNA, 18 nt, Mycobacterium avium subsp. paratuberculosis
acgccucgcgcagcgcgu

SEQ ID NO: 2916939 - RNA, 13 nt, Mycobacterium avium subsp. paratuberculosis
acgccucggcgag

SEQ ID NO: 2916940 - RNA, 14 nt, Mycobacterium avium subsp. paratuberculosis
acgccucggcgagc

SEQ ID NO: 2916941 - RNA, 19 nt, Mycobacterium avium subsp. paratuberculosis
acgccucggcgagccgcuc

SEQ ID NO: 2916942 - RNA, 14 nt, Mycobacterium avium subsp. paratuberculosis
acgccucgggccgg

SEQ ID NO: 2916943 - RNA, 15 nt, Mycobacterium avium subsp. paratuberculosis
acgccucgggccggc

SEQ ID NO: 2916944 - RNA, 13 nt, Mycobacterium avium subsp. paratuberculosis
acgccucggugcg

SEQ ID NO: 2916945 - RNA, 19 nt, Mycobacterium avium subsp. paratuberculosis
acgccucgguggucgacga

SEQ ID NO: 2916946 - RNA, 14 nt, Mycobacterium avium subsp. paratuberculosis
acgccucgucgacc

SEQ ID NO: 2916947 - RNA, 20 nt, Mycobacterium avium subsp. paratuberculosis
acgccucgucgaccgcggcc

SEQ ID NO: 2916948 - RNA, 16 nt, Mycobacterium avium subsp. paratuberculosis
acgccucgucgagcag

SEQ ID NO: 2916949 - RNA, 14 nt, Mycobacterium avium subsp. paratuberculosis
acgccugcaccuug

SEQ ID NO: 2916950 - RNA, 20 nt, Mycobacterium avium subsp. paratuberculosis
acgccugcaccuugcccguc

SEQ ID NO: 2916951 - RNA, 15 nt, Mycobacterium avium subsp. paratuberculosis
acgccugccggcgcc

SEQ ID NO: 2916952 - RNA, 13 nt, Mycobacterium avium subsp. paratuberculosis
acgccugcgccgc

SEQ ID NO: 2916953 - RNA, 22 nt, Mycobacterium avium subsp. paratuberculosis
acgccugcgcgaacagcgaagc

SEQ ID NO: 2916954 - RNA, 17 nt, Mycobacterium avium subsp. paratuberculosis
acgccugcggcccagcg

SEQ ID NO: 2916955 - RNA, 21 nt, Mycobacterium avium subsp. paratuberculosis
acgccuggacagggucguuca

SEQ ID NO: 2916956 - RNA, 23 nt, Mycobacterium avium subsp. paratuberculosis
acgccuggacagggucguucagc

SEQ ID NO: 2916957 - RNA, 20 nt, Mycobacterium avium subsp. paratuberculosis
acgccuggcggaaggccgcg

SEQ ID NO: 2916958 - RNA, 22 nt, Mycobacterium avium subsp. paratuberculosis
acgccuggcggaaggccgcgcg

SEQ ID NO: 2916959 - RNA, 19 nt, Mycobacterium avium subsp. paratuberculosis
acgccuuacaaagccgguc

SEQ ID NO: 2916960 - RNA, 20 nt, Mycobacterium avium subsp. paratuberculosis
acgccuugaccgccuuggcc

SEQ ID NO: 2916961 - RNA, 13 nt, Mycobacterium avium subsp. paratuberculosis
acgccuuggugcc

SEQ ID NO: 2916962 - RNA, 15 nt, Mycobacterium avium subsp. paratuberculosis
acgcgaaagcagcgu

SEQ ID NO: 2916963 - RNA, 20 nt, Mycobacterium avium subsp. paratuberculosis
acgcgaacaccagaugccgc

SEQ ID NO: 2916964 - RNA, 22 nt, Mycobacterium avium subsp. paratuberculosis
acgcgaacaccagaugccgcuc

SEQ ID NO: 2916965 - RNA, 13 nt, Mycobacterium avium subsp. paratuberculosis
acgcgaacccaca

SEQ ID NO: 2916966 - RNA, 16 nt, Mycobacterium avium subsp. paratuberculosis
acgcgaacggguagcc

SEQ ID NO: 2916967 - RNA, 17 nt, Mycobacterium avium subsp. paratuberculosis
acgcgaaguccgacgag

SEQ ID NO: 2916968 - RNA, 15 nt, Mycobacterium avium subsp. paratuberculosis
acgcgaagucgccgc

SEQ ID NO: 2916969 - RNA, 16 nt, Mycobacterium avium subsp. paratuberculosis
acgcgaaugucgacca

SEQ ID NO: 2916970 - RNA, 13 nt, Mycobacterium avium subsp. paratuberculosis
acgcgaccaggcc

SEQ ID NO: 2916971 - RNA, 14 nt, Mycobacterium avium subsp. paratuberculosis
acgcgaccaggccc

SEQ ID NO: 2916972 - RNA, 17 nt, Mycobacterium avium subsp. paratuberculosis
acgcgaccaggcccagc

SEQ ID NO: 2916973 - RNA, 17 nt, Mycobacterium avium subsp. paratuberculosis
acgcgaccgaggucgac

SEQ ID NO: 2916974 - RNA, 17 nt, Mycobacterium avium subsp. paratuberculosis
acgcgaccgcgcggcga

SEQ ID NO: 2916975 - RNA, 16 nt, Mycobacterium avium subsp. paratuberculosis
acgcgaccgcgucgac

SEQ ID NO: 2916976 - RNA, 17 nt, Mycobacterium avium subsp. paratuberculosis
acgcgaccgcgucgacg

SEQ ID NO: 2916977 - RNA, 15 nt, Mycobacterium avium subsp. paratuberculosis
acgcgaccgucggga

SEQ ID NO: 2916978 - RNA, 22 nt, Mycobacterium avium subsp. paratuberculosis
acgcgaccgucgggacggccag

SEQ ID NO: 2916979 - RNA, 23 nt, Mycobacterium avium subsp. paratuberculosis
acgcgaccgucgggacggccagc

SEQ ID NO: 2916980 - RNA, 22 nt, Mycobacterium avium subsp. paratuberculosis
acgcgaccugcaucucgacccg

SEQ ID NO: 2916981 - RNA, 22 nt, Mycobacterium avium subsp. paratuberculosis
acgcgaccuguuugaacaccuc

SEQ ID NO: 2916982 - RNA, 18 nt, Mycobacterium avium subsp. paratuberculosis
acgcgacgaaccgccaca

SEQ ID NO: 2916983 - RNA, 20 nt, Mycobacterium avium subsp. paratuberculosis
acgcgacgaaccgccacacg

SEQ ID NO: 2916984 - RNA, 21 nt, Mycobacterium avium subsp. paratuberculosis
acgcgacgaagcggucgcgga

SEQ ID NO: 2916985 - RNA, 14 nt, Mycobacterium avium subsp. paratuberculosis
acgcgacgaucagc

SEQ ID NO: 2916986 - RNA, 22 nt, Mycobacterium avium subsp. paratuberculosis
acgcgacgaucagcagccgggc

SEQ ID NO: 2916987 - RNA, 14 nt, Mycobacterium avium subsp. paratuberculosis
acgcgacgcgcucg

SEQ ID NO: 2916988 - RNA, 16 nt, Mycobacterium avium subsp. paratuberculosis
acgcgacgcgcucggc

SEQ ID NO: 2916989 - RNA, 13 nt, Mycobacterium avium subsp. paratuberculosis
acgcgacggcccg

SEQ ID NO: 2916990 - RNA, 19 nt, Mycobacterium avium subsp. paratuberculosis
acgcgacggcccgguccag

SEQ ID NO: 2916991 - RNA, 21 nt, Mycobacterium avium subsp. paratuberculosis
acgcgacgggcaugccgucgg

SEQ ID NO: 2916992 - RNA, 23 nt, Mycobacterium avium subsp. paratuberculosis
acgcgacgggcaugccgucggcg

SEQ ID NO: 2916993 - RNA, 16 nt, Mycobacterium avium subsp. paratuberculosis
acgcgacggucgugcu

SEQ ID NO: 2916994 - RNA, 17 nt, Mycobacterium avium subsp. paratuberculosis
acgcgacgguggcggcg

SEQ ID NO: 2916995 - RNA, 18 nt, Mycobacterium avium subsp. paratuberculosis
acgcgacgguggcggcga

SEQ ID NO: 2916996 - RNA, 21 nt, Mycobacterium avium subsp. paratuberculosis
acgcgacgguggcggcgaugu

SEQ ID NO: 2916997 - RNA, 16 nt, Mycobacterium avium subsp. paratuberculosis
acgcgagacgagccgc

SEQ ID NO: 2916998 - RNA, 24 nt, Mycobacterium avium subsp. paratuberculosis
acgcgagacgagccgccgcggguc

SEQ ID NO: 2916999 - RNA, 14 nt, Mycobacterium avium subsp. paratuberculosis
acgcgagcggacgg

SEQ ID NO: 2917000 - RNA, 13 nt, Mycobacterium avium subsp. paratuberculosis
acgcgagcugcuu

SEQ ID NO: 2917001 - RNA, 16 nt, Mycobacterium avium subsp. paratuberculosis
acgcgagcugcuucgu

SEQ ID NO: 2917002 - RNA, 18 nt, Mycobacterium avium subsp. paratuberculosis
acgcgagcugcuucgucg

SEQ ID NO: 2917003 - RNA, 23 nt, Mycobacterium avium subsp. paratuberculosis
acgcgauagaccucacggucggc

SEQ ID NO: 2917004 - RNA, 20 nt, Mycobacterium avium subsp. paratuberculosis
acgcgaucagguccggaauc

SEQ ID NO: 2917005 - RNA, 16 nt, Mycobacterium avium subsp. paratuberculosis
acgcgaugaucagcuc

SEQ ID NO: 2917006 - RNA, 16 nt, Mycobacterium avium subsp. paratuberculosis
acgcgauggcgcuggc

SEQ ID NO: 2917007 - RNA, 19 nt, Mycobacterium avium subsp. paratuberculosis
acgcgauggcgcuggccgc

SEQ ID NO: 2917008 - RNA, 14 nt, Mycobacterium avium subsp. paratuberculosis
acgcgauggcggcg

SEQ ID NO: 2917009 - RNA, 20 nt, Mycobacterium avium subsp. paratuberculosis
acgcgauucucgcugcggcg

SEQ ID NO: 2917010 - RNA, 21 nt, Mycobacterium avium subsp. paratuberculosis
acgcgauucucgcugcggcgc

SEQ ID NO: 2917011 - RNA, 18 nt, Mycobacterium avium subsp. paratuberculosis
acgcgcaauccugcccgg

SEQ ID NO: 2917012 - RNA, 23 nt, Mycobacterium avium subsp. paratuberculosis
acgcgcacaacagccaugccggu

SEQ ID NO: 2917013 - RNA, 23 nt, Mycobacterium avium subsp. paratuberculosis
acgcgcacacggccucgcccagc

SEQ ID NO: 2917014 - RNA, 20 nt, Mycobacterium avium subsp. paratuberculosis
acgcgcacaucacgguggcc

SEQ ID NO: 2917015 - RNA, 22 nt, Mycobacterium avium subsp. paratuberculosis
acgcgcacaucacgguggccgc

SEQ ID NO: 2917016 - RNA, 15 nt, Mycobacterium avium subsp. paratuberculosis
acgcgcaccagggcc

SEQ ID NO: 2917017 - RNA, 19 nt, Mycobacterium avium subsp. paratuberculosis
acgcgcaccagggccgcga

SEQ ID NO: 2917018 - RNA, 24 nt, Mycobacterium avium subsp. paratuberculosis
acgcggaccuuggugucggcgagc

SEQ ID NO: 2917019 - RNA, 16 nt, Mycobacterium avium subsp. paratuberculosis
acgcggauagcccagc

SEQ ID NO: 2917020 - RNA, 22 nt, Mycobacterium avium subsp. paratuberculosis
acgcggaucgcgcugaccaggc

SEQ ID NO: 2917021 - RNA, 19 nt, Mycobacterium avium subsp. paratuberculosis
acgcggaucgguggacgcg

SEQ ID NO: 2917022 - RNA, 22 nt, Mycobacterium avium subsp. paratuberculosis
acgcggaucgguggacgcgguc

SEQ ID NO: 2917023 - RNA, 12 nt, Mycobacterium avium subsp. paratuberculosis
acgcggcacgcc

SEQ ID NO: 2917024 - RNA, 16 nt, Mycobacterium avium subsp. paratuberculosis
acgcggcacgccgcuc

SEQ ID NO: 2917025 - RNA, 18 nt, Mycobacterium avium subsp. paratuberculosis
acgcggcacgccgcucgu

SEQ ID NO: 2917026 - RNA, 19 nt, Mycobacterium avium subsp. paratuberculosis
acgcggcacgccgcucguc

SEQ ID NO: 2917027 - RNA, 17 nt, Mycobacterium avium subsp. paratuberculosis
acgcggcaugaccggcc

SEQ ID NO: 2917028 - RNA, 18 nt, Mycobacterium avium subsp. paratuberculosis
acgcggcaugaccggcca

SEQ ID NO: 2917029 - RNA, 19 nt, Mycobacterium avium subsp. paratuberculosis
acgcggccaccaccgcauc

SEQ ID NO: 2917030 - RNA, 14 nt, Mycobacterium avium subsp. paratuberculosis
acgcggccagcgcc

SEQ ID NO: 2917031 - RNA, 17 nt, Mycobacterium avium subsp. paratuberculosis
acgcggccagcgcccgc

SEQ ID NO: 2917032 - RNA, 21 nt, Mycobacterium avium subsp. paratuberculosis
acgcggccagcgcccgcgcga

SEQ ID NO: 2917033 - RNA, 13 nt, Mycobacterium avium subsp. paratuberculosis
acgcggccagcgg

SEQ ID NO: 2917034 - RNA, 20 nt, Mycobacterium avium subsp. paratuberculosis
acgcggccagcgggccguug

SEQ ID NO: 2917035 - RNA, 22 nt, Mycobacterium avium subsp. paratuberculosis
acgcggccgccagcgcaccgag

SEQ ID NO: 2917036 - RNA, 13 nt, Mycobacterium avium subsp. paratuberculosis
acgcggccgccau

SEQ ID NO: 2917037 - RNA, 14 nt, Mycobacterium avium subsp. paratuberculosis
acgcggccgccauc

SEQ ID NO: 2917038 - RNA, 16 nt, Mycobacterium avium subsp. paratuberculosis
acgcggccgccaucga

SEQ ID NO: 2917039 - RNA, 18 nt, Mycobacterium avium subsp. paratuberculosis
acgcggccgcgccggccg

SEQ ID NO: 2917040 - RNA, 21 nt, Mycobacterium avium subsp. paratuberculosis
acgcggccgcgccggccggac

SEQ ID NO: 2917041 - RNA, 12 nt, Mycobacterium avium subsp. paratuberculosis
acgcggccucga

SEQ ID NO: 2917042 - RNA, 19 nt, Mycobacterium avium subsp. paratuberculosis
acgcggcgaacaccucggc

SEQ ID NO: 2917043 - RNA, 19 nt, Mycobacterium avium subsp. paratuberculosis
acgcggcgaagcaggccag

SEQ ID NO: 2917044 - RNA, 17 nt, Mycobacterium avium subsp. paratuberculosis
acgcggcgaaggccagc

SEQ ID NO: 2917045 - RNA, 19 nt, Mycobacterium avium subsp. paratuberculosis
acgcggcgaaggccagcga

SEQ ID NO: 2917046 - RNA, 19 nt, Mycobacterium avium subsp. paratuberculosis
acgcggcgaccaccaccgc

SEQ ID NO: 2917047 - RNA, 22 nt, Mycobacterium avium subsp. paratuberculosis
acgcggcgaccaccaccgccca

SEQ ID NO: 2917048 - RNA, 23 nt, Mycobacterium avium subsp. paratuberculosis
acgcggcgaccaccaccgcccac

SEQ ID NO: 2917049 - RNA, 17 nt, Mycobacterium avium subsp. paratuberculosis
acgcggcgccgacgucc

SEQ ID NO: 2917050 - RNA, 12 nt, Mycobacterium avium subsp. paratuberculosis
acgcggcgccgg

SEQ ID NO: 2917051 - RNA, 13 nt, Mycobacterium avium subsp. paratuberculosis
acgcggcgccggu

SEQ ID NO: 2917052 - RNA, 15 nt, Mycobacterium avium subsp. paratuberculosis
acgcggcgcgacacc

SEQ ID NO: 2917053 - RNA, 21 nt, Mycobacterium avium subsp. paratuberculosis
acgcggcgcgacaccgcggcg

SEQ ID NO: 2917054 - RNA, 23 nt, Mycobacterium avium subsp. paratuberculosis
acgcggcgcgacaccgcggcgac

SEQ ID NO: 2917055 - RNA, 18 nt, Mycobacterium avium subsp. paratuberculosis
acgcggcgcgcgauggac

SEQ ID NO: 2917056 - RNA, 14 nt, Mycobacterium avium subsp. paratuberculosis
acgcggcggacgau

SEQ ID NO: 2917057 - RNA, 20 nt, Mycobacterium avium subsp. paratuberculosis
acgcggcggccgacagcgcg

SEQ ID NO: 2917058 - RNA, 17 nt, Mycobacterium avium subsp. paratuberculosis
acgcggcggccugcgcg

SEQ ID NO: 2917059 - RNA, 19 nt, Mycobacterium avium subsp. paratuberculosis
acgcggcggccuggccguc

SEQ ID NO: 2917060 - RNA, 13 nt, Mycobacterium avium subsp. paratuberculosis
acgcggcggcggu

SEQ ID NO: 2917061 - RNA, 22 nt, Mycobacterium avium subsp. paratuberculosis
acgcggcgggcauaccgucugc

SEQ ID NO: 2917062 - RNA, 15 nt, Mycobacterium avium subsp. paratuberculosis
acgcggcgucgggcg

SEQ ID NO: 2917063 - RNA, 16 nt, Mycobacterium avium subsp. paratuberculosis
acgcggcguugccgcc

SEQ ID NO: 2917064 - RNA, 17 nt, Mycobacterium avium subsp. paratuberculosis
acgcggcguugccgccg

SEQ ID NO: 2917065 - RNA, 19 nt, Mycobacterium avium subsp. paratuberculosis
acgcggcguugccgccggc

SEQ ID NO: 2917066 - RNA, 23 nt, Mycobacterium avium subsp. paratuberculosis
acgcggcguugccgccggcgcgg

SEQ ID NO: 2917067 - RNA, 20 nt, Mycobacterium avium subsp. paratuberculosis
acgcggcugaucagccggcg

SEQ ID NO: 2917068 - RNA, 16 nt, Mycobacterium avium subsp. paratuberculosis
acgcggcuggcccggc

SEQ ID NO: 2917069 - RNA, 22 nt, Mycobacterium avium subsp. paratuberculosis
acgcggcuggcccggcgcggcg

SEQ ID NO: 2917070 - RNA, 23 nt, Mycobacterium avium subsp. paratuberculosis
acgcggcuucauaugacgccggc

SEQ ID NO: 2917071 - RNA, 19 nt, Mycobacterium avium subsp. paratuberculosis
acgcgggaccgggcccggc

SEQ ID NO: 2917072 - RNA, 22 nt, Mycobacterium avium subsp. paratuberculosis
acgcgggaccgggcccggcgcc

SEQ ID NO: 2917073 - RNA, 23 nt, Mycobacterium avium subsp. paratuberculosis
acgcgggaccgggcccggcgcca

SEQ ID NO: 2917074 - RNA, 14 nt, Mycobacterium avium subsp. paratuberculosis
acgcgggccggcac

SEQ ID NO: 2917075 - RNA, 18 nt, Mycobacterium avium subsp. paratuberculosis
acgcgggccggcacccgg

SEQ ID NO: 2917076 - RNA, 15 nt, Mycobacterium avium subsp. paratuberculosis
acgcgggcgcccagc

SEQ ID NO: 2917077 - RNA, 16 nt, Mycobacterium avium subsp. paratuberculosis
acgcgggcgcccagca

SEQ ID NO: 2917078 - RNA, 23 nt, Mycobacterium avium subsp. paratuberculosis
acgcggggaaguaguaccccggg

SEQ ID NO: 2917079 - RNA, 13 nt, Mycobacterium avium subsp. paratuberculosis
acgcggggcggcg

SEQ ID NO: 2917080 - RNA, 15 nt, Mycobacterium avium subsp. paratuberculosis
acgcggggcggcggc

SEQ ID NO: 2917081 - RNA, 16 nt, Mycobacterium avium subsp. paratuberculosis
acgcggggcggcggcg

SEQ ID NO: 2917082 - RNA, 18 nt, Mycobacterium avium subsp. paratuberculosis
acgcggggcggcggcgcc

SEQ ID NO: 2917083 - RNA, 20 nt, Mycobacterium avium subsp. paratuberculosis
acgcggggcggcggcgccgg

SEQ ID NO: 2917084 - RNA, 22 nt, Mycobacterium avium subsp. paratuberculosis
acgcggggcggcggcgccgggg

SEQ ID NO: 2917085 - RNA, 17 nt, Mycobacterium avium subsp. paratuberculosis
acgcggucaccggcucg

SEQ ID NO: 2917086 - RNA, 22 nt, Mycobacterium avium subsp. paratuberculosis
acgcgguccacuuccgcgcagg

SEQ ID NO: 2917087 - RNA, 13 nt, Mycobacterium avium subsp. paratuberculosis
acgcggucgccgc

SEQ ID NO: 2917088 - RNA, 20 nt, Mycobacterium avium subsp. paratuberculosis
acgcggucgccgcccacgcc

SEQ ID NO: 2917089 - RNA, 20 nt, Mycobacterium avium subsp. paratuberculosis
acgcggucugcggugcgccc

SEQ ID NO: 2917090 - RNA, 21 nt, Mycobacterium avium subsp. paratuberculosis
acgcggucugcggugcgccca

SEQ ID NO: 2917091 - RNA, 23 nt, Mycobacterium avium subsp. paratuberculosis
acgcggugacaugcccgggcucg

SEQ ID NO: 2917092 - RNA, 19 nt, Mycobacterium avium subsp. paratuberculosis
acgcggugagcgcgccggc

SEQ ID NO: 2917093 - RNA, 21 nt, Mycobacterium avium subsp. paratuberculosis
acgcggugagcgcgccggccc

SEQ ID NO: 2917094 - RNA, 22 nt, Mycobacterium avium subsp. paratuberculosis
acgcggugagcgcgccggcccg

SEQ ID NO: 2917095 - RNA, 16 nt, Mycobacterium avium subsp. paratuberculosis
acgcggugagcgugcc

SEQ ID NO: 2917096 - RNA, 13 nt, Mycobacterium avium subsp. paratuberculosis
acgcggugggcac

SEQ ID NO: 2917097 - RNA, 17 nt, Mycobacterium avium subsp. paratuberculosis
acgcggugggcaccagc

SEQ ID NO: 2917098 - RNA, 18 nt, Mycobacterium avium subsp. paratuberculosis
acgcggugggcaccagca

SEQ ID NO: 2917099 - RNA, 20 nt, Mycobacterium avium subsp. paratuberculosis
acgcggugggcaccagcagc

SEQ ID NO: 2917100 - RNA, 20 nt, Mycobacterium avium subsp. paratuberculosis
acgcgguguuggcggcgucg

SEQ ID NO: 2917101 - RNA, 22 nt, Mycobacterium avium subsp. paratuberculosis
acgcgguguuggcggcgucguc

SEQ ID NO: 2917102 - RNA, 13 nt, Mycobacterium avium subsp. paratuberculosis
acgcucggcggcc

SEQ ID NO: 2917103 - RNA, 14 nt, Mycobacterium avium subsp. paratuberculosis
acgcucggcggccg

SEQ ID NO: 2917104 - RNA, 14 nt, Mycobacterium avium subsp. paratuberculosis
acgcucggcggcgc

SEQ ID NO: 2917105 - RNA, 16 nt, Mycobacterium avium subsp. paratuberculosis
acgcucggcggcgcgc

SEQ ID NO: 2917106 - RNA, 18 nt, Mycobacterium avium subsp. paratuberculosis
acgcucggcggcgcgcag

SEQ ID NO: 2917107 - RNA, 16 nt, Mycobacterium avium subsp. paratuberculosis
acgcucgggccggcgc

SEQ ID NO: 2917108 - RNA, 19 nt, Mycobacterium avium subsp. paratuberculosis
acgcucgggccggcgccga

SEQ ID NO: 2917109 - RNA, 20 nt, Mycobacterium avium subsp. paratuberculosis
acgcucgggccggcgccgac

SEQ ID NO: 2917110 - RNA, 21 nt, Mycobacterium avium subsp. paratuberculosis
acgcucgggccggcgccgacg

SEQ ID NO: 2917111 - RNA, 22 nt, Mycobacterium avium subsp. paratuberculosis
acgcucgggccggcgccgacga

SEQ ID NO: 2917112 - RNA, 18 nt, Mycobacterium avium subsp. paratuberculosis
acgcucgggcuucggcgu

SEQ ID NO: 2917113 - RNA, 21 nt, Mycobacterium avium subsp. paratuberculosis
acgcucgggcuucggcgucac

SEQ ID NO: 2917114 - RNA, 22 nt, Mycobacterium avium subsp. paratuberculosis
acgcucggggccgguuggugcg

SEQ ID NO: 2917115 - RNA, 24 nt, Mycobacterium avium subsp. paratuberculosis
acgcucggggccgguuggugcgcc

SEQ ID NO: 2917116 - RNA, 22 nt, Mycobacterium avium subsp. paratuberculosis
acgcucggucgccacggccggc

SEQ ID NO: 2917117 - RNA, 12 nt, Mycobacterium avium subsp. paratuberculosis
acgcugaacagc

SEQ ID NO: 2917118 - RNA, 17 nt, Mycobacterium avium subsp. paratuberculosis
acgcugaacggugccgu

SEQ ID NO: 2917119 - RNA, 16 nt, Mycobacterium avium subsp. paratuberculosis
acgcugaagcccaccg

SEQ ID NO: 2917120 - RNA, 17 nt, Mycobacterium avium subsp. paratuberculosis
acgcugaagcccaccgc

SEQ ID NO: 2917121 - RNA, 19 nt, Mycobacterium avium subsp. paratuberculosis
acgcugaagcccaccgccg

SEQ ID NO: 2917122 - RNA, 20 nt, Mycobacterium avium subsp. paratuberculosis
acgcugaagcccaccgccgu

SEQ ID NO: 2917123 - RNA, 13 nt, Mycobacterium avium subsp. paratuberculosis
acgcugaccgugg

SEQ ID NO: 2917124 - RNA, 15 nt, Mycobacterium avium subsp. paratuberculosis
acgcugaccugugcg

SEQ ID NO: 2917125 - RNA, 21 nt, Mycobacterium avium subsp. paratuberculosis
acgcugaccugugcgccccac

SEQ ID NO: 2917126 - RNA, 21 nt, Mycobacterium avium subsp. paratuberculosis
acgcugacgaugcggccggcg

SEQ ID NO: 2917127 - RNA, 23 nt, Mycobacterium avium subsp. paratuberculosis
acgcugacgaugcggccggcggg

SEQ ID NO: 2917128 - RNA, 18 nt, Mycobacterium avium subsp. paratuberculosis
acgcugagcaaccgccga

SEQ ID NO: 2917129 - RNA, 19 nt, Mycobacterium avium subsp. paratuberculosis
acgcugagcaaccgccgaa

SEQ ID NO: 2917130 - RNA, 14 nt, Mycobacterium avium subsp. paratuberculosis
acgcugagcacccg

SEQ ID NO: 2917131 - RNA, 19 nt, Mycobacterium avium subsp. paratuberculosis
acgcugagcacccgcccgg

SEQ ID NO: 2917132 - RNA, 13 nt, Mycobacterium avium subsp. paratuberculosis
acgcugagcgcca

SEQ ID NO: 2917133 - RNA, 16 nt, Mycobacterium avium subsp. paratuberculosis
acgcugagcgccaggc

SEQ ID NO: 2917134 - RNA, 17 nt, Mycobacterium avium subsp. paratuberculosis
acgcugagcgccaggcc

SEQ ID NO: 2917135 - RNA, 23 nt, Mycobacterium avium subsp. paratuberculosis
acgcugagcgccaggccauggcg

SEQ ID NO: 2917136 - RNA, 20 nt, Mycobacterium avium subsp. paratuberculosis
acgcugaucaccacggucag

SEQ ID NO: 2917137 - RNA, 18 nt, Mycobacterium avium subsp. paratuberculosis
acgcugaucuacgucggc

SEQ ID NO: 2917138 - RNA, 22 nt, Mycobacterium avium subsp. paratuberculosis
acgcugaucuacgucggcuggc

SEQ ID NO: 2917139 - RNA, 23 nt, Mycobacterium avium subsp. paratuberculosis
acgcugaucuacgucggcuggcg

SEQ ID NO: 2917140 - RNA, 15 nt, Mycobacterium avium subsp. paratuberculosis
acgcugcagguggcc

SEQ ID NO: 2917141 - RNA, 21 nt, Mycobacterium avium subsp. paratuberculosis
acgcugccaggcgguggccga

SEQ ID NO: 2917142 - RNA, 23 nt, Mycobacterium avium subsp. paratuberculosis
acgcugccgagguacgcgcugac

SEQ ID NO: 2917143 - RNA, 22 nt, Mycobacterium avium subsp. paratuberculosis
acgcugccgcuggcgucgaucg

SEQ ID NO: 2917144 - RNA, 12 nt, Mycobacterium avium subsp. paratuberculosis
acgcugccgggg

SEQ ID NO: 2917145 - RNA, 20 nt, Mycobacterium avium subsp. paratuberculosis
acgcugccggggcgcagcug

SEQ ID NO: 2917146 - RNA, 21 nt, Mycobacterium avium subsp. paratuberculosis
acgcugccgguggucccgguc

SEQ ID NO: 2917147 - RNA, 17 nt, Mycobacterium avium subsp. paratuberculosis
acgcugcgcacccgguc

SEQ ID NO: 2917148 - RNA, 21 nt, Mycobacterium avium subsp. paratuberculosis
acgcugcgcacccgguccggc

SEQ ID NO: 2917149 - RNA, 15 nt, Mycobacterium avium subsp. paratuberculosis
acgcugcgccagccg

SEQ ID NO: 2917150 - RNA, 17 nt, Mycobacterium avium subsp. paratuberculosis
acgcugcggaugucggu

SEQ ID NO: 2917151 - RNA, 13 nt, Mycobacterium avium subsp. paratuberculosis
acgcugcggcgcc

SEQ ID NO: 2917152 - RNA, 14 nt, Mycobacterium avium subsp. paratuberculosis
acgcugcggcgccg

SEQ ID NO: 2917153 - RNA, 18 nt, Mycobacterium avium subsp. paratuberculosis
acgcugcggcgccgggca

SEQ ID NO: 2917154 - RNA, 12 nt, Mycobacterium avium subsp. paratuberculosis
acgcugcgguac

SEQ ID NO: 2917155 - RNA, 13 nt, Mycobacterium avium subsp. paratuberculosis
acgcuggccggca

SEQ ID NO: 2917156 - RNA, 16 nt, Mycobacterium avium subsp. paratuberculosis
acgcuggcguccaggu

SEQ ID NO: 2917157 - RNA, 13 nt, Mycobacterium avium subsp. paratuberculosis
acgcuggcgugac

SEQ ID NO: 2917158 - RNA, 16 nt, Mycobacterium avium subsp. paratuberculosis
acgcuggcgugacgcu

SEQ ID NO: 2917159 - RNA, 17 nt, Mycobacterium avium subsp. paratuberculosis
acgcuggcgugacgcuc

SEQ ID NO: 2917160 - RNA, 23 nt, Mycobacterium avium subsp. paratuberculosis
acgcuggcgugacgcucgccggc

SEQ ID NO: 2917161 - RNA, 19 nt, Mycobacterium avium subsp. paratuberculosis
acgcuggcgugacgcucgg

SEQ ID NO: 2917162 - RNA, 20 nt, Mycobacterium avium subsp. paratuberculosis
acgcuggcgugacgcucggc

SEQ ID NO: 2917163 - RNA, 23 nt, Mycobacterium avium subsp. paratuberculosis
acgcuggcgugacgcucggccgu

SEQ ID NO: 2917164 - RNA, 22 nt, Mycobacterium avium subsp. paratuberculosis
acgcuggcgugacgcucggcgc

SEQ ID NO: 2917165 - RNA, 23 nt, Mycobacterium avium subsp. paratuberculosis
acgcuggcguggcacccgggcgc

SEQ ID NO: 2917166 - RNA, 16 nt, Mycobacterium avium subsp. paratuberculosis
acgcuggcguggcgcc

SEQ ID NO: 2917167 - RNA, 18 nt, Mycobacterium avium subsp. paratuberculosis
acgcuggcguggcgccgg

SEQ ID NO: 2917168 - RNA, 18 nt, Mycobacterium avium subsp. paratuberculosis
acgcuggcguggcucggc

SEQ ID NO: 2917169 - RNA, 14 nt, Mycobacterium avium subsp. paratuberculosis
acgcugggcgccgg

SEQ ID NO: 2917170 - RNA, 15 nt, Mycobacterium avium subsp. paratuberculosis
acgcugggcggcgac

SEQ ID NO: 2917171 - RNA, 15 nt, Mycobacterium avium subsp. paratuberculosis
acgcugggcuccgac

SEQ ID NO: 2917172 - RNA, 13 nt, Mycobacterium avium subsp. paratuberculosis
acgcuggugacgu

SEQ ID NO: 2917173 - RNA, 16 nt, Mycobacterium avium subsp. paratuberculosis
acgcuggugugacgcu

SEQ ID NO: 2917174 - RNA, 17 nt, Mycobacterium avium subsp. paratuberculosis
acgcuggugugacgcuc

SEQ ID NO: 2917175 - RNA, 19 nt, Mycobacterium avium subsp. paratuberculosis
acgcuggugugacgcucgc

SEQ ID NO: 2917176 - RNA, 21 nt, Mycobacterium avium subsp. paratuberculosis
acgcuguagggccaccacgcc

SEQ ID NO: 2917177 - RNA, 22 nt, Mycobacterium avium subsp. paratuberculosis
acgcuguagggccaccacgcca

SEQ ID NO: 2917178 - RNA, 20 nt, Mycobacterium avium subsp. paratuberculosis
acgcugucggggucgcggcc

SEQ ID NO: 2917179 - RNA, 14 nt, Mycobacterium avium subsp. paratuberculosis
acgcugugcucgac

SEQ ID NO: 2917180 - RNA, 20 nt, Mycobacterium avium subsp. paratuberculosis
acgcuguuggaaccggccac

SEQ ID NO: 2917181 - RNA, 23 nt, Mycobacterium avium subsp. paratuberculosis
acgcuuccagcaccacccggucg

SEQ ID NO: 2917182 - RNA, 13 nt, Mycobacterium avium subsp. paratuberculosis
acgcuuccgugcu

SEQ ID NO: 2917183 - RNA, 14 nt, Mycobacterium avium subsp. paratuberculosis
acgcuucuccgccu

SEQ ID NO: 2917184 - RNA, 19 nt, Mycobacterium avium subsp. paratuberculosis
acgcuugggguuuggcgac

SEQ ID NO: 2917185 - RNA, 20 nt, Mycobacterium avium subsp. paratuberculosis
acggaaaccgcugcggcaca

SEQ ID NO: 2917186 - RNA, 19 nt, Mycobacterium avium subsp. paratuberculosis
acggccaaccgcccggcgc

SEQ ID NO: 2917187 - RNA, 21 nt, Mycobacterium avium subsp. paratuberculosis
acggccaaccgcccggcgccg

SEQ ID NO: 2917188 - RNA, 18 nt, Mycobacterium avium subsp. paratuberculosis
acggccaacugcaucgcc

SEQ ID NO: 2917189 - RNA, 21 nt, Mycobacterium avium subsp. paratuberculosis
acggccaacugcaucgccagc

SEQ ID NO: 2917190 - RNA, 14 nt, Mycobacterium avium subsp. paratuberculosis
acggccaccacggc

SEQ ID NO: 2917191 - RNA, 15 nt, Mycobacterium avium subsp. paratuberculosis
acggccaccacggca

SEQ ID NO: 2917192 - RNA, 14 nt, Mycobacterium avium subsp. paratuberculosis
acggccaccagcag

SEQ ID NO: 2917193 - RNA, 13 nt, Mycobacterium avium subsp. paratuberculosis
acggccaccgccg

SEQ ID NO: 2917194 - RNA, 13 nt, Mycobacterium avium subsp. paratuberculosis
acggccagaccgc

SEQ ID NO: 2917195 - RNA, 14 nt, Mycobacterium avium subsp. paratuberculosis
acggccagaccgca

SEQ ID NO: 2917196 - RNA, 14 nt, Mycobacterium avium subsp. paratuberculosis
acggccagcaccgc

SEQ ID NO: 2917197 - RNA, 15 nt, Mycobacterium avium subsp. paratuberculosis
acggccagcaccgcc

SEQ ID NO: 2917198 - RNA, 17 nt, Mycobacterium avium subsp. paratuberculosis
acggccagcaccgccag

SEQ ID NO: 2917199 - RNA, 18 nt, Mycobacterium avium subsp. paratuberculosis
acggccagcaccgccagc

SEQ ID NO: 2917200 - RNA, 17 nt, Mycobacterium avium subsp. paratuberculosis
acggccagcagcaccgc

SEQ ID NO: 2917201 - RNA, 21 nt, Mycobacterium avium subsp. paratuberculosis
acggccagcagcaccgcguug

SEQ ID NO: 2917202 - RNA, 12 nt, Mycobacterium avium subsp. paratuberculosis
acggccagcagg

SEQ ID NO: 2917203 - RNA, 24 nt, Mycobacterium avium subsp. paratuberculosis
acggccagcaggaugaugaccgac

SEQ ID NO: 2917204 - RNA, 16 nt, Mycobacterium avium subsp. paratuberculosis
acggccagcagggcgc

SEQ ID NO: 2917205 - RNA, 22 nt, Mycobacterium avium subsp. paratuberculosis
acggccagcagggcgccgacga

SEQ ID NO: 2917206 - RNA, 16 nt, Mycobacterium avium subsp. paratuberculosis
acggccagccagccgc

SEQ ID NO: 2917207 - RNA, 20 nt, Mycobacterium avium subsp. paratuberculosis
acggccagccagccgcccag

SEQ ID NO: 2917208 - RNA, 22 nt, Mycobacterium avium subsp. paratuberculosis
acggccagccagccgcccagca

SEQ ID NO: 2917209 - RNA, 12 nt, Mycobacterium avium subsp. paratuberculosis
acggccagcccg

SEQ ID NO: 2917210 - RNA, 18 nt, Mycobacterium avium subsp. paratuberculosis
acggccagcgccgucauc

SEQ ID NO: 2917211 - RNA, 12 nt, Mycobacterium avium subsp. paratuberculosis
acggccagcgcg

SEQ ID NO: 2917212 - RNA, 18 nt, Mycobacterium avium subsp. paratuberculosis
acggccagcgcggcgguc

SEQ ID NO: 2917213 - RNA, 23 nt, Mycobacterium avium subsp. paratuberculosis
acggccagcugauagccgcccug

SEQ ID NO: 2917214 - RNA, 19 nt, Mycobacterium avium subsp. paratuberculosis
acggccaggaagccggcga

SEQ ID NO: 2917215 - RNA, 16 nt, Mycobacterium avium subsp. paratuberculosis
acggccaguccaggcc

SEQ ID NO: 2917216 - RNA, 17 nt, Mycobacterium avium subsp. paratuberculosis
acggccaguccaggccg

SEQ ID NO: 2917217 - RNA, 18 nt, Mycobacterium avium subsp. paratuberculosis
acggccaugaagccguug

SEQ ID NO: 2917218 - RNA, 20 nt, Mycobacterium avium subsp. paratuberculosis
acggccaugcagaccagccc

SEQ ID NO: 2917219 - RNA, 15 nt, Mycobacterium avium subsp. paratuberculosis
acggcccaucaccag

SEQ ID NO: 2917220 - RNA, 20 nt, Mycobacterium avium subsp. paratuberculosis
acggcccaucaccagcggcu

SEQ ID NO: 2917221 - RNA, 21 nt, Mycobacterium avium subsp. paratuberculosis
acggcccaucacgucggggcc

SEQ ID NO: 2917222 - RNA, 15 nt, Mycobacterium avium subsp. paratuberculosis
acggccccagacgaa

SEQ ID NO: 2917223 - RNA, 15 nt, Mycobacterium avium subsp. paratuberculosis
acggccccagccgcc

SEQ ID NO: 2917224 - RNA, 17 nt, Mycobacterium avium subsp. paratuberculosis
acggccccagccgccgc

SEQ ID NO: 2917225 - RNA, 13 nt, Mycobacterium avium subsp. paratuberculosis
acggcccccacga

SEQ ID NO: 2917226 - RNA, 14 nt, Mycobacterium avium subsp. paratuberculosis
acggcccccacgag

SEQ ID NO: 2917227 - RNA, 17 nt, Mycobacterium avium subsp. paratuberculosis
acggccccccgggcacc

SEQ ID NO: 2917228 - RNA, 20 nt, Mycobacterium avium subsp. paratuberculosis
acggccccccgggcaccagc

SEQ ID NO: 2917229 - RNA, 22 nt, Mycobacterium avium subsp. paratuberculosis
acggccccccgggcaccagcgc

SEQ ID NO: 2917230 - RNA, 20 nt, Mycobacterium avium subsp. paratuberculosis
acggcccgaacaccgugaac

SEQ ID NO: 2917231 - RNA, 13 nt, Mycobacterium avium subsp. paratuberculosis
acggcccgacgac

SEQ ID NO: 2917232 - RNA, 14 nt, Mycobacterium avium subsp. paratuberculosis
acggcccgacgacg

SEQ ID NO: 2917233 - RNA, 22 nt, Mycobacterium avium subsp. paratuberculosis
acggcccgacgacgccgucacg

SEQ ID NO: 2917234 - RNA, 12 nt, Mycobacterium avium subsp. paratuberculosis
acggcccgccgc

SEQ ID NO: 2917235 - RNA, 21 nt, Mycobacterium avium subsp. paratuberculosis
acggcccgccgccggcggcgu

SEQ ID NO: 2917236 - RNA, 20 nt, Mycobacterium avium subsp. paratuberculosis
acggcccgcgccccggcggc

SEQ ID NO: 2917237 - RNA, 13 nt, Mycobacterium avium subsp. paratuberculosis
acggcccgcggca

SEQ ID NO: 2917238 - RNA, 18 nt, Mycobacterium avium subsp. paratuberculosis
acggcccgcucgggccau

SEQ ID NO: 2917239 - RNA, 13 nt, Mycobacterium avium subsp. paratuberculosis
acggcccggcgaa

SEQ ID NO: 2917240 - RNA, 20 nt, Mycobacterium avium subsp. paratuberculosis
acggcccgggaagccgcagc

SEQ ID NO: 2917241 - RNA, 21 nt, Mycobacterium avium subsp. paratuberculosis
acggcccgggaagccgcagca

SEQ ID NO: 2917242 - RNA, 15 nt, Mycobacterium avium subsp. paratuberculosis
acggcccggucuugc

SEQ ID NO: 2917243 - RNA, 22 nt, Mycobacterium avium subsp. paratuberculosis
acggcccggucuugccggcuuc

SEQ ID NO: 2917244 - RNA, 17 nt, Mycobacterium avium subsp. paratuberculosis
acggccgaaacgcccgg

SEQ ID NO: 2917245 - RNA, 18 nt, Mycobacterium avium subsp. paratuberculosis
acggccgaaacgcccggc

SEQ ID NO: 2917246 - RNA, 19 nt, Mycobacterium avium subsp. paratuberculosis
acggccgaaacgcccggcu

SEQ ID NO: 2917247 - RNA, 20 nt, Mycobacterium avium subsp. paratuberculosis
acggccgaaacgcccggcuc

SEQ ID NO: 2917248 - RNA, 16 nt, Mycobacterium avium subsp. paratuberculosis
acggccgacgcccagc

SEQ ID NO: 2917249 - RNA, 14 nt, Mycobacterium avium subsp. paratuberculosis
acggccgcaacggc

SEQ ID NO: 2917250 - RNA, 18 nt, Mycobacterium avium subsp. paratuberculosis
acggccgcaacggcgguc

SEQ ID NO: 2917251 - RNA, 14 nt, Mycobacterium avium subsp. paratuberculosis
acggccgcacccca

SEQ ID NO: 2917252 - RNA, 21 nt, Mycobacterium avium subsp. paratuberculosis
acggccgcacguauccgcggu

SEQ ID NO: 2917253 - RNA, 13 nt, Mycobacterium avium subsp. paratuberculosis
acggccgcagcgg

SEQ ID NO: 2917254 - RNA, 12 nt, Mycobacterium avium subsp. paratuberculosis
acggccgccagc

SEQ ID NO: 2917255 - RNA, 15 nt, Mycobacterium avium subsp. paratuberculosis
acggccgccagcagc

SEQ ID NO: 2917256 - RNA, 12 nt, Mycobacterium avium subsp. paratuberculosis
acggccgccgag

SEQ ID NO: 2917257 - RNA, 14 nt, Mycobacterium avium subsp. paratuberculosis
acggccgccgaggc

SEQ ID NO: 2917258 - RNA, 16 nt, Mycobacterium avium subsp. paratuberculosis
acggccgccgauuccg

SEQ ID NO: 2917259 - RNA, 16 nt, Mycobacterium avium subsp. paratuberculosis
acggccgcgccguuga

SEQ ID NO: 2917260 - RNA, 14 nt, Mycobacterium avium subsp. paratuberculosis
acggccgcggccag

SEQ ID NO: 2917261 - RNA, 13 nt, Mycobacterium avium subsp. paratuberculosis
acggccgcggccc

SEQ ID NO: 2917262 - RNA, 15 nt, Mycobacterium avium subsp. paratuberculosis
acggccgcggcccgg

SEQ ID NO: 2917263 - RNA, 17 nt, Mycobacterium avium subsp. paratuberculosis
acggccgcggcccggcc

SEQ ID NO: 2917264 - RNA, 14 nt, Mycobacterium avium subsp. paratuberculosis
acggccgcggcgcg

SEQ ID NO: 2917265 - RNA, 16 nt, Mycobacterium avium subsp. paratuberculosis
acggccgcggcgcggc

SEQ ID NO: 2917266 - RNA, 22 nt, Mycobacterium avium subsp. paratuberculosis
acggccgcggcgcggcccggcc

SEQ ID NO: 2917267 - RNA, 15 nt, Mycobacterium avium subsp. paratuberculosis
acggccgcggcggug

SEQ ID NO: 2917268 - RNA, 17 nt, Mycobacterium avium subsp. paratuberculosis
acggccgcggcggugcc

SEQ ID NO: 2917269 - RNA, 19 nt, Mycobacterium avium subsp. paratuberculosis
acggccggcaacgacccgu

SEQ ID NO: 2917270 - RNA, 21 nt, Mycobacterium avium subsp. paratuberculosis
acggccggcaacgacccgucg

SEQ ID NO: 2917271 - RNA, 21 nt, Mycobacterium avium subsp. paratuberculosis
acggcgcuggccgcggccagc

SEQ ID NO: 2917272 - RNA, 22 nt, Mycobacterium avium subsp. paratuberculosis
acggcgcuggccgcggccagcu

SEQ ID NO: 2917273 - RNA, 14 nt, Mycobacterium avium subsp. paratuberculosis
acggcgcuguggcc

SEQ ID NO: 2917274 - RNA, 15 nt, Mycobacterium avium subsp. paratuberculosis
acggcggaccggcgg

SEQ ID NO: 2917275 - RNA, 17 nt, Mycobacterium avium subsp. paratuberculosis
acggcggaccggcggcc

SEQ ID NO: 2917276 - RNA, 20 nt, Mycobacterium avium subsp. paratuberculosis
acggcggaccggcggccgcc

SEQ ID NO: 2917277 - RNA, 23 nt, Mycobacterium avium subsp. paratuberculosis
acggcggaccggcggccgccauc

SEQ ID NO: 2917278 - RNA, 15 nt, Mycobacterium avium subsp. paratuberculosis
acggcggauccaggu

SEQ ID NO: 2917279 - RNA, 20 nt, Mycobacterium avium subsp. paratuberculosis
acggcggcagcgaggcgcgc

SEQ ID NO: 2917280 - RNA, 21 nt, Mycobacterium avium subsp. paratuberculosis
acggcggcagcgaggcgcgca

SEQ ID NO: 2917281 - RNA, 22 nt, Mycobacterium avium subsp. paratuberculosis
acggcggcagcgaggcgcgcag

SEQ ID NO: 2917282 - RNA, 16 nt, Mycobacterium avium subsp. paratuberculosis
acggcggcagcgcggc

SEQ ID NO: 2917283 - RNA, 18 nt, Mycobacterium avium subsp. paratuberculosis
acggcggcagcgcggcgu

SEQ ID NO: 2917284 - RNA, 22 nt, Mycobacterium avium subsp. paratuberculosis
acggcggcauguucgaugcggu

SEQ ID NO: 2917285 - RNA, 14 nt, Mycobacterium avium subsp. paratuberculosis
acggcggccgaauc

SEQ ID NO: 2917286 - RNA, 18 nt, Mycobacterium avium subsp. paratuberculosis
acggcggccgaauccggc

SEQ ID NO: 2917287 - RNA, 21 nt, Mycobacterium avium subsp. paratuberculosis
acggcggccgaauccggccgg

SEQ ID NO: 2917288 - RNA, 22 nt, Mycobacterium avium subsp. paratuberculosis
acggcggccgaauccggccgga

SEQ ID NO: 2917289 - RNA, 12 nt, Mycobacterium avium subsp. paratuberculosis
acggcggccgcg

SEQ ID NO: 2917290 - RNA, 15 nt, Mycobacterium avium subsp. paratuberculosis
acggcggccgcggac

SEQ ID NO: 2917291 - RNA, 16 nt, Mycobacterium avium subsp. paratuberculosis
acggcggccgcggacc

SEQ ID NO: 2917292 - RNA, 13 nt, Mycobacterium avium subsp. paratuberculosis
acggcggccgucu

SEQ ID NO: 2917293 - RNA, 20 nt, Mycobacterium avium subsp. paratuberculosis
acggcggcgaacgccgccgu

SEQ ID NO: 2917294 - RNA, 22 nt, Mycobacterium avium subsp. paratuberculosis
acggcggcgaacgccgccgugu

SEQ ID NO: 2917295 - RNA, 16 nt, Mycobacterium avium subsp. paratuberculosis
acggcggcgaagacgu

SEQ ID NO: 2917296 - RNA, 12 nt, Mycobacterium avium subsp. paratuberculosis
acggcggcgacg

SEQ ID NO: 2917297 - RNA, 18 nt, Mycobacterium avium subsp. paratuberculosis
acggcggcgaguucggcg

SEQ ID NO: 2917298 - RNA, 22 nt, Mycobacterium avium subsp. paratuberculosis
acggcggcgaguucggcggccc

SEQ ID NO: 2917299 - RNA, 13 nt, Mycobacterium avium subsp. paratuberculosis
acggcggcgcccu

SEQ ID NO: 2917300 - RNA, 14 nt, Mycobacterium avium subsp. paratuberculosis
acggcggcgcgcac

SEQ ID NO: 2917301 - RNA, 16 nt, Mycobacterium avium subsp. paratuberculosis
acggcggcgcgcacgu

SEQ ID NO: 2917302 - RNA, 13 nt, Mycobacterium avium subsp. paratuberculosis
acggcggcgcggg

SEQ ID NO: 2917303 - RNA, 14 nt, Mycobacterium avium subsp. paratuberculosis
acggcggcgcgggc

SEQ ID NO: 2917304 - RNA, 17 nt, Mycobacterium avium subsp. paratuberculosis
acggcggcgcgggcggc

SEQ ID NO: 2917305 - RNA, 19 nt, Mycobacterium avium subsp. paratuberculosis
acggcggcgcgggcggcgu

SEQ ID NO: 2917306 - RNA, 21 nt, Mycobacterium avium subsp. paratuberculosis
acggcggcgcgggcggcgucg

SEQ ID NO: 2917307 - RNA, 22 nt, Mycobacterium avium subsp. paratuberculosis
acggcggcgcugaugccguccu

SEQ ID NO: 2917308 - RNA, 14 nt, Mycobacterium avium subsp. paratuberculosis
acggcggcggcggc

SEQ ID NO: 2917309 - RNA, 13 nt, Mycobacterium avium subsp. paratuberculosis
acggcggcggugc

SEQ ID NO: 2917310 - RNA, 18 nt, Mycobacterium avium subsp. paratuberculosis
acggcggcggugccgcag

SEQ ID NO: 2917311 - RNA, 19 nt, Mycobacterium avium subsp. paratuberculosis
acggcggcgucccagugcu

SEQ ID NO: 2917312 - RNA, 22 nt, Mycobacterium avium subsp. paratuberculosis
acggcggcgugcaccgcccgcg

SEQ ID NO: 2917313 - RNA, 13 nt, Mycobacterium avium subsp. paratuberculosis
acggcgggcccgu

SEQ ID NO: 2917314 - RNA, 21 nt, Mycobacterium avium subsp. paratuberculosis
acggcgggcccgucgccggcg

SEQ ID NO: 2917315 - RNA, 16 nt, Mycobacterium avium subsp. paratuberculosis
acggcgggccggcgcc

SEQ ID NO: 2917316 - RNA, 22 nt, Mycobacterium avium subsp. paratuberculosis
acggcggggccuccaccagcgg

SEQ ID NO: 2917317 - RNA, 22 nt, Mycobacterium avium subsp. paratuberculosis
acggcggggcggaugcgcuggu

SEQ ID NO: 2917318 - RNA, 23 nt, Mycobacterium avium subsp. paratuberculosis
acggcggggcggaugcgcuggug

SEQ ID NO: 2917319 - RNA, 18 nt, Mycobacterium avium subsp. paratuberculosis
acggcggggugcgcggcg

SEQ ID NO: 2917320 - RNA, 17 nt, Mycobacterium avium subsp. paratuberculosis
acggcgggugcgacggc

SEQ ID NO: 2917321 - RNA, 20 nt, Mycobacterium avium subsp. paratuberculosis
acggcggucgugcggcugcc

SEQ ID NO: 2917322 - RNA, 21 nt, Mycobacterium avium subsp. paratuberculosis
acggcggugacguuccagccg

SEQ ID NO: 2917323 - RNA, 17 nt, Mycobacterium avium subsp. paratuberculosis
acggcggugucggcggc

SEQ ID NO: 2917324 - RNA, 20 nt, Mycobacterium avium subsp. paratuberculosis
acggcgguucgaagcgcagc

SEQ ID NO: 2917325 - RNA, 23 nt, Mycobacterium avium subsp. paratuberculosis
acggcgguucgaagcgcagcguc

SEQ ID NO: 2917326 - RNA, 17 nt, Mycobacterium avium subsp. paratuberculosis
acggcguccagcugcgc

SEQ ID NO: 2917327 - RNA, 21 nt, Mycobacterium avium subsp. paratuberculosis
acggcguccagcugcgcgccg

SEQ ID NO: 2917328 - RNA, 23 nt, Mycobacterium avium subsp. paratuberculosis
acggcguccagcugcgcgccggc

SEQ ID NO: 2917329 - RNA, 16 nt, Mycobacterium avium subsp. paratuberculosis
acggcguccgggcgcu

SEQ ID NO: 2917330 - RNA, 17 nt, Mycobacterium avium subsp. paratuberculosis
acggcguccgggcgcug

SEQ ID NO: 2917331 - RNA, 13 nt, Mycobacterium avium subsp. paratuberculosis
acggcgucgcuga

SEQ ID NO: 2917332 - RNA, 14 nt, Mycobacterium avium subsp. paratuberculosis
acggcgucggcggc

SEQ ID NO: 2917333 - RNA, 15 nt, Mycobacterium avium subsp. paratuberculosis
acggcgucggcggcc

SEQ ID NO: 2917334 - RNA, 16 nt, Mycobacterium avium subsp. paratuberculosis
acggcgucggcggccu

SEQ ID NO: 2917335 - RNA, 16 nt, Mycobacterium avium subsp. paratuberculosis
acggcgucguugagca

SEQ ID NO: 2917336 - RNA, 20 nt, Mycobacterium avium subsp. paratuberculosis
acggcgucguugagcaggcu

SEQ ID NO: 2917337 - RNA, 23 nt, Mycobacterium avium subsp. paratuberculosis
acggcgucguugagcaggcugga

SEQ ID NO: 2917338 - RNA, 21 nt, Mycobacterium avium subsp. paratuberculosis
acggcguggaacacgcccagc

SEQ ID NO: 2917339 - RNA, 19 nt, Mycobacterium avium subsp. paratuberculosis
acggcguggcugaggccgc

SEQ ID NO: 2917340 - RNA, 22 nt, Mycobacterium avium subsp. paratuberculosis
acggcguggcugaggccgcccc

SEQ ID NO: 2917341 - RNA, 23 nt, Mycobacterium avium subsp. paratuberculosis
acggcguggcugaggccgccccg

SEQ ID NO: 2917342 - RNA, 21 nt, Mycobacterium avium subsp. paratuberculosis
acggcguugaccaacgccgcc

SEQ ID NO: 2917343 - RNA, 17 nt, Mycobacterium avium subsp. paratuberculosis
acggcguugcuggcgcg

SEQ ID NO: 2917344 - RNA, 22 nt, Mycobacterium avium subsp. paratuberculosis
acggcuaccugaccagcggcgc

SEQ ID NO: 2917345 - RNA, 15 nt, Mycobacterium avium subsp. paratuberculosis
acggcucaacggccg

SEQ ID NO: 2917346 - RNA, 18 nt, Mycobacterium avium subsp. paratuberculosis
acggcucaacggccggcg

SEQ ID NO: 2917347 - RNA, 22 nt, Mycobacterium avium subsp. paratuberculosis
acggcucaacggccggcgccgc

SEQ ID NO: 2917348 - RNA, 16 nt, Mycobacterium avium subsp. paratuberculosis
acggcucccaggccca

SEQ ID NO: 2917349 - RNA, 18 nt, Mycobacterium avium subsp. paratuberculosis
acggcucccaggcccauc

SEQ ID NO: 2917350 - RNA, 21 nt, Mycobacterium avium subsp. paratuberculosis
acggcucccaggcccaucgcg

SEQ ID NO: 2917351 - RNA, 19 nt, Mycobacterium avium subsp. paratuberculosis
acggcuccuaugucggugc

SEQ ID NO: 2917352 - RNA, 17 nt, Mycobacterium avium subsp. paratuberculosis
acggcucgccgcgcauc

SEQ ID NO: 2917353 - RNA, 18 nt, Mycobacterium avium subsp. paratuberculosis
acggcucgccgcgcauca

SEQ ID NO: 2917354 - RNA, 23 nt, Mycobacterium avium subsp. paratuberculosis
acggcucgccgcgcaucaucgcc

SEQ ID NO: 2917355 - RNA, 21 nt, Mycobacterium avium subsp. paratuberculosis
acgggcggggggcgagccggc

SEQ ID NO: 2917356 - RNA, 16 nt, Mycobacterium avium subsp. paratuberculosis
acgggcggucggacgc

SEQ ID NO: 2917357 - RNA, 18 nt, Mycobacterium avium subsp. paratuberculosis
acgggcggucggacgcgg

SEQ ID NO: 2917358 - RNA, 20 nt, Mycobacterium avium subsp. paratuberculosis
acgggcggucggacgcgggg

SEQ ID NO: 2917359 - RNA, 18 nt, Mycobacterium avium subsp. paratuberculosis
acgggcguccgagaaggg

SEQ ID NO: 2917360 - RNA, 20 nt, Mycobacterium avium subsp. paratuberculosis
acgggcguccgagaagggcc

SEQ ID NO: 2917361 - RNA, 21 nt, Mycobacterium avium subsp. paratuberculosis
acgggcguccgagaagggccg

SEQ ID NO: 2917362 - RNA, 14 nt, Mycobacterium avium subsp. paratuberculosis
acgggcgucggcgg

SEQ ID NO: 2917363 - RNA, 22 nt, Mycobacterium avium subsp. paratuberculosis
acgggcgugacggaugugacgc

SEQ ID NO: 2917364 - RNA, 14 nt, Mycobacterium avium subsp. paratuberculosis
acgggcgugccggc

SEQ ID NO: 2917365 - RNA, 16 nt, Mycobacterium avium subsp. paratuberculosis
acgggcgugccggcgg

SEQ ID NO: 2917366 - RNA, 17 nt, Mycobacterium avium subsp. paratuberculosis
acgggcgugccggcggc

SEQ ID NO: 2917367 - RNA, 19 nt, Mycobacterium avium subsp. paratuberculosis
acgggcguguagccugcgg

SEQ ID NO: 2917368 - RNA, 21 nt, Mycobacterium avium subsp. paratuberculosis
acgggcguguagccugcggcc

SEQ ID NO: 2917369 - RNA, 23 nt, Mycobacterium avium subsp. paratuberculosis
acgggcguguagccugcggccug

SEQ ID NO: 2917370 - RNA, 19 nt, Mycobacterium avium subsp. paratuberculosis
acgggcucggcguacaggc

SEQ ID NO: 2917371 - RNA, 23 nt, Mycobacterium avium subsp. paratuberculosis
acgggcugaagaucaacagccgc

SEQ ID NO: 2917372 - RNA, 16 nt, Mycobacterium avium subsp. paratuberculosis
acgggcugaccgccag

SEQ ID NO: 2917373 - RNA, 12 nt, Mycobacterium avium subsp. paratuberculosis
acgggcugcugc

SEQ ID NO: 2917374 - RNA, 18 nt, Mycobacterium avium subsp. paratuberculosis
acgggcugcugcacgucg

SEQ ID NO: 2917375 - RNA, 20 nt, Mycobacterium avium subsp. paratuberculosis
acgggcugcugcacgucgcc

SEQ ID NO: 2917376 - RNA, 23 nt, Mycobacterium avium subsp. paratuberculosis
acgggcugcugcacgucgccggc

SEQ ID NO: 2917377 - RNA, 17 nt, Mycobacterium avium subsp. paratuberculosis
acgggcugucccggccg

SEQ ID NO: 2917378 - RNA, 18 nt, Mycobacterium avium subsp. paratuberculosis
acgggcugucccggccgc

SEQ ID NO: 2917379 - RNA, 22 nt, Mycobacterium avium subsp. paratuberculosis
acgggcugucccggccgcgaca

SEQ ID NO: 2917380 - RNA, 19 nt, Mycobacterium avium subsp. paratuberculosis
acggggcgaugccgacacc

SEQ ID NO: 2917381 - RNA, 22 nt, Mycobacterium avium subsp. paratuberculosis
acggggcgaugccgacacccca

SEQ ID NO: 2917382 - RNA, 12 nt, Mycobacterium avium subsp. paratuberculosis
acggggcgccgc

SEQ ID NO: 2917383 - RNA, 17 nt, Mycobacterium avium subsp. paratuberculosis
acggggcgccgcugcgg

SEQ ID NO: 2917384 - RNA, 14 nt, Mycobacterium avium subsp. paratuberculosis
acgggggugccgac

SEQ ID NO: 2917385 - RNA, 17 nt, Mycobacterium avium subsp. paratuberculosis
acgggggugccgaccgc

SEQ ID NO: 2917386 - RNA, 22 nt, Mycobacterium avium subsp. paratuberculosis
acgggggugccgaccgcguguc

SEQ ID NO: 2917387 - RNA, 19 nt, Mycobacterium avium subsp. paratuberculosis
acgggguggaauaggccgc

SEQ ID NO: 2917388 - RNA, 22 nt, Mycobacterium avium subsp. paratuberculosis
acgggguucaguagcagcgucu

SEQ ID NO: 2917389 - RNA, 19 nt, Mycobacterium avium subsp. paratuberculosis
acggguaggugcccggguc

SEQ ID NO: 2917390 - RNA, 19 nt, Mycobacterium avium subsp. paratuberculosis
acggguagugcacggacag

SEQ ID NO: 2917391 - RNA, 18 nt, Mycobacterium avium subsp. paratuberculosis
acggguccuugccggcgg

SEQ ID NO: 2917392 - RNA, 18 nt, Mycobacterium avium subsp. paratuberculosis
acgggucgaccgccgcgu

SEQ ID NO: 2917393 - RNA, 17 nt, Mycobacterium avium subsp. paratuberculosis
acgggucgaucucggcg

SEQ ID NO: 2917394 - RNA, 15 nt, Mycobacterium avium subsp. paratuberculosis
acgggucggcggcga

SEQ ID NO: 2917395 - RNA, 23 nt, Mycobacterium avium subsp. paratuberculosis
acgggucgggggugggcucccag

SEQ ID NO: 2917396 - RNA, 17 nt, Mycobacterium avium subsp. paratuberculosis
acgggucggucggcccg

SEQ ID NO: 2917397 - RNA, 18 nt, Mycobacterium avium subsp. paratuberculosis
acgggucggucggcccgc

SEQ ID NO: 2917398 - RNA, 22 nt, Mycobacterium avium subsp. paratuberculosis
acgggucggugguucgcgcgau

SEQ ID NO: 2917399 - RNA, 15 nt, Mycobacterium avium subsp. paratuberculosis
acgggugaccggcgg

SEQ ID NO: 2917400 - RNA, 17 nt, Mycobacterium avium subsp. paratuberculosis
acgggugaccggcggcc

SEQ ID NO: 2917401 - RNA, 20 nt, Mycobacterium avium subsp. paratuberculosis
acgggugcucagguugcgca

SEQ ID NO: 2917402 - RNA, 18 nt, Mycobacterium avium subsp. paratuberculosis
acggguggguggagacgu

SEQ ID NO: 2917403 - RNA, 15 nt, Mycobacterium avium subsp. paratuberculosis
acggguucgcgcagc

SEQ ID NO: 2917404 - RNA, 21 nt, Mycobacterium avium subsp. paratuberculosis
acggguucggucucggcggcg

SEQ ID NO: 2917405 - RNA, 14 nt, Mycobacterium avium subsp. paratuberculosis
acggguugagccag

SEQ ID NO: 2917406 - RNA, 16 nt, Mycobacterium avium subsp. paratuberculosis
acggguugagccagac

SEQ ID NO: 2917407 - RNA, 13 nt, Mycobacterium avium subsp. paratuberculosis
acggguugcaggc

SEQ ID NO: 2917408 - RNA, 22 nt, Mycobacterium avium subsp. paratuberculosis
acggguugcaggccacgcccac

SEQ ID NO: 2917409 - RNA, 14 nt, Mycobacterium avium subsp. paratuberculosis
acggguugccgucg

SEQ ID NO: 2917410 - RNA, 19 nt, Mycobacterium avium subsp. paratuberculosis
acggguugccgucgacgaa

SEQ ID NO: 2917411 - RNA, 23 nt, Mycobacterium avium subsp. paratuberculosis
acggguugcggaucggugcaggc

SEQ ID NO: 2917412 - RNA, 16 nt, Mycobacterium avium subsp. paratuberculosis
acggguugcgguccac

SEQ ID NO: 2917413 - RNA, 18 nt, Mycobacterium avium subsp. paratuberculosis
acggguugcgguccacgu

SEQ ID NO: 2917414 - RNA, 17 nt, Mycobacterium avium subsp. paratuberculosis
acggguugggcgccagc

SEQ ID NO: 2917415 - RNA, 20 nt, Mycobacterium avium subsp. paratuberculosis
acggguugggcgccagcagc

SEQ ID NO: 2917416 - RNA, 17 nt, Mycobacterium avium subsp. paratuberculosis
acggguugggcggggcg

SEQ ID NO: 2917417 - RNA, 18 nt, Mycobacterium avium subsp. paratuberculosis
acggguuggucggcgcgg

SEQ ID NO: 2917418 - RNA, 17 nt, Mycobacterium avium subsp. paratuberculosis
acgguacgugcgccggc

SEQ ID NO: 2917419 - RNA, 22 nt, Mycobacterium avium subsp. paratuberculosis
acgguacuguuacgcccgaucc

SEQ ID NO: 2917420 - RNA, 17 nt, Mycobacterium avium subsp. paratuberculosis
acgguagccugcagugu

SEQ ID NO: 2917421 - RNA, 18 nt, Mycobacterium avium subsp. paratuberculosis
acgguaggcgcggucggu

SEQ ID NO: 2917422 - RNA, 16 nt, Mycobacterium avium subsp. paratuberculosis
acgguaugcccgccgc

SEQ ID NO: 2917423 - RNA, 13 nt, Mycobacterium avium subsp. paratuberculosis
acggucacgcugg

SEQ ID NO: 2917424 - RNA, 17 nt, Mycobacterium avium subsp. paratuberculosis
acggucacgcuggcgug

SEQ ID NO: 2917425 - RNA, 21 nt, Mycobacterium avium subsp. paratuberculosis
acggucacgcuggcgugacgc

SEQ ID NO: 2917426 - RNA, 21 nt, Mycobacterium avium subsp. paratuberculosis
acggucacggccgccagcagc

SEQ ID NO: 2917427 - RNA, 22 nt, Mycobacterium avium subsp. paratuberculosis
acggucacggccgccagcagca

SEQ ID NO: 2917428 - RNA, 23 nt, Mycobacterium avium subsp. paratuberculosis
acggucagcacgcugaucaccac

SEQ ID NO: 2917429 - RNA, 16 nt, Mycobacterium avium subsp. paratuberculosis
acggucagccgcggcu

SEQ ID NO: 2917430 - RNA, 13 nt, Mycobacterium avium subsp. paratuberculosis
acggucagcgcgc

SEQ ID NO: 2917431 - RNA, 14 nt, Mycobacterium avium subsp. paratuberculosis
acggucagcgcgcc

SEQ ID NO: 2917432 - RNA, 13 nt, Mycobacterium avium subsp. paratuberculosis
acggucagcgcgu

SEQ ID NO: 2917433 - RNA, 14 nt, Mycobacterium avium subsp. paratuberculosis
acggucagcgcguc

SEQ ID NO: 2917434 - RNA, 23 nt, Mycobacterium avium subsp. paratuberculosis
acggucagcucgcgcccggccag

SEQ ID NO: 2917435 - RNA, 13 nt, Mycobacterium avium subsp. paratuberculosis
acggucaggccgg

SEQ ID NO: 2917436 - RNA, 14 nt, Mycobacterium avium subsp. paratuberculosis
acggucaggccggg

SEQ ID NO: 2917437 - RNA, 13 nt, Mycobacterium avium subsp. paratuberculosis
acggucaggcgca

SEQ ID NO: 2917438 - RNA, 17 nt, Mycobacterium avium subsp. paratuberculosis
acggucaggcgcagcca

SEQ ID NO: 2917439 - RNA, 14 nt, Mycobacterium avium subsp. paratuberculosis
acgguguccgcggc

SEQ ID NO: 2917440 - RNA, 15 nt, Mycobacterium avium subsp. paratuberculosis
acgguguccgcggcg

SEQ ID NO: 2917441 - RNA, 22 nt, Mycobacterium avium subsp. paratuberculosis
acgguguccgcggcgucgggua

SEQ ID NO: 2917442 - RNA, 15 nt, Mycobacterium avium subsp. paratuberculosis
acgguguccgcgggc

SEQ ID NO: 2917443 - RNA, 12 nt, Mycobacterium avium subsp. paratuberculosis
acggugucgaua

SEQ ID NO: 2917444 - RNA, 21 nt, Mycobacterium avium subsp. paratuberculosis
acggugucgcccucgcgcagg

SEQ ID NO: 2917445 - RNA, 21 nt, Mycobacterium avium subsp. paratuberculosis
acgguguucuugaacggcgcg

SEQ ID NO: 2917446 - RNA, 23 nt, Mycobacterium avium subsp. paratuberculosis
acgguguugcgcacccgcggguc

SEQ ID NO: 2917447 - RNA, 17 nt, Mycobacterium avium subsp. paratuberculosis
acgguguuguucaccgg

SEQ ID NO: 2917448 - RNA, 18 nt, Mycobacterium avium subsp. paratuberculosis
acgguucggccgcucggg

SEQ ID NO: 2917449 - RNA, 17 nt, Mycobacterium avium subsp. paratuberculosis
acgguugccucggccag

SEQ ID NO: 2917450 - RNA, 18 nt, Mycobacterium avium subsp. paratuberculosis
acgguugccucggccagc

SEQ ID NO: 2917451 - RNA, 15 nt, Mycobacterium avium subsp. paratuberculosis
acgguuggccggccc

SEQ ID NO: 2917452 - RNA, 21 nt, Mycobacterium avium subsp. paratuberculosis
acgguuuccaccaccacccgg

SEQ ID NO: 2917453 - RNA, 17 nt, Mycobacterium avium subsp. paratuberculosis
acgguuucugccggccg

SEQ ID NO: 2917454 - RNA, 17 nt, Mycobacterium avium subsp. paratuberculosis
acguaagccauggcggc

SEQ ID NO: 2917455 - RNA, 22 nt, Mycobacterium avium subsp. paratuberculosis
acguaagccauggcggcccgcg

SEQ ID NO: 2917456 - RNA, 15 nt, Mycobacterium avium subsp. paratuberculosis
acguacaccgggauc

SEQ ID NO: 2917457 - RNA, 15 nt, Mycobacterium avium subsp. paratuberculosis
acguacagcggcggc

SEQ ID NO: 2917458 - RNA, 17 nt, Mycobacterium avium subsp. paratuberculosis
acguacccccgcacgcc

SEQ ID NO: 2917459 - RNA, 20 nt, Mycobacterium avium subsp. paratuberculosis
acguacccccgcacgccagc

SEQ ID NO: 2917460 - RNA, 23 nt, Mycobacterium avium subsp. paratuberculosis
acguacccccgcacgccagcauc

SEQ ID NO: 2917461 - RNA, 13 nt, Mycobacterium avium subsp. paratuberculosis
acguacgcgcuga

SEQ ID NO: 2917462 - RNA, 13 nt, Mycobacterium avium subsp. paratuberculosis
acguacgggcuga

SEQ ID NO: 2917463 - RNA, 14 nt, Mycobacterium avium subsp. paratuberculosis
acguacuccugcgc

SEQ ID NO: 2917464 - RNA, 19 nt, Mycobacterium avium subsp. paratuberculosis
acguagaaggcgccgucgg

SEQ ID NO: 2917465 - RNA, 20 nt, Mycobacterium avium subsp. paratuberculosis
acguagaaggcgccgucggu

SEQ ID NO: 2917466 - RNA, 16 nt, Mycobacterium avium subsp. paratuberculosis
acguagaagucgauug

SEQ ID NO: 2917467 - RNA, 18 nt, Mycobacterium avium subsp. paratuberculosis
acguagcagcagaccgcg

SEQ ID NO: 2917468 - RNA, 15 nt, Mycobacterium avium subsp. paratuberculosis
acguagcccagcgcg

SEQ ID NO: 2917469 - RNA, 16 nt, Mycobacterium avium subsp. paratuberculosis
acguagcccagcgcgu

SEQ ID NO: 2917470 - RNA, 18 nt, Mycobacterium avium subsp. paratuberculosis
acguagcccagcgcguug

SEQ ID NO: 2917471 - RNA, 16 nt, Mycobacterium avium subsp. paratuberculosis
acguagcccgccgaau

SEQ ID NO: 2917472 - RNA, 22 nt, Mycobacterium avium subsp. paratuberculosis
acguagcgaucggugaacccgc

SEQ ID NO: 2917473 - RNA, 21 nt, Mycobacterium avium subsp. paratuberculosis
acguagcgcggccgcccgucg

SEQ ID NO: 2917474 - RNA, 12 nt, Mycobacterium avium subsp. paratuberculosis
acguaggacagc

SEQ ID NO: 2917475 - RNA, 16 nt, Mycobacterium avium subsp. paratuberculosis
acguaggacagcacca

SEQ ID NO: 2917476 - RNA, 19 nt, Mycobacterium avium subsp. paratuberculosis
acguaggacagcaccacau

SEQ ID NO: 2917477 - RNA, 15 nt, Mycobacterium avium subsp. paratuberculosis
acguaggccagaucu

SEQ ID NO: 2917478 - RNA, 18 nt, Mycobacterium avium subsp. paratuberculosis
acguaggcgaucagcgcg

SEQ ID NO: 2917479 - RNA, 13 nt, Mycobacterium avium subsp. paratuberculosis
acguaggcggcca

SEQ ID NO: 2917480 - RNA, 14 nt, Mycobacterium avium subsp. paratuberculosis
acguaggcggccag

SEQ ID NO: 2917481 - RNA, 17 nt, Mycobacterium avium subsp. paratuberculosis
acguaggcggccagcag

SEQ ID NO: 2917482 - RNA, 18 nt, Mycobacterium avium subsp. paratuberculosis
acguaggcggccagcagc

SEQ ID NO: 2917483 - RNA, 19 nt, Mycobacterium avium subsp. paratuberculosis
acguaggcggccagcagca

SEQ ID NO: 2917484 - RNA, 16 nt, Mycobacterium avium subsp. paratuberculosis
acguaggggcccgggu

SEQ ID NO: 2917485 - RNA, 13 nt, Mycobacterium avium subsp. paratuberculosis
acguaggugagca

SEQ ID NO: 2917486 - RNA, 21 nt, Mycobacterium avium subsp. paratuberculosis
acguaggugagcaacgccagc

SEQ ID NO: 2917487 - RNA, 13 nt, Mycobacterium avium subsp. paratuberculosis
acguaguccggcc

SEQ ID NO: 2917488 - RNA, 15 nt, Mycobacterium avium subsp. paratuberculosis
acguaguccggccag

SEQ ID NO: 2917489 - RNA, 24 nt, Mycobacterium avium subsp. paratuberculosis
acguaguccggccaguccagcgaa

SEQ ID NO: 2917490 - RNA, 14 nt, Mycobacterium avium subsp. paratuberculosis
acguagucgcgcac

SEQ ID NO: 2917491 - RNA, 15 nt, Mycobacterium avium subsp. paratuberculosis
acguagugcagccgc

SEQ ID NO: 2917492 - RNA, 18 nt, Mycobacterium avium subsp. paratuberculosis
acguagugcagccgcccg

SEQ ID NO: 2917493 - RNA, 20 nt, Mycobacterium avium subsp. paratuberculosis
acgucaccaccgggucgucg

SEQ ID NO: 2917494 - RNA, 13 nt, Mycobacterium avium subsp. paratuberculosis
acgucaccgacgc

SEQ ID NO: 2917495 - RNA, 13 nt, Mycobacterium avium subsp. paratuberculosis
acgucaccgcgcu

SEQ ID NO: 2917496 - RNA, 20 nt, Mycobacterium avium subsp. paratuberculosis
acgucaccgcgcuugccgcg

SEQ ID NO: 2917497 - RNA, 15 nt, Mycobacterium avium subsp. paratuberculosis
acgucacgacgguca

SEQ ID NO: 2917498 - RNA, 12 nt, Mycobacterium avium subsp. paratuberculosis
acgucacggcga

SEQ ID NO: 2917499 - RNA, 15 nt, Mycobacterium avium subsp. paratuberculosis
acgucacggcgagga

SEQ ID NO: 2917500 - RNA, 22 nt, Mycobacterium avium subsp. paratuberculosis
acgucacgggccaggcgcgcgc

SEQ ID NO: 2917501 - RNA, 14 nt, Mycobacterium avium subsp. paratuberculosis
acgucacggugacg

SEQ ID NO: 2917502 - RNA, 18 nt, Mycobacterium avium subsp. paratuberculosis
acgucagcccgcgucgcg
